United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 61

SEQ ID NO: 2766569 - RNA, 13 nt, Human
gcuauaggugcua

SEQ ID NO: 2766570 - RNA, 19 nt, Human
gcuagaacucccuuucaac

SEQ ID NO: 2766571 - RNA, 12 nt, Human
gcgacagugaga

SEQ ID NO: 2766572 - RNA, 18 nt, Human
gcacggugaauggcuuug

SEQ ID NO: 2766573 - RNA, 16 nt, Human
gcagauuauucacuga

SEQ ID NO: 2766574 - RNA, 18 nt, Human
gcagauuauucacugauu

SEQ ID NO: 2766575 - RNA, 18 nt, Human
gcagauaaacaguaguga

SEQ ID NO: 2766576 - RNA, 20 nt, Human
gcagccccgugggguuccuc

SEQ ID NO: 2766577 - RNA, 12 nt, Human
gcaucagcugcu

SEQ ID NO: 2766578 - RNA, 13 nt, Human
gcauuauauuuau

SEQ ID NO: 2766579 - RNA, 20 nt, Human
gcauauauuuuuauauuuac

SEQ ID NO: 2766580 - RNA, 17 nt, Human
gcauagguuuaauaauu

SEQ ID NO: 2766581 - RNA, 13 nt, Human
gcauagaaguaaa

SEQ ID NO: 2766582 - RNA, 17 nt, Human
gcaguucugaagaagau

SEQ ID NO: 2766583 - RNA, 14 nt, Human
gcaguucugaagaa

SEQ ID NO: 2766584 - RNA, 18 nt, Human
gcaguucagagcugcccu

SEQ ID NO: 2766585 - RNA, 17 nt, Human
gcaguucagagcugccc

SEQ ID NO: 2766586 - RNA, 15 nt, Human
gcaguucugaagaag

SEQ ID NO: 2766587 - RNA, 16 nt, Human
gcaguucagagcugcc

SEQ ID NO: 2766588 - RNA, 23 nt, Human
gauuuuauuauguaaaucccauu

SEQ ID NO: 2766589 - RNA, 20 nt, Human
gauuuuauuauguaaauccc

SEQ ID NO: 2766590 - RNA, 19 nt, Human
gauuuuauuauguaaaucc

SEQ ID NO: 2766591 - RNA, 18 nt, Human
gauuuuauuauguaaauc

SEQ ID NO: 2766592 - RNA, 15 nt, Human
gauuuuauuauguaa

SEQ ID NO: 2766593 - RNA, 13 nt, Human
gauuuuauuaugu

SEQ ID NO: 2766594 - RNA, 15 nt, Human
gauuuuccugaaaac

SEQ ID NO: 2766595 - RNA, 23 nt, Human
gcaaagcacugacuucuaaguaa

SEQ ID NO: 2766596 - RNA, 10 nt, Human
gcaagccaga

SEQ ID NO: 2766597 - RNA, 14 nt, Human
gcaagggugauggg

SEQ ID NO: 2766598 - RNA, 22 nt, Human
gauaaauaguuuaugauuccac

SEQ ID NO: 2766599 - RNA, 17 nt, Human
gauaggucagugcaaau

SEQ ID NO: 2766600 - RNA, 23 nt, Human
gauagauaggucagugcaaauac

SEQ ID NO: 2766601 - RNA, 21 nt, Human
gauggcuaguaucaaaagaaa

SEQ ID NO: 2766602 - RNA, 14 nt, Human
gaugaaaauauuug

SEQ ID NO: 2766603 - RNA, 12 nt, Human
gacuuguuagau

SEQ ID NO: 2766604 - RNA, 13 nt, Human
gagaaagacuauu

SEQ ID NO: 2766605 - RNA, 15 nt, Human
gagaaagacuauuca

SEQ ID NO: 2766606 - RNA, 17 nt, Human
gagaaagacuauucaaa

SEQ ID NO: 2766607 - RNA, 18 nt, Human
gagaaagacuauucaaac

SEQ ID NO: 2766608 - RNA, 16 nt, Human
gagaagaacugaaauc

SEQ ID NO: 2766609 - RNA, 14 nt, Human
gagaagaacugaaa

SEQ ID NO: 2766610 - RNA, 13 nt, Human
gagaagaacugaa

SEQ ID NO: 2766611 - RNA, 15 nt, Human
gagaagagcuguuca

SEQ ID NO: 2766612 - RNA, 22 nt, Human
gagaagagcuguucacagccag

SEQ ID NO: 2766613 - RNA, 13 nt, Human
gagaagagcuguu

SEQ ID NO: 2766614 - RNA, 18 nt, Human
gagacacacugaagaagc

SEQ ID NO: 2766615 - RNA, 13 nt, Human
gagacagcucugc

SEQ ID NO: 2766616 - RNA, 18 nt, Human
gagacagcucugcauacu

SEQ ID NO: 2766617 - RNA, 15 nt, Human
gagacagcucugcau

SEQ ID NO: 2766618 - RNA, 17 nt, Human
gagauacagaauuuuau

SEQ ID NO: 2766619 - RNA, 19 nt, Human
gagagugaacaaauuuaca

SEQ ID NO: 2766620 - RNA, 15 nt, Human
gagagugaacaaauu

SEQ ID NO: 2766621 - RNA, 17 nt, Human
gagcugcccucuccugg

SEQ ID NO: 2766622 - RNA, 16 nt, Human
gagcucgugggacagu

SEQ ID NO: 2766623 - RNA, 19 nt, Human
gaggaagccugauuaaaga

SEQ ID NO: 2766624 - RNA, 18 nt, Human
gaggaagccugauuaaag

SEQ ID NO: 2766625 - RNA, 23 nt, Human
gagcugcccucuccugggcagcu

SEQ ID NO: 2766626 - RNA, 21 nt, Human
gagcugcccucuccugggcag

SEQ ID NO: 2766627 - RNA, 19 nt, Human
gagcugcccucuccugggc

SEQ ID NO: 2766628 - RNA, 18 nt, Human
gagcugcccucuccuggg

SEQ ID NO: 2766629 - RNA, 16 nt, Human
gacauagucuggcugu

SEQ ID NO: 2766630 - RNA, 20 nt, Human
gaccaaaaaccaguauugua

SEQ ID NO: 2766631 - RNA, 19 nt, Human
gaccaaaaaccaguauugu

SEQ ID NO: 2766632 - RNA, 13 nt, Human
gaccaaaaaccag

SEQ ID NO: 2766633 - RNA, 22 nt, Human
gacaugggacauuugcucaugg

SEQ ID NO: 2766634 - RNA, 17 nt, Human
gacaugggacauuugcu

SEQ ID NO: 2766635 - RNA, 18 nt, Human
gacuccaaagaaauguaa

SEQ ID NO: 2766636 - RNA, 22 nt, Human
gacccacaagaaaugaaagcag

SEQ ID NO: 2766637 - RNA, 23 nt, Human
gaccugauuucugagcauuuaau

SEQ ID NO: 2766638 - RNA, 21 nt, Human
cuuuuucauuauuuuauuaug

SEQ ID NO: 2766639 - RNA, 13 nt, Human
cuucuuuccacag

SEQ ID NO: 2766640 - RNA, 19 nt, Human
cuucuuuccacagaagcuc

SEQ ID NO: 2766641 - RNA, 20 nt, Human
cuugaaauuugaauuuugug

SEQ ID NO: 2766642 - RNA, 19 nt, Human
cuugaaauuugaauuuugu

SEQ ID NO: 2766643 - RNA, 14 nt, Human
cuugaacccgggag

SEQ ID NO: 2766644 - RNA, 20 nt, Human
cuugaacccgggaggcagag

SEQ ID NO: 2766645 - RNA, 19 nt, Human
cuugaacccgggaggcaga

SEQ ID NO: 2766646 - RNA, 23 nt, Human
cuugcaucaauuuuucuuauuuc

SEQ ID NO: 2766647 - RNA, 21 nt, Human
cuugcaugguuuagaaagcuu

SEQ ID NO: 2766648 - RNA, 18 nt, Human
cuuguaaaggaauuuaaa

SEQ ID NO: 2766649 - RNA, 17 nt, Human
cuugccaaauauaaaua

SEQ ID NO: 2766650 - RNA, 21 nt, Human
gaaagcuugcccuggugccuc

SEQ ID NO: 2766651 - RNA, 16 nt, Human
gaaacggaugauuucu

SEQ ID NO: 2766652 - RNA, 13 nt, Human
gaaacugccagca

SEQ ID NO: 2766653 - RNA, 15 nt, Human
gaaacugccagcaac

SEQ ID NO: 2766654 - RNA, 13 nt, Human
gaaagcagaacag

SEQ ID NO: 2766655 - RNA, 22 nt, Human
gaaagacuauucaaacagucuc

SEQ ID NO: 2766656 - RNA, 23 nt, Human
gaaagacuauucaaacagucuca

SEQ ID NO: 2766657 - RNA, 19 nt, Human
gaaagacuauucaaacagu

SEQ ID NO: 2766658 - RNA, 13 nt, Human
gaaauuugaauuu

SEQ ID NO: 2766659 - RNA, 24 nt, Human
gaaauuugaauuuuguguuagaga

SEQ ID NO: 2766660 - RNA, 16 nt, Human
gaaauuugaauuuugu

SEQ ID NO: 2766661 - RNA, 24 nt, Human
gaacaguuaccucugccucagaaa

SEQ ID NO: 2766662 - RNA, 22 nt, Human
gaaauguaagggaaacugccag

SEQ ID NO: 2766663 - RNA, 13 nt, Human
gaaauauuuauuu

SEQ ID NO: 2766664 - RNA, 16 nt, Human
gaaauauuuauuuuaa

SEQ ID NO: 2766665 - RNA, 15 nt, Human
gaaauauuuauuuua

SEQ ID NO: 2766666 - RNA, 14 nt, Human
gaagucagaucugc

SEQ ID NO: 2766667 - RNA, 23 nt, Human
gaagucagaucugccuaaggacu

SEQ ID NO: 2766668 - RNA, 22 nt, Human
gaagucagaucugccuaaggac

SEQ ID NO: 2766669 - RNA, 23 nt, Human
gaaguccaagcauuuagauguau

SEQ ID NO: 2766670 - RNA, 23 nt, Human
gaagagcuguucacagccagacu

SEQ ID NO: 2766671 - RNA, 13 nt, Human
gaagagcuguuca

SEQ ID NO: 2766672 - RNA, 15 nt, Human
gaagagcuguucaca

SEQ ID NO: 2766673 - RNA, 20 nt, Human
gaagagcuguucacagccag

SEQ ID NO: 2766674 - RNA, 22 nt, Human
gaacuuguaaaggaauuuaaaa

SEQ ID NO: 2766675 - RNA, 22 nt, Human
gaacuugaaauuugaauuuugu

SEQ ID NO: 2766676 - RNA, 15 nt, Human
gaacuugaaauuuga

SEQ ID NO: 2766677 - RNA, 13 nt, Human
gaacuugaaauuu

SEQ ID NO: 2766678 - RNA, 12 nt, Human
gaacuugaaauu

SEQ ID NO: 2766679 - RNA, 15 nt, Human
gaaccacaagacugc

SEQ ID NO: 2766680 - RNA, 14 nt, Human
gaaccacaagacug

SEQ ID NO: 2766681 - RNA, 15 nt, Human
gaacucccuuucaac

SEQ ID NO: 2766682 - RNA, 16 nt, Human
gaacucccuuucaaca

SEQ ID NO: 2766683 - RNA, 16 nt, Human
cuguauagauuagaga

SEQ ID NO: 2766684 - RNA, 20 nt, Human
cuguauagauuagaauucug

SEQ ID NO: 2766685 - RNA, 15 nt, Human
cuguauagauuagag

SEQ ID NO: 2766686 - RNA, 15 nt, Human
cuguaugauucccag

SEQ ID NO: 2766687 - RNA, 16 nt, Human
cuguauuuuaaaagaa

SEQ ID NO: 2766688 - RNA, 13 nt, Human
cuguauuuuaaaa

SEQ ID NO: 2766689 - RNA, 18 nt, Human
cugucucuacuaaaaaua

SEQ ID NO: 2766690 - RNA, 15 nt, Human
cuggccuucggccuc

SEQ ID NO: 2766691 - RNA, 21 nt, Human
cuggccuucggccuccauccu

SEQ ID NO: 2766692 - RNA, 18 nt, Human
cuggccuucggccuccau

SEQ ID NO: 2766693 - RNA, 17 nt, Human
cuggccuucggccucca

SEQ ID NO: 2766694 - RNA, 16 nt, Human
cuggccuucggccucc

SEQ ID NO: 2766695 - RNA, 15 nt, Human
cugccagcaacgcag

SEQ ID NO: 2766696 - RNA, 12 nt, Human
cugcacugucaa

SEQ ID NO: 2766697 - RNA, 15 nt, Human
cugcuuucagauacu

SEQ ID NO: 2766698 - RNA, 12 nt, Human
cugcuuucagau

SEQ ID NO: 2766699 - RNA, 15 nt, Human
cugcuugccaucccu

SEQ ID NO: 2766700 - RNA, 16 nt, Human
cugcuugccaucccuc

SEQ ID NO: 2766701 - RNA, 22 nt, Human
cugcuugccaucccucccucca

SEQ ID NO: 2766702 - RNA, 20 nt, Human
cugcuugccaucccucccuc

SEQ ID NO: 2766703 - RNA, 19 nt, Human
cugcuugccaucccucccu

SEQ ID NO: 2766704 - RNA, 18 nt, Human
cugcuugccaucccuccc

SEQ ID NO: 2766705 - RNA, 15 nt, Human
cugcccucuccuggg

SEQ ID NO: 2766706 - RNA, 14 nt, Human
cugcccucuccugg

SEQ ID NO: 2766707 - RNA, 13 nt, Human
cugcccucuccug

SEQ ID NO: 2766708 - RNA, 12 nt, Human
cugcccucuccu

SEQ ID NO: 2766709 - RNA, 14 nt, Human
cugaagaagauggu

SEQ ID NO: 2766710 - RNA, 23 nt, Human
cugaagaagcaccaaucaugaau

SEQ ID NO: 2766711 - RNA, 22 nt, Human
cucuucuuuaaagggauggcaa

SEQ ID NO: 2766712 - RNA, 20 nt, Human
cucugcuugccaucccuccc

SEQ ID NO: 2766713 - RNA, 17 nt, Human
cucugcuugccaucccu

SEQ ID NO: 2766714 - RNA, 14 nt, Human
cucugcuugccauc

SEQ ID NO: 2766715 - RNA, 12 nt, Human
cucugcuugcca

SEQ ID NO: 2766716 - RNA, 12 nt, Human
cucuggccuucg

SEQ ID NO: 2766717 - RNA, 19 nt, Human
cucuggccuucggccucca

SEQ ID NO: 2766718 - RNA, 17 nt, Human
cugacucuuaagaagac

SEQ ID NO: 2766719 - RNA, 16 nt, Human
cugacuucuaaguaaa

SEQ ID NO: 2766720 - RNA, 13 nt, Human
cugacuucuaagu

SEQ ID NO: 2766721 - RNA, 15 nt, Human
cugacuucuaaguaa

SEQ ID NO: 2766722 - RNA, 22 nt, Human
cugagaaagacuauucaaacag

SEQ ID NO: 2766723 - RNA, 23 nt, Human
cugagaaagacuauucaaacagu

SEQ ID NO: 2766724 - RNA, 20 nt, Human
cugagcgacagugagacucu

SEQ ID NO: 2766725 - RNA, 16 nt, Human
cugagcgacagugaga

SEQ ID NO: 2766726 - RNA, 18 nt, Human
cuccauccugaggcucca

SEQ ID NO: 2766727 - RNA, 16 nt, Human
cuccauccugaggcuc

SEQ ID NO: 2766728 - RNA, 14 nt, Human
cuccauccugaggc

SEQ ID NO: 2766729 - RNA, 17 nt, Human
cucccuccaccucccug

SEQ ID NO: 2766730 - RNA, 15 nt, Human
cucccuccaccuccc

SEQ ID NO: 2766731 - RNA, 17 nt, Human
cucuaggaaauauuuau

SEQ ID NO: 2766732 - RNA, 15 nt, Human
cucuaggaaauauuu

SEQ ID NO: 2766733 - RNA, 12 nt, Human
cucuccugggca

SEQ ID NO: 2766734 - RNA, 19 nt, Human
cucuccugggcagcugccu

SEQ ID NO: 2766735 - RNA, 18 nt, Human
cucuccugggcagcugcc

SEQ ID NO: 2766736 - RNA, 16 nt, Human
cucuccugggcagcug

SEQ ID NO: 2766737 - RNA, 15 nt, Human
cucuccugggcagcu

SEQ ID NO: 2766738 - RNA, 20 nt, Human
cucuccugggcagcugccuc

SEQ ID NO: 2766739 - RNA, 22 nt, Human
cggugaauggcuuuguauagaa

SEQ ID NO: 2766740 - RNA, 20 nt, Human
cggugaauggcuuuguauag

SEQ ID NO: 2766741 - RNA, 18 nt, Human
cggugaauggcuuuguau

SEQ ID NO: 2766742 - RNA, 17 nt, Human
cggugagcuacaaaugc

SEQ ID NO: 2766743 - RNA, 16 nt, Human
cggugaauggcuuugu

SEQ ID NO: 2766744 - RNA, 15 nt, Human
cggugaauggcuuug

SEQ ID NO: 2766745 - RNA, 14 nt, Human
cggugaauggcuuu

SEQ ID NO: 2766746 - RNA, 13 nt, Human
cggugaauggcuu

SEQ ID NO: 2766747 - RNA, 22 nt, Human
cggucggguuuuauuguuuaaa

SEQ ID NO: 2766748 - RNA, 21 nt, Human
cggguuuuauuguuuaaaauc

SEQ ID NO: 2766749 - RNA, 12 nt, Human
cggccuccaucc

SEQ ID NO: 2766750 - RNA, 15 nt, Human
cgcucucuggccuuc

SEQ ID NO: 2766751 - RNA, 14 nt, Human
cgcucucuggccuu

SEQ ID NO: 2766752 - RNA, 18 nt, Human
cgcucucuggccuucggc

SEQ ID NO: 2766753 - RNA, 16 nt, Human
cgugcuaaggacuugu

SEQ ID NO: 2766754 - RNA, 15 nt, Human
cgugcuaaggacuug

SEQ ID NO: 2766755 - RNA, 14 nt, Human
cgugcuaaggacuu

SEQ ID NO: 2766756 - RNA, 13 nt, Human
cgugcuaaggacu

SEQ ID NO: 2766757 - RNA, 12 nt, Human
cgugcuaaggac

SEQ ID NO: 2766758 - RNA, 18 nt, Human
cguugaaauuguaauuau

SEQ ID NO: 2766759 - RNA, 23 nt, Human
cguugaaauuguaauuauaucug

SEQ ID NO: 2766760 - RNA, 16 nt, Human
cuaaauccauuuggaa

SEQ ID NO: 2766761 - RNA, 20 nt, Human
cuaaauccauuuggaaaucu

SEQ ID NO: 2766762 - RNA, 19 nt, Human
cuaaauccauuuggaaauc

SEQ ID NO: 2766763 - RNA, 17 nt, Human
cuaaauccauuuggaaa

SEQ ID NO: 2766764 - RNA, 23 nt, Human
cuaaauugacacuuaaaaauggu

SEQ ID NO: 2766765 - RNA, 17 nt, Human
cuacacuccagugagac

SEQ ID NO: 2766766 - RNA, 16 nt, Human
cuacacuccagugaga

SEQ ID NO: 2766767 - RNA, 22 nt, Human
cuaaggacuucuuuaauuuugg

SEQ ID NO: 2766768 - RNA, 11 nt, Human
cuaaggacuug

SEQ ID NO: 2766769 - RNA, 17 nt, Human
cuaaggacuuguuagau

SEQ ID NO: 2766770 - RNA, 16 nt, Human
cuaaggacuuguuaga

SEQ ID NO: 2766771 - RNA, 14 nt, Human
cuaagcaaaaugug

SEQ ID NO: 2766772 - RNA, 18 nt, Human
cuaagcaaaaugugauau

SEQ ID NO: 2766773 - RNA, 15 nt, Human
cuaagcaaaauguga

SEQ ID NO: 2766774 - RNA, 18 nt, Human
cuacuugggaggcugaga

SEQ ID NO: 2766775 - RNA, 15 nt, Human
cuacuugggaggcug

SEQ ID NO: 2766776 - RNA, 19 nt, Human
cuacuugggaggcugagau

SEQ ID NO: 2766777 - RNA, 17 nt, Human
cucaccccuugccauaa

SEQ ID NO: 2766778 - RNA, 22 nt, Human
cuauauuuuuuguuaaaugauu

SEQ ID NO: 2766779 - RNA, 13 nt, Human
cuaugaaauauua

SEQ ID NO: 2766780 - RNA, 12 nt, Human
cuaguucacucu

SEQ ID NO: 2766781 - RNA, 18 nt, Human
cuauauuguuugcuaagc

SEQ ID NO: 2766782 - RNA, 20 nt, Human
cuauauuuuuuguuaaauga

SEQ ID NO: 2766783 - RNA, 19 nt, Human
cuauauuguuugcuaagca

SEQ ID NO: 2766784 - RNA, 22 nt, Human
cuaggaaauauuuauuuuaaua

SEQ ID NO: 2766785 - RNA, 20 nt, Human
cuaguauuucuaugaaauau

SEQ ID NO: 2766786 - RNA, 19 nt, Human
cuaguauuucuaugaaaua

SEQ ID NO: 2766787 - RNA, 22 nt, Human
cuaguauuucuaugaaauauua

SEQ ID NO: 2766788 - RNA, 23 nt, Human
cuaguaucaaaagaaagaaaauc

SEQ ID NO: 2766789 - RNA, 17 nt, Human
cuaguaucaaaagaaag

SEQ ID NO: 2766790 - RNA, 15 nt, Human
cuaguaucaaaagaa

SEQ ID NO: 2766791 - RNA, 15 nt, Human
cccugcaauaaaaug

SEQ ID NO: 2766792 - RNA, 14 nt, Human
cccugcaauaaaau

SEQ ID NO: 2766793 - RNA, 14 nt, Human
ccccaggugccagu

SEQ ID NO: 2766794 - RNA, 12 nt, Human
cccucccuccac

SEQ ID NO: 2766795 - RNA, 13 nt, Human
cccucccuccacc

SEQ ID NO: 2766796 - RNA, 20 nt, Human
cccucccuccaccucccugc

SEQ ID NO: 2766797 - RNA, 13 nt, Human
ccuccauccugag

SEQ ID NO: 2766798 - RNA, 12 nt, Human
ccuccauccuga

SEQ ID NO: 2766799 - RNA, 13 nt, Human
ccuccccuccucu

SEQ ID NO: 2766800 - RNA, 12 nt, Human
ccuccccuccuc

SEQ ID NO: 2766801 - RNA, 17 nt, Human
cccuucuuuccacagaa

SEQ ID NO: 2766802 - RNA, 21 nt, Human
ccuaaauccauuuggaaaucu

SEQ ID NO: 2766803 - RNA, 20 nt, Human
ccuaaauccauuuggaaauc

SEQ ID NO: 2766804 - RNA, 18 nt, Human
ccuaaauccauuuggaaa

SEQ ID NO: 2766805 - RNA, 19 nt, Human
ccuaaauccauuuggaaau

SEQ ID NO: 2766806 - RNA, 13 nt, Human
ccuaaacauauga

SEQ ID NO: 2766807 - RNA, 15 nt, Human
ccauccugaggcucc

SEQ ID NO: 2766808 - RNA, 16 nt, Human
ccauccugaggcucca

SEQ ID NO: 2766809 - RNA, 23 nt, Human
ccauggcacucuauguucuaaga

SEQ ID NO: 2766810 - RNA, 14 nt, Human
cauuugcucaugga

SEQ ID NO: 2766811 - RNA, 15 nt, Human
cauuugcucauggaa

SEQ ID NO: 2766812 - RNA, 16 nt, Human
cauuugcucauggaau

SEQ ID NO: 2766813 - RNA, 17 nt, Human
ccaaagaaauguaaggg

SEQ ID NO: 2766814 - RNA, 16 nt, Human
cauuauuuuauuauga

SEQ ID NO: 2766815 - RNA, 14 nt, Human
cauuauuuuauuau

SEQ ID NO: 2766816 - RNA, 12 nt, Human
cauuauuuuauu

SEQ ID NO: 2766817 - RNA, 23 nt, Human
cauuucugcaucagcugcugaaa

SEQ ID NO: 2766818 - RNA, 12 nt, Human
cauuuccaagca

SEQ ID NO: 2766819 - RNA, 19 nt, Human
cauuuaaagcuuauuaaaa

SEQ ID NO: 2766820 - RNA, 18 nt, Human
ccaaggcuagaaccaccu

SEQ ID NO: 2766821 - RNA, 19 nt, Human
ccaaggcugauuaaaccaa

SEQ ID NO: 2766822 - RNA, 20 nt, Human
ccaauauucauagcagcuua

SEQ ID NO: 2766823 - RNA, 22 nt, Human
ccacaagaaaugaaagcaggga

SEQ ID NO: 2766824 - RNA, 16 nt, Human
ccacaagaaaugaaag

SEQ ID NO: 2766825 - RNA, 14 nt, Human
ccaacacgagcagg

SEQ ID NO: 2766826 - RNA, 21 nt, Human
ccaacacgagcaggcuacugu

SEQ ID NO: 2766827 - RNA, 11 nt, Human
cauuauuuuau

SEQ ID NO: 2766828 - RNA, 12 nt, Human
cauguuuauuac

SEQ ID NO: 2766829 - RNA, 22 nt, Human
cauguuuauuacaguauaauua

SEQ ID NO: 2766830 - RNA, 20 nt, Human
cauguuuauuacaguauaau

SEQ ID NO: 2766831 - RNA, 19 nt, Human
cauguuuauuacaguauaa

SEQ ID NO: 2766832 - RNA, 18 nt, Human
cauguuuauuacaguaua

SEQ ID NO: 2766833 - RNA, 13 nt, Human
cauguuuauuaca

SEQ ID NO: 2766834 - RNA, 17 nt, Human
caugggacagggaggac

SEQ ID NO: 2766835 - RNA, 18 nt, Human
cauggaacgcguugaaau

SEQ ID NO: 2766836 - RNA, 23 nt, Human
cauggaacgcguugaaauuguaa

SEQ ID NO: 2766837 - RNA, 20 nt, Human
cauggaacgcguugaaauug

SEQ ID NO: 2766838 - RNA, 19 nt, Human
cauggaacgcguugaaauu

SEQ ID NO: 2766839 - RNA, 23 nt, Human
caugcugucuacacuaagagaga

SEQ ID NO: 2766840 - RNA, 22 nt, Human
cauauauuuuuauauuuacuaa

SEQ ID NO: 2766841 - RNA, 20 nt, Human
cauauauaacaaugcuguau

SEQ ID NO: 2766842 - RNA, 22 nt, Human
caucaagucuuucacauuuaaa

SEQ ID NO: 2766843 - RNA, 18 nt, Human
caucaaugaaugaaugaa

SEQ ID NO: 2766844 - RNA, 13 nt, Human
caucccucccucc

SEQ ID NO: 2766845 - RNA, 12 nt, Human
caucccucccuc

SEQ ID NO: 2766846 - RNA, 14 nt, Human
caucccucccucca

SEQ ID NO: 2766847 - RNA, 14 nt, Human
caucuagugagcag

SEQ ID NO: 2766848 - RNA, 22 nt, Human
caucuagugagcagucaggaaa

SEQ ID NO: 2766849 - RNA, 14 nt, Human
caguuuucugagaa

SEQ ID NO: 2766850 - RNA, 15 nt, Human
caguuuucugagaaa

SEQ ID NO: 2766851 - RNA, 21 nt, Human
caguuuuguuuggaccaaaaa

SEQ ID NO: 2766852 - RNA, 19 nt, Human
caguuuucugagaaagacu

SEQ ID NO: 2766853 - RNA, 20 nt, Human
caguuuucugagaaagacua

SEQ ID NO: 2766854 - RNA, 21 nt, Human
caguugaaaagacuccaaaga

SEQ ID NO: 2766855 - RNA, 22 nt, Human
caguugaaaagacuccaaagaa

SEQ ID NO: 2766856 - RNA, 23 nt, Human
caguugaaaagacuccaaagaaa

SEQ ID NO: 2766857 - RNA, 14 nt, Human
caguugaaaagacu

SEQ ID NO: 2766858 - RNA, 18 nt, Human
caguugaaaagacuccaa

SEQ ID NO: 2766859 - RNA, 23 nt, Human
cauaaaucugugaacuugaaauu

SEQ ID NO: 2766860 - RNA, 22 nt, Human
cauaaaucugugaacuugaaau

SEQ ID NO: 2766861 - RNA, 18 nt, Human
cauaaaucugugaacuug

SEQ ID NO: 2766862 - RNA, 16 nt, Human
cauaaaucugugaacu

SEQ ID NO: 2766863 - RNA, 14 nt, Human
cauaaaucugugaa

SEQ ID NO: 2766864 - RNA, 19 nt, Human
cauaacauaaaucugugaa

SEQ ID NO: 2766865 - RNA, 12 nt, Human
cauaacauaaau

SEQ ID NO: 2766866 - RNA, 21 nt, Human
cauaacauaaaucugugaacu

SEQ ID NO: 2766867 - RNA, 17 nt, Human
cauaccaacacgagcag

SEQ ID NO: 2766868 - RNA, 22 nt, Human
caguucggugagcuacaaaugc

SEQ ID NO: 2766869 - RNA, 16 nt, Human
caguucugaagaagau

SEQ ID NO: 2766870 - RNA, 15 nt, Human
caguucugaagaaga

SEQ ID NO: 2766871 - RNA, 22 nt, Human
caguucugaagaagaugguacc

SEQ ID NO: 2766872 - RNA, 14 nt, Human
caguucugaagaag

SEQ ID NO: 2766873 - RNA, 13 nt, Human
caguucugaagaa

SEQ ID NO: 2766874 - RNA, 12 nt, Human
caguucugaaga

SEQ ID NO: 2766875 - RNA, 21 nt, Human
caguuaccucugccucagaaa

SEQ ID NO: 2766876 - RNA, 14 nt, Human
cagugucaaugcag

SEQ ID NO: 2766877 - RNA, 21 nt, Human
cacaguuuucugagaaagacu

SEQ ID NO: 2766878 - RNA, 22 nt, Human
cacaguuuucugagaaagacua

SEQ ID NO: 2766879 - RNA, 20 nt, Human
cacaguuuucugagaaagac

SEQ ID NO: 2766880 - RNA, 16 nt, Human
cacaugaaguccaagc

SEQ ID NO: 2766881 - RNA, 20 nt, Human
cacaugaaguccaagcauuu

SEQ ID NO: 2766882 - RNA, 17 nt, Human
cacaugaaguccaagca

SEQ ID NO: 2766883 - RNA, 17 nt, Human
caauuuuguuucuguac

SEQ ID NO: 2766884 - RNA, 16 nt, Human
caauuuuguuucugua

SEQ ID NO: 2766885 - RNA, 14 nt, Human
caauuuuguuucug

SEQ ID NO: 2766886 - RNA, 13 nt, Human
caauuuuguuucu

SEQ ID NO: 2766887 - RNA, 15 nt, Human
cacaagaaaugaaag

SEQ ID NO: 2766888 - RNA, 13 nt, Human
cacaagaaaugaa

SEQ ID NO: 2766889 - RNA, 23 nt, Human
cacaagacccaaaaggcagaagc

SEQ ID NO: 2766890 - RNA, 23 nt, Human
cacaagaaaugaaagcagggacu

SEQ ID NO: 2766891 - RNA, 23 nt, Human
caaauuuacagagacagaaagca

SEQ ID NO: 2766892 - RNA, 17 nt, Human
caaauuuacagagacag

SEQ ID NO: 2766893 - RNA, 16 nt, Human
caaauuuacagagaca

SEQ ID NO: 2766894 - RNA, 19 nt, Human
caagcauuuagauguauag

SEQ ID NO: 2766895 - RNA, 16 nt, Human
caagcauuuagaugua

SEQ ID NO: 2766896 - RNA, 21 nt, Human
caagcauaccaacacgagcag

SEQ ID NO: 2766897 - RNA, 16 nt, Human
caagcauaccaacacg

SEQ ID NO: 2766898 - RNA, 13 nt, Human
caagaaaugaaag

SEQ ID NO: 2766899 - RNA, 19 nt, Human
caagacugcacaucaaaau

SEQ ID NO: 2766900 - RNA, 18 nt, Human
caaaguugccuaaaucca

SEQ ID NO: 2766901 - RNA, 14 nt, Human
caaaguugccuaaa

SEQ ID NO: 2766902 - RNA, 17 nt, Human
caaaguugccuaaaucc

SEQ ID NO: 2766903 - RNA, 15 nt, Human
caaaguugccuaaau

SEQ ID NO: 2766904 - RNA, 14 nt, Human
caaagaaauguaag

SEQ ID NO: 2766905 - RNA, 19 nt, Human
auuuuaauaauguuucaaa

SEQ ID NO: 2766906 - RNA, 18 nt, Human
auuuuaauaauguuucaa

SEQ ID NO: 2766907 - RNA, 20 nt, Human
auuuacuaaaauggacugug

SEQ ID NO: 2766908 - RNA, 19 nt, Human
auuuacuaaaauggacugu

SEQ ID NO: 2766909 - RNA, 16 nt, Human
auuuacuaaaauggac

SEQ ID NO: 2766910 - RNA, 15 nt, Human
auuuacuaaaaugga

SEQ ID NO: 2766911 - RNA, 22 nt, Human
auuuaccacuuguguuuugcaa

SEQ ID NO: 2766912 - RNA, 15 nt, Human
auuuaccacuugugu

SEQ ID NO: 2766913 - RNA, 15 nt, Human
auuguacuuugugcu

SEQ ID NO: 2766914 - RNA, 16 nt, Human
auuguaguccuguaau

SEQ ID NO: 2766915 - RNA, 17 nt, Human
auuuaaaaaaaaaccug

SEQ ID NO: 2766916 - RNA, 18 nt, Human
auuuauuggcuuuucuga

SEQ ID NO: 2766917 - RNA, 14 nt, Human
auuuauuggcuuuu

SEQ ID NO: 2766918 - RNA, 20 nt, Human
auuuauuacuguaagaaaau

SEQ ID NO: 2766919 - RNA, 19 nt, Human
auuuauuacuguaagaaaa

SEQ ID NO: 2766920 - RNA, 23 nt, Human
auuuauuggcuuuucugauccag

SEQ ID NO: 2766921 - RNA, 20 nt, Human
auuuauuggcuuuucugauc

SEQ ID NO: 2766922 - RNA, 21 nt, Human
auuuauuuuaauaauguuuca

SEQ ID NO: 2766923 - RNA, 13 nt, Human
auuugaauuuugu

SEQ ID NO: 2766924 - RNA, 20 nt, Human
auuucuugagguaaaagcau

SEQ ID NO: 2766925 - RNA, 22 nt, Human
auuggggauucuuaaaguugaa

SEQ ID NO: 2766926 - RNA, 21 nt, Human
auuggggauucuuaaaguuga

SEQ ID NO: 2766927 - RNA, 20 nt, Human
auuggggauucuuaaaguug

SEQ ID NO: 2766928 - RNA, 16 nt, Human
auuggggauucuuaaa

SEQ ID NO: 2766929 - RNA, 15 nt, Human
auuggggauucuuaa

SEQ ID NO: 2766930 - RNA, 14 nt, Human
auuggggauucuua

SEQ ID NO: 2766931 - RNA, 17 nt, Human
auuggagcucgugggac

SEQ ID NO: 2766932 - RNA, 16 nt, Human
auuggagcucguggaa

SEQ ID NO: 2766933 - RNA, 23 nt, Human
auguuuauuacaguauaauuaac

SEQ ID NO: 2766934 - RNA, 22 nt, Human
auguuuauuacaguauaauuaa

SEQ ID NO: 2766935 - RNA, 19 nt, Human
auguuuauuacaguauaau

SEQ ID NO: 2766936 - RNA, 18 nt, Human
auguuuauuacaguauaa

SEQ ID NO: 2766937 - RNA, 16 nt, Human
auguuuauuacaguau

SEQ ID NO: 2766938 - RNA, 15 nt, Human
auguuuauuacagua

SEQ ID NO: 2766939 - RNA, 12 nt, Human
auguuuauuaca

SEQ ID NO: 2766940 - RNA, 19 nt, Human
uuuucugauccaguuuugu

SEQ ID NO: 2766941 - RNA, 16 nt, Human
uuuucucuaggaaaua

SEQ ID NO: 2766942 - RNA, 20 nt, Human
uuuucaggcuagauguaugu

SEQ ID NO: 2766943 - RNA, 22 nt, Human
uuuuauggcacuaguauuucua

SEQ ID NO: 2766944 - RNA, 20 nt, Human
augugcuaguaauuggaaag

SEQ ID NO: 2766945 - RNA, 21 nt, Human
augugcuaguaauuggaaagg

SEQ ID NO: 2766946 - RNA, 19 nt, Human
auguauauuuuauaucaau

SEQ ID NO: 2766947 - RNA, 23 nt, Human
augucgucaaagcugaaauggac

SEQ ID NO: 2766948 - RNA, 14 nt, Human
uuugaauuuugugu

SEQ ID NO: 2766949 - RNA, 12 nt, Human
uuugaauuuugu

SEQ ID NO: 2766950 - RNA, 19 nt, Human
uuugcuaagcauuccaacu

SEQ ID NO: 2766951 - RNA, 20 nt, Human
uuugcuggagcucugcccau

SEQ ID NO: 2766952 - RNA, 22 nt, Human
auucaaacagucucaggaaauc

SEQ ID NO: 2766953 - RNA, 19 nt, Human
auuauaucugaggaauucu

SEQ ID NO: 2766954 - RNA, 18 nt, Human
auuauaucugaggaauuc

SEQ ID NO: 2766955 - RNA, 16 nt, Human
auuauaugcuauuucu

SEQ ID NO: 2766956 - RNA, 22 nt, Human
auuauaucugaggaauucugua

SEQ ID NO: 2766957 - RNA, 21 nt, Human
auuauaucugaggaauucugu

SEQ ID NO: 2766958 - RNA, 20 nt, Human
auuauaucugaggaauucug

SEQ ID NO: 2766959 - RNA, 19 nt, Human
auuauucacugauuugaca

SEQ ID NO: 2766960 - RNA, 24 nt, Human
auuauucaaaguugccuaaaucca

SEQ ID NO: 2766961 - RNA, 18 nt, Human
auuauucaaaguugccua

SEQ ID NO: 2766962 - RNA, 22 nt, Human
auuauucaaaguugccuaaauc

SEQ ID NO: 2766963 - RNA, 19 nt, Human
auuauucaaaguugccuaa

SEQ ID NO: 2766964 - RNA, 19 nt, Human
auuauaugcuauuucuaua

SEQ ID NO: 2766965 - RNA, 17 nt, Human
auuauaugcuauuucua

SEQ ID NO: 2766966 - RNA, 18 nt, Human
auuauaugcuauuucuau

SEQ ID NO: 2766967 - RNA, 20 nt, Human
auuauauggcuugaguuuaa

SEQ ID NO: 2766968 - RNA, 17 nt, Human
auucacugauuugacau

SEQ ID NO: 2766969 - RNA, 12 nt, Human
auucacugauuu

SEQ ID NO: 2766970 - RNA, 17 nt, Human
auuccaagugauugaaa

SEQ ID NO: 2766971 - RNA, 24 nt, Human
uuuuuggcauaacauaaaucugug

SEQ ID NO: 2766972 - RNA, 23 nt, Human
uuuuuggcauaacauaaaucugu

SEQ ID NO: 2766973 - RNA, 15 nt, Human
uuuuugaagcuguau

SEQ ID NO: 2766974 - RNA, 20 nt, Human
uuuuuauauuuacuaaaaug

SEQ ID NO: 2766975 - RNA, 15 nt, Human
uuuuguuuucauuau

SEQ ID NO: 2766976 - RNA, 15 nt, Human
uuuuggaauuuuccu

SEQ ID NO: 2766977 - RNA, 14 nt, Human
uuuugugaagcaaa

SEQ ID NO: 2766978 - RNA, 21 nt, Human
auuagaauucuguauagauua

SEQ ID NO: 2766979 - RNA, 16 nt, Human
auuacuguaagaaaau

SEQ ID NO: 2766980 - RNA, 15 nt, Human
auuacuguaagaaaa

SEQ ID NO: 2766981 - RNA, 20 nt, Human
uugucaauaaaauccauaca

SEQ ID NO: 2766982 - RNA, 15 nt, Human
augagguacugagag

SEQ ID NO: 2766983 - RNA, 18 nt, Human
augagguacugagaguga

SEQ ID NO: 2766984 - RNA, 17 nt, Human
augagguacugagagug

SEQ ID NO: 2766985 - RNA, 13 nt, Human
augauuucauuca

SEQ ID NO: 2766986 - RNA, 18 nt, Human
uuuaaaaaaauuccaagu

SEQ ID NO: 2766987 - RNA, 12 nt, Human
augcaaagcacu

SEQ ID NO: 2766988 - RNA, 13 nt, Human
augcaaagcacug

SEQ ID NO: 2766989 - RNA, 14 nt, Human
augcaaagcacuga

SEQ ID NO: 2766990 - RNA, 21 nt, Human
uuuaaauauaugcuaagucuu

SEQ ID NO: 2766991 - RNA, 17 nt, Human
uuucaaacauauauaac

SEQ ID NO: 2766992 - RNA, 19 nt, Human
uuucaaacauauauaacaa

SEQ ID NO: 2766993 - RNA, 21 nt, Human
augcuucuguuuuauaauuuu

SEQ ID NO: 2766994 - RNA, 22 nt, Human
augcuguauuuuaaaagaauga

SEQ ID NO: 2766995 - RNA, 19 nt, Human
augcuguauuuuaaaagaa

SEQ ID NO: 2766996 - RNA, 23 nt, Human
augcuguauuuuaaaagaaugau

SEQ ID NO: 2766997 - RNA, 14 nt, Human
augccaucaauaaa

SEQ ID NO: 2766998 - RNA, 18 nt, Human
augcuacaggauuugaaa

SEQ ID NO: 2766999 - RNA, 22 nt, Human
augccuuuucccaacuccagaa

SEQ ID NO: 2767000 - RNA, 20 nt, Human
augccuuuucccaacuccag

SEQ ID NO: 2767001 - RNA, 14 nt, Human
augccuuuucccaa

SEQ ID NO: 2767002 - RNA, 15 nt, Human
uuuagucuugucuca

SEQ ID NO: 2767003 - RNA, 23 nt, Human
uuuagucuugucucagauuuuau

SEQ ID NO: 2767004 - RNA, 17 nt, Human
uuuagucuugucucaga

SEQ ID NO: 2767005 - RNA, 19 nt, Human
uuuauaugcuucuguuuua

SEQ ID NO: 2767006 - RNA, 21 nt, Human
uuuauaugcuucuguuuuaua

SEQ ID NO: 2767007 - RNA, 23 nt, Human
aucugaagucagaucugccuaag

SEQ ID NO: 2767008 - RNA, 18 nt, Human
aucugaagucagaucugc

SEQ ID NO: 2767009 - RNA, 17 nt, Human
aucugaagucagaucug

SEQ ID NO: 2767010 - RNA, 16 nt, Human
aucugaagucagaucu

SEQ ID NO: 2767011 - RNA, 12 nt, Human
uugacuuuuuau

SEQ ID NO: 2767012 - RNA, 13 nt, Human
uugacaugggaca

SEQ ID NO: 2767013 - RNA, 19 nt, Human
aucucaaaacugcacuguc

SEQ ID NO: 2767014 - RNA, 20 nt, Human
aucucaaaacugcacuguca

SEQ ID NO: 2767015 - RNA, 15 nt, Human
aucucaaaacugcac

SEQ ID NO: 2767016 - RNA, 15 nt, Human
uuggagaagaacuga

SEQ ID NO: 2767017 - RNA, 22 nt, Human
uuggagaagaacugaaaucaua

SEQ ID NO: 2767018 - RNA, 17 nt, Human
uuggagaagaacugaaa

SEQ ID NO: 2767019 - RNA, 12 nt, Human
aucuuuaaaaua

SEQ ID NO: 2767020 - RNA, 15 nt, Human
aucuuuaaaauacac

SEQ ID NO: 2767021 - RNA, 14 nt, Human
aucuuauaauuuaa

SEQ ID NO: 2767022 - RNA, 16 nt, Human
aucuuauaauuuaaaa

SEQ ID NO: 2767023 - RNA, 15 nt, Human
aucuuauaauuuaaa

SEQ ID NO: 2767024 - RNA, 18 nt, Human
augaacuuguaaaggaau

SEQ ID NO: 2767025 - RNA, 23 nt, Human
auaucugaggaauucuguauaga

SEQ ID NO: 2767026 - RNA, 22 nt, Human
auaucugaggaauucuguauag

SEQ ID NO: 2767027 - RNA, 21 nt, Human
auaucugaggaauucuguaua

SEQ ID NO: 2767028 - RNA, 20 nt, Human
auaucugaggaauucuguau

SEQ ID NO: 2767029 - RNA, 19 nt, Human
auaucugaggaauucugua

SEQ ID NO: 2767030 - RNA, 18 nt, Human
auaucugaggaauucugu

SEQ ID NO: 2767031 - RNA, 17 nt, Human
auaucugaggaauucug

SEQ ID NO: 2767032 - RNA, 16 nt, Human
auaucugaggaauucu

SEQ ID NO: 2767033 - RNA, 15 nt, Human
auaucugaggaauuc

SEQ ID NO: 2767034 - RNA, 23 nt, Human
auaugcaaagcacugacuucuaa

SEQ ID NO: 2767035 - RNA, 16 nt, Human
auaugcaaagcacuga

SEQ ID NO: 2767036 - RNA, 15 nt, Human
auaugcaaagcacug

SEQ ID NO: 2767037 - RNA, 21 nt, Human
uucagcaaaaauauuuuauga

SEQ ID NO: 2767038 - RNA, 15 nt, Human
auauaacaaugcugu

SEQ ID NO: 2767039 - RNA, 12 nt, Human
auauaacaaugc

SEQ ID NO: 2767040 - RNA, 19 nt, Human
auauaagcuuguauuccuu

SEQ ID NO: 2767041 - RNA, 18 nt, Human
auauauaacaaugcugua

SEQ ID NO: 2767042 - RNA, 17 nt, Human
auauauaacaaugcugu

SEQ ID NO: 2767043 - RNA, 14 nt, Human
auauauaacaaugc

SEQ ID NO: 2767044 - RNA, 18 nt, Human
auagucaaauugugugaa

SEQ ID NO: 2767045 - RNA, 17 nt, Human
auagucaaauuguguga

SEQ ID NO: 2767046 - RNA, 15 nt, Human
uucaaacauauauaa

SEQ ID NO: 2767047 - RNA, 21 nt, Human
auaggaauugacccacaagaa

SEQ ID NO: 2767048 - RNA, 14 nt, Human
auagcuacuaauuu

SEQ ID NO: 2767049 - RNA, 17 nt, Human
auagcuacuaauuuuaa

SEQ ID NO: 2767050 - RNA, 23 nt, Human
auagcuagacuggugacugauuc

SEQ ID NO: 2767051 - RNA, 19 nt, Human
auagcuagacuggugacug

SEQ ID NO: 2767052 - RNA, 18 nt, Human
auagcuagacuggugacu

SEQ ID NO: 2767053 - RNA, 14 nt, Human
auagcuagacuggu

SEQ ID NO: 2767054 - RNA, 16 nt, Human
auagcuagacugguga

SEQ ID NO: 2767055 - RNA, 15 nt, Human
auagcuagacuggug

SEQ ID NO: 2767056 - RNA, 18 nt, Human
auagcuacuaauuuuaaa

SEQ ID NO: 2767057 - RNA, 17 nt, Human
uuauuguuuaaaaucau

SEQ ID NO: 2767058 - RNA, 18 nt, Human
uucucaacuccaaacuga

SEQ ID NO: 2767059 - RNA, 14 nt, Human
uucucaacuccaaa

SEQ ID NO: 2767060 - RNA, 20 nt, Human
aucauuucugcaucagcugc

SEQ ID NO: 2767061 - RNA, 23 nt, Human
aucccucccuccaccucccugca

SEQ ID NO: 2767062 - RNA, 21 nt, Human
aucccucccuccaccucccug

SEQ ID NO: 2767063 - RNA, 13 nt, Human
aucccucccucca

SEQ ID NO: 2767064 - RNA, 11 nt, Human
aucccucccuc

SEQ ID NO: 2767065 - RNA, 16 nt, Human
uucugcaucagcugcu

SEQ ID NO: 2767066 - RNA, 23 nt, Human
uucugcaucagcugcugaaacaa

SEQ ID NO: 2767067 - RNA, 14 nt, Human
uucugaagaagaug

SEQ ID NO: 2767068 - RNA, 13 nt, Human
uucugaagaagau

SEQ ID NO: 2767069 - RNA, 12 nt, Human
uucugaagaaga

SEQ ID NO: 2767070 - RNA, 23 nt, Human
auauuaaagccauguuuauuaca

SEQ ID NO: 2767071 - RNA, 18 nt, Human
auauuaaagccauguuua

SEQ ID NO: 2767072 - RNA, 15 nt, Human
auauuaaagccaugu

SEQ ID NO: 2767073 - RNA, 14 nt, Human
auauuaaagccaug

SEQ ID NO: 2767074 - RNA, 19 nt, Human
auauuugaaauauugacuu

SEQ ID NO: 2767075 - RNA, 14 nt, Human
auauuugaaauauu

SEQ ID NO: 2767076 - RNA, 23 nt, Human
auauuugaaauauugacuuuuua

SEQ ID NO: 2767077 - RNA, 12 nt, Human
auauuuuaacuu

SEQ ID NO: 2767078 - RNA, 22 nt, Human
auauuuguaucacaaaucuuaa

SEQ ID NO: 2767079 - RNA, 13 nt, Human
auauuugaaauau

SEQ ID NO: 2767080 - RNA, 13 nt, Human
auauuuuaugauc

SEQ ID NO: 2767081 - RNA, 12 nt, Human
auauuuuaugau

SEQ ID NO: 2767082 - RNA, 22 nt, Human
auauuuuaugauccagcagauu

SEQ ID NO: 2767083 - RNA, 17 nt, Human
auauuuuaugauccagc

SEQ ID NO: 2767084 - RNA, 19 nt, Human
aucaauuuuucuuauuuca

SEQ ID NO: 2767085 - RNA, 14 nt, Human
uguuccuagugaaa

SEQ ID NO: 2767086 - RNA, 18 nt, Human
uguuccuagugaaagagg

SEQ ID NO: 2767087 - RNA, 15 nt, Human
uguuauaaucuuuca

SEQ ID NO: 2767088 - RNA, 13 nt, Human
uguguaaguagau

SEQ ID NO: 2767089 - RNA, 19 nt, Human
agugaguuggguguauugu

SEQ ID NO: 2767090 - RNA, 20 nt, Human
uguggucacaggaaguagag

SEQ ID NO: 2767091 - RNA, 18 nt, Human
ugugcugggguuaucuga

SEQ ID NO: 2767092 - RNA, 15 nt, Human
agugaaagaaaauaa

SEQ ID NO: 2767093 - RNA, 20 nt, Human
agugaacaaauuuacagaga

SEQ ID NO: 2767094 - RNA, 16 nt, Human
agugaacaaauuuaca

SEQ ID NO: 2767095 - RNA, 12 nt, Human
ugugaacuugaa

SEQ ID NO: 2767096 - RNA, 16 nt, Human
ugugaacuugaaauuu

SEQ ID NO: 2767097 - RNA, 15 nt, Human
ugugaacuugaaauu

SEQ ID NO: 2767098 - RNA, 14 nt, Human
ugugaacuugaaau

SEQ ID NO: 2767099 - RNA, 16 nt, Human
agucucaggaaaucaa

SEQ ID NO: 2767100 - RNA, 22 nt, Human
agucucaggaaaucaaauaugc

SEQ ID NO: 2767101 - RNA, 19 nt, Human
ugugagaugcuagaacucc

SEQ ID NO: 2767102 - RNA, 15 nt, Human
ugugagaugcuagaa

SEQ ID NO: 2767103 - RNA, 20 nt, Human
agugaaacucguuaauuugu

SEQ ID NO: 2767104 - RNA, 18 nt, Human
agucuuucacauuuaaau

SEQ ID NO: 2767105 - RNA, 19 nt, Human
auaaaauccauacauuugu

SEQ ID NO: 2767106 - RNA, 18 nt, Human
auaaaauccauacauuug

SEQ ID NO: 2767107 - RNA, 21 nt, Human
auaaaauaauuuuuauauuug

SEQ ID NO: 2767108 - RNA, 16 nt, Human
auaaaauaauuuuuau

SEQ ID NO: 2767109 - RNA, 15 nt, Human
auaaaauaauuuuua

SEQ ID NO: 2767110 - RNA, 18 nt, Human
uuaaguaaugauaacugg

SEQ ID NO: 2767111 - RNA, 22 nt, Human
uuaagaagacugcauuauauuu

SEQ ID NO: 2767112 - RNA, 20 nt, Human
uuaagaagacugcauuauau

SEQ ID NO: 2767113 - RNA, 20 nt, Human
uuacaguauaauuaacaugu

SEQ ID NO: 2767114 - RNA, 19 nt, Human
uuacaguauaauuaacaug

SEQ ID NO: 2767115 - RNA, 18 nt, Human
uuacaguauaauuaacau

SEQ ID NO: 2767116 - RNA, 13 nt, Human
uuacaguauaauu

SEQ ID NO: 2767117 - RNA, 17 nt, Human
uuacaguauaauuaaca

SEQ ID NO: 2767118 - RNA, 16 nt, Human
uuacaguauaauuaac

SEQ ID NO: 2767119 - RNA, 20 nt, Human
auaaaucugugaacuugaaa

SEQ ID NO: 2767120 - RNA, 22 nt, Human
auaaaucugugaacuugaaauu

SEQ ID NO: 2767121 - RNA, 21 nt, Human
auaaaucugugaacuugaaau

SEQ ID NO: 2767122 - RNA, 18 nt, Human
auaaauagcuagacuggu

SEQ ID NO: 2767123 - RNA, 16 nt, Human
auaaauagcuagacug

SEQ ID NO: 2767124 - RNA, 15 nt, Human
uuacuguaagaaaau

SEQ ID NO: 2767125 - RNA, 17 nt, Human
uuagaauucuguauaga

SEQ ID NO: 2767126 - RNA, 12 nt, Human
uuaccugggaaa

SEQ ID NO: 2767127 - RNA, 14 nt, Human
uuaccuuacagaag

SEQ ID NO: 2767128 - RNA, 14 nt, Human
uuaacaacagcugg

SEQ ID NO: 2767129 - RNA, 16 nt, Human
aguuggguguauugug

SEQ ID NO: 2767130 - RNA, 19 nt, Human
aguugccuaaauccauuug

SEQ ID NO: 2767131 - RNA, 23 nt, Human
aguugccuaaauccauuuggaaa

SEQ ID NO: 2767132 - RNA, 22 nt, Human
aguugccuaaauccauuuggaa

SEQ ID NO: 2767133 - RNA, 20 nt, Human
aguuggguguauugugcgcu

SEQ ID NO: 2767134 - RNA, 17 nt, Human
aguuggguguauugugc

SEQ ID NO: 2767135 - RNA, 19 nt, Human
aguuuaauauuaaagccau

SEQ ID NO: 2767136 - RNA, 18 nt, Human
aguuuaauauuaaagcca

SEQ ID NO: 2767137 - RNA, 16 nt, Human
aguuuaauauuaaagc

SEQ ID NO: 2767138 - RNA, 15 nt, Human
aguuuaauauuaaag

SEQ ID NO: 2767139 - RNA, 20 nt, Human
aguuuaauauuaaagccaug

SEQ ID NO: 2767140 - RNA, 16 nt, Human
aguuuagcuggaaaag

SEQ ID NO: 2767141 - RNA, 23 nt, Human
uguuuagucuugucucagauuuu

SEQ ID NO: 2767142 - RNA, 20 nt, Human
uguuuagucuugucucagau

SEQ ID NO: 2767143 - RNA, 22 nt, Human
uguuuagucuugucucagauuu

SEQ ID NO: 2767144 - RNA, 14 nt, Human
uguuuauuacagua

SEQ ID NO: 2767145 - RNA, 19 nt, Human
uguuuggaccaaaaaccag

SEQ ID NO: 2767146 - RNA, 19 nt, Human
uguuuucauuaucucaaaa

SEQ ID NO: 2767147 - RNA, 14 nt, Human
uguuuugcaagcca

SEQ ID NO: 2767148 - RNA, 16 nt, Human
aguucugaagaagaug

SEQ ID NO: 2767149 - RNA, 21 nt, Human
aguucugcagauaaacaguag

SEQ ID NO: 2767150 - RNA, 16 nt, Human
aguucugcagauaaac

SEQ ID NO: 2767151 - RNA, 18 nt, Human
aggggagcaugggaagug

SEQ ID NO: 2767152 - RNA, 23 nt, Human
agggaggacgcucucuggccuuc

SEQ ID NO: 2767153 - RNA, 22 nt, Human
agggaggacgcucucuggccuu

SEQ ID NO: 2767154 - RNA, 21 nt, Human
agggaggacgcucucuggccu

SEQ ID NO: 2767155 - RNA, 13 nt, Human
agggaaauuucag

SEQ ID NO: 2767156 - RNA, 13 nt, Human
aguaaaauccaca

SEQ ID NO: 2767157 - RNA, 20 nt, Human
aguaaugauaacuggaaacu

SEQ ID NO: 2767158 - RNA, 18 nt, Human
aguaaugauaacuggaaa

SEQ ID NO: 2767159 - RNA, 17 nt, Human
aguaaugauaacuggaa

SEQ ID NO: 2767160 - RNA, 13 nt, Human
aguaaugauaacu

SEQ ID NO: 2767161 - RNA, 16 nt, Human
aguauuucuaugaaau

SEQ ID NO: 2767162 - RNA, 17 nt, Human
aguauuucuaugaaaua

SEQ ID NO: 2767163 - RNA, 18 nt, Human
aguauuucuaugaaauau

SEQ ID NO: 2767164 - RNA, 17 nt, Human
agucaccucauggaauu

SEQ ID NO: 2767165 - RNA, 15 nt, Human
agucaccucauggaa

SEQ ID NO: 2767166 - RNA, 14 nt, Human
agucaccucaugga

SEQ ID NO: 2767167 - RNA, 18 nt, Human
aguauuagaauaccacag

SEQ ID NO: 2767168 - RNA, 13 nt, Human
uguauuacaaauc

SEQ ID NO: 2767169 - RNA, 22 nt, Human
uguauuacaaauccaaugaaau

SEQ ID NO: 2767170 - RNA, 13 nt, Human
uguaugugugaag

SEQ ID NO: 2767171 - RNA, 15 nt, Human
uguaucacaaaucuu

SEQ ID NO: 2767172 - RNA, 18 nt, Human
uguaucacaaaucuuaac

SEQ ID NO: 2767173 - RNA, 15 nt, Human
uguaguguuggagaa

SEQ ID NO: 2767174 - RNA, 14 nt, Human
uguaguguuggaga

SEQ ID NO: 2767175 - RNA, 14 nt, Human
uggugcccugcuuu

SEQ ID NO: 2767176 - RNA, 20 nt, Human
uggugcccugcuuucagaua

SEQ ID NO: 2767177 - RNA, 19 nt, Human
uggugcccugcuuucagau

SEQ ID NO: 2767178 - RNA, 16 nt, Human
uggugcccugcuuuca

SEQ ID NO: 2767179 - RNA, 15 nt, Human
uguaaauacaauuuu

SEQ ID NO: 2767180 - RNA, 16 nt, Human
uguaaaggaauuuaaa

SEQ ID NO: 2767181 - RNA, 14 nt, Human
agcuguucacagcc

SEQ ID NO: 2767182 - RNA, 22 nt, Human
ugccaucaauaaaaaauuauga

SEQ ID NO: 2767183 - RNA, 14 nt, Human
ugccaucaauaaaa

SEQ ID NO: 2767184 - RNA, 15 nt, Human
agcugcccucuccug

SEQ ID NO: 2767185 - RNA, 14 nt, Human
agcugcccucuccu

SEQ ID NO: 2767186 - RNA, 13 nt, Human
agcugcccucucc

SEQ ID NO: 2767187 - RNA, 19 nt, Human
ugcccuguuaaaagaugaa

SEQ ID NO: 2767188 - RNA, 20 nt, Human
ugcccuguuaaaagaugaaa

SEQ ID NO: 2767189 - RNA, 20 nt, Human
agcuugcccuggugccucac

SEQ ID NO: 2767190 - RNA, 16 nt, Human
agcuugcccuguuaaa

SEQ ID NO: 2767191 - RNA, 18 nt, Human
agcuugcccuguuaaaag

SEQ ID NO: 2767192 - RNA, 19 nt, Human
agcuugcccuguuaaaaga

SEQ ID NO: 2767193 - RNA, 14 nt, Human
ugcuacaaaaacac

SEQ ID NO: 2767194 - RNA, 19 nt, Human
ugccuuuucccaacuccag

SEQ ID NO: 2767195 - RNA, 17 nt, Human
ugccuuuucccaacucc

SEQ ID NO: 2767196 - RNA, 22 nt, Human
ugcuauuucuauauuuucauuc

SEQ ID NO: 2767197 - RNA, 21 nt, Human
ugcuauuucuauauuuucauu

SEQ ID NO: 2767198 - RNA, 19 nt, Human
aggaaaucaaauaugcaaa

SEQ ID NO: 2767199 - RNA, 20 nt, Human
aggaaaucaaauaugcaaag

SEQ ID NO: 2767200 - RNA, 21 nt, Human
aggaaaucaaauaugcaaagc

SEQ ID NO: 2767201 - RNA, 22 nt, Human
aggaaaucaaauaugcaaagca

SEQ ID NO: 2767202 - RNA, 15 nt, Human
aggcccccaggugcc

SEQ ID NO: 2767203 - RNA, 14 nt, Human
uggaguugaaaauc

SEQ ID NO: 2767204 - RNA, 15 nt, Human
aggcagcuugaaacu

SEQ ID NO: 2767205 - RNA, 20 nt, Human
aggcagcucuaaaugucaau

SEQ ID NO: 2767206 - RNA, 20 nt, Human
aggcauuuaggccaugggac

SEQ ID NO: 2767207 - RNA, 14 nt, Human
uggagcucguggaa

SEQ ID NO: 2767208 - RNA, 21 nt, Human
uggagcucguggaacaguuac

SEQ ID NO: 2767209 - RNA, 17 nt, Human
uggagcucguggaacag

SEQ ID NO: 2767210 - RNA, 17 nt, Human
ugcuuuuaaaaaaaaau

SEQ ID NO: 2767211 - RNA, 14 nt, Human
aggacuucuuuaau

SEQ ID NO: 2767212 - RNA, 23 nt, Human
aggacuucuuuaauuuuggaauu

SEQ ID NO: 2767213 - RNA, 22 nt, Human
aggacuucuuuaauuuuggaau

SEQ ID NO: 2767214 - RNA, 21 nt, Human
aggacuucuuuaauuuuggaa

SEQ ID NO: 2767215 - RNA, 16 nt, Human
aggacuucuuuaauuu

SEQ ID NO: 2767216 - RNA, 17 nt, Human
aggagaaacuggaacuc

SEQ ID NO: 2767217 - RNA, 19 nt, Human
aggagaaacuggaacucuc

SEQ ID NO: 2767218 - RNA, 18 nt, Human
aggagaaacuggaacucu

SEQ ID NO: 2767219 - RNA, 14 nt, Human
aggaauucuguaua

SEQ ID NO: 2767220 - RNA, 13 nt, Human
aggaauucuguau

SEQ ID NO: 2767221 - RNA, 20 nt, Human
aggacgcucucuggccuucg

SEQ ID NO: 2767222 - RNA, 19 nt, Human
aggacgcucucuggccuuc

SEQ ID NO: 2767223 - RNA, 17 nt, Human
aggacgcucucuggccu

SEQ ID NO: 2767224 - RNA, 16 nt, Human
aggacgcucucuggcc

SEQ ID NO: 2767225 - RNA, 14 nt, Human
aggacgcucucugg

SEQ ID NO: 2767226 - RNA, 13 nt, Human
aggacgcucucug

SEQ ID NO: 2767227 - RNA, 15 nt, Human
ugcacuccagccuga

SEQ ID NO: 2767228 - RNA, 17 nt, Human
ugcacuccagccugagc

SEQ ID NO: 2767229 - RNA, 22 nt, Human
ugcagaagacaguauggcagcu

SEQ ID NO: 2767230 - RNA, 23 nt, Human
ugauuugacauagucuggcugua

SEQ ID NO: 2767231 - RNA, 13 nt, Human
ugauuucauucaa

SEQ ID NO: 2767232 - RNA, 20 nt, Human
ugcaaagcacugacuucuaa

SEQ ID NO: 2767233 - RNA, 22 nt, Human
ugcaaagcacugacuucuaagu

SEQ ID NO: 2767234 - RNA, 18 nt, Human
ugcaaagcacugacuucu

SEQ ID NO: 2767235 - RNA, 21 nt, Human
ugcaagccagauuuuccugaa

SEQ ID NO: 2767236 - RNA, 15 nt, Human
ugcaagccagauuuu

SEQ ID NO: 2767237 - RNA, 21 nt, Human
ugcaauaaaauggguuuuacu

SEQ ID NO: 2767238 - RNA, 17 nt, Human
ugcaauaaaauggguuu

SEQ ID NO: 2767239 - RNA, 20 nt, Human
ugcauagauucccugagcag

SEQ ID NO: 2767240 - RNA, 13 nt, Human
ugcauacucauua

SEQ ID NO: 2767241 - RNA, 19 nt, Human
ugcauacucauuaggaugg

SEQ ID NO: 2767242 - RNA, 19 nt, Human
agccugagcgacagugaga

SEQ ID NO: 2767243 - RNA, 17 nt, Human
ugccaguuauggcuaua

SEQ ID NO: 2767244 - RNA, 13 nt, Human
ugccauaauuacu

SEQ ID NO: 2767245 - RNA, 18 nt, Human
ugagugucuuaauuaaaa

SEQ ID NO: 2767246 - RNA, 18 nt, Human
agcagucaggaaagagaa

SEQ ID NO: 2767247 - RNA, 17 nt, Human
agcagucaggaaagaga

SEQ ID NO: 2767248 - RNA, 19 nt, Human
agcagucaggaaagagaac

SEQ ID NO: 2767249 - RNA, 22 nt, Human
agcauauauuuuuauauuuacu

SEQ ID NO: 2767250 - RNA, 20 nt, Human
agcauauauuuuuauauuua

SEQ ID NO: 2767251 - RNA, 18 nt, Human
agcauauauuuuuauauu

SEQ ID NO: 2767252 - RNA, 13 nt, Human
agcauaccaacac

SEQ ID NO: 2767253 - RNA, 15 nt, Human
agcauauauuuuuau

SEQ ID NO: 2767254 - RNA, 19 nt, Human
agcauaccaacacgagcag

SEQ ID NO: 2767255 - RNA, 22 nt, Human
agcauaccaacacgagcaggcu

SEQ ID NO: 2767256 - RNA, 19 nt, Human
agcagggcauggcugggaa

SEQ ID NO: 2767257 - RNA, 16 nt, Human
agcaggcuacugucag

SEQ ID NO: 2767258 - RNA, 17 nt, Human
agcaggcuacugucagc

SEQ ID NO: 2767259 - RNA, 19 nt, Human
agcaggcuacugucagcuc

SEQ ID NO: 2767260 - RNA, 20 nt, Human
agcaggcuacugucagcucc

SEQ ID NO: 2767261 - RNA, 14 nt, Human
agcaggcuacuguc

SEQ ID NO: 2767262 - RNA, 19 nt, Human
ugauccagcagauuauuca

SEQ ID NO: 2767263 - RNA, 15 nt, Human
ugauuaaguaaugau

SEQ ID NO: 2767264 - RNA, 16 nt, Human
ugauuaaguaaugaua

SEQ ID NO: 2767265 - RNA, 22 nt, Human
agcauuuagauguauagguuga

SEQ ID NO: 2767266 - RNA, 20 nt, Human
agcaucacaugaacuuguaa

SEQ ID NO: 2767267 - RNA, 22 nt, Human
agagauuuuuuuguuguuuguu

SEQ ID NO: 2767268 - RNA, 23 nt, Human
agagauuuuuuuguuguuuguuu

SEQ ID NO: 2767269 - RNA, 14 nt, Human
agagcugcccucuc

SEQ ID NO: 2767270 - RNA, 13 nt, Human
agagcugcccucu

SEQ ID NO: 2767271 - RNA, 15 nt, Human
agagcugcccucucc

SEQ ID NO: 2767272 - RNA, 23 nt, Human
ugaaauaagccagacaucaacag

SEQ ID NO: 2767273 - RNA, 20 nt, Human
ugaaauaagccagacaucaa

SEQ ID NO: 2767274 - RNA, 18 nt, Human
ugaaauaagccagacauc

SEQ ID NO: 2767275 - RNA, 17 nt, Human
ugaaauaagccagacau

SEQ ID NO: 2767276 - RNA, 17 nt, Human
ugaaauuugaauuuugu

SEQ ID NO: 2767277 - RNA, 14 nt, Human
ugaaauuugaauuu

SEQ ID NO: 2767278 - RNA, 16 nt, Human
ugaaauuugaauuuug

SEQ ID NO: 2767279 - RNA, 15 nt, Human
ugaaauuugaauuuu

SEQ ID NO: 2767280 - RNA, 20 nt, Human
ugaaauuguaauuauaucug

SEQ ID NO: 2767281 - RNA, 21 nt, Human
ugaaauuguaauuauaucuga

SEQ ID NO: 2767282 - RNA, 15 nt, Human
ugaaauuguauuaca

SEQ ID NO: 2767283 - RNA, 18 nt, Human
ugaaauauuauguuaaaa

SEQ ID NO: 2767284 - RNA, 18 nt, Human
ugaacaaauuuacagaga

SEQ ID NO: 2767285 - RNA, 20 nt, Human
ugaacaaauuuacagagaca

SEQ ID NO: 2767286 - RNA, 19 nt, Human
ugaacaaauuuacagagac

SEQ ID NO: 2767287 - RNA, 23 nt, Human
ugaacuagaguuuagcuggaaaa

SEQ ID NO: 2767288 - RNA, 22 nt, Human
agagcugcccucuccugggcag

SEQ ID NO: 2767289 - RNA, 19 nt, Human
agagcuguucacagccaga

SEQ ID NO: 2767290 - RNA, 21 nt, Human
agagcuguucacagccagacu

SEQ ID NO: 2767291 - RNA, 15 nt, Human
agagguugcagugag

SEQ ID NO: 2767292 - RNA, 17 nt, Human
ugacccacaagaaauga

SEQ ID NO: 2767293 - RNA, 17 nt, Human
agaugcaguucugaaga

SEQ ID NO: 2767294 - RNA, 19 nt, Human
agaugcaguucugaagaag

SEQ ID NO: 2767295 - RNA, 18 nt, Human
agaugcaguucugaagaa

SEQ ID NO: 2767296 - RNA, 14 nt, Human
agaugcuagaacuc

SEQ ID NO: 2767297 - RNA, 23 nt, Human
ugaauuuauuggcuuuucugauc

SEQ ID NO: 2767298 - RNA, 22 nt, Human
ugaauuuauuggcuuuucugau

SEQ ID NO: 2767299 - RNA, 21 nt, Human
ugaauuuauuggcuuuucuga

SEQ ID NO: 2767300 - RNA, 17 nt, Human
ugaauuuauuggcuuuu

SEQ ID NO: 2767301 - RNA, 17 nt, Human
agaguuuagcuggaaaa

SEQ ID NO: 2767302 - RNA, 16 nt, Human
agaguuuagcuggaaa

SEQ ID NO: 2767303 - RNA, 23 nt, Human
agacuauucaaacagucucagga

SEQ ID NO: 2767304 - RNA, 16 nt, Human
ucuuauuucauuucuu

SEQ ID NO: 2767305 - RNA, 15 nt, Human
ucuuauuucauuucu

SEQ ID NO: 2767306 - RNA, 12 nt, Human
agacuggugacu

SEQ ID NO: 2767307 - RNA, 14 nt, Human
agacuggugacuga

SEQ ID NO: 2767308 - RNA, 13 nt, Human
agacuggugacug

SEQ ID NO: 2767309 - RNA, 17 nt, Human
agacuggugacugauuc

SEQ ID NO: 2767310 - RNA, 16 nt, Human
agacuggugacugauu

SEQ ID NO: 2767311 - RNA, 15 nt, Human
agagacagaaagcag

SEQ ID NO: 2767312 - RNA, 24 nt, Human
agagacagaaagcagaacagugau

SEQ ID NO: 2767313 - RNA, 23 nt, Human
agaauuaacacaugauccugcaa

SEQ ID NO: 2767314 - RNA, 13 nt, Human
ucuguacuuuuug

SEQ ID NO: 2767315 - RNA, 17 nt, Human
ucuguacuuuuuggcau

SEQ ID NO: 2767316 - RNA, 14 nt, Human
ucuguacuuuuugg

SEQ ID NO: 2767317 - RNA, 22 nt, Human
ucugugaacuugaaauuugaau

SEQ ID NO: 2767318 - RNA, 19 nt, Human
ucugugaacuugaaauuug

SEQ ID NO: 2767319 - RNA, 22 nt, Human
ucuuagaugcaguucugaagaa

SEQ ID NO: 2767320 - RNA, 23 nt, Human
ucuuagaugcaguucugaagaag

SEQ ID NO: 2767321 - RNA, 15 nt, Human
agacacacaugaagu

SEQ ID NO: 2767322 - RNA, 17 nt, Human
agacacacugaagaagc

SEQ ID NO: 2767323 - RNA, 16 nt, Human
agacacacugaagaag

SEQ ID NO: 2767324 - RNA, 23 nt, Human
acuuguuagaucuaguucacucu

SEQ ID NO: 2767325 - RNA, 15 nt, Human
acuuguuagaucuag

SEQ ID NO: 2767326 - RNA, 14 nt, Human
acuuguuagaucua

SEQ ID NO: 2767327 - RNA, 16 nt, Human
acuuguguuuugcaag

SEQ ID NO: 2767328 - RNA, 23 nt, Human
acuucuaaguaaaaccacagcag

SEQ ID NO: 2767329 - RNA, 16 nt, Human
acuugucaauaaaauc

SEQ ID NO: 2767330 - RNA, 16 nt, Human
acuugaaauuugaauu

SEQ ID NO: 2767331 - RNA, 19 nt, Human
acuugaaauuugaauuuug

SEQ ID NO: 2767332 - RNA, 20 nt, Human
acuugaaauuugaauuuugu

SEQ ID NO: 2767333 - RNA, 20 nt, Human
acuugaacccgggaggcaga

SEQ ID NO: 2767334 - RNA, 19 nt, Human
acuugaacccgggaggcag

SEQ ID NO: 2767335 - RNA, 21 nt, Human
acuugaacccauauuuguaca

SEQ ID NO: 2767336 - RNA, 12 nt, Human
ucucuggccuuc

SEQ ID NO: 2767337 - RNA, 22 nt, Human
ucucuggccuucggccuccauc

SEQ ID NO: 2767338 - RNA, 21 nt, Human
ucucuggccuucggccuccau

SEQ ID NO: 2767339 - RNA, 23 nt, Human
agaaacuuaagguuaccuuuguu

SEQ ID NO: 2767340 - RNA, 19 nt, Human
ucugaagucagaucugccu

SEQ ID NO: 2767341 - RNA, 15 nt, Human
ucugaagucagaucu

SEQ ID NO: 2767342 - RNA, 12 nt, Human
ucugaagaagau

SEQ ID NO: 2767343 - RNA, 22 nt, Human
ucggguuuuauuguuuaaaauc

SEQ ID NO: 2767344 - RNA, 21 nt, Human
acuguggugacuuuggauaau

SEQ ID NO: 2767345 - RNA, 20 nt, Human
acuguggugacuuuggauaa

SEQ ID NO: 2767346 - RNA, 18 nt, Human
acuguggugacuuuggau

SEQ ID NO: 2767347 - RNA, 12 nt, Human
acuguggugacu

SEQ ID NO: 2767348 - RNA, 15 nt, Human
acuguggugacuuug

SEQ ID NO: 2767349 - RNA, 14 nt, Human
acuguggugacuuu

SEQ ID NO: 2767350 - RNA, 18 nt, Human
acuguggguagacacaca

SEQ ID NO: 2767351 - RNA, 13 nt, Human
acuguggguagac

SEQ ID NO: 2767352 - RNA, 21 nt, Human
acugucagcuccccucggaga

SEQ ID NO: 2767353 - RNA, 18 nt, Human
acugggacaggggagaac

SEQ ID NO: 2767354 - RNA, 23 nt, Human
ucuaaguaaaaccacagcaguug

SEQ ID NO: 2767355 - RNA, 16 nt, Human
ucuacauacuauggaa

SEQ ID NO: 2767356 - RNA, 20 nt, Human
ucuaaguaaaaccacagcag

SEQ ID NO: 2767357 - RNA, 21 nt, Human
ucuaaguaaaaccacagcagu

SEQ ID NO: 2767358 - RNA, 22 nt, Human
ucuaaguaaaaccacagcaguu

SEQ ID NO: 2767359 - RNA, 20 nt, Human
ucuaaagccauuguaguccu

SEQ ID NO: 2767360 - RNA, 13 nt, Human
acuggcacaguuu

SEQ ID NO: 2767361 - RNA, 19 nt, Human
acuggcacaguuuucugag

SEQ ID NO: 2767362 - RNA, 20 nt, Human
acuggcacaguuuucugaga

SEQ ID NO: 2767363 - RNA, 19 nt, Human
acugccuucucaacuccaa

SEQ ID NO: 2767364 - RNA, 13 nt, Human
acugccuucucaa

SEQ ID NO: 2767365 - RNA, 15 nt, Human
acugcauuauauuua

SEQ ID NO: 2767366 - RNA, 14 nt, Human
acugcauuauauuu

SEQ ID NO: 2767367 - RNA, 21 nt, Human
uccaacuaucucauuuccaag

SEQ ID NO: 2767368 - RNA, 19 nt, Human
acgagcaggcuacugucag

SEQ ID NO: 2767369 - RNA, 20 nt, Human
acgagcaggcuacugucagc

SEQ ID NO: 2767370 - RNA, 14 nt, Human
acgagaaaacaaua

SEQ ID NO: 2767371 - RNA, 13 nt, Human
accucccugcaau

SEQ ID NO: 2767372 - RNA, 12 nt, Human
accucccugcaa

SEQ ID NO: 2767373 - RNA, 16 nt, Human
ucaugaauuaguuuua

SEQ ID NO: 2767374 - RNA, 22 nt, Human
ucaggaaaucaaauaugcaaag

SEQ ID NO: 2767375 - RNA, 23 nt, Human
ucaggaaaucaaauaugcaaagc

SEQ ID NO: 2767376 - RNA, 16 nt, Human
accuagggugauauua

SEQ ID NO: 2767377 - RNA, 21 nt, Human
accuagggugauauuaaccag

SEQ ID NO: 2767378 - RNA, 18 nt, Human
acuccagaaagugacaag

SEQ ID NO: 2767379 - RNA, 21 nt, Human
acuccaaagaaauguaaggga

SEQ ID NO: 2767380 - RNA, 15 nt, Human
acuccaaagaaaugu

SEQ ID NO: 2767381 - RNA, 18 nt, Human
acuccaaagaaauguaag

SEQ ID NO: 2767382 - RNA, 14 nt, Human
acuccaaagaaaug

SEQ ID NO: 2767383 - RNA, 11 nt, Human
ucccugagcag

SEQ ID NO: 2767384 - RNA, 16 nt, Human
ucccucccuccaccuc

SEQ ID NO: 2767385 - RNA, 15 nt, Human
ucccucccuccaccu

SEQ ID NO: 2767386 - RNA, 23 nt, Human
ucccuccaccucccugcaauaaa

SEQ ID NO: 2767387 - RNA, 21 nt, Human
ucccuccaccucccugcaaua

SEQ ID NO: 2767388 - RNA, 14 nt, Human
ucccucccuccacc

SEQ ID NO: 2767389 - RNA, 13 nt, Human
ucccucccuccac

SEQ ID NO: 2767390 - RNA, 17 nt, Human
uccccucggagaagagc

SEQ ID NO: 2767391 - RNA, 16 nt, Human
uccccucggagaagag

SEQ ID NO: 2767392 - RNA, 18 nt, Human
ucccagccagcaguucag

SEQ ID NO: 2767393 - RNA, 17 nt, Human
ucccagccagcaguuca

SEQ ID NO: 2767394 - RNA, 14 nt, Human
ucccagucauuuaa

SEQ ID NO: 2767395 - RNA, 22 nt, Human
ucccagucauuuaauaaaugug

SEQ ID NO: 2767396 - RNA, 18 nt, Human
uccauuuaauaauuauau

SEQ ID NO: 2767397 - RNA, 13 nt, Human
uccaugaagaugu

SEQ ID NO: 2767398 - RNA, 21 nt, Human
uccaugaagauguagaggaga

SEQ ID NO: 2767399 - RNA, 21 nt, Human
uccauccugaggcuccacuug

SEQ ID NO: 2767400 - RNA, 20 nt, Human
uccauccugaggcuccacuu

SEQ ID NO: 2767401 - RNA, 19 nt, Human
uccauccugaggcuccacu

SEQ ID NO: 2767402 - RNA, 20 nt, Human
ucaggaaaucaaauaugcaa

SEQ ID NO: 2767403 - RNA, 21 nt, Human
ucaggaaaucaaauaugcaaa

SEQ ID NO: 2767404 - RNA, 19 nt, Human
ucaggaaagagaacuucca

SEQ ID NO: 2767405 - RNA, 13 nt, Human
ucaggaaagagaa

SEQ ID NO: 2767406 - RNA, 12 nt, Human
ucagagcugccc

SEQ ID NO: 2767407 - RNA, 19 nt, Human
accaugggauaaaugccau

SEQ ID NO: 2767408 - RNA, 18 nt, Human
accaugggauaaaugcca

SEQ ID NO: 2767409 - RNA, 23 nt, Human
accauuucuugagguaaaagcau

SEQ ID NO: 2767410 - RNA, 15 nt, Human
accaaucaugaauua

SEQ ID NO: 2767411 - RNA, 13 nt, Human
accaaucaugaau

SEQ ID NO: 2767412 - RNA, 20 nt, Human
ucaauuuuucuuauuucauu

SEQ ID NO: 2767413 - RNA, 23 nt, Human
ucaauuuuucuuauuucauuucu

SEQ ID NO: 2767414 - RNA, 13 nt, Human
ucaauuuuaacaa

SEQ ID NO: 2767415 - RNA, 15 nt, Human
ucaauucuugccaaa

SEQ ID NO: 2767416 - RNA, 18 nt, Human
accacuuguguuuugcaa

SEQ ID NO: 2767417 - RNA, 14 nt, Human
accagggacugagg

SEQ ID NO: 2767418 - RNA, 20 nt, Human
acauagucuggcuguaccca

SEQ ID NO: 2767419 - RNA, 15 nt, Human
acauagucuggcugu

SEQ ID NO: 2767420 - RNA, 14 nt, Human
acauagucuggcug

SEQ ID NO: 2767421 - RNA, 19 nt, Human
acauauauaacaaugcugu

SEQ ID NO: 2767422 - RNA, 18 nt, Human
acauagaauuaacacaug

SEQ ID NO: 2767423 - RNA, 14 nt, Human
acauagaauuaaca

SEQ ID NO: 2767424 - RNA, 13 nt, Human
acaucaacagaua

SEQ ID NO: 2767425 - RNA, 18 nt, Human
uauuucuauauuuucauu

SEQ ID NO: 2767426 - RNA, 17 nt, Human
uauuucuauauuuucau

SEQ ID NO: 2767427 - RNA, 16 nt, Human
uauuucuauauuuuca

SEQ ID NO: 2767428 - RNA, 13 nt, Human
uauuucauuucuu

SEQ ID NO: 2767429 - RNA, 18 nt, Human
acaguuuucugagaaaga

SEQ ID NO: 2767430 - RNA, 19 nt, Human
acaguuuucugagaaagac

SEQ ID NO: 2767431 - RNA, 20 nt, Human
acaguuuucugagaaagacu

SEQ ID NO: 2767432 - RNA, 21 nt, Human
acaguuuucugagaaagacua

SEQ ID NO: 2767433 - RNA, 16 nt, Human
acaguuuucugagaaa

SEQ ID NO: 2767434 - RNA, 17 nt, Human
acaguuuucugagaaag

SEQ ID NO: 2767435 - RNA, 15 nt, Human
acaguuuucugagaa

SEQ ID NO: 2767436 - RNA, 22 nt, Human
ucaagaugaugaugaucuuuaa

SEQ ID NO: 2767437 - RNA, 21 nt, Human
ucaaaauaugccccauucaac

SEQ ID NO: 2767438 - RNA, 23 nt, Human
ucaaaauaccaugccauuuaaag

SEQ ID NO: 2767439 - RNA, 21 nt, Human
ucaaaauaccaugccauuuaa

SEQ ID NO: 2767440 - RNA, 16 nt, Human
uauuuuuauauuuacu

SEQ ID NO: 2767441 - RNA, 18 nt, Human
ucaaaagaaagaaaauca

SEQ ID NO: 2767442 - RNA, 22 nt, Human
ucaaaguugccuaaauccauuu

SEQ ID NO: 2767443 - RNA, 21 nt, Human
ucaaaguugccuaaauccauu

SEQ ID NO: 2767444 - RNA, 19 nt, Human
ucaaaguugccuaaaucca

SEQ ID NO: 2767445 - RNA, 18 nt, Human
ucaaaguugccuaaaucc

SEQ ID NO: 2767446 - RNA, 14 nt, Human
ucaaagcugaaaug

SEQ ID NO: 2767447 - RNA, 19 nt, Human
acaugauccugcaauucca

SEQ ID NO: 2767448 - RNA, 17 nt, Human
uaucucaaaacugcacu

SEQ ID NO: 2767449 - RNA, 15 nt, Human
uauauuuauuacugu

SEQ ID NO: 2767450 - RNA, 19 nt, Human
uauauuuauuacuguaaga

SEQ ID NO: 2767451 - RNA, 19 nt, Human
acagcccuucuuuccacag

SEQ ID NO: 2767452 - RNA, 21 nt, Human
acagcccuucuuuccacagaa

SEQ ID NO: 2767453 - RNA, 20 nt, Human
acagcccuucuuuccacaga

SEQ ID NO: 2767454 - RNA, 15 nt, Human
acacuuaaaaauggu

SEQ ID NO: 2767455 - RNA, 13 nt, Human
acacuuaaaaaug

SEQ ID NO: 2767456 - RNA, 12 nt, Human
uauauuuacaaa

SEQ ID NO: 2767457 - RNA, 14 nt, Human
acacugaagaagca

SEQ ID NO: 2767458 - RNA, 12 nt, Human
acacugaagaag

SEQ ID NO: 2767459 - RNA, 14 nt, Human
acacuccagugaga

SEQ ID NO: 2767460 - RNA, 23 nt, Human
uauaaaauaauuuuuauauuuga

SEQ ID NO: 2767461 - RNA, 14 nt, Human
acacuaagagagaa

SEQ ID NO: 2767462 - RNA, 18 nt, Human
acacuaagagagaaugag

SEQ ID NO: 2767463 - RNA, 17 nt, Human
acacuaagagagaauga

SEQ ID NO: 2767464 - RNA, 22 nt, Human
uagucuugucucagauuuuauu

SEQ ID NO: 2767465 - RNA, 17 nt, Human
uagucuugucucagauu

SEQ ID NO: 2767466 - RNA, 12 nt, Human
uaguguuggaga

SEQ ID NO: 2767467 - RNA, 16 nt, Human
uaguguuggagaagaa

SEQ ID NO: 2767468 - RNA, 14 nt, Human
acacacugaagaag

SEQ ID NO: 2767469 - RNA, 17 nt, Human
acaaugcuguauuuuaa

SEQ ID NO: 2767470 - RNA, 14 nt, Human
acaaugcuguauuu

SEQ ID NO: 2767471 - RNA, 17 nt, Human
acacaacuauauuguuu

SEQ ID NO: 2767472 - RNA, 14 nt, Human
acacaacuauauug

SEQ ID NO: 2767473 - RNA, 20 nt, Human
acacacucaaaucaagaaac

SEQ ID NO: 2767474 - RNA, 13 nt, Human
acacacugaagaa

SEQ ID NO: 2767475 - RNA, 14 nt, Human
uacuaaaaauacaa

SEQ ID NO: 2767476 - RNA, 18 nt, Human
uacuaaaaauacaaaaaa

SEQ ID NO: 2767477 - RNA, 17 nt, Human
uacugagagugaacaaa

SEQ ID NO: 2767478 - RNA, 18 nt, Human
aauugaggacacugauau

SEQ ID NO: 2767479 - RNA, 18 nt, Human
aauuuacagagacagaaa

SEQ ID NO: 2767480 - RNA, 17 nt, Human
aauuuacagagacagaa

SEQ ID NO: 2767481 - RNA, 19 nt, Human
uacuucuuaggguuaugau

SEQ ID NO: 2767482 - RNA, 16 nt, Human
uacuucaugcugucua

SEQ ID NO: 2767483 - RNA, 20 nt, Human
acaaaguauuaagcauauau

SEQ ID NO: 2767484 - RNA, 17 nt, Human
uagauaggccaugggca

SEQ ID NO: 2767485 - RNA, 22 nt, Human
uagauaggucagugcaaauacu

SEQ ID NO: 2767486 - RNA, 14 nt, Human
uagaucuaguucac

SEQ ID NO: 2767487 - RNA, 20 nt, Human
uagaugcaguucugaagaag

SEQ ID NO: 2767488 - RNA, 21 nt, Human
uagaugcaguucugaagaaga

SEQ ID NO: 2767489 - RNA, 20 nt, Human
uacuuuuuggcauaacauaa

SEQ ID NO: 2767490 - RNA, 19 nt, Human
uacuuuuuggcauaacaua

SEQ ID NO: 2767491 - RNA, 22 nt, Human
uacuuugugcugggguuaucug

SEQ ID NO: 2767492 - RNA, 16 nt, Human
uacuuugugcuggggu

SEQ ID NO: 2767493 - RNA, 14 nt, Human
uacuuuuuggcaua

SEQ ID NO: 2767494 - RNA, 15 nt, Human
aauuuuguuucugua

SEQ ID NO: 2767495 - RNA, 16 nt, Human
aauuuuguuucuguac

SEQ ID NO: 2767496 - RNA, 21 nt, Human
aauuuuucuuauuucauuucu

SEQ ID NO: 2767497 - RNA, 22 nt, Human
aauuuuuucucuaggaaauauu

SEQ ID NO: 2767498 - RNA, 22 nt, Human
acaagcucacagaccuuugaac

SEQ ID NO: 2767499 - RNA, 15 nt, Human
acaacagcuggugcc

SEQ ID NO: 2767500 - RNA, 17 nt, Human
acaaauuuacagagaca

SEQ ID NO: 2767501 - RNA, 18 nt, Human
uagcuagacuggugacug

SEQ ID NO: 2767502 - RNA, 15 nt, Human
uagcuagacugguga

SEQ ID NO: 2767503 - RNA, 16 nt, Human
uagcuacuaauuuuaa

SEQ ID NO: 2767504 - RNA, 18 nt, Human
aauaggcguaacuaauuu

SEQ ID NO: 2767505 - RNA, 14 nt, Human
uaacauaaaucugu

SEQ ID NO: 2767506 - RNA, 20 nt, Human
uaacauaaaucugugaacuu

SEQ ID NO: 2767507 - RNA, 18 nt, Human
uaacauaaaucugugaac

SEQ ID NO: 2767508 - RNA, 17 nt, Human
uaacauaaaucugugaa

SEQ ID NO: 2767509 - RNA, 16 nt, Human
uaacauaaaucuguga

SEQ ID NO: 2767510 - RNA, 15 nt, Human
uaacauaaaucugug

SEQ ID NO: 2767511 - RNA, 12 nt, Human
aauaucacuugu

SEQ ID NO: 2767512 - RNA, 15 nt, Human
aauaucacuugucaa

SEQ ID NO: 2767513 - RNA, 15 nt, Human
aauaugcaaagcacu

SEQ ID NO: 2767514 - RNA, 17 nt, Human
aauaugcaaagcacuga

SEQ ID NO: 2767515 - RNA, 24 nt, Human
aauaugcaaagcacugacuucuaa

SEQ ID NO: 2767516 - RNA, 18 nt, Human
aauauuuuaugauccagc

SEQ ID NO: 2767517 - RNA, 17 nt, Human
aauauuuuaugauccag

SEQ ID NO: 2767518 - RNA, 14 nt, Human
aauauuucagauaa

SEQ ID NO: 2767519 - RNA, 15 nt, Human
aauauuucagauaau

SEQ ID NO: 2767520 - RNA, 19 nt, Human
aauaucuuuuuuuuaauaa

SEQ ID NO: 2767521 - RNA, 21 nt, Human
aauaacaaugaaaguugauaa

SEQ ID NO: 2767522 - RNA, 22 nt, Human
uaaaucugugaacuugaaauuu

SEQ ID NO: 2767523 - RNA, 21 nt, Human
uaaaucugugaacuugaaauu

SEQ ID NO: 2767524 - RNA, 19 nt, Human
uaaaucugugaacuugaaa

SEQ ID NO: 2767525 - RNA, 18 nt, Human
uaaaucugugaacuugaa

SEQ ID NO: 2767526 - RNA, 17 nt, Human
uaaaucugugaacuuga

SEQ ID NO: 2767527 - RNA, 16 nt, Human
uaaaucugugaacuug

SEQ ID NO: 2767528 - RNA, 15 nt, Human
uaaaucugugaacuu

SEQ ID NO: 2767529 - RNA, 18 nt, Human
uaaauagcuagacuggug

SEQ ID NO: 2767530 - RNA, 16 nt, Human
aauaauuuuuauauuu

SEQ ID NO: 2767531 - RNA, 19 nt, Human
aauaauuuuuauauuugaa

SEQ ID NO: 2767532 - RNA, 17 nt, Human
aauaauuuuuauauuug

SEQ ID NO: 2767533 - RNA, 14 nt, Human
uaaauaaauagcua

SEQ ID NO: 2767534 - RNA, 17 nt, Human
uaaauaaauaaauagcu

SEQ ID NO: 2767535 - RNA, 20 nt, Human
aauaauuuuuauauuugaaa

SEQ ID NO: 2767536 - RNA, 23 nt, Human
uacaguauaauuaacauguuaaa

SEQ ID NO: 2767537 - RNA, 19 nt, Human
uacaguauaauuaacaugu

SEQ ID NO: 2767538 - RNA, 18 nt, Human
uacaguauaauuaacaug

SEQ ID NO: 2767539 - RNA, 11 nt, Human
aaugugauaug

SEQ ID NO: 2767540 - RNA, 20 nt, Human
aauggacuguggugacuuug

SEQ ID NO: 2767541 - RNA, 16 nt, Human
aauggacuguggugac

SEQ ID NO: 2767542 - RNA, 19 nt, Human
aauggacuuuuguacauag

SEQ ID NO: 2767543 - RNA, 14 nt, Human
uacaguauaauuaa

SEQ ID NO: 2767544 - RNA, 17 nt, Human
uacaguauaauuaacau

SEQ ID NO: 2767545 - RNA, 16 nt, Human
uacaguauaauuaaca

SEQ ID NO: 2767546 - RNA, 19 nt, Human
uacacuaagagagaaugag

SEQ ID NO: 2767547 - RNA, 18 nt, Human
uacacuaagagagaauga

SEQ ID NO: 2767548 - RNA, 13 nt, Human
uacaaaaacacag

SEQ ID NO: 2767549 - RNA, 14 nt, Human
uacaaaaacacagc

SEQ ID NO: 2767550 - RNA, 15 nt, Human
uacaaaaacacagca

SEQ ID NO: 2767551 - RNA, 15 nt, Human
aaucugugaacuuga

SEQ ID NO: 2767552 - RNA, 13 nt, Human
aaucugugaacuu

SEQ ID NO: 2767553 - RNA, 18 nt, Human
aaucugugaacuugaaau

SEQ ID NO: 2767554 - RNA, 17 nt, Human
aaucugugaacuugaaa

SEQ ID NO: 2767555 - RNA, 19 nt, Human
aaucugugaacuugaaauu

SEQ ID NO: 2767556 - RNA, 14 nt, Human
aaucuuauaauuua

SEQ ID NO: 2767557 - RNA, 16 nt, Human
aaucuuauaauuuaaa

SEQ ID NO: 2767558 - RNA, 13 nt, Human
aauccuugaagau

SEQ ID NO: 2767559 - RNA, 15 nt, Human
aaucaucaagucuuu

SEQ ID NO: 2767560 - RNA, 17 nt, Human
aaucaugaauuaguuuu

SEQ ID NO: 2767561 - RNA, 19 nt, Human
aaucaugaauuaguuuuau

SEQ ID NO: 2767562 - RNA, 23 nt, Human
aaucaugaauuaguuuuauaugc

SEQ ID NO: 2767563 - RNA, 20 nt, Human
aaucuuuaaaaaaaaaauug

SEQ ID NO: 2767564 - RNA, 19 nt, Human
aaucuuuaaaaaaaaaauu

SEQ ID NO: 2767565 - RNA, 16 nt, Human
uaaugauaacuggaaa

SEQ ID NO: 2767566 - RNA, 21 nt, Human
aaugagagacacacugaagaa

SEQ ID NO: 2767567 - RNA, 22 nt, Human
aagaaugguccgugcuaaggac

SEQ ID NO: 2767568 - RNA, 19 nt, Human
aagaaugguccgugcuaag

SEQ ID NO: 2767569 - RNA, 18 nt, Human
aagaaugauuaugaauua

SEQ ID NO: 2767570 - RNA, 16 nt, Human
aagaaugauuaugaau

SEQ ID NO: 2767571 - RNA, 22 nt, Human
aagaagugaaaaucuacacucc

SEQ ID NO: 2767572 - RNA, 16 nt, Human
aagaagugaaaaucua

SEQ ID NO: 2767573 - RNA, 21 nt, Human
gugggacagucaccucaugga

SEQ ID NO: 2767574 - RNA, 19 nt, Human
aagagcuguucacagccag

SEQ ID NO: 2767575 - RNA, 19 nt, Human
guguuguacucaauuuuaa

SEQ ID NO: 2767576 - RNA, 21 nt, Human
gugugaccacugcagaagaca

SEQ ID NO: 2767577 - RNA, 12 nt, Human
guuagaucuagu

SEQ ID NO: 2767578 - RNA, 13 nt, Human
guugacaugggac

SEQ ID NO: 2767579 - RNA, 18 nt, Human
guugacaugggacauuug

SEQ ID NO: 2767580 - RNA, 14 nt, Human
guugacaugggaca

SEQ ID NO: 2767581 - RNA, 23 nt, Human
aagcuuguauuccuuuuucucuc

SEQ ID NO: 2767582 - RNA, 20 nt, Human
guuucuguacuuuuuggcau

SEQ ID NO: 2767583 - RNA, 15 nt, Human
guuucuguacuuuuu

SEQ ID NO: 2767584 - RNA, 23 nt, Human
guuuucugagaaagacuauucaa

SEQ ID NO: 2767585 - RNA, 21 nt, Human
guuucaaacauauauaacaau

SEQ ID NO: 2767586 - RNA, 14 nt, Human
guugccuaaaucca

SEQ ID NO: 2767587 - RNA, 16 nt, Human
guugccuaaauccauu

SEQ ID NO: 2767588 - RNA, 15 nt, Human
guugccuaaauccau

SEQ ID NO: 2767589 - RNA, 10 nt, Human
guuuaaaauc

SEQ ID NO: 2767590 - RNA, 16 nt, Human
guuuaaaaucauuucu

SEQ ID NO: 2767591 - RNA, 18 nt, Human
guuguaccgcaaugugac

SEQ ID NO: 2767592 - RNA, 20 nt, Human
aacccauauuuguacaccaa

SEQ ID NO: 2767593 - RNA, 21 nt, Human
aaccaugggauaaaugccauc

SEQ ID NO: 2767594 - RNA, 13 nt, Human
aacccaaauguuc

SEQ ID NO: 2767595 - RNA, 18 nt, Human
aacccaaauguucaucaa

SEQ ID NO: 2767596 - RNA, 20 nt, Human
aaccuagggugauauuaacc

SEQ ID NO: 2767597 - RNA, 20 nt, Human
aaccaugggauaaaugccau

SEQ ID NO: 2767598 - RNA, 18 nt, Human
aaccaugggauaaaugcc

SEQ ID NO: 2767599 - RNA, 17 nt, Human
aaccaugggauaaaugc

SEQ ID NO: 2767600 - RNA, 15 nt, Human
aaccaugggauaaau

SEQ ID NO: 2767601 - RNA, 12 nt, Human
aaccacagcagu

SEQ ID NO: 2767602 - RNA, 22 nt, Human
gucuuaauuaaaagaauauuuu

SEQ ID NO: 2767603 - RNA, 19 nt, Human
gucuuaauuaaaagaauau

SEQ ID NO: 2767604 - RNA, 21 nt, Human
gucuuaauuaaaagaauauuu

SEQ ID NO: 2767605 - RNA, 15 nt, Human
gugaacacaucagcu

SEQ ID NO: 2767606 - RNA, 18 nt, Human
aacucguuaauuuguagu

SEQ ID NO: 2767607 - RNA, 14 nt, Human
aacucccuuucaac

SEQ ID NO: 2767608 - RNA, 13 nt, Human
aacucccuuucaa

SEQ ID NO: 2767609 - RNA, 21 nt, Human
aacuccagaaagugacaagcu

SEQ ID NO: 2767610 - RNA, 14 nt, Human
aacuccagaaagug

SEQ ID NO: 2767611 - RNA, 24 nt, Human
guccaagcauaccaacacgagcag

SEQ ID NO: 2767612 - RNA, 21 nt, Human
guccaagcauuuagauguaua

SEQ ID NO: 2767613 - RNA, 15 nt, Human
aacaaggaugaauua

SEQ ID NO: 2767614 - RNA, 21 nt, Human
aacaagccuccuuuuaaagua

SEQ ID NO: 2767615 - RNA, 22 nt, Human
aacaguagugauaguuguaccg

SEQ ID NO: 2767616 - RNA, 18 nt, Human
aacauuugguaaggggaa

SEQ ID NO: 2767617 - RNA, 18 nt, Human
aaauggcuuccuggcaau

SEQ ID NO: 2767618 - RNA, 19 nt, Human
aaauggcuuccuggcaaua

SEQ ID NO: 2767619 - RNA, 14 nt, Human
aaaugcauuucuaa

SEQ ID NO: 2767620 - RNA, 22 nt, Human
aaaugaaagcagggacuugaac

SEQ ID NO: 2767621 - RNA, 21 nt, Human
aaaugaaagcagggacuugaa

SEQ ID NO: 2767622 - RNA, 18 nt, Human
aaauccauacauuugugu

SEQ ID NO: 2767623 - RNA, 14 nt, Human
aaauccauuuggaa

SEQ ID NO: 2767624 - RNA, 16 nt, Human
aaauccauuuggaaau

SEQ ID NO: 2767625 - RNA, 15 nt, Human
aaauccauuuggaaa

SEQ ID NO: 2767626 - RNA, 22 nt, Human
aaaucccauuauucaaaguugc

SEQ ID NO: 2767627 - RNA, 21 nt, Human
aaaucccauuauucaaaguug

SEQ ID NO: 2767628 - RNA, 20 nt, Human
aaaucccauuauucaaaguu

SEQ ID NO: 2767629 - RNA, 19 nt, Human
aaaucccauuauucaaagu

SEQ ID NO: 2767630 - RNA, 17 nt, Human
aaaucccauuauucaaa

SEQ ID NO: 2767631 - RNA, 16 nt, Human
aaaucccauuauucaa

SEQ ID NO: 2767632 - RNA, 15 nt, Human
aaaucccauuauuca

SEQ ID NO: 2767633 - RNA, 13 nt, Human
aaaucccauuauu

SEQ ID NO: 2767634 - RNA, 23 nt, Human
aaauccauuuggaaaucuuuaaa

SEQ ID NO: 2767635 - RNA, 22 nt, Human
aaauccauuuggaaaucuuuaa

SEQ ID NO: 2767636 - RNA, 21 nt, Human
aaauccauuuggaaaucuuua

SEQ ID NO: 2767637 - RNA, 18 nt, Human
aaauccauuuggaaaucu

SEQ ID NO: 2767638 - RNA, 14 nt, Human
aaauccuugaagau

SEQ ID NO: 2767639 - RNA, 19 nt, Human
aaaucuacacuccagugag

SEQ ID NO: 2767640 - RNA, 13 nt, Human
guaugugugaagu

SEQ ID NO: 2767641 - RNA, 17 nt, Human
guaugugugaagugagu

SEQ ID NO: 2767642 - RNA, 14 nt, Human
guaugauucccagc

SEQ ID NO: 2767643 - RNA, 22 nt, Human
aaauguaagggaaacugccagc

SEQ ID NO: 2767644 - RNA, 17 nt, Human
aaauuucagcagcugca

SEQ ID NO: 2767645 - RNA, 18 nt, Human
aaauuucagcagcugcag

SEQ ID NO: 2767646 - RNA, 14 nt, Human
ccaguauuguacaa

SEQ ID NO: 2767647 - RNA, 15 nt, Human
ccaggggccaugaau

SEQ ID NO: 2767648 - RNA, 19 nt, Human
ccacuuggucugugagaug

SEQ ID NO: 2767649 - RNA, 17 nt, Human
ccacuuggucugugaga

SEQ ID NO: 2767650 - RNA, 16 nt, Human
ccacuuggucugugag

SEQ ID NO: 2767651 - RNA, 15 nt, Human
ccacuuggucuguga

SEQ ID NO: 2767652 - RNA, 22 nt, Human
ccacuuggucugugagaugcua

SEQ ID NO: 2767653 - RNA, 20 nt, Human
ccacuuggucugugagaugc

SEQ ID NO: 2767654 - RNA, 12 nt, Human
ccacuuggucug

SEQ ID NO: 2767655 - RNA, 13 nt, Human
ccauuuaaagcuu

SEQ ID NO: 2767656 - RNA, 22 nt, Human
ccauuguggucacaggaaguag

SEQ ID NO: 2767657 - RNA, 19 nt, Human
ccaugggauaaaugccauc

SEQ ID NO: 2767658 - RNA, 17 nt, Human
ccaugggauaaaugcca

SEQ ID NO: 2767659 - RNA, 18 nt, Human
ccaugggcacugugggua

SEQ ID NO: 2767660 - RNA, 15 nt, Human
ccccauuguggucac

SEQ ID NO: 2767661 - RNA, 22 nt, Human
ccucuccugggcagcugccucc

SEQ ID NO: 2767662 - RNA, 21 nt, Human
ccucuccugggcagcugccuc

SEQ ID NO: 2767663 - RNA, 16 nt, Human
ccucuccugggcagcu

SEQ ID NO: 2767664 - RNA, 15 nt, Human
ccucuccugggcagc

SEQ ID NO: 2767665 - RNA, 14 nt, Human
ccucuccugggcag

SEQ ID NO: 2767666 - RNA, 20 nt, Human
ccucuccugggcagcugccu

SEQ ID NO: 2767667 - RNA, 19 nt, Human
ccucuccugggcagcugcc

SEQ ID NO: 2767668 - RNA, 18 nt, Human
ccucuccugggcagcugc

SEQ ID NO: 2767669 - RNA, 17 nt, Human
ccucuccugggcagcug

SEQ ID NO: 2767670 - RNA, 13 nt, Human
cccucggagaaga

SEQ ID NO: 2767671 - RNA, 14 nt, Human
cccugagcaggauu

SEQ ID NO: 2767672 - RNA, 12 nt, Human
ccuaaggacuuc

SEQ ID NO: 2767673 - RNA, 11 nt, Human
ccuaaggacuu

SEQ ID NO: 2767674 - RNA, 23 nt, Human
ccuaaggacuucuuuaauuuugg

SEQ ID NO: 2767675 - RNA, 18 nt, Human
ccuaaggacuucuuuaau

SEQ ID NO: 2767676 - RNA, 17 nt, Human
ccuaaggacuucuuuaa

SEQ ID NO: 2767677 - RNA, 16 nt, Human
ccuaaggacuucuuua

SEQ ID NO: 2767678 - RNA, 20 nt, Human
ccuaacgaaguauccuucag

SEQ ID NO: 2767679 - RNA, 15 nt, Human
cucuccccaugaugu

SEQ ID NO: 2767680 - RNA, 16 nt, Human
cucuccccaugauguu

SEQ ID NO: 2767681 - RNA, 19 nt, Human
cucuauguucuaagaagug

SEQ ID NO: 2767682 - RNA, 13 nt, Human
cucucuggccuuc

SEQ ID NO: 2767683 - RNA, 16 nt, Human
cucucuggccuucggc

SEQ ID NO: 2767684 - RNA, 14 nt, Human
cucucuggccuucg

SEQ ID NO: 2767685 - RNA, 22 nt, Human
cuccucugcuugccaucccucc

SEQ ID NO: 2767686 - RNA, 22 nt, Human
cucccuccaccucccugcaaua

SEQ ID NO: 2767687 - RNA, 21 nt, Human
cucccuccaccucccugcaau

SEQ ID NO: 2767688 - RNA, 20 nt, Human
cucccuccaccucccugcaa

SEQ ID NO: 2767689 - RNA, 19 nt, Human
cucccuccaccucccugca

SEQ ID NO: 2767690 - RNA, 16 nt, Human
cucaguccaugaagau

SEQ ID NO: 2767691 - RNA, 23 nt, Human
cuaugucauuugcuggagcucug

SEQ ID NO: 2767692 - RNA, 18 nt, Human
cuaucucauuuccaagca

SEQ ID NO: 2767693 - RNA, 18 nt, Human
cuauguucuaagaaguga

SEQ ID NO: 2767694 - RNA, 17 nt, Human
ccuucucuucacaguca

SEQ ID NO: 2767695 - RNA, 20 nt, Human
cuaacgaaguauccuucagc

SEQ ID NO: 2767696 - RNA, 20 nt, Human
cuacaaaaacacagcaaggg

SEQ ID NO: 2767697 - RNA, 12 nt, Human
ccuuuucccaac

SEQ ID NO: 2767698 - RNA, 12 nt, Human
auuauguaaauc

SEQ ID NO: 2767699 - RNA, 14 nt, Human
auuauguaaauccc

SEQ ID NO: 2767700 - RNA, 13 nt, Human
auuauguaaaucc

SEQ ID NO: 2767701 - RNA, 23 nt, Human
auuauguaaaucccauuauucaa

SEQ ID NO: 2767702 - RNA, 22 nt, Human
auuauguaaaucccauuauuca

SEQ ID NO: 2767703 - RNA, 17 nt, Human
auuauguaaaucccauu

SEQ ID NO: 2767704 - RNA, 15 nt, Human
auuauguaaauccca

SEQ ID NO: 2767705 - RNA, 22 nt, Human
auugaggacacugauauggguc

SEQ ID NO: 2767706 - RNA, 18 nt, Human
auuuaauaauuauaugcu

SEQ ID NO: 2767707 - RNA, 15 nt, Human
auuuaauaauuauau

SEQ ID NO: 2767708 - RNA, 13 nt, Human
auuuaauaauuau

SEQ ID NO: 2767709 - RNA, 16 nt, Human
auuucagcagcugcag

SEQ ID NO: 2767710 - RNA, 18 nt, Human
auuuuuuuguuguuuguu

SEQ ID NO: 2767711 - RNA, 16 nt, Human
auuuuuauauuugaaa

SEQ ID NO: 2767712 - RNA, 19 nt, Human
auuuuuauauuugaaauau

SEQ ID NO: 2767713 - RNA, 17 nt, Human
caaacauauauaacaau

SEQ ID NO: 2767714 - RNA, 21 nt, Human
caaaagguauuuuaaucacca

SEQ ID NO: 2767715 - RNA, 19 nt, Human
auuuucuauaauuuaaaua

SEQ ID NO: 2767716 - RNA, 17 nt, Human
auuuucuauaauuuaaa

SEQ ID NO: 2767717 - RNA, 18 nt, Human
auuuucuauaauuuaaau

SEQ ID NO: 2767718 - RNA, 13 nt, Human
cacaucagcuugc

SEQ ID NO: 2767719 - RNA, 23 nt, Human
cacaucagcuugcccuguuaaaa

SEQ ID NO: 2767720 - RNA, 23 nt, Human
cacugaagaagcaccaaucauga

SEQ ID NO: 2767721 - RNA, 11 nt, Human
cacugaagaag

SEQ ID NO: 2767722 - RNA, 21 nt, Human
cacuccagugagacagcucug

SEQ ID NO: 2767723 - RNA, 16 nt, Human
cacuccagugagacag

SEQ ID NO: 2767724 - RNA, 14 nt, Human
caagcaaguauuag

SEQ ID NO: 2767725 - RNA, 12 nt, Human
caacuccagaaa

SEQ ID NO: 2767726 - RNA, 19 nt, Human
caacuaucucauuuccaag

SEQ ID NO: 2767727 - RNA, 19 nt, Human
caacuauauuguuugcuaa

SEQ ID NO: 2767728 - RNA, 17 nt, Human
caaucagccuaguugau

SEQ ID NO: 2767729 - RNA, 21 nt, Human
caauauuucagauaaucacaa

SEQ ID NO: 2767730 - RNA, 19 nt, Human
cagcuguaugauucccagc

SEQ ID NO: 2767731 - RNA, 20 nt, Human
cagcugccuccccuccucug

SEQ ID NO: 2767732 - RNA, 19 nt, Human
cagcugccuccccuccucu

SEQ ID NO: 2767733 - RNA, 18 nt, Human
cagcugccuccccuccuc

SEQ ID NO: 2767734 - RNA, 17 nt, Human
cagcugccuccccuccu

SEQ ID NO: 2767735 - RNA, 16 nt, Human
cagcugccuccccucc

SEQ ID NO: 2767736 - RNA, 15 nt, Human
cagcugccuccccuc

SEQ ID NO: 2767737 - RNA, 14 nt, Human
cagcugccuccccu

SEQ ID NO: 2767738 - RNA, 9 nt, Human
cagcugccu

SEQ ID NO: 2767739 - RNA, 10 nt, Human
cagcugccuc

SEQ ID NO: 2767740 - RNA, 11 nt, Human
cagcugccucc

SEQ ID NO: 2767741 - RNA, 20 nt, Human
cagcuuauugucuagugaaa

SEQ ID NO: 2767742 - RNA, 17 nt, Human
cagcuuauucacaagac

SEQ ID NO: 2767743 - RNA, 20 nt, Human
cagcuguaugauucccagcc

SEQ ID NO: 2767744 - RNA, 14 nt, Human
cagcuuauugucua

SEQ ID NO: 2767745 - RNA, 16 nt, Human
caggaaagagaacuuc

SEQ ID NO: 2767746 - RNA, 11 nt, Human
caggcuacugu

SEQ ID NO: 2767747 - RNA, 14 nt, Human
cagauacuggauug

SEQ ID NO: 2767748 - RNA, 13 nt, Human
cagauacuggauu

SEQ ID NO: 2767749 - RNA, 18 nt, Human
cagauacuggauuguacu

SEQ ID NO: 2767750 - RNA, 17 nt, Human
cagagcugcccucuccu

SEQ ID NO: 2767751 - RNA, 23 nt, Human
cagagcugcccucuccugggcag

SEQ ID NO: 2767752 - RNA, 21 nt, Human
cagagcugcccucuccugggc

SEQ ID NO: 2767753 - RNA, 20 nt, Human
cagagcugcccucuccuggg

SEQ ID NO: 2767754 - RNA, 19 nt, Human
cagagcugcccucuccugg

SEQ ID NO: 2767755 - RNA, 18 nt, Human
cagagcugcccucuccug

SEQ ID NO: 2767756 - RNA, 14 nt, Human
cagccagacuggca

SEQ ID NO: 2767757 - RNA, 15 nt, Human
cagccagacuggcac

SEQ ID NO: 2767758 - RNA, 18 nt, Human
cagccagacuggcacagu

SEQ ID NO: 2767759 - RNA, 23 nt, Human
cagccagcaguucagagcugccc

SEQ ID NO: 2767760 - RNA, 22 nt, Human
cagccagcaguucagagcugcc

SEQ ID NO: 2767761 - RNA, 22 nt, Human
cagacuggcacaguuuucugag

SEQ ID NO: 2767762 - RNA, 23 nt, Human
cagacuggcacaguuuucugaga

SEQ ID NO: 2767763 - RNA, 17 nt, Human
cagacuggcacaguuuu

SEQ ID NO: 2767764 - RNA, 18 nt, Human
cagacuggcacaguuuuc

SEQ ID NO: 2767765 - RNA, 22 nt, Human
caguucagagcugcccucuccu

SEQ ID NO: 2767766 - RNA, 21 nt, Human
caguucagagcugcccucucc

SEQ ID NO: 2767767 - RNA, 19 nt, Human
caguucagagcugcccucu

SEQ ID NO: 2767768 - RNA, 18 nt, Human
caguucagagcugcccuc

SEQ ID NO: 2767769 - RNA, 24 nt, Human
caguucagagcugcccucuccugg

SEQ ID NO: 2767770 - RNA, 23 nt, Human
caguucagagcugcccucuccug

SEQ ID NO: 2767771 - RNA, 22 nt, Human
caguuauuauauuuacaaaugg

SEQ ID NO: 2767772 - RNA, 17 nt, Human
caguucagagcugcccu

SEQ ID NO: 2767773 - RNA, 16 nt, Human
caguucagagcugccc

SEQ ID NO: 2767774 - RNA, 15 nt, Human
caguucagagcugcc

SEQ ID NO: 2767775 - RNA, 22 nt, Human
cagugauuaccagggacugagg

SEQ ID NO: 2767776 - RNA, 13 nt, Human
caguuauggcuau

SEQ ID NO: 2767777 - RNA, 19 nt, Human
caguuauggcuauaggugc

SEQ ID NO: 2767778 - RNA, 20 nt, Human
caguuauggcuauaggugcu

SEQ ID NO: 2767779 - RNA, 17 nt, Human
caguuauuauauuuaca

SEQ ID NO: 2767780 - RNA, 21 nt, Human
caguuauuauauuuacaaaug

SEQ ID NO: 2767781 - RNA, 16 nt, Human
cauagguuuaauaauu

SEQ ID NO: 2767782 - RNA, 19 nt, Human
cauagcagcuuauucacaa

SEQ ID NO: 2767783 - RNA, 19 nt, Human
cauccugaggcuccacuug

SEQ ID NO: 2767784 - RNA, 18 nt, Human
cauccugaggcuccacuu

SEQ ID NO: 2767785 - RNA, 15 nt, Human
cauuauucaaaguug

SEQ ID NO: 2767786 - RNA, 14 nt, Human
cauuauucaaaguu

SEQ ID NO: 2767787 - RNA, 19 nt, Human
cauuauauuuauuacugua

SEQ ID NO: 2767788 - RNA, 21 nt, Human
ccaacuccagaaagugacaag

SEQ ID NO: 2767789 - RNA, 17 nt, Human
cauugguguuguacuca

SEQ ID NO: 2767790 - RNA, 16 nt, Human
cauuuguauaaaauaa

SEQ ID NO: 2767791 - RNA, 14 nt, Human
cauuuguauaaaau

SEQ ID NO: 2767792 - RNA, 14 nt, Human
ccaaaaggcagaag

SEQ ID NO: 2767793 - RNA, 20 nt, Human
cugcacggugaauggcuuug

SEQ ID NO: 2767794 - RNA, 17 nt, Human
cugcacggugaauggcu

SEQ ID NO: 2767795 - RNA, 15 nt, Human
cugcacggugaaugg

SEQ ID NO: 2767796 - RNA, 14 nt, Human
cugcacggugaaug

SEQ ID NO: 2767797 - RNA, 16 nt, Human
cugcacuccagccuga

SEQ ID NO: 2767798 - RNA, 20 nt, Human
cugcacuccagccugagcga

SEQ ID NO: 2767799 - RNA, 17 nt, Human
cugcacuccagccugag

SEQ ID NO: 2767800 - RNA, 15 nt, Human
cugggcagcugccuc

SEQ ID NO: 2767801 - RNA, 14 nt, Human
cugggcagcugccu

SEQ ID NO: 2767802 - RNA, 13 nt, Human
cugggcagcugcc

SEQ ID NO: 2767803 - RNA, 12 nt, Human
cuggugccucac

SEQ ID NO: 2767804 - RNA, 21 nt, Human
cuggugccucaccccuugcca

SEQ ID NO: 2767805 - RNA, 13 nt, Human
cuuaaaguugaau

SEQ ID NO: 2767806 - RNA, 11 nt, Human
cuuaaaguuga

SEQ ID NO: 2767807 - RNA, 11 nt, Human
cuucagacaua

SEQ ID NO: 2767808 - RNA, 23 nt, Human
cuucaugcugucuacacuaagag

SEQ ID NO: 2767809 - RNA, 20 nt, Human
cuucuguuuuauaauuuugu

SEQ ID NO: 2767810 - RNA, 15 nt, Human
cuucuguuuuauaau

SEQ ID NO: 2767811 - RNA, 16 nt, Human
cuuuaauuuuggaauu

SEQ ID NO: 2767812 - RNA, 13 nt, Human
cuuuaauuuugga

SEQ ID NO: 2767813 - RNA, 15 nt, Human
cuuuaauuuuggaau

SEQ ID NO: 2767814 - RNA, 14 nt, Human
cuuuaauuuuggaa

SEQ ID NO: 2767815 - RNA, 20 nt, Human
cuuuaaagggauggcaagau

SEQ ID NO: 2767816 - RNA, 21 nt, Human
cuuugagugucuuaauuaaaa

SEQ ID NO: 2767817 - RNA, 21 nt, Human
gacagaaagcagaacagugau

SEQ ID NO: 2767818 - RNA, 14 nt, Human
gacacacugaagaa

SEQ ID NO: 2767819 - RNA, 16 nt, Human
gacacacugaagaagc

SEQ ID NO: 2767820 - RNA, 15 nt, Human
gacacacugaagaag

SEQ ID NO: 2767821 - RNA, 21 nt, Human
gacagugagacucugucucag

SEQ ID NO: 2767822 - RNA, 17 nt, Human
gacauuugcucauggaa

SEQ ID NO: 2767823 - RNA, 16 nt, Human
gacauuugcucaugga

SEQ ID NO: 2767824 - RNA, 14 nt, Human
gacuguggugacuu

SEQ ID NO: 2767825 - RNA, 13 nt, Human
gacuguggugacu

SEQ ID NO: 2767826 - RNA, 21 nt, Human
gacucuuaagaagacugcauu

SEQ ID NO: 2767827 - RNA, 18 nt, Human
gacucuuaagaagacugc

SEQ ID NO: 2767828 - RNA, 14 nt, Human
gacucuuaagaaga

SEQ ID NO: 2767829 - RNA, 15 nt, Human
gacgcucucuggccu

SEQ ID NO: 2767830 - RNA, 17 nt, Human
gacgcucucuggccuuc

SEQ ID NO: 2767831 - RNA, 16 nt, Human
gacgcucucuggccuu

SEQ ID NO: 2767832 - RNA, 13 nt, Human
gaacugaaaucau

SEQ ID NO: 2767833 - RNA, 14 nt, Human
gaacugaaaucaua

SEQ ID NO: 2767834 - RNA, 19 nt, Human
gaacccgggaggcagaggu

SEQ ID NO: 2767835 - RNA, 23 nt, Human
gaagcaacccaaauguucaucaa

SEQ ID NO: 2767836 - RNA, 14 nt, Human
gaagcaaaauuuuu

SEQ ID NO: 2767837 - RNA, 23 nt, Human
gcacaguuuucugagaaagacua

SEQ ID NO: 2767838 - RNA, 20 nt, Human
gcacaguuuucugagaaaga

SEQ ID NO: 2767839 - RNA, 22 nt, Human
gcacaguuuucugagaaagacu

SEQ ID NO: 2767840 - RNA, 22 nt, Human
gcaauagucaaauugugugaaa

SEQ ID NO: 2767841 - RNA, 20 nt, Human
gcaaguauuagaauaccaca

SEQ ID NO: 2767842 - RNA, 21 nt, Human
gauuuuuuuguuguuuguuua

SEQ ID NO: 2767843 - RNA, 18 nt, Human
gauuuuuuuguuguuugu

SEQ ID NO: 2767844 - RNA, 22 nt, Human
gaugguucccuugaugaagaag

SEQ ID NO: 2767845 - RNA, 18 nt, Human
gauguagaggagaaacug

SEQ ID NO: 2767846 - RNA, 17 nt, Human
gauguagaggagaaacu

SEQ ID NO: 2767847 - RNA, 16 nt, Human
gaugaucuuuaaaaua

SEQ ID NO: 2767848 - RNA, 17 nt, Human
gaucugccuaaggacuu

SEQ ID NO: 2767849 - RNA, 23 nt, Human
gaucugccuaaggacuucuuuaa

SEQ ID NO: 2767850 - RNA, 21 nt, Human
gaucugccuaaggacuucuuu

SEQ ID NO: 2767851 - RNA, 20 nt, Human
gaucugccuaaggacuucuu

SEQ ID NO: 2767852 - RNA, 18 nt, Human
gaucugccuaaggacuuc

SEQ ID NO: 2767853 - RNA, 16 nt, Human
gauuuaccacuugugu

SEQ ID NO: 2767854 - RNA, 23 nt, Human
gauucuucagcaaaaauauuuua

SEQ ID NO: 2767855 - RNA, 15 nt, Human
gauuuaccacuugug

SEQ ID NO: 2767856 - RNA, 22 nt, Human
gauuauucacugauuugacaua

SEQ ID NO: 2767857 - RNA, 21 nt, Human
gauuauucacugauuugacau

SEQ ID NO: 2767858 - RNA, 15 nt, Human
gaggacgcucucugg

SEQ ID NO: 2767859 - RNA, 18 nt, Human
gaggcuccacuuggucug

SEQ ID NO: 2767860 - RNA, 19 nt, Human
gaggcuccacuuggucugu

SEQ ID NO: 2767861 - RNA, 23 nt, Human
gaggcuccacuuggucugugaga

SEQ ID NO: 2767862 - RNA, 21 nt, Human
gagugaguuggguguauugug

SEQ ID NO: 2767863 - RNA, 14 nt, Human
gcccuguuaaaaga

SEQ ID NO: 2767864 - RNA, 17 nt, Human
gcccuguuaaaagauga

SEQ ID NO: 2767865 - RNA, 13 nt, Human
gcccuguuaaaag

SEQ ID NO: 2767866 - RNA, 16 nt, Human
gcccccaggugccagu

SEQ ID NO: 2767867 - RNA, 16 nt, Human
gccauaugaaaaggcu

SEQ ID NO: 2767868 - RNA, 23 nt, Human
gccagcaguucagagcugcccuc

SEQ ID NO: 2767869 - RNA, 22 nt, Human
gccagcaguucagagcugcccu

SEQ ID NO: 2767870 - RNA, 19 nt, Human
gccagauuuuccugaaaac

SEQ ID NO: 2767871 - RNA, 22 nt, Human
gccagacaucaacagauaaaua

SEQ ID NO: 2767872 - RNA, 15 nt, Human
gcuccccucggagaa

SEQ ID NO: 2767873 - RNA, 21 nt, Human
gcuaguaauuggaaaggcagc

SEQ ID NO: 2767874 - RNA, 16 nt, Human
gcuaguaucaaaagaa

SEQ ID NO: 2767875 - RNA, 17 nt, Human
gcuggagcucugcccau

SEQ ID NO: 2767876 - RNA, 14 nt, Human
gcuggagcucugcc

SEQ ID NO: 2767877 - RNA, 20 nt, Human
gcugccuccccuccucugcu

SEQ ID NO: 2767878 - RNA, 17 nt, Human
gcugccuccccuccucu

SEQ ID NO: 2767879 - RNA, 16 nt, Human
gcugccuccccuccuc

SEQ ID NO: 2767880 - RNA, 14 nt, Human
gcugccuccccucc

SEQ ID NO: 2767881 - RNA, 22 nt, Human
gcugccuccccuccucugcuug

SEQ ID NO: 2767882 - RNA, 21 nt, Human
gcugccuccccuccucugcuu

SEQ ID NO: 2767883 - RNA, 19 nt, Human
ggaggcugagaugggagaa

SEQ ID NO: 2767884 - RNA, 15 nt, Human
ggaggcugagauggg

SEQ ID NO: 2767885 - RNA, 23 nt, Human
ggaugguucccuugaugaagaag

SEQ ID NO: 2767886 - RNA, 22 nt, Human
ggaugguucccuugaugaagaa

SEQ ID NO: 2767887 - RNA, 22 nt, Human
ggauguugaaaaaguucugcag

SEQ ID NO: 2767888 - RNA, 16 nt, Human
ggccuccauccugagg

SEQ ID NO: 2767889 - RNA, 20 nt, Human
aaagaggcagcuugaaacug

SEQ ID NO: 2767890 - RNA, 18 nt, Human
aaagagaacuuccagauc

SEQ ID NO: 2767891 - RNA, 22 nt, Human
aaagacuauucaaacagucuca

SEQ ID NO: 2767892 - RNA, 13 nt, Human
aaagacuccaaag

SEQ ID NO: 2767893 - RNA, 23 nt, Human
aaagacuauucaaacagucucag

SEQ ID NO: 2767894 - RNA, 15 nt, Human
aaacuuguguaaaua

SEQ ID NO: 2767895 - RNA, 17 nt, Human
aaacuuguguaaauaca

SEQ ID NO: 2767896 - RNA, 12 nt, Human
aaacuuuucuga

SEQ ID NO: 2767897 - RNA, 14 nt, Human
aaacuuuucugaua

SEQ ID NO: 2767898 - RNA, 13 nt, Human
aaacuuuucugau

SEQ ID NO: 2767899 - RNA, 17 nt, Human
aaacuuuucugauagag

SEQ ID NO: 2767900 - RNA, 16 nt, Human
aaacuuuucugauaga

SEQ ID NO: 2767901 - RNA, 16 nt, Human
aaagaaugauuaugaa

SEQ ID NO: 2767902 - RNA, 13 nt, Human
aaagcuuauuaaa

SEQ ID NO: 2767903 - RNA, 13 nt, Human
aaaggaauuuaaa

SEQ ID NO: 2767904 - RNA, 15 nt, Human
ggugccaguuauggc

SEQ ID NO: 2767905 - RNA, 24 nt, Human
ggucugugagaugcuagaacuccc

SEQ ID NO: 2767906 - RNA, 14 nt, Human
ggucugugagaugc

SEQ ID NO: 2767907 - RNA, 18 nt, Human
aaacggaugauuucuaug

SEQ ID NO: 2767908 - RNA, 16 nt, Human
aaacggaugauuucua

SEQ ID NO: 2767909 - RNA, 16 nt, Human
aaaccacagcaguuga

SEQ ID NO: 2767910 - RNA, 15 nt, Human
aaaccacagcaguug

SEQ ID NO: 2767911 - RNA, 23 nt, Human
aaaauuggggauucuuaaaguug

SEQ ID NO: 2767912 - RNA, 21 nt, Human
aaaauuggggauucuuaaagu

SEQ ID NO: 2767913 - RNA, 22 nt, Human
aaaauggacuguggugacuuug

SEQ ID NO: 2767914 - RNA, 19 nt, Human
aaaauuuuuucucuaggaa

SEQ ID NO: 2767915 - RNA, 17 nt, Human
aaacaaggaugaauuaa

SEQ ID NO: 2767916 - RNA, 14 nt, Human
aaacacaacuauau

SEQ ID NO: 2767917 - RNA, 13 nt, Human
aaacauauauaac

SEQ ID NO: 2767918 - RNA, 19 nt, Human
aaacauauauaacaaugcu

SEQ ID NO: 2767919 - RNA, 16 nt, Human
aaacauauauaacaau

SEQ ID NO: 2767920 - RNA, 21 nt, Human
aaacauauauaacaaugcugu

SEQ ID NO: 2767921 - RNA, 23 nt, Human
aaaauaauuuuuauauuugaaau

SEQ ID NO: 2767922 - RNA, 21 nt, Human
aaaauaauuuuuauauuugaa

SEQ ID NO: 2767923 - RNA, 20 nt, Human
aaaauaauuuuuauauuuga

SEQ ID NO: 2767924 - RNA, 15 nt, Human
gggauucuuaaaguu

SEQ ID NO: 2767925 - RNA, 20 nt, Human
gggauucuuaaaguugaauu

SEQ ID NO: 2767926 - RNA, 23 nt, Human
gggcagcugccuccccuccucug

SEQ ID NO: 2767927 - RNA, 20 nt, Human
gggcagcugccuccccuccu

SEQ ID NO: 2767928 - RNA, 19 nt, Human
gggcagcugccuccccucc

SEQ ID NO: 2767929 - RNA, 14 nt, Human
gggcagcugccucc

SEQ ID NO: 2767930 - RNA, 13 nt, Human
gggcagcugccuc

SEQ ID NO: 2767931 - RNA, 12 nt, Human
gggcagcugccu

SEQ ID NO: 2767932 - RNA, 20 nt, Human
gggaggcagagguugcagug

SEQ ID NO: 2767933 - RNA, 11 nt, Human
gggaggcagag

SEQ ID NO: 2767934 - RNA, 22 nt, Human
aaaagcuccauuuuuagugaaa

SEQ ID NO: 2767935 - RNA, 21 nt, Human
aaaacuuuaugcuaagugaaa

SEQ ID NO: 2767936 - RNA, 14 nt, Human
agccagcaguucag

SEQ ID NO: 2767937 - RNA, 17 nt, Human
agcacugacuucuaagu

SEQ ID NO: 2767938 - RNA, 19 nt, Human
agcacugacuucuaaguaa

SEQ ID NO: 2767939 - RNA, 20 nt, Human
agauagauaggucagugcaa

SEQ ID NO: 2767940 - RNA, 18 nt, Human
agaucugccuaaggacuu

SEQ ID NO: 2767941 - RNA, 13 nt, Human
agaucugccuaag

SEQ ID NO: 2767942 - RNA, 18 nt, Human
agaagacugcauuauauu

SEQ ID NO: 2767943 - RNA, 21 nt, Human
agaagacugcauuauauuuau

SEQ ID NO: 2767944 - RNA, 20 nt, Human
agaagagcuguucacagcca

SEQ ID NO: 2767945 - RNA, 13 nt, Human
agaagauagcagg

SEQ ID NO: 2767946 - RNA, 13 nt, Human
agaagagcuguuc

SEQ ID NO: 2767947 - RNA, 22 nt, Human
agaacagugauuaccagggacu

SEQ ID NO: 2767948 - RNA, 19 nt, Human
agacaaggaaaaaauaaca

SEQ ID NO: 2767949 - RNA, 18 nt, Human
aggaaaaaauaacaauga

SEQ ID NO: 2767950 - RNA, 18 nt, Human
agcuguaugauucccagc

SEQ ID NO: 2767951 - RNA, 17 nt, Human
agcuguaugauucccag

SEQ ID NO: 2767952 - RNA, 14 nt, Human
agcuggugcccugc

SEQ ID NO: 2767953 - RNA, 14 nt, Human
agcuguaugauucc

SEQ ID NO: 2767954 - RNA, 14 nt, Human
agcugcugaaacaa

SEQ ID NO: 2767955 - RNA, 15 nt, Human
agcugcugaaacaac

SEQ ID NO: 2767956 - RNA, 16 nt, Human
agcugcugaaacaaca

SEQ ID NO: 2767957 - RNA, 20 nt, Human
agcugcugaaacaacaaaua

SEQ ID NO: 2767958 - RNA, 15 nt, Human
agcgacagugagacu

SEQ ID NO: 2767959 - RNA, 13 nt, Human
agcgacagugaga

SEQ ID NO: 2767960 - RNA, 12 nt, Human
agcuacaaaugc

SEQ ID NO: 2767961 - RNA, 13 nt, Human
agcuacaaaugca

SEQ ID NO: 2767962 - RNA, 20 nt, Human
aggcagagguugcagugagc

SEQ ID NO: 2767963 - RNA, 23 nt, Human
aggccaugggcacuguggguaga

SEQ ID NO: 2767964 - RNA, 17 nt, Human
agggacaggauaagagg

SEQ ID NO: 2767965 - RNA, 20 nt, Human
agggauuagggagagaagau

SEQ ID NO: 2767966 - RNA, 18 nt, Human
augaaacuuguguaaaua

SEQ ID NO: 2767967 - RNA, 20 nt, Human
augggacauuugcucaugga

SEQ ID NO: 2767968 - RNA, 15 nt, Human
augggacagggagga

SEQ ID NO: 2767969 - RNA, 14 nt, Human
augggaaagcauug

SEQ ID NO: 2767970 - RNA, 20 nt, Human
augggaaagcauuguaaaug

SEQ ID NO: 2767971 - RNA, 16 nt, Human
auggcuuuguauagaa

SEQ ID NO: 2767972 - RNA, 15 nt, Human
auggcuuuguauaga

SEQ ID NO: 2767973 - RNA, 23 nt, Human
auggcuuccuggcaauagucaaa

SEQ ID NO: 2767974 - RNA, 14 nt, Human
aucaaaagaaagaa

SEQ ID NO: 2767975 - RNA, 12 nt, Human
auccuugaagau

SEQ ID NO: 2767976 - RNA, 18 nt, Human
auccagcagauuauucac

SEQ ID NO: 2767977 - RNA, 21 nt, Human
aucaugaauuaguuuuauaug

SEQ ID NO: 2767978 - RNA, 21 nt, Human
agucuggcuguacccaggaau

SEQ ID NO: 2767979 - RNA, 19 nt, Human
agucuggcuguacccagga

SEQ ID NO: 2767980 - RNA, 13 nt, Human
agucauuuaauaa

SEQ ID NO: 2767981 - RNA, 19 nt, Human
agugaugucacuagggcag

SEQ ID NO: 2767982 - RNA, 13 nt, Human
agugauuaccagg

SEQ ID NO: 2767983 - RNA, 13 nt, Human
aguacucauacau

SEQ ID NO: 2767984 - RNA, 17 nt, Human
auacaauuuuguuucug

SEQ ID NO: 2767985 - RNA, 16 nt, Human
auacaauuuuguuucu

SEQ ID NO: 2767986 - RNA, 14 nt, Human
auacaauuuuguuu

SEQ ID NO: 2767987 - RNA, 20 nt, Human
auacacacucaaaucaagaa

SEQ ID NO: 2767988 - RNA, 16 nt, Human
auaaaaaauuaugaca

SEQ ID NO: 2767989 - RNA, 16 nt, Human
auaaaagacagugaaa

SEQ ID NO: 2767990 - RNA, 15 nt, Human
auaaaagacagugaa

SEQ ID NO: 2767991 - RNA, 22 nt, Human
acugauuugacauagucuggcu

SEQ ID NO: 2767992 - RNA, 19 nt, Human
acugauaugggucuugaua

SEQ ID NO: 2767993 - RNA, 19 nt, Human
acucguuaauuuguagugu

SEQ ID NO: 2767994 - RNA, 14 nt, Human
acucguuaauuugu

SEQ ID NO: 2767995 - RNA, 14 nt, Human
acucccuuucaaca

SEQ ID NO: 2767996 - RNA, 20 nt, Human
acuucuuuaauuuuggaauu

SEQ ID NO: 2767997 - RNA, 19 nt, Human
acuucuuuaauuuuggaau

SEQ ID NO: 2767998 - RNA, 18 nt, Human
acuucuuuaauuuuggaa

SEQ ID NO: 2767999 - RNA, 21 nt, Human
acuucagacauagaauuaaca

SEQ ID NO: 2768000 - RNA, 17 nt, Human
acuucaaauccuugaag

SEQ ID NO: 2768001 - RNA, 18 nt, Human
acuucaaauccuugaaga

SEQ ID NO: 2768002 - RNA, 22 nt, Human
acuuaaaaaugguuuaaauggu

SEQ ID NO: 2768003 - RNA, 21 nt, Human
acuuaaaaaugguuuaaaugg

SEQ ID NO: 2768004 - RNA, 16 nt, Human
acuggugacugauucu

SEQ ID NO: 2768005 - RNA, 19 nt, Human
acuggugacugauucuuca

SEQ ID NO: 2768006 - RNA, 18 nt, Human
acuggugacugauucuuc

SEQ ID NO: 2768007 - RNA, 20 nt, Human
acuggugacugauucuucag

SEQ ID NO: 2768008 - RNA, 17 nt, Human
acuguaaaauaauaacu

SEQ ID NO: 2768009 - RNA, 21 nt, Human
acccugucucuacuaaaaaua

SEQ ID NO: 2768010 - RNA, 20 nt, Human
accucugccucagaaaacaa

SEQ ID NO: 2768011 - RNA, 14 nt, Human
acauguuaaaccau

SEQ ID NO: 2768012 - RNA, 23 nt, Human
acauguuaaaccaugggauaaau

SEQ ID NO: 2768013 - RNA, 21 nt, Human
acauguuaaaccaugggauaa

SEQ ID NO: 2768014 - RNA, 16 nt, Human
acauguuaaaccaugg

SEQ ID NO: 2768015 - RNA, 21 nt, Human
acauuuguauaaaauaauuuu

SEQ ID NO: 2768016 - RNA, 19 nt, Human
acauuuguauaaaauaauu

SEQ ID NO: 2768017 - RNA, 16 nt, Human
acauuuguauaaaaua

SEQ ID NO: 2768018 - RNA, 15 nt, Human
acauuugcucaugga

SEQ ID NO: 2768019 - RNA, 19 nt, Human
acagugauuaccagggacu

SEQ ID NO: 2768020 - RNA, 22 nt, Human
acaggaugguucccuugaugaa

SEQ ID NO: 2768021 - RNA, 24 nt, Human
acaggaugguucccuugaugaaga

SEQ ID NO: 2768022 - RNA, 15 nt, Human
acaccaauauucaua

SEQ ID NO: 2768023 - RNA, 17 nt, Human
aauuguaauuauaucug

SEQ ID NO: 2768024 - RNA, 22 nt, Human
aauuucauaccuaucaucuuaa

SEQ ID NO: 2768025 - RNA, 14 nt, Human
aauuguaauuauau

SEQ ID NO: 2768026 - RNA, 16 nt, Human
aauuguaauuauaucu

SEQ ID NO: 2768027 - RNA, 15 nt, Human
aauuguaauuauauc

SEQ ID NO: 2768028 - RNA, 11 nt, Human
aauuguaauag

SEQ ID NO: 2768029 - RNA, 21 nt, Human
aauuauaugcuauuucuauau

SEQ ID NO: 2768030 - RNA, 20 nt, Human
aauuauaugcuauuucuaua

SEQ ID NO: 2768031 - RNA, 19 nt, Human
aauuauaugcuauuucuau

SEQ ID NO: 2768032 - RNA, 23 nt, Human
aauuauaucugaggaauucugua

SEQ ID NO: 2768033 - RNA, 22 nt, Human
aauuauaucugaggaauucugu

SEQ ID NO: 2768034 - RNA, 20 nt, Human
aauuauaucugaggaauucu

SEQ ID NO: 2768035 - RNA, 20 nt, Human
aauucuguauagauuagaga

SEQ ID NO: 2768036 - RNA, 14 nt, Human
aauucuguauagau

SEQ ID NO: 2768037 - RNA, 13 nt, Human
aauucuguauaga

SEQ ID NO: 2768038 - RNA, 12 nt, Human
aauucuguauag

SEQ ID NO: 2768039 - RNA, 15 nt, Human
aauuggagcucgugg

SEQ ID NO: 2768040 - RNA, 23 nt, Human
aaggacuuguuagaucuaguuca

SEQ ID NO: 2768041 - RNA, 23 nt, Human
aaggacuucuuuaauuuuggaau

SEQ ID NO: 2768042 - RNA, 21 nt, Human
aaggacuuguuagaucuaguu

SEQ ID NO: 2768043 - RNA, 15 nt, Human
aaggacuuguuagau

SEQ ID NO: 2768044 - RNA, 15 nt, Human
aagaacugaaaucau

SEQ ID NO: 2768045 - RNA, 11 nt, Human
aagaacugaaa

SEQ ID NO: 2768046 - RNA, 13 nt, Human
aagaacugaaauc

SEQ ID NO: 2768047 - RNA, 12 nt, Human
aagaacugaaau

SEQ ID NO: 2768048 - RNA, 20 nt, Human
aacgcaggcccccaggugcc

SEQ ID NO: 2768049 - RNA, 15 nt, Human
aagaagacugcauua

SEQ ID NO: 2768050 - RNA, 20 nt, Human
aagaagacugcauuauauuu

SEQ ID NO: 2768051 - RNA, 21 nt, Human
aagacaaggaaaaaauaacaa

SEQ ID NO: 2768052 - RNA, 17 nt, Human
aaguuuaauauuaaagc

SEQ ID NO: 2768053 - RNA, 15 nt, Human
aaguuuaauauuaaa

SEQ ID NO: 2768054 - RNA, 24 nt, Human
aaguugaauuuauuggcuuuucug

SEQ ID NO: 2768055 - RNA, 23 nt, Human
aaguugaauuuauuggcuuuucu

SEQ ID NO: 2768056 - RNA, 14 nt, Human
aaguugaauuuauu

SEQ ID NO: 2768057 - RNA, 17 nt, Human
aaguugaauuuauuggc

SEQ ID NO: 2768058 - RNA, 15 nt, Human
aaguugaauuuauug

SEQ ID NO: 2768059 - RNA, 22 nt, Human
aauauuaaagccauguuuauua

SEQ ID NO: 2768060 - RNA, 16 nt, Human
aaucucaauauuucag

SEQ ID NO: 2768061 - RNA, 20 nt, Human
aaugaauacuuuauaaagga

SEQ ID NO: 2768062 - RNA, 23 nt, Human
aaauguugacaugggacauuugc

SEQ ID NO: 2768063 - RNA, 22 nt, Human
aaauguugacaugggacauuug

SEQ ID NO: 2768064 - RNA, 13 nt, Human
aaauguucaucaa

SEQ ID NO: 2768065 - RNA, 23 nt, Human
aaauggacuguggugacuuugga

SEQ ID NO: 2768066 - RNA, 20 nt, Human
aaauggacuguggugacuuu

SEQ ID NO: 2768067 - RNA, 21 nt, Human
aaauggacuguggugacuuug

SEQ ID NO: 2768068 - RNA, 18 nt, Human
aaaucucaauauuucaga

SEQ ID NO: 2768069 - RNA, 21 nt, Human
aaauauuuauuuuaauaaugu

SEQ ID NO: 2768070 - RNA, 22 nt, Human
aaaccaguauuguacaaaguau

SEQ ID NO: 2768071 - RNA, 18 nt, Human
aaaccaguauuguacaaa

SEQ ID NO: 2768072 - RNA, 17 nt, Human
aaaccaguauuguacaa

SEQ ID NO: 2768073 - RNA, 16 nt, Human
aaaccaguauuguaca

SEQ ID NO: 2768074 - RNA, 14 nt, Human
aaaccaguauugua

SEQ ID NO: 2768075 - RNA, 19 nt, Human
aaacccuugccaugugcua

SEQ ID NO: 2768076 - RNA, 15 nt, Human
aaacugcacugucaa

SEQ ID NO: 2768077 - RNA, 21 nt, Human
aaaaucauuucugcaucagcu

SEQ ID NO: 2768078 - RNA, 23 nt, Human
aaagccauguuuauuacaguaua

SEQ ID NO: 2768079 - RNA, 18 nt, Human
aaagccauguuuauuaca

SEQ ID NO: 2768080 - RNA, 17 nt, Human
aaagccauguuuauuac

SEQ ID NO: 2768081 - RNA, 16 nt, Human
aaagccauguuuauua

SEQ ID NO: 2768082 - RNA, 14 nt, Human
aaagccauguuuau

SEQ ID NO: 2768083 - RNA, 15 nt, Human
aaagcauuguaaaug

SEQ ID NO: 2768084 - RNA, 17 nt, Human
aaagcauuguaaaugug

SEQ ID NO: 2768085 - RNA, 18 nt, Human
aaaaguuuaauauuaaag

SEQ ID NO: 2768086 - RNA, 16 nt, Human
aaaaguuuaauauuaa

SEQ ID NO: 2768087 - RNA, 14 nt, Human
aaaaguuuaauauu

SEQ ID NO: 2768088 - RNA, 11 nt, Human
aaaaucauuuc

SEQ ID NO: 2768089 - RNA, 12 nt, Human
aaaaucauuucu

SEQ ID NO: 2768090 - RNA, 10 nt, Human
aaaaucauuu

SEQ ID NO: 2768091 - RNA, 13 nt, Human
aaaagacuccaaa

SEQ ID NO: 2768092 - RNA, 11 nt, Human
aaaagaaugau

SEQ ID NO: 2768093 - RNA, 13 nt, Human
aaaagaauauuuu

SEQ ID NO: 2768094 - RNA, 20 nt, Human
aaaagacaaggaaaaaauaa

SEQ ID NO: 2768095 - RNA, 12 nt, Human
aaaagaauauuu

SEQ ID NO: 2768096 - RNA, 17 nt, Human
aaaagaaagaaaaucag

SEQ ID NO: 2768097 - RNA, 15 nt, Human
uuuuaugauccagca

SEQ ID NO: 2768098 - RNA, 13 nt, Human
uuuuaugauccag

SEQ ID NO: 2768099 - RNA, 19 nt, Human
uuuguuguuuguuuagucu

SEQ ID NO: 2768100 - RNA, 20 nt, Human
uuuuauaugcuucuguuuua

SEQ ID NO: 2768101 - RNA, 15 nt, Human
uuuuauaugcuucug

SEQ ID NO: 2768102 - RNA, 20 nt, Human
uuuuauaucaauuuaaaaaa

SEQ ID NO: 2768103 - RNA, 10 nt, Human
uuuuauauuu

SEQ ID NO: 2768104 - RNA, 15 nt, Human
uuuggaaaucuuuaa

SEQ ID NO: 2768105 - RNA, 16 nt, Human
uuuggaaaucuuuaaa

SEQ ID NO: 2768106 - RNA, 21 nt, Human
uuugcauagauucccugagca

SEQ ID NO: 2768107 - RNA, 12 nt, Human
uuuguguuagag

SEQ ID NO: 2768108 - RNA, 14 nt, Human
uuuguuguuuguuu

SEQ ID NO: 2768109 - RNA, 12 nt, Human
uuuguuguuugu

SEQ ID NO: 2768110 - RNA, 11 nt, Human
uuuguauagaa

SEQ ID NO: 2768111 - RNA, 21 nt, Human
uuuguauaaaauaauuuuuau

SEQ ID NO: 2768112 - RNA, 21 nt, Human
uuuauuggcuuuucugaucca

SEQ ID NO: 2768113 - RNA, 17 nt, Human
uuuauuggcuuuucuga

SEQ ID NO: 2768114 - RNA, 13 nt, Human
uuuaugauccagc

SEQ ID NO: 2768115 - RNA, 20 nt, Human
uuuagaaacacaacuauauu

SEQ ID NO: 2768116 - RNA, 12 nt, Human
uuuagaaacaca

SEQ ID NO: 2768117 - RNA, 22 nt, Human
uuucugagaaagacuauucaaa

SEQ ID NO: 2768118 - RNA, 14 nt, Human
uuucucuuucguua

SEQ ID NO: 2768119 - RNA, 15 nt, Human
uuucugagaaagacu

SEQ ID NO: 2768120 - RNA, 15 nt, Human
uuucagauaaucaca

SEQ ID NO: 2768121 - RNA, 15 nt, Human
uuucagcagcugcag

SEQ ID NO: 2768122 - RNA, 17 nt, Human
uucuaugcugaguuugu

SEQ ID NO: 2768123 - RNA, 14 nt, Human
uucuauauuuucau

SEQ ID NO: 2768124 - RNA, 11 nt, Human
uucuauauuuu

SEQ ID NO: 2768125 - RNA, 21 nt, Human
uucuauauuuucauucuccua

SEQ ID NO: 2768126 - RNA, 18 nt, Human
uucuauauuuucauucuc

SEQ ID NO: 2768127 - RNA, 16 nt, Human
uucuauauuuucauuc

SEQ ID NO: 2768128 - RNA, 15 nt, Human
uucuauauuuucauu

SEQ ID NO: 2768129 - RNA, 18 nt, Human
uucccuugaugaagaagu

SEQ ID NO: 2768130 - RNA, 12 nt, Human
uuccuagugaaa

SEQ ID NO: 2768131 - RNA, 19 nt, Human
uucggccuccauccugagg

SEQ ID NO: 2768132 - RNA, 18 nt, Human
uucggccuccauccugag

SEQ ID NO: 2768133 - RNA, 19 nt, Human
uuccacuuauaggaauuga

SEQ ID NO: 2768134 - RNA, 18 nt, Human
uuacuaaaauggacugug

SEQ ID NO: 2768135 - RNA, 17 nt, Human
uuacuaaaauggacugu

SEQ ID NO: 2768136 - RNA, 16 nt, Human
uuacuaaaauggacug

SEQ ID NO: 2768137 - RNA, 15 nt, Human
uuacuaaaauggacu

SEQ ID NO: 2768138 - RNA, 11 nt, Human
uucacugauuu

SEQ ID NO: 2768139 - RNA, 23 nt, Human
uucagagcugcccucuccugggc

SEQ ID NO: 2768140 - RNA, 22 nt, Human
uucagagcugcccucuccuggg

SEQ ID NO: 2768141 - RNA, 21 nt, Human
uucagagcugcccucuccugg

SEQ ID NO: 2768142 - RNA, 12 nt, Human
uugaugaagaag

SEQ ID NO: 2768143 - RNA, 18 nt, Human
uugcauagauucccugag

SEQ ID NO: 2768144 - RNA, 14 nt, Human
uugaggacacugau

SEQ ID NO: 2768145 - RNA, 15 nt, Human
uugaggacacugaua

SEQ ID NO: 2768146 - RNA, 21 nt, Human
uugaaacggaugauuucuaug

SEQ ID NO: 2768147 - RNA, 20 nt, Human
uugaaacggaugauuucuau

SEQ ID NO: 2768148 - RNA, 22 nt, Human
uugaaacggaugauuucuaugc

SEQ ID NO: 2768149 - RNA, 23 nt, Human
uugaaacugagaugugaacacau

SEQ ID NO: 2768150 - RNA, 16 nt, Human
uugaaaagacuccaaa

SEQ ID NO: 2768151 - RNA, 18 nt, Human
uugaaaagacuccaaaga

SEQ ID NO: 2768152 - RNA, 22 nt, Human
uugaaaagacuccaaagaaaug

SEQ ID NO: 2768153 - RNA, 23 nt, Human
uugaaaagacuccaaagaaaugu

SEQ ID NO: 2768154 - RNA, 15 nt, Human
uucuuauuucauuuc

SEQ ID NO: 2768155 - RNA, 15 nt, Human
uucugagaaagacua

SEQ ID NO: 2768156 - RNA, 14 nt, Human
uucugagcauuuaa

SEQ ID NO: 2768157 - RNA, 21 nt, Human
uuggaccaaaaaccaguauug

SEQ ID NO: 2768158 - RNA, 12 nt, Human
uuggaaaucuuu

SEQ ID NO: 2768159 - RNA, 15 nt, Human
uuggaaaucuuuaaa

SEQ ID NO: 2768160 - RNA, 16 nt, Human
uuguaaaggaauuuaa

SEQ ID NO: 2768161 - RNA, 22 nt, Human
uuguacaaaguauuaagcauau

SEQ ID NO: 2768162 - RNA, 11 nt, Human
uuguaaaugug

SEQ ID NO: 2768163 - RNA, 14 nt, Human
uuguaaaugugcuu

SEQ ID NO: 2768164 - RNA, 18 nt, Human
uuguaaaugugcuuuuaa

SEQ ID NO: 2768165 - RNA, 19 nt, Human
uuguaucacaaaucuuaac

SEQ ID NO: 2768166 - RNA, 14 nt, Human
uuguauuacaaauc

SEQ ID NO: 2768167 - RNA, 15 nt, Human
uuggcuuuucugauc

SEQ ID NO: 2768168 - RNA, 22 nt, Human
uuggcuuuucugauccaguuuu

SEQ ID NO: 2768169 - RNA, 19 nt, Human
uuggcuuuucugauccagu

SEQ ID NO: 2768170 - RNA, 12 nt, Human
uugggaggcuga

SEQ ID NO: 2768171 - RNA, 22 nt, Human
ugugaccacugcagaagacagu

SEQ ID NO: 2768172 - RNA, 22 nt, Human
ugucucaguccaugaagaugua

SEQ ID NO: 2768173 - RNA, 21 nt, Human
ugucucaguccaugaagaugu

SEQ ID NO: 2768174 - RNA, 14 nt, Human
ugugcgcuaaacuu

SEQ ID NO: 2768175 - RNA, 23 nt, Human
ugugcgcuaaacuuuucugauag

SEQ ID NO: 2768176 - RNA, 22 nt, Human
ugugcgcuaaacuuuucugaua

SEQ ID NO: 2768177 - RNA, 19 nt, Human
ugugcgcuaaacuuuucug

SEQ ID NO: 2768178 - RNA, 13 nt, Human
uguacucaauuuu

SEQ ID NO: 2768179 - RNA, 17 nt, Human
uguagauaauacaguuc

SEQ ID NO: 2768180 - RNA, 14 nt, Human
uguaaucacagcua

SEQ ID NO: 2768181 - RNA, 15 nt, Human
uguaaucacagcuac

SEQ ID NO: 2768182 - RNA, 16 nt, Human
uguauagaaccucuuu

SEQ ID NO: 2768183 - RNA, 16 nt, Human
uguaugauucccagcc

SEQ ID NO: 2768184 - RNA, 20 nt, Human
uguugaaacggaugauuucu

SEQ ID NO: 2768185 - RNA, 23 nt, Human
uguugaaacggaugauuucuaug

SEQ ID NO: 2768186 - RNA, 22 nt, Human
uguugaaacggaugauuucuau

SEQ ID NO: 2768187 - RNA, 21 nt, Human
uguugaaacggaugauuucua

SEQ ID NO: 2768188 - RNA, 21 nt, Human
uguuggagaagaacugaaauc

SEQ ID NO: 2768189 - RNA, 14 nt, Human
uguuguuuguuuag

SEQ ID NO: 2768190 - RNA, 13 nt, Human
uguuuaaaaucau

SEQ ID NO: 2768191 - RNA, 23 nt, Human
uguuaaaccaugggauaaaugcc

SEQ ID NO: 2768192 - RNA, 16 nt, Human
uguuaaaccaugggau

SEQ ID NO: 2768193 - RNA, 18 nt, Human
uguuaaaccaugggauaa

SEQ ID NO: 2768194 - RNA, 21 nt, Human
uguuaaaccaugggauaaaug

SEQ ID NO: 2768195 - RNA, 20 nt, Human
uguuaaaccaugggauaaau

SEQ ID NO: 2768196 - RNA, 12 nt, Human
uguuauaaucuu

SEQ ID NO: 2768197 - RNA, 16 nt, Human
uguuagaucuaguuca

SEQ ID NO: 2768198 - RNA, 14 nt, Human
uguuagugcaaauu

SEQ ID NO: 2768199 - RNA, 16 nt, Human
uguucacagccagacu

SEQ ID NO: 2768200 - RNA, 17 nt, Human
ugugugaagugagugag

SEQ ID NO: 2768201 - RNA, 21 nt, Human
uuaccacuuguguuuugcaag

SEQ ID NO: 2768202 - RNA, 15 nt, Human
uuacauuuguauaaa

SEQ ID NO: 2768203 - RNA, 14 nt, Human
uuacauuuguauaa

SEQ ID NO: 2768204 - RNA, 20 nt, Human
uuacagagacagaaagcaga

SEQ ID NO: 2768205 - RNA, 22 nt, Human
uuaaugucaauucuugccaaau

SEQ ID NO: 2768206 - RNA, 16 nt, Human
uuaauaauguuucaaa

SEQ ID NO: 2768207 - RNA, 23 nt, Human
uuaauaauuauaugcuauuucua

SEQ ID NO: 2768208 - RNA, 20 nt, Human
uuaauaauuauaugcuauuu

SEQ ID NO: 2768209 - RNA, 18 nt, Human
uuaauaauuauaugcuau

SEQ ID NO: 2768210 - RNA, 18 nt, Human
uuaauaauguuucaaaca

SEQ ID NO: 2768211 - RNA, 12 nt, Human
uguuuguuuagu

SEQ ID NO: 2768212 - RNA, 21 nt, Human
uguuuguuuagucuugucuca

SEQ ID NO: 2768213 - RNA, 12 nt, Human
uuaacauguuaa

SEQ ID NO: 2768214 - RNA, 19 nt, Human
uuaacauguuaaaccaugg

SEQ ID NO: 2768215 - RNA, 18 nt, Human
uuaacauguuaaaccaug

SEQ ID NO: 2768216 - RNA, 20 nt, Human
uuaaagcuuauuaaaacuca

SEQ ID NO: 2768217 - RNA, 13 nt, Human
uuaaaagaaugau

SEQ ID NO: 2768218 - RNA, 19 nt, Human
uuaaaagaaugauuaugaa

SEQ ID NO: 2768219 - RNA, 18 nt, Human
uggccuucggccuccauc

SEQ ID NO: 2768220 - RNA, 17 nt, Human
uggccuucggccuccau

SEQ ID NO: 2768221 - RNA, 14 nt, Human
uggccuucggccuc

SEQ ID NO: 2768222 - RNA, 20 nt, Human
ugggacauuugcucauggaa

SEQ ID NO: 2768223 - RNA, 19 nt, Human
ugggacauuugcucaugga

SEQ ID NO: 2768224 - RNA, 22 nt, Human
uggcuuuguauagaaccucuuu

SEQ ID NO: 2768225 - RNA, 14 nt, Human
uggcuuuguauaga

SEQ ID NO: 2768226 - RNA, 15 nt, Human
uggcuguacccagga

SEQ ID NO: 2768227 - RNA, 21 nt, Human
ugggacagucaccucauggaa

SEQ ID NO: 2768228 - RNA, 20 nt, Human
ugggacagucaccucaugga

SEQ ID NO: 2768229 - RNA, 18 nt, Human
ugggacagucaccucaug

SEQ ID NO: 2768230 - RNA, 16 nt, Human
uggguagacacacaug

SEQ ID NO: 2768231 - RNA, 17 nt, Human
uggguagacacacauga

SEQ ID NO: 2768232 - RNA, 15 nt, Human
uggcauaacauaaau

SEQ ID NO: 2768233 - RNA, 20 nt, Human
uggauaauaaggaaaaguuu

SEQ ID NO: 2768234 - RNA, 12 nt, Human
ugcuuucagaua

SEQ ID NO: 2768235 - RNA, 21 nt, Human
ugcuuucagauacuggauugu

SEQ ID NO: 2768236 - RNA, 20 nt, Human
ugcuuucagauacuggauug

SEQ ID NO: 2768237 - RNA, 17 nt, Human
ugcuuucagauacugga

SEQ ID NO: 2768238 - RNA, 16 nt, Human
ugcuuucagauacugg

SEQ ID NO: 2768239 - RNA, 14 nt, Human
ugcuucuguuuuau

SEQ ID NO: 2768240 - RNA, 22 nt, Human
uggaaaaguauguuagugcaaa

SEQ ID NO: 2768241 - RNA, 14 nt, Human
uggaacucucgagc

SEQ ID NO: 2768242 - RNA, 15 nt, Human
ugcauuauauuuauu

SEQ ID NO: 2768243 - RNA, 20 nt, Human
ugcauuauauuuauuacugu

SEQ ID NO: 2768244 - RNA, 14 nt, Human
ugcauuauauuuau

SEQ ID NO: 2768245 - RNA, 19 nt, Human
ugcaucagcugcugaaaca

SEQ ID NO: 2768246 - RNA, 22 nt, Human
ugcaucagcugcugaaacaaca

SEQ ID NO: 2768247 - RNA, 20 nt, Human
ugccaucccucccuccaccu

SEQ ID NO: 2768248 - RNA, 19 nt, Human
ugccaucccucccuccacc

SEQ ID NO: 2768249 - RNA, 14 nt, Human
ugccaucccucccu

SEQ ID NO: 2768250 - RNA, 15 nt, Human
ugccaucccucccuc

SEQ ID NO: 2768251 - RNA, 22 nt, Human
ugccaucccucccuccaccucc

SEQ ID NO: 2768252 - RNA, 21 nt, Human
ugccaucccucccuccaccuc

SEQ ID NO: 2768253 - RNA, 15 nt, Human
ugcacaucaaaauau

SEQ ID NO: 2768254 - RNA, 19 nt, Human
ugcacggugaauggcuuug

SEQ ID NO: 2768255 - RNA, 23 nt, Human
ugcacggugaauggcuuuguaua

SEQ ID NO: 2768256 - RNA, 22 nt, Human
ugcacggugaauggcuuuguau

SEQ ID NO: 2768257 - RNA, 16 nt, Human
ugcagauaaacaguag

SEQ ID NO: 2768258 - RNA, 17 nt, Human
ugcugaguuugugcugg

SEQ ID NO: 2768259 - RNA, 15 nt, Human
ugcugaguuugugcu

SEQ ID NO: 2768260 - RNA, 21 nt, Human
ugcuagaacucccuuucaaca

SEQ ID NO: 2768261 - RNA, 20 nt, Human
ugcuagaacucccuuucaac

SEQ ID NO: 2768262 - RNA, 18 nt, Human
ugcuagaacucccuuuca

SEQ ID NO: 2768263 - RNA, 19 nt, Human
ugcuagaacucccuuucaa

SEQ ID NO: 2768264 - RNA, 17 nt, Human
ugccuucucaacuccaa

SEQ ID NO: 2768265 - RNA, 22 nt, Human
ugccuucucaacuccaaacuga

SEQ ID NO: 2768266 - RNA, 23 nt, Human
ugccuaaggacuucuuuaauuuu

SEQ ID NO: 2768267 - RNA, 23 nt, Human
ugccuccccuccucugcuugcca

SEQ ID NO: 2768268 - RNA, 22 nt, Human
ugccuccccuccucugcuugcc

SEQ ID NO: 2768269 - RNA, 19 nt, Human
ugccuccccuccucugcuu

SEQ ID NO: 2768270 - RNA, 18 nt, Human
ugccuccccuccucugcu

SEQ ID NO: 2768271 - RNA, 17 nt, Human
ucuugucucagauuuua

SEQ ID NO: 2768272 - RNA, 19 nt, Human
ucuugucucagauuuuauu

SEQ ID NO: 2768273 - RNA, 19 nt, Human
ucuuuaaaaaaaaaauugg

SEQ ID NO: 2768274 - RNA, 18 nt, Human
ucuuuaaaaaaaaaauug

SEQ ID NO: 2768275 - RNA, 23 nt, Human
ucuggccuucggccuccauccug

SEQ ID NO: 2768276 - RNA, 22 nt, Human
ucuguuuuauaauuuugugaag

SEQ ID NO: 2768277 - RNA, 20 nt, Human
ucuguuuuauaauuuuguga

SEQ ID NO: 2768278 - RNA, 15 nt, Human
ugaaaagacuccaaa

SEQ ID NO: 2768279 - RNA, 16 nt, Human
ugaaaagacuccaaag

SEQ ID NO: 2768280 - RNA, 17 nt, Human
ugaaaagacuccaaaga

SEQ ID NO: 2768281 - RNA, 19 nt, Human
ugaaaagacuccaaagaaa

SEQ ID NO: 2768282 - RNA, 19 nt, Human
ugaaaacuuuaugcuaagu

SEQ ID NO: 2768283 - RNA, 22 nt, Human
ugaaaagacuccaaagaaaugu

SEQ ID NO: 2768284 - RNA, 18 nt, Human
ugaaacccugucucuacu

SEQ ID NO: 2768285 - RNA, 23 nt, Human
ugaaagcagggacuugaacccau

SEQ ID NO: 2768286 - RNA, 19 nt, Human
ugaaagcagggacuugaac

SEQ ID NO: 2768287 - RNA, 18 nt, Human
ugaaagcagggacuugaa

SEQ ID NO: 2768288 - RNA, 22 nt, Human
ugaaguccaagcauuuagaugu

SEQ ID NO: 2768289 - RNA, 21 nt, Human
ugaaguccaagcauuuagaug

SEQ ID NO: 2768290 - RNA, 22 nt, Human
ugaacuuguaaaggaauuuaaa

SEQ ID NO: 2768291 - RNA, 14 nt, Human
ugaacacaucagcu

SEQ ID NO: 2768292 - RNA, 17 nt, Human
ucuacacuaagagagaa

SEQ ID NO: 2768293 - RNA, 17 nt, Human
ucuacacuccagugaga

SEQ ID NO: 2768294 - RNA, 21 nt, Human
ucuacacuaagagagaaugag

SEQ ID NO: 2768295 - RNA, 15 nt, Human
uccuugcaucaauuu

SEQ ID NO: 2768296 - RNA, 18 nt, Human
ucuccugggcagcugccu

SEQ ID NO: 2768297 - RNA, 17 nt, Human
ucuccugggcagcugcc

SEQ ID NO: 2768298 - RNA, 16 nt, Human
ucuccugggcagcugc

SEQ ID NO: 2768299 - RNA, 15 nt, Human
ucuccugggcagcug

SEQ ID NO: 2768300 - RNA, 13 nt, Human
ucuccugggcagc

SEQ ID NO: 2768301 - RNA, 14 nt, Human
ucuccugggcagcu

SEQ ID NO: 2768302 - RNA, 21 nt, Human
ucucagugucaaugcagcccc

SEQ ID NO: 2768303 - RNA, 20 nt, Human
ucuccugggcagcugccucc

SEQ ID NO: 2768304 - RNA, 19 nt, Human
ucuccugggcagcugccuc

SEQ ID NO: 2768305 - RNA, 21 nt, Human
ucuccugggcagcugccuccc

SEQ ID NO: 2768306 - RNA, 13 nt, Human
ucucuaggaaaua

SEQ ID NO: 2768307 - RNA, 19 nt, Human
ucugaggaauucuguauag

SEQ ID NO: 2768308 - RNA, 20 nt, Human
ucugaggaauucuguauaga

SEQ ID NO: 2768309 - RNA, 18 nt, Human
ucucuucacagucacauu

SEQ ID NO: 2768310 - RNA, 13 nt, Human
ucauuauuuuauu

SEQ ID NO: 2768311 - RNA, 15 nt, Human
ucauuauuuuauuau

SEQ ID NO: 2768312 - RNA, 14 nt, Human
ucauuauuuuauua

SEQ ID NO: 2768313 - RNA, 19 nt, Human
ucauuauuuuauuaugaaa

SEQ ID NO: 2768314 - RNA, 18 nt, Human
ucauuauuuuauuaugaa

SEQ ID NO: 2768315 - RNA, 16 nt, Human
ucauuauuuuauuaug

SEQ ID NO: 2768316 - RNA, 13 nt, Human
uccacuuggucug

SEQ ID NO: 2768317 - RNA, 12 nt, Human
uccacuuggucu

SEQ ID NO: 2768318 - RNA, 20 nt, Human
uccagcagauuauucacuga

SEQ ID NO: 2768319 - RNA, 17 nt, Human
uccagcagauuauucac

SEQ ID NO: 2768320 - RNA, 22 nt, Human
uccagcagauuauucacugauu

SEQ ID NO: 2768321 - RNA, 17 nt, Human
uccagauccuggaaauc

SEQ ID NO: 2768322 - RNA, 16 nt, Human
uccagauccuggaaau

SEQ ID NO: 2768323 - RNA, 14 nt, Human
uccagauccuggaa

SEQ ID NO: 2768324 - RNA, 20 nt, Human
uccaagcauuuagauguaua

SEQ ID NO: 2768325 - RNA, 23 nt, Human
uccaccucccugcaauaaaaugg

SEQ ID NO: 2768326 - RNA, 14 nt, Human
uccaccuacaugag

SEQ ID NO: 2768327 - RNA, 23 nt, Human
uccaaacugacucuuaagaagac

SEQ ID NO: 2768328 - RNA, 12 nt, Human
uccaaagaaaug

SEQ ID NO: 2768329 - RNA, 16 nt, Human
ucauuucugcaucagc

SEQ ID NO: 2768330 - RNA, 22 nt, Human
ucauuucugcaucagcugcuga

SEQ ID NO: 2768331 - RNA, 14 nt, Human
ucauuucuuugagu

SEQ ID NO: 2768332 - RNA, 23 nt, Human
uccaagcauaccaacacgagcag

SEQ ID NO: 2768333 - RNA, 17 nt, Human
uccaagcauuuagaugu

SEQ ID NO: 2768334 - RNA, 17 nt, Human
ucccucccuccaccucc

SEQ ID NO: 2768335 - RNA, 16 nt, Human
ucccaaauuucauacc

SEQ ID NO: 2768336 - RNA, 18 nt, Human
ucacucuccauuuaauaa

SEQ ID NO: 2768337 - RNA, 17 nt, Human
ucacuugucaauaaaau

SEQ ID NO: 2768338 - RNA, 19 nt, Human
ucagacauagaauuaacac

SEQ ID NO: 2768339 - RNA, 22 nt, Human
ucagacauagaauuaacacaug

SEQ ID NO: 2768340 - RNA, 23 nt, Human
ucagagcugcccucuccugggca

SEQ ID NO: 2768341 - RNA, 23 nt, Human
ucacaggacagcccuucuuucca

SEQ ID NO: 2768342 - RNA, 19 nt, Human
ucacaggaaguagaggagg

SEQ ID NO: 2768343 - RNA, 14 nt, Human
ucacaggaaguaga

SEQ ID NO: 2768344 - RNA, 19 nt, Human
ucaacuccaaacugacucu

SEQ ID NO: 2768345 - RNA, 12 nt, Human
uauuuuaugauc

SEQ ID NO: 2768346 - RNA, 13 nt, Human
ucaaaacugcacu

SEQ ID NO: 2768347 - RNA, 15 nt, Human
uaucugaggaauucu

SEQ ID NO: 2768348 - RNA, 18 nt, Human
uaucugaagucagaucug

SEQ ID NO: 2768349 - RNA, 17 nt, Human
uaucugaagucagaucu

SEQ ID NO: 2768350 - RNA, 22 nt, Human
uauuucuaugaaauauuauguu

SEQ ID NO: 2768351 - RNA, 21 nt, Human
uauuucuaugaaauauuaugu

SEQ ID NO: 2768352 - RNA, 14 nt, Human
uaaauccauuugga

SEQ ID NO: 2768353 - RNA, 16 nt, Human
uaaauccauuuggaaa

SEQ ID NO: 2768354 - RNA, 15 nt, Human
uaaauccauuuggaa

SEQ ID NO: 2768355 - RNA, 18 nt, Human
uaaauauaugcuaagucu

SEQ ID NO: 2768356 - RNA, 13 nt, Human
uaaaguugaauuu

SEQ ID NO: 2768357 - RNA, 15 nt, Human
uaaaguugaauuuau

SEQ ID NO: 2768358 - RNA, 14 nt, Human
uaaaguugaauuua

SEQ ID NO: 2768359 - RNA, 23 nt, Human
uaaaguugaauuuauuggcuuuu

SEQ ID NO: 2768360 - RNA, 21 nt, Human
uaaaguugaauuuauuggcuu

SEQ ID NO: 2768361 - RNA, 19 nt, Human
uaaaguugaauuuauuggc

SEQ ID NO: 2768362 - RNA, 17 nt, Human
uaaaguugaauuuauug

SEQ ID NO: 2768363 - RNA, 17 nt, Human
uaaauaaaaauaauccu

SEQ ID NO: 2768364 - RNA, 15 nt, Human
uaaacuuuucugaua

SEQ ID NO: 2768365 - RNA, 14 nt, Human
uaaacuuuucugau

SEQ ID NO: 2768366 - RNA, 13 nt, Human
uaaacuuuucuga

SEQ ID NO: 2768367 - RNA, 14 nt, Human
uaaaggaauuuaaa

SEQ ID NO: 2768368 - RNA, 17 nt, Human
uaaaauggguuuuacug

SEQ ID NO: 2768369 - RNA, 18 nt, Human
uaaaauccauacauuugu

SEQ ID NO: 2768370 - RNA, 19 nt, Human
uaaaauccauacauuugug

SEQ ID NO: 2768371 - RNA, 14 nt, Human
uaaaagaugaaaau

SEQ ID NO: 2768372 - RNA, 16 nt, Human
guuuucauuaucucaa

SEQ ID NO: 2768373 - RNA, 12 nt, Human
guuuguuuaguc

SEQ ID NO: 2768374 - RNA, 18 nt, Human
guuuucaggcuagaugua

SEQ ID NO: 2768375 - RNA, 16 nt, Human
uaaaaaagaaacauuu

SEQ ID NO: 2768376 - RNA, 23 nt, Human
guuugugcugguguaugugugaa

SEQ ID NO: 2768377 - RNA, 13 nt, Human
guuuagaaagcuu

SEQ ID NO: 2768378 - RNA, 14 nt, Human
guuuagucuugucu

SEQ ID NO: 2768379 - RNA, 20 nt, Human
guuuaggauguugaaaaagu

SEQ ID NO: 2768380 - RNA, 21 nt, Human
uaagccagacaucaacagaua

SEQ ID NO: 2768381 - RNA, 20 nt, Human
uaagccagacaucaacagau

SEQ ID NO: 2768382 - RNA, 16 nt, Human
uaagcauauauuuuua

SEQ ID NO: 2768383 - RNA, 19 nt, Human
uaagcauauauuuuuauau

SEQ ID NO: 2768384 - RNA, 22 nt, Human
uaagcauauauuuuuauauuua

SEQ ID NO: 2768385 - RNA, 21 nt, Human
uaagcauauauuuuuauauuu

SEQ ID NO: 2768386 - RNA, 23 nt, Human
uaagcauauauuuuuauauuuac

SEQ ID NO: 2768387 - RNA, 18 nt, Human
uaagcauuccaacuaucu

SEQ ID NO: 2768388 - RNA, 16 nt, Human
uaagcauuccaacuau

SEQ ID NO: 2768389 - RNA, 20 nt, Human
uaagcauuccaacuaucuca

SEQ ID NO: 2768390 - RNA, 13 nt, Human
uaagccagacauc

SEQ ID NO: 2768391 - RNA, 23 nt, Human
uaagagagaaugagagacacacu

SEQ ID NO: 2768392 - RNA, 23 nt, Human
uaagagggauuagggagagaaga

SEQ ID NO: 2768393 - RNA, 18 nt, Human
uaacauguuaaaccaugg

SEQ ID NO: 2768394 - RNA, 17 nt, Human
uaacauguuaaaccaug

SEQ ID NO: 2768395 - RNA, 16 nt, Human
uaacauguuaaaccau

SEQ ID NO: 2768396 - RNA, 23 nt, Human
uaaauccauuuggaaaucuuuaa

SEQ ID NO: 2768397 - RNA, 22 nt, Human
uaaauccauuuggaaaucuuua

SEQ ID NO: 2768398 - RNA, 19 nt, Human
uaaauccauuuggaaaucu

SEQ ID NO: 2768399 - RNA, 18 nt, Human
uaaauccauuuggaaauc

SEQ ID NO: 2768400 - RNA, 17 nt, Human
uaaaucccauuauucaa

SEQ ID NO: 2768401 - RNA, 16 nt, Human
uaaaucccauuauuca

SEQ ID NO: 2768402 - RNA, 23 nt, Human
uaaauugacacuuaaaaaugguu

SEQ ID NO: 2768403 - RNA, 19 nt, Human
uaacaaugcuguauuuuaa

SEQ ID NO: 2768404 - RNA, 14 nt, Human
uaauguuucaaaca

SEQ ID NO: 2768405 - RNA, 15 nt, Human
uaauguuucaaacau

SEQ ID NO: 2768406 - RNA, 19 nt, Human
uaauuaacauguuaaacca

SEQ ID NO: 2768407 - RNA, 18 nt, Human
uaauuaacauguuaaacc

SEQ ID NO: 2768408 - RNA, 17 nt, Human
uaauuaacauguuaaac

SEQ ID NO: 2768409 - RNA, 15 nt, Human
uaauuaacauguuaa

SEQ ID NO: 2768410 - RNA, 14 nt, Human
uaauuaacauguua

SEQ ID NO: 2768411 - RNA, 12 nt, Human
uaauuaacaugu

SEQ ID NO: 2768412 - RNA, 20 nt, Human
uaauuaaaagaauauuuuaa

SEQ ID NO: 2768413 - RNA, 22 nt, Human
uaauuggaaaggcagcucuaaa

SEQ ID NO: 2768414 - RNA, 23 nt, Human
uaauuuguaguguuggagaagaa

SEQ ID NO: 2768415 - RNA, 20 nt, Human
uaauuuguaguguuggagaa

SEQ ID NO: 2768416 - RNA, 18 nt, Human
uaauaaggaaaaguuuaa

SEQ ID NO: 2768417 - RNA, 20 nt, Human
uaauaaggaaaaguuuaaua

SEQ ID NO: 2768418 - RNA, 23 nt, Human
uaauaauuauaugcuauuucuau

SEQ ID NO: 2768419 - RNA, 22 nt, Human
uaauaauuauaugcuauuucua

SEQ ID NO: 2768420 - RNA, 20 nt, Human
uaauaauuauaugcuauuuc

SEQ ID NO: 2768421 - RNA, 19 nt, Human
uaauaauuauaugcuauuu

SEQ ID NO: 2768422 - RNA, 16 nt, Human
uaauaauuauaugcua

SEQ ID NO: 2768423 - RNA, 15 nt, Human
uaauaauuauaugcu

SEQ ID NO: 2768424 - RNA, 14 nt, Human
uaauaauguuucaa

SEQ ID NO: 2768425 - RNA, 15 nt, Human
uaauaauguuucaaa

SEQ ID NO: 2768426 - RNA, 12 nt, Human
uaauauuaaagc

SEQ ID NO: 2768427 - RNA, 14 nt, Human
uaauauuaaagcca

SEQ ID NO: 2768428 - RNA, 13 nt, Human
uaauauuaaagcc

SEQ ID NO: 2768429 - RNA, 19 nt, Human
uaaugccacuaaauugaca

SEQ ID NO: 2768430 - RNA, 18 nt, Human
uacaauuuuguuucugua

SEQ ID NO: 2768431 - RNA, 21 nt, Human
uacaauuuuguuucuguacuu

SEQ ID NO: 2768432 - RNA, 19 nt, Human
uacaauuuuguuucuguac

SEQ ID NO: 2768433 - RNA, 13 nt, Human
uaauuuuggaauu

SEQ ID NO: 2768434 - RNA, 12 nt, Human
uaauuuuggaau

SEQ ID NO: 2768435 - RNA, 14 nt, Human
uacaggauuugaaa

SEQ ID NO: 2768436 - RNA, 16 nt, Human
uaccaacacgagcagg

SEQ ID NO: 2768437 - RNA, 16 nt, Human
uacauuuguauaaaau

SEQ ID NO: 2768438 - RNA, 11 nt, Human
uacauuugugu

SEQ ID NO: 2768439 - RNA, 17 nt, Human
uacauuuguauaaaaua

SEQ ID NO: 2768440 - RNA, 22 nt, Human
uacaugagguacugagagugaa

SEQ ID NO: 2768441 - RNA, 21 nt, Human
uacaugagguacugagaguga

SEQ ID NO: 2768442 - RNA, 23 nt, Human
uaccacaggaaccacaagacugc

SEQ ID NO: 2768443 - RNA, 23 nt, Human
uacugauguuccuagugaaagag

SEQ ID NO: 2768444 - RNA, 19 nt, Human
uacugagagugaacaaauu

SEQ ID NO: 2768445 - RNA, 20 nt, Human
uagcagggcauggcugggaa

SEQ ID NO: 2768446 - RNA, 16 nt, Human
uagauguauguacuuc

SEQ ID NO: 2768447 - RNA, 20 nt, Human
uagauguauguacuucaugc

SEQ ID NO: 2768448 - RNA, 17 nt, Human
uagacuggugacugauu

SEQ ID NO: 2768449 - RNA, 14 nt, Human
uagacuggugacug

SEQ ID NO: 2768450 - RNA, 13 nt, Human
uagacuggugacu

SEQ ID NO: 2768451 - RNA, 15 nt, Human
uagagaguguugaaa

SEQ ID NO: 2768452 - RNA, 14 nt, Human
uagagaguguugaa

SEQ ID NO: 2768453 - RNA, 18 nt, Human
uagaguuuagcuggaaaa

SEQ ID NO: 2768454 - RNA, 17 nt, Human
uagaguuuagcuggaaa

SEQ ID NO: 2768455 - RNA, 13 nt, Human
uaggccaugggac

SEQ ID NO: 2768456 - RNA, 20 nt, Human
uaggaauugacccacaagaa

SEQ ID NO: 2768457 - RNA, 23 nt, Human
uaggaauugacccacaagaaaug

SEQ ID NO: 2768458 - RNA, 21 nt, Human
uaguuguaccgcaaugugacu

SEQ ID NO: 2768459 - RNA, 14 nt, Human
uagucaaauugugu

SEQ ID NO: 2768460 - RNA, 18 nt, Human
uagucaaauugugugaaa

SEQ ID NO: 2768461 - RNA, 16 nt, Human
uauaugcuauuucuau

SEQ ID NO: 2768462 - RNA, 18 nt, Human
uauaugcuauuucuauau

SEQ ID NO: 2768463 - RNA, 18 nt, Human
uauauuuuuauauuuacu

SEQ ID NO: 2768464 - RNA, 13 nt, Human
uauauuugaaaua

SEQ ID NO: 2768465 - RNA, 14 nt, Human
uauauuugaaauau

SEQ ID NO: 2768466 - RNA, 23 nt, Human
uauauuuauuacuguaagaaaau

SEQ ID NO: 2768467 - RNA, 20 nt, Human
uauauuuauuacuguaagaa

SEQ ID NO: 2768468 - RNA, 19 nt, Human
uauauuuuuauauuuacua

SEQ ID NO: 2768469 - RNA, 19 nt, Human
uauauuuuuuguuaaauga

SEQ ID NO: 2768470 - RNA, 15 nt, Human
ggggauucuuaaagu

SEQ ID NO: 2768471 - RNA, 11 nt, Human
ggggauucuua

SEQ ID NO: 2768472 - RNA, 16 nt, Human
gguguaugugugaagu

SEQ ID NO: 2768473 - RNA, 20 nt, Human
gguuaucugaagucagaucu

SEQ ID NO: 2768474 - RNA, 18 nt, Human
ggugacuuuggauaauaa

SEQ ID NO: 2768475 - RNA, 14 nt, Human
ggugacuuuggaua

SEQ ID NO: 2768476 - RNA, 21 nt, Human
ggugacuuuggauaauaagga

SEQ ID NO: 2768477 - RNA, 20 nt, Human
ggugacuuuggauaauaagg

SEQ ID NO: 2768478 - RNA, 19 nt, Human
ggugacuuuggauaauaag

SEQ ID NO: 2768479 - RNA, 21 nt, Human
ggugcuacaaaaacacagcaa

SEQ ID NO: 2768480 - RNA, 23 nt, Human
ggugcuacaaaaacacagcaagg

SEQ ID NO: 2768481 - RNA, 17 nt, Human
ggcuuuucugauccagu

SEQ ID NO: 2768482 - RNA, 14 nt, Human
gggaauugaggaca

SEQ ID NO: 2768483 - RNA, 12 nt, Human
ggcuuuucugau

SEQ ID NO: 2768484 - RNA, 16 nt, Human
ggcuuuucugauccag

SEQ ID NO: 2768485 - RNA, 13 nt, Human
ggcuuuucugauc

SEQ ID NO: 2768486 - RNA, 22 nt, Human
ggcuugaguuuaaauuguaaua

SEQ ID NO: 2768487 - RNA, 20 nt, Human
ggaaaaaauaacaaugaaag

SEQ ID NO: 2768488 - RNA, 17 nt, Human
gcuuuuaaaaaaaaaua

SEQ ID NO: 2768489 - RNA, 16 nt, Human
gcuugccaucccuccc

SEQ ID NO: 2768490 - RNA, 21 nt, Human
gcuugccaucccucccuccac

SEQ ID NO: 2768491 - RNA, 18 nt, Human
gcuugccaucccucccuc

SEQ ID NO: 2768492 - RNA, 19 nt, Human
gcuugcccuggugccucac

SEQ ID NO: 2768493 - RNA, 17 nt, Human
gcuugcccuggugccuc

SEQ ID NO: 2768494 - RNA, 15 nt, Human
gcuguucacagccag

SEQ ID NO: 2768495 - RNA, 16 nt, Human
gcuguucacagccaga

SEQ ID NO: 2768496 - RNA, 23 nt, Human
gcuguucacagccagacuggcac

SEQ ID NO: 2768497 - RNA, 21 nt, Human
ggaacgcguugaaauuguaau

SEQ ID NO: 2768498 - RNA, 16 nt, Human
ggaacgcguugaaauu

SEQ ID NO: 2768499 - RNA, 17 nt, Human
ggaacgcguugaaauug

SEQ ID NO: 2768500 - RNA, 18 nt, Human
ggaaaaguuuaauauuaa

SEQ ID NO: 2768501 - RNA, 19 nt, Human
ggaaaaguuuaauauuaaa

SEQ ID NO: 2768502 - RNA, 18 nt, Human
ggaaauauuuauuuuaau

SEQ ID NO: 2768503 - RNA, 17 nt, Human
ggaaauauuuauuuuaa

SEQ ID NO: 2768504 - RNA, 12 nt, Human
ggaaauauuuau

SEQ ID NO: 2768505 - RNA, 15 nt, Human
ggaaauauuuauuuu

SEQ ID NO: 2768506 - RNA, 13 nt, Human
ggaaauauuuauu

SEQ ID NO: 2768507 - RNA, 16 nt, Human
gcuagauguauguacu

SEQ ID NO: 2768508 - RNA, 18 nt, Human
gcuagauguauguacuuc

SEQ ID NO: 2768509 - RNA, 24 nt, Human
gcuggugcccugcuuucagauacu

SEQ ID NO: 2768510 - RNA, 22 nt, Human
gcuggugcccugcuuucagaua

SEQ ID NO: 2768511 - RNA, 22 nt, Human
gcuguauuuuaaaagaaugauu

SEQ ID NO: 2768512 - RNA, 21 nt, Human
ggaggacgcucucuggccuuc

SEQ ID NO: 2768513 - RNA, 20 nt, Human
ggaggacgcucucuggccuu

SEQ ID NO: 2768514 - RNA, 19 nt, Human
ggaggacgcucucuggccu

SEQ ID NO: 2768515 - RNA, 22 nt, Human
ggccaugggacagggaggacgc

SEQ ID NO: 2768516 - RNA, 21 nt, Human
ggcagcugccuccccuccucu

SEQ ID NO: 2768517 - RNA, 18 nt, Human
ggcagcugccuccccucc

SEQ ID NO: 2768518 - RNA, 22 nt, Human
ggcagcugccuccccuccucug

SEQ ID NO: 2768519 - RNA, 16 nt, Human
ggcagcugccuccccu

SEQ ID NO: 2768520 - RNA, 13 nt, Human
gccuaaggacuuc

SEQ ID NO: 2768521 - RNA, 12 nt, Human
gccuaaggacuu

SEQ ID NO: 2768522 - RNA, 18 nt, Human
gccuaaggacuucuuuaa

SEQ ID NO: 2768523 - RNA, 15 nt, Human
gccuaaggacuucuu

SEQ ID NO: 2768524 - RNA, 14 nt, Human
gccuaaggacuucu

SEQ ID NO: 2768525 - RNA, 11 nt, Human
gccuaaaucca

SEQ ID NO: 2768526 - RNA, 19 nt, Human
gcccuucuuuccacagaag

SEQ ID NO: 2768527 - RNA, 14 nt, Human
gccuccccuccucu

SEQ ID NO: 2768528 - RNA, 13 nt, Human
gccuccccuccuc

SEQ ID NO: 2768529 - RNA, 12 nt, Human
gccuccccuccu

SEQ ID NO: 2768530 - RNA, 11 nt, Human
gccuccccucc

SEQ ID NO: 2768531 - RNA, 22 nt, Human
gcuagacuggugacugauucuu

SEQ ID NO: 2768532 - RNA, 20 nt, Human
gcuagacuggugacugauuc

SEQ ID NO: 2768533 - RNA, 19 nt, Human
gcuagacuggugacugauu

SEQ ID NO: 2768534 - RNA, 16 nt, Human
gcuagacuggugacug

SEQ ID NO: 2768535 - RNA, 15 nt, Human
gcuagacuggugacu

SEQ ID NO: 2768536 - RNA, 13 nt, Human
gcuagacugguga

SEQ ID NO: 2768537 - RNA, 18 nt, Human
gccuguaaucacagcuac

SEQ ID NO: 2768538 - RNA, 16 nt, Human
gccuuuuucauuauuu

SEQ ID NO: 2768539 - RNA, 12 nt, Human
gccuuuuucauu

SEQ ID NO: 2768540 - RNA, 22 nt, Human
gccuuuuucauuauuuuauuau

SEQ ID NO: 2768541 - RNA, 20 nt, Human
gccuuuuucauuauuuuauu

SEQ ID NO: 2768542 - RNA, 22 nt, Human
gcgacagugagacucugucuca

SEQ ID NO: 2768543 - RNA, 18 nt, Human
gccuucggccuccauccu

SEQ ID NO: 2768544 - RNA, 19 nt, Human
gccuucggccuccauccug

SEQ ID NO: 2768545 - RNA, 22 nt, Human
gccacguucuuacuaguuuccc

SEQ ID NO: 2768546 - RNA, 14 nt, Human
gccaucccucccuc

SEQ ID NO: 2768547 - RNA, 13 nt, Human
gccaucccucccu

SEQ ID NO: 2768548 - RNA, 11 nt, Human
gccaucccucc

SEQ ID NO: 2768549 - RNA, 16 nt, Human
gccaucccucccucca

SEQ ID NO: 2768550 - RNA, 15 nt, Human
gccaucccucccucc

SEQ ID NO: 2768551 - RNA, 19 nt, Human
gccaugggacagggaggac

SEQ ID NO: 2768552 - RNA, 14 nt, Human
gccaugggacaggg

SEQ ID NO: 2768553 - RNA, 22 nt, Human
gccauuuaaagcuuauuaaaac

SEQ ID NO: 2768554 - RNA, 16 nt, Human
gcccacagcuguauga

SEQ ID NO: 2768555 - RNA, 17 nt, Human
gccccgugggguuccuc

SEQ ID NO: 2768556 - RNA, 19 nt, Human
gccccugcacuccagccug

SEQ ID NO: 2768557 - RNA, 16 nt, Human
gcccucuccugggcag

SEQ ID NO: 2768558 - RNA, 15 nt, Human
gcccucuccugggca

SEQ ID NO: 2768559 - RNA, 14 nt, Human
gcccucuccugggc

SEQ ID NO: 2768560 - RNA, 21 nt, Human
gcccucuccugggcagcugcc

SEQ ID NO: 2768561 - RNA, 19 nt, Human
gcccucuccugggcagcug

SEQ ID NO: 2768562 - RNA, 18 nt, Human
gcccucuccugggcagcu

SEQ ID NO: 2768563 - RNA, 16 nt, Human
gcauauauuuuuauau

SEQ ID NO: 2768564 - RNA, 11 nt, Human
gcauauauuuu

SEQ ID NO: 2768565 - RNA, 15 nt, Human
gcauauauuuuuaua

SEQ ID NO: 2768566 - RNA, 14 nt, Human
gcauauauuuuuau

SEQ ID NO: 2768567 - RNA, 18 nt, Human
gcauagauucccugagca

SEQ ID NO: 2768568 - RNA, 13 nt, Human
gcaguucugaaga

SEQ ID NO: 2768569 - RNA, 15 nt, Human
gcaggcuacugucag

SEQ ID NO: 2768570 - RNA, 20 nt, Human
gcacagccucuuagaugcag

SEQ ID NO: 2768571 - RNA, 18 nt, Human
gcacagccucuuagaugc

SEQ ID NO: 2768572 - RNA, 15 nt, Human
gcacugucaagauga

SEQ ID NO: 2768573 - RNA, 14 nt, Human
gcagaagacaguau

SEQ ID NO: 2768574 - RNA, 14 nt, Human
gauuaaguaaugau

SEQ ID NO: 2768575 - RNA, 22 nt, Human
gauuaaguaaugauaacuggaa

SEQ ID NO: 2768576 - RNA, 16 nt, Human
gaugcuagaacucccu

SEQ ID NO: 2768577 - RNA, 12 nt, Human
gcaagauguggg

SEQ ID NO: 2768578 - RNA, 16 nt, Human
gcaagaugugggcagu

SEQ ID NO: 2768579 - RNA, 23 nt, Human
gaucagcuuauugucuagugaaa

SEQ ID NO: 2768580 - RNA, 21 nt, Human
gauaauaaggaaaaguuuaau

SEQ ID NO: 2768581 - RNA, 20 nt, Human
gauaauaaggaaaaguuuaa

SEQ ID NO: 2768582 - RNA, 22 nt, Human
gauaauaaggaaaaguuuaaua

SEQ ID NO: 2768583 - RNA, 13 nt, Human
gauaaacaguagu

SEQ ID NO: 2768584 - RNA, 17 nt, Human
gaucuaguucacucucc

SEQ ID NO: 2768585 - RNA, 14 nt, Human
gauccuggaaauca

SEQ ID NO: 2768586 - RNA, 13 nt, Human
gauccuggaaauc

SEQ ID NO: 2768587 - RNA, 15 nt, Human
gaacauaaaauacaa

SEQ ID NO: 2768588 - RNA, 20 nt, Human
gaacagugauuaccagggac

SEQ ID NO: 2768589 - RNA, 16 nt, Human
gaacagugauuaccag

SEQ ID NO: 2768590 - RNA, 17 nt, Human
gaaauuguaauuauauc

SEQ ID NO: 2768591 - RNA, 16 nt, Human
gaaauuguauuacaaa

SEQ ID NO: 2768592 - RNA, 17 nt, Human
gaagacugcauuauauu

SEQ ID NO: 2768593 - RNA, 19 nt, Human
gaagacugcauuauauuua

SEQ ID NO: 2768594 - RNA, 12 nt, Human
gaagaacugaaa

SEQ ID NO: 2768595 - RNA, 18 nt, Human
gaagauguagaggagaaa

SEQ ID NO: 2768596 - RNA, 17 nt, Human
gaagauguagaggagaa

SEQ ID NO: 2768597 - RNA, 23 nt, Human
gaaugguccgugcuaaggacuug

SEQ ID NO: 2768598 - RNA, 22 nt, Human
gaaugguccgugcuaaggacuu

SEQ ID NO: 2768599 - RNA, 20 nt, Human
gaaugguccgugcuaaggac

SEQ ID NO: 2768600 - RNA, 21 nt, Human
gaauggcuuuguauagaaccu

SEQ ID NO: 2768601 - RNA, 22 nt, Human
gaauuuauuggcuuuucugauc

SEQ ID NO: 2768602 - RNA, 21 nt, Human
gaauuuauuggcuuuucugau

SEQ ID NO: 2768603 - RNA, 20 nt, Human
gaauuuauuggcuuuucuga

SEQ ID NO: 2768604 - RNA, 16 nt, Human
gaauuuauuggcuuuu

SEQ ID NO: 2768605 - RNA, 14 nt, Human
gaauuuauuggcuu

SEQ ID NO: 2768606 - RNA, 16 nt, Human
gaauauuuuaacuucc

SEQ ID NO: 2768607 - RNA, 22 nt, Human
gaaguccaagcauuuagaugua

SEQ ID NO: 2768608 - RNA, 12 nt, Human
gaaguccaagca

SEQ ID NO: 2768609 - RNA, 14 nt, Human
gaaguauccuucag

SEQ ID NO: 2768610 - RNA, 16 nt, Human
gaaguauccuucagcc

SEQ ID NO: 2768611 - RNA, 14 nt, Human
gacaucaacagaua

SEQ ID NO: 2768612 - RNA, 23 nt, Human
gacaggaugguucccuugaugaa

SEQ ID NO: 2768613 - RNA, 20 nt, Human
gacccaaaaggcagaagcaa

SEQ ID NO: 2768614 - RNA, 19 nt, Human
gacccaaaaggcagaagca

SEQ ID NO: 2768615 - RNA, 18 nt, Human
gacccaaaaggcagaagc

SEQ ID NO: 2768616 - RNA, 18 nt, Human
gaccacugcagaagacag

SEQ ID NO: 2768617 - RNA, 16 nt, Human
gaccacugcagaagac

SEQ ID NO: 2768618 - RNA, 18 nt, Human
gacuggcacaguuuucug

SEQ ID NO: 2768619 - RNA, 22 nt, Human
gacuggcacaguuuucugagaa

SEQ ID NO: 2768620 - RNA, 14 nt, Human
gacuggcacaguuu

SEQ ID NO: 2768621 - RNA, 16 nt, Human
gacugaggggagggga

SEQ ID NO: 2768622 - RNA, 13 nt, Human
gacugauucuuca

SEQ ID NO: 2768623 - RNA, 16 nt, Human
gacugauucuucagca

SEQ ID NO: 2768624 - RNA, 24 nt, Human
gacugcauuauauuuauuacugua

SEQ ID NO: 2768625 - RNA, 14 nt, Human
cuugcccuguuaaa

SEQ ID NO: 2768626 - RNA, 18 nt, Human
cuugcccuggugccucac

SEQ ID NO: 2768627 - RNA, 19 nt, Human
cuugccaucccucccucca

SEQ ID NO: 2768628 - RNA, 16 nt, Human
cuugccaucccucccu

SEQ ID NO: 2768629 - RNA, 15 nt, Human
cuugccaucccuccc

SEQ ID NO: 2768630 - RNA, 17 nt, Human
cuugccaucccucccuc

SEQ ID NO: 2768631 - RNA, 14 nt, Human
cuugccaucccucc

SEQ ID NO: 2768632 - RNA, 20 nt, Human
cuugcuugauuguauggugg

SEQ ID NO: 2768633 - RNA, 22 nt, Human
cuugcccuguuaaaagaugaaa

SEQ ID NO: 2768634 - RNA, 17 nt, Human
cuuuaaaaaaaaaauug

SEQ ID NO: 2768635 - RNA, 16 nt, Human
cuuguuagaucuaguu

SEQ ID NO: 2768636 - RNA, 13 nt, Human
cuuguuagaucua

SEQ ID NO: 2768637 - RNA, 16 nt, Human
cuuggacucauuuuaa

SEQ ID NO: 2768638 - RNA, 16 nt, Human
cuuggggcugaugcag

SEQ ID NO: 2768639 - RNA, 18 nt, Human
cuuggggcugaugcaguu

SEQ ID NO: 2768640 - RNA, 17 nt, Human
cuuguacuuuauuuucu

SEQ ID NO: 2768641 - RNA, 14 nt, Human
cuuuggauaauaag

SEQ ID NO: 2768642 - RNA, 16 nt, Human
cuuuggauaauaagga

SEQ ID NO: 2768643 - RNA, 19 nt, Human
cuuuccucaaaacuucaga

SEQ ID NO: 2768644 - RNA, 14 nt, Human
cuuuuucauuauuu

SEQ ID NO: 2768645 - RNA, 13 nt, Human
cuuuuucauuauu

SEQ ID NO: 2768646 - RNA, 12 nt, Human
cuuuuucauuau

SEQ ID NO: 2768647 - RNA, 15 nt, Human
cuuuuuuaaauaaau

SEQ ID NO: 2768648 - RNA, 18 nt, Human
cuuuucugauccaguuuu

SEQ ID NO: 2768649 - RNA, 16 nt, Human
cuuuucugauccaguu

SEQ ID NO: 2768650 - RNA, 11 nt, Human
cuuuucugauc

SEQ ID NO: 2768651 - RNA, 14 nt, Human
cuuuucugauagag

SEQ ID NO: 2768652 - RNA, 15 nt, Human
cuuuucugauccagu

SEQ ID NO: 2768653 - RNA, 14 nt, Human
cuuuucugauccag

SEQ ID NO: 2768654 - RNA, 14 nt, Human
gaaaacaaggauga

SEQ ID NO: 2768655 - RNA, 14 nt, Human
gaaaaguauguuag

SEQ ID NO: 2768656 - RNA, 20 nt, Human
gaaaaguauguuagugcaaa

SEQ ID NO: 2768657 - RNA, 19 nt, Human
gaaaauaacaauaaaagac

SEQ ID NO: 2768658 - RNA, 18 nt, Human
cuuaaugccacuaaauug

SEQ ID NO: 2768659 - RNA, 19 nt, Human
cuguuuuauaauuuuguga

SEQ ID NO: 2768660 - RNA, 19 nt, Human
cuuacuaguuucccuugca

SEQ ID NO: 2768661 - RNA, 19 nt, Human
cuuagaugcaguucugaag

SEQ ID NO: 2768662 - RNA, 14 nt, Human
cuuauaauuuaaaa

SEQ ID NO: 2768663 - RNA, 19 nt, Human
cuuauaggaauugacccac

SEQ ID NO: 2768664 - RNA, 21 nt, Human
cuuaggguuaugauuaaguaa

SEQ ID NO: 2768665 - RNA, 13 nt, Human
cuuauaauuuaaa

SEQ ID NO: 2768666 - RNA, 19 nt, Human
cuuccagauccuggaaauc

SEQ ID NO: 2768667 - RNA, 16 nt, Human
cuucagcgguuuauau

SEQ ID NO: 2768668 - RNA, 18 nt, Human
cuucagcgguuuauauaa

SEQ ID NO: 2768669 - RNA, 19 nt, Human
cuuccuuggacucauuuua

SEQ ID NO: 2768670 - RNA, 17 nt, Human
cuucggccuccauccug

SEQ ID NO: 2768671 - RNA, 18 nt, Human
cuucggccuccauccuga

SEQ ID NO: 2768672 - RNA, 18 nt, Human
cuccuaucaccugucuug

SEQ ID NO: 2768673 - RNA, 16 nt, Human
cucccuucucuucaca

SEQ ID NO: 2768674 - RNA, 12 nt, Human
cucccuuucaac

SEQ ID NO: 2768675 - RNA, 13 nt, Human
cucccuuucaaca

SEQ ID NO: 2768676 - RNA, 13 nt, Human
cucggagaagagc

SEQ ID NO: 2768677 - RNA, 20 nt, Human
cucggagaagagcuguucac

SEQ ID NO: 2768678 - RNA, 12 nt, Human
cucggagaagag

SEQ ID NO: 2768679 - RNA, 18 nt, Human
cucauuaggauggcuagu

SEQ ID NO: 2768680 - RNA, 17 nt, Human
cucauuaggauggcuag

SEQ ID NO: 2768681 - RNA, 20 nt, Human
cuccauccugaggcuccacu

SEQ ID NO: 2768682 - RNA, 21 nt, Human
cuccauccugaggcuccacuu

SEQ ID NO: 2768683 - RNA, 23 nt, Human
cuccauccugaggcuccacuugg

SEQ ID NO: 2768684 - RNA, 17 nt, Human
cucccagucauuuaaua

SEQ ID NO: 2768685 - RNA, 17 nt, Human
cuccaccucccugcaau

SEQ ID NO: 2768686 - RNA, 16 nt, Human
cuccaccucccugcaa

SEQ ID NO: 2768687 - RNA, 15 nt, Human
cuccaccucccugca

SEQ ID NO: 2768688 - RNA, 14 nt, Human
cuccaccucccugc

SEQ ID NO: 2768689 - RNA, 23 nt, Human
cucugcauacucauuaggauggc

SEQ ID NO: 2768690 - RNA, 13 nt, Human
cucuccauuuaau

SEQ ID NO: 2768691 - RNA, 21 nt, Human
cucuccugggcagcugccucc

SEQ ID NO: 2768692 - RNA, 21 nt, Human
cugaagucagaucugccuaag

SEQ ID NO: 2768693 - RNA, 14 nt, Human
cugaagucagaucu

SEQ ID NO: 2768694 - RNA, 16 nt, Human
cugaagucagaucugc

SEQ ID NO: 2768695 - RNA, 15 nt, Human
cugaagucagaucug

SEQ ID NO: 2768696 - RNA, 20 nt, Human
cugauccaguuuuguuugga

SEQ ID NO: 2768697 - RNA, 20 nt, Human
cugauagaggaagccugauu

SEQ ID NO: 2768698 - RNA, 13 nt, Human
cugauguuccuag

SEQ ID NO: 2768699 - RNA, 18 nt, Human
cugauguuccuagugaaa

SEQ ID NO: 2768700 - RNA, 20 nt, Human
cugauguuccuagugaaaga

SEQ ID NO: 2768701 - RNA, 21 nt, Human
cugauguuccuagugaaagag

SEQ ID NO: 2768702 - RNA, 15 nt, Human
cugauucuucagcaa

SEQ ID NO: 2768703 - RNA, 13 nt, Human
cugcagaagacag

SEQ ID NO: 2768704 - RNA, 23 nt, Human
cugcagaagacaguauggcagcu

SEQ ID NO: 2768705 - RNA, 19 nt, Human
cugccuaaggacuucuuua

SEQ ID NO: 2768706 - RNA, 22 nt, Human
cugccuaaggacuucuuuaauu

SEQ ID NO: 2768707 - RNA, 21 nt, Human
cugccuaaggacuucuuuaau

SEQ ID NO: 2768708 - RNA, 20 nt, Human
cugccuaaggacuucuuuaa

SEQ ID NO: 2768709 - RNA, 15 nt, Human
cugccuaagugcagc

SEQ ID NO: 2768710 - RNA, 16 nt, Human
cugcuuucagauacug

SEQ ID NO: 2768711 - RNA, 21 nt, Human
cugcuuucagauacuggauug

SEQ ID NO: 2768712 - RNA, 18 nt, Human
cugcuuucagauacugga

SEQ ID NO: 2768713 - RNA, 13 nt, Human
cugcugaaacaac

SEQ ID NO: 2768714 - RNA, 23 nt, Human
cuggaauaauccuaaacauauga

SEQ ID NO: 2768715 - RNA, 16 nt, Human
cuggccaacgggguga

SEQ ID NO: 2768716 - RNA, 20 nt, Human
cuggauuguacuuugugcug

SEQ ID NO: 2768717 - RNA, 19 nt, Human
cuggauuguacuuugugcu

SEQ ID NO: 2768718 - RNA, 18 nt, Human
cuggcacaguuuucugag

SEQ ID NO: 2768719 - RNA, 19 nt, Human
cuggcacaguuuucugaga

SEQ ID NO: 2768720 - RNA, 22 nt, Human
cugggaacccaaguccaagcau

SEQ ID NO: 2768721 - RNA, 21 nt, Human
cuggucccagccagcaguuca

SEQ ID NO: 2768722 - RNA, 21 nt, Human
ccucacccacccuuuuuuaaa

SEQ ID NO: 2768723 - RNA, 13 nt, Human
ccgugcuaaggac

SEQ ID NO: 2768724 - RNA, 22 nt, Human
ccgggaggcagagguugcagug

SEQ ID NO: 2768725 - RNA, 16 nt, Human
cccuugaugaagaagu

SEQ ID NO: 2768726 - RNA, 15 nt, Human
cccuugaugaagaag

SEQ ID NO: 2768727 - RNA, 23 nt, Human
ccucuuagaugcaguucugaaga

SEQ ID NO: 2768728 - RNA, 13 nt, Human
ccugaaagaggaa

SEQ ID NO: 2768729 - RNA, 18 nt, Human
ccugaaagaggaaugaag

SEQ ID NO: 2768730 - RNA, 23 nt, Human
ccugaaagaggaaugaaguacuc

SEQ ID NO: 2768731 - RNA, 13 nt, Human
ccugauuaaagaa

SEQ ID NO: 2768732 - RNA, 12 nt, Human
ccugauuaaaga

SEQ ID NO: 2768733 - RNA, 20 nt, Human
ccugaggcuccacuuggucu

SEQ ID NO: 2768734 - RNA, 18 nt, Human
ccugaggcuccacuuggu

SEQ ID NO: 2768735 - RNA, 17 nt, Human
ccugaggcuccacuugg

SEQ ID NO: 2768736 - RNA, 13 nt, Human
ccucuccugggca

SEQ ID NO: 2768737 - RNA, 12 nt, Human
ccucuccugggc

SEQ ID NO: 2768738 - RNA, 11 nt, Human
ccucuccuggg

SEQ ID NO: 2768739 - RNA, 21 nt, Human
ccucugcuugccaucccuccc

SEQ ID NO: 2768740 - RNA, 20 nt, Human
ccucugcuugccaucccucc

SEQ ID NO: 2768741 - RNA, 17 nt, Human
ccucugcuugccauccc

SEQ ID NO: 2768742 - RNA, 20 nt, Human
ccucagaaaacaaggaugaa

SEQ ID NO: 2768743 - RNA, 14 nt, Human
ccuccccuccucug

SEQ ID NO: 2768744 - RNA, 15 nt, Human
ccuccccuccucugc

SEQ ID NO: 2768745 - RNA, 11 nt, Human
ccuccucugcu

SEQ ID NO: 2768746 - RNA, 16 nt, Human
ccucccugcaauaaaa

SEQ ID NO: 2768747 - RNA, 12 nt, Human
ccucccugcaau

SEQ ID NO: 2768748 - RNA, 18 nt, Human
ccuccccuccucugcuug

SEQ ID NO: 2768749 - RNA, 17 nt, Human
ccuccccuccucugcuu

SEQ ID NO: 2768750 - RNA, 12 nt, Human
ccuucagccuga

SEQ ID NO: 2768751 - RNA, 16 nt, Human
ccugcuuucagauacu

SEQ ID NO: 2768752 - RNA, 15 nt, Human
ccugcuuucagauac

SEQ ID NO: 2768753 - RNA, 21 nt, Human
ccugcuuucagauacuggauu

SEQ ID NO: 2768754 - RNA, 18 nt, Human
ccugggcagcugccuccc

SEQ ID NO: 2768755 - RNA, 17 nt, Human
ccugggcagcugccucc

SEQ ID NO: 2768756 - RNA, 16 nt, Human
ccugggcagcugccuc

SEQ ID NO: 2768757 - RNA, 15 nt, Human
ccugggcagcugccu

SEQ ID NO: 2768758 - RNA, 20 nt, Human
ccugggcagcugccuccccu

SEQ ID NO: 2768759 - RNA, 22 nt, Human
cguucauggaacgcguugaaau

SEQ ID NO: 2768760 - RNA, 21 nt, Human
cguucauggaacgcguugaaa

SEQ ID NO: 2768761 - RNA, 23 nt, Human
cguucauggaacgcguugaaauu

SEQ ID NO: 2768762 - RNA, 13 nt, Human
cguugaaauugua

SEQ ID NO: 2768763 - RNA, 21 nt, Human
cgcguugaaauuguaauuaua

SEQ ID NO: 2768764 - RNA, 17 nt, Human
cgcguugaaauuguaau

SEQ ID NO: 2768765 - RNA, 13 nt, Human
cgcguugaaauug

SEQ ID NO: 2768766 - RNA, 16 nt, Human
ccuuucucuuucguua

SEQ ID NO: 2768767 - RNA, 11 nt, Human
cgcaaugugac

SEQ ID NO: 2768768 - RNA, 13 nt, Human
cggaugauuucua

SEQ ID NO: 2768769 - RNA, 14 nt, Human
cggaugauuucuau

SEQ ID NO: 2768770 - RNA, 17 nt, Human
cggccuccauccugagg

SEQ ID NO: 2768771 - RNA, 16 nt, Human
cggccuccauccugag

SEQ ID NO: 2768772 - RNA, 14 nt, Human
cggccuccauccug

SEQ ID NO: 2768773 - RNA, 18 nt, Human
cauuugcucauggaauug

SEQ ID NO: 2768774 - RNA, 13 nt, Human
cauuugcucaugg

SEQ ID NO: 2768775 - RNA, 14 nt, Human
cauuuaauaauuau

SEQ ID NO: 2768776 - RNA, 12 nt, Human
cauuuaauaauu

SEQ ID NO: 2768777 - RNA, 19 nt, Human
cauuuaauaauuauaugcu

SEQ ID NO: 2768778 - RNA, 17 nt, Human
cauuuaauaauuauaug

SEQ ID NO: 2768779 - RNA, 16 nt, Human
cauuuaauaauuauau

SEQ ID NO: 2768780 - RNA, 15 nt, Human
cauuuaauaauuaua

SEQ ID NO: 2768781 - RNA, 23 nt, Human
cauuuaauaauuauaugcuauuu

SEQ ID NO: 2768782 - RNA, 17 nt, Human
cauuuaggccaugggac

SEQ ID NO: 2768783 - RNA, 22 nt, Human
ccaagcauaccaacacgagcag

SEQ ID NO: 2768784 - RNA, 17 nt, Human
ccaagcauuuagaugua

SEQ ID NO: 2768785 - RNA, 14 nt, Human
ccaagcaaguauua

SEQ ID NO: 2768786 - RNA, 23 nt, Human
ccaaauuucauaccuaucaucuu

SEQ ID NO: 2768787 - RNA, 22 nt, Human
ccaaacugacucuuaagaagac

SEQ ID NO: 2768788 - RNA, 20 nt, Human
ccacaggaaccacaagacug

SEQ ID NO: 2768789 - RNA, 16 nt, Human
ccaauauucauagcag

SEQ ID NO: 2768790 - RNA, 18 nt, Human
ccacugcagaagacagua

SEQ ID NO: 2768791 - RNA, 13 nt, Human
ccacugcagaaga

SEQ ID NO: 2768792 - RNA, 20 nt, Human
ccaggaauggagccugcacg

SEQ ID NO: 2768793 - RNA, 17 nt, Human
ccaggugccaguuaugg

SEQ ID NO: 2768794 - RNA, 13 nt, Human
cccaaaaggcaga

SEQ ID NO: 2768795 - RNA, 18 nt, Human
cccaaaaggcagaagcaa

SEQ ID NO: 2768796 - RNA, 16 nt, Human
ccaugauguuuagaaa

SEQ ID NO: 2768797 - RNA, 14 nt, Human
ccaugaagauguag

SEQ ID NO: 2768798 - RNA, 20 nt, Human
ccaucaauaaaaaauuauga

SEQ ID NO: 2768799 - RNA, 19 nt, Human
ccaucaauaaaaaauuaug

SEQ ID NO: 2768800 - RNA, 18 nt, Human
ccaucaaggguacacugc

SEQ ID NO: 2768801 - RNA, 13 nt, Human
cccaggugccagu

SEQ ID NO: 2768802 - RNA, 13 nt, Human
guuuaaaugguca

SEQ ID NO: 2768803 - RNA, 15 nt, Human
ugugacuuaaugcca

SEQ ID NO: 2768804 - RNA, 11 nt, Human
auaaggcuuca

SEQ ID NO: 2768805 - RNA, 18 nt, Human
auaagccaguguugccua

SEQ ID NO: 2768806 - RNA, 20 nt, Human
auaagccaguguugccuaag

SEQ ID NO: 2768807 - RNA, 14 nt, Human
auaaugguugacug

SEQ ID NO: 2768808 - RNA, 18 nt, Human
auaaugguugacuggguu

SEQ ID NO: 2768809 - RNA, 15 nt, Human
auaauguaaauaaag

SEQ ID NO: 2768810 - RNA, 15 nt, Human
auaagggcagaguca

SEQ ID NO: 2768811 - RNA, 13 nt, Human
auaagggcagagu

SEQ ID NO: 2768812 - RNA, 17 nt, Human
auaagggguuugccauu

SEQ ID NO: 2768813 - RNA, 18 nt, Human
auaagggguuugccauuu

SEQ ID NO: 2768814 - RNA, 20 nt, Human
auaagggguuugccauuuga

SEQ ID NO: 2768815 - RNA, 21 nt, Human
auaagggguuugccauuugau

SEQ ID NO: 2768816 - RNA, 19 nt, Human
auaagguguuuucugugua

SEQ ID NO: 2768817 - RNA, 17 nt, Human
auaauggguuucuuuca

SEQ ID NO: 2768818 - RNA, 14 nt, Human
auacaauaacauaa

SEQ ID NO: 2768819 - RNA, 11 nt, Human
auacaauaaug

SEQ ID NO: 2768820 - RNA, 13 nt, Human
auacaauaaugga

SEQ ID NO: 2768821 - RNA, 15 nt, Human
auacaauaauggaaa

SEQ ID NO: 2768822 - RNA, 16 nt, Human
auacaauaauggaaaa

SEQ ID NO: 2768823 - RNA, 18 nt, Human
auacaauaauggaaaaaa

SEQ ID NO: 2768824 - RNA, 19 nt, Human
auacaauaauggaaaaaaa

SEQ ID NO: 2768825 - RNA, 13 nt, Human
auacaauauauaa

SEQ ID NO: 2768826 - RNA, 15 nt, Human
auacaauauauaaaa

SEQ ID NO: 2768827 - RNA, 19 nt, Human
auacaauauauaaaaauau

SEQ ID NO: 2768828 - RNA, 20 nt, Human
auacaauauauaaaaauaua

SEQ ID NO: 2768829 - RNA, 21 nt, Human
auacaauauauaaaaauauau

SEQ ID NO: 2768830 - RNA, 14 nt, Human
auacaauauauagc

SEQ ID NO: 2768831 - RNA, 16 nt, Human
auacaauauauagcug

SEQ ID NO: 2768832 - RNA, 15 nt, Human
auacaauaucaucca

SEQ ID NO: 2768833 - RNA, 17 nt, Human
auacaaugaacacuuau

SEQ ID NO: 2768834 - RNA, 18 nt, Human
auacaaugaacacuuaua

SEQ ID NO: 2768835 - RNA, 13 nt, Human
auaccccccucug

SEQ ID NO: 2768836 - RNA, 19 nt, Human
auacccccugcaaagccca

SEQ ID NO: 2768837 - RNA, 17 nt, Human
auacccccugcaaagcc

SEQ ID NO: 2768838 - RNA, 16 nt, Human
auacacuugcccugcu

SEQ ID NO: 2768839 - RNA, 22 nt, Human
auacacuuggggagauuugcca

SEQ ID NO: 2768840 - RNA, 15 nt, Human
auacacuuguauaaa

SEQ ID NO: 2768841 - RNA, 17 nt, Human
auacacuuguauaaaug

SEQ ID NO: 2768842 - RNA, 18 nt, Human
auacacuuguauaaaugu

SEQ ID NO: 2768843 - RNA, 19 nt, Human
auacacuuguauaaaugua

SEQ ID NO: 2768844 - RNA, 22 nt, Human
auacacuuguauaaauguauau

SEQ ID NO: 2768845 - RNA, 20 nt, Human
auacacuugugauuauaaaa

SEQ ID NO: 2768846 - RNA, 20 nt, Human
auacccccugcaaagcccag

SEQ ID NO: 2768847 - RNA, 17 nt, Human
auacccccccaugcagu

SEQ ID NO: 2768848 - RNA, 16 nt, Human
auaacaaugugcucuc

SEQ ID NO: 2768849 - RNA, 13 nt, Human
auaacaauguuaa

SEQ ID NO: 2768850 - RNA, 14 nt, Human
auaacaauguuaag

SEQ ID NO: 2768851 - RNA, 16 nt, Human
auaacaauguuaagga

SEQ ID NO: 2768852 - RNA, 18 nt, Human
auaacaauguuaaggaaa

SEQ ID NO: 2768853 - RNA, 20 nt, Human
auaaauuguuuggcuuccuc

SEQ ID NO: 2768854 - RNA, 16 nt, Human
auaaauuuacuuuaca

SEQ ID NO: 2768855 - RNA, 15 nt, Human
auaaauuuauaugaa

SEQ ID NO: 2768856 - RNA, 22 nt, Human
auaaagcaacuguuaugaaaua

SEQ ID NO: 2768857 - RNA, 15 nt, Human
auaaagauguuaaaa

SEQ ID NO: 2768858 - RNA, 11 nt, Human
auaacacacau

SEQ ID NO: 2768859 - RNA, 16 nt, Human
auaacacacuuuuuau

SEQ ID NO: 2768860 - RNA, 14 nt, Human
auaacacacagcua

SEQ ID NO: 2768861 - RNA, 23 nt, Human
auaacacacagcuaacacacagc

SEQ ID NO: 2768862 - RNA, 13 nt, Human
auaacacacagcu

SEQ ID NO: 2768863 - RNA, 22 nt, Human
auaacaauguuaaggaaacucu

SEQ ID NO: 2768864 - RNA, 15 nt, Human
auaacaauuguuugg

SEQ ID NO: 2768865 - RNA, 20 nt, Human
auaaaaagccugcaauuuca

SEQ ID NO: 2768866 - RNA, 17 nt, Human
aguuuggcaauaguuug

SEQ ID NO: 2768867 - RNA, 16 nt, Human
aguuuggcaauaguuu

SEQ ID NO: 2768868 - RNA, 13 nt, Human
aguuugcuuagaa

SEQ ID NO: 2768869 - RNA, 14 nt, Human
aguuugcuuagaaa

SEQ ID NO: 2768870 - RNA, 15 nt, Human
aguuugcuuguuucu

SEQ ID NO: 2768871 - RNA, 21 nt, Human
aguuuggagagucagaucuuu

SEQ ID NO: 2768872 - RNA, 18 nt, Human
aguuuggauucuuaugua

SEQ ID NO: 2768873 - RNA, 11 nt, Human
aguuugcuuag

SEQ ID NO: 2768874 - RNA, 14 nt, Human
aguuugcuauuaga

SEQ ID NO: 2768875 - RNA, 20 nt, Human
aguuugcacuguaugcugga

SEQ ID NO: 2768876 - RNA, 22 nt, Human
auaaaaagccugcaauuucaua

SEQ ID NO: 2768877 - RNA, 21 nt, Human
auaaaaagcuuccaugauucu

SEQ ID NO: 2768878 - RNA, 17 nt, Human
auaaaaagcuuccauga

SEQ ID NO: 2768879 - RNA, 14 nt, Human
auaaaaaggacauc

SEQ ID NO: 2768880 - RNA, 11 nt, Human
auaaaaaggac

SEQ ID NO: 2768881 - RNA, 13 nt, Human
auaaaacauuaug

SEQ ID NO: 2768882 - RNA, 22 nt, Human
auaaaacauuaugcuccagaaa

SEQ ID NO: 2768883 - RNA, 19 nt, Human
auaaaaaggacaucagcaa

SEQ ID NO: 2768884 - RNA, 17 nt, Human
auaaaacuuugcugcca

SEQ ID NO: 2768885 - RNA, 18 nt, Human
auaaagauggcugacuuu

SEQ ID NO: 2768886 - RNA, 15 nt, Human
auaaagaugcucuuu

SEQ ID NO: 2768887 - RNA, 14 nt, Human
auaaagaugcucuu

SEQ ID NO: 2768888 - RNA, 22 nt, Human
auaaaaccuuucaaauuucaca

SEQ ID NO: 2768889 - RNA, 21 nt, Human
auaaaaccuuucaaauuucac

SEQ ID NO: 2768890 - RNA, 20 nt, Human
auaaaaccuuucaaauuuca

SEQ ID NO: 2768891 - RNA, 15 nt, Human
auaaaaccuuucaaa

SEQ ID NO: 2768892 - RNA, 14 nt, Human
auaaaaccuuucaa

SEQ ID NO: 2768893 - RNA, 13 nt, Human
auaaaaccuuuca

SEQ ID NO: 2768894 - RNA, 11 nt, Human
auaaaaccuuu

SEQ ID NO: 2768895 - RNA, 23 nt, Human
aguugugccuuuuauagcuauua

SEQ ID NO: 2768896 - RNA, 15 nt, Human
aguuugaaggaaaca

SEQ ID NO: 2768897 - RNA, 16 nt, Human
aguuugaaggaaacag

SEQ ID NO: 2768898 - RNA, 18 nt, Human
aguuugaaggaaacaguu

SEQ ID NO: 2768899 - RNA, 15 nt, Human
aguuugaacuucaua

SEQ ID NO: 2768900 - RNA, 21 nt, Human
aguuucuucugcgccucaggc

SEQ ID NO: 2768901 - RNA, 16 nt, Human
aguuucuugguaaagu

SEQ ID NO: 2768902 - RNA, 17 nt, Human
aguuucuuagcuuuuua

SEQ ID NO: 2768903 - RNA, 15 nt, Human
aguuucuuagcuuuu

SEQ ID NO: 2768904 - RNA, 13 nt, Human
aguuucuuuggga

SEQ ID NO: 2768905 - RNA, 17 nt, Human
auauuauguguuuccau

SEQ ID NO: 2768906 - RNA, 16 nt, Human
auauggcaaaaauggc

SEQ ID NO: 2768907 - RNA, 13 nt, Human
auauggcaagaaa

SEQ ID NO: 2768908 - RNA, 15 nt, Human
auauggcaagaaagc

SEQ ID NO: 2768909 - RNA, 17 nt, Human
auauggcaagaaagcug

SEQ ID NO: 2768910 - RNA, 18 nt, Human
auauggcaagaaagcugg

SEQ ID NO: 2768911 - RNA, 19 nt, Human
auauggcaagaaagcuggu

SEQ ID NO: 2768912 - RNA, 12 nt, Human
auauggcagaag

SEQ ID NO: 2768913 - RNA, 15 nt, Human
auauggcagaagaca

SEQ ID NO: 2768914 - RNA, 17 nt, Human
auauggcagaagacacc

SEQ ID NO: 2768915 - RNA, 20 nt, Human
auaugcagugauauggcaga

SEQ ID NO: 2768916 - RNA, 16 nt, Human
auaugcacuauguaua

SEQ ID NO: 2768917 - RNA, 18 nt, Human
auaugcucuuuuguuugg

SEQ ID NO: 2768918 - RNA, 17 nt, Human
auauggauuuguuacag

SEQ ID NO: 2768919 - RNA, 18 nt, Human
auauggaugauucagaaa

SEQ ID NO: 2768920 - RNA, 16 nt, Human
auauggacucugcaca

SEQ ID NO: 2768921 - RNA, 18 nt, Human
auauggagaauugcugaa

SEQ ID NO: 2768922 - RNA, 21 nt, Human
auauggagaauugcugaaggg

SEQ ID NO: 2768923 - RNA, 15 nt, Human
auauggacucugcac

SEQ ID NO: 2768924 - RNA, 21 nt, Human
auaugcaccuugugucuguac

SEQ ID NO: 2768925 - RNA, 19 nt, Human
auaugcaccuugugucugu

SEQ ID NO: 2768926 - RNA, 20 nt, Human
auaugcaccuugugucugua

SEQ ID NO: 2768927 - RNA, 15 nt, Human
auaugcaccuugugu

SEQ ID NO: 2768928 - RNA, 17 nt, Human
auaugcaccuugugucu

SEQ ID NO: 2768929 - RNA, 14 nt, Human
auaucauauuggua

SEQ ID NO: 2768930 - RNA, 19 nt, Human
auaucauauugguauucac

SEQ ID NO: 2768931 - RNA, 16 nt, Human
auaucagugacaguug

SEQ ID NO: 2768932 - RNA, 12 nt, Human
auaucaguuuga

SEQ ID NO: 2768933 - RNA, 13 nt, Human
auaucauacaaau

SEQ ID NO: 2768934 - RNA, 19 nt, Human
auaucauacuguucaaugg

SEQ ID NO: 2768935 - RNA, 13 nt, Human
auaucauauguau

SEQ ID NO: 2768936 - RNA, 14 nt, Human
auaucauauguaua

SEQ ID NO: 2768937 - RNA, 22 nt, Human
auauucagugcuguggccuggg

SEQ ID NO: 2768938 - RNA, 15 nt, Human
auauucacugggcca

SEQ ID NO: 2768939 - RNA, 16 nt, Human
auauucacugggccaa

SEQ ID NO: 2768940 - RNA, 19 nt, Human
auauucagaaucuuuguua

SEQ ID NO: 2768941 - RNA, 20 nt, Human
auauucagaaucuuuguuaa

SEQ ID NO: 2768942 - RNA, 12 nt, Human
auauucagaauu

SEQ ID NO: 2768943 - RNA, 15 nt, Human
auauggcauuugcag

SEQ ID NO: 2768944 - RNA, 16 nt, Human
auauggcauuugcaga

SEQ ID NO: 2768945 - RNA, 11 nt, Human
auauucaacca

SEQ ID NO: 2768946 - RNA, 12 nt, Human
auauucaaccau

SEQ ID NO: 2768947 - RNA, 17 nt, Human
auauucaaccauggacu

SEQ ID NO: 2768948 - RNA, 21 nt, Human
auauucaaccauggacuuuau

SEQ ID NO: 2768949 - RNA, 23 nt, Human
auauucaaccauggacuuuauaa

SEQ ID NO: 2768950 - RNA, 21 nt, Human
auauuuaugucuauuuaagcc

SEQ ID NO: 2768951 - RNA, 16 nt, Human
auauuuauuaaauaaa

SEQ ID NO: 2768952 - RNA, 18 nt, Human
auauuuauuaaauaaaau

SEQ ID NO: 2768953 - RNA, 20 nt, Human
auauuuauuaaauaaaauca

SEQ ID NO: 2768954 - RNA, 18 nt, Human
auauuuaugucuauuuaa

SEQ ID NO: 2768955 - RNA, 12 nt, Human
auauuuauccaa

SEQ ID NO: 2768956 - RNA, 15 nt, Human
auauuuauccaaaau

SEQ ID NO: 2768957 - RNA, 20 nt, Human
auauuuauccaaaaugugua

SEQ ID NO: 2768958 - RNA, 14 nt, Human
auauuuauccacua

SEQ ID NO: 2768959 - RNA, 21 nt, Human
auauuucccauuugugccaga

SEQ ID NO: 2768960 - RNA, 19 nt, Human
auauuucccuaaaauacau

SEQ ID NO: 2768961 - RNA, 20 nt, Human
auauuucccuaaaauacauu

SEQ ID NO: 2768962 - RNA, 22 nt, Human
auauuucccuaaaauacauuua

SEQ ID NO: 2768963 - RNA, 19 nt, Human
auauuuaugucuauuuaag

SEQ ID NO: 2768964 - RNA, 15 nt, Human
auauuucagauguaa

SEQ ID NO: 2768965 - RNA, 18 nt, Human
auauuucagauguaaugu

SEQ ID NO: 2768966 - RNA, 19 nt, Human
auauuucagauguaauguu

SEQ ID NO: 2768967 - RNA, 20 nt, Human
auauuucagauguaauguuu

SEQ ID NO: 2768968 - RNA, 21 nt, Human
auauuucagauguaauguuuu

SEQ ID NO: 2768969 - RNA, 23 nt, Human
auauucagugcuguggccugggc

SEQ ID NO: 2768970 - RNA, 18 nt, Human
auauucaugcuucuuccu

SEQ ID NO: 2768971 - RNA, 20 nt, Human
auauucaugcuucuuccuua

SEQ ID NO: 2768972 - RNA, 12 nt, Human
auauucauauug

SEQ ID NO: 2768973 - RNA, 14 nt, Human
auauucauauugga

SEQ ID NO: 2768974 - RNA, 17 nt, Human
auauucauauuggaaaa

SEQ ID NO: 2768975 - RNA, 19 nt, Human
auauucauauuggaaaaau

SEQ ID NO: 2768976 - RNA, 17 nt, Human
auauucauucauggacc

SEQ ID NO: 2768977 - RNA, 15 nt, Human
auauuuauauauuua

SEQ ID NO: 2768978 - RNA, 15 nt, Human
auauuuauaacucau

SEQ ID NO: 2768979 - RNA, 23 nt, Human
auauuuauaacucaucauaaaau

SEQ ID NO: 2768980 - RNA, 19 nt, Human
auauuuauagguacccaau

SEQ ID NO: 2768981 - RNA, 22 nt, Human
auauuuauaacucaucauaaaa

SEQ ID NO: 2768982 - RNA, 21 nt, Human
auauuuauaacucaucauaaa

SEQ ID NO: 2768983 - RNA, 20 nt, Human
auauuuauaacucaucauaa

SEQ ID NO: 2768984 - RNA, 17 nt, Human
auauuuauaacucauca

SEQ ID NO: 2768985 - RNA, 15 nt, Human
auauauuuuuauauu

SEQ ID NO: 2768986 - RNA, 21 nt, Human
auauauuuuuauauuuaguua

SEQ ID NO: 2768987 - RNA, 14 nt, Human
auauauuuuuauau

SEQ ID NO: 2768988 - RNA, 16 nt, Human
auaucagcacauauuu

SEQ ID NO: 2768989 - RNA, 14 nt, Human
auauauuuuuugua

SEQ ID NO: 2768990 - RNA, 18 nt, Human
auagcauggauagaguau

SEQ ID NO: 2768991 - RNA, 15 nt, Human
auagcagcaaaaaua

SEQ ID NO: 2768992 - RNA, 19 nt, Human
auagcagcaaaaauauaaa

SEQ ID NO: 2768993 - RNA, 20 nt, Human
auagcagcaaaaauauaaaa

SEQ ID NO: 2768994 - RNA, 13 nt, Human
auagcauucauaa

SEQ ID NO: 2768995 - RNA, 18 nt, Human
auagcauuuuugauuuau

SEQ ID NO: 2768996 - RNA, 19 nt, Human
auagcauuuuugauuuaug

SEQ ID NO: 2768997 - RNA, 21 nt, Human
auagcauuuuugauuuaugca

SEQ ID NO: 2768998 - RNA, 12 nt, Human
auagcauugcuu

SEQ ID NO: 2768999 - RNA, 18 nt, Human
auagaaauauauacgaac

SEQ ID NO: 2769000 - RNA, 12 nt, Human
auagcacuuuga

SEQ ID NO: 2769001 - RNA, 13 nt, Human
auagcacuuugaa

SEQ ID NO: 2769002 - RNA, 14 nt, Human
auagcacuuugaaa

SEQ ID NO: 2769003 - RNA, 15 nt, Human
auagcacuuugaaau

SEQ ID NO: 2769004 - RNA, 19 nt, Human
auagcacuuugaaauaccu

SEQ ID NO: 2769005 - RNA, 20 nt, Human
auagcacuuugaaauaccuc

SEQ ID NO: 2769006 - RNA, 21 nt, Human
auagcacuuugaaauaccuca

SEQ ID NO: 2769007 - RNA, 22 nt, Human
auagcacuuugaaauaccucau

SEQ ID NO: 2769008 - RNA, 19 nt, Human
auagaaauaagugguuauu

SEQ ID NO: 2769009 - RNA, 14 nt, Human
auagaaauauauac

SEQ ID NO: 2769010 - RNA, 22 nt, Human
auagaaauaaaggaugugauug

SEQ ID NO: 2769011 - RNA, 13 nt, Human
auagaaagaaagu

SEQ ID NO: 2769012 - RNA, 12 nt, Human
auagaaagcauu

SEQ ID NO: 2769013 - RNA, 14 nt, Human
auacuuuaguauga

SEQ ID NO: 2769014 - RNA, 13 nt, Human
auacuuugucuga

SEQ ID NO: 2769015 - RNA, 16 nt, Human
auacuuuguggaccaa

SEQ ID NO: 2769016 - RNA, 24 nt, Human
auacuuuguggaccaauuauugau

SEQ ID NO: 2769017 - RNA, 13 nt, Human
auagaaaaguuau

SEQ ID NO: 2769018 - RNA, 14 nt, Human
auagaaaaguuauu

SEQ ID NO: 2769019 - RNA, 15 nt, Human
auagaaaaguuauua

SEQ ID NO: 2769020 - RNA, 11 nt, Human
auagaaacaug

SEQ ID NO: 2769021 - RNA, 13 nt, Human
auagaaacaugac

SEQ ID NO: 2769022 - RNA, 14 nt, Human
auagaaacaugaca

SEQ ID NO: 2769023 - RNA, 15 nt, Human
auagaaacaugacac

SEQ ID NO: 2769024 - RNA, 16 nt, Human
auagaaacaugacacu

SEQ ID NO: 2769025 - RNA, 21 nt, Human
auagaaacaugacacugaccu

SEQ ID NO: 2769026 - RNA, 21 nt, Human
auacuuucauccugacucugc

SEQ ID NO: 2769027 - RNA, 17 nt, Human
auacuugugguuuucaa

SEQ ID NO: 2769028 - RNA, 18 nt, Human
auacuugugguuuucaaa

SEQ ID NO: 2769029 - RNA, 19 nt, Human
auacuugugguuuucaaau

SEQ ID NO: 2769030 - RNA, 12 nt, Human
auacuuuacaug

SEQ ID NO: 2769031 - RNA, 13 nt, Human
auacuuuaaauaa

SEQ ID NO: 2769032 - RNA, 17 nt, Human
auacuuuaaauaauuua

SEQ ID NO: 2769033 - RNA, 19 nt, Human
auacuuuaaauaauuuaac

SEQ ID NO: 2769034 - RNA, 20 nt, Human
auacuuuaaauaauuuaacu

SEQ ID NO: 2769035 - RNA, 23 nt, Human
auacuugcagcucccauucuaug

SEQ ID NO: 2769036 - RNA, 17 nt, Human
auagccuaggugacaga

SEQ ID NO: 2769037 - RNA, 15 nt, Human
auagccuaggugaca

SEQ ID NO: 2769038 - RNA, 19 nt, Human
auagccuauggcagaaaaa

SEQ ID NO: 2769039 - RNA, 17 nt, Human
auaguaaguucagcacu

SEQ ID NO: 2769040 - RNA, 14 nt, Human
auaguaaaagaaau

SEQ ID NO: 2769041 - RNA, 18 nt, Human
auaguaacaucaaagauu

SEQ ID NO: 2769042 - RNA, 21 nt, Human
auaguaacuucuuauggaauu

SEQ ID NO: 2769043 - RNA, 14 nt, Human
auaguaauucucag

SEQ ID NO: 2769044 - RNA, 19 nt, Human
auaguaacuucuuauggaa

SEQ ID NO: 2769045 - RNA, 16 nt, Human
auaguaaccuggguaa

SEQ ID NO: 2769046 - RNA, 13 nt, Human
auaguaacuccca

SEQ ID NO: 2769047 - RNA, 16 nt, Human
auaguaacugacauga

SEQ ID NO: 2769048 - RNA, 19 nt, Human
auaguaacugacaugauua

SEQ ID NO: 2769049 - RNA, 20 nt, Human
auaguaacugacaugauuag

SEQ ID NO: 2769050 - RNA, 23 nt, Human
auagguuuuccccucuuuuguua

SEQ ID NO: 2769051 - RNA, 13 nt, Human
auaguaaaaauaa

SEQ ID NO: 2769052 - RNA, 14 nt, Human
auaguaaaaauaaa

SEQ ID NO: 2769053 - RNA, 15 nt, Human
auaguacuaagcauu

SEQ ID NO: 2769054 - RNA, 16 nt, Human
auaguacuaagcauuu

SEQ ID NO: 2769055 - RNA, 14 nt, Human
auaguacuggcaug

SEQ ID NO: 2769056 - RNA, 21 nt, Human
auaguagagugauauggagca

SEQ ID NO: 2769057 - RNA, 22 nt, Human
auaguagagugauauggagcaa

SEQ ID NO: 2769058 - RNA, 20 nt, Human
auaguacaugauaaaugaua

SEQ ID NO: 2769059 - RNA, 14 nt, Human
auauaaguuugaag

SEQ ID NO: 2769060 - RNA, 17 nt, Human
auauaaguuugaaggaa

SEQ ID NO: 2769061 - RNA, 19 nt, Human
auauaaguuugaaggaaac

SEQ ID NO: 2769062 - RNA, 21 nt, Human
auauaaguuugaaggaaacag

SEQ ID NO: 2769063 - RNA, 22 nt, Human
auauaauaaaauguguugaaac

SEQ ID NO: 2769064 - RNA, 16 nt, Human
auauacaauaacauaa

SEQ ID NO: 2769065 - RNA, 18 nt, Human
auauacaauaacauaauu

SEQ ID NO: 2769066 - RNA, 13 nt, Human
auauacaauaaug

SEQ ID NO: 2769067 - RNA, 14 nt, Human
auauacaauaaugg

SEQ ID NO: 2769068 - RNA, 15 nt, Human
auauacaauaaugga

SEQ ID NO: 2769069 - RNA, 16 nt, Human
auauacaauaauggaa

SEQ ID NO: 2769070 - RNA, 17 nt, Human
auauacaauaauggaaa

SEQ ID NO: 2769071 - RNA, 20 nt, Human
auauacaauaauggaaaaaa

SEQ ID NO: 2769072 - RNA, 16 nt, Human
auauaauggaagagaa

SEQ ID NO: 2769073 - RNA, 19 nt, Human
auauaauggaagagaaauc

SEQ ID NO: 2769074 - RNA, 22 nt, Human
auauaauggaagagaaaucuca

SEQ ID NO: 2769075 - RNA, 17 nt, Human
auauaauauauuugugu

SEQ ID NO: 2769076 - RNA, 20 nt, Human
auauaauauauuuguguauu

SEQ ID NO: 2769077 - RNA, 17 nt, Human
auauaauaucuaaaguu

SEQ ID NO: 2769078 - RNA, 20 nt, Human
auauaauaucuaaaguuaua

SEQ ID NO: 2769079 - RNA, 20 nt, Human
auauaauauauauauauauc

SEQ ID NO: 2769080 - RNA, 23 nt, Human
auauaauauauauauauaucagu

SEQ ID NO: 2769081 - RNA, 23 nt, Human
auauacaguaacuuuauguguaa

SEQ ID NO: 2769082 - RNA, 13 nt, Human
auauacagaggaa

SEQ ID NO: 2769083 - RNA, 14 nt, Human
auauacagaggaaa

SEQ ID NO: 2769084 - RNA, 13 nt, Human
auauacagaugaa

SEQ ID NO: 2769085 - RNA, 15 nt, Human
auauacagaugaaaa

SEQ ID NO: 2769086 - RNA, 16 nt, Human
auauacagaugaaaau

SEQ ID NO: 2769087 - RNA, 17 nt, Human
auauacagaugaaaauu

SEQ ID NO: 2769088 - RNA, 18 nt, Human
auauacagaugaaaauuu

SEQ ID NO: 2769089 - RNA, 21 nt, Human
auauacagaugaaaauuugag

SEQ ID NO: 2769090 - RNA, 22 nt, Human
auauacagaugaaaauuugaga

SEQ ID NO: 2769091 - RNA, 15 nt, Human
auauacacacacaca

SEQ ID NO: 2769092 - RNA, 16 nt, Human
auauacacauauaccu

SEQ ID NO: 2769093 - RNA, 12 nt, Human
auauacacacac

SEQ ID NO: 2769094 - RNA, 13 nt, Human
auauacacacaca

SEQ ID NO: 2769095 - RNA, 14 nt, Human
auauacaguaacuu

SEQ ID NO: 2769096 - RNA, 16 nt, Human
auauacaguaacuuua

SEQ ID NO: 2769097 - RNA, 17 nt, Human
auauacaguaacuuuau

SEQ ID NO: 2769098 - RNA, 22 nt, Human
auauacaguaacuuuaugugua

SEQ ID NO: 2769099 - RNA, 19 nt, Human
aguccucuuuucugagagg

SEQ ID NO: 2769100 - RNA, 23 nt, Human
aguccaaauguccuccagaagcc

SEQ ID NO: 2769101 - RNA, 19 nt, Human
aguccaaauguccuccaga

SEQ ID NO: 2769102 - RNA, 22 nt, Human
aguccucuuuucugagaggacu

SEQ ID NO: 2769103 - RNA, 19 nt, Human
aguccaagaggguccuuua

SEQ ID NO: 2769104 - RNA, 14 nt, Human
aguccaagaaucca

SEQ ID NO: 2769105 - RNA, 16 nt, Human
aguccaagaccagacu

SEQ ID NO: 2769106 - RNA, 15 nt, Human
agucauguaaauacu

SEQ ID NO: 2769107 - RNA, 16 nt, Human
agucauguaaauacug

SEQ ID NO: 2769108 - RNA, 18 nt, Human
agucauguaaauacuguu

SEQ ID NO: 2769109 - RNA, 21 nt, Human
agucaugcauaaauaugcagu

SEQ ID NO: 2769110 - RNA, 22 nt, Human
agucaugcauaaauaugcagug

SEQ ID NO: 2769111 - RNA, 21 nt, Human
aguccaaaaagcuccuggggc

SEQ ID NO: 2769112 - RNA, 16 nt, Human
aguccaaauguccucc

SEQ ID NO: 2769113 - RNA, 22 nt, Human
agucauguuuuaaauguacagu

SEQ ID NO: 2769114 - RNA, 13 nt, Human
agucaugugcauu

SEQ ID NO: 2769115 - RNA, 19 nt, Human
agucaugcguuuaaucaca

SEQ ID NO: 2769116 - RNA, 16 nt, Human
agucaugcauaaauau

SEQ ID NO: 2769117 - RNA, 17 nt, Human
agucaugcauaaauaug

SEQ ID NO: 2769118 - RNA, 19 nt, Human
agucaugcauaaauaugca

SEQ ID NO: 2769119 - RNA, 20 nt, Human
agucaugcauaaauaugcag

SEQ ID NO: 2769120 - RNA, 17 nt, Human
agucaugcaaaggcugg

SEQ ID NO: 2769121 - RNA, 18 nt, Human
agucaugcaaaggcuggg

SEQ ID NO: 2769122 - RNA, 19 nt, Human
agucaugcaaaggcuggga

SEQ ID NO: 2769123 - RNA, 20 nt, Human
agucaugcaaaggcugggac

SEQ ID NO: 2769124 - RNA, 13 nt, Human
agucaugcauaaa

SEQ ID NO: 2769125 - RNA, 14 nt, Human
agucaugcauaaau

SEQ ID NO: 2769126 - RNA, 11 nt, Human
aguccuuccac

SEQ ID NO: 2769127 - RNA, 14 nt, Human
aguccuugaaaaua

SEQ ID NO: 2769128 - RNA, 22 nt, Human
aguccuugaaaauauuuuuuau

SEQ ID NO: 2769129 - RNA, 16 nt, Human
aguccuugaaaauauu

SEQ ID NO: 2769130 - RNA, 17 nt, Human
aguccuugaaaauauuu

SEQ ID NO: 2769131 - RNA, 16 nt, Human
agucugaaugcugcca

SEQ ID NO: 2769132 - RNA, 17 nt, Human
agucugaaugcugccac

SEQ ID NO: 2769133 - RNA, 12 nt, Human
agucugugugaa

SEQ ID NO: 2769134 - RNA, 11 nt, Human
agucuguguga

SEQ ID NO: 2769135 - RNA, 20 nt, Human
agugaauucuugaaggaaaa

SEQ ID NO: 2769136 - RNA, 16 nt, Human
agucuguuguguguca

SEQ ID NO: 2769137 - RNA, 13 nt, Human
agucuguugugug

SEQ ID NO: 2769138 - RNA, 21 nt, Human
agucugugugaugaacuuucu

SEQ ID NO: 2769139 - RNA, 22 nt, Human
agucugugugaugaacuuucuc

SEQ ID NO: 2769140 - RNA, 15 nt, Human
agucugugugaaggu

SEQ ID NO: 2769141 - RNA, 18 nt, Human
agucugugugaugaacuu

SEQ ID NO: 2769142 - RNA, 19 nt, Human
agucugugugaugaacuuu

SEQ ID NO: 2769143 - RNA, 17 nt, Human
agugaccucagcuuuga

SEQ ID NO: 2769144 - RNA, 13 nt, Human
agugacccuuccc

SEQ ID NO: 2769145 - RNA, 21 nt, Human
agugacccuucccaaucagca

SEQ ID NO: 2769146 - RNA, 18 nt, Human
agugaccucagcuuugau

SEQ ID NO: 2769147 - RNA, 14 nt, Human
agugaccuguuuau

SEQ ID NO: 2769148 - RNA, 14 nt, Human
agugacgugcaccu

SEQ ID NO: 2769149 - RNA, 14 nt, Human
aguauuuuuaucca

SEQ ID NO: 2769150 - RNA, 19 nt, Human
aguauuuuuauacaaaccu

SEQ ID NO: 2769151 - RNA, 13 nt, Human
aguauuuuuauaa

SEQ ID NO: 2769152 - RNA, 22 nt, Human
aguauuuuuauaaauauaagcc

SEQ ID NO: 2769153 - RNA, 22 nt, Human
aguaucuauauauguguaugua

SEQ ID NO: 2769154 - RNA, 23 nt, Human
aguaucuauauauguguauguac

SEQ ID NO: 2769155 - RNA, 17 nt, Human
aguaucuauauaugugu

SEQ ID NO: 2769156 - RNA, 18 nt, Human
aguaucuauauaugugua

SEQ ID NO: 2769157 - RNA, 19 nt, Human
aguaucuauauauguguau

SEQ ID NO: 2769158 - RNA, 14 nt, Human
aguaucuaaaagug

SEQ ID NO: 2769159 - RNA, 18 nt, Human
aguaucccacauccaacu

SEQ ID NO: 2769160 - RNA, 12 nt, Human
aguaucccacau

SEQ ID NO: 2769161 - RNA, 23 nt, Human
aguauccaggcuuuguacagagu

SEQ ID NO: 2769162 - RNA, 21 nt, Human
aguauccaugcucuugaccuu

SEQ ID NO: 2769163 - RNA, 11 nt, Human
aguauccaggc

SEQ ID NO: 2769164 - RNA, 14 nt, Human
aguauccacuuugc

SEQ ID NO: 2769165 - RNA, 16 nt, Human
aguacuugaaaaagua

SEQ ID NO: 2769166 - RNA, 18 nt, Human
aguacuugaguguaaugu

SEQ ID NO: 2769167 - RNA, 20 nt, Human
aguacuugaguguaauguuu

SEQ ID NO: 2769168 - RNA, 22 nt, Human
aguacuugaguguaauguuugu

SEQ ID NO: 2769169 - RNA, 18 nt, Human
aguacuugugaaacacag

SEQ ID NO: 2769170 - RNA, 20 nt, Human
aguacuugugaaacacagcu

SEQ ID NO: 2769171 - RNA, 21 nt, Human
aguacuugugaaacacagcug

SEQ ID NO: 2769172 - RNA, 22 nt, Human
aguacuugugaaacacagcugu

SEQ ID NO: 2769173 - RNA, 23 nt, Human
aguacuugugaaacacagcuguu

SEQ ID NO: 2769174 - RNA, 24 nt, Human
aguacuugugaaacacagcuguuc

SEQ ID NO: 2769175 - RNA, 17 nt, Human
agucaaaacuacaaauc

SEQ ID NO: 2769176 - RNA, 17 nt, Human
agucaauauuuuuagau

SEQ ID NO: 2769177 - RNA, 14 nt, Human
agucaaucauuucu

SEQ ID NO: 2769178 - RNA, 15 nt, Human
agucaaucauuucuc

SEQ ID NO: 2769179 - RNA, 16 nt, Human
agucaaucauuucuca

SEQ ID NO: 2769180 - RNA, 17 nt, Human
agucaaucauuucucac

SEQ ID NO: 2769181 - RNA, 22 nt, Human
agucaaucauuucucacugugu

SEQ ID NO: 2769182 - RNA, 22 nt, Human
agucacacaguauuacuucugc

SEQ ID NO: 2769183 - RNA, 13 nt, Human
agucacaauguuc

SEQ ID NO: 2769184 - RNA, 16 nt, Human
agucacaauguucuuu

SEQ ID NO: 2769185 - RNA, 18 nt, Human
agucacaauguucuuuau

SEQ ID NO: 2769186 - RNA, 23 nt, Human
agucacaauguucuuuauauaca

SEQ ID NO: 2769187 - RNA, 18 nt, Human
aguacuguaauaauaccu

SEQ ID NO: 2769188 - RNA, 20 nt, Human
aguacuguaauaauaccuca

SEQ ID NO: 2769189 - RNA, 21 nt, Human
aguacuguaauaauaccucaa

SEQ ID NO: 2769190 - RNA, 23 nt, Human
aguacuguaauaauaccucaaug

SEQ ID NO: 2769191 - RNA, 20 nt, Human
aguacuggcugauggaguaa

SEQ ID NO: 2769192 - RNA, 22 nt, Human
aguacuucuccacccugcucuc

SEQ ID NO: 2769193 - RNA, 12 nt, Human
aguacuucuuuu

SEQ ID NO: 2769194 - RNA, 17 nt, Human
aguacuucuccacccug

SEQ ID NO: 2769195 - RNA, 15 nt, Human
aguacuguguacugu

SEQ ID NO: 2769196 - RNA, 17 nt, Human
aguacuguuuaccauuu

SEQ ID NO: 2769197 - RNA, 21 nt, Human
aguacuguuuaccauuuuuca

SEQ ID NO: 2769198 - RNA, 15 nt, Human
aguacuucagcaaga

SEQ ID NO: 2769199 - RNA, 17 nt, Human
aguacuucagcaagaga

SEQ ID NO: 2769200 - RNA, 18 nt, Human
aguacuucagcaagagag

SEQ ID NO: 2769201 - RNA, 19 nt, Human
aguacuucagcaagagaga

SEQ ID NO: 2769202 - RNA, 21 nt, Human
aguacuucagcaagagagaac

SEQ ID NO: 2769203 - RNA, 22 nt, Human
aguacuucagcaagagagaacc

SEQ ID NO: 2769204 - RNA, 14 nt, Human
aguacuaagaguau

SEQ ID NO: 2769205 - RNA, 14 nt, Human
aguacuaagcauuu

SEQ ID NO: 2769206 - RNA, 16 nt, Human
aguacuacacauuuuu

SEQ ID NO: 2769207 - RNA, 22 nt, Human
aguacuacacauuuuuaaauug

SEQ ID NO: 2769208 - RNA, 23 nt, Human
aguacuacacauuuuuaaauugu

SEQ ID NO: 2769209 - RNA, 17 nt, Human
aguacuaacacaaggac

SEQ ID NO: 2769210 - RNA, 18 nt, Human
aguacuaacacaaggaca

SEQ ID NO: 2769211 - RNA, 22 nt, Human
aguaaaugcuagguuaauucca

SEQ ID NO: 2769212 - RNA, 11 nt, Human
aguaaaugcua

SEQ ID NO: 2769213 - RNA, 23 nt, Human
aguaaaugcuagguuaauuccaa

SEQ ID NO: 2769214 - RNA, 22 nt, Human
aguaaauggcuuauccagcugg

SEQ ID NO: 2769215 - RNA, 15 nt, Human
aguaaaucuuuuaca

SEQ ID NO: 2769216 - RNA, 19 nt, Human
aguaacaaugaagauaaaa

SEQ ID NO: 2769217 - RNA, 10 nt, Human
aguaaauguu

SEQ ID NO: 2769218 - RNA, 22 nt, Human
aguaaauguuaucuuauacugu

SEQ ID NO: 2769219 - RNA, 23 nt, Human
aguaaauguuaucuuauacugua

SEQ ID NO: 2769220 - RNA, 11 nt, Human
aguaaaugucu

SEQ ID NO: 2769221 - RNA, 12 nt, Human
aguaaaugucuu

SEQ ID NO: 2769222 - RNA, 15 nt, Human
aguaaaugucuuugu

SEQ ID NO: 2769223 - RNA, 16 nt, Human
aguaaaugucuuugua

SEQ ID NO: 2769224 - RNA, 17 nt, Human
aguaaaugucuuuguaa

SEQ ID NO: 2769225 - RNA, 18 nt, Human
aguaaaugucuuuguaag

SEQ ID NO: 2769226 - RNA, 19 nt, Human
aguaaaugucuuuguaagu

SEQ ID NO: 2769227 - RNA, 17 nt, Human
aguaaaucagauguuga

SEQ ID NO: 2769228 - RNA, 18 nt, Human
aguaaaucagauguugaa

SEQ ID NO: 2769229 - RNA, 14 nt, Human
aguaagaggcugga

SEQ ID NO: 2769230 - RNA, 24 nt, Human
aguaagacauugggucuauuccag

SEQ ID NO: 2769231 - RNA, 11 nt, Human
aguaagagacu

SEQ ID NO: 2769232 - RNA, 15 nt, Human
aguaacauaauaaau

SEQ ID NO: 2769233 - RNA, 22 nt, Human
aguaacaucaaagauuagguga

SEQ ID NO: 2769234 - RNA, 23 nt, Human
aguaacaggaaaccacuuaucac

SEQ ID NO: 2769235 - RNA, 17 nt, Human
aguaagaaauuucaggu

SEQ ID NO: 2769236 - RNA, 18 nt, Human
aguaagaaauuucagguu

SEQ ID NO: 2769237 - RNA, 14 nt, Human
aguaaccauuugca

SEQ ID NO: 2769238 - RNA, 12 nt, Human
agugggccaggg

SEQ ID NO: 2769239 - RNA, 14 nt, Human
agugggccagggcu

SEQ ID NO: 2769240 - RNA, 15 nt, Human
agugggccagggcug

SEQ ID NO: 2769241 - RNA, 22 nt, Human
agugggccagggcugcccugag

SEQ ID NO: 2769242 - RNA, 20 nt, Human
agugggcagagcccccagga

SEQ ID NO: 2769243 - RNA, 20 nt, Human
agugggaucugucacaccag

SEQ ID NO: 2769244 - RNA, 12 nt, Human
agugggagguca

SEQ ID NO: 2769245 - RNA, 14 nt, Human
agugucuaaaaaca

SEQ ID NO: 2769246 - RNA, 14 nt, Human
agugucaggaggaa

SEQ ID NO: 2769247 - RNA, 13 nt, Human
agugucauuucca

SEQ ID NO: 2769248 - RNA, 12 nt, Human
agugucauguuu

SEQ ID NO: 2769249 - RNA, 18 nt, Human
agugggaacucugacaag

SEQ ID NO: 2769250 - RNA, 19 nt, Human
agugggacagggcauggcc

SEQ ID NO: 2769251 - RNA, 21 nt, Human
agugggacagggcauggccag

SEQ ID NO: 2769252 - RNA, 15 nt, Human
agugggacccauaga

SEQ ID NO: 2769253 - RNA, 18 nt, Human
agugggacccauagaucu

SEQ ID NO: 2769254 - RNA, 21 nt, Human
agugggacccauagaucuucu

SEQ ID NO: 2769255 - RNA, 22 nt, Human
agugggacccauagaucuucug

SEQ ID NO: 2769256 - RNA, 23 nt, Human
agugggacccauagaucuucuga

SEQ ID NO: 2769257 - RNA, 16 nt, Human
agugggagcugccugu

SEQ ID NO: 2769258 - RNA, 23 nt, Human
aguggccuggccaggagcucuuc

SEQ ID NO: 2769259 - RNA, 22 nt, Human
aguggccuggccaggagcucuu

SEQ ID NO: 2769260 - RNA, 18 nt, Human
aguggccuuaccccugcc

SEQ ID NO: 2769261 - RNA, 20 nt, Human
aguggccuuaccccugccuu

SEQ ID NO: 2769262 - RNA, 20 nt, Human
aguggccuggccaggagcuc

SEQ ID NO: 2769263 - RNA, 19 nt, Human
aguggccuggccaggagcu

SEQ ID NO: 2769264 - RNA, 18 nt, Human
aguggccuggccaggagc

SEQ ID NO: 2769265 - RNA, 15 nt, Human
aguggccuggccagg

SEQ ID NO: 2769266 - RNA, 14 nt, Human
aguggccuggccag

SEQ ID NO: 2769267 - RNA, 13 nt, Human
aguggccuggcca

SEQ ID NO: 2769268 - RNA, 16 nt, Human
agugucaccuuuucuu

SEQ ID NO: 2769269 - RNA, 24 nt, Human
agugauccucccaccucagccucc

SEQ ID NO: 2769270 - RNA, 23 nt, Human
agugauccucccaccucagccuc

SEQ ID NO: 2769271 - RNA, 18 nt, Human
agugauccucccaccuca

SEQ ID NO: 2769272 - RNA, 15 nt, Human
agugauccucccacc

SEQ ID NO: 2769273 - RNA, 14 nt, Human
agugauccucccac

SEQ ID NO: 2769274 - RNA, 17 nt, Human
agugauucuccugccuc

SEQ ID NO: 2769275 - RNA, 15 nt, Human
agugauucuccugcc

SEQ ID NO: 2769276 - RNA, 17 nt, Human
agugaugggcuuucucu

SEQ ID NO: 2769277 - RNA, 19 nt, Human
agugaugggcuuucucuuu

SEQ ID NO: 2769278 - RNA, 14 nt, Human
agugauucuccugc

SEQ ID NO: 2769279 - RNA, 21 nt, Human
agugauucucaugccucagcc

SEQ ID NO: 2769280 - RNA, 22 nt, Human
agugaucuacaugaggaacugu

SEQ ID NO: 2769281 - RNA, 20 nt, Human
aguucagaguccuuaaaaug

SEQ ID NO: 2769282 - RNA, 12 nt, Human
aguucagaguuu

SEQ ID NO: 2769283 - RNA, 15 nt, Human
aguucagaguuuucu

SEQ ID NO: 2769284 - RNA, 16 nt, Human
aguucagaguuuucug

SEQ ID NO: 2769285 - RNA, 17 nt, Human
aguucagaguuuucugg

SEQ ID NO: 2769286 - RNA, 18 nt, Human
aguucagguaacaggcag

SEQ ID NO: 2769287 - RNA, 18 nt, Human
aguucagcaccacccuag

SEQ ID NO: 2769288 - RNA, 14 nt, Human
aguucagcacuugu

SEQ ID NO: 2769289 - RNA, 21 nt, Human
aguucagcacuugucucauuu

SEQ ID NO: 2769290 - RNA, 17 nt, Human
aguucagcaccacccua

SEQ ID NO: 2769291 - RNA, 15 nt, Human
aguucagcaccaccc

SEQ ID NO: 2769292 - RNA, 16 nt, Human
aguucaggagucccaa

SEQ ID NO: 2769293 - RNA, 20 nt, Human
aguucaggagucccaaggaa

SEQ ID NO: 2769294 - RNA, 19 nt, Human
aguucaggagucccaagga

SEQ ID NO: 2769295 - RNA, 21 nt, Human
aguucaggagucccaaggaaa

SEQ ID NO: 2769296 - RNA, 17 nt, Human
aguugacaugagauuua

SEQ ID NO: 2769297 - RNA, 15 nt, Human
aguugacuuauagua

SEQ ID NO: 2769298 - RNA, 22 nt, Human
aguugacaaaaagcucuuacac

SEQ ID NO: 2769299 - RNA, 17 nt, Human
aguugacaccugagaaa

SEQ ID NO: 2769300 - RNA, 21 nt, Human
aguugacuuauaguacaugau

SEQ ID NO: 2769301 - RNA, 18 nt, Human
aguugacuuauaguacau

SEQ ID NO: 2769302 - RNA, 17 nt, Human
aguugacuuauaguaca

SEQ ID NO: 2769303 - RNA, 20 nt, Human
aguugagucgucaucacuuu

SEQ ID NO: 2769304 - RNA, 16 nt, Human
aguugaggaacuguac

SEQ ID NO: 2769305 - RNA, 18 nt, Human
aguugaggaacuguacag

SEQ ID NO: 2769306 - RNA, 20 nt, Human
aguuguccauauuuucacag

SEQ ID NO: 2769307 - RNA, 13 nt, Human
aguugucuaaaca

SEQ ID NO: 2769308 - RNA, 14 nt, Human
aguugucucucuuc

SEQ ID NO: 2769309 - RNA, 15 nt, Human
aguugucucucuuca

SEQ ID NO: 2769310 - RNA, 21 nt, Human
aguugucucucuucagacucu

SEQ ID NO: 2769311 - RNA, 14 nt, Human
aguugugaaaguuu

SEQ ID NO: 2769312 - RNA, 17 nt, Human
aguugugaaaguuuuga

SEQ ID NO: 2769313 - RNA, 20 nt, Human
aguugugaaaguuuugagua

SEQ ID NO: 2769314 - RNA, 15 nt, Human
aguugugcacgcaga

SEQ ID NO: 2769315 - RNA, 14 nt, Human
aguugugcagcuuu

SEQ ID NO: 2769316 - RNA, 20 nt, Human
aguugugcagcuuuugguca

SEQ ID NO: 2769317 - RNA, 21 nt, Human
aguugugcagcuuuuggucau

SEQ ID NO: 2769318 - RNA, 13 nt, Human
aguugugaucauc

SEQ ID NO: 2769319 - RNA, 21 nt, Human
aguugugccuuuuauagcuau

SEQ ID NO: 2769320 - RNA, 22 nt, Human
aguugugccuuuuauagcuauu

SEQ ID NO: 2769321 - RNA, 15 nt, Human
aguugugccuuuuau

SEQ ID NO: 2769322 - RNA, 18 nt, Human
aguugugccuuuuauagc

SEQ ID NO: 2769323 - RNA, 19 nt, Human
aguugugccuuuuauagcu

SEQ ID NO: 2769324 - RNA, 18 nt, Human
augaaaaugaguugugaa

SEQ ID NO: 2769325 - RNA, 19 nt, Human
augaaaaugaguugugaaa

SEQ ID NO: 2769326 - RNA, 20 nt, Human
augaaaaugaguugugaaag

SEQ ID NO: 2769327 - RNA, 21 nt, Human
augaaaaugaguugugaaagu

SEQ ID NO: 2769328 - RNA, 16 nt, Human
augaagugcgugaaug

SEQ ID NO: 2769329 - RNA, 18 nt, Human
augaagugcgugaaugua

SEQ ID NO: 2769330 - RNA, 20 nt, Human
augaagugcgugaauguaug

SEQ ID NO: 2769331 - RNA, 23 nt, Human
augaaguguguuuccuucagugc

SEQ ID NO: 2769332 - RNA, 19 nt, Human
augaaguguguuuccuuca

SEQ ID NO: 2769333 - RNA, 17 nt, Human
augaaguaucuaaaagu

SEQ ID NO: 2769334 - RNA, 21 nt, Human
augaaguaucuaaaaguguca

SEQ ID NO: 2769335 - RNA, 15 nt, Human
augacccaggcuggg

SEQ ID NO: 2769336 - RNA, 14 nt, Human
augacccaggcugg

SEQ ID NO: 2769337 - RNA, 12 nt, Human
augacccaggcu

SEQ ID NO: 2769338 - RNA, 21 nt, Human
augaccagaugcgucccaaga

SEQ ID NO: 2769339 - RNA, 18 nt, Human
augaccagaugcguccca

SEQ ID NO: 2769340 - RNA, 17 nt, Human
augaccauacugaggga

SEQ ID NO: 2769341 - RNA, 15 nt, Human
augaaguguuagaua

SEQ ID NO: 2769342 - RNA, 18 nt, Human
augaaguguuagauagaa

SEQ ID NO: 2769343 - RNA, 17 nt, Human
augaaguuacuuucuua

SEQ ID NO: 2769344 - RNA, 20 nt, Human
augaaguuacuuucuuaaug

SEQ ID NO: 2769345 - RNA, 15 nt, Human
augaaguuguaggua

SEQ ID NO: 2769346 - RNA, 15 nt, Human
augaaguuuaaaaca

SEQ ID NO: 2769347 - RNA, 20 nt, Human
augaaguuuaaaacaguauu

SEQ ID NO: 2769348 - RNA, 21 nt, Human
augaaguuuaaaacaguauuu

SEQ ID NO: 2769349 - RNA, 22 nt, Human
augaaguuuaaaacaguauuua

SEQ ID NO: 2769350 - RNA, 15 nt, Human
augaccacacuccag

SEQ ID NO: 2769351 - RNA, 18 nt, Human
augaccacacuccagcug

SEQ ID NO: 2769352 - RNA, 18 nt, Human
augaaaauauuuuuuaca

SEQ ID NO: 2769353 - RNA, 21 nt, Human
augacugcuccccagcccugg

SEQ ID NO: 2769354 - RNA, 13 nt, Human
augacuaauuagg

SEQ ID NO: 2769355 - RNA, 21 nt, Human
augacuaauuaggguacauuu

SEQ ID NO: 2769356 - RNA, 23 nt, Human
augacuaauuaggguacauuuau

SEQ ID NO: 2769357 - RNA, 22 nt, Human
augacugugcuacugucuuugg

SEQ ID NO: 2769358 - RNA, 13 nt, Human
augacuguagaau

SEQ ID NO: 2769359 - RNA, 17 nt, Human
augacuguagaauuugu

SEQ ID NO: 2769360 - RNA, 22 nt, Human
augacugcuccccagcccuggc

SEQ ID NO: 2769361 - RNA, 23 nt, Human
augacugcuccccagcccuggcu

SEQ ID NO: 2769362 - RNA, 13 nt, Human
augacuggcauuu

SEQ ID NO: 2769363 - RNA, 14 nt, Human
augacuggcauuuu

SEQ ID NO: 2769364 - RNA, 15 nt, Human
augacuggcauuuua

SEQ ID NO: 2769365 - RNA, 16 nt, Human
augacuggcauuuuau

SEQ ID NO: 2769366 - RNA, 20 nt, Human
augacuggcauuuuauagac

SEQ ID NO: 2769367 - RNA, 18 nt, Human
augacuggggugggaggu

SEQ ID NO: 2769368 - RNA, 16 nt, Human
augagggaugggccug

SEQ ID NO: 2769369 - RNA, 17 nt, Human
augagggaugggccugg

SEQ ID NO: 2769370 - RNA, 18 nt, Human
augagggaugggccuggc

SEQ ID NO: 2769371 - RNA, 20 nt, Human
augaggguaucaaauaaaau

SEQ ID NO: 2769372 - RNA, 16 nt, Human
aucuaguuuacagaaa

SEQ ID NO: 2769373 - RNA, 17 nt, Human
aucuaguuuacagaaaa

SEQ ID NO: 2769374 - RNA, 18 nt, Human
aucuaguuuacagaaaaa

SEQ ID NO: 2769375 - RNA, 20 nt, Human
aucuaguuuacagaaaaauc

SEQ ID NO: 2769376 - RNA, 22 nt, Human
aucuaguuuacagaaaaaucuu

SEQ ID NO: 2769377 - RNA, 13 nt, Human
aucuauaaagaag

SEQ ID NO: 2769378 - RNA, 16 nt, Human
aucuauaaagaagaac

SEQ ID NO: 2769379 - RNA, 12 nt, Human
aucuauaaagcg

SEQ ID NO: 2769380 - RNA, 21 nt, Human
aucuauaaagcgauauacaga

SEQ ID NO: 2769381 - RNA, 11 nt, Human
aucuaguguug

SEQ ID NO: 2769382 - RNA, 22 nt, Human
aucuaguaagacguaaggggaa

SEQ ID NO: 2769383 - RNA, 16 nt, Human
aucuagguaauuuuua

SEQ ID NO: 2769384 - RNA, 14 nt, Human
aucuaggcaugaag

SEQ ID NO: 2769385 - RNA, 20 nt, Human
aucuaggcaugaagagcaaa

SEQ ID NO: 2769386 - RNA, 17 nt, Human
aucuccuagggcuaugg

SEQ ID NO: 2769387 - RNA, 17 nt, Human
aucuccuauaaucuguc

SEQ ID NO: 2769388 - RNA, 18 nt, Human
aucuccuauaaucuguca

SEQ ID NO: 2769389 - RNA, 19 nt, Human
aucuccuauaaucugucaa

SEQ ID NO: 2769390 - RNA, 20 nt, Human
aucuccuauaaucugucaaa

SEQ ID NO: 2769391 - RNA, 21 nt, Human
aucuccuauaaucugucaaaa

SEQ ID NO: 2769392 - RNA, 14 nt, Human
aucuauuuuggauu

SEQ ID NO: 2769393 - RNA, 17 nt, Human
aucuccugacagaaggu

SEQ ID NO: 2769394 - RNA, 18 nt, Human
aucuccugacagaaggug

SEQ ID NO: 2769395 - RNA, 15 nt, Human
aucuccugacagaag

SEQ ID NO: 2769396 - RNA, 15 nt, Human
aucucucccuccccu

SEQ ID NO: 2769397 - RNA, 14 nt, Human
aucucucccucccc

SEQ ID NO: 2769398 - RNA, 23 nt, Human
aucucucccuccccugccauuuu

SEQ ID NO: 2769399 - RNA, 11 nt, Human
aucucucccuc

SEQ ID NO: 2769400 - RNA, 12 nt, Human
aucucucauccu

SEQ ID NO: 2769401 - RNA, 16 nt, Human
aucucucauccuccag

SEQ ID NO: 2769402 - RNA, 17 nt, Human
aucucucauccuccagu

SEQ ID NO: 2769403 - RNA, 21 nt, Human
aucucucauccuccaguaccu

SEQ ID NO: 2769404 - RNA, 17 nt, Human
aucucuauuuaauauuu

SEQ ID NO: 2769405 - RNA, 21 nt, Human
aucuccuguccaucagccagg

SEQ ID NO: 2769406 - RNA, 19 nt, Human
aucuccugucuuuucaggu

SEQ ID NO: 2769407 - RNA, 19 nt, Human
aucucuauuuaauauuuau

SEQ ID NO: 2769408 - RNA, 14 nt, Human
aucucucaaaacuu

SEQ ID NO: 2769409 - RNA, 15 nt, Human
aucucucaaaacuug

SEQ ID NO: 2769410 - RNA, 14 nt, Human
aucucucaaaucug

SEQ ID NO: 2769411 - RNA, 15 nt, Human
aucucucaaaucugu

SEQ ID NO: 2769412 - RNA, 16 nt, Human
aucucucaaaucuguu

SEQ ID NO: 2769413 - RNA, 17 nt, Human
aucucucaaaucuguua

SEQ ID NO: 2769414 - RNA, 19 nt, Human
aucucucaaaucuguuauc

SEQ ID NO: 2769415 - RNA, 18 nt, Human
aucucuauuuaauauuua

SEQ ID NO: 2769416 - RNA, 15 nt, Human
aucuauauaugugua

SEQ ID NO: 2769417 - RNA, 16 nt, Human
aucuauauauguguau

SEQ ID NO: 2769418 - RNA, 17 nt, Human
aucuauauauguguaug

SEQ ID NO: 2769419 - RNA, 15 nt, Human
aucuauauuuaacaa

SEQ ID NO: 2769420 - RNA, 18 nt, Human
aucuauauauguguaugu

SEQ ID NO: 2769421 - RNA, 19 nt, Human
aucuauauauguguaugua

SEQ ID NO: 2769422 - RNA, 21 nt, Human
aucuauaguugauauguuuua

SEQ ID NO: 2769423 - RNA, 13 nt, Human
aucuauuuauuaa

SEQ ID NO: 2769424 - RNA, 16 nt, Human
aucuauuuauuaaguu

SEQ ID NO: 2769425 - RNA, 13 nt, Human
aucuauuuaagua

SEQ ID NO: 2769426 - RNA, 15 nt, Human
aucuauuuauuaaua

SEQ ID NO: 2769427 - RNA, 19 nt, Human
aucuauuuauuaauauuua

SEQ ID NO: 2769428 - RNA, 17 nt, Human
aucuauuucacuuauuu

SEQ ID NO: 2769429 - RNA, 16 nt, Human
aucuauuugugugugu

SEQ ID NO: 2769430 - RNA, 13 nt, Human
aucuauuuucuau

SEQ ID NO: 2769431 - RNA, 14 nt, Human
aucuauuuucuaug

SEQ ID NO: 2769432 - RNA, 15 nt, Human
aucuauuuucuaugu

SEQ ID NO: 2769433 - RNA, 16 nt, Human
aucuauuuucuaugua

SEQ ID NO: 2769434 - RNA, 18 nt, Human
aucuauuuucuauguacu

SEQ ID NO: 2769435 - RNA, 20 nt, Human
aucuauuuucuauguacuag

SEQ ID NO: 2769436 - RNA, 22 nt, Human
aucuauuuucuauguacuagua

SEQ ID NO: 2769437 - RNA, 12 nt, Human
aucuauuuugau

SEQ ID NO: 2769438 - RNA, 16 nt, Human
aucuauuuugaugcag

SEQ ID NO: 2769439 - RNA, 17 nt, Human
aucuauuuugaugcagc

SEQ ID NO: 2769440 - RNA, 18 nt, Human
aucuauuuugaugcagca

SEQ ID NO: 2769441 - RNA, 20 nt, Human
aucuauuuugaugcagcauu

SEQ ID NO: 2769442 - RNA, 21 nt, Human
aucuauuuugaugcagcauuu

SEQ ID NO: 2769443 - RNA, 14 nt, Human
aucuuccauauuug

SEQ ID NO: 2769444 - RNA, 15 nt, Human
aucuuccauauuugg

SEQ ID NO: 2769445 - RNA, 16 nt, Human
aucuuccauauuugga

SEQ ID NO: 2769446 - RNA, 17 nt, Human
aucuuccauauuuggaa

SEQ ID NO: 2769447 - RNA, 18 nt, Human
aucuuccauauuuggaag

SEQ ID NO: 2769448 - RNA, 19 nt, Human
aucuuccauauuuggaaga

SEQ ID NO: 2769449 - RNA, 15 nt, Human
aucuucgggaccagg

SEQ ID NO: 2769450 - RNA, 18 nt, Human
aucuucgggaccaggauu

SEQ ID NO: 2769451 - RNA, 14 nt, Human
aucuucgucuucac

SEQ ID NO: 2769452 - RNA, 15 nt, Human
aucuucgucuucacu

SEQ ID NO: 2769453 - RNA, 16 nt, Human
aucuucgucuucacuc

SEQ ID NO: 2769454 - RNA, 22 nt, Human
aucuucgucuucacucuuaggc

SEQ ID NO: 2769455 - RNA, 21 nt, Human
aucuucuaaacccaauccaaa

SEQ ID NO: 2769456 - RNA, 20 nt, Human
aucuggagaccagggagccu

SEQ ID NO: 2769457 - RNA, 20 nt, Human
aucucugcacccuggggccu

SEQ ID NO: 2769458 - RNA, 23 nt, Human
aucucugcacccuggggccugga

SEQ ID NO: 2769459 - RNA, 21 nt, Human
aucuggagaccagggagccuu

SEQ ID NO: 2769460 - RNA, 22 nt, Human
aucuggagaccagggagccuuu

SEQ ID NO: 2769461 - RNA, 17 nt, Human
aucuggaggccuuccag

SEQ ID NO: 2769462 - RNA, 19 nt, Human
aucuggaggccuuccagcu

SEQ ID NO: 2769463 - RNA, 21 nt, Human
aucuggaggccuuccagcugc

SEQ ID NO: 2769464 - RNA, 22 nt, Human
aucuggaggccuuccagcugcu

SEQ ID NO: 2769465 - RNA, 23 nt, Human
aucuggaggccuuccagcugcug

SEQ ID NO: 2769466 - RNA, 17 nt, Human
aucuggauaggagccug

SEQ ID NO: 2769467 - RNA, 18 nt, Human
aucuggauaggagccugc

SEQ ID NO: 2769468 - RNA, 20 nt, Human
aucuggauaggagccugcug

SEQ ID NO: 2769469 - RNA, 21 nt, Human
aucuggauaggagccugcugg

SEQ ID NO: 2769470 - RNA, 22 nt, Human
aucuggauaggagccugcuggu

SEQ ID NO: 2769471 - RNA, 16 nt, Human
aucucugaagcauguu

SEQ ID NO: 2769472 - RNA, 17 nt, Human
aucucugaagcauguuu

SEQ ID NO: 2769473 - RNA, 19 nt, Human
aucucugaagcauguuuca

SEQ ID NO: 2769474 - RNA, 20 nt, Human
aucucugaagcauguuucau

SEQ ID NO: 2769475 - RNA, 11 nt, Human
aucucugaaag

SEQ ID NO: 2769476 - RNA, 13 nt, Human
aucucugaaagca

SEQ ID NO: 2769477 - RNA, 13 nt, Human
aucucugaagcau

SEQ ID NO: 2769478 - RNA, 22 nt, Human
aucuggacuccucuguccaggc

SEQ ID NO: 2769479 - RNA, 16 nt, Human
aucucugcuuuggaaa

SEQ ID NO: 2769480 - RNA, 16 nt, Human
aucuuauuuucaugua

SEQ ID NO: 2769481 - RNA, 23 nt, Human
aucuuauuuucauguauaugugu

SEQ ID NO: 2769482 - RNA, 15 nt, Human
aucuuauuuuucuaa

SEQ ID NO: 2769483 - RNA, 17 nt, Human
aucuuauuuuucuaaac

SEQ ID NO: 2769484 - RNA, 19 nt, Human
aucuuauuuuucuaaacgu

SEQ ID NO: 2769485 - RNA, 21 nt, Human
aucuuauuuuucuaaacguaa

SEQ ID NO: 2769486 - RNA, 17 nt, Human
aucuucaaaaguaaugc

SEQ ID NO: 2769487 - RNA, 19 nt, Human
aucuucaaaaguaaugccu

SEQ ID NO: 2769488 - RNA, 22 nt, Human
aucuucaaaaguaaugccucug

SEQ ID NO: 2769489 - RNA, 23 nt, Human
aucuucaaaaguaaugccucugu

SEQ ID NO: 2769490 - RNA, 24 nt, Human
aucuucaaaaguaaugccucuguc

SEQ ID NO: 2769491 - RNA, 12 nt, Human
aucuucacauag

SEQ ID NO: 2769492 - RNA, 19 nt, Human
aucuucacauaguucucca

SEQ ID NO: 2769493 - RNA, 13 nt, Human
aucuuauuuagga

SEQ ID NO: 2769494 - RNA, 14 nt, Human
aucuggguccuugc

SEQ ID NO: 2769495 - RNA, 18 nt, Human
aucuggguccuugcaccc

SEQ ID NO: 2769496 - RNA, 22 nt, Human
aucccuacccccuaagagccau

SEQ ID NO: 2769497 - RNA, 21 nt, Human
aucccuacccccuaagagcca

SEQ ID NO: 2769498 - RNA, 14 nt, Human
aucccuacccccua

SEQ ID NO: 2769499 - RNA, 22 nt, Human
auccccagggggcaugaccaga

SEQ ID NO: 2769500 - RNA, 21 nt, Human
auccccaggggucccagccac

SEQ ID NO: 2769501 - RNA, 19 nt, Human
auccccaggggucccagcc

SEQ ID NO: 2769502 - RNA, 15 nt, Human
aucccggcugcccuu

SEQ ID NO: 2769503 - RNA, 16 nt, Human
aucccuaaugcugcag

SEQ ID NO: 2769504 - RNA, 18 nt, Human
aucccuaaugugugccau

SEQ ID NO: 2769505 - RNA, 23 nt, Human
auccccaggggucccagccaccc

SEQ ID NO: 2769506 - RNA, 13 nt, Human
aucccguguucuc

SEQ ID NO: 2769507 - RNA, 16 nt, Human
aucccguguucuccuu

SEQ ID NO: 2769508 - RNA, 16 nt, Human
auccccaagccuggca

SEQ ID NO: 2769509 - RNA, 18 nt, Human
auccccaagccuggcaag

SEQ ID NO: 2769510 - RNA, 16 nt, Human
auccccaagugugaac

SEQ ID NO: 2769511 - RNA, 14 nt, Human
auccccaaguguga

SEQ ID NO: 2769512 - RNA, 19 nt, Human
aucccaugagccucagcau

SEQ ID NO: 2769513 - RNA, 15 nt, Human
aucccauguauuuau

SEQ ID NO: 2769514 - RNA, 18 nt, Human
aucccauuaaucauuucc

SEQ ID NO: 2769515 - RNA, 21 nt, Human
aucccauuaaucauuucccca

SEQ ID NO: 2769516 - RNA, 22 nt, Human
auccagaggcaaacggaggcaa

SEQ ID NO: 2769517 - RNA, 20 nt, Human
auccagaggguugugauuuu

SEQ ID NO: 2769518 - RNA, 16 nt, Human
auccacucccaggcag

SEQ ID NO: 2769519 - RNA, 19 nt, Human
auccagacccggcugcgug

SEQ ID NO: 2769520 - RNA, 21 nt, Human
auccacucuacccucccaccc

SEQ ID NO: 2769521 - RNA, 20 nt, Human
auccacucuacccucccacc

SEQ ID NO: 2769522 - RNA, 19 nt, Human
auccacucuacccucccac

SEQ ID NO: 2769523 - RNA, 18 nt, Human
auccacucuacccuccca

SEQ ID NO: 2769524 - RNA, 21 nt, Human
auccaccugucucagccuccc

SEQ ID NO: 2769525 - RNA, 21 nt, Human
auccacguauuccccuuccca

SEQ ID NO: 2769526 - RNA, 22 nt, Human
auccacguauuccccuucccac

SEQ ID NO: 2769527 - RNA, 18 nt, Human
auccaccugucucagccu

SEQ ID NO: 2769528 - RNA, 13 nt, Human
auccaccugucuc

SEQ ID NO: 2769529 - RNA, 16 nt, Human
auccacucuacccucc

SEQ ID NO: 2769530 - RNA, 13 nt, Human
auccacucgccuu

SEQ ID NO: 2769531 - RNA, 20 nt, Human
aucgcggcggagcuggcccc

SEQ ID NO: 2769532 - RNA, 22 nt, Human
aucgcggcggagcuggccccgc

SEQ ID NO: 2769533 - RNA, 23 nt, Human
aucgcgccacuacacuccagccu

SEQ ID NO: 2769534 - RNA, 17 nt, Human
auccuuuaaauccuucc

SEQ ID NO: 2769535 - RNA, 17 nt, Human
auccuuuacguguuuaa

SEQ ID NO: 2769536 - RNA, 12 nt, Human
auccuuguuuca

SEQ ID NO: 2769537 - RNA, 13 nt, Human
auccuuguuucaa

SEQ ID NO: 2769538 - RNA, 14 nt, Human
auccuuguuucaaa

SEQ ID NO: 2769539 - RNA, 16 nt, Human
auccuuguuucaaaca

SEQ ID NO: 2769540 - RNA, 23 nt, Human
auccuuguuucaaacacaaaugc

SEQ ID NO: 2769541 - RNA, 23 nt, Human
auccuuguuuugaaaaccuaaaa

SEQ ID NO: 2769542 - RNA, 19 nt, Human
aucgccagaggugcuucac

SEQ ID NO: 2769543 - RNA, 20 nt, Human
aucgccagaggugcuucacc

SEQ ID NO: 2769544 - RNA, 14 nt, Human
aucgcauugcauac

SEQ ID NO: 2769545 - RNA, 14 nt, Human
auccucagaugcuc

SEQ ID NO: 2769546 - RNA, 16 nt, Human
auccucacugcccucc

SEQ ID NO: 2769547 - RNA, 21 nt, Human
auccuuagagguccucuggag

SEQ ID NO: 2769548 - RNA, 20 nt, Human
auccuuagagguccucugga

SEQ ID NO: 2769549 - RNA, 19 nt, Human
auccuuagagguccucugg

SEQ ID NO: 2769550 - RNA, 18 nt, Human
auccuuagagguccucug

SEQ ID NO: 2769551 - RNA, 15 nt, Human
auccuuaucagagcu

SEQ ID NO: 2769552 - RNA, 16 nt, Human
auccuuaucagagcua

SEQ ID NO: 2769553 - RNA, 20 nt, Human
auccuuaucagagcuaaggg

SEQ ID NO: 2769554 - RNA, 13 nt, Human
auccuuagagguc

SEQ ID NO: 2769555 - RNA, 12 nt, Human
auccuucccaag

SEQ ID NO: 2769556 - RNA, 18 nt, Human
auccuucccaaguaagag

SEQ ID NO: 2769557 - RNA, 22 nt, Human
auccuucccaaguaagaggcug

SEQ ID NO: 2769558 - RNA, 23 nt, Human
auccuucccaaguaagaggcugg

SEQ ID NO: 2769559 - RNA, 16 nt, Human
auccuucccuuuggag

SEQ ID NO: 2769560 - RNA, 17 nt, Human
auccuucccuuuggaga

SEQ ID NO: 2769561 - RNA, 21 nt, Human
auccuucccuuuggagaugcu

SEQ ID NO: 2769562 - RNA, 20 nt, Human
auccuucaagaacucugggc

SEQ ID NO: 2769563 - RNA, 17 nt, Human
auccuucaucuuuuaaa

SEQ ID NO: 2769564 - RNA, 19 nt, Human
auccuucaucuuuuaaaga

SEQ ID NO: 2769565 - RNA, 18 nt, Human
auccuuccaaaaauuauu

SEQ ID NO: 2769566 - RNA, 19 nt, Human
auccuuccaaaaauuauua

SEQ ID NO: 2769567 - RNA, 20 nt, Human
auccuuccaaaaauuauuau

SEQ ID NO: 2769568 - RNA, 23 nt, Human
auccuuccaaaaauuauuauaag

SEQ ID NO: 2769569 - RNA, 14 nt, Human
auccuuccaaagaa

SEQ ID NO: 2769570 - RNA, 18 nt, Human
auccuuccaaagaauucu

SEQ ID NO: 2769571 - RNA, 20 nt, Human
auccuuccaaagaauucuua

SEQ ID NO: 2769572 - RNA, 22 nt, Human
auccuuccaaagaauucuuaua

SEQ ID NO: 2769573 - RNA, 16 nt, Human
auccuugacuggaccu

SEQ ID NO: 2769574 - RNA, 15 nt, Human
auccuuggucuuugu

SEQ ID NO: 2769575 - RNA, 17 nt, Human
auccuuggucuuuguau

SEQ ID NO: 2769576 - RNA, 18 nt, Human
auccuuggucuuuguauc

SEQ ID NO: 2769577 - RNA, 19 nt, Human
auccuuggucuuuguaucu

SEQ ID NO: 2769578 - RNA, 15 nt, Human
auccuuggcaccaaa

SEQ ID NO: 2769579 - RNA, 16 nt, Human
auccuuggcaccaaag

SEQ ID NO: 2769580 - RNA, 11 nt, Human
aucacacacac

SEQ ID NO: 2769581 - RNA, 11 nt, Human
aucacacacau

SEQ ID NO: 2769582 - RNA, 12 nt, Human
aucacacacaug

SEQ ID NO: 2769583 - RNA, 13 nt, Human
aucacacacaugg

SEQ ID NO: 2769584 - RNA, 14 nt, Human
aucacacacaugga

SEQ ID NO: 2769585 - RNA, 18 nt, Human
aucacacuucugugagac

SEQ ID NO: 2769586 - RNA, 16 nt, Human
aucacacuucugugag

SEQ ID NO: 2769587 - RNA, 14 nt, Human
aucacacuucugug

SEQ ID NO: 2769588 - RNA, 14 nt, Human
aucacacuauuuua

SEQ ID NO: 2769589 - RNA, 16 nt, Human
aucacacuauuuuaga

SEQ ID NO: 2769590 - RNA, 20 nt, Human
aucacaccaucgcuggcccc

SEQ ID NO: 2769591 - RNA, 21 nt, Human
aucacaccaucgcuggccccu

SEQ ID NO: 2769592 - RNA, 12 nt, Human
aucacagcagcc

SEQ ID NO: 2769593 - RNA, 14 nt, Human
aucacagcagccuc

SEQ ID NO: 2769594 - RNA, 18 nt, Human
aucacaggguugggccca

SEQ ID NO: 2769595 - RNA, 20 nt, Human
aucacaggguugggcccaga

SEQ ID NO: 2769596 - RNA, 19 nt, Human
aucacaggguugggcccag

SEQ ID NO: 2769597 - RNA, 14 nt, Human
aucacagcagcuuc

SEQ ID NO: 2769598 - RNA, 20 nt, Human
aucacagggcagagccggga

SEQ ID NO: 2769599 - RNA, 19 nt, Human
aucacaucuuuuaagacaa

SEQ ID NO: 2769600 - RNA, 23 nt, Human
aucacaggguugggcccagaucu

SEQ ID NO: 2769601 - RNA, 22 nt, Human
aucaccgacgcgucuccuguuu

SEQ ID NO: 2769602 - RNA, 20 nt, Human
aucaccgacgcgucuccugu

SEQ ID NO: 2769603 - RNA, 20 nt, Human
aucaccccaaccccccaaaa

SEQ ID NO: 2769604 - RNA, 13 nt, Human
aucaaaaugcuuu

SEQ ID NO: 2769605 - RNA, 22 nt, Human
aucaaaaugcuuuuuauuucug

SEQ ID NO: 2769606 - RNA, 12 nt, Human
aucaaaaugcuu

SEQ ID NO: 2769607 - RNA, 14 nt, Human
aucaaagccacacu

SEQ ID NO: 2769608 - RNA, 16 nt, Human
aucaaagccacacucu

SEQ ID NO: 2769609 - RNA, 13 nt, Human
aucaaagccaggg

SEQ ID NO: 2769610 - RNA, 16 nt, Human
aucaaagccagggucu

SEQ ID NO: 2769611 - RNA, 17 nt, Human
aucaaagcauagauguu

SEQ ID NO: 2769612 - RNA, 21 nt, Human
auauuucccuccccuggggac

SEQ ID NO: 2769613 - RNA, 14 nt, Human
aucaaaauaaaaag

SEQ ID NO: 2769614 - RNA, 15 nt, Human
aucaaaauaaaaagu

SEQ ID NO: 2769615 - RNA, 18 nt, Human
aucaaaauaaaaagugac

SEQ ID NO: 2769616 - RNA, 14 nt, Human
aucaugucuggcua

SEQ ID NO: 2769617 - RNA, 14 nt, Human
aucaugucagagca

SEQ ID NO: 2769618 - RNA, 19 nt, Human
aucaugucaggccugugug

SEQ ID NO: 2769619 - RNA, 18 nt, Human
aucaugucaggccugugu

SEQ ID NO: 2769620 - RNA, 14 nt, Human
aucaccuauuucca

SEQ ID NO: 2769621 - RNA, 22 nt, Human
aucaccuauuuccauucaacaa

SEQ ID NO: 2769622 - RNA, 15 nt, Human
aucaccuauuuccau

SEQ ID NO: 2769623 - RNA, 19 nt, Human
aucaugaaucuuuguuuca

SEQ ID NO: 2769624 - RNA, 11 nt, Human
aucaugaagcc

SEQ ID NO: 2769625 - RNA, 12 nt, Human
aucaugaagccu

SEQ ID NO: 2769626 - RNA, 13 nt, Human
aucaugaagccug

SEQ ID NO: 2769627 - RNA, 14 nt, Human
aucaugaagccugu

SEQ ID NO: 2769628 - RNA, 15 nt, Human
aucaugaagccugug

SEQ ID NO: 2769629 - RNA, 18 nt, Human
aucaugaaauaugcaucu

SEQ ID NO: 2769630 - RNA, 16 nt, Human
aucaugaaauuacuua

SEQ ID NO: 2769631 - RNA, 15 nt, Human
aucaugaaauaugca

SEQ ID NO: 2769632 - RNA, 16 nt, Human
aucaugaaauaugcau

SEQ ID NO: 2769633 - RNA, 18 nt, Human
aucagcuuucaaagcauu

SEQ ID NO: 2769634 - RNA, 21 nt, Human
aucagcuucuauccuugacuu

SEQ ID NO: 2769635 - RNA, 14 nt, Human
aucaugaaauaugc

SEQ ID NO: 2769636 - RNA, 13 nt, Human
auguucucugagg

SEQ ID NO: 2769637 - RNA, 14 nt, Human
auguucugggacac

SEQ ID NO: 2769638 - RNA, 17 nt, Human
auguucucugaggacac

SEQ ID NO: 2769639 - RNA, 15 nt, Human
auguucugggacaca

SEQ ID NO: 2769640 - RNA, 20 nt, Human
auguuccgaauugagcacaa

SEQ ID NO: 2769641 - RNA, 21 nt, Human
auguucugugccuguaaacau

SEQ ID NO: 2769642 - RNA, 18 nt, Human
auguucugugauacagaa

SEQ ID NO: 2769643 - RNA, 17 nt, Human
auguuugccucugccuc

SEQ ID NO: 2769644 - RNA, 15 nt, Human
auguuugccucugcc

SEQ ID NO: 2769645 - RNA, 14 nt, Human
auguuugccucugc

SEQ ID NO: 2769646 - RNA, 20 nt, Human
auguuucuggguccugaaga

SEQ ID NO: 2769647 - RNA, 21 nt, Human
auguuucuggguccugaagaa

SEQ ID NO: 2769648 - RNA, 13 nt, Human
auguuucuaucug

SEQ ID NO: 2769649 - RNA, 14 nt, Human
auguuucuuaacua

SEQ ID NO: 2769650 - RNA, 24 nt, Human
auguuuccagcagaagacaaaaag

SEQ ID NO: 2769651 - RNA, 18 nt, Human
auguguaucggaugcuuu

SEQ ID NO: 2769652 - RNA, 22 nt, Human
auguguaggcaguuuagugcau

SEQ ID NO: 2769653 - RNA, 15 nt, Human
auguguagccugugc

SEQ ID NO: 2769654 - RNA, 14 nt, Human
auguguagccugug

SEQ ID NO: 2769655 - RNA, 16 nt, Human
auguguagccugugca

SEQ ID NO: 2769656 - RNA, 17 nt, Human
auguguagccugugcau

SEQ ID NO: 2769657 - RNA, 23 nt, Human
auguguagccugugcauguaugu

SEQ ID NO: 2769658 - RNA, 22 nt, Human
auguguaguugucucucuucag

SEQ ID NO: 2769659 - RNA, 23 nt, Human
auguguaguugucucucuucaga

SEQ ID NO: 2769660 - RNA, 15 nt, Human
auguguauauauaca

SEQ ID NO: 2769661 - RNA, 16 nt, Human
auguguauauauacau

SEQ ID NO: 2769662 - RNA, 17 nt, Human
auguguauauauacaua

SEQ ID NO: 2769663 - RNA, 19 nt, Human
auguguauauauacauaca

SEQ ID NO: 2769664 - RNA, 23 nt, Human
auguguauauauacauacacuug

SEQ ID NO: 2769665 - RNA, 22 nt, Human
auguguauauauaugugaggau

SEQ ID NO: 2769666 - RNA, 19 nt, Human
auguguaaagaucuacaug

SEQ ID NO: 2769667 - RNA, 21 nt, Human
auguguaaagaucuacaugaa

SEQ ID NO: 2769668 - RNA, 22 nt, Human
auguguaaagaucuacaugaau

SEQ ID NO: 2769669 - RNA, 15 nt, Human
auguguaaaauguga

SEQ ID NO: 2769670 - RNA, 16 nt, Human
augugguuuuagauuu

SEQ ID NO: 2769671 - RNA, 17 nt, Human
augugguuuucuuaagg

SEQ ID NO: 2769672 - RNA, 23 nt, Human
augugguuugguuccucucuggu

SEQ ID NO: 2769673 - RNA, 13 nt, Human
augugaaacacuu

SEQ ID NO: 2769674 - RNA, 22 nt, Human
augugaaacacuuugccuccug

SEQ ID NO: 2769675 - RNA, 19 nt, Human
augucacaggcagguccag

SEQ ID NO: 2769676 - RNA, 21 nt, Human
auguauuuauuuaaaagauuc

SEQ ID NO: 2769677 - RNA, 12 nt, Human
augucacagggc

SEQ ID NO: 2769678 - RNA, 13 nt, Human
augucacagggcc

SEQ ID NO: 2769679 - RNA, 14 nt, Human
augucacagggcca

SEQ ID NO: 2769680 - RNA, 16 nt, Human
augucuuuugaauauu

SEQ ID NO: 2769681 - RNA, 15 nt, Human
augucuuuugaauau

SEQ ID NO: 2769682 - RNA, 16 nt, Human
augugaaaaucaaaua

SEQ ID NO: 2769683 - RNA, 18 nt, Human
augugaaaaucaaauaca

SEQ ID NO: 2769684 - RNA, 18 nt, Human
auguauuuauuuaaaaga

SEQ ID NO: 2769685 - RNA, 19 nt, Human
auguauuuauuuaaaagau

SEQ ID NO: 2769686 - RNA, 12 nt, Human
auguauuuguuc

SEQ ID NO: 2769687 - RNA, 13 nt, Human
auguauuuguuca

SEQ ID NO: 2769688 - RNA, 14 nt, Human
auguauuuguucau

SEQ ID NO: 2769689 - RNA, 18 nt, Human
auguauuuguucauguuu

SEQ ID NO: 2769690 - RNA, 13 nt, Human
auguauuuaugua

SEQ ID NO: 2769691 - RNA, 16 nt, Human
auguauuuauuuaaaa

SEQ ID NO: 2769692 - RNA, 22 nt, Human
auguauuuauuuaaaagauuca

SEQ ID NO: 2769693 - RNA, 19 nt, Human
auguauuuccuggauguuu

SEQ ID NO: 2769694 - RNA, 13 nt, Human
augucacaggcag

SEQ ID NO: 2769695 - RNA, 21 nt, Human
auguauuguaaacauguguuu

SEQ ID NO: 2769696 - RNA, 11 nt, Human
auguauuguaa

SEQ ID NO: 2769697 - RNA, 19 nt, Human
auguauuguaaacaugugu

SEQ ID NO: 2769698 - RNA, 20 nt, Human
auguauuguaaacauguguu

SEQ ID NO: 2769699 - RNA, 21 nt, Human
auguaauuuaggguacuaaau

SEQ ID NO: 2769700 - RNA, 22 nt, Human
auguaauuuaggguacuaaauu

SEQ ID NO: 2769701 - RNA, 12 nt, Human
auguaacuugaa

SEQ ID NO: 2769702 - RNA, 17 nt, Human
auguaauuguaauuuug

SEQ ID NO: 2769703 - RNA, 19 nt, Human
auguaauuguaauuuugaa

SEQ ID NO: 2769704 - RNA, 15 nt, Human
auggguuauguguau

SEQ ID NO: 2769705 - RNA, 16 nt, Human
auggguuggugcuucu

SEQ ID NO: 2769706 - RNA, 16 nt, Human
auggguuuuaugagau

SEQ ID NO: 2769707 - RNA, 22 nt, Human
auggguuuuaugagauggauca

SEQ ID NO: 2769708 - RNA, 21 nt, Human
auggguguuguauggggaggc

SEQ ID NO: 2769709 - RNA, 14 nt, Human
augguaauuguugc

SEQ ID NO: 2769710 - RNA, 19 nt, Human
augguaggaagaagcucuc

SEQ ID NO: 2769711 - RNA, 13 nt, Human
augguagaccuuu

SEQ ID NO: 2769712 - RNA, 18 nt, Human
augguaggcauuuccuau

SEQ ID NO: 2769713 - RNA, 17 nt, Human
augguaggcauuuccua

SEQ ID NO: 2769714 - RNA, 17 nt, Human
augguaccaaucaugaa

SEQ ID NO: 2769715 - RNA, 14 nt, Human
augguacaaccuuu

SEQ ID NO: 2769716 - RNA, 22 nt, Human
augguacaaccuuuauucuuuu

SEQ ID NO: 2769717 - RNA, 18 nt, Human
augguacaugucuuccau

SEQ ID NO: 2769718 - RNA, 20 nt, Human
augguaccaaucaugaaucu

SEQ ID NO: 2769719 - RNA, 15 nt, Human
augguaccagcccug

SEQ ID NO: 2769720 - RNA, 20 nt, Human
augguaccagcccuggggcu

SEQ ID NO: 2769721 - RNA, 13 nt, Human
augguacuauuua

SEQ ID NO: 2769722 - RNA, 17 nt, Human
augaucuuugcagacag

SEQ ID NO: 2769723 - RNA, 21 nt, Human
augaucuugaguauaagaaau

SEQ ID NO: 2769724 - RNA, 23 nt, Human
augaucuugaguauaagaaaugc

SEQ ID NO: 2769725 - RNA, 21 nt, Human
augaucuuugcagacaggcaa

SEQ ID NO: 2769726 - RNA, 19 nt, Human
augaucuuugcagacaggc

SEQ ID NO: 2769727 - RNA, 18 nt, Human
augaucuuugcagacagg

SEQ ID NO: 2769728 - RNA, 23 nt, Human
augaugaaaugaggucagagccu

SEQ ID NO: 2769729 - RNA, 15 nt, Human
augaugaaugagaau

SEQ ID NO: 2769730 - RNA, 12 nt, Human
augaugaaugag

SEQ ID NO: 2769731 - RNA, 20 nt, Human
augaugaucaauuauaguuu

SEQ ID NO: 2769732 - RNA, 19 nt, Human
augaugagaauuucuaaaa

SEQ ID NO: 2769733 - RNA, 20 nt, Human
augaugagccuucgugcccc

SEQ ID NO: 2769734 - RNA, 18 nt, Human
augaugaaaugaggucag

SEQ ID NO: 2769735 - RNA, 20 nt, Human
augaugaaaaccuacauauu

SEQ ID NO: 2769736 - RNA, 12 nt, Human
augaugaaaauu

SEQ ID NO: 2769737 - RNA, 21 nt, Human
augauguaaucucucugcagc

SEQ ID NO: 2769738 - RNA, 13 nt, Human
augauguaauuga

SEQ ID NO: 2769739 - RNA, 23 nt, Human
augauggggcccuaauucagcca

SEQ ID NO: 2769740 - RNA, 18 nt, Human
augaugguugcaaaagac

SEQ ID NO: 2769741 - RNA, 19 nt, Human
augauggcaauuuuguaac

SEQ ID NO: 2769742 - RNA, 19 nt, Human
augauggaugccaauauua

SEQ ID NO: 2769743 - RNA, 15 nt, Human
augauggaugccaau

SEQ ID NO: 2769744 - RNA, 16 nt, Human
augauggucacuuaaa

SEQ ID NO: 2769745 - RNA, 21 nt, Human
augccugauugccaagcucag

SEQ ID NO: 2769746 - RNA, 19 nt, Human
augccugccccaaacaaau

SEQ ID NO: 2769747 - RNA, 19 nt, Human
augccugagugccuggcca

SEQ ID NO: 2769748 - RNA, 20 nt, Human
augccugagugccuggccaa

SEQ ID NO: 2769749 - RNA, 18 nt, Human
augccuggaagcuuuguc

SEQ ID NO: 2769750 - RNA, 23 nt, Human
augccuggaagcuuuguccccug

SEQ ID NO: 2769751 - RNA, 18 nt, Human
augccuguccagccuggg

SEQ ID NO: 2769752 - RNA, 17 nt, Human
augccuguccagccugg

SEQ ID NO: 2769753 - RNA, 23 nt, Human
augcaugugguuugguuccucuc

SEQ ID NO: 2769754 - RNA, 18 nt, Human
augcauguugaccauguc

SEQ ID NO: 2769755 - RNA, 22 nt, Human
augcauguugaccaugucuaug

SEQ ID NO: 2769756 - RNA, 19 nt, Human
augcauguuuuccagcucc

SEQ ID NO: 2769757 - RNA, 21 nt, Human
augcauuauaggaucauuugu

SEQ ID NO: 2769758 - RNA, 12 nt, Human
augcauuaaacc

SEQ ID NO: 2769759 - RNA, 14 nt, Human
augcauuaaaccug

SEQ ID NO: 2769760 - RNA, 15 nt, Human
augcauuaaaccugu

SEQ ID NO: 2769761 - RNA, 17 nt, Human
augcauuaaaccugucu

SEQ ID NO: 2769762 - RNA, 20 nt, Human
augcauuaaaccugucucca

SEQ ID NO: 2769763 - RNA, 16 nt, Human
augccugagugccugg

SEQ ID NO: 2769764 - RNA, 14 nt, Human
augcauuguaguuu

SEQ ID NO: 2769765 - RNA, 21 nt, Human
augcauucuugguuggcuggc

SEQ ID NO: 2769766 - RNA, 17 nt, Human
augcauugauauuguga

SEQ ID NO: 2769767 - RNA, 18 nt, Human
augcauugauauugugaa

SEQ ID NO: 2769768 - RNA, 19 nt, Human
augcauugauauugugaac

SEQ ID NO: 2769769 - RNA, 22 nt, Human
augcauuauaggaucauuuguu

SEQ ID NO: 2769770 - RNA, 20 nt, Human
augcauguuuuccagcuccu

SEQ ID NO: 2769771 - RNA, 10 nt, Human
augcacacac

SEQ ID NO: 2769772 - RNA, 12 nt, Human
augcacacacac

SEQ ID NO: 2769773 - RNA, 21 nt, Human
augcacacacacacgcuuucu

SEQ ID NO: 2769774 - RNA, 20 nt, Human
augccuucuuauugcuuuua

SEQ ID NO: 2769775 - RNA, 15 nt, Human
augccuugaauaaua

SEQ ID NO: 2769776 - RNA, 23 nt, Human
augccuugaauaauaagcaggau

SEQ ID NO: 2769777 - RNA, 20 nt, Human
augccuuggggaggacaaaa

SEQ ID NO: 2769778 - RNA, 22 nt, Human
augccuuggggaggacaaaacu

SEQ ID NO: 2769779 - RNA, 12 nt, Human
augccuugugcu

SEQ ID NO: 2769780 - RNA, 19 nt, Human
augccuugugcuguuaaua

SEQ ID NO: 2769781 - RNA, 14 nt, Human
augccuucuuauug

SEQ ID NO: 2769782 - RNA, 22 nt, Human
augccuguggaagagugugugu

SEQ ID NO: 2769783 - RNA, 12 nt, Human
augccuguggcu

SEQ ID NO: 2769784 - RNA, 14 nt, Human
augccuguggcugc

SEQ ID NO: 2769785 - RNA, 15 nt, Human
augccuguggcugcg

SEQ ID NO: 2769786 - RNA, 13 nt, Human
augccuuaaaaug

SEQ ID NO: 2769787 - RNA, 15 nt, Human
augccuuaaaaugga

SEQ ID NO: 2769788 - RNA, 16 nt, Human
augccuuaaaauggaa

SEQ ID NO: 2769789 - RNA, 18 nt, Human
augccuuaaaauggaauu

SEQ ID NO: 2769790 - RNA, 19 nt, Human
augccuuaaaauggaauug

SEQ ID NO: 2769791 - RNA, 22 nt, Human
augccuuaaaauggaauugaaa

SEQ ID NO: 2769792 - RNA, 17 nt, Human
auggcugugccucugcc

SEQ ID NO: 2769793 - RNA, 15 nt, Human
auggcugugccucug

SEQ ID NO: 2769794 - RNA, 16 nt, Human
auggcugugccucugc

SEQ ID NO: 2769795 - RNA, 18 nt, Human
auggauauuauuagaaau

SEQ ID NO: 2769796 - RNA, 21 nt, Human
auggauauuuguacuguuuaa

SEQ ID NO: 2769797 - RNA, 14 nt, Human
auggaucccgaaga

SEQ ID NO: 2769798 - RNA, 13 nt, Human
auggauacuacau

SEQ ID NO: 2769799 - RNA, 19 nt, Human
auggauacuacaucuuuaa

SEQ ID NO: 2769800 - RNA, 16 nt, Human
auggauagagaagaaa

SEQ ID NO: 2769801 - RNA, 16 nt, Human
auggauagaguauuga

SEQ ID NO: 2769802 - RNA, 18 nt, Human
auggauaaccuauaugau

SEQ ID NO: 2769803 - RNA, 19 nt, Human
auggauaaccuauaugauu

SEQ ID NO: 2769804 - RNA, 19 nt, Human
augcuugugaaaauguguu

SEQ ID NO: 2769805 - RNA, 17 nt, Human
augcugacuucacuuau

SEQ ID NO: 2769806 - RNA, 18 nt, Human
augcuuuaccaaacagca

SEQ ID NO: 2769807 - RNA, 19 nt, Human
augcuuuaccaaacagcaa

SEQ ID NO: 2769808 - RNA, 20 nt, Human
augcuuuaccaaacagcaaa

SEQ ID NO: 2769809 - RNA, 18 nt, Human
augcuuuaggauguacag

SEQ ID NO: 2769810 - RNA, 13 nt, Human
auggaguagaggu

SEQ ID NO: 2769811 - RNA, 21 nt, Human
auggaguagagguacuagaau

SEQ ID NO: 2769812 - RNA, 22 nt, Human
auggaguagagguacuagaaug

SEQ ID NO: 2769813 - RNA, 17 nt, Human
auggagguucuaaggcc

SEQ ID NO: 2769814 - RNA, 15 nt, Human
auggagguucuaagg

SEQ ID NO: 2769815 - RNA, 16 nt, Human
auggagguucuaaggc

SEQ ID NO: 2769816 - RNA, 12 nt, Human
auggagguucua

SEQ ID NO: 2769817 - RNA, 13 nt, Human
auggagguucuaa

SEQ ID NO: 2769818 - RNA, 16 nt, Human
auggaggcccuccugu

SEQ ID NO: 2769819 - RNA, 20 nt, Human
auggaggcccuccugugcug

SEQ ID NO: 2769820 - RNA, 17 nt, Human
auggaggggaguguugg

SEQ ID NO: 2769821 - RNA, 12 nt, Human
augcugaucauc

SEQ ID NO: 2769822 - RNA, 14 nt, Human
augcugaucaucgc

SEQ ID NO: 2769823 - RNA, 19 nt, Human
augcugaucaucgccagag

SEQ ID NO: 2769824 - RNA, 22 nt, Human
augcugaucaucgccagaggug

SEQ ID NO: 2769825 - RNA, 24 nt, Human
augcugaucaucgccagaggugcu

SEQ ID NO: 2769826 - RNA, 17 nt, Human
augcugaugaaucacug

SEQ ID NO: 2769827 - RNA, 18 nt, Human
augcugaugaaucacugu

SEQ ID NO: 2769828 - RNA, 19 nt, Human
augcugaugaaucacuguu

SEQ ID NO: 2769829 - RNA, 21 nt, Human
augcugaugaaucacuguuuu

SEQ ID NO: 2769830 - RNA, 14 nt, Human
augcugauguccuc

SEQ ID NO: 2769831 - RNA, 16 nt, Human
augcugauguccucac

SEQ ID NO: 2769832 - RNA, 13 nt, Human
augcugagggugu

SEQ ID NO: 2769833 - RNA, 17 nt, Human
augcugaggguguuucu

SEQ ID NO: 2769834 - RNA, 20 nt, Human
augcugaggguguuucuucc

SEQ ID NO: 2769835 - RNA, 23 nt, Human
augcugaggguguuucuuccugc

SEQ ID NO: 2769836 - RNA, 14 nt, Human
augcugagauucuu

SEQ ID NO: 2769837 - RNA, 19 nt, Human
augcugacuguacuccucc

SEQ ID NO: 2769838 - RNA, 20 nt, Human
augcugacuguacuccuccc

SEQ ID NO: 2769839 - RNA, 21 nt, Human
augcugacuguacuccuccca

SEQ ID NO: 2769840 - RNA, 23 nt, Human
augcugaauauacagcaggugcu

SEQ ID NO: 2769841 - RNA, 12 nt, Human
augcugccucca

SEQ ID NO: 2769842 - RNA, 15 nt, Human
augcugccuccagaa

SEQ ID NO: 2769843 - RNA, 13 nt, Human
augcugccugagu

SEQ ID NO: 2769844 - RNA, 12 nt, Human
augcugccugag

SEQ ID NO: 2769845 - RNA, 22 nt, Human
augcugccuucccaugaaucug

SEQ ID NO: 2769846 - RNA, 23 nt, Human
augcugccuucccaugaaucugu

SEQ ID NO: 2769847 - RNA, 18 nt, Human
augcugccuuuucuuuaa

SEQ ID NO: 2769848 - RNA, 23 nt, Human
agccuuuucccucuuuggcuccc

SEQ ID NO: 2769849 - RNA, 13 nt, Human
agccuuuugaaag

SEQ ID NO: 2769850 - RNA, 21 nt, Human
agcgacauagcccaucccugc

SEQ ID NO: 2769851 - RNA, 19 nt, Human
agcgacauagcccaucccu

SEQ ID NO: 2769852 - RNA, 17 nt, Human
agcgaccgcccccuccu

SEQ ID NO: 2769853 - RNA, 22 nt, Human
agcgaccuuccucauccacccc

SEQ ID NO: 2769854 - RNA, 17 nt, Human
agcgacccauucagaga

SEQ ID NO: 2769855 - RNA, 14 nt, Human
agcgaccgcccccu

SEQ ID NO: 2769856 - RNA, 15 nt, Human
agcgaccgcccccuc

SEQ ID NO: 2769857 - RNA, 16 nt, Human
agcgaccgcccccucc

SEQ ID NO: 2769858 - RNA, 19 nt, Human
agccuuugguucuggccag

SEQ ID NO: 2769859 - RNA, 18 nt, Human
agccuuuucccucuuugg

SEQ ID NO: 2769860 - RNA, 15 nt, Human
agccuuuuaacugug

SEQ ID NO: 2769861 - RNA, 17 nt, Human
agccuuuuauacugauu

SEQ ID NO: 2769862 - RNA, 18 nt, Human
agccuuugguucuggcca

SEQ ID NO: 2769863 - RNA, 23 nt, Human
agccuuuggcucuggagacagcc

SEQ ID NO: 2769864 - RNA, 17 nt, Human
agccuuugggaaaugcu

SEQ ID NO: 2769865 - RNA, 16 nt, Human
agccuuuggcucugga

SEQ ID NO: 2769866 - RNA, 17 nt, Human
agccuuuggcucuggag

SEQ ID NO: 2769867 - RNA, 18 nt, Human
agccuuuggcucuggaga

SEQ ID NO: 2769868 - RNA, 21 nt, Human
agccuuuggcucuggagacag

SEQ ID NO: 2769869 - RNA, 15 nt, Human
agccuuuggaaacag

SEQ ID NO: 2769870 - RNA, 17 nt, Human
agccuuuggccuuggcu

SEQ ID NO: 2769871 - RNA, 13 nt, Human
agcgagcccuggu

SEQ ID NO: 2769872 - RNA, 16 nt, Human
agcgagagucugucuc

SEQ ID NO: 2769873 - RNA, 15 nt, Human
agcgagcauccccca

SEQ ID NO: 2769874 - RNA, 19 nt, Human
agcgagcaucccccaaagu

SEQ ID NO: 2769875 - RNA, 19 nt, Human
agcgagcccugguggcagu

SEQ ID NO: 2769876 - RNA, 16 nt, Human
agcgagggcagcugcu

SEQ ID NO: 2769877 - RNA, 15 nt, Human
agcgagggcagcugc

SEQ ID NO: 2769878 - RNA, 14 nt, Human
agcgagggcagcug

SEQ ID NO: 2769879 - RNA, 17 nt, Human
agcgagggcagcugcua

SEQ ID NO: 2769880 - RNA, 21 nt, Human
agcgaguuguggaaagccucu

SEQ ID NO: 2769881 - RNA, 15 nt, Human
agcgauauacagaug

SEQ ID NO: 2769882 - RNA, 17 nt, Human
agcgauauacagaugaa

SEQ ID NO: 2769883 - RNA, 20 nt, Human
agcgauauacagaugaaaau

SEQ ID NO: 2769884 - RNA, 14 nt, Human
agcgaguuguggaa

SEQ ID NO: 2769885 - RNA, 18 nt, Human
agcgaugaauuuggagac

SEQ ID NO: 2769886 - RNA, 19 nt, Human
agcgaugaauuuggagacu

SEQ ID NO: 2769887 - RNA, 18 nt, Human
agcgauggucucagaaac

SEQ ID NO: 2769888 - RNA, 18 nt, Human
agcguguuuacaugugua

SEQ ID NO: 2769889 - RNA, 20 nt, Human
agccugggcagccaggcugc

SEQ ID NO: 2769890 - RNA, 19 nt, Human
agccugggcagccaggcug

SEQ ID NO: 2769891 - RNA, 18 nt, Human
agccugggcagccaggcu

SEQ ID NO: 2769892 - RNA, 21 nt, Human
agccugggacaguuuaucaug

SEQ ID NO: 2769893 - RNA, 14 nt, Human
agccugggaggcac

SEQ ID NO: 2769894 - RNA, 15 nt, Human
agccugggaggcaca

SEQ ID NO: 2769895 - RNA, 16 nt, Human
agccugggaggcacag

SEQ ID NO: 2769896 - RNA, 18 nt, Human
agccugggaggcacagca

SEQ ID NO: 2769897 - RNA, 22 nt, Human
agccugggaggcacagcaaacu

SEQ ID NO: 2769898 - RNA, 23 nt, Human
agccuggcuucuggagcccuugg

SEQ ID NO: 2769899 - RNA, 21 nt, Human
agccuggcuucuggagcccuu

SEQ ID NO: 2769900 - RNA, 20 nt, Human
agccuggcuucuggagcccu

SEQ ID NO: 2769901 - RNA, 19 nt, Human
agccuggcuucuggagccc

SEQ ID NO: 2769902 - RNA, 18 nt, Human
agccuggcuucuggagcc

SEQ ID NO: 2769903 - RNA, 15 nt, Human
agccuggcuucugga

SEQ ID NO: 2769904 - RNA, 15 nt, Human
agccugggcgacaga

SEQ ID NO: 2769905 - RNA, 13 nt, Human
agccuggggccug

SEQ ID NO: 2769906 - RNA, 14 nt, Human
agccuggggccugg

SEQ ID NO: 2769907 - RNA, 15 nt, Human
agccuggggccuggc

SEQ ID NO: 2769908 - RNA, 16 nt, Human
agccuggggccuggca

SEQ ID NO: 2769909 - RNA, 17 nt, Human
agccuggggccuggcag

SEQ ID NO: 2769910 - RNA, 18 nt, Human
agccuggggccuggcagg

SEQ ID NO: 2769911 - RNA, 19 nt, Human
agccuggggccuggcaggg

SEQ ID NO: 2769912 - RNA, 11 nt, Human
agccugggccc

SEQ ID NO: 2769913 - RNA, 12 nt, Human
agccugggcccc

SEQ ID NO: 2769914 - RNA, 21 nt, Human
agccugggcagccaggcugcc

SEQ ID NO: 2769915 - RNA, 16 nt, Human
agccugggccccagcu

SEQ ID NO: 2769916 - RNA, 14 nt, Human
agccugggcgacag

SEQ ID NO: 2769917 - RNA, 22 nt, Human
agcccucccugccccucccuuc

SEQ ID NO: 2769918 - RNA, 23 nt, Human
agcccucccugccccucccuuca

SEQ ID NO: 2769919 - RNA, 15 nt, Human
agcccucccugcccc

SEQ ID NO: 2769920 - RNA, 16 nt, Human
agcccucccugccccu

SEQ ID NO: 2769921 - RNA, 17 nt, Human
agcccucccugccccuc

SEQ ID NO: 2769922 - RNA, 19 nt, Human
agcccucccugccccuccc

SEQ ID NO: 2769923 - RNA, 14 nt, Human
agccuggcuucugg

SEQ ID NO: 2769924 - RNA, 11 nt, Human
agccuggcucu

SEQ ID NO: 2769925 - RNA, 12 nt, Human
agccuggcucuu

SEQ ID NO: 2769926 - RNA, 23 nt, Human
agcuaauguaauaacugugaagu

SEQ ID NO: 2769927 - RNA, 14 nt, Human
agcuaauuugcauu

SEQ ID NO: 2769928 - RNA, 13 nt, Human
agcuaauuugcau

SEQ ID NO: 2769929 - RNA, 22 nt, Human
agcucaaagcguggacaggugu

SEQ ID NO: 2769930 - RNA, 15 nt, Human
agcuaauugggaguc

SEQ ID NO: 2769931 - RNA, 19 nt, Human
agcuaauugggaguccagg

SEQ ID NO: 2769932 - RNA, 22 nt, Human
agcuaauuugcauuaaauucac

SEQ ID NO: 2769933 - RNA, 20 nt, Human
agcuaauuugcauuaaauuc

SEQ ID NO: 2769934 - RNA, 16 nt, Human
agcucaccagccccag

SEQ ID NO: 2769935 - RNA, 14 nt, Human
agcucaauggacug

SEQ ID NO: 2769936 - RNA, 17 nt, Human
agcucaaauaaaaauaa

SEQ ID NO: 2769937 - RNA, 20 nt, Human
agcucaagcaggaaguucaa

SEQ ID NO: 2769938 - RNA, 19 nt, Human
agcucaaggaaaggccuga

SEQ ID NO: 2769939 - RNA, 19 nt, Human
agcucaagggacaaggaca

SEQ ID NO: 2769940 - RNA, 15 nt, Human
agcucaacuuucugu

SEQ ID NO: 2769941 - RNA, 19 nt, Human
agcucaacuuucuguugga

SEQ ID NO: 2769942 - RNA, 16 nt, Human
agcguuggauguagca

SEQ ID NO: 2769943 - RNA, 11 nt, Human
agcguuuuuua

SEQ ID NO: 2769944 - RNA, 17 nt, Human
agcguuuuuuaaaugua

SEQ ID NO: 2769945 - RNA, 14 nt, Human
agcguuuuuuaaau

SEQ ID NO: 2769946 - RNA, 23 nt, Human
agcguuuuuuaaauguauacuau

SEQ ID NO: 2769947 - RNA, 20 nt, Human
agcguuuuuuaaauguauac

SEQ ID NO: 2769948 - RNA, 19 nt, Human
agcguuuuuuaaauguaua

SEQ ID NO: 2769949 - RNA, 18 nt, Human
agcguuuuuuaaauguau

SEQ ID NO: 2769950 - RNA, 21 nt, Human
agcuaaucagcauucucacuc

SEQ ID NO: 2769951 - RNA, 16 nt, Human
agcuaaucagcauucu

SEQ ID NO: 2769952 - RNA, 22 nt, Human
agcuaauaauucuucaccuaag

SEQ ID NO: 2769953 - RNA, 16 nt, Human
agcuaauaauucuuca

SEQ ID NO: 2769954 - RNA, 12 nt, Human
agcuaauaauga

SEQ ID NO: 2769955 - RNA, 15 nt, Human
agcuaauaauguuaa

SEQ ID NO: 2769956 - RNA, 21 nt, Human
agcuaauaauguuaaccaagg

SEQ ID NO: 2769957 - RNA, 15 nt, Human
agcucaccagcccca

SEQ ID NO: 2769958 - RNA, 20 nt, Human
agcucaccagccccagugcc

SEQ ID NO: 2769959 - RNA, 19 nt, Human
agcucaccagccccagugc

SEQ ID NO: 2769960 - RNA, 21 nt, Human
agcucagagagggcaggcaug

SEQ ID NO: 2769961 - RNA, 16 nt, Human
agcucagagagggcag

SEQ ID NO: 2769962 - RNA, 17 nt, Human
agcucagagagggcagg

SEQ ID NO: 2769963 - RNA, 14 nt, Human
agcucagagagggc

SEQ ID NO: 2769964 - RNA, 14 nt, Human
agcucagaacccag

SEQ ID NO: 2769965 - RNA, 15 nt, Human
agcucagaacccagg

SEQ ID NO: 2769966 - RNA, 16 nt, Human
agcucagaacccaggg

SEQ ID NO: 2769967 - RNA, 17 nt, Human
agcucagaacccagggc

SEQ ID NO: 2769968 - RNA, 18 nt, Human
agcucagaacccagggcu

SEQ ID NO: 2769969 - RNA, 19 nt, Human
agcucagaacccagggcuc

SEQ ID NO: 2769970 - RNA, 15 nt, Human
agcucacgcuucaca

SEQ ID NO: 2769971 - RNA, 13 nt, Human
agcucacuacccu

SEQ ID NO: 2769972 - RNA, 14 nt, Human
agcuccuguccucc

SEQ ID NO: 2769973 - RNA, 15 nt, Human
agcuccuguccuccc

SEQ ID NO: 2769974 - RNA, 16 nt, Human
agcuccuguccuccca

SEQ ID NO: 2769975 - RNA, 17 nt, Human
agcuccuguccucccau

SEQ ID NO: 2769976 - RNA, 21 nt, Human
agcuccuguccucccaucccc

SEQ ID NO: 2769977 - RNA, 23 nt, Human
agcugaacaauaggcuguuccca

SEQ ID NO: 2769978 - RNA, 19 nt, Human
agcugaagaguugccccgu

SEQ ID NO: 2769979 - RNA, 20 nt, Human
agcugaagaguugccccguc

SEQ ID NO: 2769980 - RNA, 13 nt, Human
agcugaaguuacu

SEQ ID NO: 2769981 - RNA, 17 nt, Human
agcugaaugccuccugu

SEQ ID NO: 2769982 - RNA, 18 nt, Human
agcugaaugccuccugug

SEQ ID NO: 2769983 - RNA, 20 nt, Human
agcugaaugccuccuguggg

SEQ ID NO: 2769984 - RNA, 21 nt, Human
agcugaaugccuccugugggg

SEQ ID NO: 2769985 - RNA, 22 nt, Human
agcugaaugccuccugugggga

SEQ ID NO: 2769986 - RNA, 12 nt, Human
agcugagccagg

SEQ ID NO: 2769987 - RNA, 13 nt, Human
agcugagccaggc

SEQ ID NO: 2769988 - RNA, 14 nt, Human
agcugagccaggcu

SEQ ID NO: 2769989 - RNA, 18 nt, Human
agcugcgguccacccagg

SEQ ID NO: 2769990 - RNA, 17 nt, Human
agcugcgguccacccag

SEQ ID NO: 2769991 - RNA, 16 nt, Human
agcugcgguccaccca

SEQ ID NO: 2769992 - RNA, 13 nt, Human
agcugcgguccac

SEQ ID NO: 2769993 - RNA, 20 nt, Human
agcugcgguccacccaggag

SEQ ID NO: 2769994 - RNA, 19 nt, Human
agcugcgguccacccagga

SEQ ID NO: 2769995 - RNA, 12 nt, Human
agcugcugacag

SEQ ID NO: 2769996 - RNA, 17 nt, Human
agcuggucccacucagu

SEQ ID NO: 2769997 - RNA, 16 nt, Human
agcuggucccacucag

SEQ ID NO: 2769998 - RNA, 14 nt, Human
agcugcugacagug

SEQ ID NO: 2769999 - RNA, 13 nt, Human
agcugcugacagu

SEQ ID NO: 2770000 - RNA, 18 nt, Human
agcuggucccacucaguc

SEQ ID NO: 2770001 - RNA, 17 nt, Human
agcugcugaccaauugu

SEQ ID NO: 2770002 - RNA, 20 nt, Human
agcugcugaccaauugugcu

SEQ ID NO: 2770003 - RNA, 21 nt, Human
agcugcugaccaauugugcug

SEQ ID NO: 2770004 - RNA, 22 nt, Human
agcugcugaccaauugugcugc

SEQ ID NO: 2770005 - RNA, 23 nt, Human
agcugcugaccaauugugcugcc

SEQ ID NO: 2770006 - RNA, 22 nt, Human
agcugguuuuuagcggagacgg

SEQ ID NO: 2770007 - RNA, 22 nt, Human
agcucagccccgagcugucccc

SEQ ID NO: 2770008 - RNA, 23 nt, Human
agcucagccccgagcuguccccg

SEQ ID NO: 2770009 - RNA, 21 nt, Human
aggaagggggucuaaggucua

SEQ ID NO: 2770010 - RNA, 20 nt, Human
aggaagggguuggauugcaa

SEQ ID NO: 2770011 - RNA, 18 nt, Human
aggaacuguagaugaugu

SEQ ID NO: 2770012 - RNA, 15 nt, Human
aggaacuguccagag

SEQ ID NO: 2770013 - RNA, 16 nt, Human
aggaacuguccagaga

SEQ ID NO: 2770014 - RNA, 17 nt, Human
aggaacuguccagagag

SEQ ID NO: 2770015 - RNA, 22 nt, Human
aggaaggcugagaggagagaga

SEQ ID NO: 2770016 - RNA, 15 nt, Human
aggaaggcugagagg

SEQ ID NO: 2770017 - RNA, 17 nt, Human
aggaagggcaggaagga

SEQ ID NO: 2770018 - RNA, 12 nt, Human
aggaagggcaaa

SEQ ID NO: 2770019 - RNA, 20 nt, Human
aggaacuguccagagagcaa

SEQ ID NO: 2770020 - RNA, 18 nt, Human
aggaacuguccagagagc

SEQ ID NO: 2770021 - RNA, 19 nt, Human
aggaacuguccagagagca

SEQ ID NO: 2770022 - RNA, 18 nt, Human
aggaauaauuauuuauuu

SEQ ID NO: 2770023 - RNA, 16 nt, Human
aggaauagaagcaaau

SEQ ID NO: 2770024 - RNA, 22 nt, Human
aggaauaauuauuuauuuaaua

SEQ ID NO: 2770025 - RNA, 15 nt, Human
aggaauacaauauau

SEQ ID NO: 2770026 - RNA, 15 nt, Human
aggaauaaugggcuu

SEQ ID NO: 2770027 - RNA, 23 nt, Human
aggaauaaugggcuuagagcagu

SEQ ID NO: 2770028 - RNA, 16 nt, Human
aggaauaauuauuuau

SEQ ID NO: 2770029 - RNA, 17 nt, Human
aggaauaauuauuuauu

SEQ ID NO: 2770030 - RNA, 15 nt, Human
aggaagugcccccuc

SEQ ID NO: 2770031 - RNA, 21 nt, Human
aggaaguguugaagggaggug

SEQ ID NO: 2770032 - RNA, 14 nt, Human
aggaagugaagaau

SEQ ID NO: 2770033 - RNA, 23 nt, Human
aggaaguugacuuauaguacaug

SEQ ID NO: 2770034 - RNA, 15 nt, Human
aggaaguuuucugua

SEQ ID NO: 2770035 - RNA, 16 nt, Human
aggaaguuuucuguag

SEQ ID NO: 2770036 - RNA, 22 nt, Human
aggaaguugacuuauaguacau

SEQ ID NO: 2770037 - RNA, 18 nt, Human
aggaaguugacuuauagu

SEQ ID NO: 2770038 - RNA, 19 nt, Human
aggaauaaauugcuccuug

SEQ ID NO: 2770039 - RNA, 12 nt, Human
aggaauaagaau

SEQ ID NO: 2770040 - RNA, 20 nt, Human
aggaauaaauugcuccuuga

SEQ ID NO: 2770041 - RNA, 15 nt, Human
aggaacaaaaaaacc

SEQ ID NO: 2770042 - RNA, 16 nt, Human
aggaacaaaaaaacca

SEQ ID NO: 2770043 - RNA, 18 nt, Human
aggaacaaaaaaaccaca

SEQ ID NO: 2770044 - RNA, 22 nt, Human
aggaacaaaaaaaccacaaagg

SEQ ID NO: 2770045 - RNA, 18 nt, Human
aggaacugggccuguugc

SEQ ID NO: 2770046 - RNA, 13 nt, Human
aggaacuguacag

SEQ ID NO: 2770047 - RNA, 15 nt, Human
aggaacuguacagaa

SEQ ID NO: 2770048 - RNA, 17 nt, Human
aggaacauuuaggggca

SEQ ID NO: 2770049 - RNA, 18 nt, Human
agcuucauuuccuguguc

SEQ ID NO: 2770050 - RNA, 21 nt, Human
agcuucaccccaaucccagcu

SEQ ID NO: 2770051 - RNA, 16 nt, Human
agcuucauucuccuug

SEQ ID NO: 2770052 - RNA, 21 nt, Human
agcuucauucuccuuguuguu

SEQ ID NO: 2770053 - RNA, 20 nt, Human
agcuucaccccaaucccagc

SEQ ID NO: 2770054 - RNA, 18 nt, Human
agcuucaccccaauccca

SEQ ID NO: 2770055 - RNA, 19 nt, Human
agcuucauuuccugugucu

SEQ ID NO: 2770056 - RNA, 20 nt, Human
agcuucauuugugucaaugg

SEQ ID NO: 2770057 - RNA, 20 nt, Human
agcuuccaaggggcaaauuu

SEQ ID NO: 2770058 - RNA, 22 nt, Human
agcuuccaaggggcaaauuuuu

SEQ ID NO: 2770059 - RNA, 15 nt, Human
agcuucaccagagca

SEQ ID NO: 2770060 - RNA, 13 nt, Human
agcuucauuugug

SEQ ID NO: 2770061 - RNA, 17 nt, Human
agcuucauuugugucaa

SEQ ID NO: 2770062 - RNA, 19 nt, Human
agcuucauuugugucaaug

SEQ ID NO: 2770063 - RNA, 18 nt, Human
agcuucugaggcgcugcu

SEQ ID NO: 2770064 - RNA, 12 nt, Human
agcuuuuaaaaa

SEQ ID NO: 2770065 - RNA, 16 nt, Human
agcuuuuaaacccuau

SEQ ID NO: 2770066 - RNA, 12 nt, Human
agcuguaaaacg

SEQ ID NO: 2770067 - RNA, 14 nt, Human
agcuguaaaacgcu

SEQ ID NO: 2770068 - RNA, 18 nt, Human
agcuguaaaacgcuguca

SEQ ID NO: 2770069 - RNA, 19 nt, Human
agcuguaaaacgcugucaa

SEQ ID NO: 2770070 - RNA, 10 nt, Human
aggagagagg

SEQ ID NO: 2770071 - RNA, 13 nt, Human
aggagagaggcag

SEQ ID NO: 2770072 - RNA, 14 nt, Human
aggagagaggcaga

SEQ ID NO: 2770073 - RNA, 18 nt, Human
aggagagaggcagagagc

SEQ ID NO: 2770074 - RNA, 13 nt, Human
aggagaggaugag

SEQ ID NO: 2770075 - RNA, 15 nt, Human
aggagaggaugagag

SEQ ID NO: 2770076 - RNA, 17 nt, Human
aggagaggaugagagcc

SEQ ID NO: 2770077 - RNA, 21 nt, Human
aggagagagaaagccaggcag

SEQ ID NO: 2770078 - RNA, 22 nt, Human
aggagagagaaagccaggcagg

SEQ ID NO: 2770079 - RNA, 12 nt, Human
aggagagagaaa

SEQ ID NO: 2770080 - RNA, 14 nt, Human
aggagagagaaagc

SEQ ID NO: 2770081 - RNA, 18 nt, Human
aggagagagaaagccagg

SEQ ID NO: 2770082 - RNA, 19 nt, Human
aggagagagaaagccaggc

SEQ ID NO: 2770083 - RNA, 11 nt, Human
aggagagagaa

SEQ ID NO: 2770084 - RNA, 20 nt, Human
aggagagacucccaugaagc

SEQ ID NO: 2770085 - RNA, 21 nt, Human
aggagagacucccaugaagcc

SEQ ID NO: 2770086 - RNA, 22 nt, Human
aggagagacucccaugaagccu

SEQ ID NO: 2770087 - RNA, 23 nt, Human
aggagagacucccaugaagccuu

SEQ ID NO: 2770088 - RNA, 14 nt, Human
aggagagaaaauau

SEQ ID NO: 2770089 - RNA, 15 nt, Human
aggagagaaaauaua

SEQ ID NO: 2770090 - RNA, 16 nt, Human
aggagagaaaauauau

SEQ ID NO: 2770091 - RNA, 17 nt, Human
aggagagaaaauauaug

SEQ ID NO: 2770092 - RNA, 22 nt, Human
aggagagaaaauauauguauuu

SEQ ID NO: 2770093 - RNA, 14 nt, Human
aggaccugccugua

SEQ ID NO: 2770094 - RNA, 13 nt, Human
aggaccugccugu

SEQ ID NO: 2770095 - RNA, 13 nt, Human
aggaccuggggca

SEQ ID NO: 2770096 - RNA, 16 nt, Human
aggaccuggggcacag

SEQ ID NO: 2770097 - RNA, 17 nt, Human
aggaccuggggcacagu

SEQ ID NO: 2770098 - RNA, 22 nt, Human
aggaccuggggcacaguccagg

SEQ ID NO: 2770099 - RNA, 23 nt, Human
aggaccuggggcacaguccagga

SEQ ID NO: 2770100 - RNA, 17 nt, Human
aggaccuguauuuaagc

SEQ ID NO: 2770101 - RNA, 18 nt, Human
aggaccuguauuuaagca

SEQ ID NO: 2770102 - RNA, 20 nt, Human
aggaccuguauuuaagcaaa

SEQ ID NO: 2770103 - RNA, 21 nt, Human
aggaccuguauuuaagcaaau

SEQ ID NO: 2770104 - RNA, 13 nt, Human
aggaccaggcaau

SEQ ID NO: 2770105 - RNA, 21 nt, Human
aggaccaggacucccuccuca

SEQ ID NO: 2770106 - RNA, 18 nt, Human
aggaccaggauccagccu

SEQ ID NO: 2770107 - RNA, 19 nt, Human
aggaccaggacucccuccu

SEQ ID NO: 2770108 - RNA, 18 nt, Human
aggaccaggacucccucc

SEQ ID NO: 2770109 - RNA, 17 nt, Human
aggaccaggacucccuc

SEQ ID NO: 2770110 - RNA, 16 nt, Human
aggaccaggacucccu

SEQ ID NO: 2770111 - RNA, 13 nt, Human
aggaccaggacuc

SEQ ID NO: 2770112 - RNA, 18 nt, Human
aggacccggaggggccug

SEQ ID NO: 2770113 - RNA, 20 nt, Human
aggacccggaggggccuggc

SEQ ID NO: 2770114 - RNA, 18 nt, Human
aggacccuaacacaguau

SEQ ID NO: 2770115 - RNA, 21 nt, Human
aggacccggaggggccuggca

SEQ ID NO: 2770116 - RNA, 22 nt, Human
aggacccggaggggccuggcag

SEQ ID NO: 2770117 - RNA, 17 nt, Human
aggaccugaaauuccaa

SEQ ID NO: 2770118 - RNA, 18 nt, Human
aggaccugaaauuccaaa

SEQ ID NO: 2770119 - RNA, 20 nt, Human
aggaccugaaauuccaaagu

SEQ ID NO: 2770120 - RNA, 22 nt, Human
aggaccugacccuacucccuug

SEQ ID NO: 2770121 - RNA, 12 nt, Human
aggaccaggacu

SEQ ID NO: 2770122 - RNA, 17 nt, Human
aggaaucaaaaauugaa

SEQ ID NO: 2770123 - RNA, 16 nt, Human
aggaaucaagagcugc

SEQ ID NO: 2770124 - RNA, 17 nt, Human
aggaaucaagagcugcc

SEQ ID NO: 2770125 - RNA, 19 nt, Human
aggaaucaagagcugcccu

SEQ ID NO: 2770126 - RNA, 20 nt, Human
aggaaucaagagcugcccuc

SEQ ID NO: 2770127 - RNA, 21 nt, Human
aggaaucaagagcugcccucc

SEQ ID NO: 2770128 - RNA, 22 nt, Human
aggaaucagcaagaagauccua

SEQ ID NO: 2770129 - RNA, 21 nt, Human
aggaaucaugucaggccugug

SEQ ID NO: 2770130 - RNA, 22 nt, Human
aggaaucaugucaggccugugu

SEQ ID NO: 2770131 - RNA, 19 nt, Human
agggauuuuagucacacgu

SEQ ID NO: 2770132 - RNA, 23 nt, Human
agggcaaaauauucacugggcca

SEQ ID NO: 2770133 - RNA, 21 nt, Human
agggcaaauccagucccaaug

SEQ ID NO: 2770134 - RNA, 13 nt, Human
agggcaaaucugc

SEQ ID NO: 2770135 - RNA, 18 nt, Human
agggcaaaugacaugcac

SEQ ID NO: 2770136 - RNA, 20 nt, Human
agggcaaaugacaugcacug

SEQ ID NO: 2770137 - RNA, 21 nt, Human
agggcaaaugacaugcacuga

SEQ ID NO: 2770138 - RNA, 22 nt, Human
agggcaaaugacaugcacugac

SEQ ID NO: 2770139 - RNA, 23 nt, Human
agggcaaaugacaugcacugacc

SEQ ID NO: 2770140 - RNA, 19 nt, Human
agggaucaucaugcagcuc

SEQ ID NO: 2770141 - RNA, 23 nt, Human
agggccugcaggaccugccugua

SEQ ID NO: 2770142 - RNA, 17 nt, Human
agggccugccuggcccc

SEQ ID NO: 2770143 - RNA, 22 nt, Human
agggccugcaggaccugccugu

SEQ ID NO: 2770144 - RNA, 20 nt, Human
agggccugcaggaccugccu

SEQ ID NO: 2770145 - RNA, 22 nt, Human
agggccugagccuggccagccu

SEQ ID NO: 2770146 - RNA, 20 nt, Human
agggccugagccuggccagc

SEQ ID NO: 2770147 - RNA, 18 nt, Human
agggccugagccuggcca

SEQ ID NO: 2770148 - RNA, 19 nt, Human
agggauaguacuaagcauu

SEQ ID NO: 2770149 - RNA, 20 nt, Human
aggguccuuuaguaccugaa

SEQ ID NO: 2770150 - RNA, 14 nt, Human
agggucgaaagcuc

SEQ ID NO: 2770151 - RNA, 15 nt, Human
agggucgaaagcucu

SEQ ID NO: 2770152 - RNA, 16 nt, Human
agggucgaaagcucua

SEQ ID NO: 2770153 - RNA, 17 nt, Human
agggucggaacccaagc

SEQ ID NO: 2770154 - RNA, 18 nt, Human
agggucgaaagcucuaga

SEQ ID NO: 2770155 - RNA, 22 nt, Human
agggucgaaagcucuagaaucu

SEQ ID NO: 2770156 - RNA, 22 nt, Human
agggucggaacccaagcuuaga

SEQ ID NO: 2770157 - RNA, 16 nt, Human
aggguccuggcuccug

SEQ ID NO: 2770158 - RNA, 18 nt, Human
aggguccuuuaguaccug

SEQ ID NO: 2770159 - RNA, 14 nt, Human
aggguccuggcucc

SEQ ID NO: 2770160 - RNA, 18 nt, Human
aggguccucuacuucagg

SEQ ID NO: 2770161 - RNA, 18 nt, Human
aggguauugcuugccacu

SEQ ID NO: 2770162 - RNA, 20 nt, Human
agggucaacaucuuuuacau

SEQ ID NO: 2770163 - RNA, 14 nt, Human
agggucaaugcuau

SEQ ID NO: 2770164 - RNA, 12 nt, Human
aggggccuggca

SEQ ID NO: 2770165 - RNA, 13 nt, Human
aggggccuggcag

SEQ ID NO: 2770166 - RNA, 19 nt, Human
agggccuggaagacagaga

SEQ ID NO: 2770167 - RNA, 15 nt, Human
agggccuggggccug

SEQ ID NO: 2770168 - RNA, 16 nt, Human
agggccuggggccuga

SEQ ID NO: 2770169 - RNA, 17 nt, Human
agggccuggggccugag

SEQ ID NO: 2770170 - RNA, 18 nt, Human
agggccuggggccugaga

SEQ ID NO: 2770171 - RNA, 19 nt, Human
agggccuggggccugagag

SEQ ID NO: 2770172 - RNA, 20 nt, Human
agggccuggggccugagaga

SEQ ID NO: 2770173 - RNA, 21 nt, Human
agggccuggggccugagagaa

SEQ ID NO: 2770174 - RNA, 22 nt, Human
agggccuggggccugagagaau

SEQ ID NO: 2770175 - RNA, 12 nt, Human
agggccugguug

SEQ ID NO: 2770176 - RNA, 17 nt, Human
agggccugguugaagaa

SEQ ID NO: 2770177 - RNA, 16 nt, Human
aggggccccccugccc

SEQ ID NO: 2770178 - RNA, 17 nt, Human
aggggcccaaggcggcc

SEQ ID NO: 2770179 - RNA, 20 nt, Human
aggggcccaaggcggccccu

SEQ ID NO: 2770180 - RNA, 22 nt, Human
aggggcccaaggcggccccucc

SEQ ID NO: 2770181 - RNA, 14 nt, Human
aggggcaucugccc

SEQ ID NO: 2770182 - RNA, 15 nt, Human
aggggcaucugcccc

SEQ ID NO: 2770183 - RNA, 22 nt, Human
aggggccccccugcccuguggg

SEQ ID NO: 2770184 - RNA, 21 nt, Human
aggggccccccugcccugugg

SEQ ID NO: 2770185 - RNA, 20 nt, Human
aggggccccccugcccugug

SEQ ID NO: 2770186 - RNA, 18 nt, Human
aggggccccccugcccug

SEQ ID NO: 2770187 - RNA, 20 nt, Human
agggucucacuauguugccc

SEQ ID NO: 2770188 - RNA, 15 nt, Human
agggucuauggggag

SEQ ID NO: 2770189 - RNA, 23 nt, Human
aggguuuugccauguuggccagg

SEQ ID NO: 2770190 - RNA, 19 nt, Human
aggguuuuccacccuggaa

SEQ ID NO: 2770191 - RNA, 22 nt, Human
agguaacagaacagcuucaggu

SEQ ID NO: 2770192 - RNA, 23 nt, Human
agguaacagaacagcuucagguu

SEQ ID NO: 2770193 - RNA, 18 nt, Human
aggguuuuccacccugga

SEQ ID NO: 2770194 - RNA, 15 nt, Human
aggguuuuccacccu

SEQ ID NO: 2770195 - RNA, 22 nt, Human
aggguuuugccauguuggccag

SEQ ID NO: 2770196 - RNA, 14 nt, Human
aggguuuguggcug

SEQ ID NO: 2770197 - RNA, 14 nt, Human
agguaacaggcaga

SEQ ID NO: 2770198 - RNA, 13 nt, Human
agguaacaggcag

SEQ ID NO: 2770199 - RNA, 16 nt, Human
agguaacaggcagaua

SEQ ID NO: 2770200 - RNA, 13 nt, Human
agguacgcacaga

SEQ ID NO: 2770201 - RNA, 15 nt, Human
agguacgcacagaca

SEQ ID NO: 2770202 - RNA, 16 nt, Human
agguacgcacagacag

SEQ ID NO: 2770203 - RNA, 17 nt, Human
agguacgcacagacagg

SEQ ID NO: 2770204 - RNA, 16 nt, Human
agguccuacagggcca

SEQ ID NO: 2770205 - RNA, 19 nt, Human
agguccgguguucuaagau

SEQ ID NO: 2770206 - RNA, 18 nt, Human
agguccgguguucuaaga

SEQ ID NO: 2770207 - RNA, 14 nt, Human
agguacuauucuga

SEQ ID NO: 2770208 - RNA, 15 nt, Human
agguacuaaauaccu

SEQ ID NO: 2770209 - RNA, 14 nt, Human
agguacuagaaugc

SEQ ID NO: 2770210 - RNA, 16 nt, Human
agguacuagaaugcuu

SEQ ID NO: 2770211 - RNA, 17 nt, Human
agguacuagaaugcuua

SEQ ID NO: 2770212 - RNA, 15 nt, Human
agguacuauauuugc

SEQ ID NO: 2770213 - RNA, 19 nt, Human
aggucgggaguuggagacc

SEQ ID NO: 2770214 - RNA, 21 nt, Human
agguccugaaaguaacucaua

SEQ ID NO: 2770215 - RNA, 20 nt, Human
agguccucuggagcccuaac

SEQ ID NO: 2770216 - RNA, 15 nt, Human
agguccucuggagcc

SEQ ID NO: 2770217 - RNA, 15 nt, Human
agguccucagagaau

SEQ ID NO: 2770218 - RNA, 13 nt, Human
aggucucacgggc

SEQ ID NO: 2770219 - RNA, 17 nt, Human
aggucucccacguggga

SEQ ID NO: 2770220 - RNA, 21 nt, Human
aggucugggcuagguagaaaa

SEQ ID NO: 2770221 - RNA, 23 nt, Human
agggacugccagucccccugccc

SEQ ID NO: 2770222 - RNA, 15 nt, Human
agggacugccucugc

SEQ ID NO: 2770223 - RNA, 16 nt, Human
agggacugccucugcc

SEQ ID NO: 2770224 - RNA, 17 nt, Human
agggacugccucugcca

SEQ ID NO: 2770225 - RNA, 18 nt, Human
agggacugccucugccac

SEQ ID NO: 2770226 - RNA, 13 nt, Human
agggaccaugugu

SEQ ID NO: 2770227 - RNA, 18 nt, Human
agggaccacacccuguac

SEQ ID NO: 2770228 - RNA, 15 nt, Human
aggcuuagcuuugcu

SEQ ID NO: 2770229 - RNA, 19 nt, Human
aggcuuagcuuugcucugc

SEQ ID NO: 2770230 - RNA, 20 nt, Human
aggcuuagcuuugcucugcc

SEQ ID NO: 2770231 - RNA, 22 nt, Human
aggcuguaucccaugagccuca

SEQ ID NO: 2770232 - RNA, 21 nt, Human
aggcuguaucccaugagccuc

SEQ ID NO: 2770233 - RNA, 20 nt, Human
aggcuguaucccaugagccu

SEQ ID NO: 2770234 - RNA, 22 nt, Human
aggcuggucucaaacuccugac

SEQ ID NO: 2770235 - RNA, 23 nt, Human
aggcuggucucgaacuccugacc

SEQ ID NO: 2770236 - RNA, 11 nt, Human
aggcuggucuu

SEQ ID NO: 2770237 - RNA, 15 nt, Human
aggcuggucuugaag

SEQ ID NO: 2770238 - RNA, 19 nt, Human
aggcuggucuugaaguccu

SEQ ID NO: 2770239 - RNA, 17 nt, Human
aggcuggucuaaaacuc

SEQ ID NO: 2770240 - RNA, 19 nt, Human
aggcuacacugacacuggu

SEQ ID NO: 2770241 - RNA, 13 nt, Human
aggcuacacugac

SEQ ID NO: 2770242 - RNA, 18 nt, Human
aggcuacacugacacugg

SEQ ID NO: 2770243 - RNA, 15 nt, Human
aggcuaaggcgugga

SEQ ID NO: 2770244 - RNA, 18 nt, Human
aggcuaaggcguggagcu

SEQ ID NO: 2770245 - RNA, 19 nt, Human
aggcuaaggcguggagcug

SEQ ID NO: 2770246 - RNA, 23 nt, Human
aggcuaaggcguggagcugccug

SEQ ID NO: 2770247 - RNA, 20 nt, Human
aggcuaaggcguggagcugc

SEQ ID NO: 2770248 - RNA, 13 nt, Human
aggcuaaugucaa

SEQ ID NO: 2770249 - RNA, 14 nt, Human
aggcuaaugucaaa

SEQ ID NO: 2770250 - RNA, 21 nt, Human
aggcugaggcggguggaucac

SEQ ID NO: 2770251 - RNA, 11 nt, Human
aggcugaggcg

SEQ ID NO: 2770252 - RNA, 17 nt, Human
aggcugaggcaggagga

SEQ ID NO: 2770253 - RNA, 19 nt, Human
aggcugaggcaggagaaug

SEQ ID NO: 2770254 - RNA, 15 nt, Human
aggcugaggcaggag

SEQ ID NO: 2770255 - RNA, 14 nt, Human
aggcugaggcagga

SEQ ID NO: 2770256 - RNA, 16 nt, Human
aggcugagacugcggg

SEQ ID NO: 2770257 - RNA, 17 nt, Human
aggcugagacugcggga

SEQ ID NO: 2770258 - RNA, 11 nt, Human
aggcugagcca

SEQ ID NO: 2770259 - RNA, 16 nt, Human
aggcugacgugugagg

SEQ ID NO: 2770260 - RNA, 20 nt, Human
aggcugacgugugagggagg

SEQ ID NO: 2770261 - RNA, 16 nt, Human
aggcugagaacacugu

SEQ ID NO: 2770262 - RNA, 19 nt, Human
aggcugagaacacugugaa

SEQ ID NO: 2770263 - RNA, 13 nt, Human
aggcugagacagg

SEQ ID NO: 2770264 - RNA, 14 nt, Human
aggcgggaggaggu

SEQ ID NO: 2770265 - RNA, 20 nt, Human
aggcgggaggaggugugagg

SEQ ID NO: 2770266 - RNA, 16 nt, Human
aggcggccccucccgc

SEQ ID NO: 2770267 - RNA, 14 nt, Human
aggcggccccuccc

SEQ ID NO: 2770268 - RNA, 17 nt, Human
aggcgggggcugcccuu

SEQ ID NO: 2770269 - RNA, 20 nt, Human
aggcgguggacuugaacuuu

SEQ ID NO: 2770270 - RNA, 19 nt, Human
aggcuaaggcaggaaaauu

SEQ ID NO: 2770271 - RNA, 17 nt, Human
aggcgucccgcaccugu

SEQ ID NO: 2770272 - RNA, 19 nt, Human
aggcgucccgcaccugucu

SEQ ID NO: 2770273 - RNA, 21 nt, Human
aggcgucccgcaccugucuga

SEQ ID NO: 2770274 - RNA, 14 nt, Human
aggcggugggcacc

SEQ ID NO: 2770275 - RNA, 21 nt, Human
aggcggugggcacccacccug

SEQ ID NO: 2770276 - RNA, 20 nt, Human
aggccggcgagcccugugga

SEQ ID NO: 2770277 - RNA, 10 nt, Human
aggcccuggc

SEQ ID NO: 2770278 - RNA, 14 nt, Human
aggcccugcugccc

SEQ ID NO: 2770279 - RNA, 15 nt, Human
aggcccugcugccca

SEQ ID NO: 2770280 - RNA, 11 nt, Human
aggcccugcag

SEQ ID NO: 2770281 - RNA, 12 nt, Human
aggcccugcagu

SEQ ID NO: 2770282 - RNA, 13 nt, Human
aggcccugcagug

SEQ ID NO: 2770283 - RNA, 11 nt, Human
aggcccugcau

SEQ ID NO: 2770284 - RNA, 12 nt, Human
aggcccugcaug

SEQ ID NO: 2770285 - RNA, 12 nt, Human
aggcccugccca

SEQ ID NO: 2770286 - RNA, 12 nt, Human
aggcccugcucc

SEQ ID NO: 2770287 - RNA, 16 nt, Human
aggcccugcuccugca

SEQ ID NO: 2770288 - RNA, 17 nt, Human
aggcccugcuccugcag

SEQ ID NO: 2770289 - RNA, 18 nt, Human
aggcccugcuccugcagc

SEQ ID NO: 2770290 - RNA, 19 nt, Human
aggcccugcuccugcagca

SEQ ID NO: 2770291 - RNA, 21 nt, Human
aggcccugcuccugcagcaug

SEQ ID NO: 2770292 - RNA, 22 nt, Human
aggcccugcuccugcagcaugg

SEQ ID NO: 2770293 - RNA, 12 nt, Human
aggccauggcuc

SEQ ID NO: 2770294 - RNA, 22 nt, Human
aggcccuggugcgaauggacuu

SEQ ID NO: 2770295 - RNA, 13 nt, Human
aggcccugucugu

SEQ ID NO: 2770296 - RNA, 14 nt, Human
aggcccugucugua

SEQ ID NO: 2770297 - RNA, 16 nt, Human
aggccgcgcccuuucc

SEQ ID NO: 2770298 - RNA, 19 nt, Human
aggcccuuccucuccacug

SEQ ID NO: 2770299 - RNA, 22 nt, Human
aggcccuuccucuccacugccu

SEQ ID NO: 2770300 - RNA, 13 nt, Human
aggccggccagcc

SEQ ID NO: 2770301 - RNA, 14 nt, Human
aggccggccagccu

SEQ ID NO: 2770302 - RNA, 15 nt, Human
aggccggccagccuc

SEQ ID NO: 2770303 - RNA, 16 nt, Human
aggccggccagccuca

SEQ ID NO: 2770304 - RNA, 19 nt, Human
aggccggcgagcccugugg

SEQ ID NO: 2770305 - RNA, 14 nt, Human
aggcauguccugga

SEQ ID NO: 2770306 - RNA, 21 nt, Human
aggccaggaguuugagaccag

SEQ ID NO: 2770307 - RNA, 11 nt, Human
aggccaggagu

SEQ ID NO: 2770308 - RNA, 15 nt, Human
aggccaggccagcug

SEQ ID NO: 2770309 - RNA, 13 nt, Human
aggccaggccagc

SEQ ID NO: 2770310 - RNA, 16 nt, Human
aggccauaaaacaggu

SEQ ID NO: 2770311 - RNA, 21 nt, Human
aggccaucaucaguggagcca

SEQ ID NO: 2770312 - RNA, 14 nt, Human
aggccaggugcagu

SEQ ID NO: 2770313 - RNA, 13 nt, Human
aggccaugaaaaa

SEQ ID NO: 2770314 - RNA, 19 nt, Human
aggccaugaaaaaaaugau

SEQ ID NO: 2770315 - RNA, 15 nt, Human
aggccauggcagaau

SEQ ID NO: 2770316 - RNA, 17 nt, Human
aggccauggagagcugg

SEQ ID NO: 2770317 - RNA, 18 nt, Human
aggccauggagagcugga

SEQ ID NO: 2770318 - RNA, 21 nt, Human
aggccauggagagcuggagcc

SEQ ID NO: 2770319 - RNA, 22 nt, Human
aggccauggagagcuggagccu

SEQ ID NO: 2770320 - RNA, 16 nt, Human
aggccauggagagcug

SEQ ID NO: 2770321 - RNA, 12 nt, Human
aggcauguucuc

SEQ ID NO: 2770322 - RNA, 19 nt, Human
aggcauguucucugaggac

SEQ ID NO: 2770323 - RNA, 18 nt, Human
aggcauguucucugagga

SEQ ID NO: 2770324 - RNA, 17 nt, Human
aggcauguucucugagg

SEQ ID NO: 2770325 - RNA, 12 nt, Human
aggcauguccug

SEQ ID NO: 2770326 - RNA, 17 nt, Human
aggcauguaggacccug

SEQ ID NO: 2770327 - RNA, 19 nt, Human
aggcauguaggacccugca

SEQ ID NO: 2770328 - RNA, 12 nt, Human
aggcaugguggc

SEQ ID NO: 2770329 - RNA, 21 nt, Human
aggcaugggggguggggggag

SEQ ID NO: 2770330 - RNA, 19 nt, Human
aggcaugggugcaaggaaa

SEQ ID NO: 2770331 - RNA, 20 nt, Human
aggcaugggugcaaggaaaa

SEQ ID NO: 2770332 - RNA, 21 nt, Human
aggcaugggugcaaggaaaau

SEQ ID NO: 2770333 - RNA, 15 nt, Human
aggcauggcccuggg

SEQ ID NO: 2770334 - RNA, 14 nt, Human
aggcauggcccugg

SEQ ID NO: 2770335 - RNA, 16 nt, Human
aggcauggcccugggg

SEQ ID NO: 2770336 - RNA, 21 nt, Human
aggcauggcccugggguccca

SEQ ID NO: 2770337 - RNA, 23 nt, Human
aggcagaucugugccccaugccu

SEQ ID NO: 2770338 - RNA, 22 nt, Human
aggcagaucugugccccaugcc

SEQ ID NO: 2770339 - RNA, 13 nt, Human
aggcauggcccug

SEQ ID NO: 2770340 - RNA, 12 nt, Human
aggcauggcccu

SEQ ID NO: 2770341 - RNA, 16 nt, Human
aggcagcauguauagu

SEQ ID NO: 2770342 - RNA, 21 nt, Human
aggcagcauguauaguugcuu

SEQ ID NO: 2770343 - RNA, 13 nt, Human
aggcacuagccuu

SEQ ID NO: 2770344 - RNA, 15 nt, Human
aggcacuagccuuug

SEQ ID NO: 2770345 - RNA, 23 nt, Human
aggcacuagccuuuggcucugga

SEQ ID NO: 2770346 - RNA, 14 nt, Human
aggcacucuagauu

SEQ ID NO: 2770347 - RNA, 15 nt, Human
aggcacucuagauuc

SEQ ID NO: 2770348 - RNA, 16 nt, Human
aggcacucuguuauuu

SEQ ID NO: 2770349 - RNA, 17 nt, Human
aggcacucuagauucca

SEQ ID NO: 2770350 - RNA, 20 nt, Human
aggcacucuguuauuuagac

SEQ ID NO: 2770351 - RNA, 14 nt, Human
aggcacucuuaaau

SEQ ID NO: 2770352 - RNA, 22 nt, Human
aggcagacuucccugaauguau

SEQ ID NO: 2770353 - RNA, 19 nt, Human
aggcacucuguuauuuaga

SEQ ID NO: 2770354 - RNA, 9 nt, Human
aggcagaga

SEQ ID NO: 2770355 - RNA, 17 nt, Human
aggcacugaagugcuua

SEQ ID NO: 2770356 - RNA, 13 nt, Human
aggcagagaaagg

SEQ ID NO: 2770357 - RNA, 21 nt, Human
aggcagaucugugccccaugc

SEQ ID NO: 2770358 - RNA, 20 nt, Human
aggcagaucugugccccaug

SEQ ID NO: 2770359 - RNA, 16 nt, Human
aggcagaucugugccc

SEQ ID NO: 2770360 - RNA, 15 nt, Human
aggcagaucugugcc

SEQ ID NO: 2770361 - RNA, 14 nt, Human
aggcagagaaucau

SEQ ID NO: 2770362 - RNA, 22 nt, Human
aggcagagaaucauacuuagca

SEQ ID NO: 2770363 - RNA, 11 nt, Human
aggcagagagc

SEQ ID NO: 2770364 - RNA, 13 nt, Human
aggcagagagcgg

SEQ ID NO: 2770365 - RNA, 20 nt, Human
aggcagagagcggucucagg

SEQ ID NO: 2770366 - RNA, 21 nt, Human
aggagaggcaacauccaaaau

SEQ ID NO: 2770367 - RNA, 23 nt, Human
aggagaggaugagagcccagagg

SEQ ID NO: 2770368 - RNA, 20 nt, Human
aggagaggcaacauccaaaa

SEQ ID NO: 2770369 - RNA, 18 nt, Human
aggagaggaugagagccc

SEQ ID NO: 2770370 - RNA, 19 nt, Human
aggagaggaugagagccca

SEQ ID NO: 2770371 - RNA, 20 nt, Human
aggagaggaugagagcccag

SEQ ID NO: 2770372 - RNA, 21 nt, Human
aggagaggaugagagcccaga

SEQ ID NO: 2770373 - RNA, 12 nt, Human
aggaccugcccc

SEQ ID NO: 2770374 - RNA, 19 nt, Human
agaggaauccaugaagaau

SEQ ID NO: 2770375 - RNA, 14 nt, Human
agaggaauaagaau

SEQ ID NO: 2770376 - RNA, 17 nt, Human
agagggcucugugcuga

SEQ ID NO: 2770377 - RNA, 19 nt, Human
agagggcucugugcugaca

SEQ ID NO: 2770378 - RNA, 18 nt, Human
agaggggcuuucuggaga

SEQ ID NO: 2770379 - RNA, 16 nt, Human
agagggggacugcugc

SEQ ID NO: 2770380 - RNA, 22 nt, Human
agagggggacugcugcugccug

SEQ ID NO: 2770381 - RNA, 22 nt, Human
agaggacuuuucuuuguggcuu

SEQ ID NO: 2770382 - RNA, 21 nt, Human
agaggacuuuucuuuguggcu

SEQ ID NO: 2770383 - RNA, 14 nt, Human
agaggacuuuucuu

SEQ ID NO: 2770384 - RNA, 13 nt, Human
agaggaauuuaua

SEQ ID NO: 2770385 - RNA, 21 nt, Human
agaggaauccuggcagcccag

SEQ ID NO: 2770386 - RNA, 17 nt, Human
agaggaauccuggcagc

SEQ ID NO: 2770387 - RNA, 15 nt, Human
agaggaauccuggca

SEQ ID NO: 2770388 - RNA, 23 nt, Human
agaggacuuuucuuuguggcuuc

SEQ ID NO: 2770389 - RNA, 14 nt, Human
agaggagccuuuuu

SEQ ID NO: 2770390 - RNA, 23 nt, Human
agaggagccuuuuuaaaacacau

SEQ ID NO: 2770391 - RNA, 22 nt, Human
agaggagccuuuuuaaaacaca

SEQ ID NO: 2770392 - RNA, 23 nt, Human
agaggagggagcaucagugcccu

SEQ ID NO: 2770393 - RNA, 17 nt, Human
agaggagggaugcugcc

SEQ ID NO: 2770394 - RNA, 20 nt, Human
agaggaguacaggugaagca

SEQ ID NO: 2770395 - RNA, 16 nt, Human
agacucuguggggccu

SEQ ID NO: 2770396 - RNA, 16 nt, Human
agacugaggacaaagu

SEQ ID NO: 2770397 - RNA, 17 nt, Human
agacugaggacaaagug

SEQ ID NO: 2770398 - RNA, 19 nt, Human
agacugcugggacuggcca

SEQ ID NO: 2770399 - RNA, 22 nt, Human
agacugcugggacuggccaggu

SEQ ID NO: 2770400 - RNA, 20 nt, Human
agacugcugggacuggccag

SEQ ID NO: 2770401 - RNA, 19 nt, Human
agacugcuuccaauuuucu

SEQ ID NO: 2770402 - RNA, 13 nt, Human
agacucugucuca

SEQ ID NO: 2770403 - RNA, 18 nt, Human
agacucugucucaaaaaa

SEQ ID NO: 2770404 - RNA, 16 nt, Human
agagagaccacuuuuc

SEQ ID NO: 2770405 - RNA, 10 nt, Human
agagagagag

SEQ ID NO: 2770406 - RNA, 11 nt, Human
agagagagaga

SEQ ID NO: 2770407 - RNA, 12 nt, Human
agagagagagaa

SEQ ID NO: 2770408 - RNA, 14 nt, Human
agagagagagaaaa

SEQ ID NO: 2770409 - RNA, 14 nt, Human
agagagagagaaau

SEQ ID NO: 2770410 - RNA, 12 nt, Human
agagagagagag

SEQ ID NO: 2770411 - RNA, 15 nt, Human
agagagagagagaaa

SEQ ID NO: 2770412 - RNA, 10 nt, Human
agagagagaa

SEQ ID NO: 2770413 - RNA, 12 nt, Human
agagagagaaaa

SEQ ID NO: 2770414 - RNA, 13 nt, Human
agagagagaaaga

SEQ ID NO: 2770415 - RNA, 14 nt, Human
agagagagaaagag

SEQ ID NO: 2770416 - RNA, 21 nt, Human
agacuggaagcuaauuugcau

SEQ ID NO: 2770417 - RNA, 11 nt, Human
agacuggaagg

SEQ ID NO: 2770418 - RNA, 14 nt, Human
agacuggaaguuca

SEQ ID NO: 2770419 - RNA, 19 nt, Human
agacuggaaguucauaccu

SEQ ID NO: 2770420 - RNA, 21 nt, Human
agacuggaaguucauaccuaa

SEQ ID NO: 2770421 - RNA, 14 nt, Human
agacuggaaaaaau

SEQ ID NO: 2770422 - RNA, 16 nt, Human
agacuggaaaaaauga

SEQ ID NO: 2770423 - RNA, 17 nt, Human
agacuggaaaaaaugag

SEQ ID NO: 2770424 - RNA, 18 nt, Human
agacuggaaaaaaugagc

SEQ ID NO: 2770425 - RNA, 20 nt, Human
agacuggaagcuaauuugca

SEQ ID NO: 2770426 - RNA, 13 nt, Human
agagccagggucu

SEQ ID NO: 2770427 - RNA, 13 nt, Human
agagcccaccuug

SEQ ID NO: 2770428 - RNA, 19 nt, Human
agagccauauaaguuugaa

SEQ ID NO: 2770429 - RNA, 16 nt, Human
agagccaugcugggaa

SEQ ID NO: 2770430 - RNA, 20 nt, Human
agagccauauaaguuugaag

SEQ ID NO: 2770431 - RNA, 22 nt, Human
agagccauauaaguuugaagga

SEQ ID NO: 2770432 - RNA, 20 nt, Human
agagaggccuuuuggaaugu

SEQ ID NO: 2770433 - RNA, 14 nt, Human
agagaggccuuuug

SEQ ID NO: 2770434 - RNA, 17 nt, Human
agagagggagguaugga

SEQ ID NO: 2770435 - RNA, 15 nt, Human
agagagggcaggcau

SEQ ID NO: 2770436 - RNA, 20 nt, Human
agagagggccaugcaauuca

SEQ ID NO: 2770437 - RNA, 14 nt, Human
agagagggcaggca

SEQ ID NO: 2770438 - RNA, 17 nt, Human
agagccauuuugugaau

SEQ ID NO: 2770439 - RNA, 16 nt, Human
agagccgggaagcgau

SEQ ID NO: 2770440 - RNA, 13 nt, Human
agagccgggaagc

SEQ ID NO: 2770441 - RNA, 15 nt, Human
agagcccuucauuug

SEQ ID NO: 2770442 - RNA, 16 nt, Human
agagccauuuugugaa

SEQ ID NO: 2770443 - RNA, 18 nt, Human
agagccauguagaagcug

SEQ ID NO: 2770444 - RNA, 20 nt, Human
agagccauguagaagcugca

SEQ ID NO: 2770445 - RNA, 22 nt, Human
agagccgggcacauugagcugu

SEQ ID NO: 2770446 - RNA, 21 nt, Human
agagccucccaaggagaacaa

SEQ ID NO: 2770447 - RNA, 22 nt, Human
agagccucccaaggagaacaaa

SEQ ID NO: 2770448 - RNA, 23 nt, Human
agagccucccaaggagaacaaau

SEQ ID NO: 2770449 - RNA, 12 nt, Human
agaccagcucuu

SEQ ID NO: 2770450 - RNA, 15 nt, Human
agaccagccuggcca

SEQ ID NO: 2770451 - RNA, 19 nt, Human
agaccagccuggccaacau

SEQ ID NO: 2770452 - RNA, 22 nt, Human
agaccagccuggccaacauggc

SEQ ID NO: 2770453 - RNA, 22 nt, Human
agaccagccugggcaacaaagu

SEQ ID NO: 2770454 - RNA, 13 nt, Human
agaccagccuggc

SEQ ID NO: 2770455 - RNA, 14 nt, Human
agaccagccuggcc

SEQ ID NO: 2770456 - RNA, 12 nt, Human
agaccagccugg

SEQ ID NO: 2770457 - RNA, 13 nt, Human
agacccaccccac

SEQ ID NO: 2770458 - RNA, 16 nt, Human
agacccaccccaccug

SEQ ID NO: 2770459 - RNA, 17 nt, Human
agacccaccccaccugc

SEQ ID NO: 2770460 - RNA, 18 nt, Human
agacccaccccaccugca

SEQ ID NO: 2770461 - RNA, 19 nt, Human
agacccaccccaccugcag

SEQ ID NO: 2770462 - RNA, 20 nt, Human
agacccaccccaccugcagg

SEQ ID NO: 2770463 - RNA, 21 nt, Human
agacccaccccaccugcaggg

SEQ ID NO: 2770464 - RNA, 11 nt, Human
agacccaggac

SEQ ID NO: 2770465 - RNA, 17 nt, Human
agacgauuugucaguua

SEQ ID NO: 2770466 - RNA, 14 nt, Human
agacgcauuucggu

SEQ ID NO: 2770467 - RNA, 15 nt, Human
agacgccugagcuca

SEQ ID NO: 2770468 - RNA, 20 nt, Human
agacgccggggacagaggcc

SEQ ID NO: 2770469 - RNA, 22 nt, Human
agacgccggggacagaggccug

SEQ ID NO: 2770470 - RNA, 14 nt, Human
agacagcaggcagc

SEQ ID NO: 2770471 - RNA, 18 nt, Human
agacagcaggcagcgcca

SEQ ID NO: 2770472 - RNA, 19 nt, Human
agacagaugccccagagcu

SEQ ID NO: 2770473 - RNA, 16 nt, Human
agacagaugccccaga

SEQ ID NO: 2770474 - RNA, 15 nt, Human
agacagaugccccag

SEQ ID NO: 2770475 - RNA, 14 nt, Human
agacagaugcccca

SEQ ID NO: 2770476 - RNA, 21 nt, Human
agacagagucucacuguugcc

SEQ ID NO: 2770477 - RNA, 17 nt, Human
agacagagggucacagu

SEQ ID NO: 2770478 - RNA, 19 nt, Human
agacagagggucacagugu

SEQ ID NO: 2770479 - RNA, 18 nt, Human
agacaaauucauauucuu

SEQ ID NO: 2770480 - RNA, 20 nt, Human
agacagagucucacuguugc

SEQ ID NO: 2770481 - RNA, 19 nt, Human
agacagagucucacuguug

SEQ ID NO: 2770482 - RNA, 11 nt, Human
agacagagucu

SEQ ID NO: 2770483 - RNA, 12 nt, Human
agacaaauauuu

SEQ ID NO: 2770484 - RNA, 15 nt, Human
agacaaauauuugga

SEQ ID NO: 2770485 - RNA, 16 nt, Human
agacaaaucaaagcag

SEQ ID NO: 2770486 - RNA, 17 nt, Human
agacaaaucaacagaag

SEQ ID NO: 2770487 - RNA, 18 nt, Human
agacaaaucaacagaagc

SEQ ID NO: 2770488 - RNA, 21 nt, Human
agacaaaucaacagaagcauu

SEQ ID NO: 2770489 - RNA, 16 nt, Human
agacaaauauuuggag

SEQ ID NO: 2770490 - RNA, 18 nt, Human
agacaaacuguaaaaaau

SEQ ID NO: 2770491 - RNA, 21 nt, Human
agacaaacuguaaaaaaugug

SEQ ID NO: 2770492 - RNA, 19 nt, Human
agacaaacaccucccagga

SEQ ID NO: 2770493 - RNA, 18 nt, Human
agacaaagguuuuccucu

SEQ ID NO: 2770494 - RNA, 14 nt, Human
agacaaaauguuuu

SEQ ID NO: 2770495 - RNA, 13 nt, Human
agacaaaauuuua

SEQ ID NO: 2770496 - RNA, 20 nt, Human
agacaaaauuuuaguccaaa

SEQ ID NO: 2770497 - RNA, 22 nt, Human
agaaugacggaauaagagaccu

SEQ ID NO: 2770498 - RNA, 16 nt, Human
agaaugagcacccauu

SEQ ID NO: 2770499 - RNA, 13 nt, Human
agaagucaugaag

SEQ ID NO: 2770500 - RNA, 14 nt, Human
agaagucaaaguaa

SEQ ID NO: 2770501 - RNA, 18 nt, Human
agaaugaaagggcccaga

SEQ ID NO: 2770502 - RNA, 16 nt, Human
agaagucuuucaagaa

SEQ ID NO: 2770503 - RNA, 19 nt, Human
agaagucuuucaagaauga

SEQ ID NO: 2770504 - RNA, 21 nt, Human
agaauggcgccaccagcucug

SEQ ID NO: 2770505 - RNA, 17 nt, Human
agaaugggaauauuuua

SEQ ID NO: 2770506 - RNA, 22 nt, Human
agaauggcccaguccucuccca

SEQ ID NO: 2770507 - RNA, 16 nt, Human
agaaugauuuuuagau

SEQ ID NO: 2770508 - RNA, 14 nt, Human
agaaugauuucaug

SEQ ID NO: 2770509 - RNA, 13 nt, Human
agaaugauuucau

SEQ ID NO: 2770510 - RNA, 22 nt, Human
agaaugcugcaggacuugagaa

SEQ ID NO: 2770511 - RNA, 13 nt, Human
agaaugcuguaca

SEQ ID NO: 2770512 - RNA, 15 nt, Human
agaaugcuguacauc

SEQ ID NO: 2770513 - RNA, 14 nt, Human
agaaugcuguacau

SEQ ID NO: 2770514 - RNA, 20 nt, Human
agaaugcuguacaucuauuu

SEQ ID NO: 2770515 - RNA, 13 nt, Human
agaauggaaaaga

SEQ ID NO: 2770516 - RNA, 23 nt, Human
agaauggaaaccacaacuuuuaa

SEQ ID NO: 2770517 - RNA, 14 nt, Human
agaauggagaggaa

SEQ ID NO: 2770518 - RNA, 15 nt, Human
agaauggagaggaac

SEQ ID NO: 2770519 - RNA, 18 nt, Human
agaauggauaaaauaaug

SEQ ID NO: 2770520 - RNA, 23 nt, Human
agaauggauaaaauaaugcugca

SEQ ID NO: 2770521 - RNA, 22 nt, Human
agaagagaggagaggagagagg

SEQ ID NO: 2770522 - RNA, 15 nt, Human
agaagagaggggaag

SEQ ID NO: 2770523 - RNA, 15 nt, Human
agaagagaggagagg

SEQ ID NO: 2770524 - RNA, 16 nt, Human
agaagagaggagagga

SEQ ID NO: 2770525 - RNA, 20 nt, Human
agaagagaggagaggagaga

SEQ ID NO: 2770526 - RNA, 21 nt, Human
agaagagaggagaggagagag

SEQ ID NO: 2770527 - RNA, 15 nt, Human
agaagagagaaauag

SEQ ID NO: 2770528 - RNA, 13 nt, Human
agaagagaggaga

SEQ ID NO: 2770529 - RNA, 18 nt, Human
agaagagacucuuugcau

SEQ ID NO: 2770530 - RNA, 21 nt, Human
agaagaccacaaaaauugacu

SEQ ID NO: 2770531 - RNA, 21 nt, Human
agaagacacugaugggcaacc

SEQ ID NO: 2770532 - RNA, 23 nt, Human
agaagacaccagagcagaugcag

SEQ ID NO: 2770533 - RNA, 13 nt, Human
agaagacacugau

SEQ ID NO: 2770534 - RNA, 14 nt, Human
agaagacaccagag

SEQ ID NO: 2770535 - RNA, 15 nt, Human
agaagacaccagagc

SEQ ID NO: 2770536 - RNA, 16 nt, Human
agaagacaccagagca

SEQ ID NO: 2770537 - RNA, 17 nt, Human
agaagacaccagagcag

SEQ ID NO: 2770538 - RNA, 18 nt, Human
agaagacaccagagcaga

SEQ ID NO: 2770539 - RNA, 19 nt, Human
agaagacaccagagcagau

SEQ ID NO: 2770540 - RNA, 22 nt, Human
agaagacaccagagcagaugca

SEQ ID NO: 2770541 - RNA, 21 nt, Human
acuuuccucuuagucgagcca

SEQ ID NO: 2770542 - RNA, 19 nt, Human
acuuuccuccugaggcuuu

SEQ ID NO: 2770543 - RNA, 11 nt, Human
acuuucccuug

SEQ ID NO: 2770544 - RNA, 13 nt, Human
acuuucccuugcu

SEQ ID NO: 2770545 - RNA, 14 nt, Human
acuuucccuugcuu

SEQ ID NO: 2770546 - RNA, 17 nt, Human
acuuucccuugcuuuuc

SEQ ID NO: 2770547 - RNA, 22 nt, Human
acuuucccuugcuuuucccucu

SEQ ID NO: 2770548 - RNA, 23 nt, Human
acuuucccuugcuuuucccucuu

SEQ ID NO: 2770549 - RNA, 16 nt, Human
acuuucccagguucug

SEQ ID NO: 2770550 - RNA, 21 nt, Human
acuuucccagguucuguuuau

SEQ ID NO: 2770551 - RNA, 17 nt, Human
agaagguugacacaguu

SEQ ID NO: 2770552 - RNA, 20 nt, Human
agaagguugcucuagauuga

SEQ ID NO: 2770553 - RNA, 16 nt, Human
agaagguugcucuaga

SEQ ID NO: 2770554 - RNA, 18 nt, Human
agaagguuucagaaagaa

SEQ ID NO: 2770555 - RNA, 19 nt, Human
agaaguagauuaagagcca

SEQ ID NO: 2770556 - RNA, 13 nt, Human
agaaguagauuaa

SEQ ID NO: 2770557 - RNA, 20 nt, Human
agaaguagauuaagagccau

SEQ ID NO: 2770558 - RNA, 16 nt, Human
agaaguagccacagua

SEQ ID NO: 2770559 - RNA, 15 nt, Human
agaaggugccacuuu

SEQ ID NO: 2770560 - RNA, 22 nt, Human
agaagguggguuuucaucaaga

SEQ ID NO: 2770561 - RNA, 21 nt, Human
agaaggugccucaagaauuuc

SEQ ID NO: 2770562 - RNA, 15 nt, Human
agaagguggaccuuu

SEQ ID NO: 2770563 - RNA, 18 nt, Human
agaagguggaccuuuuaa

SEQ ID NO: 2770564 - RNA, 21 nt, Human
agaagguggaccuuuuaaagu

SEQ ID NO: 2770565 - RNA, 22 nt, Human
agaagguggaccuuuuaaagug

SEQ ID NO: 2770566 - RNA, 24 nt, Human
agaagguggaccuuuuaaaguguu

SEQ ID NO: 2770567 - RNA, 20 nt, Human
agaaggguuuuccacccugg

SEQ ID NO: 2770568 - RNA, 22 nt, Human
agaaggguuuuccacccuggaa

SEQ ID NO: 2770569 - RNA, 21 nt, Human
agaaggguuuuccacccugga

SEQ ID NO: 2770570 - RNA, 23 nt, Human
agaaggguuuuccacccuggaau

SEQ ID NO: 2770571 - RNA, 16 nt, Human
agaagaguugaggaac

SEQ ID NO: 2770572 - RNA, 22 nt, Human
agaagaguugaggaacuguaca

SEQ ID NO: 2770573 - RNA, 23 nt, Human
agaagaguugaggaacuguacag

SEQ ID NO: 2770574 - RNA, 19 nt, Human
agaagaguugugcacgcag

SEQ ID NO: 2770575 - RNA, 13 nt, Human
agaagauaauugu

SEQ ID NO: 2770576 - RNA, 14 nt, Human
agaagauaauuguu

SEQ ID NO: 2770577 - RNA, 17 nt, Human
agaagauaauuguugaa

SEQ ID NO: 2770578 - RNA, 22 nt, Human
agaagauaauuguugaaauuuu

SEQ ID NO: 2770579 - RNA, 21 nt, Human
agaaggggcgggaauauuguu

SEQ ID NO: 2770580 - RNA, 24 nt, Human
agaaggggcgggaauauuguuucu

SEQ ID NO: 2770581 - RNA, 15 nt, Human
agaagaggguguguu

SEQ ID NO: 2770582 - RNA, 17 nt, Human
agaagaggguguguuug

SEQ ID NO: 2770583 - RNA, 14 nt, Human
agaugguugccaag

SEQ ID NO: 2770584 - RNA, 17 nt, Human
agaugguuuccacauuu

SEQ ID NO: 2770585 - RNA, 17 nt, Human
agauguaaaagguauua

SEQ ID NO: 2770586 - RNA, 21 nt, Human
agauucucuggcuguaaggcu

SEQ ID NO: 2770587 - RNA, 23 nt, Human
agauucucuggcuguaaggcucu

SEQ ID NO: 2770588 - RNA, 16 nt, Human
agauucucugugucua

SEQ ID NO: 2770589 - RNA, 17 nt, Human
agauucucugugucuaa

SEQ ID NO: 2770590 - RNA, 21 nt, Human
agauucugauuugccacugau

SEQ ID NO: 2770591 - RNA, 24 nt, Human
agauucugauuugccacugauauu

SEQ ID NO: 2770592 - RNA, 14 nt, Human
agauucugauuuua

SEQ ID NO: 2770593 - RNA, 19 nt, Human
agauucucugugucuaaga

SEQ ID NO: 2770594 - RNA, 20 nt, Human
agauucucugugucuaagau

SEQ ID NO: 2770595 - RNA, 22 nt, Human
agauucucugugucuaagauuc

SEQ ID NO: 2770596 - RNA, 23 nt, Human
agauucucugugucuaagauucu

SEQ ID NO: 2770597 - RNA, 21 nt, Human
agauucuggacagucagcucu

SEQ ID NO: 2770598 - RNA, 19 nt, Human
agauucugugaucuuuuaa

SEQ ID NO: 2770599 - RNA, 21 nt, Human
agauucugugaucuuuuaaag

SEQ ID NO: 2770600 - RNA, 22 nt, Human
agauucugugaucuuuuaaagu

SEQ ID NO: 2770601 - RNA, 19 nt, Human
agaugaaguuuuacauugu

SEQ ID NO: 2770602 - RNA, 14 nt, Human
agaugaaguuuuau

SEQ ID NO: 2770603 - RNA, 11 nt, Human
agaugaauaaa

SEQ ID NO: 2770604 - RNA, 13 nt, Human
agaugauccauga

SEQ ID NO: 2770605 - RNA, 22 nt, Human
agaugaucaguggacagucugc

SEQ ID NO: 2770606 - RNA, 17 nt, Human
agaugaguuaucuaaga

SEQ ID NO: 2770607 - RNA, 20 nt, Human
agaugaguuaucuaagaaua

SEQ ID NO: 2770608 - RNA, 22 nt, Human
agaugaguuaucuaagaauaca

SEQ ID NO: 2770609 - RNA, 15 nt, Human
agauggugaaauuua

SEQ ID NO: 2770610 - RNA, 20 nt, Human
agauggugaagcauucuccc

SEQ ID NO: 2770611 - RNA, 22 nt, Human
agauggugaagcauucucccca

SEQ ID NO: 2770612 - RNA, 14 nt, Human
agaugguggcagua

SEQ ID NO: 2770613 - RNA, 12 nt, Human
agauggugggau

SEQ ID NO: 2770614 - RNA, 19 nt, Human
agauggucacgcaccuggg

SEQ ID NO: 2770615 - RNA, 21 nt, Human
agauggucacgcaccugggug

SEQ ID NO: 2770616 - RNA, 14 nt, Human
agaugaugagaauu

SEQ ID NO: 2770617 - RNA, 18 nt, Human
agaugaugagaauuucua

SEQ ID NO: 2770618 - RNA, 20 nt, Human
agaugaugagaauuucuaaa

SEQ ID NO: 2770619 - RNA, 22 nt, Human
agaugguacaaccuuuauucuu

SEQ ID NO: 2770620 - RNA, 22 nt, Human
agauggguggaucacuugaggu

SEQ ID NO: 2770621 - RNA, 22 nt, Human
agaugaaguuuguaguuguuuu

SEQ ID NO: 2770622 - RNA, 15 nt, Human
agaugaaguuuuaca

SEQ ID NO: 2770623 - RNA, 16 nt, Human
agaugaaggagaggca

SEQ ID NO: 2770624 - RNA, 19 nt, Human
agaugaacucuuagaaaug

SEQ ID NO: 2770625 - RNA, 19 nt, Human
agaugaacucugaacuuug

SEQ ID NO: 2770626 - RNA, 21 nt, Human
agaugaacucugaacuuugga

SEQ ID NO: 2770627 - RNA, 22 nt, Human
agaugaacucugaacuuuggag

SEQ ID NO: 2770628 - RNA, 18 nt, Human
agaucuguaauuuuuauu

SEQ ID NO: 2770629 - RNA, 17 nt, Human
agagugauaauacaagu

SEQ ID NO: 2770630 - RNA, 15 nt, Human
agagugauugcagcu

SEQ ID NO: 2770631 - RNA, 16 nt, Human
agagugauugcagcuu

SEQ ID NO: 2770632 - RNA, 18 nt, Human
agagugauugcagcuuua

SEQ ID NO: 2770633 - RNA, 21 nt, Human
agagugcaagccccugcucca

SEQ ID NO: 2770634 - RNA, 14 nt, Human
agagugcacagcug

SEQ ID NO: 2770635 - RNA, 15 nt, Human
agagugcacagcugu

SEQ ID NO: 2770636 - RNA, 16 nt, Human
agagugcacagcuguc

SEQ ID NO: 2770637 - RNA, 18 nt, Human
agagugcauugugagggu

SEQ ID NO: 2770638 - RNA, 11 nt, Human
agaguggccug

SEQ ID NO: 2770639 - RNA, 13 nt, Human
agcaaacagagga

SEQ ID NO: 2770640 - RNA, 13 nt, Human
agcaaaccaagag

SEQ ID NO: 2770641 - RNA, 14 nt, Human
agcaaaccaagaga

SEQ ID NO: 2770642 - RNA, 15 nt, Human
agcaaaccaagagau

SEQ ID NO: 2770643 - RNA, 17 nt, Human
agcaaaccaagagauug

SEQ ID NO: 2770644 - RNA, 19 nt, Human
agcaaaccaagagauugcu

SEQ ID NO: 2770645 - RNA, 21 nt, Human
agcaaaccaagagauugcuaa

SEQ ID NO: 2770646 - RNA, 22 nt, Human
agcaaaccaagagauugcuaau

SEQ ID NO: 2770647 - RNA, 17 nt, Human
agcaaaccauuuuuaaa

SEQ ID NO: 2770648 - RNA, 23 nt, Human
agcaaaccauuuuuaaaguagaa

SEQ ID NO: 2770649 - RNA, 21 nt, Human
agcaaaauaauuuuaaacaaa

SEQ ID NO: 2770650 - RNA, 15 nt, Human
agcaaaauaaaaacu

SEQ ID NO: 2770651 - RNA, 16 nt, Human
agcaaaauaaaaacua

SEQ ID NO: 2770652 - RNA, 17 nt, Human
agcaaaauaaaaacuau

SEQ ID NO: 2770653 - RNA, 19 nt, Human
agauugaaguaaacugcag

SEQ ID NO: 2770654 - RNA, 22 nt, Human
agauugaauauuuaucuagaga

SEQ ID NO: 2770655 - RNA, 21 nt, Human
agauugcaacaggcugggcuu

SEQ ID NO: 2770656 - RNA, 20 nt, Human
agauugcaacaggcugggcu

SEQ ID NO: 2770657 - RNA, 23 nt, Human
agauugcaacaggcugggcuuca

SEQ ID NO: 2770658 - RNA, 13 nt, Human
agcaaaacuuuua

SEQ ID NO: 2770659 - RNA, 14 nt, Human
agcaaaacuuuuaa

SEQ ID NO: 2770660 - RNA, 16 nt, Human
agcaaaacuuuuaaac

SEQ ID NO: 2770661 - RNA, 12 nt, Human
agcaaaagaaaa

SEQ ID NO: 2770662 - RNA, 13 nt, Human
agcaaaagaaaaa

SEQ ID NO: 2770663 - RNA, 14 nt, Human
agcaaaagaaaaag

SEQ ID NO: 2770664 - RNA, 13 nt, Human
agauucuucugug

SEQ ID NO: 2770665 - RNA, 16 nt, Human
agauucuucuguguuu

SEQ ID NO: 2770666 - RNA, 13 nt, Human
agauucuuuuucu

SEQ ID NO: 2770667 - RNA, 15 nt, Human
agauucuuuuucuga

SEQ ID NO: 2770668 - RNA, 19 nt, Human
agauugaaaacuuuucuca

SEQ ID NO: 2770669 - RNA, 20 nt, Human
agauugaaaacuuuucucag

SEQ ID NO: 2770670 - RNA, 14 nt, Human
agauugaaaaucuu

SEQ ID NO: 2770671 - RNA, 18 nt, Human
agauugaaaaucuugugu

SEQ ID NO: 2770672 - RNA, 21 nt, Human
agcaaagcugaugacaacuuc

SEQ ID NO: 2770673 - RNA, 23 nt, Human
agcaaagcugaugacaacuuccc

SEQ ID NO: 2770674 - RNA, 16 nt, Human
agcaaauguggcuccu

SEQ ID NO: 2770675 - RNA, 20 nt, Human
agcaaaugucuuccuggauu

SEQ ID NO: 2770676 - RNA, 17 nt, Human
agcaaaugucuuccugg

SEQ ID NO: 2770677 - RNA, 20 nt, Human
agcaaaaucaagcaagccuc

SEQ ID NO: 2770678 - RNA, 20 nt, Human
agcagccucagaacaaagug

SEQ ID NO: 2770679 - RNA, 20 nt, Human
agcagccgccuuaagcugau

SEQ ID NO: 2770680 - RNA, 21 nt, Human
agcagccgccuuaagcugauc

SEQ ID NO: 2770681 - RNA, 19 nt, Human
agcagccugagcaacucuu

SEQ ID NO: 2770682 - RNA, 15 nt, Human
agcagcuucaccaga

SEQ ID NO: 2770683 - RNA, 13 nt, Human
agcagccugagca

SEQ ID NO: 2770684 - RNA, 16 nt, Human
agcagcuucaccagag

SEQ ID NO: 2770685 - RNA, 18 nt, Human
agcagcuucaccagagca

SEQ ID NO: 2770686 - RNA, 16 nt, Human
agcagcuuuaaacaaa

SEQ ID NO: 2770687 - RNA, 17 nt, Human
agcagcuuuaaacaaau

SEQ ID NO: 2770688 - RNA, 19 nt, Human
agcagcuuuaaacucaggg

SEQ ID NO: 2770689 - RNA, 20 nt, Human
agcagcuuuaaacucaggga

SEQ ID NO: 2770690 - RNA, 15 nt, Human
agcacuuauuuaaug

SEQ ID NO: 2770691 - RNA, 19 nt, Human
agcacuucaucuggcugcc

SEQ ID NO: 2770692 - RNA, 23 nt, Human
agcacuucaucuggcugccuuug

SEQ ID NO: 2770693 - RNA, 12 nt, Human
agcacuuccaaa

SEQ ID NO: 2770694 - RNA, 16 nt, Human
agcacuuccaaaauuc

SEQ ID NO: 2770695 - RNA, 18 nt, Human
agcacuuccaaaauucuu

SEQ ID NO: 2770696 - RNA, 19 nt, Human
agcacuuccaaaauucuua

SEQ ID NO: 2770697 - RNA, 17 nt, Human
agcacggacucuuacug

SEQ ID NO: 2770698 - RNA, 13 nt, Human
agcacggacaaua

SEQ ID NO: 2770699 - RNA, 14 nt, Human
agcacggacaauaa

SEQ ID NO: 2770700 - RNA, 15 nt, Human
agcacggacaauaaa

SEQ ID NO: 2770701 - RNA, 17 nt, Human
agcacggacaauaaacc

SEQ ID NO: 2770702 - RNA, 21 nt, Human
agcacggacaauaaaccuccg

SEQ ID NO: 2770703 - RNA, 18 nt, Human
agcacgggacggaagugc

SEQ ID NO: 2770704 - RNA, 14 nt, Human
agcacuguuuuucc

SEQ ID NO: 2770705 - RNA, 16 nt, Human
agcacuguuuuuccau

SEQ ID NO: 2770706 - RNA, 21 nt, Human
agcacuguuuuuccauaguuu

SEQ ID NO: 2770707 - RNA, 23 nt, Human
agcacuguuuuuccauaguuuug

SEQ ID NO: 2770708 - RNA, 19 nt, Human
agcacaauuugcacuaaau

SEQ ID NO: 2770709 - RNA, 13 nt, Human
agcaauuaaaaau

SEQ ID NO: 2770710 - RNA, 19 nt, Human
agcaauucauaaaaacugc

SEQ ID NO: 2770711 - RNA, 15 nt, Human
agcacaaacacaagg

SEQ ID NO: 2770712 - RNA, 16 nt, Human
agcacaaacacaaggu

SEQ ID NO: 2770713 - RNA, 17 nt, Human
agcacaaacacaagguc

SEQ ID NO: 2770714 - RNA, 18 nt, Human
agcacaaacacaagguca

SEQ ID NO: 2770715 - RNA, 14 nt, Human
agcacaaacauuuu

SEQ ID NO: 2770716 - RNA, 15 nt, Human
agcacaaacauuuuu

SEQ ID NO: 2770717 - RNA, 15 nt, Human
agcacaaacuuuagg

SEQ ID NO: 2770718 - RNA, 23 nt, Human
agcacaagcagagugcacagcug

SEQ ID NO: 2770719 - RNA, 12 nt, Human
agcaaucuuuga

SEQ ID NO: 2770720 - RNA, 18 nt, Human
agcaaugacaucucaggg

SEQ ID NO: 2770721 - RNA, 19 nt, Human
agcaaugacaucucagggg

SEQ ID NO: 2770722 - RNA, 23 nt, Human
agcaauccucucaccucagccuc

SEQ ID NO: 2770723 - RNA, 21 nt, Human
agcaaugcugaugaaucacug

SEQ ID NO: 2770724 - RNA, 22 nt, Human
agcaaugcugaugaaucacugu

SEQ ID NO: 2770725 - RNA, 15 nt, Human
agcaaugcuguugga

SEQ ID NO: 2770726 - RNA, 23 nt, Human
agcaauggugucaguauccaggc

SEQ ID NO: 2770727 - RNA, 21 nt, Human
agcaaugcccguaaugcuuag

SEQ ID NO: 2770728 - RNA, 16 nt, Human
agcaauggauauuugu

SEQ ID NO: 2770729 - RNA, 20 nt, Human
agcaaugacaucucaggggc

SEQ ID NO: 2770730 - RNA, 21 nt, Human
agcaaugacaucucaggggcc

SEQ ID NO: 2770731 - RNA, 20 nt, Human
agcaaugcccguaaugcuua

SEQ ID NO: 2770732 - RNA, 17 nt, Human
agccaagcuuguuauca

SEQ ID NO: 2770733 - RNA, 21 nt, Human
agccaagcuuguuaucagcuu

SEQ ID NO: 2770734 - RNA, 16 nt, Human
agccaaagcuaggccu

SEQ ID NO: 2770735 - RNA, 12 nt, Human
agccaaagccaa

SEQ ID NO: 2770736 - RNA, 17 nt, Human
agcauccuggcacccgg

SEQ ID NO: 2770737 - RNA, 14 nt, Human
agcauccuggcacc

SEQ ID NO: 2770738 - RNA, 14 nt, Human
agccaaagaaauga

SEQ ID NO: 2770739 - RNA, 16 nt, Human
agccaaagaaaugaac

SEQ ID NO: 2770740 - RNA, 17 nt, Human
agccaaagaaaugaaca

SEQ ID NO: 2770741 - RNA, 18 nt, Human
agccaaagaaaugaacau

SEQ ID NO: 2770742 - RNA, 19 nt, Human
agccaaagaaaugaacauu

SEQ ID NO: 2770743 - RNA, 22 nt, Human
agccaaagaaaugaacauucca

SEQ ID NO: 2770744 - RNA, 15 nt, Human
agccaaacucugcca

SEQ ID NO: 2770745 - RNA, 14 nt, Human
agccaaacucugcc

SEQ ID NO: 2770746 - RNA, 16 nt, Human
agcccaauccagguac

SEQ ID NO: 2770747 - RNA, 21 nt, Human
agcccaauccagguacgcaca

SEQ ID NO: 2770748 - RNA, 22 nt, Human
agcccaauccagguacgcacag

SEQ ID NO: 2770749 - RNA, 12 nt, Human
agcccacagcac

SEQ ID NO: 2770750 - RNA, 23 nt, Human
agcccacagcacagcucccugcc

SEQ ID NO: 2770751 - RNA, 14 nt, Human
agcccaccuuggcu

SEQ ID NO: 2770752 - RNA, 16 nt, Human
agcccaccuuggcuca

SEQ ID NO: 2770753 - RNA, 20 nt, Human
agcccacggcuaagaggcug

SEQ ID NO: 2770754 - RNA, 21 nt, Human
agcccacggcuaagaggcugc

SEQ ID NO: 2770755 - RNA, 22 nt, Human
agcccacggcuaagaggcugcu

SEQ ID NO: 2770756 - RNA, 16 nt, Human
agcccacgucacgugu

SEQ ID NO: 2770757 - RNA, 23 nt, Human
agcccacgucacguguagugucc

SEQ ID NO: 2770758 - RNA, 23 nt, Human
agcccacauuggauucaucagca

SEQ ID NO: 2770759 - RNA, 14 nt, Human
agcccacucugcuc

SEQ ID NO: 2770760 - RNA, 13 nt, Human
agcccacucugcu

SEQ ID NO: 2770761 - RNA, 15 nt, Human
agcccacucugcucg

SEQ ID NO: 2770762 - RNA, 13 nt, Human
agcauccuggcac

SEQ ID NO: 2770763 - RNA, 21 nt, Human
agcaggaagcauucagagagc

SEQ ID NO: 2770764 - RNA, 22 nt, Human
agcagcuuuaaacucagggaca

SEQ ID NO: 2770765 - RNA, 19 nt, Human
agccccauucugccugccc

SEQ ID NO: 2770766 - RNA, 18 nt, Human
agccccauucugccugcc

SEQ ID NO: 2770767 - RNA, 17 nt, Human
agccccauucugccugc

SEQ ID NO: 2770768 - RNA, 20 nt, Human
agccccacccaggagggagg

SEQ ID NO: 2770769 - RNA, 12 nt, Human
agccccaucugu

SEQ ID NO: 2770770 - RNA, 13 nt, Human
agccccaucuguc

SEQ ID NO: 2770771 - RNA, 14 nt, Human
agccccaucugugc

SEQ ID NO: 2770772 - RNA, 15 nt, Human
agccccaucugugca

SEQ ID NO: 2770773 - RNA, 16 nt, Human
agccccaucugugcau

SEQ ID NO: 2770774 - RNA, 17 nt, Human
agccccaucugugcauu

SEQ ID NO: 2770775 - RNA, 23 nt, Human
agccccaucugugcauucuccug

SEQ ID NO: 2770776 - RNA, 14 nt, Human
agccccaucuucac

SEQ ID NO: 2770777 - RNA, 16 nt, Human
agccccacccaggagg

SEQ ID NO: 2770778 - RNA, 15 nt, Human
agccccacccaggag

SEQ ID NO: 2770779 - RNA, 13 nt, Human
agccccacccagg

SEQ ID NO: 2770780 - RNA, 12 nt, Human
agccccacccag

SEQ ID NO: 2770781 - RNA, 11 nt, Human
agcccucccca

SEQ ID NO: 2770782 - RNA, 15 nt, Human
agcccuccccaggaa

SEQ ID NO: 2770783 - RNA, 23 nt, Human
agcccuccaucuaaacugccccc

SEQ ID NO: 2770784 - RNA, 21 nt, Human
agcccuccaucuaaacugccc

SEQ ID NO: 2770785 - RNA, 12 nt, Human
agcccuccccau

SEQ ID NO: 2770786 - RNA, 19 nt, Human
agcccuccccauggagcca

SEQ ID NO: 2770787 - RNA, 20 nt, Human
agcccuccccauggagccag

SEQ ID NO: 2770788 - RNA, 21 nt, Human
agcccuccccauggagccagc

SEQ ID NO: 2770789 - RNA, 12 nt, Human
agcccucccugc

SEQ ID NO: 2770790 - RNA, 13 nt, Human
agcccucccugcc

SEQ ID NO: 2770791 - RNA, 12 nt, Human
agccccacacag

SEQ ID NO: 2770792 - RNA, 14 nt, Human
agccccacacagcu

SEQ ID NO: 2770793 - RNA, 21 nt, Human
aagguucucuccuccccaagg

SEQ ID NO: 2770794 - RNA, 17 nt, Human
aaguagacaaucauugu

SEQ ID NO: 2770795 - RNA, 18 nt, Human
aaguagacaaucauuguu

SEQ ID NO: 2770796 - RNA, 19 nt, Human
aaguagacaaucauuguuu

SEQ ID NO: 2770797 - RNA, 21 nt, Human
aaguagacaaucauuguuuug

SEQ ID NO: 2770798 - RNA, 18 nt, Human
aaguagacaguuuugaga

SEQ ID NO: 2770799 - RNA, 19 nt, Human
aaguagacaguuuugagaa

SEQ ID NO: 2770800 - RNA, 21 nt, Human
aaguagacaguuuugagaacg

SEQ ID NO: 2770801 - RNA, 15 nt, Human
aaguagcugggauuu

SEQ ID NO: 2770802 - RNA, 19 nt, Human
aaguagcugggauuuuaaa

SEQ ID NO: 2770803 - RNA, 14 nt, Human
aagggcaaaucugc

SEQ ID NO: 2770804 - RNA, 20 nt, Human
aaguagagguuguauacacc

SEQ ID NO: 2770805 - RNA, 22 nt, Human
aagguuauaguaacaucaaaga

SEQ ID NO: 2770806 - RNA, 22 nt, Human
aagguguucauucacuugcauu

SEQ ID NO: 2770807 - RNA, 17 nt, Human
aagguucacuaaagcag

SEQ ID NO: 2770808 - RNA, 22 nt, Human
aagguuccaaucagaucuuuau

SEQ ID NO: 2770809 - RNA, 15 nt, Human
aagguuccacagagu

SEQ ID NO: 2770810 - RNA, 21 nt, Human
aagguuccacagaguaagaca

SEQ ID NO: 2770811 - RNA, 18 nt, Human
aagguuccaacuguauau

SEQ ID NO: 2770812 - RNA, 19 nt, Human
aagguuccaacuguauaua

SEQ ID NO: 2770813 - RNA, 15 nt, Human
aagguucccuugugg

SEQ ID NO: 2770814 - RNA, 21 nt, Human
aagguuccaacuguauauauu

SEQ ID NO: 2770815 - RNA, 11 nt, Human
aagguucuaag

SEQ ID NO: 2770816 - RNA, 13 nt, Human
aagguucuaaggc

SEQ ID NO: 2770817 - RNA, 14 nt, Human
aagguucuaaggcc

SEQ ID NO: 2770818 - RNA, 12 nt, Human
aagguucuaggu

SEQ ID NO: 2770819 - RNA, 13 nt, Human
aagguucuagguu

SEQ ID NO: 2770820 - RNA, 13 nt, Human
aaggucuuugguu

SEQ ID NO: 2770821 - RNA, 19 nt, Human
aaggucuuugguucagcua

SEQ ID NO: 2770822 - RNA, 21 nt, Human
aagggcaugagcauuggauac

SEQ ID NO: 2770823 - RNA, 13 nt, Human
aagggcaugccuu

SEQ ID NO: 2770824 - RNA, 14 nt, Human
aagggcaugccuug

SEQ ID NO: 2770825 - RNA, 15 nt, Human
aagggcaugccuugu

SEQ ID NO: 2770826 - RNA, 16 nt, Human
aagggcaugccuugug

SEQ ID NO: 2770827 - RNA, 13 nt, Human
aaggucugagcca

SEQ ID NO: 2770828 - RNA, 14 nt, Human
aaggucugagccac

SEQ ID NO: 2770829 - RNA, 19 nt, Human
aaggucugagccacagcag

SEQ ID NO: 2770830 - RNA, 16 nt, Human
aagguggggacaggga

SEQ ID NO: 2770831 - RNA, 19 nt, Human
aaggugggcugagcccugg

SEQ ID NO: 2770832 - RNA, 21 nt, Human
aaggugggcugagcccuggca

SEQ ID NO: 2770833 - RNA, 20 nt, Human
aaggugggcugagcccuggc

SEQ ID NO: 2770834 - RNA, 20 nt, Human
aaggugacagaaggaccagc

SEQ ID NO: 2770835 - RNA, 20 nt, Human
aagguggugggggugcagau

SEQ ID NO: 2770836 - RNA, 16 nt, Human
aagguggugugaucuu

SEQ ID NO: 2770837 - RNA, 12 nt, Human
aagguguauuua

SEQ ID NO: 2770838 - RNA, 21 nt, Human
aagguguauuuaaacuaucuu

SEQ ID NO: 2770839 - RNA, 23 nt, Human
aagggauuuaguaacaucauuuu

SEQ ID NO: 2770840 - RNA, 15 nt, Human
aagggauuucuuagg

SEQ ID NO: 2770841 - RNA, 16 nt, Human
aagggauuucuuaggg

SEQ ID NO: 2770842 - RNA, 17 nt, Human
aagggauuuuagucaca

SEQ ID NO: 2770843 - RNA, 20 nt, Human
aagggauuuuagucacacgu

SEQ ID NO: 2770844 - RNA, 24 nt, Human
aagggauggaggucacacugguag

SEQ ID NO: 2770845 - RNA, 22 nt, Human
aagggauuuuagucacacgugg

SEQ ID NO: 2770846 - RNA, 22 nt, Human
aagggcaggaaggagagccugc

SEQ ID NO: 2770847 - RNA, 21 nt, Human
aagggcaggaaggagagccug

SEQ ID NO: 2770848 - RNA, 17 nt, Human
aagggcauaaaacagcu

SEQ ID NO: 2770849 - RNA, 15 nt, Human
aagggcagagucaca

SEQ ID NO: 2770850 - RNA, 20 nt, Human
aagggacuuggaagcuccgc

SEQ ID NO: 2770851 - RNA, 16 nt, Human
aagggaucaucaugca

SEQ ID NO: 2770852 - RNA, 15 nt, Human
aagccacuagacucu

SEQ ID NO: 2770853 - RNA, 17 nt, Human
aagccacuagacucuuc

SEQ ID NO: 2770854 - RNA, 19 nt, Human
aagccacucugucccuucc

SEQ ID NO: 2770855 - RNA, 15 nt, Human
aagcagguuagagaa

SEQ ID NO: 2770856 - RNA, 21 nt, Human
aagcagguuagagaaaauaga

SEQ ID NO: 2770857 - RNA, 14 nt, Human
aagccacugaagcu

SEQ ID NO: 2770858 - RNA, 13 nt, Human
aagccacugaagc

SEQ ID NO: 2770859 - RNA, 17 nt, Human
aagccacugaagcuggg

SEQ ID NO: 2770860 - RNA, 16 nt, Human
aagcgauucuucugcu

SEQ ID NO: 2770861 - RNA, 16 nt, Human
aagcgugagccacugc

SEQ ID NO: 2770862 - RNA, 14 nt, Human
aagcgauucuucug

SEQ ID NO: 2770863 - RNA, 15 nt, Human
aagcgauucuucugc

SEQ ID NO: 2770864 - RNA, 22 nt, Human
aaggacccggaggggccuggca

SEQ ID NO: 2770865 - RNA, 18 nt, Human
aaggacacagaugaaaca

SEQ ID NO: 2770866 - RNA, 22 nt, Human
aaggacacagaugaaacacaaa

SEQ ID NO: 2770867 - RNA, 19 nt, Human
aaggaccugaaauuccaaa

SEQ ID NO: 2770868 - RNA, 18 nt, Human
aaggaccugaaauuccaa

SEQ ID NO: 2770869 - RNA, 19 nt, Human
aaggaccguggcccugccc

SEQ ID NO: 2770870 - RNA, 21 nt, Human
aaggacccggaggggccuggc

SEQ ID NO: 2770871 - RNA, 23 nt, Human
aaggaccuccucuucccccuucc

SEQ ID NO: 2770872 - RNA, 17 nt, Human
aaggacggguuggggcc

SEQ ID NO: 2770873 - RNA, 13 nt, Human
aaggacuaggguc

SEQ ID NO: 2770874 - RNA, 12 nt, Human
aaggcaaaauug

SEQ ID NO: 2770875 - RNA, 15 nt, Human
aaggcaaaaauguaa

SEQ ID NO: 2770876 - RNA, 16 nt, Human
aaggcagcauguauag

SEQ ID NO: 2770877 - RNA, 21 nt, Human
aaggcagcauguauaguugcu

SEQ ID NO: 2770878 - RNA, 11 nt, Human
aaggcagccac

SEQ ID NO: 2770879 - RNA, 14 nt, Human
aaggcagccaccag

SEQ ID NO: 2770880 - RNA, 14 nt, Human
aaggcacugccuga

SEQ ID NO: 2770881 - RNA, 14 nt, Human
aaggcagacagcag

SEQ ID NO: 2770882 - RNA, 19 nt, Human
aaggcaaaauugcaaaucu

SEQ ID NO: 2770883 - RNA, 15 nt, Human
aaggcaaaauugcaa

SEQ ID NO: 2770884 - RNA, 14 nt, Human
aaggcaaaauugca

SEQ ID NO: 2770885 - RNA, 16 nt, Human
aaggcaaaugcccaag

SEQ ID NO: 2770886 - RNA, 17 nt, Human
aaggcaaaugcccaagg

SEQ ID NO: 2770887 - RNA, 14 nt, Human
aaggcacucuagau

SEQ ID NO: 2770888 - RNA, 15 nt, Human
aaggcacucuagauu

SEQ ID NO: 2770889 - RNA, 16 nt, Human
aaggcacucuagauuc

SEQ ID NO: 2770890 - RNA, 21 nt, Human
aaggcacucuguuauuuagac

SEQ ID NO: 2770891 - RNA, 19 nt, Human
aaggcacucuagauuccau

SEQ ID NO: 2770892 - RNA, 12 nt, Human
aaggcacugccu

SEQ ID NO: 2770893 - RNA, 13 nt, Human
aaggcacugccug

SEQ ID NO: 2770894 - RNA, 14 nt, Human
aaggaaucuuuaag

SEQ ID NO: 2770895 - RNA, 21 nt, Human
aaggaaucuuuaagcagagaa

SEQ ID NO: 2770896 - RNA, 20 nt, Human
aaggaauccacucccaggca

SEQ ID NO: 2770897 - RNA, 21 nt, Human
aaggaauccacucccaggcag

SEQ ID NO: 2770898 - RNA, 22 nt, Human
aaggaauccacucccaggcagc

SEQ ID NO: 2770899 - RNA, 23 nt, Human
aaggaauccacucccaggcagcc

SEQ ID NO: 2770900 - RNA, 16 nt, Human
aagcugcugacagugu

SEQ ID NO: 2770901 - RNA, 20 nt, Human
aagcugcccacuguuucucu

SEQ ID NO: 2770902 - RNA, 13 nt, Human
aagcugcugacca

SEQ ID NO: 2770903 - RNA, 21 nt, Human
aagcugcugaccaauugugcu

SEQ ID NO: 2770904 - RNA, 22 nt, Human
aagcugcugaccaauugugcug

SEQ ID NO: 2770905 - RNA, 18 nt, Human
aagcugcccacuguuucu

SEQ ID NO: 2770906 - RNA, 13 nt, Human
aagcugcagcuug

SEQ ID NO: 2770907 - RNA, 15 nt, Human
aagcugcccugccca

SEQ ID NO: 2770908 - RNA, 20 nt, Human
aagcugccgaaccaaaagaa

SEQ ID NO: 2770909 - RNA, 21 nt, Human
aagcugccgaaccaaaagaau

SEQ ID NO: 2770910 - RNA, 21 nt, Human
aagcugcuuuaaaaaaauaca

SEQ ID NO: 2770911 - RNA, 14 nt, Human
aagcugcugacagu

SEQ ID NO: 2770912 - RNA, 20 nt, Human
aagcgugagccacugcaccg

SEQ ID NO: 2770913 - RNA, 17 nt, Human
aagcgugagccacugca

SEQ ID NO: 2770914 - RNA, 21 nt, Human
aagcgugagccacugcaccgg

SEQ ID NO: 2770915 - RNA, 21 nt, Human
aagacagggcugauaagcuaa

SEQ ID NO: 2770916 - RNA, 22 nt, Human
aagacaggaugggggcuggccu

SEQ ID NO: 2770917 - RNA, 21 nt, Human
aagacauucuuccaaaaagau

SEQ ID NO: 2770918 - RNA, 16 nt, Human
aagacauguuguaaau

SEQ ID NO: 2770919 - RNA, 18 nt, Human
aagacauguuguaaauua

SEQ ID NO: 2770920 - RNA, 19 nt, Human
aagacauguuguaaauuag

SEQ ID NO: 2770921 - RNA, 18 nt, Human
aagacauugggucuauuc

SEQ ID NO: 2770922 - RNA, 22 nt, Human
aagacauugggucuauuccagc

SEQ ID NO: 2770923 - RNA, 23 nt, Human
aagacauugggucuauuccagcu

SEQ ID NO: 2770924 - RNA, 21 nt, Human
aagacauuaguaacauaauaa

SEQ ID NO: 2770925 - RNA, 16 nt, Human
aacuguuaugaaauaa

SEQ ID NO: 2770926 - RNA, 13 nt, Human
aacuguuuauaug

SEQ ID NO: 2770927 - RNA, 16 nt, Human
aacuguuuauaugugu

SEQ ID NO: 2770928 - RNA, 18 nt, Human
aacuguuuauauguguug

SEQ ID NO: 2770929 - RNA, 19 nt, Human
aacuguuuauauguguuga

SEQ ID NO: 2770930 - RNA, 22 nt, Human
aacuguuuauauguguugaaaa

SEQ ID NO: 2770931 - RNA, 22 nt, Human
aagacagcuucucauccugcag

SEQ ID NO: 2770932 - RNA, 18 nt, Human
aagacaggaaaguucaga

SEQ ID NO: 2770933 - RNA, 20 nt, Human
aagacaggaaaguucagagu

SEQ ID NO: 2770934 - RNA, 21 nt, Human
aagacaggaaaguucagaguu

SEQ ID NO: 2770935 - RNA, 23 nt, Human
aagacaggacagugcuucagccu

SEQ ID NO: 2770936 - RNA, 23 nt, Human
aacuuacuauucauuaaauguuu

SEQ ID NO: 2770937 - RNA, 15 nt, Human
aacuuacugauuauu

SEQ ID NO: 2770938 - RNA, 23 nt, Human
aacuuaccuaagugacauuugua

SEQ ID NO: 2770939 - RNA, 20 nt, Human
aacuuagaucaucagucacc

SEQ ID NO: 2770940 - RNA, 11 nt, Human
aagagaagaag

SEQ ID NO: 2770941 - RNA, 13 nt, Human
aagagaagaagaa

SEQ ID NO: 2770942 - RNA, 14 nt, Human
aagagaagaagaaa

SEQ ID NO: 2770943 - RNA, 16 nt, Human
aagagaagaagaaaaa

SEQ ID NO: 2770944 - RNA, 17 nt, Human
aagagaagaagaaaaaa

SEQ ID NO: 2770945 - RNA, 16 nt, Human
aagagaagacgaaaua

SEQ ID NO: 2770946 - RNA, 14 nt, Human
aagagaagcaauuu

SEQ ID NO: 2770947 - RNA, 16 nt, Human
aagagaaccgagcaaa

SEQ ID NO: 2770948 - RNA, 21 nt, Human
aagagaaccgagcaaagauca

SEQ ID NO: 2770949 - RNA, 22 nt, Human
aagagaaccgagcaaagaucaa

SEQ ID NO: 2770950 - RNA, 13 nt, Human
aagagaagcugcu

SEQ ID NO: 2770951 - RNA, 14 nt, Human
aagagaagcugcug

SEQ ID NO: 2770952 - RNA, 15 nt, Human
aagagaagcugcuga

SEQ ID NO: 2770953 - RNA, 16 nt, Human
aagagaagcugcugac

SEQ ID NO: 2770954 - RNA, 17 nt, Human
aagagaagcugcugacc

SEQ ID NO: 2770955 - RNA, 18 nt, Human
aagagaagcugcugacca

SEQ ID NO: 2770956 - RNA, 14 nt, Human
aagagacagucacc

SEQ ID NO: 2770957 - RNA, 20 nt, Human
aagagacagucaccccagga

SEQ ID NO: 2770958 - RNA, 21 nt, Human
aagagacagucaccccaggac

SEQ ID NO: 2770959 - RNA, 14 nt, Human
aagagacagaaugu

SEQ ID NO: 2770960 - RNA, 16 nt, Human
aagagacagaauguau

SEQ ID NO: 2770961 - RNA, 18 nt, Human
aagagacagaauguaucu

SEQ ID NO: 2770962 - RNA, 21 nt, Human
aagagacaaacaccucccagg

SEQ ID NO: 2770963 - RNA, 13 nt, Human
aagagacaaacug

SEQ ID NO: 2770964 - RNA, 19 nt, Human
aagagacaaacaccuccca

SEQ ID NO: 2770965 - RNA, 11 nt, Human
aagagagaacc

SEQ ID NO: 2770966 - RNA, 18 nt, Human
aagagagaaccuaacugu

SEQ ID NO: 2770967 - RNA, 20 nt, Human
aagagagaaccuaacuguau

SEQ ID NO: 2770968 - RNA, 23 nt, Human
aagagagaaccuaacuguaucuu

SEQ ID NO: 2770969 - RNA, 19 nt, Human
aagagagagaaacaaacuu

SEQ ID NO: 2770970 - RNA, 11 nt, Human
aagagagaaau

SEQ ID NO: 2770971 - RNA, 13 nt, Human
aagagagaaaucu

SEQ ID NO: 2770972 - RNA, 16 nt, Human
aagagagauauaucug

SEQ ID NO: 2770973 - RNA, 17 nt, Human
aagagagauauaucuga

SEQ ID NO: 2770974 - RNA, 20 nt, Human
aagagagauauaucugaaaa

SEQ ID NO: 2770975 - RNA, 20 nt, Human
aagagagagaaacaaacuuu

SEQ ID NO: 2770976 - RNA, 21 nt, Human
aagagagagaaacaaacuuuu

SEQ ID NO: 2770977 - RNA, 15 nt, Human
aagagagcagagaau

SEQ ID NO: 2770978 - RNA, 19 nt, Human
aagagagagagagaaaaaa

SEQ ID NO: 2770979 - RNA, 20 nt, Human
aagagagagagagaaaaaaa

SEQ ID NO: 2770980 - RNA, 19 nt, Human
aagagagagagagagagaa

SEQ ID NO: 2770981 - RNA, 22 nt, Human
aagagagcuuaaugauaauauu

SEQ ID NO: 2770982 - RNA, 17 nt, Human
aagagaggagaggagag

SEQ ID NO: 2770983 - RNA, 18 nt, Human
aagagaggagaggagaga

SEQ ID NO: 2770984 - RNA, 19 nt, Human
aagagacacucagaccaga

SEQ ID NO: 2770985 - RNA, 17 nt, Human
aagcagagugcacagcu

SEQ ID NO: 2770986 - RNA, 18 nt, Human
aagcagagugcacagcug

SEQ ID NO: 2770987 - RNA, 19 nt, Human
aagcagagugcacagcugu

SEQ ID NO: 2770988 - RNA, 20 nt, Human
aagcagagugcacagcuguc

SEQ ID NO: 2770989 - RNA, 21 nt, Human
aagcagagugcacagcugucc

SEQ ID NO: 2770990 - RNA, 17 nt, Human
aagcagggucugggcag

SEQ ID NO: 2770991 - RNA, 21 nt, Human
aagcaggggcuacaagaggga

SEQ ID NO: 2770992 - RNA, 22 nt, Human
aagcaggggcuacaagagggaa

SEQ ID NO: 2770993 - RNA, 20 nt, Human
aagcaggggcuacaagaggg

SEQ ID NO: 2770994 - RNA, 13 nt, Human
aagauuuucagaa

SEQ ID NO: 2770995 - RNA, 23 nt, Human
aagauuuucugggccuaaaggau

SEQ ID NO: 2770996 - RNA, 13 nt, Human
aagauuuuucuca

SEQ ID NO: 2770997 - RNA, 14 nt, Human
aagauuuuucucaa

SEQ ID NO: 2770998 - RNA, 19 nt, Human
aagcagaaaauaaaggaag

SEQ ID NO: 2770999 - RNA, 20 nt, Human
aagcagaaaauaaaggaagc

SEQ ID NO: 2771000 - RNA, 16 nt, Human
aagcacugugcucagg

SEQ ID NO: 2771001 - RNA, 13 nt, Human
aagcacuguuuuu

SEQ ID NO: 2771002 - RNA, 16 nt, Human
aagcacuguuuuucca

SEQ ID NO: 2771003 - RNA, 15 nt, Human
aagcacugugcucag

SEQ ID NO: 2771004 - RNA, 22 nt, Human
aagcagaaauccugcaaugaaa

SEQ ID NO: 2771005 - RNA, 15 nt, Human
aagauucagguaugu

SEQ ID NO: 2771006 - RNA, 21 nt, Human
aagauucaccuaagagauucu

SEQ ID NO: 2771007 - RNA, 21 nt, Human
aagauuauagauucuaaagau

SEQ ID NO: 2771008 - RNA, 17 nt, Human
aagauuauuuuauuaug

SEQ ID NO: 2771009 - RNA, 19 nt, Human
aagauuauuuuauuaugcg

SEQ ID NO: 2771010 - RNA, 19 nt, Human
aagauucauuuuuaaucau

SEQ ID NO: 2771011 - RNA, 20 nt, Human
aagauucauuuuuaaucaug

SEQ ID NO: 2771012 - RNA, 21 nt, Human
aagauucauuuuuaaucauga

SEQ ID NO: 2771013 - RNA, 20 nt, Human
aagauucuucuguguuuaua

SEQ ID NO: 2771014 - RNA, 16 nt, Human
aagauucuuuuucuga

SEQ ID NO: 2771015 - RNA, 16 nt, Human
aagauagauccuuuua

SEQ ID NO: 2771016 - RNA, 23 nt, Human
aagauagauuuggaauaggaaua

SEQ ID NO: 2771017 - RNA, 11 nt, Human
aagauuagaag

SEQ ID NO: 2771018 - RNA, 13 nt, Human
aagauuagaagcu

SEQ ID NO: 2771019 - RNA, 18 nt, Human
aagauuagaagcugaaaa

SEQ ID NO: 2771020 - RNA, 21 nt, Human
aagauuagcaaggucauuucu

SEQ ID NO: 2771021 - RNA, 22 nt, Human
aagauuagcaaggucauuucuu

SEQ ID NO: 2771022 - RNA, 24 nt, Human
aagauuagcaaggucauuucuuca

SEQ ID NO: 2771023 - RNA, 14 nt, Human
aagauuauagauuc

SEQ ID NO: 2771024 - RNA, 17 nt, Human
aagauucaaucccagga

SEQ ID NO: 2771025 - RNA, 15 nt, Human
aagauuauagauucu

SEQ ID NO: 2771026 - RNA, 16 nt, Human
aagauuauagauucua

SEQ ID NO: 2771027 - RNA, 17 nt, Human
aagauuauagauucuaa

SEQ ID NO: 2771028 - RNA, 20 nt, Human
aagauuauagauucuaaaga

SEQ ID NO: 2771029 - RNA, 14 nt, Human
aagugggugagaug

SEQ ID NO: 2771030 - RNA, 19 nt, Human
aagugggugagaugcugga

SEQ ID NO: 2771031 - RNA, 19 nt, Human
aaguggguuauucuggagu

SEQ ID NO: 2771032 - RNA, 19 nt, Human
aagugggaggucaggaaac

SEQ ID NO: 2771033 - RNA, 20 nt, Human
aagugggaggucaggaaacu

SEQ ID NO: 2771034 - RNA, 16 nt, Human
aagugggcuugauucu

SEQ ID NO: 2771035 - RNA, 12 nt, Human
aagugggcuuga

SEQ ID NO: 2771036 - RNA, 13 nt, Human
aaguggggcagag

SEQ ID NO: 2771037 - RNA, 17 nt, Human
aaguggggcagagccuc

SEQ ID NO: 2771038 - RNA, 22 nt, Human
aagugggcuugauucugcagua

SEQ ID NO: 2771039 - RNA, 15 nt, Human
aaguggggacagagc

SEQ ID NO: 2771040 - RNA, 15 nt, Human
aaguucuucuccaau

SEQ ID NO: 2771041 - RNA, 15 nt, Human
aaguucuguguuuaa

SEQ ID NO: 2771042 - RNA, 20 nt, Human
aaguucuguguuuaauuucu

SEQ ID NO: 2771043 - RNA, 22 nt, Human
aaguucuguguuuaauuucuuc

SEQ ID NO: 2771044 - RNA, 23 nt, Human
aaguucuguguuuaauuucuuca

SEQ ID NO: 2771045 - RNA, 13 nt, Human
aaguucugcuuuc

SEQ ID NO: 2771046 - RNA, 16 nt, Human
aaguucugcuuucucc

SEQ ID NO: 2771047 - RNA, 19 nt, Human
aaguucugcuuucucccca

SEQ ID NO: 2771048 - RNA, 14 nt, Human
aagugcugagauua

SEQ ID NO: 2771049 - RNA, 13 nt, Human
aagugcugagauu

SEQ ID NO: 2771050 - RNA, 12 nt, Human
aaguauagagag

SEQ ID NO: 2771051 - RNA, 17 nt, Human
aagugcucaucuguugu

SEQ ID NO: 2771052 - RNA, 19 nt, Human
aagugcuaagguucuaagg

SEQ ID NO: 2771053 - RNA, 20 nt, Human
aagugcuaagguucuaaggc

SEQ ID NO: 2771054 - RNA, 21 nt, Human
aagugcuaagguucuaaggcc

SEQ ID NO: 2771055 - RNA, 14 nt, Human
aagugcuacauaaa

SEQ ID NO: 2771056 - RNA, 17 nt, Human
aagugcuacauaaauug

SEQ ID NO: 2771057 - RNA, 22 nt, Human
aagugcguguguagaguuaaga

SEQ ID NO: 2771058 - RNA, 23 nt, Human
aagugcguguguagaguuaagaa

SEQ ID NO: 2771059 - RNA, 15 nt, Human
aagugcuaagguucu

SEQ ID NO: 2771060 - RNA, 16 nt, Human
aagugcuaagguucua

SEQ ID NO: 2771061 - RNA, 17 nt, Human
aagugcuaagguucuaa

SEQ ID NO: 2771062 - RNA, 18 nt, Human
aagugcuaagguucuaag

SEQ ID NO: 2771063 - RNA, 15 nt, Human
aaguagcagugugaa

SEQ ID NO: 2771064 - RNA, 23 nt, Human
aaguaguucuguuuggugugucc

SEQ ID NO: 2771065 - RNA, 15 nt, Human
aaguagugugcaguu

SEQ ID NO: 2771066 - RNA, 20 nt, Human
aaguaguuuguauaacuucu

SEQ ID NO: 2771067 - RNA, 15 nt, Human
aaguauaaaauacaa

SEQ ID NO: 2771068 - RNA, 12 nt, Human
aaguaguuugua

SEQ ID NO: 2771069 - RNA, 12 nt, Human
aaguauacaguu

SEQ ID NO: 2771070 - RNA, 21 nt, Human
aaguauacaguucaauaaacu

SEQ ID NO: 2771071 - RNA, 15 nt, Human
aaguauacuuauauu

SEQ ID NO: 2771072 - RNA, 17 nt, Human
aauaaaccucaaaaugu

SEQ ID NO: 2771073 - RNA, 13 nt, Human
aauaaacaaauaa

SEQ ID NO: 2771074 - RNA, 18 nt, Human
aaguugcacugauauuuu

SEQ ID NO: 2771075 - RNA, 20 nt, Human
aaguugcacugauauuuuac

SEQ ID NO: 2771076 - RNA, 15 nt, Human
aaguugcacggcugc

SEQ ID NO: 2771077 - RNA, 16 nt, Human
aaguugcacggcugcu

SEQ ID NO: 2771078 - RNA, 18 nt, Human
aaguugcacggcugcuga

SEQ ID NO: 2771079 - RNA, 21 nt, Human
aaguugauauagaacagugcu

SEQ ID NO: 2771080 - RNA, 18 nt, Human
aaguugauggugaugaaa

SEQ ID NO: 2771081 - RNA, 15 nt, Human
aauaaaauuucuaag

SEQ ID NO: 2771082 - RNA, 21 nt, Human
aauaaaauuucuaagagagcu

SEQ ID NO: 2771083 - RNA, 14 nt, Human
aauaauaaauauuu

SEQ ID NO: 2771084 - RNA, 18 nt, Human
aauaauaaagaugcucuu

SEQ ID NO: 2771085 - RNA, 19 nt, Human
aauaauaaagaugcucuuu

SEQ ID NO: 2771086 - RNA, 18 nt, Human
aauaaaggacuguaaucu

SEQ ID NO: 2771087 - RNA, 11 nt, Human
aauaaaggacu

SEQ ID NO: 2771088 - RNA, 16 nt, Human
aauaaaggaugugauu

SEQ ID NO: 2771089 - RNA, 22 nt, Human
aauaaaggacuguaaucuuauu

SEQ ID NO: 2771090 - RNA, 20 nt, Human
aauaaaccucaaaaugucua

SEQ ID NO: 2771091 - RNA, 15 nt, Human
aauaaagccugcuuu

SEQ ID NO: 2771092 - RNA, 21 nt, Human
aauaauguuaaccaaggaaau

SEQ ID NO: 2771093 - RNA, 16 nt, Human
aauaauguucuauugu

SEQ ID NO: 2771094 - RNA, 17 nt, Human
aauaauaugcauuguca

SEQ ID NO: 2771095 - RNA, 19 nt, Human
aauaauauggcuaugcuua

SEQ ID NO: 2771096 - RNA, 12 nt, Human
aauaauauuguu

SEQ ID NO: 2771097 - RNA, 14 nt, Human
aauaauauuguugu

SEQ ID NO: 2771098 - RNA, 20 nt, Human
aauaauauuguuguauaauu

SEQ ID NO: 2771099 - RNA, 20 nt, Human
aauaauauccaggucaacag

SEQ ID NO: 2771100 - RNA, 22 nt, Human
aauaauauccaggucaacagaa

SEQ ID NO: 2771101 - RNA, 13 nt, Human
aauaauaugauuu

SEQ ID NO: 2771102 - RNA, 11 nt, Human
aauaauaugca

SEQ ID NO: 2771103 - RNA, 12 nt, Human
aauaauaugcau

SEQ ID NO: 2771104 - RNA, 13 nt, Human
aauaauaugcauu

SEQ ID NO: 2771105 - RNA, 15 nt, Human
aauaauaugcauugu

SEQ ID NO: 2771106 - RNA, 17 nt, Human
aauaauaguaugaguaa

SEQ ID NO: 2771107 - RNA, 14 nt, Human
aauaauacacuaau

SEQ ID NO: 2771108 - RNA, 21 nt, Human
aauaauaauuagguuaacauu

SEQ ID NO: 2771109 - RNA, 12 nt, Human
aauaauaauauc

SEQ ID NO: 2771110 - RNA, 15 nt, Human
aauaauaauauccag

SEQ ID NO: 2771111 - RNA, 20 nt, Human
aauaauaauuuuuauauuua

SEQ ID NO: 2771112 - RNA, 13 nt, Human
aauaauaccucaa

SEQ ID NO: 2771113 - RNA, 20 nt, Human
aauaauaccucaauguuuga

SEQ ID NO: 2771114 - RNA, 21 nt, Human
aauaauaccucaauguuugag

SEQ ID NO: 2771115 - RNA, 20 nt, Human
aauauggaacuucuaauaua

SEQ ID NO: 2771116 - RNA, 14 nt, Human
aauauggacaagag

SEQ ID NO: 2771117 - RNA, 15 nt, Human
aauauggacaagagg

SEQ ID NO: 2771118 - RNA, 13 nt, Human
aauaugcuaauuu

SEQ ID NO: 2771119 - RNA, 14 nt, Human
aauaugcuaauuug

SEQ ID NO: 2771120 - RNA, 15 nt, Human
aauaugcuaauuugg

SEQ ID NO: 2771121 - RNA, 14 nt, Human
aauauggaacuucu

SEQ ID NO: 2771122 - RNA, 17 nt, Human
aauauggaacuucuaau

SEQ ID NO: 2771123 - RNA, 11 nt, Human
aauaugcuuac

SEQ ID NO: 2771124 - RNA, 23 nt, Human
aauaugcuuucaucuucuguugc

SEQ ID NO: 2771125 - RNA, 10 nt, Human
aauaugcuua

SEQ ID NO: 2771126 - RNA, 15 nt, Human
aauauagauuagaaa

SEQ ID NO: 2771127 - RNA, 17 nt, Human
aauauagauuagaaaaa

SEQ ID NO: 2771128 - RNA, 18 nt, Human
aauauagauuagaaaaau

SEQ ID NO: 2771129 - RNA, 13 nt, Human
aauauaacaugaa

SEQ ID NO: 2771130 - RNA, 16 nt, Human
aauauaacaugaaaug

SEQ ID NO: 2771131 - RNA, 18 nt, Human
aauauaacaugaaaugau

SEQ ID NO: 2771132 - RNA, 19 nt, Human
aauauaacaugaaaugaua

SEQ ID NO: 2771133 - RNA, 21 nt, Human
aauauagaucaguuauaagua

SEQ ID NO: 2771134 - RNA, 12 nt, Human
aauauaaacauc

SEQ ID NO: 2771135 - RNA, 21 nt, Human
aauauaaagauggcugacuuu

SEQ ID NO: 2771136 - RNA, 15 nt, Human
aauacuaccuugaaa

SEQ ID NO: 2771137 - RNA, 14 nt, Human
aauacuaccuugaa

SEQ ID NO: 2771138 - RNA, 13 nt, Human
aauacguuugaua

SEQ ID NO: 2771139 - RNA, 14 nt, Human
aauacuaaaauaug

SEQ ID NO: 2771140 - RNA, 15 nt, Human
aauacuaaaauaugu

SEQ ID NO: 2771141 - RNA, 16 nt, Human
aauacgcacuacaugu

SEQ ID NO: 2771142 - RNA, 18 nt, Human
aauacgcacuacaugugg

SEQ ID NO: 2771143 - RNA, 19 nt, Human
aauacgcaggcaucugauu

SEQ ID NO: 2771144 - RNA, 20 nt, Human
aauacgacacugaaauaugu

SEQ ID NO: 2771145 - RNA, 23 nt, Human
aauacgacacugaaauaugugaa

SEQ ID NO: 2771146 - RNA, 16 nt, Human
aauacuuacauucucu

SEQ ID NO: 2771147 - RNA, 17 nt, Human
aauacuuagcaaaaagu

SEQ ID NO: 2771148 - RNA, 23 nt, Human
aauauaaacaaagauucaugauu

SEQ ID NO: 2771149 - RNA, 22 nt, Human
aauauaaacaaagauucaugau

SEQ ID NO: 2771150 - RNA, 21 nt, Human
aauauaaacaaagauucauga

SEQ ID NO: 2771151 - RNA, 22 nt, Human
aauauaaaaggcaaauguguac

SEQ ID NO: 2771152 - RNA, 14 nt, Human
aauauaaacaaaga

SEQ ID NO: 2771153 - RNA, 23 nt, Human
aauauaaaaggcaaauguguaca

SEQ ID NO: 2771154 - RNA, 13 nt, Human
aauauaaaauagu

SEQ ID NO: 2771155 - RNA, 22 nt, Human
aauauaaaauaguuguccauau

SEQ ID NO: 2771156 - RNA, 14 nt, Human
aauauaaaaggcaa

SEQ ID NO: 2771157 - RNA, 14 nt, Human
aauaguuuuuucuu

SEQ ID NO: 2771158 - RNA, 22 nt, Human
aauauaaaacaaauaaaaaaua

SEQ ID NO: 2771159 - RNA, 14 nt, Human
aauaguuugucuau

SEQ ID NO: 2771160 - RNA, 16 nt, Human
aauaguuugucuauuu

SEQ ID NO: 2771161 - RNA, 17 nt, Human
aauaguuugucuauuuu

SEQ ID NO: 2771162 - RNA, 18 nt, Human
aauaguuugucuauuuua

SEQ ID NO: 2771163 - RNA, 19 nt, Human
aauaguuugucuauuuuaa

SEQ ID NO: 2771164 - RNA, 23 nt, Human
aauaguuugucuauuuuaaaaua

SEQ ID NO: 2771165 - RNA, 15 nt, Human
aauaguuuguuuaau

SEQ ID NO: 2771166 - RNA, 20 nt, Human
aauagaaaacugaaaaucua

SEQ ID NO: 2771167 - RNA, 12 nt, Human
aauagaaaagua

SEQ ID NO: 2771168 - RNA, 13 nt, Human
aauagaaaaguag

SEQ ID NO: 2771169 - RNA, 18 nt, Human
aauagaaaaguagacaau

SEQ ID NO: 2771170 - RNA, 14 nt, Human
aauagaaaaguuau

SEQ ID NO: 2771171 - RNA, 15 nt, Human
aauagaaaaguuauu

SEQ ID NO: 2771172 - RNA, 19 nt, Human
aauagaaaaguuauuagug

SEQ ID NO: 2771173 - RNA, 14 nt, Human
aauagaaagaaagu

SEQ ID NO: 2771174 - RNA, 22 nt, Human
aauagaaauaaaggaugugauu

SEQ ID NO: 2771175 - RNA, 16 nt, Human
aauagaaauaaguggu

SEQ ID NO: 2771176 - RNA, 20 nt, Human
aauagaaccauguugguugc

SEQ ID NO: 2771177 - RNA, 18 nt, Human
aauauggaacuucuaaua

SEQ ID NO: 2771178 - RNA, 19 nt, Human
aaucaaauaaguauuuaua

SEQ ID NO: 2771179 - RNA, 14 nt, Human
aaucauuugcuuuu

SEQ ID NO: 2771180 - RNA, 20 nt, Human
aaucauuuuacccuuggcuc

SEQ ID NO: 2771181 - RNA, 17 nt, Human
aaucauuuuaggaaagg

SEQ ID NO: 2771182 - RNA, 19 nt, Human
aaucauuuuaggaaaggau

SEQ ID NO: 2771183 - RNA, 19 nt, Human
aaucauuuugccucuuuuc

SEQ ID NO: 2771184 - RNA, 14 nt, Human
aaugaaauuguaaa

SEQ ID NO: 2771185 - RNA, 13 nt, Human
aaugaaauuuaaa

SEQ ID NO: 2771186 - RNA, 16 nt, Human
aaugaaauuuaaacau

SEQ ID NO: 2771187 - RNA, 17 nt, Human
aaugaaauuuaaacauu

SEQ ID NO: 2771188 - RNA, 16 nt, Human
aaugauacugauggug

SEQ ID NO: 2771189 - RNA, 18 nt, Human
aaugauacccugaauuug

SEQ ID NO: 2771190 - RNA, 21 nt, Human
aaugauagacaauugagguaa

SEQ ID NO: 2771191 - RNA, 14 nt, Human
aaugauagauuuga

SEQ ID NO: 2771192 - RNA, 18 nt, Human
aaugauagauuugaccuc

SEQ ID NO: 2771193 - RNA, 18 nt, Human
aaugaacacucuuuugcu

SEQ ID NO: 2771194 - RNA, 15 nt, Human
aaugaacacucuuuu

SEQ ID NO: 2771195 - RNA, 21 nt, Human
aaugaacacucuuuugcuuua

SEQ ID NO: 2771196 - RNA, 20 nt, Human
aaugauaauauuguggugcc

SEQ ID NO: 2771197 - RNA, 15 nt, Human
aaugauagcuacugu

SEQ ID NO: 2771198 - RNA, 18 nt, Human
aaugauaguaagaaaagu

SEQ ID NO: 2771199 - RNA, 16 nt, Human
aaugauaguagaguga

SEQ ID NO: 2771200 - RNA, 18 nt, Human
aaugauaguugauuuuca

SEQ ID NO: 2771201 - RNA, 19 nt, Human
aaugauaguugauuuucaa

SEQ ID NO: 2771202 - RNA, 13 nt, Human
aaugauaugcauu

SEQ ID NO: 2771203 - RNA, 23 nt, Human
aaugauguauguugaagccuuug

SEQ ID NO: 2771204 - RNA, 20 nt, Human
aaugauguauguugaagccu

SEQ ID NO: 2771205 - RNA, 16 nt, Human
aaugaucagcaucugu

SEQ ID NO: 2771206 - RNA, 17 nt, Human
aaugaucagcaucugug

SEQ ID NO: 2771207 - RNA, 13 nt, Human
aauccauaucuua

SEQ ID NO: 2771208 - RNA, 15 nt, Human
aauccacucccaggc

SEQ ID NO: 2771209 - RNA, 17 nt, Human
aauccacucccaggcag

SEQ ID NO: 2771210 - RNA, 18 nt, Human
aauccacucccaggcagc

SEQ ID NO: 2771211 - RNA, 17 nt, Human
aauccaacccaugauga

SEQ ID NO: 2771212 - RNA, 20 nt, Human
aauccaaauggcgucuggaa

SEQ ID NO: 2771213 - RNA, 13 nt, Human
aauccaaauggcg

SEQ ID NO: 2771214 - RNA, 18 nt, Human
aauccaccugccucggcc

SEQ ID NO: 2771215 - RNA, 19 nt, Human
aauccaccugccucggccu

SEQ ID NO: 2771216 - RNA, 16 nt, Human
aauccacauuucuaaa

SEQ ID NO: 2771217 - RNA, 15 nt, Human
aauccacauuucuaa

SEQ ID NO: 2771218 - RNA, 17 nt, Human
aaucucccgcugcugcu

SEQ ID NO: 2771219 - RNA, 15 nt, Human
aaucuccaguauucu

SEQ ID NO: 2771220 - RNA, 16 nt, Human
aaucucccaugugcau

SEQ ID NO: 2771221 - RNA, 18 nt, Human
aaucucggcucacugcau

SEQ ID NO: 2771222 - RNA, 19 nt, Human
aaucucccgcugcugcugc

SEQ ID NO: 2771223 - RNA, 23 nt, Human
aaucucgcucugucgcccaggcu

SEQ ID NO: 2771224 - RNA, 20 nt, Human
aaucuggacuccucugucca

SEQ ID NO: 2771225 - RNA, 17 nt, Human
aaucuggacuccucugu

SEQ ID NO: 2771226 - RNA, 18 nt, Human
aaucuggacuccucuguc

SEQ ID NO: 2771227 - RNA, 15 nt, Human
aaucuggacuccucu

SEQ ID NO: 2771228 - RNA, 16 nt, Human
aaucuggacuccucug

SEQ ID NO: 2771229 - RNA, 15 nt, Human
aaugucacaggcagg

SEQ ID NO: 2771230 - RNA, 16 nt, Human
aaugguauggaacucu

SEQ ID NO: 2771231 - RNA, 14 nt, Human
aaugcucuccuuuc

SEQ ID NO: 2771232 - RNA, 19 nt, Human
aaugcucucucaaauuguc

SEQ ID NO: 2771233 - RNA, 13 nt, Human
aaugcucuccuuu

SEQ ID NO: 2771234 - RNA, 16 nt, Human
aaugggaauauuuuau

SEQ ID NO: 2771235 - RNA, 20 nt, Human
aaugcucuggggucuuuuua

SEQ ID NO: 2771236 - RNA, 15 nt, Human
aaugcucagaccagc

SEQ ID NO: 2771237 - RNA, 17 nt, Human
aaugcuaggucucggac

SEQ ID NO: 2771238 - RNA, 23 nt, Human
aaugcuauuuuuguuuuuagaau

SEQ ID NO: 2771239 - RNA, 13 nt, Human
aaugggacacuaa

SEQ ID NO: 2771240 - RNA, 14 nt, Human
aaugcuagaagaaa

SEQ ID NO: 2771241 - RNA, 16 nt, Human
aaugggaggccucuga

SEQ ID NO: 2771242 - RNA, 16 nt, Human
aaugggaucaugaaag

SEQ ID NO: 2771243 - RNA, 23 nt, Human
aaugggauguaugaauacagcag

SEQ ID NO: 2771244 - RNA, 23 nt, Human
aaugggcacugggaugagccgcu

SEQ ID NO: 2771245 - RNA, 23 nt, Human
aaugcuaccgccccaaaguaaaa

SEQ ID NO: 2771246 - RNA, 14 nt, Human
aaugcuaauauuaa

SEQ ID NO: 2771247 - RNA, 17 nt, Human
aaugcuaauauuaaaag

SEQ ID NO: 2771248 - RNA, 19 nt, Human
aaugcuaauuuaaagagac

SEQ ID NO: 2771249 - RNA, 17 nt, Human
aaugccugagugccugg

SEQ ID NO: 2771250 - RNA, 19 nt, Human
aaugccugagugccuggcc

SEQ ID NO: 2771251 - RNA, 16 nt, Human
aaugccugagugccug

SEQ ID NO: 2771252 - RNA, 11 nt, Human
aaugccucugu

SEQ ID NO: 2771253 - RNA, 14 nt, Human
aaugcgcaggcugg

SEQ ID NO: 2771254 - RNA, 15 nt, Human
aaugcgcaggcuggc

SEQ ID NO: 2771255 - RNA, 20 nt, Human
aaugcgcaggcuggcccugc

SEQ ID NO: 2771256 - RNA, 19 nt, Human
aaugcgcaggcuggcccug

SEQ ID NO: 2771257 - RNA, 18 nt, Human
aaugcgcaggcuggcccu

SEQ ID NO: 2771258 - RNA, 17 nt, Human
aaugcgcaggcuggccc

SEQ ID NO: 2771259 - RNA, 16 nt, Human
aaugcccuuaaaucau

SEQ ID NO: 2771260 - RNA, 19 nt, Human
aaugcccguaaugcuuaga

SEQ ID NO: 2771261 - RNA, 18 nt, Human
aaugcccguaaugcuuag

SEQ ID NO: 2771262 - RNA, 13 nt, Human
aaugccuccugug

SEQ ID NO: 2771263 - RNA, 15 nt, Human
aaugccuccuguggg

SEQ ID NO: 2771264 - RNA, 17 nt, Human
aaugccuccugugggga

SEQ ID NO: 2771265 - RNA, 15 nt, Human
aaugccuaauaaaca

SEQ ID NO: 2771266 - RNA, 16 nt, Human
aaugccuaauaaacaa

SEQ ID NO: 2771267 - RNA, 24 nt, Human
aaugccuaguuuuuaguaaucugu

SEQ ID NO: 2771268 - RNA, 12 nt, Human
aacugaggaauu

SEQ ID NO: 2771269 - RNA, 16 nt, Human
aacugaggaauuuucu

SEQ ID NO: 2771270 - RNA, 15 nt, Human
aacuguguuguauua

SEQ ID NO: 2771271 - RNA, 16 nt, Human
aacuguguuguauuaa

SEQ ID NO: 2771272 - RNA, 17 nt, Human
aacuguguuguauuaac

SEQ ID NO: 2771273 - RNA, 18 nt, Human
aacuguguuguauuaaca

SEQ ID NO: 2771274 - RNA, 20 nt, Human
aacuguguuguauuaacaaa

SEQ ID NO: 2771275 - RNA, 23 nt, Human
aacuguguuguauuaacaaaagu

SEQ ID NO: 2771276 - RNA, 13 nt, Human
aacugaggaauuu

SEQ ID NO: 2771277 - RNA, 18 nt, Human
aacuguucccaccugcug

SEQ ID NO: 2771278 - RNA, 15 nt, Human
aacuguucccaccug

SEQ ID NO: 2771279 - RNA, 13 nt, Human
aacuguucccacc

SEQ ID NO: 2771280 - RNA, 21 nt, Human
aacuguuaagaaaucuguuuu

SEQ ID NO: 2771281 - RNA, 14 nt, Human
aacuguuaugaaau

SEQ ID NO: 2771282 - RNA, 14 nt, Human
aacuguuagcacug

SEQ ID NO: 2771283 - RNA, 15 nt, Human
aacuguuagcacugu

SEQ ID NO: 2771284 - RNA, 17 nt, Human
aacuguuagcacuguug

SEQ ID NO: 2771285 - RNA, 18 nt, Human
aacuguuagcacuguuga

SEQ ID NO: 2771286 - RNA, 20 nt, Human
aacuguuagcacuguugaug

SEQ ID NO: 2771287 - RNA, 22 nt, Human
aacuguuagcacuguugaugua

SEQ ID NO: 2771288 - RNA, 15 nt, Human
aacuguuaccuaaag

SEQ ID NO: 2771289 - RNA, 20 nt, Human
aacuguuaccuaaaguauuu

SEQ ID NO: 2771290 - RNA, 18 nt, Human
aacucaucauaaaauaaa

SEQ ID NO: 2771291 - RNA, 21 nt, Human
aacucaucccuaaugcugcag

SEQ ID NO: 2771292 - RNA, 22 nt, Human
aacucaucccuaaugcugcaga

SEQ ID NO: 2771293 - RNA, 17 nt, Human
aacucaucauaaaauaa

SEQ ID NO: 2771294 - RNA, 16 nt, Human
aacucaucauaaaaua

SEQ ID NO: 2771295 - RNA, 15 nt, Human
aacucaucauaaaau

SEQ ID NO: 2771296 - RNA, 14 nt, Human
aacucaucauaaaa

SEQ ID NO: 2771297 - RNA, 18 nt, Human
aacucaucacuguggcug

SEQ ID NO: 2771298 - RNA, 16 nt, Human
aacugaauuuguacuu

SEQ ID NO: 2771299 - RNA, 20 nt, Human
aacugaauguuuauuccuug

SEQ ID NO: 2771300 - RNA, 14 nt, Human
aacgcgaaaccaau

SEQ ID NO: 2771301 - RNA, 13 nt, Human
aacgcgcagaugu

SEQ ID NO: 2771302 - RNA, 14 nt, Human
aacgcgcagaugug

SEQ ID NO: 2771303 - RNA, 21 nt, Human
aacgcgcagaugugcagcaga

SEQ ID NO: 2771304 - RNA, 23 nt, Human
aacgcgcagaugugcagcagauu

SEQ ID NO: 2771305 - RNA, 15 nt, Human
aacgcuaccucucug

SEQ ID NO: 2771306 - RNA, 15 nt, Human
aacgggcugcccugc

SEQ ID NO: 2771307 - RNA, 15 nt, Human
aacgggguccuucaa

SEQ ID NO: 2771308 - RNA, 17 nt, Human
aacgggucguaaugacu

SEQ ID NO: 2771309 - RNA, 17 nt, Human
aacgggcugcccugcca

SEQ ID NO: 2771310 - RNA, 17 nt, Human
aacguaaccacggaaaa

SEQ ID NO: 2771311 - RNA, 19 nt, Human
aacguaagcacuguuuuuc

SEQ ID NO: 2771312 - RNA, 14 nt, Human
aacgguucaguuuc

SEQ ID NO: 2771313 - RNA, 15 nt, Human
aacucaaaauauuug

SEQ ID NO: 2771314 - RNA, 22 nt, Human
aacucaaacuucuggcucccuc

SEQ ID NO: 2771315 - RNA, 23 nt, Human
aacucaaacuucuggcucccucu

SEQ ID NO: 2771316 - RNA, 16 nt, Human
aacucaaaauauuugu

SEQ ID NO: 2771317 - RNA, 13 nt, Human
aacguauuuuaaa

SEQ ID NO: 2771318 - RNA, 21 nt, Human
aacucaacugggcucuguccc

SEQ ID NO: 2771319 - RNA, 13 nt, Human
aacucaagacaau

SEQ ID NO: 2771320 - RNA, 16 nt, Human
aacucaagacaaugca

SEQ ID NO: 2771321 - RNA, 18 nt, Human
aacgccuccccugcccca

SEQ ID NO: 2771322 - RNA, 23 nt, Human
aacgacaaagccaaacucugcca

SEQ ID NO: 2771323 - RNA, 14 nt, Human
aacgaaacacuuca

SEQ ID NO: 2771324 - RNA, 23 nt, Human
aaccuuuuuuaagauuuuucuca

SEQ ID NO: 2771325 - RNA, 15 nt, Human
aaccuuuuuuaagau

SEQ ID NO: 2771326 - RNA, 17 nt, Human
aaccuuuuuuaagauuu

SEQ ID NO: 2771327 - RNA, 18 nt, Human
aaccuuuuuuaagauuuu

SEQ ID NO: 2771328 - RNA, 21 nt, Human
aaccuuuuuuaagauuuuucu

SEQ ID NO: 2771329 - RNA, 22 nt, Human
aaccuuuuuuaagauuuuucuc

SEQ ID NO: 2771330 - RNA, 12 nt, Human
aaccaguugugg

SEQ ID NO: 2771331 - RNA, 19 nt, Human
aaccaguuguggugugagu

SEQ ID NO: 2771332 - RNA, 20 nt, Human
aaccaguuguggugugagua

SEQ ID NO: 2771333 - RNA, 21 nt, Human
aaccaguuguggugugaguau

SEQ ID NO: 2771334 - RNA, 17 nt, Human
aaccaguuuagauuuca

SEQ ID NO: 2771335 - RNA, 22 nt, Human
aaccaguuuagauuucaagaaa

SEQ ID NO: 2771336 - RNA, 23 nt, Human
aacccuuaccccuuagccucccu

SEQ ID NO: 2771337 - RNA, 21 nt, Human
aacccuuaccccuuagccucc

SEQ ID NO: 2771338 - RNA, 20 nt, Human
aacccuuccugagcuuuaug

SEQ ID NO: 2771339 - RNA, 19 nt, Human
aacccuucaacguuucuuc

SEQ ID NO: 2771340 - RNA, 22 nt, Human
aacccuucaacguuucuucacu

SEQ ID NO: 2771341 - RNA, 18 nt, Human
aaccauaacaacuucaua

SEQ ID NO: 2771342 - RNA, 19 nt, Human
aaccagggaagcugucccu

SEQ ID NO: 2771343 - RNA, 18 nt, Human
aaccagggaagcuguccc

SEQ ID NO: 2771344 - RNA, 23 nt, Human
aacaugcuuaugacaaugacugu

SEQ ID NO: 2771345 - RNA, 15 nt, Human
aaccgcacagcucag

SEQ ID NO: 2771346 - RNA, 14 nt, Human
aaccgcacagcuca

SEQ ID NO: 2771347 - RNA, 13 nt, Human
aaccgcacagcuc

SEQ ID NO: 2771348 - RNA, 12 nt, Human
aaccgcacagcu

SEQ ID NO: 2771349 - RNA, 14 nt, Human
aaccgaugcuuuac

SEQ ID NO: 2771350 - RNA, 17 nt, Human
aaccgaugcuuuaccaa

SEQ ID NO: 2771351 - RNA, 18 nt, Human
aaccgaugcuuuaccaaa

SEQ ID NO: 2771352 - RNA, 22 nt, Human
aaccgagcaaagaucaaaauaa

SEQ ID NO: 2771353 - RNA, 17 nt, Human
aaccgagcaaagaucaa

SEQ ID NO: 2771354 - RNA, 16 nt, Human
aaccgccucaaaaugu

SEQ ID NO: 2771355 - RNA, 16 nt, Human
aaccgcuuuggccuga

SEQ ID NO: 2771356 - RNA, 17 nt, Human
aaccgcuuuggccugag

SEQ ID NO: 2771357 - RNA, 18 nt, Human
aaccgcuuuggccugagu

SEQ ID NO: 2771358 - RNA, 12 nt, Human
aaccgcucaccu

SEQ ID NO: 2771359 - RNA, 16 nt, Human
aaccgcucaccuagag

SEQ ID NO: 2771360 - RNA, 19 nt, Human
aaccgcucaccuagagcca

SEQ ID NO: 2771361 - RNA, 16 nt, Human
aacagcuaaugggaca

SEQ ID NO: 2771362 - RNA, 20 nt, Human
aacagccuuugggaaaugcu

SEQ ID NO: 2771363 - RNA, 20 nt, Human
aacagcgaaguagcuugcuc

SEQ ID NO: 2771364 - RNA, 16 nt, Human
aacagauuuugggguu

SEQ ID NO: 2771365 - RNA, 15 nt, Human
aacagcaaaccaaga

SEQ ID NO: 2771366 - RNA, 16 nt, Human
aacagcaaaccaagag

SEQ ID NO: 2771367 - RNA, 17 nt, Human
aacagcaaaccaagaga

SEQ ID NO: 2771368 - RNA, 18 nt, Human
aacagcaaaccaagagau

SEQ ID NO: 2771369 - RNA, 19 nt, Human
aacagcaaaccaagagauu

SEQ ID NO: 2771370 - RNA, 17 nt, Human
aacaggagacaggaagg

SEQ ID NO: 2771371 - RNA, 20 nt, Human
aacaggaaucaagagcugcc

SEQ ID NO: 2771372 - RNA, 19 nt, Human
aacagcuaugggagcccca

SEQ ID NO: 2771373 - RNA, 18 nt, Human
aacagcuaugggagcccc

SEQ ID NO: 2771374 - RNA, 13 nt, Human
aacagcuacaaca

SEQ ID NO: 2771375 - RNA, 14 nt, Human
aacagcuacaacag

SEQ ID NO: 2771376 - RNA, 15 nt, Human
aacagcuacaacagc

SEQ ID NO: 2771377 - RNA, 19 nt, Human
aacagcuacaacagccuca

SEQ ID NO: 2771378 - RNA, 20 nt, Human
aacagcuacaacagccucac

SEQ ID NO: 2771379 - RNA, 21 nt, Human
aacagcuacaacagccucacu

SEQ ID NO: 2771380 - RNA, 22 nt, Human
aacagcuacaacagccucacuu

SEQ ID NO: 2771381 - RNA, 22 nt, Human
aacaggaaaggcucgaaauaca

SEQ ID NO: 2771382 - RNA, 22 nt, Human
aacagcuaugggagccccaggg

SEQ ID NO: 2771383 - RNA, 14 nt, Human
aacaggauaacccu

SEQ ID NO: 2771384 - RNA, 20 nt, Human
aacaggaucaguuaacuauu

SEQ ID NO: 2771385 - RNA, 19 nt, Human
aacauccuucaagaacucu

SEQ ID NO: 2771386 - RNA, 22 nt, Human
aacauccuaucaacaacaaggu

SEQ ID NO: 2771387 - RNA, 12 nt, Human
aacauccugcca

SEQ ID NO: 2771388 - RNA, 14 nt, Human
aacauccugccagc

SEQ ID NO: 2771389 - RNA, 19 nt, Human
aacauccuuugcagggcag

SEQ ID NO: 2771390 - RNA, 21 nt, Human
aacauccuuugcagggcagcc

SEQ ID NO: 2771391 - RNA, 22 nt, Human
aacauccuuugcagggcagccc

SEQ ID NO: 2771392 - RNA, 12 nt, Human
aacaucuagaaa

SEQ ID NO: 2771393 - RNA, 16 nt, Human
aacaucuagaaauugc

SEQ ID NO: 2771394 - RNA, 22 nt, Human
aacauccuacaagacacaguga

SEQ ID NO: 2771395 - RNA, 15 nt, Human
aacauccuacaagac

SEQ ID NO: 2771396 - RNA, 12 nt, Human
aaaucuuaaaaa

SEQ ID NO: 2771397 - RNA, 14 nt, Human
aaaucuuaaaaagu

SEQ ID NO: 2771398 - RNA, 17 nt, Human
aaaucuuaaaaaguugu

SEQ ID NO: 2771399 - RNA, 12 nt, Human
aaaucuguguau

SEQ ID NO: 2771400 - RNA, 18 nt, Human
aaaucuguguauauuauu

SEQ ID NO: 2771401 - RNA, 20 nt, Human
aaaucuguguauauuauuug

SEQ ID NO: 2771402 - RNA, 22 nt, Human
aaaucuguguauauuauuuggc

SEQ ID NO: 2771403 - RNA, 15 nt, Human
aaaucuguucuaaca

SEQ ID NO: 2771404 - RNA, 20 nt, Human
aaaucuguucugggcucuuu

SEQ ID NO: 2771405 - RNA, 12 nt, Human
aaaucuguugcc

SEQ ID NO: 2771406 - RNA, 20 nt, Human
aaaugcuagguuaauuccaa

SEQ ID NO: 2771407 - RNA, 22 nt, Human
aaaucugcuggaguuucaugua

SEQ ID NO: 2771408 - RNA, 20 nt, Human
aaaucugcuggaguuucaug

SEQ ID NO: 2771409 - RNA, 13 nt, Human
aaaucugcagagg

SEQ ID NO: 2771410 - RNA, 12 nt, Human
aaaucucuaaua

SEQ ID NO: 2771411 - RNA, 15 nt, Human
aaaucugaagauugc

SEQ ID NO: 2771412 - RNA, 13 nt, Human
aaaucucuaauau

SEQ ID NO: 2771413 - RNA, 15 nt, Human
aaaucucuaauaugg

SEQ ID NO: 2771414 - RNA, 16 nt, Human
aaauggacacugugcc

SEQ ID NO: 2771415 - RNA, 22 nt, Human
aaauggaauugaaaaacucuuu

SEQ ID NO: 2771416 - RNA, 15 nt, Human
aaauggacauggugg

SEQ ID NO: 2771417 - RNA, 13 nt, Human
aaaugcucucuca

SEQ ID NO: 2771418 - RNA, 16 nt, Human
aaaugcucucucaaau

SEQ ID NO: 2771419 - RNA, 22 nt, Human
aaaugcucucucaaauugucag

SEQ ID NO: 2771420 - RNA, 12 nt, Human
aaauguugaaua

SEQ ID NO: 2771421 - RNA, 15 nt, Human
aaauguugaauaaaa

SEQ ID NO: 2771422 - RNA, 22 nt, Human
aaauguugaaccaaaccucccu

SEQ ID NO: 2771423 - RNA, 21 nt, Human
aaauguucuaaguuucuaaga

SEQ ID NO: 2771424 - RNA, 18 nt, Human
aaauguucuaugguuaug

SEQ ID NO: 2771425 - RNA, 13 nt, Human
aaauguucuaagu

SEQ ID NO: 2771426 - RNA, 14 nt, Human
aaauguucuaaguu

SEQ ID NO: 2771427 - RNA, 17 nt, Human
aaauguucuaaguuucu

SEQ ID NO: 2771428 - RNA, 19 nt, Human
aaauguucuaaguuucuaa

SEQ ID NO: 2771429 - RNA, 18 nt, Human
aaauugagacagugcaca

SEQ ID NO: 2771430 - RNA, 21 nt, Human
aaauugagacagugcacauga

SEQ ID NO: 2771431 - RNA, 13 nt, Human
aaauuaaaaagau

SEQ ID NO: 2771432 - RNA, 17 nt, Human
aaauuaaaaagauucuu

SEQ ID NO: 2771433 - RNA, 18 nt, Human
aaauuaaaaagauucuuu

SEQ ID NO: 2771434 - RNA, 23 nt, Human
aaauuaaaaagauucuuuuucug

SEQ ID NO: 2771435 - RNA, 18 nt, Human
aaauguucaucaauuccc

SEQ ID NO: 2771436 - RNA, 14 nt, Human
aaauugauguguuu

SEQ ID NO: 2771437 - RNA, 20 nt, Human
aaauugauaaugcuuucaca

SEQ ID NO: 2771438 - RNA, 15 nt, Human
aaauuggguucauga

SEQ ID NO: 2771439 - RNA, 16 nt, Human
aaauuggguucaugau

SEQ ID NO: 2771440 - RNA, 19 nt, Human
aaauuggguucaugaugca

SEQ ID NO: 2771441 - RNA, 16 nt, Human
aaauugguucuuuauu

SEQ ID NO: 2771442 - RNA, 19 nt, Human
aacaaaauuuguuugaaau

SEQ ID NO: 2771443 - RNA, 21 nt, Human
aacaaaauuuuauuuugugcu

SEQ ID NO: 2771444 - RNA, 16 nt, Human
aacaaacaccuucuua

SEQ ID NO: 2771445 - RNA, 19 nt, Human
aacaaacaccuucuuauua

SEQ ID NO: 2771446 - RNA, 15 nt, Human
aacaaacauuguguu

SEQ ID NO: 2771447 - RNA, 20 nt, Human
aacaaacauuguguugacau

SEQ ID NO: 2771448 - RNA, 21 nt, Human
aacaaacauuguguugacauu

SEQ ID NO: 2771449 - RNA, 22 nt, Human
aacaaacauuguguugacauua

SEQ ID NO: 2771450 - RNA, 14 nt, Human
aaauuaaaauggau

SEQ ID NO: 2771451 - RNA, 16 nt, Human
aacaaaccagaauccc

SEQ ID NO: 2771452 - RNA, 10 nt, Human
aacaaaccau

SEQ ID NO: 2771453 - RNA, 11 nt, Human
aacaaaccauc

SEQ ID NO: 2771454 - RNA, 18 nt, Human
aacacccucgaagcgcgc

SEQ ID NO: 2771455 - RNA, 13 nt, Human
aacacccuuagaa

SEQ ID NO: 2771456 - RNA, 14 nt, Human
aacacccuuagaaa

SEQ ID NO: 2771457 - RNA, 15 nt, Human
aacacccuuagaaaa

SEQ ID NO: 2771458 - RNA, 20 nt, Human
aacacccuuagaaaaugugu

SEQ ID NO: 2771459 - RNA, 12 nt, Human
aacacccuuccu

SEQ ID NO: 2771460 - RNA, 14 nt, Human
aacacccuuccuuc

SEQ ID NO: 2771461 - RNA, 19 nt, Human
aacacccuuccuucuguaa

SEQ ID NO: 2771462 - RNA, 20 nt, Human
aacaccgcuucugccuuuuc

SEQ ID NO: 2771463 - RNA, 19 nt, Human
aacaccuagcuuuauucuu

SEQ ID NO: 2771464 - RNA, 21 nt, Human
aacaccucacaccucacucuu

SEQ ID NO: 2771465 - RNA, 13 nt, Human
aacaccccucagu

SEQ ID NO: 2771466 - RNA, 21 nt, Human
aacaccccucaguugugcagc

SEQ ID NO: 2771467 - RNA, 23 nt, Human
aacaccucccaggagacaguuca

SEQ ID NO: 2771468 - RNA, 13 nt, Human
aacaccucccagg

SEQ ID NO: 2771469 - RNA, 19 nt, Human
aacacuaacucaccagccc

SEQ ID NO: 2771470 - RNA, 18 nt, Human
aacacuaacucaccagcc

SEQ ID NO: 2771471 - RNA, 17 nt, Human
aacacuaacucaccagc

SEQ ID NO: 2771472 - RNA, 16 nt, Human
aacaccuccucaugua

SEQ ID NO: 2771473 - RNA, 16 nt, Human
aacacagucaaaauaa

SEQ ID NO: 2771474 - RNA, 19 nt, Human
aacacagucaaaauaauuc

SEQ ID NO: 2771475 - RNA, 22 nt, Human
aacacaggcaaaauccuugcuu

SEQ ID NO: 2771476 - RNA, 13 nt, Human
aacacaggcagcu

SEQ ID NO: 2771477 - RNA, 14 nt, Human
aacacaggcagcuu

SEQ ID NO: 2771478 - RNA, 15 nt, Human
aacacaggcagcuuu

SEQ ID NO: 2771479 - RNA, 17 nt, Human
aacacaggcagcuuucu

SEQ ID NO: 2771480 - RNA, 18 nt, Human
aacacaggcagcuuucua

SEQ ID NO: 2771481 - RNA, 22 nt, Human
aacacaggcagcuuucuagaag

SEQ ID NO: 2771482 - RNA, 14 nt, Human
aacaaaugugaagg

SEQ ID NO: 2771483 - RNA, 16 nt, Human
aacaaacucucugaac

SEQ ID NO: 2771484 - RNA, 16 nt, Human
aacaaauaaucacauu

SEQ ID NO: 2771485 - RNA, 16 nt, Human
aacaaagguugagaug

SEQ ID NO: 2771486 - RNA, 12 nt, Human
aacaaagucuuu

SEQ ID NO: 2771487 - RNA, 12 nt, Human
aacaaauaugca

SEQ ID NO: 2771488 - RNA, 13 nt, Human
aacaaauaugcaa

SEQ ID NO: 2771489 - RNA, 16 nt, Human
aacaaauaugcuaauu

SEQ ID NO: 2771490 - RNA, 18 nt, Human
aacaaauaugcuaauuug

SEQ ID NO: 2771491 - RNA, 23 nt, Human
aaaauuaaucugggccagaauuu

SEQ ID NO: 2771492 - RNA, 20 nt, Human
aaaauuaagacaagccuggc

SEQ ID NO: 2771493 - RNA, 18 nt, Human
aaaauccccaugccugug

SEQ ID NO: 2771494 - RNA, 12 nt, Human
aaaauuacuaau

SEQ ID NO: 2771495 - RNA, 15 nt, Human
aaaauuacuaauuuu

SEQ ID NO: 2771496 - RNA, 17 nt, Human
aaaauuacuaauuuuac

SEQ ID NO: 2771497 - RNA, 14 nt, Human
aaaauuagaaauug

SEQ ID NO: 2771498 - RNA, 18 nt, Human
aaaauuagccgggcgugg

SEQ ID NO: 2771499 - RNA, 20 nt, Human
aaaauuagaaauuggcugga

SEQ ID NO: 2771500 - RNA, 18 nt, Human
aaaauuagaugcauguug

SEQ ID NO: 2771501 - RNA, 19 nt, Human
aaaauuaggauuucaugau

SEQ ID NO: 2771502 - RNA, 21 nt, Human
aaaauuauacuaacuuauuua

SEQ ID NO: 2771503 - RNA, 22 nt, Human
aaaauuauacuaacuuauuuau

SEQ ID NO: 2771504 - RNA, 13 nt, Human
aaaauuauuugca

SEQ ID NO: 2771505 - RNA, 14 nt, Human
aaaauuauuugcag

SEQ ID NO: 2771506 - RNA, 17 nt, Human
aaaauuauuuuaaacaa

SEQ ID NO: 2771507 - RNA, 18 nt, Human
aaaauuauuuuaaacaaa

SEQ ID NO: 2771508 - RNA, 19 nt, Human
aaaauuauuuuaaacaaaa

SEQ ID NO: 2771509 - RNA, 13 nt, Human
aaaauuaugaauc

SEQ ID NO: 2771510 - RNA, 14 nt, Human
aaaauuaugaaucu

SEQ ID NO: 2771511 - RNA, 16 nt, Human
aaaauuaugaaucuga

SEQ ID NO: 2771512 - RNA, 19 nt, Human
aaaauuaugaaucugauuu

SEQ ID NO: 2771513 - RNA, 22 nt, Human
aaaauuaugaaucugauuuuua

SEQ ID NO: 2771514 - RNA, 13 nt, Human
aaaauuaucuaua

SEQ ID NO: 2771515 - RNA, 16 nt, Human
aaaaguuuacaagugu

SEQ ID NO: 2771516 - RNA, 22 nt, Human
aaaaguuuacaaguguauauca

SEQ ID NO: 2771517 - RNA, 13 nt, Human
aaaaguuuacaac

SEQ ID NO: 2771518 - RNA, 17 nt, Human
aaaaguuuacaacauaa

SEQ ID NO: 2771519 - RNA, 23 nt, Human
aaaaguuuacaacauaaucuagu

SEQ ID NO: 2771520 - RNA, 18 nt, Human
aaaaguuucaaugugauu

SEQ ID NO: 2771521 - RNA, 12 nt, Human
aaaaguuucaau

SEQ ID NO: 2771522 - RNA, 13 nt, Human
aaaaguuucaaug

SEQ ID NO: 2771523 - RNA, 12 nt, Human
aaaaguuuccau

SEQ ID NO: 2771524 - RNA, 21 nt, Human
aaaauaaaaacccacaaaaau

SEQ ID NO: 2771525 - RNA, 16 nt, Human
aaaauaaaaacuauuc

SEQ ID NO: 2771526 - RNA, 18 nt, Human
aaaauaaaaacuauucga

SEQ ID NO: 2771527 - RNA, 15 nt, Human
aaaauaaaaaaugug

SEQ ID NO: 2771528 - RNA, 15 nt, Human
aaaauccaaaaagaa

SEQ ID NO: 2771529 - RNA, 14 nt, Human
aaaauccaaaaaga

SEQ ID NO: 2771530 - RNA, 21 nt, Human
aaaaucacuuugucuaacuca

SEQ ID NO: 2771531 - RNA, 14 nt, Human
aaaaucacuugauu

SEQ ID NO: 2771532 - RNA, 23 nt, Human
aaaauauuuuuuauauauacagu

SEQ ID NO: 2771533 - RNA, 20 nt, Human
aaaauauuuuuuauauauac

SEQ ID NO: 2771534 - RNA, 14 nt, Human
aaaaucaaaacaag

SEQ ID NO: 2771535 - RNA, 16 nt, Human
aaaaucaaaacaagug

SEQ ID NO: 2771536 - RNA, 16 nt, Human
aaaaucaaagcugagg

SEQ ID NO: 2771537 - RNA, 11 nt, Human
aaaaucaacuu

SEQ ID NO: 2771538 - RNA, 13 nt, Human
aaaaucacaaaaa

SEQ ID NO: 2771539 - RNA, 14 nt, Human
aaaaucacaaaaau

SEQ ID NO: 2771540 - RNA, 14 nt, Human
aaaaucacaauuuu

SEQ ID NO: 2771541 - RNA, 20 nt, Human
aaaaucacaauuuuuaaugg

SEQ ID NO: 2771542 - RNA, 23 nt, Human
aaaaucacacuguaaauaugaau

SEQ ID NO: 2771543 - RNA, 22 nt, Human
aaaauaaaaagugacacagcag

SEQ ID NO: 2771544 - RNA, 17 nt, Human
aaaauaaaaagugacac

SEQ ID NO: 2771545 - RNA, 21 nt, Human
aaaauaaaaagugacacagca

SEQ ID NO: 2771546 - RNA, 20 nt, Human
aaaauucgcccgagcuguuu

SEQ ID NO: 2771547 - RNA, 22 nt, Human
aaaauucgcccgagcuguuuau

SEQ ID NO: 2771548 - RNA, 13 nt, Human
aaaauucuccuga

SEQ ID NO: 2771549 - RNA, 22 nt, Human
aaaauuccuuuguguuucuauu

SEQ ID NO: 2771550 - RNA, 22 nt, Human
aaaauugaagagagauauaucu

SEQ ID NO: 2771551 - RNA, 17 nt, Human
aaacagcaaaccaagag

SEQ ID NO: 2771552 - RNA, 18 nt, Human
aaacagcaaaccaagaga

SEQ ID NO: 2771553 - RNA, 19 nt, Human
aaacagcaaaccaagagau

SEQ ID NO: 2771554 - RNA, 20 nt, Human
aaacagcaaaccaagagauu

SEQ ID NO: 2771555 - RNA, 23 nt, Human
aaacagcaaaccaagagauugcu

SEQ ID NO: 2771556 - RNA, 24 nt, Human
aaacagcaaaccaagagauugcua

SEQ ID NO: 2771557 - RNA, 13 nt, Human
aaaauucuuggaa

SEQ ID NO: 2771558 - RNA, 20 nt, Human
aaaauucuguagguucugug

SEQ ID NO: 2771559 - RNA, 17 nt, Human
aaaauucuugaaagaau

SEQ ID NO: 2771560 - RNA, 14 nt, Human
aaacagcaguguuc

SEQ ID NO: 2771561 - RNA, 17 nt, Human
aaacagcuaaugggaca

SEQ ID NO: 2771562 - RNA, 18 nt, Human
aaacagcugcauuagaaa

SEQ ID NO: 2771563 - RNA, 20 nt, Human
aaacagcugcauuagaaaaa

SEQ ID NO: 2771564 - RNA, 16 nt, Human
aaacagcugucucuaa

SEQ ID NO: 2771565 - RNA, 16 nt, Human
aaacaggagacaggaa

SEQ ID NO: 2771566 - RNA, 17 nt, Human
aaacaggagacaggaag

SEQ ID NO: 2771567 - RNA, 18 nt, Human
aaacaggagacaggaagg

SEQ ID NO: 2771568 - RNA, 12 nt, Human
aaacaggaucag

SEQ ID NO: 2771569 - RNA, 12 nt, Human
aaacagcuuuca

SEQ ID NO: 2771570 - RNA, 14 nt, Human
aaacagcuuucaag

SEQ ID NO: 2771571 - RNA, 18 nt, Human
aaacagcuuucaagugcc

SEQ ID NO: 2771572 - RNA, 19 nt, Human
aaacagcuuucaagugccu

SEQ ID NO: 2771573 - RNA, 20 nt, Human
aaacagcuuuggggugucuu

SEQ ID NO: 2771574 - RNA, 22 nt, Human
aaagaaccaaaaguuuuccuga

SEQ ID NO: 2771575 - RNA, 20 nt, Human
aaagaggcugccccucucac

SEQ ID NO: 2771576 - RNA, 18 nt, Human
aaagaggcugccccucuc

SEQ ID NO: 2771577 - RNA, 14 nt, Human
aaagaggcugcccc

SEQ ID NO: 2771578 - RNA, 17 nt, Human
aaagaagaacuugcaug

SEQ ID NO: 2771579 - RNA, 10 nt, Human
aaagaagaag

SEQ ID NO: 2771580 - RNA, 21 nt, Human
aaagaagaagaagaagaaaag

SEQ ID NO: 2771581 - RNA, 20 nt, Human
aaagaagaauguguuucaaa

SEQ ID NO: 2771582 - RNA, 15 nt, Human
aaagaaaccacuucu

SEQ ID NO: 2771583 - RNA, 16 nt, Human
aaagaagaaagacucu

SEQ ID NO: 2771584 - RNA, 12 nt, Human
aaagaacuuacc

SEQ ID NO: 2771585 - RNA, 12 nt, Human
aaagaacuuacu

SEQ ID NO: 2771586 - RNA, 17 nt, Human
aaagaacuuacugauua

SEQ ID NO: 2771587 - RNA, 9 nt, Human
aaagaagaa

SEQ ID NO: 2771588 - RNA, 23 nt, Human
aaagaaaauaaagacaaccauau

SEQ ID NO: 2771589 - RNA, 19 nt, Human
aaacugaggaauuuucuuu

SEQ ID NO: 2771590 - RNA, 22 nt, Human
aaagaaaaugaaaaacaaccaa

SEQ ID NO: 2771591 - RNA, 18 nt, Human
aaagaaaauucuuggaau

SEQ ID NO: 2771592 - RNA, 12 nt, Human
aaagaaaauuuu

SEQ ID NO: 2771593 - RNA, 19 nt, Human
aaagaaaauuuuuguagua

SEQ ID NO: 2771594 - RNA, 13 nt, Human
aaagaaacagcuu

SEQ ID NO: 2771595 - RNA, 15 nt, Human
aaagaaacagcuuuc

SEQ ID NO: 2771596 - RNA, 14 nt, Human
aaacugaaaaucua

SEQ ID NO: 2771597 - RNA, 17 nt, Human
aaacugaaaaucuaaua

SEQ ID NO: 2771598 - RNA, 18 nt, Human
aaacugaaaaucuaauau

SEQ ID NO: 2771599 - RNA, 19 nt, Human
aaacugaaaaucuaauauu

SEQ ID NO: 2771600 - RNA, 12 nt, Human
aaacugaaaauc

SEQ ID NO: 2771601 - RNA, 13 nt, Human
aaacugaaaaucu

SEQ ID NO: 2771602 - RNA, 12 nt, Human
aaacucuugcua

SEQ ID NO: 2771603 - RNA, 13 nt, Human
aaacucuuuauuu

SEQ ID NO: 2771604 - RNA, 23 nt, Human
aaaccccauuugcuuucuuuucu

SEQ ID NO: 2771605 - RNA, 19 nt, Human
aaacccauaggcccacaca

SEQ ID NO: 2771606 - RNA, 21 nt, Human
aaacccauaggcccacacaca

SEQ ID NO: 2771607 - RNA, 22 nt, Human
aaacccauaggcccacacacag

SEQ ID NO: 2771608 - RNA, 23 nt, Human
aaacccauaggcccacacacagg

SEQ ID NO: 2771609 - RNA, 17 nt, Human
aaacucuugaccucagg

SEQ ID NO: 2771610 - RNA, 22 nt, Human
aaacucuuaucucagucaugca

SEQ ID NO: 2771611 - RNA, 16 nt, Human
aaaccuaguacugccc

SEQ ID NO: 2771612 - RNA, 17 nt, Human
aaaccuauccucacugc

SEQ ID NO: 2771613 - RNA, 18 nt, Human
aaaccuauccucacugcc

SEQ ID NO: 2771614 - RNA, 22 nt, Human
aaaccucaaaaugucuaagaua

SEQ ID NO: 2771615 - RNA, 17 nt, Human
aaaccucaaaaugucua

SEQ ID NO: 2771616 - RNA, 17 nt, Human
aaaccuagagaagauaa

SEQ ID NO: 2771617 - RNA, 19 nt, Human
aaaccuaaguccuuuaugu

SEQ ID NO: 2771618 - RNA, 20 nt, Human
aaaccuaaguccuuuaugug

SEQ ID NO: 2771619 - RNA, 18 nt, Human
aaaccuacacacugucau

SEQ ID NO: 2771620 - RNA, 15 nt, Human
aaaccuacauauucc

SEQ ID NO: 2771621 - RNA, 16 nt, Human
aaaccuacauauucca

SEQ ID NO: 2771622 - RNA, 16 nt, Human
aaaccgccuaguuuac

SEQ ID NO: 2771623 - RNA, 20 nt, Human
aaaccgccuaguuuacuguu

SEQ ID NO: 2771624 - RNA, 18 nt, Human
aaaccgcuuuggccugag

SEQ ID NO: 2771625 - RNA, 20 nt, Human
aaagauaauugcuauuuauu

SEQ ID NO: 2771626 - RNA, 17 nt, Human
aaagauaauauuacugu

SEQ ID NO: 2771627 - RNA, 23 nt, Human
aaagaggcugccccucucaccaa

SEQ ID NO: 2771628 - RNA, 22 nt, Human
aaagaggcugccccucucacca

SEQ ID NO: 2771629 - RNA, 14 nt, Human
aaagcauuuaucau

SEQ ID NO: 2771630 - RNA, 15 nt, Human
aaagccaaagcuagg

SEQ ID NO: 2771631 - RNA, 17 nt, Human
aaagccaaacucugcca

SEQ ID NO: 2771632 - RNA, 14 nt, Human
aaagcccugagauc

SEQ ID NO: 2771633 - RNA, 19 nt, Human
aaaggcuagguacacagcu

SEQ ID NO: 2771634 - RNA, 21 nt, Human
aaaggcucagucucaggagca

SEQ ID NO: 2771635 - RNA, 19 nt, Human
aaaggcucagucucaggag

SEQ ID NO: 2771636 - RNA, 20 nt, Human
aaauaaaaauauuguguugu

SEQ ID NO: 2771637 - RNA, 22 nt, Human
aaagucacuuacuauuguugcu

SEQ ID NO: 2771638 - RNA, 13 nt, Human
aaagugcuaaggu

SEQ ID NO: 2771639 - RNA, 23 nt, Human
aaauaaaaauuauuauugauuuu

SEQ ID NO: 2771640 - RNA, 13 nt, Human
aaauaaaacaaag

SEQ ID NO: 2771641 - RNA, 15 nt, Human
aaauaaaacaaaggg

SEQ ID NO: 2771642 - RNA, 20 nt, Human
aaauaaaacaaagggcacag

SEQ ID NO: 2771643 - RNA, 14 nt, Human
aaauaaaaccagcu

SEQ ID NO: 2771644 - RNA, 19 nt, Human
aaauaaaccucaaaauguc

SEQ ID NO: 2771645 - RNA, 22 nt, Human
aaauaaaccaaaggacauuaug

SEQ ID NO: 2771646 - RNA, 18 nt, Human
aaauaaacaaauaacaau

SEQ ID NO: 2771647 - RNA, 15 nt, Human
aaauaaaaccuuuca

SEQ ID NO: 2771648 - RNA, 14 nt, Human
aaauaaaaccuuuc

SEQ ID NO: 2771649 - RNA, 13 nt, Human
aaauaaaaccuuu

SEQ ID NO: 2771650 - RNA, 12 nt, Human
aaauaaaaccuu

SEQ ID NO: 2771651 - RNA, 11 nt, Human
aaauaaaaccu

SEQ ID NO: 2771652 - RNA, 14 nt, Human
aaagucacaauguu

SEQ ID NO: 2771653 - RNA, 18 nt, Human
aaagucacaauguucuuu

SEQ ID NO: 2771654 - RNA, 20 nt, Human
aaagucacaauguucuuuau

SEQ ID NO: 2771655 - RNA, 15 nt, Human
aaaggcugugcugcc

SEQ ID NO: 2771656 - RNA, 23 nt, Human
aaaggcugugcugcccugaagaa

SEQ ID NO: 2771657 - RNA, 18 nt, Human
aaaggcugugcugcccug

SEQ ID NO: 2771658 - RNA, 12 nt, Human
aaaguauuuuga

SEQ ID NO: 2771659 - RNA, 13 nt, Human
aaaguauuuugaa

SEQ ID NO: 2771660 - RNA, 14 nt, Human
aaaguauuuugaag

SEQ ID NO: 2771661 - RNA, 15 nt, Human
aaaguauuuugaagu

SEQ ID NO: 2771662 - RNA, 16 nt, Human
aaaguauuuugaaguu

SEQ ID NO: 2771663 - RNA, 17 nt, Human
aaaguauuuugaaguuu

SEQ ID NO: 2771664 - RNA, 18 nt, Human
aaaguauuuugaaguuua

SEQ ID NO: 2771665 - RNA, 21 nt, Human
aaaguauuuugaaguuuacau

SEQ ID NO: 2771666 - RNA, 22 nt, Human
aaaguauuuugaaguuuacauu

SEQ ID NO: 2771667 - RNA, 23 nt, Human
aaaguauuuugaaguuuacauuu

SEQ ID NO: 2771668 - RNA, 15 nt, Human
aaagugccacucauu

SEQ ID NO: 2771669 - RNA, 23 nt, Human
aaagugcagcuccguuuggcagu

SEQ ID NO: 2771670 - RNA, 18 nt, Human
aaagugcauauuuaucca

SEQ ID NO: 2771671 - RNA, 13 nt, Human
aaagugcacaccu

SEQ ID NO: 2771672 - RNA, 21 nt, Human
aaagugauaauuucuggaauu

SEQ ID NO: 2771673 - RNA, 15 nt, Human
aaagugaugacauau

SEQ ID NO: 2771674 - RNA, 16 nt, Human
aaagugaugacauauu

SEQ ID NO: 2771675 - RNA, 17 nt, Human
aaagugaugacauauuu

SEQ ID NO: 2771676 - RNA, 21 nt, Human
aaagugaugggcuuucucuuu

SEQ ID NO: 2771677 - RNA, 15 nt, Human
aaagugauaauuucu

SEQ ID NO: 2771678 - RNA, 15 nt, Human
aaauaaauguaucau

SEQ ID NO: 2771679 - RNA, 16 nt, Human
aaauaaauguaucaua

SEQ ID NO: 2771680 - RNA, 21 nt, Human
aaauaaauguaucauagaaau

SEQ ID NO: 2771681 - RNA, 12 nt, Human
aaauaaauuagu

SEQ ID NO: 2771682 - RNA, 17 nt, Human
aaauaaauuaguuguua

SEQ ID NO: 2771683 - RNA, 14 nt, Human
aaauaaauuuauau

SEQ ID NO: 2771684 - RNA, 17 nt, Human
acagaacuugaaugugu

SEQ ID NO: 2771685 - RNA, 20 nt, Human
acagaacuugaaugugucag

SEQ ID NO: 2771686 - RNA, 19 nt, Human
acagaacuugaauguguca

SEQ ID NO: 2771687 - RNA, 13 nt, Human
acagaagcuucag

SEQ ID NO: 2771688 - RNA, 14 nt, Human
acagaagcuucaga

SEQ ID NO: 2771689 - RNA, 18 nt, Human
acagaagcuucagaaguu

SEQ ID NO: 2771690 - RNA, 19 nt, Human
acagaagcuucagaaguuu

SEQ ID NO: 2771691 - RNA, 14 nt, Human
acagacaacagaag

SEQ ID NO: 2771692 - RNA, 16 nt, Human
acagaagucaugaagc

SEQ ID NO: 2771693 - RNA, 12 nt, Human
acagacacacac

SEQ ID NO: 2771694 - RNA, 13 nt, Human
acagacacacaca

SEQ ID NO: 2771695 - RNA, 14 nt, Human
acagacacacacac

SEQ ID NO: 2771696 - RNA, 11 nt, Human
acagacacaca

SEQ ID NO: 2771697 - RNA, 15 nt, Human
acagacacacacacg

SEQ ID NO: 2771698 - RNA, 23 nt, Human
acagaggccaugggccuccugug

SEQ ID NO: 2771699 - RNA, 21 nt, Human
acagaggccaugggccuccug

SEQ ID NO: 2771700 - RNA, 17 nt, Human
acagaggccaugggccu

SEQ ID NO: 2771701 - RNA, 23 nt, Human
acagaggcagccccauucugccu

SEQ ID NO: 2771702 - RNA, 17 nt, Human
acagaggccauggcaga

SEQ ID NO: 2771703 - RNA, 20 nt, Human
acagaggaugagcucuaccc

SEQ ID NO: 2771704 - RNA, 13 nt, Human
acagaggcagccc

SEQ ID NO: 2771705 - RNA, 16 nt, Human
acagaggaugagcucu

SEQ ID NO: 2771706 - RNA, 23 nt, Human
acagacacacacacgcacgcaca

SEQ ID NO: 2771707 - RNA, 16 nt, Human
acagacacacacacgc

SEQ ID NO: 2771708 - RNA, 17 nt, Human
acagacacacacacgca

SEQ ID NO: 2771709 - RNA, 18 nt, Human
acagacacacacacgcac

SEQ ID NO: 2771710 - RNA, 22 nt, Human
acagacacacacacgcacgcac

SEQ ID NO: 2771711 - RNA, 21 nt, Human
acagaggaauuuauaccucaa

SEQ ID NO: 2771712 - RNA, 19 nt, Human
acacuguggaacuaauaaa

SEQ ID NO: 2771713 - RNA, 20 nt, Human
acacuguggaacuaauaaau

SEQ ID NO: 2771714 - RNA, 23 nt, Human
acacuguggaacuaauaaauaca

SEQ ID NO: 2771715 - RNA, 17 nt, Human
acacuguggguguguga

SEQ ID NO: 2771716 - RNA, 19 nt, Human
acacugugggugugugacu

SEQ ID NO: 2771717 - RNA, 17 nt, Human
acagaacaucauuagaa

SEQ ID NO: 2771718 - RNA, 17 nt, Human
acagaaccccuacauga

SEQ ID NO: 2771719 - RNA, 13 nt, Human
acagaacuaaaug

SEQ ID NO: 2771720 - RNA, 14 nt, Human
acagaacuaaaugu

SEQ ID NO: 2771721 - RNA, 15 nt, Human
acagaacuaaauguu

SEQ ID NO: 2771722 - RNA, 16 nt, Human
acagaacuaaauguuc

SEQ ID NO: 2771723 - RNA, 17 nt, Human
acagaacuaaauguucu

SEQ ID NO: 2771724 - RNA, 18 nt, Human
acagaacuaaauguucua

SEQ ID NO: 2771725 - RNA, 22 nt, Human
acacugggaggccgaggcaggg

SEQ ID NO: 2771726 - RNA, 14 nt, Human
acacugggaaacag

SEQ ID NO: 2771727 - RNA, 13 nt, Human
acaauuuuuaaug

SEQ ID NO: 2771728 - RNA, 14 nt, Human
acaauuuuuaaugg

SEQ ID NO: 2771729 - RNA, 15 nt, Human
acaauuuuuaauggc

SEQ ID NO: 2771730 - RNA, 21 nt, Human
acaauuguuugggguugaaaa

SEQ ID NO: 2771731 - RNA, 16 nt, Human
acaauuguuuuaaucu

SEQ ID NO: 2771732 - RNA, 18 nt, Human
acaauuguuuuaaucuga

SEQ ID NO: 2771733 - RNA, 20 nt, Human
acaauuguuuuaaucugaaa

SEQ ID NO: 2771734 - RNA, 22 nt, Human
acaauuguuuuaaucugaaauu

SEQ ID NO: 2771735 - RNA, 23 nt, Human
acaauuguuuuaaucugaaauuc

SEQ ID NO: 2771736 - RNA, 17 nt, Human
acaauuauuuaaagcaa

SEQ ID NO: 2771737 - RNA, 16 nt, Human
acaaggauugcuacug

SEQ ID NO: 2771738 - RNA, 13 nt, Human
acaaggauugaaa

SEQ ID NO: 2771739 - RNA, 15 nt, Human
acaaggauugaaaau

SEQ ID NO: 2771740 - RNA, 16 nt, Human
acaaggauugaaaauu

SEQ ID NO: 2771741 - RNA, 17 nt, Human
acaaggauugaaaauuc

SEQ ID NO: 2771742 - RNA, 13 nt, Human
acacgaaucucac

SEQ ID NO: 2771743 - RNA, 22 nt, Human
acacgaccggggccagcaccac

SEQ ID NO: 2771744 - RNA, 19 nt, Human
acacgguuugaagccugga

SEQ ID NO: 2771745 - RNA, 22 nt, Human
acacgguuugaagccuggaaca

SEQ ID NO: 2771746 - RNA, 23 nt, Human
acacgggggcagcugauacaaau

SEQ ID NO: 2771747 - RNA, 16 nt, Human
acacgggggcagcuga

SEQ ID NO: 2771748 - RNA, 21 nt, Human
acacagcucuucuccaggcug

SEQ ID NO: 2771749 - RNA, 20 nt, Human
acacagcucuucuccaggcu

SEQ ID NO: 2771750 - RNA, 19 nt, Human
acacaaaaguuucucuuuu

SEQ ID NO: 2771751 - RNA, 19 nt, Human
acacagcucuucuccaggc

SEQ ID NO: 2771752 - RNA, 16 nt, Human
acacaaaacuccgccc

SEQ ID NO: 2771753 - RNA, 19 nt, Human
acacaaaacuccgccccca

SEQ ID NO: 2771754 - RNA, 21 nt, Human
acacaaaacuccgcccccagc

SEQ ID NO: 2771755 - RNA, 22 nt, Human
acaaccuccauucuauuuuaga

SEQ ID NO: 2771756 - RNA, 15 nt, Human
acaaccucccucuug

SEQ ID NO: 2771757 - RNA, 16 nt, Human
acaaccucccucuugu

SEQ ID NO: 2771758 - RNA, 17 nt, Human
acaaccucccucuuguu

SEQ ID NO: 2771759 - RNA, 18 nt, Human
acaaccucccucuuguuu

SEQ ID NO: 2771760 - RNA, 20 nt, Human
acaaccucccucuuguuuug

SEQ ID NO: 2771761 - RNA, 21 nt, Human
acaaccucccucuuguuuugu

SEQ ID NO: 2771762 - RNA, 22 nt, Human
acaaccucccucuuguuuuguu

SEQ ID NO: 2771763 - RNA, 23 nt, Human
acaaccucccucuuguuuuguuu

SEQ ID NO: 2771764 - RNA, 22 nt, Human
acaaacuuuaggguaaaaauug

SEQ ID NO: 2771765 - RNA, 10 nt, Human
acaaaaugga

SEQ ID NO: 2771766 - RNA, 12 nt, Human
acaaagaaauau

SEQ ID NO: 2771767 - RNA, 13 nt, Human
acaaacuuuuaua

SEQ ID NO: 2771768 - RNA, 18 nt, Human
acaaacuuuucaaggcuu

SEQ ID NO: 2771769 - RNA, 20 nt, Human
aauuuuggucauagcauuca

SEQ ID NO: 2771770 - RNA, 15 nt, Human
aauuuugcaaauaua

SEQ ID NO: 2771771 - RNA, 16 nt, Human
aauuuugcaaauauaa

SEQ ID NO: 2771772 - RNA, 18 nt, Human
aauuuugcaaauauaaac

SEQ ID NO: 2771773 - RNA, 19 nt, Human
aauuuugcaaauauaaaca

SEQ ID NO: 2771774 - RNA, 20 nt, Human
aauuuugcaaauauaaacau

SEQ ID NO: 2771775 - RNA, 21 nt, Human
aauuuugcaaauauaaacauc

SEQ ID NO: 2771776 - RNA, 12 nt, Human
aauuuugcaaug

SEQ ID NO: 2771777 - RNA, 20 nt, Human
aauuuugcuggaauuccuaa

SEQ ID NO: 2771778 - RNA, 22 nt, Human
aauuuugcuggaauuccuaacu

SEQ ID NO: 2771779 - RNA, 16 nt, Human
aauuuugcuuuuaauu

SEQ ID NO: 2771780 - RNA, 17 nt, Human
aauuuugcuuuuaauua

SEQ ID NO: 2771781 - RNA, 18 nt, Human
aauuuugcuuuuaauuaa

SEQ ID NO: 2771782 - RNA, 18 nt, Human
aauuuuggaagauuuuca

SEQ ID NO: 2771783 - RNA, 13 nt, Human
aauuuuauuuugu

SEQ ID NO: 2771784 - RNA, 20 nt, Human
aauuuuauuuugugcucauu

SEQ ID NO: 2771785 - RNA, 23 nt, Human
aauuuuauuuugugcucauuuaa

SEQ ID NO: 2771786 - RNA, 12 nt, Human
aauuuuauuccu

SEQ ID NO: 2771787 - RNA, 19 nt, Human
aaugucacaggcaggucca

SEQ ID NO: 2771788 - RNA, 16 nt, Human
aaugucacaggcaggu

SEQ ID NO: 2771789 - RNA, 13 nt, Human
aauuggguucaug

SEQ ID NO: 2771790 - RNA, 15 nt, Human
aauuggguucaugau

SEQ ID NO: 2771791 - RNA, 16 nt, Human
aauuggguucaugaug

SEQ ID NO: 2771792 - RNA, 19 nt, Human
aauuggguucaugaugcag

SEQ ID NO: 2771793 - RNA, 20 nt, Human
aauuggguucaugaugcagu

SEQ ID NO: 2771794 - RNA, 15 nt, Human
aauugguucuuuauu

SEQ ID NO: 2771795 - RNA, 16 nt, Human
aauuguauuuuaguaa

SEQ ID NO: 2771796 - RNA, 16 nt, Human
aauuuauuauugaaau

SEQ ID NO: 2771797 - RNA, 17 nt, Human
aauuuauuauugaaauu

SEQ ID NO: 2771798 - RNA, 18 nt, Human
aauuuauuauugaaauug

SEQ ID NO: 2771799 - RNA, 18 nt, Human
aauuuauugcacauuguu

SEQ ID NO: 2771800 - RNA, 19 nt, Human
aauuuauugcacauuguuc

SEQ ID NO: 2771801 - RNA, 20 nt, Human
aauuuauugcacauuguuca

SEQ ID NO: 2771802 - RNA, 20 nt, Human
aauuuauuuauacuauuuag

SEQ ID NO: 2771803 - RNA, 17 nt, Human
aauuuauuuauacuauu

SEQ ID NO: 2771804 - RNA, 22 nt, Human
aauuguguacucggaaauuaaa

SEQ ID NO: 2771805 - RNA, 18 nt, Human
aauugugggcauaaacug

SEQ ID NO: 2771806 - RNA, 20 nt, Human
aauugugggcauaaacuguu

SEQ ID NO: 2771807 - RNA, 23 nt, Human
aauugugggcauaaacuguuuca

SEQ ID NO: 2771808 - RNA, 20 nt, Human
aauugugccgagaaaagcau

SEQ ID NO: 2771809 - RNA, 12 nt, Human
aauugugcugcc

SEQ ID NO: 2771810 - RNA, 13 nt, Human
aauugugcugcca

SEQ ID NO: 2771811 - RNA, 14 nt, Human
aauugugcugccau

SEQ ID NO: 2771812 - RNA, 15 nt, Human
aauugugcugccauu

SEQ ID NO: 2771813 - RNA, 16 nt, Human
aauugugcugccauuu

SEQ ID NO: 2771814 - RNA, 19 nt, Human
aauugugcugccauuugau

SEQ ID NO: 2771815 - RNA, 12 nt, Human
aauugugcuucu

SEQ ID NO: 2771816 - RNA, 13 nt, Human
aauugugcuucuc

SEQ ID NO: 2771817 - RNA, 17 nt, Human
aauugugcuucucccca

SEQ ID NO: 2771818 - RNA, 20 nt, Human
aauugugcuucuccccagaa

SEQ ID NO: 2771819 - RNA, 21 nt, Human
aauugugcuucuccccagaau

SEQ ID NO: 2771820 - RNA, 18 nt, Human
aauugucagcaauuuaac

SEQ ID NO: 2771821 - RNA, 11 nt, Human
aauugucaugg

SEQ ID NO: 2771822 - RNA, 23 nt, Human
aauugucaugguuacaaacuaca

SEQ ID NO: 2771823 - RNA, 16 nt, Human
aauugucuucauguac

SEQ ID NO: 2771824 - RNA, 17 nt, Human
aauugucuucauguaca

SEQ ID NO: 2771825 - RNA, 17 nt, Human
aauuguccguguucaua

SEQ ID NO: 2771826 - RNA, 18 nt, Human
aauugucgaaaagagucu

SEQ ID NO: 2771827 - RNA, 23 nt, Human
aauugucgaaaagagucuuccaa

SEQ ID NO: 2771828 - RNA, 12 nt, Human
aauugucuauuu

SEQ ID NO: 2771829 - RNA, 13 nt, Human
aauugucuauuua

SEQ ID NO: 2771830 - RNA, 14 nt, Human
aauugucuauuuau

SEQ ID NO: 2771831 - RNA, 17 nt, Human
aauugucuauuuaucuu

SEQ ID NO: 2771832 - RNA, 18 nt, Human
aauugucuauuuaucuuu

SEQ ID NO: 2771833 - RNA, 21 nt, Human
aauugucuauuuaucuuuuau

SEQ ID NO: 2771834 - RNA, 20 nt, Human
aauugucuuuugucaugugg

SEQ ID NO: 2771835 - RNA, 18 nt, Human
aauugucuuuaauuucug

SEQ ID NO: 2771836 - RNA, 19 nt, Human
aauugucuuuaauuucugu

SEQ ID NO: 2771837 - RNA, 15 nt, Human
aauugugaacucauu

SEQ ID NO: 2771838 - RNA, 22 nt, Human
aauuucagguuuuguaaagaug

SEQ ID NO: 2771839 - RNA, 20 nt, Human
aauuucagguuuuguaaaga

SEQ ID NO: 2771840 - RNA, 18 nt, Human
aauuucaagguucuaacc

SEQ ID NO: 2771841 - RNA, 19 nt, Human
aauuucaggcuccccagau

SEQ ID NO: 2771842 - RNA, 16 nt, Human
aauuucacuuauaccu

SEQ ID NO: 2771843 - RNA, 12 nt, Human
aauuucaaaaug

SEQ ID NO: 2771844 - RNA, 19 nt, Human
aauuucaaaaauauaacuu

SEQ ID NO: 2771845 - RNA, 15 nt, Human
aauuucaaaagacau

SEQ ID NO: 2771846 - RNA, 17 nt, Human
aauuucaaaagacaugu

SEQ ID NO: 2771847 - RNA, 20 nt, Human
aauuucaaaagacauguugu

SEQ ID NO: 2771848 - RNA, 15 nt, Human
aauuucaaaaauaua

SEQ ID NO: 2771849 - RNA, 16 nt, Human
aauuucaaaaauauaa

SEQ ID NO: 2771850 - RNA, 17 nt, Human
aauuucaaaaauauaac

SEQ ID NO: 2771851 - RNA, 14 nt, Human
aauuucacauuaau

SEQ ID NO: 2771852 - RNA, 21 nt, Human
aauuucaccaccaaaugccaa

SEQ ID NO: 2771853 - RNA, 14 nt, Human
aauuucaagguucu

SEQ ID NO: 2771854 - RNA, 15 nt, Human
aauuucaagguucua

SEQ ID NO: 2771855 - RNA, 16 nt, Human
aauuucaagguucuaa

SEQ ID NO: 2771856 - RNA, 17 nt, Human
aauuucaagguucuaac

SEQ ID NO: 2771857 - RNA, 16 nt, Human
aauuucaaaaugcuuu

SEQ ID NO: 2771858 - RNA, 17 nt, Human
aauuucagguuguuggu

SEQ ID NO: 2771859 - RNA, 23 nt, Human
aauuucaguccuguaguuuuauu

SEQ ID NO: 2771860 - RNA, 20 nt, Human
aauuuccuguuggauuuguu

SEQ ID NO: 2771861 - RNA, 21 nt, Human
aauuuccuguuggauuuguuu

SEQ ID NO: 2771862 - RNA, 16 nt, Human
aauuuccuuuauauuu

SEQ ID NO: 2771863 - RNA, 14 nt, Human
aauuucgagauuug

SEQ ID NO: 2771864 - RNA, 21 nt, Human
aauuucgccguugaagaggaa

SEQ ID NO: 2771865 - RNA, 18 nt, Human
aauuucgccguugaagag

SEQ ID NO: 2771866 - RNA, 21 nt, Human
aauuuccuuuauauuuaguga

SEQ ID NO: 2771867 - RNA, 14 nt, Human
acagugcagggcaa

SEQ ID NO: 2771868 - RNA, 19 nt, Human
acagugcagggcaaaauau

SEQ ID NO: 2771869 - RNA, 13 nt, Human
acagugcacauga

SEQ ID NO: 2771870 - RNA, 14 nt, Human
acagugcacaugaa

SEQ ID NO: 2771871 - RNA, 15 nt, Human
acagugcacaugaac

SEQ ID NO: 2771872 - RNA, 23 nt, Human
acagugagucgaggacagggagg

SEQ ID NO: 2771873 - RNA, 24 nt, Human
acagugucccccagguuccgaaga

SEQ ID NO: 2771874 - RNA, 16 nt, Human
acagugucccccaggu

SEQ ID NO: 2771875 - RNA, 15 nt, Human
acagugucccccagg

SEQ ID NO: 2771876 - RNA, 18 nt, Human
acaguguauauugaaauu

SEQ ID NO: 2771877 - RNA, 23 nt, Human
acaggugugagucaccaagccca

SEQ ID NO: 2771878 - RNA, 22 nt, Human
acaggugggcuucccaguggcu

SEQ ID NO: 2771879 - RNA, 15 nt, Human
acagguggugucacu

SEQ ID NO: 2771880 - RNA, 17 nt, Human
acagguggugucacugu

SEQ ID NO: 2771881 - RNA, 18 nt, Human
acagguggugucacuguc

SEQ ID NO: 2771882 - RNA, 19 nt, Human
acagguggugucacugucc

SEQ ID NO: 2771883 - RNA, 20 nt, Human
acagguggugucacuguccc

SEQ ID NO: 2771884 - RNA, 22 nt, Human
acagguggugucacugucccuc

SEQ ID NO: 2771885 - RNA, 23 nt, Human
acagguggugucacugucccucc

SEQ ID NO: 2771886 - RNA, 20 nt, Human
acaggugggcuucccagugg

SEQ ID NO: 2771887 - RNA, 13 nt, Human
acaggugugcacc

SEQ ID NO: 2771888 - RNA, 16 nt, Human
acaggugugguguaau

SEQ ID NO: 2771889 - RNA, 17 nt, Human
acaggugugguguaauu

SEQ ID NO: 2771890 - RNA, 18 nt, Human
acaggugugguguaauuu

SEQ ID NO: 2771891 - RNA, 21 nt, Human
acaggugugguguaauuuaua

SEQ ID NO: 2771892 - RNA, 17 nt, Human
acagguguuggugacaa

SEQ ID NO: 2771893 - RNA, 22 nt, Human
acaggugugagucaccaagccc

SEQ ID NO: 2771894 - RNA, 19 nt, Human
acaggugugaaccaccaca

SEQ ID NO: 2771895 - RNA, 22 nt, Human
acagugagucgaggacagggag

SEQ ID NO: 2771896 - RNA, 18 nt, Human
acagugagggagauccca

SEQ ID NO: 2771897 - RNA, 14 nt, Human
acagguguuuauac

SEQ ID NO: 2771898 - RNA, 17 nt, Human
acagugagccugaauuu

SEQ ID NO: 2771899 - RNA, 21 nt, Human
acagugagccugaauuuuguu

SEQ ID NO: 2771900 - RNA, 18 nt, Human
acagugagccugaauuuu

SEQ ID NO: 2771901 - RNA, 19 nt, Human
acaggcaagcaccuccugc

SEQ ID NO: 2771902 - RNA, 18 nt, Human
acagggccaguggggccu

SEQ ID NO: 2771903 - RNA, 19 nt, Human
acagggccaguggggccug

SEQ ID NO: 2771904 - RNA, 20 nt, Human
acagggccaguggggccugu

SEQ ID NO: 2771905 - RNA, 21 nt, Human
acagggccaguggggccugug

SEQ ID NO: 2771906 - RNA, 23 nt, Human
acagggccaguggggccugugga

SEQ ID NO: 2771907 - RNA, 14 nt, Human
acaggcaaugcugg

SEQ ID NO: 2771908 - RNA, 16 nt, Human
acaggucuucaucgaa

SEQ ID NO: 2771909 - RNA, 18 nt, Human
acagguggacacacaagg

SEQ ID NO: 2771910 - RNA, 16 nt, Human
acagguggacacacaa

SEQ ID NO: 2771911 - RNA, 21 nt, Human
acagggcugauaagcuaacac

SEQ ID NO: 2771912 - RNA, 14 nt, Human
acagcucuguccug

SEQ ID NO: 2771913 - RNA, 23 nt, Human
acagcuccuucuguccuacucug

SEQ ID NO: 2771914 - RNA, 18 nt, Human
acagcuccuucuguccua

SEQ ID NO: 2771915 - RNA, 16 nt, Human
acagcuccuucugucc

SEQ ID NO: 2771916 - RNA, 15 nt, Human
acagcuccuucuguc

SEQ ID NO: 2771917 - RNA, 17 nt, Human
acagcucuguccuggga

SEQ ID NO: 2771918 - RNA, 16 nt, Human
acagcucuguccuggg

SEQ ID NO: 2771919 - RNA, 13 nt, Human
acagcucuguccu

SEQ ID NO: 2771920 - RNA, 19 nt, Human
acagcugaguuaugaugua

SEQ ID NO: 2771921 - RNA, 16 nt, Human
acagcugauacuucau

SEQ ID NO: 2771922 - RNA, 23 nt, Human
acaggcaagcaccuccugccucg

SEQ ID NO: 2771923 - RNA, 20 nt, Human
acaggcaagcaccuccugcc

SEQ ID NO: 2771924 - RNA, 16 nt, Human
acagcugcauuagaaa

SEQ ID NO: 2771925 - RNA, 20 nt, Human
acagcugcauuagaaaaaga

SEQ ID NO: 2771926 - RNA, 12 nt, Human
acagcugccugc

SEQ ID NO: 2771927 - RNA, 16 nt, Human
acagcugccugcagua

SEQ ID NO: 2771928 - RNA, 11 nt, Human
acaucaguucc

SEQ ID NO: 2771929 - RNA, 16 nt, Human
acauccgccuuuugua

SEQ ID NO: 2771930 - RNA, 18 nt, Human
acauccgccuuuuguaua

SEQ ID NO: 2771931 - RNA, 20 nt, Human
acauccgccuuuuguauaca

SEQ ID NO: 2771932 - RNA, 19 nt, Human
acaucaucaaggcacugcc

SEQ ID NO: 2771933 - RNA, 20 nt, Human
acaucaucaaggcacugccu

SEQ ID NO: 2771934 - RNA, 14 nt, Human
acaucaugaauuua

SEQ ID NO: 2771935 - RNA, 15 nt, Human
acaucaugaauuuua

SEQ ID NO: 2771936 - RNA, 17 nt, Human
acaucaugaauuuuaca

SEQ ID NO: 2771937 - RNA, 21 nt, Human
acaugauuuccuugaaugugg

SEQ ID NO: 2771938 - RNA, 18 nt, Human
acauccugccagccccac

SEQ ID NO: 2771939 - RNA, 12 nt, Human
acauccugggua

SEQ ID NO: 2771940 - RNA, 13 nt, Human
acauccuggguaa

SEQ ID NO: 2771941 - RNA, 16 nt, Human
acauccuguauaagca

SEQ ID NO: 2771942 - RNA, 17 nt, Human
acauccuguauaagcac

SEQ ID NO: 2771943 - RNA, 19 nt, Human
acauccuguauaagcacug

SEQ ID NO: 2771944 - RNA, 17 nt, Human
acauccuccguccagcc

SEQ ID NO: 2771945 - RNA, 14 nt, Human
acauccuccgucca

SEQ ID NO: 2771946 - RNA, 15 nt, Human
acauccuacaagaca

SEQ ID NO: 2771947 - RNA, 23 nt, Human
acaugauuuccuugaauguggcu

SEQ ID NO: 2771948 - RNA, 14 nt, Human
acaugcaaaaagaa

SEQ ID NO: 2771949 - RNA, 15 nt, Human
acaugcaaaaagaaa

SEQ ID NO: 2771950 - RNA, 18 nt, Human
acaugcaaaaagaaauga

SEQ ID NO: 2771951 - RNA, 21 nt, Human
acaugcaaaaagaaaugacua

SEQ ID NO: 2771952 - RNA, 23 nt, Human
acaugcaaaaagaaaugacuaau

SEQ ID NO: 2771953 - RNA, 15 nt, Human
acaugcaacccgaag

SEQ ID NO: 2771954 - RNA, 18 nt, Human
acaugccaagcacugugc

SEQ ID NO: 2771955 - RNA, 14 nt, Human
acaugccaagcacu

SEQ ID NO: 2771956 - RNA, 20 nt, Human
acaugcaaggcacuguacua

SEQ ID NO: 2771957 - RNA, 15 nt, Human
acaugcaaggcacug

SEQ ID NO: 2771958 - RNA, 17 nt, Human
acaugauuuccuugaau

SEQ ID NO: 2771959 - RNA, 19 nt, Human
acauaauuaaauuuugagu

SEQ ID NO: 2771960 - RNA, 15 nt, Human
acauaaguaauucaa

SEQ ID NO: 2771961 - RNA, 22 nt, Human
acauaagcggcguaaguuuaaa

SEQ ID NO: 2771962 - RNA, 14 nt, Human
acauaagaucacug

SEQ ID NO: 2771963 - RNA, 17 nt, Human
acauaagaucacugcca

SEQ ID NO: 2771964 - RNA, 23 nt, Human
acauaagaucacugccagagaua

SEQ ID NO: 2771965 - RNA, 19 nt, Human
acauaagggguuugccauu

SEQ ID NO: 2771966 - RNA, 20 nt, Human
acauaagggguuugccauuu

SEQ ID NO: 2771967 - RNA, 21 nt, Human
acauaagggguuugccauuug

SEQ ID NO: 2771968 - RNA, 12 nt, Human
acauaauuuuuu

SEQ ID NO: 2771969 - RNA, 18 nt, Human
acauaauuuuuuauucaa

SEQ ID NO: 2771970 - RNA, 20 nt, Human
acauaauucaggaagcagcu

SEQ ID NO: 2771971 - RNA, 22 nt, Human
acaucagcuggucaaacaaacu

SEQ ID NO: 2771972 - RNA, 15 nt, Human
acaucagccagcugc

SEQ ID NO: 2771973 - RNA, 16 nt, Human
acaucagccagcugcc

SEQ ID NO: 2771974 - RNA, 14 nt, Human
acaucaggaguuca

SEQ ID NO: 2771975 - RNA, 14 nt, Human
accaagaucuauaa

SEQ ID NO: 2771976 - RNA, 20 nt, Human
accaagaucuauaaagcgau

SEQ ID NO: 2771977 - RNA, 14 nt, Human
accaagacaaauuc

SEQ ID NO: 2771978 - RNA, 15 nt, Human
accaagagauugcua

SEQ ID NO: 2771979 - RNA, 16 nt, Human
accaagagauugcuaa

SEQ ID NO: 2771980 - RNA, 17 nt, Human
accaagagauugcuaau

SEQ ID NO: 2771981 - RNA, 18 nt, Human
accaagagauugcuaauu

SEQ ID NO: 2771982 - RNA, 21 nt, Human
accaagagauugcuaauugcu

SEQ ID NO: 2771983 - RNA, 22 nt, Human
accaagagauugcuaauugcug

SEQ ID NO: 2771984 - RNA, 13 nt, Human
acauuucuaaaau

SEQ ID NO: 2771985 - RNA, 22 nt, Human
acauuuaugauuuaauaaaaua

SEQ ID NO: 2771986 - RNA, 19 nt, Human
acauuuaugauuuaauaaa

SEQ ID NO: 2771987 - RNA, 20 nt, Human
acauuuaugauuuaauaaaa

SEQ ID NO: 2771988 - RNA, 15 nt, Human
acauuucuguaaaua

SEQ ID NO: 2771989 - RNA, 18 nt, Human
acauuucuguaaauacca

SEQ ID NO: 2771990 - RNA, 19 nt, Human
accaacuuucuguaaacuc

SEQ ID NO: 2771991 - RNA, 18 nt, Human
accaacuuucuguaaacu

SEQ ID NO: 2771992 - RNA, 14 nt, Human
accaagaaagcagg

SEQ ID NO: 2771993 - RNA, 20 nt, Human
accaccccggcccccugccc

SEQ ID NO: 2771994 - RNA, 18 nt, Human
accaccccggcccccugc

SEQ ID NO: 2771995 - RNA, 22 nt, Human
accaccccgccugcccucaugg

SEQ ID NO: 2771996 - RNA, 21 nt, Human
accacccuagucccuuccccu

SEQ ID NO: 2771997 - RNA, 20 nt, Human
accacccuagucccuucccc

SEQ ID NO: 2771998 - RNA, 12 nt, Human
accaccucugug

SEQ ID NO: 2771999 - RNA, 13 nt, Human
accaccucugugg

SEQ ID NO: 2772000 - RNA, 14 nt, Human
accaccucuguggc

SEQ ID NO: 2772001 - RNA, 15 nt, Human
accaccucuguggca

SEQ ID NO: 2772002 - RNA, 12 nt, Human
accaccugccca

SEQ ID NO: 2772003 - RNA, 17 nt, Human
accaccuuuuauuacau

SEQ ID NO: 2772004 - RNA, 21 nt, Human
accacgaaagcacacacaaaa

SEQ ID NO: 2772005 - RNA, 17 nt, Human
accagccccagugccca

SEQ ID NO: 2772006 - RNA, 16 nt, Human
accagccccagugccc

SEQ ID NO: 2772007 - RNA, 17 nt, Human
accagccccacugccag

SEQ ID NO: 2772008 - RNA, 16 nt, Human
accagccccacugcca

SEQ ID NO: 2772009 - RNA, 19 nt, Human
accagccccagugcccaca

SEQ ID NO: 2772010 - RNA, 18 nt, Human
accagccccagugcccac

SEQ ID NO: 2772011 - RNA, 20 nt, Human
accagccccagugcccacag

SEQ ID NO: 2772012 - RNA, 22 nt, Human
accagccccacugccagcagca

SEQ ID NO: 2772013 - RNA, 21 nt, Human
accagccccacugccagcagc

SEQ ID NO: 2772014 - RNA, 20 nt, Human
accagccccacugccagcag

SEQ ID NO: 2772015 - RNA, 18 nt, Human
accagccccacugccagc

SEQ ID NO: 2772016 - RNA, 23 nt, Human
accagccccacugccagcagcag

SEQ ID NO: 2772017 - RNA, 11 nt, Human
accagcccugg

SEQ ID NO: 2772018 - RNA, 12 nt, Human
accagcccuggg

SEQ ID NO: 2772019 - RNA, 15 nt, Human
accagcccuggggcu

SEQ ID NO: 2772020 - RNA, 22 nt, Human
acaugccuauaugagaagaaua

SEQ ID NO: 2772021 - RNA, 12 nt, Human
acaugugaaacc

SEQ ID NO: 2772022 - RNA, 14 nt, Human
acaugugacacaua

SEQ ID NO: 2772023 - RNA, 23 nt, Human
acaugugaaaccuuuuuuaagau

SEQ ID NO: 2772024 - RNA, 12 nt, Human
acaugugacaca

SEQ ID NO: 2772025 - RNA, 20 nt, Human
acaugugaaaccuuuuuuaa

SEQ ID NO: 2772026 - RNA, 21 nt, Human
acaugugaaaccuuuuuuaag

SEQ ID NO: 2772027 - RNA, 13 nt, Human
acaugugaaaccu

SEQ ID NO: 2772028 - RNA, 14 nt, Human
acaugugaaaccuu

SEQ ID NO: 2772029 - RNA, 15 nt, Human
acaugugaaaccuuu

SEQ ID NO: 2772030 - RNA, 17 nt, Human
acaugugaaaccuuuuu

SEQ ID NO: 2772031 - RNA, 17 nt, Human
acauuuagucucuuuau

SEQ ID NO: 2772032 - RNA, 21 nt, Human
acauuuagagaacuguggccg

SEQ ID NO: 2772033 - RNA, 13 nt, Human
acauuuagauccu

SEQ ID NO: 2772034 - RNA, 23 nt, Human
acauuuagauccugguuucauaa

SEQ ID NO: 2772035 - RNA, 12 nt, Human
acauuuauaauu

SEQ ID NO: 2772036 - RNA, 13 nt, Human
acauuuauaauug

SEQ ID NO: 2772037 - RNA, 14 nt, Human
acauuuauaauugc

SEQ ID NO: 2772038 - RNA, 18 nt, Human
acauuuaugaguaacuau

SEQ ID NO: 2772039 - RNA, 14 nt, Human
acauuuaugauuua

SEQ ID NO: 2772040 - RNA, 15 nt, Human
acauuuaugauuuaa

SEQ ID NO: 2772041 - RNA, 17 nt, Human
acauuuaugauuuaaua

SEQ ID NO: 2772042 - RNA, 16 nt, Human
acauuuacauguauua

SEQ ID NO: 2772043 - RNA, 21 nt, Human
acauuuacauguauuauuuca

SEQ ID NO: 2772044 - RNA, 14 nt, Human
acauuuaccagcaa

SEQ ID NO: 2772045 - RNA, 21 nt, Human
acauuuacuacaguuuuuaac

SEQ ID NO: 2772046 - RNA, 14 nt, Human
acauuuacauguau

SEQ ID NO: 2772047 - RNA, 12 nt, Human
acauuuacaguc

SEQ ID NO: 2772048 - RNA, 21 nt, Human
acauuuacaguccuucaaaau

SEQ ID NO: 2772049 - RNA, 16 nt, Human
acccaccccaccugca

SEQ ID NO: 2772050 - RNA, 17 nt, Human
acccaccccaccugcag

SEQ ID NO: 2772051 - RNA, 23 nt, Human
acccaccccaccugcagggcugc

SEQ ID NO: 2772052 - RNA, 15 nt, Human
acccacaugugacac

SEQ ID NO: 2772053 - RNA, 16 nt, Human
acccacaugugacaca

SEQ ID NO: 2772054 - RNA, 18 nt, Human
acccacauguaaaugaua

SEQ ID NO: 2772055 - RNA, 15 nt, Human
accaugaaacaaagc

SEQ ID NO: 2772056 - RNA, 14 nt, Human
accaugaaacaaag

SEQ ID NO: 2772057 - RNA, 14 nt, Human
accaugaagacagg

SEQ ID NO: 2772058 - RNA, 15 nt, Human
accaugaagacagga

SEQ ID NO: 2772059 - RNA, 18 nt, Human
accaugaacagaaaacau

SEQ ID NO: 2772060 - RNA, 23 nt, Human
accaugaacagaaaacauucuga

SEQ ID NO: 2772061 - RNA, 15 nt, Human
acccacccuccuuuc

SEQ ID NO: 2772062 - RNA, 14 nt, Human
acccauaggcccac

SEQ ID NO: 2772063 - RNA, 15 nt, Human
acccauaggcccaca

SEQ ID NO: 2772064 - RNA, 17 nt, Human
acccauaggcccacaca

SEQ ID NO: 2772065 - RNA, 18 nt, Human
acccauaggcccacacac

SEQ ID NO: 2772066 - RNA, 19 nt, Human
acccauaggcccacacaca

SEQ ID NO: 2772067 - RNA, 20 nt, Human
acccauaggcccacacacag

SEQ ID NO: 2772068 - RNA, 21 nt, Human
acccauaggcccacacacagg

SEQ ID NO: 2772069 - RNA, 22 nt, Human
acccauaggcccacacacaggu

SEQ ID NO: 2772070 - RNA, 14 nt, Human
acccauacaccccc

SEQ ID NO: 2772071 - RNA, 17 nt, Human
acccauagaucuucuga

SEQ ID NO: 2772072 - RNA, 18 nt, Human
acccauagaucuucugaa

SEQ ID NO: 2772073 - RNA, 21 nt, Human
acccauagaucuucugaaaug

SEQ ID NO: 2772074 - RNA, 22 nt, Human
acccauagaucuucugaaauga

SEQ ID NO: 2772075 - RNA, 16 nt, Human
acccauaauccuuucu

SEQ ID NO: 2772076 - RNA, 17 nt, Human
acccauaauccuuucug

SEQ ID NO: 2772077 - RNA, 20 nt, Human
acccaugaugagcuccucuu

SEQ ID NO: 2772078 - RNA, 18 nt, Human
acccaugaugagcuccuc

SEQ ID NO: 2772079 - RNA, 14 nt, Human
acccauauguuaaa

SEQ ID NO: 2772080 - RNA, 22 nt, Human
accauauugugcuucacaguag

SEQ ID NO: 2772081 - RNA, 13 nt, Human
accauauuuagca

SEQ ID NO: 2772082 - RNA, 15 nt, Human
accauauuuagcagu

SEQ ID NO: 2772083 - RNA, 20 nt, Human
accauauuuauccauuugua

SEQ ID NO: 2772084 - RNA, 21 nt, Human
accauauuuauccauuuguaa

SEQ ID NO: 2772085 - RNA, 17 nt, Human
accauacucauuucuaa

SEQ ID NO: 2772086 - RNA, 19 nt, Human
accauacucauuucuaaaa

SEQ ID NO: 2772087 - RNA, 17 nt, Human
accauaggucaccuuua

SEQ ID NO: 2772088 - RNA, 15 nt, Human
accauacugagggac

SEQ ID NO: 2772089 - RNA, 21 nt, Human
accauacuaauuauacccccu

SEQ ID NO: 2772090 - RNA, 16 nt, Human
accauacuaauuauac

SEQ ID NO: 2772091 - RNA, 13 nt, Human
accauacuaauua

SEQ ID NO: 2772092 - RNA, 23 nt, Human
accauccacucuacccucccacc

SEQ ID NO: 2772093 - RNA, 22 nt, Human
accauccacucuacccucccac

SEQ ID NO: 2772094 - RNA, 14 nt, Human
accaucugcuuuua

SEQ ID NO: 2772095 - RNA, 18 nt, Human
accaucugcuuuuauuaa

SEQ ID NO: 2772096 - RNA, 13 nt, Human
accaucuggccug

SEQ ID NO: 2772097 - RNA, 15 nt, Human
accaucuggccuggc

SEQ ID NO: 2772098 - RNA, 16 nt, Human
accaucuggccuggcc

SEQ ID NO: 2772099 - RNA, 17 nt, Human
accaucuggccuggccu

SEQ ID NO: 2772100 - RNA, 22 nt, Human
accaucuggccuggccuggccc

SEQ ID NO: 2772101 - RNA, 23 nt, Human
accaucuggccuggccuggcccu

SEQ ID NO: 2772102 - RNA, 14 nt, Human
accaucagggacag

SEQ ID NO: 2772103 - RNA, 15 nt, Human
accaucagggacagg

SEQ ID NO: 2772104 - RNA, 18 nt, Human
accaucacaauacagaua

SEQ ID NO: 2772105 - RNA, 15 nt, Human
acggaauaguuggcu

SEQ ID NO: 2772106 - RNA, 20 nt, Human
acggaauaagagaccuguuu

SEQ ID NO: 2772107 - RNA, 21 nt, Human
acggaagugguggcuguggaa

SEQ ID NO: 2772108 - RNA, 23 nt, Human
acgcugucccuaguaaaaauaca

SEQ ID NO: 2772109 - RNA, 20 nt, Human
acgcugucaaaaguuggacu

SEQ ID NO: 2772110 - RNA, 18 nt, Human
acgcuggagugcagugag

SEQ ID NO: 2772111 - RNA, 21 nt, Human
acgcagcaggaggccaggccg

SEQ ID NO: 2772112 - RNA, 19 nt, Human
acgcuggagugcagugagc

SEQ ID NO: 2772113 - RNA, 16 nt, Human
acgcacgcacacacac

SEQ ID NO: 2772114 - RNA, 17 nt, Human
acgcagaugauccauga

SEQ ID NO: 2772115 - RNA, 15 nt, Human
acgcagaugauccau

SEQ ID NO: 2772116 - RNA, 19 nt, Human
acgcagaugauccaugagu

SEQ ID NO: 2772117 - RNA, 14 nt, Human
acgcagcaggaggc

SEQ ID NO: 2772118 - RNA, 11 nt, Human
acgcacgcaca

SEQ ID NO: 2772119 - RNA, 13 nt, Human
acgcacgcacaca

SEQ ID NO: 2772120 - RNA, 14 nt, Human
acgcacgcacacac

SEQ ID NO: 2772121 - RNA, 15 nt, Human
acgcacgcacacaca

SEQ ID NO: 2772122 - RNA, 23 nt, Human
acgucugacaggcaaugcuggcu

SEQ ID NO: 2772123 - RNA, 13 nt, Human
acgucugucuuca

SEQ ID NO: 2772124 - RNA, 15 nt, Human
acgucugacaggcaa

SEQ ID NO: 2772125 - RNA, 14 nt, Human
acggagauguuuca

SEQ ID NO: 2772126 - RNA, 22 nt, Human
acguggagcgggguaugaagag

SEQ ID NO: 2772127 - RNA, 19 nt, Human
acgucugucuucacagcuc

SEQ ID NO: 2772128 - RNA, 15 nt, Human
acgucugucuucaca

SEQ ID NO: 2772129 - RNA, 14 nt, Human
acgucugucuucac

SEQ ID NO: 2772130 - RNA, 18 nt, Human
acguggcacuauauucug

SEQ ID NO: 2772131 - RNA, 13 nt, Human
acguggaggagca

SEQ ID NO: 2772132 - RNA, 17 nt, Human
acguggaggagcagugc

SEQ ID NO: 2772133 - RNA, 18 nt, Human
acguggaggagcagugca

SEQ ID NO: 2772134 - RNA, 22 nt, Human
acuaacucaccagccccacugc

SEQ ID NO: 2772135 - RNA, 18 nt, Human
acuaauauaaaaugagua

SEQ ID NO: 2772136 - RNA, 21 nt, Human
acuaacuccugagaaauguua

SEQ ID NO: 2772137 - RNA, 23 nt, Human
acuaacuuauuuauguuaaaaga

SEQ ID NO: 2772138 - RNA, 18 nt, Human
acuaacguugagccccug

SEQ ID NO: 2772139 - RNA, 20 nt, Human
acuaacuagacaccaaaguu

SEQ ID NO: 2772140 - RNA, 22 nt, Human
acuaacuagacaccaaaguucu

SEQ ID NO: 2772141 - RNA, 21 nt, Human
acguggcugcgugccccugcu

SEQ ID NO: 2772142 - RNA, 22 nt, Human
acguggcugcgugccccugcug

SEQ ID NO: 2772143 - RNA, 15 nt, Human
acuaaccuggguucc

SEQ ID NO: 2772144 - RNA, 12 nt, Human
accugugggugu

SEQ ID NO: 2772145 - RNA, 13 nt, Human
accugugggugua

SEQ ID NO: 2772146 - RNA, 13 nt, Human
accuguguacaua

SEQ ID NO: 2772147 - RNA, 16 nt, Human
accuguguacauaacu

SEQ ID NO: 2772148 - RNA, 14 nt, Human
accugugucugcga

SEQ ID NO: 2772149 - RNA, 20 nt, Human
accugugucugcgaaguccu

SEQ ID NO: 2772150 - RNA, 22 nt, Human
accugugucugcgaaguccuau

SEQ ID NO: 2772151 - RNA, 20 nt, Human
accugugugguacucugaaa

SEQ ID NO: 2772152 - RNA, 14 nt, Human
acuaguaguucucu

SEQ ID NO: 2772153 - RNA, 17 nt, Human
acuaguaguucucuugg

SEQ ID NO: 2772154 - RNA, 13 nt, Human
acuaguacugugu

SEQ ID NO: 2772155 - RNA, 22 nt, Human
acuaguacuguguacuguauag

SEQ ID NO: 2772156 - RNA, 23 nt, Human
acuaguacuguguacuguauaga

SEQ ID NO: 2772157 - RNA, 16 nt, Human
acuagguucaauuccc

SEQ ID NO: 2772158 - RNA, 21 nt, Human
acuagguucaauucccugaag

SEQ ID NO: 2772159 - RNA, 19 nt, Human
acuaguaaguaauuaugca

SEQ ID NO: 2772160 - RNA, 13 nt, Human
acuaguacaaauu

SEQ ID NO: 2772161 - RNA, 16 nt, Human
acuaguacaaauuaua

SEQ ID NO: 2772162 - RNA, 20 nt, Human
acuaguacaaauuauaaaaa

SEQ ID NO: 2772163 - RNA, 13 nt, Human
acuauugcccagg

SEQ ID NO: 2772164 - RNA, 15 nt, Human
acuauugcauuuaua

SEQ ID NO: 2772165 - RNA, 21 nt, Human
acuauuggaaucugauauacu

SEQ ID NO: 2772166 - RNA, 22 nt, Human
acuauuucccuugaaauuuuaa

SEQ ID NO: 2772167 - RNA, 19 nt, Human
acuauuggagggugggaga

SEQ ID NO: 2772168 - RNA, 13 nt, Human
acuauuggagggu

SEQ ID NO: 2772169 - RNA, 14 nt, Human
acuaggcucagaga

SEQ ID NO: 2772170 - RNA, 19 nt, Human
acuaaucugggaagggaag

SEQ ID NO: 2772171 - RNA, 14 nt, Human
acuaaucuuucugc

SEQ ID NO: 2772172 - RNA, 12 nt, Human
accucugccaga

SEQ ID NO: 2772173 - RNA, 15 nt, Human
accugugaagcugaa

SEQ ID NO: 2772174 - RNA, 17 nt, Human
accugugaagcugaaaa

SEQ ID NO: 2772175 - RNA, 19 nt, Human
accugccaugccaggaacc

SEQ ID NO: 2772176 - RNA, 23 nt, Human
accugccccuccucucugcccua

SEQ ID NO: 2772177 - RNA, 19 nt, Human
accugccauuugcacccuc

SEQ ID NO: 2772178 - RNA, 18 nt, Human
accugccauuugcacccu

SEQ ID NO: 2772179 - RNA, 22 nt, Human
accugccccuccucucugcccu

SEQ ID NO: 2772180 - RNA, 17 nt, Human
accugcccugcccccac

SEQ ID NO: 2772181 - RNA, 12 nt, Human
accugcccugcc

SEQ ID NO: 2772182 - RNA, 15 nt, Human
accugccauuugcac

SEQ ID NO: 2772183 - RNA, 16 nt, Human
accugccaugccagga

SEQ ID NO: 2772184 - RNA, 18 nt, Human
accucaggcuuccuuggc

SEQ ID NO: 2772185 - RNA, 20 nt, Human
accgugagcaggaaggccug

SEQ ID NO: 2772186 - RNA, 21 nt, Human
accgugagcaggaaggccugg

SEQ ID NO: 2772187 - RNA, 22 nt, Human
accgugagcaggaaggccuggg

SEQ ID NO: 2772188 - RNA, 19 nt, Human
accucaggguauugcuugc

SEQ ID NO: 2772189 - RNA, 23 nt, Human
accucaggguauugcuugccacu

SEQ ID NO: 2772190 - RNA, 22 nt, Human
accucagguaaucgaccugccu

SEQ ID NO: 2772191 - RNA, 19 nt, Human
accucaggcuuccuuggca

SEQ ID NO: 2772192 - RNA, 15 nt, Human
accucaggugaucca

SEQ ID NO: 2772193 - RNA, 23 nt, Human
accucagguaaucgaccugccuc

SEQ ID NO: 2772194 - RNA, 17 nt, Human
accucaguucccuuggc

SEQ ID NO: 2772195 - RNA, 16 nt, Human
accucaguucccuugg

SEQ ID NO: 2772196 - RNA, 21 nt, Human
accucaguucccuuggccuca

SEQ ID NO: 2772197 - RNA, 20 nt, Human
accucaguucccuuggccuc

SEQ ID NO: 2772198 - RNA, 19 nt, Human
accucaguucccuuggccu

SEQ ID NO: 2772199 - RNA, 18 nt, Human
accucaguucccuuggcc

SEQ ID NO: 2772200 - RNA, 13 nt, Human
accucauccaaac

SEQ ID NO: 2772201 - RNA, 14 nt, Human
accucauccaaaca

SEQ ID NO: 2772202 - RNA, 15 nt, Human
accucauccaaacaa

SEQ ID NO: 2772203 - RNA, 14 nt, Human
accucaucccauga

SEQ ID NO: 2772204 - RNA, 23 nt, Human
accucaguucccuuggccucaga

SEQ ID NO: 2772205 - RNA, 22 nt, Human
accucaguucccuuggccucag

SEQ ID NO: 2772206 - RNA, 14 nt, Human
accccaaucccagc

SEQ ID NO: 2772207 - RNA, 20 nt, Human
accccaaguagucugcucac

SEQ ID NO: 2772208 - RNA, 21 nt, Human
accccaagccagcccggccgc

SEQ ID NO: 2772209 - RNA, 18 nt, Human
accccaagccagcccggc

SEQ ID NO: 2772210 - RNA, 16 nt, Human
accccaacgcacagga

SEQ ID NO: 2772211 - RNA, 17 nt, Human
accccaacgcacaggaa

SEQ ID NO: 2772212 - RNA, 17 nt, Human
acccuguuaccauuuug

SEQ ID NO: 2772213 - RNA, 20 nt, Human
acccuguguauacagcccug

SEQ ID NO: 2772214 - RNA, 14 nt, Human
acccuguggcccug

SEQ ID NO: 2772215 - RNA, 15 nt, Human
acccuguggcccugg

SEQ ID NO: 2772216 - RNA, 16 nt, Human
acccuguggcccuggc

SEQ ID NO: 2772217 - RNA, 17 nt, Human
acccuguggcccuggcu

SEQ ID NO: 2772218 - RNA, 18 nt, Human
acccuguuuggauuuuua

SEQ ID NO: 2772219 - RNA, 19 nt, Human
acccuguuuggauuuuuaa

SEQ ID NO: 2772220 - RNA, 12 nt, Human
acccuuagaaaa

SEQ ID NO: 2772221 - RNA, 13 nt, Human
acccuuagaaaau

SEQ ID NO: 2772222 - RNA, 13 nt, Human
acccuuagaaucc

SEQ ID NO: 2772223 - RNA, 16 nt, Human
acccuuagaauccacg

SEQ ID NO: 2772224 - RNA, 22 nt, Human
acccuuaccccuuagccucccu

SEQ ID NO: 2772225 - RNA, 19 nt, Human
acccuuaccccuuagccuc

SEQ ID NO: 2772226 - RNA, 18 nt, Human
acccuuaccccuuagccu

SEQ ID NO: 2772227 - RNA, 14 nt, Human
acccuuaacccaag

SEQ ID NO: 2772228 - RNA, 15 nt, Human
acccuuaacccaagg

SEQ ID NO: 2772229 - RNA, 16 nt, Human
acccuuaacccaagga

SEQ ID NO: 2772230 - RNA, 17 nt, Human
acccuuaacccaaggag

SEQ ID NO: 2772231 - RNA, 18 nt, Human
acccuuaacccaaggagc

SEQ ID NO: 2772232 - RNA, 23 nt, Human
acccuuaacccaaggagcacagg

SEQ ID NO: 2772233 - RNA, 16 nt, Human
acccuuaagucacccu

SEQ ID NO: 2772234 - RNA, 20 nt, Human
accgggcacucagaagacac

SEQ ID NO: 2772235 - RNA, 22 nt, Human
accggcuggcagggcuggcccc

SEQ ID NO: 2772236 - RNA, 18 nt, Human
accggccgauggagacac

SEQ ID NO: 2772237 - RNA, 11 nt, Human
accggcgcgcu

SEQ ID NO: 2772238 - RNA, 14 nt, Human
accggcgcgcucuu

SEQ ID NO: 2772239 - RNA, 21 nt, Human
accguccucaccccuguccuc

SEQ ID NO: 2772240 - RNA, 13 nt, Human
accguccucaccc

SEQ ID NO: 2772241 - RNA, 15 nt, Human
accguccucaccccu

SEQ ID NO: 2772242 - RNA, 17 nt, Human
accguccucaccccugu

SEQ ID NO: 2772243 - RNA, 18 nt, Human
accguccucaccccuguc

SEQ ID NO: 2772244 - RNA, 23 nt, Human
accgguccagcuggccuggacag

SEQ ID NO: 2772245 - RNA, 18 nt, Human
accgguccagcuggccug

SEQ ID NO: 2772246 - RNA, 17 nt, Human
accguaauaauuauuau

SEQ ID NO: 2772247 - RNA, 12 nt, Human
accguccucacc

SEQ ID NO: 2772248 - RNA, 19 nt, Human
accgggccacagagaaagu

SEQ ID NO: 2772249 - RNA, 15 nt, Human
accgggccacagaga

SEQ ID NO: 2772250 - RNA, 17 nt, Human
accgguccagcuggccu

SEQ ID NO: 2772251 - RNA, 16 nt, Human
accgguccagcuggcc

SEQ ID NO: 2772252 - RNA, 15 nt, Human
accgguccagcuggc

SEQ ID NO: 2772253 - RNA, 14 nt, Human
accgguccagcugg

SEQ ID NO: 2772254 - RNA, 15 nt, Human
acucuguuauuuaga

SEQ ID NO: 2772255 - RNA, 14 nt, Human
acucuagauuccau

SEQ ID NO: 2772256 - RNA, 19 nt, Human
acucuagaguccaagguuu

SEQ ID NO: 2772257 - RNA, 13 nt, Human
acucuagauucca

SEQ ID NO: 2772258 - RNA, 16 nt, Human
acucuguuauuuagac

SEQ ID NO: 2772259 - RNA, 20 nt, Human
acucuuaaagcaaaaaauga

SEQ ID NO: 2772260 - RNA, 17 nt, Human
acucuuaaaugaucugc

SEQ ID NO: 2772261 - RNA, 20 nt, Human
acucuuaaaugaucugccuc

SEQ ID NO: 2772262 - RNA, 19 nt, Human
acucugugucagguggggc

SEQ ID NO: 2772263 - RNA, 21 nt, Human
acucugugucagguggggcag

SEQ ID NO: 2772264 - RNA, 19 nt, Human
acucugucucaaaaaaaca

SEQ ID NO: 2772265 - RNA, 22 nt, Human
acucuagaugaaguuuuacauu

SEQ ID NO: 2772266 - RNA, 21 nt, Human
acucuagaugaaguuuuacau

SEQ ID NO: 2772267 - RNA, 14 nt, Human
acucuagaguccaa

SEQ ID NO: 2772268 - RNA, 20 nt, Human
acucuagaguccaagguuua

SEQ ID NO: 2772269 - RNA, 20 nt, Human
acucuagauaccuaaaacau

SEQ ID NO: 2772270 - RNA, 21 nt, Human
acucuagauaccuaaaacaua

SEQ ID NO: 2772271 - RNA, 14 nt, Human
acucuacuguguaa

SEQ ID NO: 2772272 - RNA, 15 nt, Human
acucuacuguguaau

SEQ ID NO: 2772273 - RNA, 20 nt, Human
acucuacuuagcaugucccu

SEQ ID NO: 2772274 - RNA, 17 nt, Human
acucuagacaagauauu

SEQ ID NO: 2772275 - RNA, 19 nt, Human
acucuagacaagauauugu

SEQ ID NO: 2772276 - RNA, 20 nt, Human
acucuagacaagauauugua

SEQ ID NO: 2772277 - RNA, 21 nt, Human
acucuagacaagauauuguac

SEQ ID NO: 2772278 - RNA, 21 nt, Human
acucuacuuagcaugucccua

SEQ ID NO: 2772279 - RNA, 20 nt, Human
acucuaagaucuuagauucu

SEQ ID NO: 2772280 - RNA, 21 nt, Human
acucuaagaucuuagauucuc

SEQ ID NO: 2772281 - RNA, 14 nt, Human
acucuaaagaccaa

SEQ ID NO: 2772282 - RNA, 15 nt, Human
acucuaaagaccaaa

SEQ ID NO: 2772283 - RNA, 16 nt, Human
acucuaaagaccaaac

SEQ ID NO: 2772284 - RNA, 18 nt, Human
acucuaaagaccaaacuu

SEQ ID NO: 2772285 - RNA, 12 nt, Human
acucuaagaucu

SEQ ID NO: 2772286 - RNA, 13 nt, Human
acucuaagaucuu

SEQ ID NO: 2772287 - RNA, 17 nt, Human
acucuaagaucuuagau

SEQ ID NO: 2772288 - RNA, 17 nt, Human
acucuaaauucuuuauu

SEQ ID NO: 2772289 - RNA, 22 nt, Human
acucuaaauucuuuauuucugu

SEQ ID NO: 2772290 - RNA, 23 nt, Human
acucuaaauucuuuauuucuguc

SEQ ID NO: 2772291 - RNA, 15 nt, Human
acuauuuuauucuaa

SEQ ID NO: 2772292 - RNA, 18 nt, Human
acuauuugucuuucagga

SEQ ID NO: 2772293 - RNA, 16 nt, Human
acuauuugucuuucag

SEQ ID NO: 2772294 - RNA, 23 nt, Human
acuauuugcuuauuuaauaaaga

SEQ ID NO: 2772295 - RNA, 19 nt, Human
acuauuugcuuauuuaaua

SEQ ID NO: 2772296 - RNA, 14 nt, Human
acuauuucggccuu

SEQ ID NO: 2772297 - RNA, 22 nt, Human
acuauuucuacacagugggaac

SEQ ID NO: 2772298 - RNA, 22 nt, Human
acuauuucugggucuuuugcua

SEQ ID NO: 2772299 - RNA, 23 nt, Human
acuauuucugggucuuuugcuac

SEQ ID NO: 2772300 - RNA, 14 nt, Human
acuauuuucuacaa

SEQ ID NO: 2772301 - RNA, 14 nt, Human
acuauuuucuuuuu

SEQ ID NO: 2772302 - RNA, 18 nt, Human
acugauuaugucuuuuau

SEQ ID NO: 2772303 - RNA, 20 nt, Human
acugauuaugucuuuuauau

SEQ ID NO: 2772304 - RNA, 15 nt, Human
acugauuauuuucuu

SEQ ID NO: 2772305 - RNA, 18 nt, Human
acugauuauuuucuucau

SEQ ID NO: 2772306 - RNA, 20 nt, Human
acugauuguuuuagagacua

SEQ ID NO: 2772307 - RNA, 21 nt, Human
acugauuguuuuagagacuau

SEQ ID NO: 2772308 - RNA, 20 nt, Human
acugauucugggaugcuccu

SEQ ID NO: 2772309 - RNA, 15 nt, Human
acugauugagaaguu

SEQ ID NO: 2772310 - RNA, 23 nt, Human
acugacauuguuggccaaagcca

SEQ ID NO: 2772311 - RNA, 22 nt, Human
acugacauuguuggccaaagcc

SEQ ID NO: 2772312 - RNA, 13 nt, Human
acugaccagccuc

SEQ ID NO: 2772313 - RNA, 15 nt, Human
acugaccagccucca

SEQ ID NO: 2772314 - RNA, 20 nt, Human
acugaccagccuccaugcug

SEQ ID NO: 2772315 - RNA, 22 nt, Human
acugaccauccacucuacccuc

SEQ ID NO: 2772316 - RNA, 16 nt, Human
acugaccauccacucu

SEQ ID NO: 2772317 - RNA, 23 nt, Human
acugaccagccuccaugcugccu

SEQ ID NO: 2772318 - RNA, 20 nt, Human
acugaucuuuguauauuaca

SEQ ID NO: 2772319 - RNA, 15 nt, Human
acugaugcugagauu

SEQ ID NO: 2772320 - RNA, 16 nt, Human
acugaugcugagauuc

SEQ ID NO: 2772321 - RNA, 18 nt, Human
acugaugcugagauucuu

SEQ ID NO: 2772322 - RNA, 15 nt, Human
acugaugcuuagaug

SEQ ID NO: 2772323 - RNA, 15 nt, Human
acugaugcuguucuc

SEQ ID NO: 2772324 - RNA, 20 nt, Human
acugaugcuguucucuucuu

SEQ ID NO: 2772325 - RNA, 22 nt, Human
acugaugggcaacccccagccu

SEQ ID NO: 2772326 - RNA, 12 nt, Human
acugaugggcaa

SEQ ID NO: 2772327 - RNA, 15 nt, Human
acugccaucaaacug

SEQ ID NO: 2772328 - RNA, 19 nt, Human
acugccagucccccugccc

SEQ ID NO: 2772329 - RNA, 18 nt, Human
acugccagucccccugcc

SEQ ID NO: 2772330 - RNA, 20 nt, Human
acugcuuuuggucuguguga

SEQ ID NO: 2772331 - RNA, 16 nt, Human
acugcuuuuggucugu

SEQ ID NO: 2772332 - RNA, 19 nt, Human
acugcccuaacuguacauu

SEQ ID NO: 2772333 - RNA, 20 nt, Human
acuggaagcuaauuugcauu

SEQ ID NO: 2772334 - RNA, 18 nt, Human
acuggaaggggaagggac

SEQ ID NO: 2772335 - RNA, 23 nt, Human
acuggaauaagaagcaaauaaau

SEQ ID NO: 2772336 - RNA, 18 nt, Human
acuggaagguggggacag

SEQ ID NO: 2772337 - RNA, 12 nt, Human
acuggaaguuca

SEQ ID NO: 2772338 - RNA, 19 nt, Human
acuggaaguucauaccuaa

SEQ ID NO: 2772339 - RNA, 20 nt, Human
acuggaaguucauaccuaag

SEQ ID NO: 2772340 - RNA, 21 nt, Human
acuggaaguucauaccuaagu

SEQ ID NO: 2772341 - RNA, 22 nt, Human
acuggaaguucauaccuaagua

SEQ ID NO: 2772342 - RNA, 15 nt, Human
acugcuuuuggucug

SEQ ID NO: 2772343 - RNA, 14 nt, Human
acugcuuuuggucu

SEQ ID NO: 2772344 - RNA, 16 nt, Human
acugccaugcagggcc

SEQ ID NO: 2772345 - RNA, 14 nt, Human
acugcccgcacacc

SEQ ID NO: 2772346 - RNA, 16 nt, Human
acugcccgcacacccu

SEQ ID NO: 2772347 - RNA, 19 nt, Human
acugcccgcacacccucac

SEQ ID NO: 2772348 - RNA, 16 nt, Human
acuugggaggcugagg

SEQ ID NO: 2772349 - RNA, 13 nt, Human
acuuggcuuucau

SEQ ID NO: 2772350 - RNA, 13 nt, Human
acuuuauguguaa

SEQ ID NO: 2772351 - RNA, 21 nt, Human
acuuucaaaucgguccccugu

SEQ ID NO: 2772352 - RNA, 13 nt, Human
acuuucaaaauua

SEQ ID NO: 2772353 - RNA, 18 nt, Human
acuuucaaaauuaaaucu

SEQ ID NO: 2772354 - RNA, 20 nt, Human
acuuucaaaauuaaaucugu

SEQ ID NO: 2772355 - RNA, 16 nt, Human
acuuuauguguaaaua

SEQ ID NO: 2772356 - RNA, 21 nt, Human
acuuuauguguaaauacauaa

SEQ ID NO: 2772357 - RNA, 18 nt, Human
acuuuauguuugucuuuu

SEQ ID NO: 2772358 - RNA, 21 nt, Human
acuuucagguacuaaauaccu

SEQ ID NO: 2772359 - RNA, 16 nt, Human
acuuucaguaaacaua

SEQ ID NO: 2772360 - RNA, 17 nt, Human
acuuucaguaaacauaa

SEQ ID NO: 2772361 - RNA, 18 nt, Human
acuuucagguacuaaaua

SEQ ID NO: 2772362 - RNA, 22 nt, Human
acuuucaggccacauggcuaaa

SEQ ID NO: 2772363 - RNA, 20 nt, Human
acuuaaaauauuccugcauu

SEQ ID NO: 2772364 - RNA, 14 nt, Human
acuuaaaaugugca

SEQ ID NO: 2772365 - RNA, 16 nt, Human
acuuaaaaugugcagu

SEQ ID NO: 2772366 - RNA, 18 nt, Human
acuuaaaaugugcaguaa

SEQ ID NO: 2772367 - RNA, 22 nt, Human
acuuaaaauauuccugcauuug

SEQ ID NO: 2772368 - RNA, 11 nt, Human
acuuaaagauu

SEQ ID NO: 2772369 - RNA, 15 nt, Human
acuuaaagauuuauc

SEQ ID NO: 2772370 - RNA, 22 nt, Human
acuuaaagcccgccugacagaa

SEQ ID NO: 2772371 - RNA, 13 nt, Human
acuuaaagauuua

SEQ ID NO: 2772372 - RNA, 19 nt, Human
acuucaaauuuuuuaaaag

SEQ ID NO: 2772373 - RNA, 19 nt, Human
acuucaacauuuacaugua

SEQ ID NO: 2772374 - RNA, 13 nt, Human
acuucaaggccca

SEQ ID NO: 2772375 - RNA, 16 nt, Human
acuucaaggugacaga

SEQ ID NO: 2772376 - RNA, 23 nt, Human
acuucaaggugacagaaggacca

SEQ ID NO: 2772377 - RNA, 15 nt, Human
acuucaaugauagua

SEQ ID NO: 2772378 - RNA, 19 nt, Human
acuucaaugggcucuucca

SEQ ID NO: 2772379 - RNA, 22 nt, Human
acuucaaugggcucuuccaaca

SEQ ID NO: 2772380 - RNA, 19 nt, Human
acuucaauaauuguccaug

SEQ ID NO: 2772381 - RNA, 20 nt, Human
acuucugccauauucuguug

SEQ ID NO: 2772382 - RNA, 19 nt, Human
acuucugccauauucuguu

SEQ ID NO: 2772383 - RNA, 16 nt, Human
acuucuuaaaaguugu

SEQ ID NO: 2772384 - RNA, 12 nt, Human
acuucuuaaaua

SEQ ID NO: 2772385 - RNA, 14 nt, Human
acuucuuaaauauc

SEQ ID NO: 2772386 - RNA, 16 nt, Human
acuucuuaaauaucuu

SEQ ID NO: 2772387 - RNA, 17 nt, Human
acuucuuaaauaucuuu

SEQ ID NO: 2772388 - RNA, 18 nt, Human
acuucuuaaauaucuuuu

SEQ ID NO: 2772389 - RNA, 19 nt, Human
acuucuuaaauaucuuuua

SEQ ID NO: 2772390 - RNA, 20 nt, Human
acuucuuaaauaucuuuuau

SEQ ID NO: 2772391 - RNA, 22 nt, Human
acuucuuaaauaucuuuuaugu

SEQ ID NO: 2772392 - RNA, 14 nt, Human
acuucugcuggcau

SEQ ID NO: 2772393 - RNA, 13 nt, Human
acuucugccucuu

SEQ ID NO: 2772394 - RNA, 23 nt, Human
acuucugugagacccccacaccu

SEQ ID NO: 2772395 - RNA, 20 nt, Human
acuucugugagacccccaca

SEQ ID NO: 2772396 - RNA, 19 nt, Human
acuucugugagacccccac

SEQ ID NO: 2772397 - RNA, 16 nt, Human
acuucuggcucccucu

SEQ ID NO: 2772398 - RNA, 18 nt, Human
acuucuggcucccucuuc

SEQ ID NO: 2772399 - RNA, 22 nt, Human
acuucuggcucccucuucuuuc

SEQ ID NO: 2772400 - RNA, 21 nt, Human
acuggaccacugggcaaugau

SEQ ID NO: 2772401 - RNA, 13 nt, Human
acuggaauuaaaa

SEQ ID NO: 2772402 - RNA, 20 nt, Human
acuggaccacugggcaauga

SEQ ID NO: 2772403 - RNA, 16 nt, Human
acuggaccacugggca

SEQ ID NO: 2772404 - RNA, 18 nt, Human
acuggacagucacugcca

SEQ ID NO: 2772405 - RNA, 18 nt, Human
acuggacauaacauuuuc

SEQ ID NO: 2772406 - RNA, 19 nt, Human
cucuguaccccaugaccuu

SEQ ID NO: 2772407 - RNA, 21 nt, Human
cugaaggacauugcggacagc

SEQ ID NO: 2772408 - RNA, 20 nt, Human
cugaaggacauugcggacag

SEQ ID NO: 2772409 - RNA, 19 nt, Human
cugaaggacauugcggaca

SEQ ID NO: 2772410 - RNA, 22 nt, Human
cugaaaauguuuuucugccagg

SEQ ID NO: 2772411 - RNA, 12 nt, Human
cugaaaauguug

SEQ ID NO: 2772412 - RNA, 21 nt, Human
cugaaaauguuguuaugcuau

SEQ ID NO: 2772413 - RNA, 22 nt, Human
cugaaggaauaaauugcuccuu

SEQ ID NO: 2772414 - RNA, 21 nt, Human
cugaagcuucacucacuguca

SEQ ID NO: 2772415 - RNA, 14 nt, Human
cugaagcuugacuc

SEQ ID NO: 2772416 - RNA, 15 nt, Human
cugaagcuugacucc

SEQ ID NO: 2772417 - RNA, 20 nt, Human
cugaagcuugacucccaagu

SEQ ID NO: 2772418 - RNA, 21 nt, Human
cugaagcuugacucccaaguu

SEQ ID NO: 2772419 - RNA, 20 nt, Human
cugaaaaccucuccucaugu

SEQ ID NO: 2772420 - RNA, 17 nt, Human
cugaaaaccucuccuca

SEQ ID NO: 2772421 - RNA, 15 nt, Human
cugaaaaccucuccu

SEQ ID NO: 2772422 - RNA, 14 nt, Human
cugaaaaccucucc

SEQ ID NO: 2772423 - RNA, 13 nt, Human
cugaaaacuggaa

SEQ ID NO: 2772424 - RNA, 15 nt, Human
cugaaaacuggaaua

SEQ ID NO: 2772425 - RNA, 19 nt, Human
cugaaaacuggaauaagaa

SEQ ID NO: 2772426 - RNA, 21 nt, Human
cugaaaacuggaauaagaagc

SEQ ID NO: 2772427 - RNA, 22 nt, Human
cugaaaacuggaauaagaagca

SEQ ID NO: 2772428 - RNA, 23 nt, Human
cugaaaacuggaauaagaagcaa

SEQ ID NO: 2772429 - RNA, 11 nt, Human
cugaaaagaaa

SEQ ID NO: 2772430 - RNA, 13 nt, Human
cugaaaagaaaua

SEQ ID NO: 2772431 - RNA, 14 nt, Human
cugaaaagaaauaa

SEQ ID NO: 2772432 - RNA, 16 nt, Human
cugaaaagaaauaaua

SEQ ID NO: 2772433 - RNA, 17 nt, Human
cugaaaagaaauaauaa

SEQ ID NO: 2772434 - RNA, 19 nt, Human
cugaaaaccuaaguccuuu

SEQ ID NO: 2772435 - RNA, 18 nt, Human
cugaaaaccaucuggccu

SEQ ID NO: 2772436 - RNA, 19 nt, Human
cugaaaaccaucuggccug

SEQ ID NO: 2772437 - RNA, 20 nt, Human
cugaaaaccaucuggccugg

SEQ ID NO: 2772438 - RNA, 21 nt, Human
cugaaaaccaucuggccuggc

SEQ ID NO: 2772439 - RNA, 22 nt, Human
cugaaaaccaucuggccuggcc

SEQ ID NO: 2772440 - RNA, 15 nt, Human
cugaaaaauuccuuu

SEQ ID NO: 2772441 - RNA, 18 nt, Human
cucuuggagaccuuaccc

SEQ ID NO: 2772442 - RNA, 16 nt, Human
cucuugcuauugaauu

SEQ ID NO: 2772443 - RNA, 12 nt, Human
cucuugcugucu

SEQ ID NO: 2772444 - RNA, 13 nt, Human
cucuugcugucuc

SEQ ID NO: 2772445 - RNA, 14 nt, Human
cucuugcugucucu

SEQ ID NO: 2772446 - RNA, 15 nt, Human
cucuugcugucucug

SEQ ID NO: 2772447 - RNA, 17 nt, Human
cucuugcugucucugcu

SEQ ID NO: 2772448 - RNA, 18 nt, Human
cucuugcugucucugcuc

SEQ ID NO: 2772449 - RNA, 19 nt, Human
cucuugcugucucugcucg

SEQ ID NO: 2772450 - RNA, 14 nt, Human
cucuugcuuucuau

SEQ ID NO: 2772451 - RNA, 16 nt, Human
cucuugccacugccuc

SEQ ID NO: 2772452 - RNA, 17 nt, Human
cucuugccacugccucu

SEQ ID NO: 2772453 - RNA, 18 nt, Human
cucuugccacugccucuu

SEQ ID NO: 2772454 - RNA, 19 nt, Human
cucuugccacugccucuuc

SEQ ID NO: 2772455 - RNA, 20 nt, Human
cucuugccacugccucuucc

SEQ ID NO: 2772456 - RNA, 14 nt, Human
cugacccuggggcu

SEQ ID NO: 2772457 - RNA, 19 nt, Human
cugacccuggggcuggcuu

SEQ ID NO: 2772458 - RNA, 20 nt, Human
cugacccuggggcuggcuuu

SEQ ID NO: 2772459 - RNA, 14 nt, Human
cugacccuuccaga

SEQ ID NO: 2772460 - RNA, 15 nt, Human
cugacccuuccagac

SEQ ID NO: 2772461 - RNA, 16 nt, Human
cugacccuuccagaca

SEQ ID NO: 2772462 - RNA, 17 nt, Human
cugacccuuccagacau

SEQ ID NO: 2772463 - RNA, 18 nt, Human
cugacccuuccagacaua

SEQ ID NO: 2772464 - RNA, 17 nt, Human
cugaccucaagugaucu

SEQ ID NO: 2772465 - RNA, 14 nt, Human
cugaccucuugcug

SEQ ID NO: 2772466 - RNA, 15 nt, Human
cugaccucuugcugu

SEQ ID NO: 2772467 - RNA, 16 nt, Human
cugaccucuugcuguc

SEQ ID NO: 2772468 - RNA, 17 nt, Human
cugaccucuugcugucu

SEQ ID NO: 2772469 - RNA, 18 nt, Human
cugaccucuugcugucuc

SEQ ID NO: 2772470 - RNA, 13 nt, Human
cugaccuuccuuc

SEQ ID NO: 2772471 - RNA, 15 nt, Human
cugaccuuccuuccu

SEQ ID NO: 2772472 - RNA, 16 nt, Human
cugaccuuccuuccug

SEQ ID NO: 2772473 - RNA, 14 nt, Human
cugaccuucagcuc

SEQ ID NO: 2772474 - RNA, 15 nt, Human
cugaccuucagcuca

SEQ ID NO: 2772475 - RNA, 22 nt, Human
cugaccuucagcucacgcuuca

SEQ ID NO: 2772476 - RNA, 14 nt, Human
cugacagacacagg

SEQ ID NO: 2772477 - RNA, 12 nt, Human
cugacagacaca

SEQ ID NO: 2772478 - RNA, 15 nt, Human
cugacagacacaggc

SEQ ID NO: 2772479 - RNA, 21 nt, Human
cugacagaaggugccacuuua

SEQ ID NO: 2772480 - RNA, 16 nt, Human
cugacagaaggugcca

SEQ ID NO: 2772481 - RNA, 18 nt, Human
cugaaggcagcauguaua

SEQ ID NO: 2772482 - RNA, 14 nt, Human
cugaaggcuuugug

SEQ ID NO: 2772483 - RNA, 15 nt, Human
cugaaggcuuuguga

SEQ ID NO: 2772484 - RNA, 17 nt, Human
cugaagggaaucacauc

SEQ ID NO: 2772485 - RNA, 18 nt, Human
cugaagggcauucuuucc

SEQ ID NO: 2772486 - RNA, 20 nt, Human
cugaagggcauucuuuccca

SEQ ID NO: 2772487 - RNA, 14 nt, Human
cugacagaaggacu

SEQ ID NO: 2772488 - RNA, 20 nt, Human
cucucuggaagcccuggaga

SEQ ID NO: 2772489 - RNA, 20 nt, Human
cucuccucauguucugcuuu

SEQ ID NO: 2772490 - RNA, 15 nt, Human
cucugaaggacauug

SEQ ID NO: 2772491 - RNA, 20 nt, Human
cucugaagcauguuucaugu

SEQ ID NO: 2772492 - RNA, 14 nt, Human
cucugaagcauguu

SEQ ID NO: 2772493 - RNA, 17 nt, Human
cucugaagcauguuuca

SEQ ID NO: 2772494 - RNA, 15 nt, Human
cucugaagccucugg

SEQ ID NO: 2772495 - RNA, 17 nt, Human
cucugaagccucuggga

SEQ ID NO: 2772496 - RNA, 18 nt, Human
cucugaagcgugauuuua

SEQ ID NO: 2772497 - RNA, 15 nt, Human
cucugaagcaaggcg

SEQ ID NO: 2772498 - RNA, 18 nt, Human
cucugaagcaaggcggug

SEQ ID NO: 2772499 - RNA, 23 nt, Human
cucugaagcaaggcgguggacuu

SEQ ID NO: 2772500 - RNA, 11 nt, Human
cucugaagcau

SEQ ID NO: 2772501 - RNA, 13 nt, Human
cucugaacuuugg

SEQ ID NO: 2772502 - RNA, 14 nt, Human
cucugaacuuugga

SEQ ID NO: 2772503 - RNA, 16 nt, Human
cucugaacuuuggaga

SEQ ID NO: 2772504 - RNA, 21 nt, Human
cucucagccccugauccugug

SEQ ID NO: 2772505 - RNA, 13 nt, Human
cucucagcccaga

SEQ ID NO: 2772506 - RNA, 14 nt, Human
cucucagcccagaa

SEQ ID NO: 2772507 - RNA, 15 nt, Human
cucucagcccagaag

SEQ ID NO: 2772508 - RNA, 18 nt, Human
cucucagcccagaagaaa

SEQ ID NO: 2772509 - RNA, 22 nt, Human
cucucagccccugauccuguga

SEQ ID NO: 2772510 - RNA, 17 nt, Human
cucucagccuuacauuu

SEQ ID NO: 2772511 - RNA, 21 nt, Human
cucuccgaccagacaccuuga

SEQ ID NO: 2772512 - RNA, 15 nt, Human
cucuccggucucucu

SEQ ID NO: 2772513 - RNA, 21 nt, Human
cucuccguuuauuauaaacug

SEQ ID NO: 2772514 - RNA, 15 nt, Human
cucucaauaugcuua

SEQ ID NO: 2772515 - RNA, 16 nt, Human
cucucaauaugcuuac

SEQ ID NO: 2772516 - RNA, 14 nt, Human
cucucacuccccau

SEQ ID NO: 2772517 - RNA, 19 nt, Human
cucucacuccccaugccac

SEQ ID NO: 2772518 - RNA, 21 nt, Human
cucucacuaaacuuuacccaa

SEQ ID NO: 2772519 - RNA, 12 nt, Human
cucucacucccc

SEQ ID NO: 2772520 - RNA, 23 nt, Human
cucucaaaacuugguauuuuuca

SEQ ID NO: 2772521 - RNA, 23 nt, Human
cucucaaaagagaaaaacaaaac

SEQ ID NO: 2772522 - RNA, 23 nt, Human
cucucaaacuaaaagacauuugu

SEQ ID NO: 2772523 - RNA, 16 nt, Human
cucuauuuauguuugc

SEQ ID NO: 2772524 - RNA, 17 nt, Human
cucuauuuauguuugca

SEQ ID NO: 2772525 - RNA, 15 nt, Human
cucuauuucauuuuu

SEQ ID NO: 2772526 - RNA, 16 nt, Human
cucuauuuaauauuua

SEQ ID NO: 2772527 - RNA, 17 nt, Human
cucuauuuaauauuuau

SEQ ID NO: 2772528 - RNA, 13 nt, Human
cucuauuuaauau

SEQ ID NO: 2772529 - RNA, 14 nt, Human
cucuauuuaauauu

SEQ ID NO: 2772530 - RNA, 15 nt, Human
cucuauuuaauauuu

SEQ ID NO: 2772531 - RNA, 12 nt, Human
cucuauuuaaua

SEQ ID NO: 2772532 - RNA, 21 nt, Human
cucuauucucaaaguuuccua

SEQ ID NO: 2772533 - RNA, 15 nt, Human
cuccguccucgaugg

SEQ ID NO: 2772534 - RNA, 22 nt, Human
cuccguccaggagccugugccu

SEQ ID NO: 2772535 - RNA, 20 nt, Human
cuccguccaggagccugugc

SEQ ID NO: 2772536 - RNA, 19 nt, Human
cuccguccaggagccuggc

SEQ ID NO: 2772537 - RNA, 15 nt, Human
cuccguccagccgcc

SEQ ID NO: 2772538 - RNA, 22 nt, Human
cuccguccagccgccauugcca

SEQ ID NO: 2772539 - RNA, 18 nt, Human
cuccguccaggagccugg

SEQ ID NO: 2772540 - RNA, 18 nt, Human
cucggcuuuucucagcug

SEQ ID NO: 2772541 - RNA, 19 nt, Human
cucggcuuuucucagcugg

SEQ ID NO: 2772542 - RNA, 15 nt, Human
cucgggacaccugcc

SEQ ID NO: 2772543 - RNA, 20 nt, Human
cucgggacaccugcccugcc

SEQ ID NO: 2772544 - RNA, 20 nt, Human
cucgggauuaguacacacuu

SEQ ID NO: 2772545 - RNA, 19 nt, Human
cucgggaggcugaggcaca

SEQ ID NO: 2772546 - RNA, 20 nt, Human
cucgggaggcugaggcacaa

SEQ ID NO: 2772547 - RNA, 15 nt, Human
cucugucaaugaaaa

SEQ ID NO: 2772548 - RNA, 15 nt, Human
cucuguauuuuuucu

SEQ ID NO: 2772549 - RNA, 20 nt, Human
cucuguauuuuuucuugcau

SEQ ID NO: 2772550 - RNA, 23 nt, Human
cucuguauuuuuucuugcauuga

SEQ ID NO: 2772551 - RNA, 16 nt, Human
cucuuagaaaugaagg

SEQ ID NO: 2772552 - RNA, 15 nt, Human
cucuuagaacauugu

SEQ ID NO: 2772553 - RNA, 13 nt, Human
cucuguauaaaca

SEQ ID NO: 2772554 - RNA, 18 nt, Human
cucuguauaaacauuaaa

SEQ ID NO: 2772555 - RNA, 13 nt, Human
cucuguauauaua

SEQ ID NO: 2772556 - RNA, 16 nt, Human
cucugguucuucauuu

SEQ ID NO: 2772557 - RNA, 14 nt, Human
cucugguuucucau

SEQ ID NO: 2772558 - RNA, 21 nt, Human
cucuguaaaugaaaaaaccca

SEQ ID NO: 2772559 - RNA, 15 nt, Human
cucuguaacaucacu

SEQ ID NO: 2772560 - RNA, 23 nt, Human
cucuguaaaaacacugaaaaauu

SEQ ID NO: 2772561 - RNA, 19 nt, Human
cucugcugacagacacagg

SEQ ID NO: 2772562 - RNA, 18 nt, Human
cucugcugacagacacag

SEQ ID NO: 2772563 - RNA, 17 nt, Human
cucugcugacagacaca

SEQ ID NO: 2772564 - RNA, 15 nt, Human
cucugguuaucuaau

SEQ ID NO: 2772565 - RNA, 14 nt, Human
cucugguuccuccc

SEQ ID NO: 2772566 - RNA, 13 nt, Human
cucugcucagcca

SEQ ID NO: 2772567 - RNA, 16 nt, Human
cucugcucagccaagc

SEQ ID NO: 2772568 - RNA, 12 nt, Human
cucugcuccacc

SEQ ID NO: 2772569 - RNA, 14 nt, Human
cucugcuccaccac

SEQ ID NO: 2772570 - RNA, 13 nt, Human
cucugcuccacca

SEQ ID NO: 2772571 - RNA, 16 nt, Human
cucugcuccaccacau

SEQ ID NO: 2772572 - RNA, 15 nt, Human
cucugcuccaccaca

SEQ ID NO: 2772573 - RNA, 18 nt, Human
cucugcuccaccacaucc

SEQ ID NO: 2772574 - RNA, 18 nt, Human
cucugcacaugucuugua

SEQ ID NO: 2772575 - RNA, 18 nt, Human
cucugcaccguacugugg

SEQ ID NO: 2772576 - RNA, 13 nt, Human
cucugcaccccuc

SEQ ID NO: 2772577 - RNA, 15 nt, Human
cucugcaccccucug

SEQ ID NO: 2772578 - RNA, 15 nt, Human
cucugcacaugucuu

SEQ ID NO: 2772579 - RNA, 16 nt, Human
cucugcacaugucuug

SEQ ID NO: 2772580 - RNA, 16 nt, Human
cucugaagccucuggg

SEQ ID NO: 2772581 - RNA, 23 nt, Human
cucccugcagaugccacccuagc

SEQ ID NO: 2772582 - RNA, 16 nt, Human
cucccugcagaugcca

SEQ ID NO: 2772583 - RNA, 15 nt, Human
cucccugcagaugcc

SEQ ID NO: 2772584 - RNA, 21 nt, Human
cucccuccucaccucuggacu

SEQ ID NO: 2772585 - RNA, 19 nt, Human
cucccuccucaccucugga

SEQ ID NO: 2772586 - RNA, 18 nt, Human
cucccuccucaccucugg

SEQ ID NO: 2772587 - RNA, 17 nt, Human
cucccuccucaccucug

SEQ ID NO: 2772588 - RNA, 18 nt, Human
cuccagucccccuauccu

SEQ ID NO: 2772589 - RNA, 21 nt, Human
cuccagucccccuauccuugg

SEQ ID NO: 2772590 - RNA, 22 nt, Human
cuccagucccccuauccuuggc

SEQ ID NO: 2772591 - RNA, 23 nt, Human
cuccagucccccuauccuuggca

SEQ ID NO: 2772592 - RNA, 12 nt, Human
cucccaccucag

SEQ ID NO: 2772593 - RNA, 12 nt, Human
cucccacccugu

SEQ ID NO: 2772594 - RNA, 13 nt, Human
cucccacccugua

SEQ ID NO: 2772595 - RNA, 18 nt, Human
cucccacccuguaccuca

SEQ ID NO: 2772596 - RNA, 20 nt, Human
cucccacccuguaccucauc

SEQ ID NO: 2772597 - RNA, 23 nt, Human
cucccacccuguaccucauccca

SEQ ID NO: 2772598 - RNA, 13 nt, Human
cucccccugggcu

SEQ ID NO: 2772599 - RNA, 12 nt, Human
cucccccugggc

SEQ ID NO: 2772600 - RNA, 11 nt, Human
cucccccuggg

SEQ ID NO: 2772601 - RNA, 15 nt, Human
cuccccggcacccuc

SEQ ID NO: 2772602 - RNA, 17 nt, Human
cuccccggcacccucug

SEQ ID NO: 2772603 - RNA, 19 nt, Human
cuccccggcacccucuggc

SEQ ID NO: 2772604 - RNA, 20 nt, Human
cuccccggcacccucuggcc

SEQ ID NO: 2772605 - RNA, 15 nt, Human
cuccccgccuuccgc

SEQ ID NO: 2772606 - RNA, 22 nt, Human
cuccccgccuuccgccccuucc

SEQ ID NO: 2772607 - RNA, 16 nt, Human
cuccccgcuaaggaag

SEQ ID NO: 2772608 - RNA, 19 nt, Human
cuccccucacagccucuga

SEQ ID NO: 2772609 - RNA, 16 nt, Human
cuccccucagagugca

SEQ ID NO: 2772610 - RNA, 13 nt, Human
cuccccucagagu

SEQ ID NO: 2772611 - RNA, 20 nt, Human
cuccccucacagccucugac

SEQ ID NO: 2772612 - RNA, 23 nt, Human
cucccccugggcucugccccagc

SEQ ID NO: 2772613 - RNA, 16 nt, Human
cucccccuuaccccac

SEQ ID NO: 2772614 - RNA, 15 nt, Human
cuccccuccccugcu

SEQ ID NO: 2772615 - RNA, 16 nt, Human
cuccccuccccugcug

SEQ ID NO: 2772616 - RNA, 17 nt, Human
cuccccuccccugcugc

SEQ ID NO: 2772617 - RNA, 18 nt, Human
cuccccuccccugcugca

SEQ ID NO: 2772618 - RNA, 15 nt, Human
cucccuccucaccuc

SEQ ID NO: 2772619 - RNA, 14 nt, Human
cucccuccucaccu

SEQ ID NO: 2772620 - RNA, 17 nt, Human
cucccuccggcuugacc

SEQ ID NO: 2772621 - RNA, 12 nt, Human
cuccccuccagc

SEQ ID NO: 2772622 - RNA, 14 nt, Human
cuccccuccagccu

SEQ ID NO: 2772623 - RNA, 13 nt, Human
cuccccuccccug

SEQ ID NO: 2772624 - RNA, 14 nt, Human
cuccccuccccugc

SEQ ID NO: 2772625 - RNA, 19 nt, Human
cuccgcuuucuacccagcg

SEQ ID NO: 2772626 - RNA, 21 nt, Human
cuccgcugccgugccgccugc

SEQ ID NO: 2772627 - RNA, 12 nt, Human
cuccgcugcucc

SEQ ID NO: 2772628 - RNA, 13 nt, Human
cuccgcugcuccu

SEQ ID NO: 2772629 - RNA, 16 nt, Human
cuccgcugcuccuugg

SEQ ID NO: 2772630 - RNA, 18 nt, Human
cuccgcugcuccuuggcu

SEQ ID NO: 2772631 - RNA, 21 nt, Human
cuccgccuucacuccggugug

SEQ ID NO: 2772632 - RNA, 19 nt, Human
cuccgccuucacuccggug

SEQ ID NO: 2772633 - RNA, 18 nt, Human
cuccgccuucacuccggu

SEQ ID NO: 2772634 - RNA, 12 nt, Human
cuccgccuucac

SEQ ID NO: 2772635 - RNA, 14 nt, Human
cuccgccuucacau

SEQ ID NO: 2772636 - RNA, 19 nt, Human
cuccgccuucacauucccc

SEQ ID NO: 2772637 - RNA, 15 nt, Human
cuccgccucccgggu

SEQ ID NO: 2772638 - RNA, 21 nt, Human
cuccagaagccucuggcuaga

SEQ ID NO: 2772639 - RNA, 20 nt, Human
cuccagaagccucuggcuag

SEQ ID NO: 2772640 - RNA, 21 nt, Human
cuccagaaucuaaagccagug

SEQ ID NO: 2772641 - RNA, 23 nt, Human
cuccagaagauagcuucacccca

SEQ ID NO: 2772642 - RNA, 16 nt, Human
cuccagaagcacuggg

SEQ ID NO: 2772643 - RNA, 20 nt, Human
cuccagaagcacugggauca

SEQ ID NO: 2772644 - RNA, 15 nt, Human
cuccagaagccucug

SEQ ID NO: 2772645 - RNA, 14 nt, Human
cuccagaagccucu

SEQ ID NO: 2772646 - RNA, 19 nt, Human
cuccagaagccucuggcua

SEQ ID NO: 2772647 - RNA, 18 nt, Human
cuccagaagccucuggcu

SEQ ID NO: 2772648 - RNA, 17 nt, Human
cuccagaagccucuggc

SEQ ID NO: 2772649 - RNA, 16 nt, Human
cuccagaagccucugg

SEQ ID NO: 2772650 - RNA, 14 nt, Human
cuccaaccuaaccu

SEQ ID NO: 2772651 - RNA, 15 nt, Human
cuccaaccuaaccug

SEQ ID NO: 2772652 - RNA, 19 nt, Human
cuccaaccuaaccuguguc

SEQ ID NO: 2772653 - RNA, 20 nt, Human
cuccaaccuaaccugugucu

SEQ ID NO: 2772654 - RNA, 22 nt, Human
cuccaaccuaaccugugucugc

SEQ ID NO: 2772655 - RNA, 15 nt, Human
cuccagaagauagcu

SEQ ID NO: 2772656 - RNA, 14 nt, Human
cuccagaagauagc

SEQ ID NO: 2772657 - RNA, 22 nt, Human
cuccagaaaugucuaaaugcug

SEQ ID NO: 2772658 - RNA, 14 nt, Human
cuccagaacccauu

SEQ ID NO: 2772659 - RNA, 12 nt, Human
cuccagguaccu

SEQ ID NO: 2772660 - RNA, 17 nt, Human
cuccagguaccuugacc

SEQ ID NO: 2772661 - RNA, 18 nt, Human
cuccagguaccuugaccu

SEQ ID NO: 2772662 - RNA, 19 nt, Human
cuccagguaccuugaccuu

SEQ ID NO: 2772663 - RNA, 20 nt, Human
cuccagguaccuugaccuuu

SEQ ID NO: 2772664 - RNA, 15 nt, Human
cuccagggugauuuu

SEQ ID NO: 2772665 - RNA, 17 nt, Human
cuccaggucagcugccc

SEQ ID NO: 2772666 - RNA, 16 nt, Human
cuccaggucucacggg

SEQ ID NO: 2772667 - RNA, 17 nt, Human
cuccaggucucacgggc

SEQ ID NO: 2772668 - RNA, 20 nt, Human
cuccaguauucuugucaaaa

SEQ ID NO: 2772669 - RNA, 18 nt, Human
cuccaggucucacgggca

SEQ ID NO: 2772670 - RNA, 16 nt, Human
cuccaguccaaggaaa

SEQ ID NO: 2772671 - RNA, 13 nt, Human
cucagugccacua

SEQ ID NO: 2772672 - RNA, 16 nt, Human
cucagugccaacugug

SEQ ID NO: 2772673 - RNA, 19 nt, Human
cucagugccaacuguggcu

SEQ ID NO: 2772674 - RNA, 21 nt, Human
cucagugccaacuguggcugg

SEQ ID NO: 2772675 - RNA, 22 nt, Human
cucagugccaacuguggcuggu

SEQ ID NO: 2772676 - RNA, 23 nt, Human
cucagugccaacuguggcugguc

SEQ ID NO: 2772677 - RNA, 21 nt, Human
cucaguggcuucaucugucaa

SEQ ID NO: 2772678 - RNA, 18 nt, Human
cucaguggcuucaucugu

SEQ ID NO: 2772679 - RNA, 13 nt, Human
cucaucuugugaa

SEQ ID NO: 2772680 - RNA, 14 nt, Human
cucaucuugugaaa

SEQ ID NO: 2772681 - RNA, 16 nt, Human
cucaucuugugaaaug

SEQ ID NO: 2772682 - RNA, 19 nt, Human
cucaucuugaagggcccag

SEQ ID NO: 2772683 - RNA, 20 nt, Human
cucaucuugaagggcccagg

SEQ ID NO: 2772684 - RNA, 13 nt, Human
cucaugaaucugc

SEQ ID NO: 2772685 - RNA, 14 nt, Human
cucaucuuuuuacu

SEQ ID NO: 2772686 - RNA, 20 nt, Human
cucaugccucagccuccuga

SEQ ID NO: 2772687 - RNA, 18 nt, Human
cucaugccucagccuccu

SEQ ID NO: 2772688 - RNA, 20 nt, Human
cuccaacagaacuaaauguu

SEQ ID NO: 2772689 - RNA, 22 nt, Human
cuccaacagaacuaaauguucu

SEQ ID NO: 2772690 - RNA, 14 nt, Human
cuccaaauuuuucu

SEQ ID NO: 2772691 - RNA, 20 nt, Human
cuccaacacaaggcuccaag

SEQ ID NO: 2772692 - RNA, 21 nt, Human
cuccaacacaaggcuccaaga

SEQ ID NO: 2772693 - RNA, 23 nt, Human
cuccaacacaaggcuccaagacc

SEQ ID NO: 2772694 - RNA, 16 nt, Human
cuccaaaguuauccag

SEQ ID NO: 2772695 - RNA, 23 nt, Human
cuccaaaucucaaugaagccagc

SEQ ID NO: 2772696 - RNA, 15 nt, Human
cuccaaaggcccccu

SEQ ID NO: 2772697 - RNA, 14 nt, Human
cucagccuccugag

SEQ ID NO: 2772698 - RNA, 22 nt, Human
cucagccuccugaguagcugga

SEQ ID NO: 2772699 - RNA, 13 nt, Human
cucagccuccuga

SEQ ID NO: 2772700 - RNA, 12 nt, Human
cucagccuccug

SEQ ID NO: 2772701 - RNA, 16 nt, Human
cucagccuuacauuug

SEQ ID NO: 2772702 - RNA, 18 nt, Human
cucagccuuacauuugug

SEQ ID NO: 2772703 - RNA, 20 nt, Human
cucagcggcgaccgcccucc

SEQ ID NO: 2772704 - RNA, 14 nt, Human
cucagcgaaugaau

SEQ ID NO: 2772705 - RNA, 13 nt, Human
cucagccucccaa

SEQ ID NO: 2772706 - RNA, 16 nt, Human
cuaucccggcugcccu

SEQ ID NO: 2772707 - RNA, 15 nt, Human
cuaucccggcugccc

SEQ ID NO: 2772708 - RNA, 21 nt, Human
cuauccacugggcacaacugc

SEQ ID NO: 2772709 - RNA, 15 nt, Human
cuauccaugcaccaa

SEQ ID NO: 2772710 - RNA, 16 nt, Human
cuauccaugcaccaaa

SEQ ID NO: 2772711 - RNA, 17 nt, Human
cuauccaugcaccaaac

SEQ ID NO: 2772712 - RNA, 18 nt, Human
cuauccaugcaccaaacu

SEQ ID NO: 2772713 - RNA, 16 nt, Human
cucagccucccaaagu

SEQ ID NO: 2772714 - RNA, 14 nt, Human
cucagccucccaaa

SEQ ID NO: 2772715 - RNA, 21 nt, Human
cucagccucccaaagugcugg

SEQ ID NO: 2772716 - RNA, 15 nt, Human
cucagccucccaaag

SEQ ID NO: 2772717 - RNA, 17 nt, Human
cucagccucccaaagug

SEQ ID NO: 2772718 - RNA, 17 nt, Human
cuaucccggcugcccuu

SEQ ID NO: 2772719 - RNA, 13 nt, Human
cucagccucccga

SEQ ID NO: 2772720 - RNA, 22 nt, Human
cucagccucccaaagugcuggg

SEQ ID NO: 2772721 - RNA, 23 nt, Human
cucagccucccgaauagcuggga

SEQ ID NO: 2772722 - RNA, 13 nt, Human
cucagccucccag

SEQ ID NO: 2772723 - RNA, 20 nt, Human
cucagccuccggaguagcug

SEQ ID NO: 2772724 - RNA, 20 nt, Human
cucagccucccagagugcug

SEQ ID NO: 2772725 - RNA, 12 nt, Human
cucagccucccg

SEQ ID NO: 2772726 - RNA, 18 nt, Human
cucaggccaggugcagug

SEQ ID NO: 2772727 - RNA, 15 nt, Human
cucaggccaggugca

SEQ ID NO: 2772728 - RNA, 23 nt, Human
cgaccagacaccuugacagggca

SEQ ID NO: 2772729 - RNA, 12 nt, Human
cgaccaccugcc

SEQ ID NO: 2772730 - RNA, 14 nt, Human
cgaccaccugccca

SEQ ID NO: 2772731 - RNA, 22 nt, Human
cgacauagcccaucccugccug

SEQ ID NO: 2772732 - RNA, 13 nt, Human
cgacaucacuguu

SEQ ID NO: 2772733 - RNA, 17 nt, Human
cgacaucacuguucaug

SEQ ID NO: 2772734 - RNA, 22 nt, Human
cgacaggcgagagaggagccag

SEQ ID NO: 2772735 - RNA, 23 nt, Human
cgacaggcgagagaggagccaga

SEQ ID NO: 2772736 - RNA, 12 nt, Human
ccuuuugucuuc

SEQ ID NO: 2772737 - RNA, 21 nt, Human
ccuuuuggugaaagcugagaa

SEQ ID NO: 2772738 - RNA, 13 nt, Human
ccuuuuggugugu

SEQ ID NO: 2772739 - RNA, 12 nt, Human
ccuuuuguaaag

SEQ ID NO: 2772740 - RNA, 19 nt, Human
ccuuuuguugagccaggcc

SEQ ID NO: 2772741 - RNA, 12 nt, Human
ccuuuugccaau

SEQ ID NO: 2772742 - RNA, 19 nt, Human
ccuuuuguaccauggugug

SEQ ID NO: 2772743 - RNA, 17 nt, Human
ccuuuuguagaaugaac

SEQ ID NO: 2772744 - RNA, 19 nt, Human
ccuuuuguagaaugaacca

SEQ ID NO: 2772745 - RNA, 19 nt, Human
ccuuuuguauacauccugg

SEQ ID NO: 2772746 - RNA, 20 nt, Human
ccuuuuguauacauccuggg

SEQ ID NO: 2772747 - RNA, 21 nt, Human
ccuuuuguauacauccugggu

SEQ ID NO: 2772748 - RNA, 23 nt, Human
ccuuuuguauacauccuggguaa

SEQ ID NO: 2772749 - RNA, 13 nt, Human
ccuuuuucugauu

SEQ ID NO: 2772750 - RNA, 15 nt, Human
ccuuuuuaaaacaca

SEQ ID NO: 2772751 - RNA, 16 nt, Human
ccuuuuuccuagccug

SEQ ID NO: 2772752 - RNA, 19 nt, Human
ccuuuuuccuagccuguuu

SEQ ID NO: 2772753 - RNA, 14 nt, Human
ccuuuuucuccagc

SEQ ID NO: 2772754 - RNA, 16 nt, Human
ccuuuuucuccagcug

SEQ ID NO: 2772755 - RNA, 23 nt, Human
ccuugccauccuaaaagccaccc

SEQ ID NO: 2772756 - RNA, 17 nt, Human
ccuuuccccagcccagg

SEQ ID NO: 2772757 - RNA, 18 nt, Human
ccuuuccccagcccaggg

SEQ ID NO: 2772758 - RNA, 20 nt, Human
ccuuuccccgacgcccaccc

SEQ ID NO: 2772759 - RNA, 15 nt, Human
ccuuuccccuuccuu

SEQ ID NO: 2772760 - RNA, 16 nt, Human
ccuuuccccuuccuuu

SEQ ID NO: 2772761 - RNA, 13 nt, Human
ccuuuccccagcc

SEQ ID NO: 2772762 - RNA, 14 nt, Human
ccuuuccccagccc

SEQ ID NO: 2772763 - RNA, 15 nt, Human
ccuuuccccagccca

SEQ ID NO: 2772764 - RNA, 16 nt, Human
ccuuuccccagcccag

SEQ ID NO: 2772765 - RNA, 12 nt, Human
ccuuuccccagc

SEQ ID NO: 2772766 - RNA, 13 nt, Human
ccuuuccccagca

SEQ ID NO: 2772767 - RNA, 14 nt, Human
ccuuuccccagcau

SEQ ID NO: 2772768 - RNA, 16 nt, Human
ccuuuccccagcauca

SEQ ID NO: 2772769 - RNA, 17 nt, Human
ccuuuccccagcaucac

SEQ ID NO: 2772770 - RNA, 21 nt, Human
ccuuuccccagcaucacuccc

SEQ ID NO: 2772771 - RNA, 22 nt, Human
ccuuuccccagcaucacucccc

SEQ ID NO: 2772772 - RNA, 23 nt, Human
ccuuuccccagcaucacucccca

SEQ ID NO: 2772773 - RNA, 22 nt, Human
ccuuuucuggggaaagacacug

SEQ ID NO: 2772774 - RNA, 18 nt, Human
ccuuuucugucucucucu

SEQ ID NO: 2772775 - RNA, 9 nt, Human
ccuuuucuu

SEQ ID NO: 2772776 - RNA, 17 nt, Human
ccuuuucuucuauguag

SEQ ID NO: 2772777 - RNA, 15 nt, Human
ccuuuucuauuccuu

SEQ ID NO: 2772778 - RNA, 21 nt, Human
ccuuuucuauuccuucuggcc

SEQ ID NO: 2772779 - RNA, 22 nt, Human
ccuuuucuauuccuucuggccu

SEQ ID NO: 2772780 - RNA, 23 nt, Human
ccuuuugaaguaguuuguauaac

SEQ ID NO: 2772781 - RNA, 15 nt, Human
ccuuuugcagaagag

SEQ ID NO: 2772782 - RNA, 19 nt, Human
ccuuuugcagaagagggug

SEQ ID NO: 2772783 - RNA, 13 nt, Human
ccuuuucuuuugu

SEQ ID NO: 2772784 - RNA, 14 nt, Human
ccuuuucuuuuguu

SEQ ID NO: 2772785 - RNA, 15 nt, Human
ccuuuucuuuuguua

SEQ ID NO: 2772786 - RNA, 16 nt, Human
ccuuuucuuuuguuac

SEQ ID NO: 2772787 - RNA, 17 nt, Human
ccuuuucuuuuguuacu

SEQ ID NO: 2772788 - RNA, 18 nt, Human
ccuuuucuuuuguuacug

SEQ ID NO: 2772789 - RNA, 19 nt, Human
ccuuuucuuuuguuacugu

SEQ ID NO: 2772790 - RNA, 20 nt, Human
ccuuuucuuuuguuacuguu

SEQ ID NO: 2772791 - RNA, 21 nt, Human
ccuuuucuuuuguuacuguuc

SEQ ID NO: 2772792 - RNA, 22 nt, Human
ccuuuucuuuuguuacuguucu

SEQ ID NO: 2772793 - RNA, 23 nt, Human
ccuuuucuuuuguuacuguucuu

SEQ ID NO: 2772794 - RNA, 20 nt, Human
ccuuuagcgcccaguugggu

SEQ ID NO: 2772795 - RNA, 14 nt, Human
ccuuuagcgcccag

SEQ ID NO: 2772796 - RNA, 13 nt, Human
ccuuuagguucuu

SEQ ID NO: 2772797 - RNA, 16 nt, Human
ccuuuagccccuccca

SEQ ID NO: 2772798 - RNA, 14 nt, Human
ccuugcuuguuaca

SEQ ID NO: 2772799 - RNA, 22 nt, Human
ccuuggaaguugcauggcauca

SEQ ID NO: 2772800 - RNA, 15 nt, Human
ccuuggaaguuucau

SEQ ID NO: 2772801 - RNA, 22 nt, Human
ccuugccuaaauuuaaugcugc

SEQ ID NO: 2772802 - RNA, 23 nt, Human
ccuugccuaaauuuaaugcugcc

SEQ ID NO: 2772803 - RNA, 15 nt, Human
ccuugcuuuucccuc

SEQ ID NO: 2772804 - RNA, 16 nt, Human
ccuugcuuuucccucu

SEQ ID NO: 2772805 - RNA, 17 nt, Human
ccuugcuuuucccucuu

SEQ ID NO: 2772806 - RNA, 18 nt, Human
ccuugcuuuucccucuuu

SEQ ID NO: 2772807 - RNA, 19 nt, Human
ccuugcuuuucccucuuuu

SEQ ID NO: 2772808 - RNA, 20 nt, Human
ccuugcuuuucccucuuuuc

SEQ ID NO: 2772809 - RNA, 22 nt, Human
ccuugcuuuucccucuuuucuu

SEQ ID NO: 2772810 - RNA, 15 nt, Human
ccuucugacggcccu

SEQ ID NO: 2772811 - RNA, 16 nt, Human
ccuucugacggcccug

SEQ ID NO: 2772812 - RNA, 17 nt, Human
ccuucugacggcccugc

SEQ ID NO: 2772813 - RNA, 18 nt, Human
ccuucugacggcccugca

SEQ ID NO: 2772814 - RNA, 19 nt, Human
ccuucugacggcccugcaa

SEQ ID NO: 2772815 - RNA, 21 nt, Human
ccuucugacggcccugcaaug

SEQ ID NO: 2772816 - RNA, 17 nt, Human
ccuucuggccucccaca

SEQ ID NO: 2772817 - RNA, 16 nt, Human
ccuucuggaaacugug

SEQ ID NO: 2772818 - RNA, 19 nt, Human
ccuucuggaaacugugaag

SEQ ID NO: 2772819 - RNA, 17 nt, Human
ccuucugccuuugaugu

SEQ ID NO: 2772820 - RNA, 13 nt, Human
ccuucugaugucu

SEQ ID NO: 2772821 - RNA, 22 nt, Human
ccuucugaugucucuaaagcac

SEQ ID NO: 2772822 - RNA, 14 nt, Human
ccuggccucugugc

SEQ ID NO: 2772823 - RNA, 20 nt, Human
ccuucugaaaaaguauccug

SEQ ID NO: 2772824 - RNA, 18 nt, Human
ccuucuggccucccacag

SEQ ID NO: 2772825 - RNA, 20 nt, Human
ccuucuggccucccacagac

SEQ ID NO: 2772826 - RNA, 12 nt, Human
ccuucuggccuu

SEQ ID NO: 2772827 - RNA, 13 nt, Human
ccuucuggccuuu

SEQ ID NO: 2772828 - RNA, 20 nt, Human
ccuucugggcagaccuugac

SEQ ID NO: 2772829 - RNA, 18 nt, Human
ccuucugucccucacagc

SEQ ID NO: 2772830 - RNA, 19 nt, Human
ccuucugucccucacagca

SEQ ID NO: 2772831 - RNA, 16 nt, Human
cggaggggccuggcag

SEQ ID NO: 2772832 - RNA, 18 nt, Human
cggaggggccuggcagcc

SEQ ID NO: 2772833 - RNA, 13 nt, Human
cggagguugcagg

SEQ ID NO: 2772834 - RNA, 21 nt, Human
cggagggugggggccaccugc

SEQ ID NO: 2772835 - RNA, 22 nt, Human
cggagggugggggccaccugcc

SEQ ID NO: 2772836 - RNA, 23 nt, Human
cggagggugggggccaccugccu

SEQ ID NO: 2772837 - RNA, 22 nt, Human
cggagguugggugggccggcuu

SEQ ID NO: 2772838 - RNA, 19 nt, Human
cggagucagccaggagcug

SEQ ID NO: 2772839 - RNA, 14 nt, Human
cggagucccaccuu

SEQ ID NO: 2772840 - RNA, 20 nt, Human
cggcgaccgcccuccgcgaa

SEQ ID NO: 2772841 - RNA, 19 nt, Human
cggcggagcuggccccgcc

SEQ ID NO: 2772842 - RNA, 21 nt, Human
cggcggagcuggccccgccgc

SEQ ID NO: 2772843 - RNA, 13 nt, Human
cggcggagcuggc

SEQ ID NO: 2772844 - RNA, 16 nt, Human
cggcgcuucccagcac

SEQ ID NO: 2772845 - RNA, 16 nt, Human
cggcgccuggccucca

SEQ ID NO: 2772846 - RNA, 17 nt, Human
cggcgccuggccuccag

SEQ ID NO: 2772847 - RNA, 18 nt, Human
cggcgccuggccuccagg

SEQ ID NO: 2772848 - RNA, 22 nt, Human
cggcgcgcucuucgcgcccgcc

SEQ ID NO: 2772849 - RNA, 18 nt, Human
cggcgccccugccaccuc

SEQ ID NO: 2772850 - RNA, 18 nt, Human
cggcucacugcagccuca

SEQ ID NO: 2772851 - RNA, 15 nt, Human
cggcggaaagccugu

SEQ ID NO: 2772852 - RNA, 19 nt, Human
cggcucacugcagccucaa

SEQ ID NO: 2772853 - RNA, 17 nt, Human
cggcucacugcauccuc

SEQ ID NO: 2772854 - RNA, 20 nt, Human
cggcucgagcaguccugccu

SEQ ID NO: 2772855 - RNA, 12 nt, Human
cggagccccagg

SEQ ID NO: 2772856 - RNA, 15 nt, Human
cggagcaucccggag

SEQ ID NO: 2772857 - RNA, 16 nt, Human
cggagcaucccggagg

SEQ ID NO: 2772858 - RNA, 22 nt, Human
cggagcaucccggaggaaaucu

SEQ ID NO: 2772859 - RNA, 14 nt, Human
cggagccccaggcc

SEQ ID NO: 2772860 - RNA, 22 nt, Human
cggagccccaggccucuguguc

SEQ ID NO: 2772861 - RNA, 19 nt, Human
cggagauuggacggccuga

SEQ ID NO: 2772862 - RNA, 18 nt, Human
cggagauaugaagagcaa

SEQ ID NO: 2772863 - RNA, 12 nt, Human
cgccucucccac

SEQ ID NO: 2772864 - RNA, 16 nt, Human
cgccuccccugcccca

SEQ ID NO: 2772865 - RNA, 15 nt, Human
cgccucccagccugg

SEQ ID NO: 2772866 - RNA, 12 nt, Human
cgaccucggugg

SEQ ID NO: 2772867 - RNA, 16 nt, Human
cgaccagggccgagga

SEQ ID NO: 2772868 - RNA, 13 nt, Human
cgaccgcccccuc

SEQ ID NO: 2772869 - RNA, 17 nt, Human
cgaccagaggagccuuu

SEQ ID NO: 2772870 - RNA, 14 nt, Human
cgaccacuuccagg

SEQ ID NO: 2772871 - RNA, 16 nt, Human
cgaccagaggagccuu

SEQ ID NO: 2772872 - RNA, 16 nt, Human
cgaccugccucggccu

SEQ ID NO: 2772873 - RNA, 18 nt, Human
cgaccugguuuuuaaaua

SEQ ID NO: 2772874 - RNA, 16 nt, Human
cgaguagcugggacua

SEQ ID NO: 2772875 - RNA, 15 nt, Human
cgaguagcugggacu

SEQ ID NO: 2772876 - RNA, 14 nt, Human
cgaguagcugggac

SEQ ID NO: 2772877 - RNA, 13 nt, Human
cgaguagcuggga

SEQ ID NO: 2772878 - RNA, 20 nt, Human
cgaguggauuguaggugcaa

SEQ ID NO: 2772879 - RNA, 19 nt, Human
cgccgcaaaccacacugga

SEQ ID NO: 2772880 - RNA, 20 nt, Human
cgccgcaaaccacacuggac

SEQ ID NO: 2772881 - RNA, 19 nt, Human
cgaguucggcucugggugg

SEQ ID NO: 2772882 - RNA, 20 nt, Human
cgcaggcuggcccugcccug

SEQ ID NO: 2772883 - RNA, 19 nt, Human
cgcaggcuggcccugcccu

SEQ ID NO: 2772884 - RNA, 18 nt, Human
cgcaggcuggcccugccc

SEQ ID NO: 2772885 - RNA, 17 nt, Human
cgcaggcuggcccugcc

SEQ ID NO: 2772886 - RNA, 15 nt, Human
cgcaggcuggcccug

SEQ ID NO: 2772887 - RNA, 14 nt, Human
cgcaggcuggcccu

SEQ ID NO: 2772888 - RNA, 14 nt, Human
cgccuacaggagug

SEQ ID NO: 2772889 - RNA, 16 nt, Human
cgccgucuccauggca

SEQ ID NO: 2772890 - RNA, 20 nt, Human
cgccggggacagaggccugc

SEQ ID NO: 2772891 - RNA, 22 nt, Human
cgccggggacagaggccugccc

SEQ ID NO: 2772892 - RNA, 14 nt, Human
cgccgugggcugcg

SEQ ID NO: 2772893 - RNA, 18 nt, Human
cgccuaaggucacagcua

SEQ ID NO: 2772894 - RNA, 20 nt, Human
cgccuaaggucacagcuagu

SEQ ID NO: 2772895 - RNA, 15 nt, Human
cgccucccacugggg

SEQ ID NO: 2772896 - RNA, 16 nt, Human
cgccucccacuggggu

SEQ ID NO: 2772897 - RNA, 19 nt, Human
cgccucccacuggggucca

SEQ ID NO: 2772898 - RNA, 14 nt, Human
cgccucccagccug

SEQ ID NO: 2772899 - RNA, 11 nt, Human
cgccucccagc

SEQ ID NO: 2772900 - RNA, 20 nt, Human
cgccgccugguacucaagcc

SEQ ID NO: 2772901 - RNA, 16 nt, Human
cgccggggacagaggc

SEQ ID NO: 2772902 - RNA, 17 nt, Human
cgccggggacagaggcc

SEQ ID NO: 2772903 - RNA, 19 nt, Human
cgccggggacagaggccug

SEQ ID NO: 2772904 - RNA, 14 nt, Human
cgccgccugguacu

SEQ ID NO: 2772905 - RNA, 15 nt, Human
cgccgccugguacuc

SEQ ID NO: 2772906 - RNA, 21 nt, Human
cgccgcaaaccacacuggacu

SEQ ID NO: 2772907 - RNA, 22 nt, Human
cgccgcaaaccacacuggacuc

SEQ ID NO: 2772908 - RNA, 23 nt, Human
cgccgcaaaccacacuggacucc

SEQ ID NO: 2772909 - RNA, 13 nt, Human
cuacaugagaaca

SEQ ID NO: 2772910 - RNA, 18 nt, Human
cuacaugaaacagaaaca

SEQ ID NO: 2772911 - RNA, 16 nt, Human
cuacaugaaacagaaa

SEQ ID NO: 2772912 - RNA, 15 nt, Human
cuacaugaaacagaa

SEQ ID NO: 2772913 - RNA, 21 nt, Human
cuacaugaggaacuguagaug

SEQ ID NO: 2772914 - RNA, 13 nt, Human
cuaccucucuguc

SEQ ID NO: 2772915 - RNA, 14 nt, Human
cuaccucucugucc

SEQ ID NO: 2772916 - RNA, 16 nt, Human
cuaccucucugucccu

SEQ ID NO: 2772917 - RNA, 20 nt, Human
cuaccucucugucccuugcu

SEQ ID NO: 2772918 - RNA, 17 nt, Human
cuacaugagaacaaaca

SEQ ID NO: 2772919 - RNA, 14 nt, Human
cuacaugagaacaa

SEQ ID NO: 2772920 - RNA, 23 nt, Human
cuacauaaguaauucaagaaaac

SEQ ID NO: 2772921 - RNA, 14 nt, Human
cuacaugaaacaga

SEQ ID NO: 2772922 - RNA, 22 nt, Human
cuacauaaguaauucaagaaaa

SEQ ID NO: 2772923 - RNA, 12 nt, Human
cuacauaaauug

SEQ ID NO: 2772924 - RNA, 13 nt, Human
cuacauaaauugg

SEQ ID NO: 2772925 - RNA, 14 nt, Human
cuacaguuuuuccu

SEQ ID NO: 2772926 - RNA, 21 nt, Human
cuacaguuauguucagucaca

SEQ ID NO: 2772927 - RNA, 22 nt, Human
cuaagugauccucccaccucag

SEQ ID NO: 2772928 - RNA, 20 nt, Human
cuaagugauccucccaccuc

SEQ ID NO: 2772929 - RNA, 16 nt, Human
cuaagugaaauuucua

SEQ ID NO: 2772930 - RNA, 19 nt, Human
cuaagugaaauuucuagcc

SEQ ID NO: 2772931 - RNA, 16 nt, Human
cuaagugacauuugua

SEQ ID NO: 2772932 - RNA, 17 nt, Human
cuaagugacauuuguag

SEQ ID NO: 2772933 - RNA, 19 nt, Human
cuaauuggccucuuuaaga

SEQ ID NO: 2772934 - RNA, 17 nt, Human
cuaauugggaguccagg

SEQ ID NO: 2772935 - RNA, 23 nt, Human
cuaauugggaguccaggcacagg

SEQ ID NO: 2772936 - RNA, 14 nt, Human
cuaauuuaaaaaau

SEQ ID NO: 2772937 - RNA, 14 nt, Human
cuaauuuaaagaga

SEQ ID NO: 2772938 - RNA, 15 nt, Human
cuaauuuaaagagac

SEQ ID NO: 2772939 - RNA, 12 nt, Human
cuaauuuaaaaa

SEQ ID NO: 2772940 - RNA, 15 nt, Human
cuaauugcuguugaa

SEQ ID NO: 2772941 - RNA, 16 nt, Human
cuaauugcuguugaaa

SEQ ID NO: 2772942 - RNA, 18 nt, Human
cuaauugcuguugaaagc

SEQ ID NO: 2772943 - RNA, 19 nt, Human
cuaauugcuguugaaagca

SEQ ID NO: 2772944 - RNA, 21 nt, Human
cuaauugcuguugaaagcaaa

SEQ ID NO: 2772945 - RNA, 24 nt, Human
cuaauugcuguugaaagcaaaaau

SEQ ID NO: 2772946 - RNA, 23 nt, Human
cuacaaaaaauuagaaauuggcu

SEQ ID NO: 2772947 - RNA, 17 nt, Human
cuaauuuuuaagcaaaa

SEQ ID NO: 2772948 - RNA, 12 nt, Human
cuaauuuuuaag

SEQ ID NO: 2772949 - RNA, 20 nt, Human
cuaauuuuuguaauuuuagu

SEQ ID NO: 2772950 - RNA, 14 nt, Human
cuaauuuuuguaau

SEQ ID NO: 2772951 - RNA, 12 nt, Human
cuaauuuuucca

SEQ ID NO: 2772952 - RNA, 10 nt, Human
cuacaaauca

SEQ ID NO: 2772953 - RNA, 20 nt, Human
cuacaaagcacuagagaaug

SEQ ID NO: 2772954 - RNA, 12 nt, Human
cuacaaccaauu

SEQ ID NO: 2772955 - RNA, 16 nt, Human
cuacaacaagaguuua

SEQ ID NO: 2772956 - RNA, 12 nt, Human
cuacaacagccu

SEQ ID NO: 2772957 - RNA, 14 nt, Human
cuacaacagccuca

SEQ ID NO: 2772958 - RNA, 16 nt, Human
cuacaacagccucacu

SEQ ID NO: 2772959 - RNA, 19 nt, Human
cuaaagagcacuuacugua

SEQ ID NO: 2772960 - RNA, 23 nt, Human
cuaaacugcccccucugcccugc

SEQ ID NO: 2772961 - RNA, 20 nt, Human
cuaaacuuccccaucuucua

SEQ ID NO: 2772962 - RNA, 16 nt, Human
cuaaacuuccccaucu

SEQ ID NO: 2772963 - RNA, 14 nt, Human
cgugucuguauuua

SEQ ID NO: 2772964 - RNA, 22 nt, Human
cuaaacugcccccucugcccug

SEQ ID NO: 2772965 - RNA, 15 nt, Human
cgugugagugugaca

SEQ ID NO: 2772966 - RNA, 17 nt, Human
cgugugagugugacagg

SEQ ID NO: 2772967 - RNA, 20 nt, Human
cgugugagugugacagggcc

SEQ ID NO: 2772968 - RNA, 21 nt, Human
cgugugagugugacagggcca

SEQ ID NO: 2772969 - RNA, 22 nt, Human
cgugucuguauuuaugugugag

SEQ ID NO: 2772970 - RNA, 13 nt, Human
cgugucuuccacu

SEQ ID NO: 2772971 - RNA, 14 nt, Human
cgugucuuccacuu

SEQ ID NO: 2772972 - RNA, 20 nt, Human
cgugucuuccacuuugcaua

SEQ ID NO: 2772973 - RNA, 11 nt, Human
cgugggucaga

SEQ ID NO: 2772974 - RNA, 12 nt, Human
cgugggucagaa

SEQ ID NO: 2772975 - RNA, 14 nt, Human
cgugggucagaaga

SEQ ID NO: 2772976 - RNA, 14 nt, Human
cgugagccaccgcg

SEQ ID NO: 2772977 - RNA, 23 nt, Human
cguggguguguguagccaagguc

SEQ ID NO: 2772978 - RNA, 14 nt, Human
cguggguugcuaac

SEQ ID NO: 2772979 - RNA, 19 nt, Human
cguggguugcuaacugaac

SEQ ID NO: 2772980 - RNA, 21 nt, Human
cgugguccccaacagcgacau

SEQ ID NO: 2772981 - RNA, 13 nt, Human
cgugagaccugcc

SEQ ID NO: 2772982 - RNA, 20 nt, Human
cgugagcaggaaggccuggg

SEQ ID NO: 2772983 - RNA, 21 nt, Human
cgugagcaggaaggccugggu

SEQ ID NO: 2772984 - RNA, 12 nt, Human
cgugagaagcau

SEQ ID NO: 2772985 - RNA, 23 nt, Human
cgugagccaccgugccuggccac

SEQ ID NO: 2772986 - RNA, 16 nt, Human
cgugagaccugccccu

SEQ ID NO: 2772987 - RNA, 14 nt, Human
cgugagaccugccc

SEQ ID NO: 2772988 - RNA, 14 nt, Human
cgugacccucugcu

SEQ ID NO: 2772989 - RNA, 20 nt, Human
cgugacccucugcugaagac

SEQ ID NO: 2772990 - RNA, 15 nt, Human
cggcucugaagcaag

SEQ ID NO: 2772991 - RNA, 21 nt, Human
cggcucugaagcaaggcggug

SEQ ID NO: 2772992 - RNA, 13 nt, Human
cggcucugggugg

SEQ ID NO: 2772993 - RNA, 15 nt, Human
cuaacuguacauuuc

SEQ ID NO: 2772994 - RNA, 10 nt, Human
cuaacuguau

SEQ ID NO: 2772995 - RNA, 17 nt, Human
cuaaccuggguucccuu

SEQ ID NO: 2772996 - RNA, 18 nt, Human
cuaaagauucuauaguuc

SEQ ID NO: 2772997 - RNA, 21 nt, Human
cuaaagauagagucauugcug

SEQ ID NO: 2772998 - RNA, 12 nt, Human
cuaaccuguguc

SEQ ID NO: 2772999 - RNA, 13 nt, Human
cuaaccugugucu

SEQ ID NO: 2773000 - RNA, 14 nt, Human
cuaaccugugucug

SEQ ID NO: 2773001 - RNA, 15 nt, Human
cuaaccugugucugc

SEQ ID NO: 2773002 - RNA, 15 nt, Human
cuaaccuuauccugc

SEQ ID NO: 2773003 - RNA, 22 nt, Human
cuaaccuuauccugcauuguua

SEQ ID NO: 2773004 - RNA, 12 nt, Human
cuaaccuugaau

SEQ ID NO: 2773005 - RNA, 14 nt, Human
cuaaccuugaaugc

SEQ ID NO: 2773006 - RNA, 16 nt, Human
cuaaccuugaaugcug

SEQ ID NO: 2773007 - RNA, 17 nt, Human
cuaaccuugaaugcugc

SEQ ID NO: 2773008 - RNA, 18 nt, Human
cuaaccuugaaugcugcc

SEQ ID NO: 2773009 - RNA, 19 nt, Human
cuaaccuugaaugcugcca

SEQ ID NO: 2773010 - RNA, 20 nt, Human
cuaaccuugaaugcugccag

SEQ ID NO: 2773011 - RNA, 21 nt, Human
cuaaccuugaaugcugccagu

SEQ ID NO: 2773012 - RNA, 18 nt, Human
cuaaagaguuuauuuuaa

SEQ ID NO: 2773013 - RNA, 19 nt, Human
cuaaagaguuuauuuuaag

SEQ ID NO: 2773014 - RNA, 15 nt, Human
cuaaagauaauauua

SEQ ID NO: 2773015 - RNA, 17 nt, Human
cuaaagauggaguuucu

SEQ ID NO: 2773016 - RNA, 18 nt, Human
cuaaagauggaguuucua

SEQ ID NO: 2773017 - RNA, 19 nt, Human
cuaaagauggaguuucuaa

SEQ ID NO: 2773018 - RNA, 20 nt, Human
cuaaagauggaguuucuaag

SEQ ID NO: 2773019 - RNA, 21 nt, Human
cuaaagauggaguuucuaagg

SEQ ID NO: 2773020 - RNA, 23 nt, Human
cuaaagauggaguuucuaagguc

SEQ ID NO: 2773021 - RNA, 12 nt, Human
cuaaagauucua

SEQ ID NO: 2773022 - RNA, 14 nt, Human
cuaaagauucuaua

SEQ ID NO: 2773023 - RNA, 17 nt, Human
cuaaagauucuauaguu

SEQ ID NO: 2773024 - RNA, 12 nt, Human
cuaacuguaucu

SEQ ID NO: 2773025 - RNA, 13 nt, Human
cuaacuguaucuu

SEQ ID NO: 2773026 - RNA, 18 nt, Human
cuaacuuaagaaauaaau

SEQ ID NO: 2773027 - RNA, 19 nt, Human
cuaacuuauuuuauuucca

SEQ ID NO: 2773028 - RNA, 22 nt, Human
cuaacuuauuuuauuuccauca

SEQ ID NO: 2773029 - RNA, 17 nt, Human
cuaagaaacccucuguc

SEQ ID NO: 2773030 - RNA, 14 nt, Human
cuaagaaacuuuug

SEQ ID NO: 2773031 - RNA, 16 nt, Human
cuaagaaacuuuugua

SEQ ID NO: 2773032 - RNA, 17 nt, Human
cuaagaaacuuuuguaa

SEQ ID NO: 2773033 - RNA, 18 nt, Human
cuaagaaacuuuuguaaa

SEQ ID NO: 2773034 - RNA, 20 nt, Human
cuaagaaacuuuuguaaaga

SEQ ID NO: 2773035 - RNA, 19 nt, Human
cuaacuuuucaaugacauu

SEQ ID NO: 2773036 - RNA, 13 nt, Human
cuagaagaagcua

SEQ ID NO: 2773037 - RNA, 18 nt, Human
cuagaacucuccaucuua

SEQ ID NO: 2773038 - RNA, 22 nt, Human
cuagaacacaggcaaaauccuu

SEQ ID NO: 2773039 - RNA, 21 nt, Human
cuagaacacaggcaaaauccu

SEQ ID NO: 2773040 - RNA, 10 nt, Human
cuagaacuuu

SEQ ID NO: 2773041 - RNA, 11 nt, Human
cuagaacuuuu

SEQ ID NO: 2773042 - RNA, 13 nt, Human
cuagaacuuuuuu

SEQ ID NO: 2773043 - RNA, 15 nt, Human
cuagaacuuuuuuaa

SEQ ID NO: 2773044 - RNA, 16 nt, Human
cuagaacuuuuuuaaa

SEQ ID NO: 2773045 - RNA, 17 nt, Human
cuagaacuuuuuuaaau

SEQ ID NO: 2773046 - RNA, 18 nt, Human
cuagaacuuuuuuaaaua

SEQ ID NO: 2773047 - RNA, 19 nt, Human
cuagaacuuuuuuaaauaa

SEQ ID NO: 2773048 - RNA, 20 nt, Human
cuagaacuuuuuuaaauaaa

SEQ ID NO: 2773049 - RNA, 21 nt, Human
cuagaacuuuuuuaaauaaac

SEQ ID NO: 2773050 - RNA, 22 nt, Human
cuagaacuuuuuuaaauaaacu

SEQ ID NO: 2773051 - RNA, 23 nt, Human
cuagaacuuuuuuaaauaaacuu

SEQ ID NO: 2773052 - RNA, 13 nt, Human
cuagcaugccaac

SEQ ID NO: 2773053 - RNA, 15 nt, Human
cuagcaugccaacaa

SEQ ID NO: 2773054 - RNA, 21 nt, Human
cuagcaugccaacaagaaugc

SEQ ID NO: 2773055 - RNA, 16 nt, Human
cuagcaguaaaagaug

SEQ ID NO: 2773056 - RNA, 17 nt, Human
cuagcaguaaaagauga

SEQ ID NO: 2773057 - RNA, 17 nt, Human
cuagcagugaacuauuu

SEQ ID NO: 2773058 - RNA, 13 nt, Human
cuagccccugugg

SEQ ID NO: 2773059 - RNA, 19 nt, Human
cuagcccaggagagagaaa

SEQ ID NO: 2773060 - RNA, 20 nt, Human
cuagcccaggagagagaaag

SEQ ID NO: 2773061 - RNA, 22 nt, Human
cuagcccaggagagagaaagcc

SEQ ID NO: 2773062 - RNA, 23 nt, Human
cuagcccaggagagagaaagcca

SEQ ID NO: 2773063 - RNA, 14 nt, Human
cuagcccaggagag

SEQ ID NO: 2773064 - RNA, 15 nt, Human
cuagcccaggagaga

SEQ ID NO: 2773065 - RNA, 16 nt, Human
cuagcccaggagagag

SEQ ID NO: 2773066 - RNA, 17 nt, Human
cuagcccaggagagaga

SEQ ID NO: 2773067 - RNA, 18 nt, Human
cuagcccaggagagagaa

SEQ ID NO: 2773068 - RNA, 19 nt, Human
cuagaacacaggcaaaauc

SEQ ID NO: 2773069 - RNA, 14 nt, Human
cuagaacacaggca

SEQ ID NO: 2773070 - RNA, 16 nt, Human
cuagaaauugacacaa

SEQ ID NO: 2773071 - RNA, 20 nt, Human
cuagaaauugacacaagugg

SEQ ID NO: 2773072 - RNA, 18 nt, Human
cuagaaauugccuauccu

SEQ ID NO: 2773073 - RNA, 19 nt, Human
cuagaaaugugaaugagga

SEQ ID NO: 2773074 - RNA, 18 nt, Human
cuaccucgcaucauugca

SEQ ID NO: 2773075 - RNA, 20 nt, Human
cuaguugccaaaucuggcuc

SEQ ID NO: 2773076 - RNA, 18 nt, Human
cuaguuggugagaaaccu

SEQ ID NO: 2773077 - RNA, 19 nt, Human
cuaguuggugagaaaccug

SEQ ID NO: 2773078 - RNA, 18 nt, Human
cuauaaccccagcucccu

SEQ ID NO: 2773079 - RNA, 20 nt, Human
cuauaacaccugccaccacu

SEQ ID NO: 2773080 - RNA, 12 nt, Human
cuauaacagaua

SEQ ID NO: 2773081 - RNA, 22 nt, Human
cuauaaccccagcucccuagga

SEQ ID NO: 2773082 - RNA, 12 nt, Human
cuauaacuugau

SEQ ID NO: 2773083 - RNA, 15 nt, Human
cuauaacuugaugca

SEQ ID NO: 2773084 - RNA, 16 nt, Human
cuauaacuugaugcau

SEQ ID NO: 2773085 - RNA, 17 nt, Human
cuauaacuugaugcaug

SEQ ID NO: 2773086 - RNA, 22 nt, Human
cuauaacuugaugcaugugguu

SEQ ID NO: 2773087 - RNA, 21 nt, Human
cuauaacauauguacauaaau

SEQ ID NO: 2773088 - RNA, 19 nt, Human
cuagcccucucacauuuau

SEQ ID NO: 2773089 - RNA, 14 nt, Human
cuagcccucucccu

SEQ ID NO: 2773090 - RNA, 16 nt, Human
cuagcccucucccucu

SEQ ID NO: 2773091 - RNA, 21 nt, Human
cuagcccucucccucuaggcu

SEQ ID NO: 2773092 - RNA, 18 nt, Human
cuagcccucucacauuua

SEQ ID NO: 2773093 - RNA, 13 nt, Human
cuagcccucucac

SEQ ID NO: 2773094 - RNA, 14 nt, Human
cuagccccugugga

SEQ ID NO: 2773095 - RNA, 20 nt, Human
cuagccccuguggagacugg

SEQ ID NO: 2773096 - RNA, 21 nt, Human
cuagccccuguggagacuggg

SEQ ID NO: 2773097 - RNA, 11 nt, Human
cuaggcugggg

SEQ ID NO: 2773098 - RNA, 20 nt, Human
cuagccuaggucauaaagag

SEQ ID NO: 2773099 - RNA, 18 nt, Human
cuagccuauuuaccugca

SEQ ID NO: 2773100 - RNA, 21 nt, Human
cuagccuauuuaccugcaggc

SEQ ID NO: 2773101 - RNA, 22 nt, Human
cuagccuauuuaccugcaggcu

SEQ ID NO: 2773102 - RNA, 23 nt, Human
cuagccuauuuaccugcaggcug

SEQ ID NO: 2773103 - RNA, 15 nt, Human
cuagccugcacuuug

SEQ ID NO: 2773104 - RNA, 19 nt, Human
cuagccugcacuuugaugu

SEQ ID NO: 2773105 - RNA, 13 nt, Human
cuaggcuggggaa

SEQ ID NO: 2773106 - RNA, 22 nt, Human
cuaggcuggggaaguccucugg

SEQ ID NO: 2773107 - RNA, 16 nt, Human
cuagggauucaggcug

SEQ ID NO: 2773108 - RNA, 15 nt, Human
cuagggauucaggcu

SEQ ID NO: 2773109 - RNA, 18 nt, Human
cuagggauucaggcugcu

SEQ ID NO: 2773110 - RNA, 17 nt, Human
cuagggauucaggcugc

SEQ ID NO: 2773111 - RNA, 20 nt, Human
cuagggauucaggcugcuug

SEQ ID NO: 2773112 - RNA, 15 nt, Human
cuagggccacugaag

SEQ ID NO: 2773113 - RNA, 14 nt, Human
cuagggcugggaaa

SEQ ID NO: 2773114 - RNA, 15 nt, Human
cuagggcugggaaac

SEQ ID NO: 2773115 - RNA, 16 nt, Human
cuagggcugggaaaca

SEQ ID NO: 2773116 - RNA, 20 nt, Human
cuagggcugggaaacacucc

SEQ ID NO: 2773117 - RNA, 19 nt, Human
cccagccaccccgggcucu

SEQ ID NO: 2773118 - RNA, 14 nt, Human
cccagccaccccgg

SEQ ID NO: 2773119 - RNA, 22 nt, Human
cccagccaccccgggcucucug

SEQ ID NO: 2773120 - RNA, 22 nt, Human
cccagcugcaccugccagccug

SEQ ID NO: 2773121 - RNA, 21 nt, Human
cccagcugcaccugccagccu

SEQ ID NO: 2773122 - RNA, 18 nt, Human
cccagcugcaccugccag

SEQ ID NO: 2773123 - RNA, 13 nt, Human
cccagcugcaccu

SEQ ID NO: 2773124 - RNA, 12 nt, Human
cccagcugcacc

SEQ ID NO: 2773125 - RNA, 12 nt, Human
cccagccacccc

SEQ ID NO: 2773126 - RNA, 23 nt, Human
cccauauuggcauggauuucugu

SEQ ID NO: 2773127 - RNA, 15 nt, Human
cccauaggcccacac

SEQ ID NO: 2773128 - RNA, 17 nt, Human
cccauaggcccacacac

SEQ ID NO: 2773129 - RNA, 18 nt, Human
cccauaggcccacacaca

SEQ ID NO: 2773130 - RNA, 19 nt, Human
cccauaggcccacacacag

SEQ ID NO: 2773131 - RNA, 20 nt, Human
cccauaggcccacacacagg

SEQ ID NO: 2773132 - RNA, 22 nt, Human
cccauaggcccacacacaggug

SEQ ID NO: 2773133 - RNA, 15 nt, Human
cccauagaaacauga

SEQ ID NO: 2773134 - RNA, 17 nt, Human
cccauagaaacaugaca

SEQ ID NO: 2773135 - RNA, 19 nt, Human
cccauagaaacaugacacu

SEQ ID NO: 2773136 - RNA, 21 nt, Human
cccauagaaacaugacacuga

SEQ ID NO: 2773137 - RNA, 22 nt, Human
cccauagaaacaugacacugac

SEQ ID NO: 2773138 - RNA, 23 nt, Human
cccauagaaacaugacacugacc

SEQ ID NO: 2773139 - RNA, 16 nt, Human
cccauagaucuucuga

SEQ ID NO: 2773140 - RNA, 17 nt, Human
cccauagaucuucugaa

SEQ ID NO: 2773141 - RNA, 22 nt, Human
cccauagaucuucugaaaugaa

SEQ ID NO: 2773142 - RNA, 13 nt, Human
cccagggccugag

SEQ ID NO: 2773143 - RNA, 19 nt, Human
cccagggccugagccuggc

SEQ ID NO: 2773144 - RNA, 15 nt, Human
cccagggccugagcc

SEQ ID NO: 2773145 - RNA, 20 nt, Human
cccagggccagggcccugca

SEQ ID NO: 2773146 - RNA, 16 nt, Human
cccauacucagccugc

SEQ ID NO: 2773147 - RNA, 22 nt, Human
cccauacucagccugcugccca

SEQ ID NO: 2773148 - RNA, 19 nt, Human
cccagggccugcaggaccu

SEQ ID NO: 2773149 - RNA, 16 nt, Human
cccagggccugcagga

SEQ ID NO: 2773150 - RNA, 14 nt, Human
cccagggccugcag

SEQ ID NO: 2773151 - RNA, 22 nt, Human
cccagggccagggcccugcaga

SEQ ID NO: 2773152 - RNA, 17 nt, Human
cccaggcuggcgugcag

SEQ ID NO: 2773153 - RNA, 21 nt, Human
cccagggccagggcccugcag

SEQ ID NO: 2773154 - RNA, 13 nt, Human
cccaggcuggcgu

SEQ ID NO: 2773155 - RNA, 19 nt, Human
cccaggcuggagugcagug

SEQ ID NO: 2773156 - RNA, 20 nt, Human
cccaggcuggagugcaauga

SEQ ID NO: 2773157 - RNA, 17 nt, Human
cccagcuuguaggagcu

SEQ ID NO: 2773158 - RNA, 18 nt, Human
cccagcuuguaggagcug

SEQ ID NO: 2773159 - RNA, 23 nt, Human
cccagcugcaccugccagccugg

SEQ ID NO: 2773160 - RNA, 15 nt, Human
cccagcuugaaaccu

SEQ ID NO: 2773161 - RNA, 13 nt, Human
cccacugcucugg

SEQ ID NO: 2773162 - RNA, 12 nt, Human
cccacugcucug

SEQ ID NO: 2773163 - RNA, 19 nt, Human
cccacugcuuuuggucugu

SEQ ID NO: 2773164 - RNA, 23 nt, Human
cccacuguuucucuugagcuggc

SEQ ID NO: 2773165 - RNA, 22 nt, Human
cccacuguuucucuugagcugg

SEQ ID NO: 2773166 - RNA, 21 nt, Human
cccacuguuucucuugagcug

SEQ ID NO: 2773167 - RNA, 16 nt, Human
cccacugugcaggugc

SEQ ID NO: 2773168 - RNA, 12 nt, Human
cccacuucucau

SEQ ID NO: 2773169 - RNA, 18 nt, Human
cccacuucucaucacaca

SEQ ID NO: 2773170 - RNA, 19 nt, Human
cccacuucucaucacacac

SEQ ID NO: 2773171 - RNA, 20 nt, Human
cccacuucucaucacacaca

SEQ ID NO: 2773172 - RNA, 21 nt, Human
cccacuucucaucacacacau

SEQ ID NO: 2773173 - RNA, 22 nt, Human
cccacuucucaucacacacaug

SEQ ID NO: 2773174 - RNA, 23 nt, Human
cccacuucucaucacacacaugg

SEQ ID NO: 2773175 - RNA, 18 nt, Human
cccacuucucucuaagga

SEQ ID NO: 2773176 - RNA, 13 nt, Human
cccacugccagca

SEQ ID NO: 2773177 - RNA, 17 nt, Human
cccacuccccaccuuca

SEQ ID NO: 2773178 - RNA, 21 nt, Human
cccacugccagcagcagcagg

SEQ ID NO: 2773179 - RNA, 17 nt, Human
cccacugccagcagcag

SEQ ID NO: 2773180 - RNA, 16 nt, Human
cccacugccagcagca

SEQ ID NO: 2773181 - RNA, 15 nt, Human
cccacugccagcagc

SEQ ID NO: 2773182 - RNA, 14 nt, Human
cccacugccagcag

SEQ ID NO: 2773183 - RNA, 18 nt, Human
cccacuagccuaggucau

SEQ ID NO: 2773184 - RNA, 18 nt, Human
cccacuauccuucgugaa

SEQ ID NO: 2773185 - RNA, 18 nt, Human
cccacucagcuccgugaa

SEQ ID NO: 2773186 - RNA, 12 nt, Human
cccacccuggga

SEQ ID NO: 2773187 - RNA, 13 nt, Human
cccacguucuuuc

SEQ ID NO: 2773188 - RNA, 18 nt, Human
cccacuagacccacugga

SEQ ID NO: 2773189 - RNA, 12 nt, Human
cccacccugcug

SEQ ID NO: 2773190 - RNA, 14 nt, Human
cccacccugcugcc

SEQ ID NO: 2773191 - RNA, 16 nt, Human
cccacccugcugccuu

SEQ ID NO: 2773192 - RNA, 15 nt, Human
cccacccucccugga

SEQ ID NO: 2773193 - RNA, 18 nt, Human
cccacccucccuggagug

SEQ ID NO: 2773194 - RNA, 13 nt, Human
cccacccuccugg

SEQ ID NO: 2773195 - RNA, 14 nt, Human
cccacccuccuggc

SEQ ID NO: 2773196 - RNA, 16 nt, Human
cccacccucccuggag

SEQ ID NO: 2773197 - RNA, 12 nt, Human
cccacccccauc

SEQ ID NO: 2773198 - RNA, 13 nt, Human
cccacccccagcu

SEQ ID NO: 2773199 - RNA, 19 nt, Human
ccccaaacgggcugcccug

SEQ ID NO: 2773200 - RNA, 18 nt, Human
ccccaaacaccuuccagc

SEQ ID NO: 2773201 - RNA, 22 nt, Human
ccccaaacaccuuccagcuccu

SEQ ID NO: 2773202 - RNA, 11 nt, Human
ccccagcacua

SEQ ID NO: 2773203 - RNA, 22 nt, Human
ccccagcaagugagagcugggu

SEQ ID NO: 2773204 - RNA, 18 nt, Human
ccccagcaccucagccug

SEQ ID NO: 2773205 - RNA, 21 nt, Human
ccccagcaagugagagcuggg

SEQ ID NO: 2773206 - RNA, 23 nt, Human
ccccagagcuguuuauggccuca

SEQ ID NO: 2773207 - RNA, 22 nt, Human
ccccagagcuguuuauggccuc

SEQ ID NO: 2773208 - RNA, 21 nt, Human
ccccagagcuguuuauggccu

SEQ ID NO: 2773209 - RNA, 12 nt, Human
ccccagagcugu

SEQ ID NO: 2773210 - RNA, 11 nt, Human
ccccagagcug

SEQ ID NO: 2773211 - RNA, 14 nt, Human
ccccagagccacac

SEQ ID NO: 2773212 - RNA, 15 nt, Human
ccccagagccacaca

SEQ ID NO: 2773213 - RNA, 17 nt, Human
ccccagagccacacaug

SEQ ID NO: 2773214 - RNA, 18 nt, Human
ccccagagccacacaugg

SEQ ID NO: 2773215 - RNA, 22 nt, Human
cccccaaagcagcccuuccccc

SEQ ID NO: 2773216 - RNA, 20 nt, Human
ccccauuugcuuucuuuucu

SEQ ID NO: 2773217 - RNA, 14 nt, Human
ccccaucucuacua

SEQ ID NO: 2773218 - RNA, 16 nt, Human
ccccaucucucccucc

SEQ ID NO: 2773219 - RNA, 12 nt, Human
ccccaucucucc

SEQ ID NO: 2773220 - RNA, 19 nt, Human
ccccaucucucccuccccu

SEQ ID NO: 2773221 - RNA, 22 nt, Human
ccccaucucgcucccucccagg

SEQ ID NO: 2773222 - RNA, 23 nt, Human
ccccgaggccuucucugaaggac

SEQ ID NO: 2773223 - RNA, 12 nt, Human
ccccgaggcccu

SEQ ID NO: 2773224 - RNA, 15 nt, Human
ccccgaggcccugca

SEQ ID NO: 2773225 - RNA, 16 nt, Human
ccccgaggcccugcau

SEQ ID NO: 2773226 - RNA, 17 nt, Human
ccccgaggcccugcaug

SEQ ID NO: 2773227 - RNA, 13 nt, Human
ccccggcaggccc

SEQ ID NO: 2773228 - RNA, 14 nt, Human
ccccggcaggcccu

SEQ ID NO: 2773229 - RNA, 17 nt, Human
ccccggcaggcccugca

SEQ ID NO: 2773230 - RNA, 18 nt, Human
ccccggcaggcccugcag

SEQ ID NO: 2773231 - RNA, 21 nt, Human
ccccggcaggcccugcagugu

SEQ ID NO: 2773232 - RNA, 14 nt, Human
ccccggcagacgcc

SEQ ID NO: 2773233 - RNA, 15 nt, Human
ccccggaucagagca

SEQ ID NO: 2773234 - RNA, 14 nt, Human
ccccggcacccucu

SEQ ID NO: 2773235 - RNA, 17 nt, Human
ccccggcacccucuggc

SEQ ID NO: 2773236 - RNA, 20 nt, Human
ccccgcuguaagcuccuuug

SEQ ID NO: 2773237 - RNA, 22 nt, Human
ccccgcuguaagcuccuuugug

SEQ ID NO: 2773238 - RNA, 16 nt, Human
ccccggccaccucugc

SEQ ID NO: 2773239 - RNA, 17 nt, Human
ccccggccaccucugcg

SEQ ID NO: 2773240 - RNA, 12 nt, Human
ccccggccaccu

SEQ ID NO: 2773241 - RNA, 13 nt, Human
ccccggccaccuc

SEQ ID NO: 2773242 - RNA, 14 nt, Human
ccccggccaccucu

SEQ ID NO: 2773243 - RNA, 15 nt, Human
ccccggccaccucug

SEQ ID NO: 2773244 - RNA, 13 nt, Human
cccgggaggcaga

SEQ ID NO: 2773245 - RNA, 15 nt, Human
cccgggagggcggca

SEQ ID NO: 2773246 - RNA, 23 nt, Human
cccgggagggcggcacaggucgg

SEQ ID NO: 2773247 - RNA, 17 nt, Human
cccuauugguaaagaau

SEQ ID NO: 2773248 - RNA, 18 nt, Human
cccgggacgcagcaggag

SEQ ID NO: 2773249 - RNA, 12 nt, Human
cccgggagccua

SEQ ID NO: 2773250 - RNA, 13 nt, Human
cccgggagccuag

SEQ ID NO: 2773251 - RNA, 16 nt, Human
cccgggagccuaggac

SEQ ID NO: 2773252 - RNA, 18 nt, Human
cccgggagccuaggacca

SEQ ID NO: 2773253 - RNA, 19 nt, Human
cccgggagccuaggaccac

SEQ ID NO: 2773254 - RNA, 20 nt, Human
cccggcucuacgggggccgc

SEQ ID NO: 2773255 - RNA, 18 nt, Human
cccggcucuacgggggcc

SEQ ID NO: 2773256 - RNA, 22 nt, Human
cccggcucgagcaguccugccu

SEQ ID NO: 2773257 - RNA, 16 nt, Human
cccggcuccaggcucc

SEQ ID NO: 2773258 - RNA, 15 nt, Human
cccggcuccaggcuc

SEQ ID NO: 2773259 - RNA, 14 nt, Human
cccggcuccaggcu

SEQ ID NO: 2773260 - RNA, 13 nt, Human
cccggcuccaggc

SEQ ID NO: 2773261 - RNA, 12 nt, Human
cccggcuccagg

SEQ ID NO: 2773262 - RNA, 11 nt, Human
cccggcuccag

SEQ ID NO: 2773263 - RNA, 14 nt, Human
ccccucuucugagc

SEQ ID NO: 2773264 - RNA, 12 nt, Human
ccccucugucuu

SEQ ID NO: 2773265 - RNA, 18 nt, Human
ccccucugucuacaaaua

SEQ ID NO: 2773266 - RNA, 15 nt, Human
ccccuuguccuuucc

SEQ ID NO: 2773267 - RNA, 18 nt, Human
ccccuuguccuuucccuu

SEQ ID NO: 2773268 - RNA, 22 nt, Human
ccccuugcucuccccugcccug

SEQ ID NO: 2773269 - RNA, 17 nt, Human
ccccuuggcagguccug

SEQ ID NO: 2773270 - RNA, 23 nt, Human
ccccuuuccuggacacucagacc

SEQ ID NO: 2773271 - RNA, 10 nt, Human
ccccuuuccu

SEQ ID NO: 2773272 - RNA, 22 nt, Human
ccccuuuccuggacacucagac

SEQ ID NO: 2773273 - RNA, 14 nt, Human
ccccuuugggcccu

SEQ ID NO: 2773274 - RNA, 15 nt, Human
ccccuuugggcccug

SEQ ID NO: 2773275 - RNA, 16 nt, Human
ccccuuugggcccugc

SEQ ID NO: 2773276 - RNA, 17 nt, Human
ccccuuugggcccugca

SEQ ID NO: 2773277 - RNA, 18 nt, Human
ccccuuugggcccugcau

SEQ ID NO: 2773278 - RNA, 19 nt, Human
ccccuuugggcccugcaug

SEQ ID NO: 2773279 - RNA, 20 nt, Human
ccccuuugggcccugcaugu

SEQ ID NO: 2773280 - RNA, 14 nt, Human
cccgaauagcuggg

SEQ ID NO: 2773281 - RNA, 17 nt, Human
ccccuuuuucuuccuca

SEQ ID NO: 2773282 - RNA, 20 nt, Human
ccccuuuuuugucccccaac

SEQ ID NO: 2773283 - RNA, 18 nt, Human
ccccuuuuuuuccuuuuu

SEQ ID NO: 2773284 - RNA, 12 nt, Human
cccggccaccuc

SEQ ID NO: 2773285 - RNA, 13 nt, Human
cccggccaccucu

SEQ ID NO: 2773286 - RNA, 14 nt, Human
cccggccaccucug

SEQ ID NO: 2773287 - RNA, 15 nt, Human
cccggccaccucugc

SEQ ID NO: 2773288 - RNA, 20 nt, Human
cccggccaccucugcggacc

SEQ ID NO: 2773289 - RNA, 21 nt, Human
cccggccaccucugcggaccc

SEQ ID NO: 2773290 - RNA, 20 nt, Human
cccgaagaauggagaggaac

SEQ ID NO: 2773291 - RNA, 15 nt, Human
cccgaagggccccca

SEQ ID NO: 2773292 - RNA, 18 nt, Human
cccgaagggcccccacau

SEQ ID NO: 2773293 - RNA, 22 nt, Human
cccgaagguuauggucaauccc

SEQ ID NO: 2773294 - RNA, 23 nt, Human
cccgaagguuauggucaauccca

SEQ ID NO: 2773295 - RNA, 11 nt, Human
ccccucuguag

SEQ ID NO: 2773296 - RNA, 18 nt, Human
ccccucuggcuccagcug

SEQ ID NO: 2773297 - RNA, 19 nt, Human
ccccucuggcuccagcugg

SEQ ID NO: 2773298 - RNA, 15 nt, Human
ccagauccucuuggu

SEQ ID NO: 2773299 - RNA, 12 nt, Human
ccagauccuggg

SEQ ID NO: 2773300 - RNA, 14 nt, Human
ccagauccucuugg

SEQ ID NO: 2773301 - RNA, 13 nt, Human
ccagaucagucag

SEQ ID NO: 2773302 - RNA, 17 nt, Human
ccagaucauguuuuggu

SEQ ID NO: 2773303 - RNA, 20 nt, Human
ccagaucauguuuuggugaa

SEQ ID NO: 2773304 - RNA, 18 nt, Human
ccagaguuccccaugcag

SEQ ID NO: 2773305 - RNA, 19 nt, Human
ccagaguuccccaugcaga

SEQ ID NO: 2773306 - RNA, 21 nt, Human
ccagaguuccccaugcagaca

SEQ ID NO: 2773307 - RNA, 13 nt, Human
ccagaguggccug

SEQ ID NO: 2773308 - RNA, 21 nt, Human
ccagaguccuuuccaaggcuu

SEQ ID NO: 2773309 - RNA, 16 nt, Human
ccagaguccuuuccaa

SEQ ID NO: 2773310 - RNA, 17 nt, Human
ccagaguggccuggcca

SEQ ID NO: 2773311 - RNA, 16 nt, Human
ccagaguggccuggcc

SEQ ID NO: 2773312 - RNA, 15 nt, Human
ccagaguggccuggc

SEQ ID NO: 2773313 - RNA, 14 nt, Human
ccagaguggccugg

SEQ ID NO: 2773314 - RNA, 21 nt, Human
ccagaguggggaugacaugca

SEQ ID NO: 2773315 - RNA, 23 nt, Human
ccagaguggccuggccaggagcu

SEQ ID NO: 2773316 - RNA, 22 nt, Human
ccagaguggccuggccaggagc

SEQ ID NO: 2773317 - RNA, 21 nt, Human
ccagaguggccuggccaggag

SEQ ID NO: 2773318 - RNA, 19 nt, Human
ccagaguggccuggccagg

SEQ ID NO: 2773319 - RNA, 18 nt, Human
ccagaguggccuggccag

SEQ ID NO: 2773320 - RNA, 16 nt, Human
ccaccuuggcucaagu

SEQ ID NO: 2773321 - RNA, 18 nt, Human
ccaccuagaacacuaacu

SEQ ID NO: 2773322 - RNA, 16 nt, Human
ccaccuagaacacuaa

SEQ ID NO: 2773323 - RNA, 15 nt, Human
ccagaugcaccagcc

SEQ ID NO: 2773324 - RNA, 17 nt, Human
ccagaugcaccagcccu

SEQ ID NO: 2773325 - RNA, 18 nt, Human
ccagaugcaccagcccuu

SEQ ID NO: 2773326 - RNA, 15 nt, Human
ccagcagcagcaggu

SEQ ID NO: 2773327 - RNA, 14 nt, Human
ccagcagcagcagg

SEQ ID NO: 2773328 - RNA, 18 nt, Human
ccagcagcagcaggugau

SEQ ID NO: 2773329 - RNA, 23 nt, Human
ccagcaggccggaucgguacugu

SEQ ID NO: 2773330 - RNA, 15 nt, Human
ccagcuacccugugu

SEQ ID NO: 2773331 - RNA, 16 nt, Human
ccagcuacccuuuuuc

SEQ ID NO: 2773332 - RNA, 21 nt, Human
ccagcuacccuuuuucuccag

SEQ ID NO: 2773333 - RNA, 22 nt, Human
ccagcuacccuuuuucuccagc

SEQ ID NO: 2773334 - RNA, 23 nt, Human
ccagcuacucagaagccugaggc

SEQ ID NO: 2773335 - RNA, 21 nt, Human
ccagcuacucagaagccugag

SEQ ID NO: 2773336 - RNA, 20 nt, Human
ccagcuacucagaagccuga

SEQ ID NO: 2773337 - RNA, 17 nt, Human
ccagcuacucagaagcc

SEQ ID NO: 2773338 - RNA, 16 nt, Human
ccagcuacucagaagc

SEQ ID NO: 2773339 - RNA, 14 nt, Human
ccagcuacucagaa

SEQ ID NO: 2773340 - RNA, 16 nt, Human
ccagcucaccagcccc

SEQ ID NO: 2773341 - RNA, 15 nt, Human
ccagcucaccagccc

SEQ ID NO: 2773342 - RNA, 22 nt, Human
ccagcucaccagccccagugcc

SEQ ID NO: 2773343 - RNA, 17 nt, Human
ccagcucaauggacugg

SEQ ID NO: 2773344 - RNA, 22 nt, Human
ccagcucaauggacuggaaggg

SEQ ID NO: 2773345 - RNA, 13 nt, Human
ccagcucacagug

SEQ ID NO: 2773346 - RNA, 15 nt, Human
ccaggaaacucuugc

SEQ ID NO: 2773347 - RNA, 17 nt, Human
ccaggaaacucuugcua

SEQ ID NO: 2773348 - RNA, 14 nt, Human
ccaggaacugggcc

SEQ ID NO: 2773349 - RNA, 19 nt, Human
ccaggaaaggauuuuauaa

SEQ ID NO: 2773350 - RNA, 18 nt, Human
ccaguuuaaccugaugca

SEQ ID NO: 2773351 - RNA, 23 nt, Human
ccaguuuagauuucaagaaaaaa

SEQ ID NO: 2773352 - RNA, 17 nt, Human
ccaguuuaaccugaugc

SEQ ID NO: 2773353 - RNA, 10 nt, Human
ccaguugugg

SEQ ID NO: 2773354 - RNA, 20 nt, Human
ccaugacaggccugaagaua

SEQ ID NO: 2773355 - RNA, 21 nt, Human
ccaugacaggccugaagauau

SEQ ID NO: 2773356 - RNA, 24 nt, Human
ccaucccaggacaccacacccagc

SEQ ID NO: 2773357 - RNA, 22 nt, Human
ccaucccucgugguccccaaca

SEQ ID NO: 2773358 - RNA, 14 nt, Human
ccaucccaggacac

SEQ ID NO: 2773359 - RNA, 21 nt, Human
ccaucccaggacaccacaccc

SEQ ID NO: 2773360 - RNA, 22 nt, Human
ccaucccaggacaccacaccca

SEQ ID NO: 2773361 - RNA, 23 nt, Human
ccaucccaggacaccacacccag

SEQ ID NO: 2773362 - RNA, 14 nt, Human
ccaugaccauacug

SEQ ID NO: 2773363 - RNA, 18 nt, Human
ccaugacccaggcugggc

SEQ ID NO: 2773364 - RNA, 16 nt, Human
ccaugacccaggcugg

SEQ ID NO: 2773365 - RNA, 17 nt, Human
ccaugacccaggcuggg

SEQ ID NO: 2773366 - RNA, 14 nt, Human
ccaugacccaggcu

SEQ ID NO: 2773367 - RNA, 15 nt, Human
ccaugacccaggcug

SEQ ID NO: 2773368 - RNA, 23 nt, Human
ccaugagccucagcauccuggca

SEQ ID NO: 2773369 - RNA, 21 nt, Human
ccaugagccucagcauccugg

SEQ ID NO: 2773370 - RNA, 14 nt, Human
ccauguaaauacca

SEQ ID NO: 2773371 - RNA, 20 nt, Human
ccauguaaauaccagacugc

SEQ ID NO: 2773372 - RNA, 23 nt, Human
ccauguaaauaccagacugcagg

SEQ ID NO: 2773373 - RNA, 20 nt, Human
ccaugguuaagaguccaaga

SEQ ID NO: 2773374 - RNA, 19 nt, Human
ccauguccaaagaggcugc

SEQ ID NO: 2773375 - RNA, 18 nt, Human
ccauguccaaagaggcug

SEQ ID NO: 2773376 - RNA, 23 nt, Human
ccauguauggaaucccacuguau

SEQ ID NO: 2773377 - RNA, 23 nt, Human
ccauguauuuaucucuauuuaau

SEQ ID NO: 2773378 - RNA, 16 nt, Human
ccauguauuuaucucu

SEQ ID NO: 2773379 - RNA, 22 nt, Human
ccauguauuuaucucuauuuaa

SEQ ID NO: 2773380 - RNA, 17 nt, Human
ccauguccaaagaggcu

SEQ ID NO: 2773381 - RNA, 14 nt, Human
ccauguccaaagag

SEQ ID NO: 2773382 - RNA, 13 nt, Human
ccauguccaaaga

SEQ ID NO: 2773383 - RNA, 20 nt, Human
ccaguuggguggaugccugg

SEQ ID NO: 2773384 - RNA, 19 nt, Human
ccaguuggguggaugccug

SEQ ID NO: 2773385 - RNA, 17 nt, Human
ccaguuggguggaugcc

SEQ ID NO: 2773386 - RNA, 17 nt, Human
ccaguucauugcacuuu

SEQ ID NO: 2773387 - RNA, 18 nt, Human
ccaguucauugcacuuug

SEQ ID NO: 2773388 - RNA, 19 nt, Human
ccaguucaaucucccgcug

SEQ ID NO: 2773389 - RNA, 21 nt, Human
ccaguucaggagucccaagga

SEQ ID NO: 2773390 - RNA, 18 nt, Human
ccaguucaggagucccaa

SEQ ID NO: 2773391 - RNA, 14 nt, Human
ccaguucaggaguc

SEQ ID NO: 2773392 - RNA, 20 nt, Human
ccagggcuuaccuguacacu

SEQ ID NO: 2773393 - RNA, 21 nt, Human
ccagggcuuaccuguacacug

SEQ ID NO: 2773394 - RNA, 22 nt, Human
ccagggcuuaccuguacacuga

SEQ ID NO: 2773395 - RNA, 21 nt, Human
ccaggcuccuuuagcgcccag

SEQ ID NO: 2773396 - RNA, 20 nt, Human
ccaggcuccuuuagcgccca

SEQ ID NO: 2773397 - RNA, 16 nt, Human
ccaggcuggcgugcag

SEQ ID NO: 2773398 - RNA, 18 nt, Human
ccaggcagaucugugccc

SEQ ID NO: 2773399 - RNA, 18 nt, Human
ccaggcuggcgugcagug

SEQ ID NO: 2773400 - RNA, 17 nt, Human
ccaggcuggcgugcagu

SEQ ID NO: 2773401 - RNA, 19 nt, Human
ccaggcuggcgugcagugg

SEQ ID NO: 2773402 - RNA, 17 nt, Human
ccaggcagaucugugcc

SEQ ID NO: 2773403 - RNA, 13 nt, Human
ccaggcagaucug

SEQ ID NO: 2773404 - RNA, 16 nt, Human
ccaggcacgguuugga

SEQ ID NO: 2773405 - RNA, 16 nt, Human
ccaggcacugcugccc

SEQ ID NO: 2773406 - RNA, 18 nt, Human
ccaggcacugcugcccag

SEQ ID NO: 2773407 - RNA, 19 nt, Human
ccaggcacccagcuuuguc

SEQ ID NO: 2773408 - RNA, 15 nt, Human
ccaggcaccaucucc

SEQ ID NO: 2773409 - RNA, 14 nt, Human
ccaggcacagcuga

SEQ ID NO: 2773410 - RNA, 15 nt, Human
ccaggcacagcugag

SEQ ID NO: 2773411 - RNA, 16 nt, Human
ccaggcacagcugagu

SEQ ID NO: 2773412 - RNA, 23 nt, Human
ccaggcacagcugaguuaugaug

SEQ ID NO: 2773413 - RNA, 11 nt, Human
ccaggcacagg

SEQ ID NO: 2773414 - RNA, 13 nt, Human
ccaggcacaggau

SEQ ID NO: 2773415 - RNA, 13 nt, Human
ccagggucccugg

SEQ ID NO: 2773416 - RNA, 13 nt, Human
ccucugcuuccca

SEQ ID NO: 2773417 - RNA, 14 nt, Human
ccucugcuucccag

SEQ ID NO: 2773418 - RNA, 15 nt, Human
ccucugcuucccagg

SEQ ID NO: 2773419 - RNA, 15 nt, Human
ccucugcugccaugg

SEQ ID NO: 2773420 - RNA, 14 nt, Human
ccucugcugcuguc

SEQ ID NO: 2773421 - RNA, 19 nt, Human
ccucugcugcugucccucc

SEQ ID NO: 2773422 - RNA, 20 nt, Human
ccucugcugcugucccuccc

SEQ ID NO: 2773423 - RNA, 14 nt, Human
ccucucuccuuugc

SEQ ID NO: 2773424 - RNA, 12 nt, Human
ccucucucccuc

SEQ ID NO: 2773425 - RNA, 16 nt, Human
ccucucucccucuccc

SEQ ID NO: 2773426 - RNA, 20 nt, Human
ccucucucuucugcuccacc

SEQ ID NO: 2773427 - RNA, 19 nt, Human
ccucucucuucugcuccac

SEQ ID NO: 2773428 - RNA, 18 nt, Human
ccucucucuucugcucca

SEQ ID NO: 2773429 - RNA, 16 nt, Human
ccucucucuucugcuc

SEQ ID NO: 2773430 - RNA, 12 nt, Human
ccucucucuucu

SEQ ID NO: 2773431 - RNA, 12 nt, Human
ccucucugcacc

SEQ ID NO: 2773432 - RNA, 22 nt, Human
ccucucucuucugcuccacccu

SEQ ID NO: 2773433 - RNA, 21 nt, Human
ccucucucuucugcuccaccc

SEQ ID NO: 2773434 - RNA, 14 nt, Human
ccucugcugccaug

SEQ ID NO: 2773435 - RNA, 20 nt, Human
ccucugcugaagacuugccc

SEQ ID NO: 2773436 - RNA, 18 nt, Human
ccucugcugauccuccca

SEQ ID NO: 2773437 - RNA, 15 nt, Human
ccucugcugauccuc

SEQ ID NO: 2773438 - RNA, 22 nt, Human
ccucugccugaagucacacagu

SEQ ID NO: 2773439 - RNA, 12 nt, Human
ccucugccuguc

SEQ ID NO: 2773440 - RNA, 14 nt, Human
ccucugcuccccag

SEQ ID NO: 2773441 - RNA, 13 nt, Human
ccucugcucccca

SEQ ID NO: 2773442 - RNA, 12 nt, Human
ccucucugcccu

SEQ ID NO: 2773443 - RNA, 13 nt, Human
ccucuuggguuca

SEQ ID NO: 2773444 - RNA, 12 nt, Human
ccucuuguuuug

SEQ ID NO: 2773445 - RNA, 15 nt, Human
ccucuuguuuuguuu

SEQ ID NO: 2773446 - RNA, 11 nt, Human
ccucuuuaaaa

SEQ ID NO: 2773447 - RNA, 13 nt, Human
ccucuuuaaaaca

SEQ ID NO: 2773448 - RNA, 15 nt, Human
ccucuuuaaaacaaa

SEQ ID NO: 2773449 - RNA, 17 nt, Human
ccucuuuaaaacaaaac

SEQ ID NO: 2773450 - RNA, 18 nt, Human
ccucuuuaaaacaaaaca

SEQ ID NO: 2773451 - RNA, 12 nt, Human
ccucuuuaagag

SEQ ID NO: 2773452 - RNA, 16 nt, Human
ccugaccucacuguga

SEQ ID NO: 2773453 - RNA, 12 nt, Human
ccugaccucuug

SEQ ID NO: 2773454 - RNA, 13 nt, Human
ccugaccucuugc

SEQ ID NO: 2773455 - RNA, 14 nt, Human
ccugaccucuugcu

SEQ ID NO: 2773456 - RNA, 15 nt, Human
ccugaccucuugcug

SEQ ID NO: 2773457 - RNA, 16 nt, Human
ccugaccucuugcugu

SEQ ID NO: 2773458 - RNA, 17 nt, Human
ccugaccucuugcuguc

SEQ ID NO: 2773459 - RNA, 18 nt, Human
ccugaccucuugcugucu

SEQ ID NO: 2773460 - RNA, 19 nt, Human
ccugaccucuugcugucuc

SEQ ID NO: 2773461 - RNA, 20 nt, Human
ccugaccucuugcugucucu

SEQ ID NO: 2773462 - RNA, 21 nt, Human
ccugaccucuugcugucucug

SEQ ID NO: 2773463 - RNA, 23 nt, Human
ccugaccucuugcugucucugcu

SEQ ID NO: 2773464 - RNA, 24 nt, Human
ccugaccucuugcugucucugcuc

SEQ ID NO: 2773465 - RNA, 14 nt, Human
ccugacugcccagc

SEQ ID NO: 2773466 - RNA, 16 nt, Human
ccugacugcccagcau

SEQ ID NO: 2773467 - RNA, 22 nt, Human
ccugacugcccagcauuugggu

SEQ ID NO: 2773468 - RNA, 15 nt, Human
ccugacucugccccc

SEQ ID NO: 2773469 - RNA, 16 nt, Human
ccugacucugcccccu

SEQ ID NO: 2773470 - RNA, 17 nt, Human
ccugacucugcccccug

SEQ ID NO: 2773471 - RNA, 22 nt, Human
ccugacucugcccccugcuggc

SEQ ID NO: 2773472 - RNA, 13 nt, Human
ccugacugucucc

SEQ ID NO: 2773473 - RNA, 19 nt, Human
ccugacuuggggagaugga

SEQ ID NO: 2773474 - RNA, 23 nt, Human
ccugacuuggggagauggaguuc

SEQ ID NO: 2773475 - RNA, 15 nt, Human
ccugagaaagcccug

SEQ ID NO: 2773476 - RNA, 15 nt, Human
ccugagaagcugcuc

SEQ ID NO: 2773477 - RNA, 16 nt, Human
ccugagaagcugcucc

SEQ ID NO: 2773478 - RNA, 17 nt, Human
ccugagaagcugcucca

SEQ ID NO: 2773479 - RNA, 19 nt, Human
ccugagaagcugcuccagg

SEQ ID NO: 2773480 - RNA, 22 nt, Human
ccugagaagcugcuccaggccu

SEQ ID NO: 2773481 - RNA, 23 nt, Human
ccugagaagcugcuccaggccug

SEQ ID NO: 2773482 - RNA, 18 nt, Human
ccugacucucugugaccu

SEQ ID NO: 2773483 - RNA, 12 nt, Human
ccugacucugcc

SEQ ID NO: 2773484 - RNA, 13 nt, Human
ccugacucugccc

SEQ ID NO: 2773485 - RNA, 14 nt, Human
ccugacucugcccc

SEQ ID NO: 2773486 - RNA, 17 nt, Human
ccugacucucugugacc

SEQ ID NO: 2773487 - RNA, 16 nt, Human
ccugacucucugugac

SEQ ID NO: 2773488 - RNA, 15 nt, Human
ccugacucucuguga

SEQ ID NO: 2773489 - RNA, 13 nt, Human
ccugacucucugu

SEQ ID NO: 2773490 - RNA, 22 nt, Human
ccugcacuugcagacucuacag

SEQ ID NO: 2773491 - RNA, 18 nt, Human
ccugcacuuugaugucau

SEQ ID NO: 2773492 - RNA, 19 nt, Human
ccugcacuuugaugucaug

SEQ ID NO: 2773493 - RNA, 22 nt, Human
ccugcacuuugaugucaugugu

SEQ ID NO: 2773494 - RNA, 19 nt, Human
ccugcacuugcagacucua

SEQ ID NO: 2773495 - RNA, 20 nt, Human
ccugaguagcuggauuacag

SEQ ID NO: 2773496 - RNA, 15 nt, Human
ccugaguagcuggau

SEQ ID NO: 2773497 - RNA, 19 nt, Human
ccugaguagcuggauuaca

SEQ ID NO: 2773498 - RNA, 16 nt, Human
ccugcagcuaguccua

SEQ ID NO: 2773499 - RNA, 20 nt, Human
ccugagaggggaagcggccc

SEQ ID NO: 2773500 - RNA, 15 nt, Human
ccugagaggggaagc

SEQ ID NO: 2773501 - RNA, 15 nt, Human
ccugagauccccuga

SEQ ID NO: 2773502 - RNA, 17 nt, Human
ccugagauccccugagc

SEQ ID NO: 2773503 - RNA, 18 nt, Human
ccugagauccccugagcc

SEQ ID NO: 2773504 - RNA, 22 nt, Human
ccugagaagugucuaaaaacac

SEQ ID NO: 2773505 - RNA, 14 nt, Human
ccugagaaauguua

SEQ ID NO: 2773506 - RNA, 22 nt, Human
ccugagaauaagaaaguuucac

SEQ ID NO: 2773507 - RNA, 12 nt, Human
ccugagaccaca

SEQ ID NO: 2773508 - RNA, 18 nt, Human
ccugagaccacagagaga

SEQ ID NO: 2773509 - RNA, 18 nt, Human
ccugagaccauuuaacau

SEQ ID NO: 2773510 - RNA, 13 nt, Human
ccugagacccagg

SEQ ID NO: 2773511 - RNA, 14 nt, Human
ccugagacccagga

SEQ ID NO: 2773512 - RNA, 15 nt, Human
ccugagacccaggac

SEQ ID NO: 2773513 - RNA, 18 nt, Human
ccugagacccaggacucc

SEQ ID NO: 2773514 - RNA, 15 nt, Human
ccugagagaauuggc

SEQ ID NO: 2773515 - RNA, 18 nt, Human
ccugagagaauuggcuca

SEQ ID NO: 2773516 - RNA, 18 nt, Human
ccugagagacauggcuuu

SEQ ID NO: 2773517 - RNA, 17 nt, Human
ccugcaggaccugccug

SEQ ID NO: 2773518 - RNA, 16 nt, Human
ccugcaggaccugccu

SEQ ID NO: 2773519 - RNA, 15 nt, Human
ccugcaggaccugcc

SEQ ID NO: 2773520 - RNA, 15 nt, Human
ccuggccgcccccug

SEQ ID NO: 2773521 - RNA, 20 nt, Human
ccuggccgcccccugccccc

SEQ ID NO: 2773522 - RNA, 12 nt, Human
ccuggccgcccc

SEQ ID NO: 2773523 - RNA, 14 nt, Human
ccuggccgcccccu

SEQ ID NO: 2773524 - RNA, 12 nt, Human
ccuggcccugcc

SEQ ID NO: 2773525 - RNA, 13 nt, Human
ccuggcccugccc

SEQ ID NO: 2773526 - RNA, 16 nt, Human
ccuggcccugcccuga

SEQ ID NO: 2773527 - RNA, 17 nt, Human
ccuggcccugcccugag

SEQ ID NO: 2773528 - RNA, 16 nt, Human
ccugcccaggccccug

SEQ ID NO: 2773529 - RNA, 22 nt, Human
ccugcccaggccccugccaccc

SEQ ID NO: 2773530 - RNA, 15 nt, Human
ccugcccaggccccu

SEQ ID NO: 2773531 - RNA, 14 nt, Human
ccugcccaggcccc

SEQ ID NO: 2773532 - RNA, 17 nt, Human
ccugcuggcucuucugc

SEQ ID NO: 2773533 - RNA, 19 nt, Human
ccugcuggcucuucugccc

SEQ ID NO: 2773534 - RNA, 12 nt, Human
ccugcuggcucu

SEQ ID NO: 2773535 - RNA, 13 nt, Human
ccugcuggcucuu

SEQ ID NO: 2773536 - RNA, 16 nt, Human
ccugcccaugggagcu

SEQ ID NO: 2773537 - RNA, 14 nt, Human
ccugcccauuucau

SEQ ID NO: 2773538 - RNA, 23 nt, Human
ccugccccaaauaacuucagucc

SEQ ID NO: 2773539 - RNA, 21 nt, Human
ccugcccauucugcccugugg

SEQ ID NO: 2773540 - RNA, 13 nt, Human
ccugcccaggccg

SEQ ID NO: 2773541 - RNA, 15 nt, Human
ccugcccaggccggc

SEQ ID NO: 2773542 - RNA, 16 nt, Human
ccugcccaggccggcc

SEQ ID NO: 2773543 - RNA, 18 nt, Human
ccugcccaggccggccag

SEQ ID NO: 2773544 - RNA, 22 nt, Human
ccugcccaggccggccagccuc

SEQ ID NO: 2773545 - RNA, 23 nt, Human
ccugcccaggccggccagccuca

SEQ ID NO: 2773546 - RNA, 15 nt, Human
ccugcuggguaaacu

SEQ ID NO: 2773547 - RNA, 17 nt, Human
ccuggagcccuccgccu

SEQ ID NO: 2773548 - RNA, 21 nt, Human
ccuggagcccuccgccuucac

SEQ ID NO: 2773549 - RNA, 22 nt, Human
ccuggagcguuucuagcaagug

SEQ ID NO: 2773550 - RNA, 17 nt, Human
ccugcuggguaaacugu

SEQ ID NO: 2773551 - RNA, 16 nt, Human
ccuggaggauuucauc

SEQ ID NO: 2773552 - RNA, 14 nt, Human
ccuggaggcacuga

SEQ ID NO: 2773553 - RNA, 22 nt, Human
ccuggaggcacugaagugcuua

SEQ ID NO: 2773554 - RNA, 21 nt, Human
ccuggcacacaucaggaguuc

SEQ ID NO: 2773555 - RNA, 14 nt, Human
ccuggcacaggacu

SEQ ID NO: 2773556 - RNA, 15 nt, Human
ccuggcacaggacug

SEQ ID NO: 2773557 - RNA, 16 nt, Human
ccuggcacaggacuga

SEQ ID NO: 2773558 - RNA, 18 nt, Human
ccuggcacaggacugauu

SEQ ID NO: 2773559 - RNA, 24 nt, Human
ccuggcacaggacugauucuggga

SEQ ID NO: 2773560 - RNA, 18 nt, Human
ccuggauccccucugucu

SEQ ID NO: 2773561 - RNA, 21 nt, Human
ccuggauccaucaggccacuu

SEQ ID NO: 2773562 - RNA, 19 nt, Human
ccuggagugcccacccugg

SEQ ID NO: 2773563 - RNA, 19 nt, Human
ccuggaguguggcugagga

SEQ ID NO: 2773564 - RNA, 20 nt, Human
ccuggaguguggcugaggag

SEQ ID NO: 2773565 - RNA, 21 nt, Human
ccuggaguguggcugaggagg

SEQ ID NO: 2773566 - RNA, 18 nt, Human
ccuggauauuauucuugu

SEQ ID NO: 2773567 - RNA, 16 nt, Human
ccuggaguugcauuga

SEQ ID NO: 2773568 - RNA, 15 nt, Human
ccuggaguuugggau

SEQ ID NO: 2773569 - RNA, 22 nt, Human
ccuggauauuauucuuguaguu

SEQ ID NO: 2773570 - RNA, 19 nt, Human
ccuggaucacgacgcugca

SEQ ID NO: 2773571 - RNA, 21 nt, Human
ccuggaucacgacgcugcaga

SEQ ID NO: 2773572 - RNA, 22 nt, Human
ccuggaucacgacgcugcagag

SEQ ID NO: 2773573 - RNA, 23 nt, Human
ccuggaucacgacgcugcagagc

SEQ ID NO: 2773574 - RNA, 15 nt, Human
ccuggaguauaauau

SEQ ID NO: 2773575 - RNA, 18 nt, Human
ccuggaggauugcaggug

SEQ ID NO: 2773576 - RNA, 16 nt, Human
ccuggcacagggcagu

SEQ ID NO: 2773577 - RNA, 17 nt, Human
ccuggcacagggcagug

SEQ ID NO: 2773578 - RNA, 18 nt, Human
ccuggcacagggcagugg

SEQ ID NO: 2773579 - RNA, 13 nt, Human
ccucagccuccug

SEQ ID NO: 2773580 - RNA, 22 nt, Human
ccucagccucccaaguagcugg

SEQ ID NO: 2773581 - RNA, 23 nt, Human
ccucagccgacugcacagcggcc

SEQ ID NO: 2773582 - RNA, 19 nt, Human
ccucagccucccaaagugc

SEQ ID NO: 2773583 - RNA, 22 nt, Human
ccucagccucccgaauagcugg

SEQ ID NO: 2773584 - RNA, 23 nt, Human
ccucagccucccaaagugcuggg

SEQ ID NO: 2773585 - RNA, 12 nt, Human
ccucagccuccg

SEQ ID NO: 2773586 - RNA, 21 nt, Human
ccucagccucccaaagugcug

SEQ ID NO: 2773587 - RNA, 16 nt, Human
ccucauuacugggccu

SEQ ID NO: 2773588 - RNA, 21 nt, Human
ccuccaagcuccaucuccacu

SEQ ID NO: 2773589 - RNA, 22 nt, Human
ccuccaagcuccaucuccacuc

SEQ ID NO: 2773590 - RNA, 20 nt, Human
ccucauuaaccgaugcuuua

SEQ ID NO: 2773591 - RNA, 13 nt, Human
ccucauguuuaug

SEQ ID NO: 2773592 - RNA, 17 nt, Human
ccucauguuuaugaaaa

SEQ ID NO: 2773593 - RNA, 18 nt, Human
ccucauguuuaugaaaau

SEQ ID NO: 2773594 - RNA, 14 nt, Human
ccucccaggcgccc

SEQ ID NO: 2773595 - RNA, 20 nt, Human
ccucccaggcgccccuuccc

SEQ ID NO: 2773596 - RNA, 20 nt, Human
ccucccagcuuguaggagcu

SEQ ID NO: 2773597 - RNA, 17 nt, Human
ccucccaggacucugac

SEQ ID NO: 2773598 - RNA, 22 nt, Human
ccucccaggacucugaccccag

SEQ ID NO: 2773599 - RNA, 20 nt, Human
ccucccaagcuggcuggggu

SEQ ID NO: 2773600 - RNA, 14 nt, Human
ccucccaaggagaa

SEQ ID NO: 2773601 - RNA, 15 nt, Human
ccucccaaggagaac

SEQ ID NO: 2773602 - RNA, 18 nt, Human
ccucccaaggagaacaaa

SEQ ID NO: 2773603 - RNA, 21 nt, Human
ccucccaaggagaacaaauau

SEQ ID NO: 2773604 - RNA, 23 nt, Human
ccucccaaggagaacaaauauuc

SEQ ID NO: 2773605 - RNA, 12 nt, Human
ccucccagccug

SEQ ID NO: 2773606 - RNA, 12 nt, Human
ccucccagaggu

SEQ ID NO: 2773607 - RNA, 16 nt, Human
ccucccagagguccag

SEQ ID NO: 2773608 - RNA, 18 nt, Human
ccucccagagguccagcc

SEQ ID NO: 2773609 - RNA, 19 nt, Human
ccucccagagguccagccc

SEQ ID NO: 2773610 - RNA, 20 nt, Human
ccucccagagguccagccca

SEQ ID NO: 2773611 - RNA, 21 nt, Human
ccucccagagguccagcccau

SEQ ID NO: 2773612 - RNA, 22 nt, Human
ccucccagagguccagcccauc

SEQ ID NO: 2773613 - RNA, 23 nt, Human
ccucccagagguccagcccaucu

SEQ ID NO: 2773614 - RNA, 16 nt, Human
ccucaagaucauucag

SEQ ID NO: 2773615 - RNA, 22 nt, Human
ccucagccucccaaagugcugg

SEQ ID NO: 2773616 - RNA, 11 nt, Human
ccucagccucc

SEQ ID NO: 2773617 - RNA, 20 nt, Human
ccucagccuagacccuccuc

SEQ ID NO: 2773618 - RNA, 19 nt, Human
ccucagccuagacccuccu

SEQ ID NO: 2773619 - RNA, 16 nt, Human
ccucagccuagacccu

SEQ ID NO: 2773620 - RNA, 14 nt, Human
ccucagccuagacc

SEQ ID NO: 2773621 - RNA, 16 nt, Human
ccucaaccuccugggc

SEQ ID NO: 2773622 - RNA, 17 nt, Human
ccuauuugccaugggcu

SEQ ID NO: 2773623 - RNA, 14 nt, Human
ccuauuugacuuac

SEQ ID NO: 2773624 - RNA, 12 nt, Human
ccucaaccucuu

SEQ ID NO: 2773625 - RNA, 16 nt, Human
ccucaaccuccugugg

SEQ ID NO: 2773626 - RNA, 20 nt, Human
ccucaaccuccuguggaacc

SEQ ID NO: 2773627 - RNA, 17 nt, Human
ccucaaccucuucuggc

SEQ ID NO: 2773628 - RNA, 20 nt, Human
ccucaaccucuucuggcuca

SEQ ID NO: 2773629 - RNA, 18 nt, Human
ccucaacguauuguuucg

SEQ ID NO: 2773630 - RNA, 15 nt, Human
ccuauuucaguacuu

SEQ ID NO: 2773631 - RNA, 20 nt, Human
ccuauuucaguacuucagca

SEQ ID NO: 2773632 - RNA, 18 nt, Human
ccuauuuccauucaacaa

SEQ ID NO: 2773633 - RNA, 12 nt, Human
ccuauuguugau

SEQ ID NO: 2773634 - RNA, 16 nt, Human
ccuauuuaccugcagg

SEQ ID NO: 2773635 - RNA, 22 nt, Human
ccggcuaugggggcacugagga

SEQ ID NO: 2773636 - RNA, 23 nt, Human
ccggcuaugggggcacugaggac

SEQ ID NO: 2773637 - RNA, 17 nt, Human
ccggcuaugggggcacu

SEQ ID NO: 2773638 - RNA, 19 nt, Human
ccggcuaauuuuuguauuu

SEQ ID NO: 2773639 - RNA, 18 nt, Human
ccggcuaauuuuuguaau

SEQ ID NO: 2773640 - RNA, 14 nt, Human
ccgucaacguugua

SEQ ID NO: 2773641 - RNA, 17 nt, Human
ccgucaacguuguacug

SEQ ID NO: 2773642 - RNA, 21 nt, Human
ccgucucaguguugagccuuu

SEQ ID NO: 2773643 - RNA, 16 nt, Human
ccguccaggagccugg

SEQ ID NO: 2773644 - RNA, 22 nt, Human
ccguccagccgccauugccacc

SEQ ID NO: 2773645 - RNA, 20 nt, Human
ccgucacgugcgcugggcac

SEQ ID NO: 2773646 - RNA, 18 nt, Human
ccgucucugguuccuccc

SEQ ID NO: 2773647 - RNA, 13 nt, Human
ccgucuguccauc

SEQ ID NO: 2773648 - RNA, 16 nt, Human
ccguaguuauuuugca

SEQ ID NO: 2773649 - RNA, 22 nt, Human
ccuaaggcaugugugaaacaua

SEQ ID NO: 2773650 - RNA, 16 nt, Human
ccuaaggaaccuuccu

SEQ ID NO: 2773651 - RNA, 13 nt, Human
ccuaaggaaccuu

SEQ ID NO: 2773652 - RNA, 19 nt, Human
ccuaagggucgaaagcucu

SEQ ID NO: 2773653 - RNA, 21 nt, Human
ccuaagggucgaaagcucuag

SEQ ID NO: 2773654 - RNA, 16 nt, Human
ccuaagccacuugaaa

SEQ ID NO: 2773655 - RNA, 13 nt, Human
ccuaagccagccu

SEQ ID NO: 2773656 - RNA, 14 nt, Human
ccuaagccagccug

SEQ ID NO: 2773657 - RNA, 15 nt, Human
ccuaagccagccugg

SEQ ID NO: 2773658 - RNA, 16 nt, Human
ccuaagccagccuggu

SEQ ID NO: 2773659 - RNA, 17 nt, Human
ccuaagccagccugguc

SEQ ID NO: 2773660 - RNA, 19 nt, Human
ccuaagccagccuggucca

SEQ ID NO: 2773661 - RNA, 12 nt, Human
ccuaagcaucua

SEQ ID NO: 2773662 - RNA, 16 nt, Human
ccuaagcaucuaaguu

SEQ ID NO: 2773663 - RNA, 16 nt, Human
ccuaagcauugccugg

SEQ ID NO: 2773664 - RNA, 17 nt, Human
ccuaagcauugccuggc

SEQ ID NO: 2773665 - RNA, 13 nt, Human
ccuaagcaucuaa

SEQ ID NO: 2773666 - RNA, 15 nt, Human
ccuaagccuguggcu

SEQ ID NO: 2773667 - RNA, 19 nt, Human
ccuaagccuguggcugugg

SEQ ID NO: 2773668 - RNA, 18 nt, Human
ccuaaguccuuuaugugg

SEQ ID NO: 2773669 - RNA, 13 nt, Human
ccuaagucucugu

SEQ ID NO: 2773670 - RNA, 15 nt, Human
ccuaagucucuguga

SEQ ID NO: 2773671 - RNA, 14 nt, Human
ccuaagucucugug

SEQ ID NO: 2773672 - RNA, 16 nt, Human
ccuaaguccuuuaugu

SEQ ID NO: 2773673 - RNA, 18 nt, Human
ccuaaguauuaaaacauu

SEQ ID NO: 2773674 - RNA, 21 nt, Human
ccuaaguauuaaaacauugga

SEQ ID NO: 2773675 - RNA, 23 nt, Human
ccuaagggucgaaagcucuagaa

SEQ ID NO: 2773676 - RNA, 12 nt, Human
ccuaaguacugu

SEQ ID NO: 2773677 - RNA, 14 nt, Human
ccuaaguacuguaa

SEQ ID NO: 2773678 - RNA, 16 nt, Human
ccuaaguacuguaaua

SEQ ID NO: 2773679 - RNA, 18 nt, Human
ccuaaguacuguaauaau

SEQ ID NO: 2773680 - RNA, 22 nt, Human
ccuaagggucgaaagcucuaga

SEQ ID NO: 2773681 - RNA, 13 nt, Human
ccuaaguauuaaa

SEQ ID NO: 2773682 - RNA, 16 nt, Human
ccuaaguauuaaaaca

SEQ ID NO: 2773683 - RNA, 17 nt, Human
ccuaaguauuaaaacau

SEQ ID NO: 2773684 - RNA, 17 nt, Human
ccuaagugucaccccgc

SEQ ID NO: 2773685 - RNA, 22 nt, Human
ccuaaucagaaauuuuuaucag

SEQ ID NO: 2773686 - RNA, 14 nt, Human
ccuagauaugaaua

SEQ ID NO: 2773687 - RNA, 15 nt, Human
ccuagauaugaauau

SEQ ID NO: 2773688 - RNA, 16 nt, Human
ccuagauaugaauaua

SEQ ID NO: 2773689 - RNA, 21 nt, Human
ccuagauaugaauauauggca

SEQ ID NO: 2773690 - RNA, 17 nt, Human
ccuaauaucaaaugcag

SEQ ID NO: 2773691 - RNA, 16 nt, Human
ccuagcacaugcuuca

SEQ ID NO: 2773692 - RNA, 18 nt, Human
ccuagcacaugcuucaau

SEQ ID NO: 2773693 - RNA, 12 nt, Human
ccuaggagacca

SEQ ID NO: 2773694 - RNA, 14 nt, Human
ccuagauccuaagg

SEQ ID NO: 2773695 - RNA, 16 nt, Human
ccuagauccuaagggu

SEQ ID NO: 2773696 - RNA, 11 nt, Human
ccuagauuaua

SEQ ID NO: 2773697 - RNA, 15 nt, Human
ccuagauuauaucaa

SEQ ID NO: 2773698 - RNA, 14 nt, Human
ccuagcaagcuggc

SEQ ID NO: 2773699 - RNA, 15 nt, Human
ccuagcaagcuggcc

SEQ ID NO: 2773700 - RNA, 16 nt, Human
ccuagcaagcuggccu

SEQ ID NO: 2773701 - RNA, 17 nt, Human
ccuagcaagcuggccuc

SEQ ID NO: 2773702 - RNA, 18 nt, Human
ccuagcaagcuggccucu

SEQ ID NO: 2773703 - RNA, 13 nt, Human
ccuagcaauucca

SEQ ID NO: 2773704 - RNA, 16 nt, Human
ccuaggaguauauuuc

SEQ ID NO: 2773705 - RNA, 21 nt, Human
ccuaggaguauauuuccgcac

SEQ ID NO: 2773706 - RNA, 14 nt, Human
ccuaggauucuaaa

SEQ ID NO: 2773707 - RNA, 13 nt, Human
ccuaggcaggaca

SEQ ID NO: 2773708 - RNA, 18 nt, Human
ccuaggcaggacaugcug

SEQ ID NO: 2773709 - RNA, 11 nt, Human
ccuaggauucu

SEQ ID NO: 2773710 - RNA, 22 nt, Human
ccuaggcaggacaugcugaagc

SEQ ID NO: 2773711 - RNA, 23 nt, Human
ccuaggcaggacaugcugaagcc

SEQ ID NO: 2773712 - RNA, 19 nt, Human
ccuaggcaguaggccggug

SEQ ID NO: 2773713 - RNA, 22 nt, Human
ccuaggcaguaggccggugugc

SEQ ID NO: 2773714 - RNA, 12 nt, Human
cccuucucugug

SEQ ID NO: 2773715 - RNA, 13 nt, Human
cccuucucuguga

SEQ ID NO: 2773716 - RNA, 19 nt, Human
cccuucucugugacccacu

SEQ ID NO: 2773717 - RNA, 21 nt, Human
cccuucucugugacccacuuc

SEQ ID NO: 2773718 - RNA, 18 nt, Human
cccuucgcuccugugucu

SEQ ID NO: 2773719 - RNA, 16 nt, Human
cccuucgcuccugugu

SEQ ID NO: 2773720 - RNA, 15 nt, Human
ccgacccucugggaa

SEQ ID NO: 2773721 - RNA, 16 nt, Human
ccgacccucugggaac

SEQ ID NO: 2773722 - RNA, 17 nt, Human
ccgacccucugggaacc

SEQ ID NO: 2773723 - RNA, 18 nt, Human
ccgacccucugggaaccu

SEQ ID NO: 2773724 - RNA, 19 nt, Human
ccgacccucugggaaccuc

SEQ ID NO: 2773725 - RNA, 16 nt, Human
ccgccacuccugaacc

SEQ ID NO: 2773726 - RNA, 16 nt, Human
ccgccagacuguuaga

SEQ ID NO: 2773727 - RNA, 15 nt, Human
ccgccagagggcuug

SEQ ID NO: 2773728 - RNA, 21 nt, Human
ccgccaaaagcugcucaggga

SEQ ID NO: 2773729 - RNA, 20 nt, Human
ccgccaaugcacggccucgc

SEQ ID NO: 2773730 - RNA, 16 nt, Human
ccgccacacagaccac

SEQ ID NO: 2773731 - RNA, 20 nt, Human
ccgaauagcugggacuacag

SEQ ID NO: 2773732 - RNA, 17 nt, Human
cccuucugucccucaca

SEQ ID NO: 2773733 - RNA, 16 nt, Human
cccuucugucccucac

SEQ ID NO: 2773734 - RNA, 18 nt, Human
ccgaccagaggagccuuu

SEQ ID NO: 2773735 - RNA, 12 nt, Human
ccgacacuguuc

SEQ ID NO: 2773736 - RNA, 14 nt, Human
ccgacacuguucuc

SEQ ID NO: 2773737 - RNA, 17 nt, Human
ccgaccagaggagccuu

SEQ ID NO: 2773738 - RNA, 22 nt, Human
ccgacaacuauuucggccuuuu

SEQ ID NO: 2773739 - RNA, 16 nt, Human
ccgaauccccucccug

SEQ ID NO: 2773740 - RNA, 18 nt, Human
ccgaauccccucccuguc

SEQ ID NO: 2773741 - RNA, 19 nt, Human
ccgaauccccucccuguca

SEQ ID NO: 2773742 - RNA, 22 nt, Human
ccgaauucgcuguuaccgccug

SEQ ID NO: 2773743 - RNA, 15 nt, Human
ccgaauugagcacaa

SEQ ID NO: 2773744 - RNA, 16 nt, Human
ccgaauugagcacaaa

SEQ ID NO: 2773745 - RNA, 14 nt, Human
ccgcccaugcacug

SEQ ID NO: 2773746 - RNA, 13 nt, Human
ccgcccaugcacu

SEQ ID NO: 2773747 - RNA, 19 nt, Human
ccgccauugccaccaggag

SEQ ID NO: 2773748 - RNA, 16 nt, Human
ccgccauugccaccag

SEQ ID NO: 2773749 - RNA, 15 nt, Human
ccgccauugccacca

SEQ ID NO: 2773750 - RNA, 14 nt, Human
ccgccauugccacc

SEQ ID NO: 2773751 - RNA, 13 nt, Human
ccgcccccagccu

SEQ ID NO: 2773752 - RNA, 14 nt, Human
ccgcccccagccua

SEQ ID NO: 2773753 - RNA, 19 nt, Human
ccgcccaugcacuggggac

SEQ ID NO: 2773754 - RNA, 19 nt, Human
ccgccccaaaguaaaagaa

SEQ ID NO: 2773755 - RNA, 12 nt, Human
ccgcccccagcc

SEQ ID NO: 2773756 - RNA, 12 nt, Human
ccgcccccuccu

SEQ ID NO: 2773757 - RNA, 14 nt, Human
ccgcccccuccuga

SEQ ID NO: 2773758 - RNA, 11 nt, Human
ccgcccccugc

SEQ ID NO: 2773759 - RNA, 16 nt, Human
ccgcccccugcccucc

SEQ ID NO: 2773760 - RNA, 17 nt, Human
ccgcccccugcccuccc

SEQ ID NO: 2773761 - RNA, 23 nt, Human
cccuggcauuauguccacugugu

SEQ ID NO: 2773762 - RNA, 20 nt, Human
cccuggcaggaugacccugc

SEQ ID NO: 2773763 - RNA, 22 nt, Human
cccuggcaggaugacccugcga

SEQ ID NO: 2773764 - RNA, 21 nt, Human
cccuggccucugugccuucuu

SEQ ID NO: 2773765 - RNA, 12 nt, Human
cccuggcccccu

SEQ ID NO: 2773766 - RNA, 16 nt, Human
cccuggcccccugagu

SEQ ID NO: 2773767 - RNA, 15 nt, Human
cccuggcuaagaccc

SEQ ID NO: 2773768 - RNA, 15 nt, Human
cccuggcuguacugc

SEQ ID NO: 2773769 - RNA, 17 nt, Human
cccuggcuguacugcuc

SEQ ID NO: 2773770 - RNA, 21 nt, Human
cccuggcuguacugcucaggc

SEQ ID NO: 2773771 - RNA, 22 nt, Human
cccuggcuguacugcucaggcu

SEQ ID NO: 2773772 - RNA, 17 nt, Human
cccuggcucccacaggc

SEQ ID NO: 2773773 - RNA, 13 nt, Human
cccuggcuuuuca

SEQ ID NO: 2773774 - RNA, 14 nt, Human
cccugcccuguggg

SEQ ID NO: 2773775 - RNA, 12 nt, Human
cccugcccugug

SEQ ID NO: 2773776 - RNA, 13 nt, Human
cccugcccugugg

SEQ ID NO: 2773777 - RNA, 18 nt, Human
cccucacagccucugacc

SEQ ID NO: 2773778 - RNA, 13 nt, Human
cccucacauuccu

SEQ ID NO: 2773779 - RNA, 12 nt, Human
cccucaccaaca

SEQ ID NO: 2773780 - RNA, 14 nt, Human
cccucacagccucu

SEQ ID NO: 2773781 - RNA, 15 nt, Human
cccucacagccucug

SEQ ID NO: 2773782 - RNA, 16 nt, Human
cccucacagccucuga

SEQ ID NO: 2773783 - RNA, 17 nt, Human
cccucacagccucugac

SEQ ID NO: 2773784 - RNA, 14 nt, Human
cccuauuuugccau

SEQ ID NO: 2773785 - RNA, 13 nt, Human
cccucacagccuc

SEQ ID NO: 2773786 - RNA, 13 nt, Human
caacaauaacacu

SEQ ID NO: 2773787 - RNA, 12 nt, Human
caacaccacaga

SEQ ID NO: 2773788 - RNA, 13 nt, Human
caacaccacagac

SEQ ID NO: 2773789 - RNA, 14 nt, Human
caacaccacagaca

SEQ ID NO: 2773790 - RNA, 15 nt, Human
caacaccacagacac

SEQ ID NO: 2773791 - RNA, 16 nt, Human
caacaccacagacaca

SEQ ID NO: 2773792 - RNA, 17 nt, Human
caacaccacagacacac

SEQ ID NO: 2773793 - RNA, 18 nt, Human
caacaccacagacacaca

SEQ ID NO: 2773794 - RNA, 19 nt, Human
caacaccacagacacacac

SEQ ID NO: 2773795 - RNA, 20 nt, Human
caacaccacagacacacaca

SEQ ID NO: 2773796 - RNA, 22 nt, Human
caaauggaaaguaacucauuug

SEQ ID NO: 2773797 - RNA, 12 nt, Human
caacaagaaugc

SEQ ID NO: 2773798 - RNA, 13 nt, Human
caacaagaaugca

SEQ ID NO: 2773799 - RNA, 14 nt, Human
caacaagaaugcau

SEQ ID NO: 2773800 - RNA, 16 nt, Human
caacaagaaugcauug

SEQ ID NO: 2773801 - RNA, 18 nt, Human
caacaagaaugcauugau

SEQ ID NO: 2773802 - RNA, 20 nt, Human
caacaagaaugcauugauau

SEQ ID NO: 2773803 - RNA, 14 nt, Human
caacaauaaaacau

SEQ ID NO: 2773804 - RNA, 20 nt, Human
caacaagguggugugaucuu

SEQ ID NO: 2773805 - RNA, 15 nt, Human
caacaagaguuuauu

SEQ ID NO: 2773806 - RNA, 13 nt, Human
caacaagauuucc

SEQ ID NO: 2773807 - RNA, 21 nt, Human
caacaagauuuccuugugcaa

SEQ ID NO: 2773808 - RNA, 14 nt, Human
caacaagaguuuau

SEQ ID NO: 2773809 - RNA, 18 nt, Human
caaauccuuccaaaaauu

SEQ ID NO: 2773810 - RNA, 19 nt, Human
caaauccuuccaaaaauua

SEQ ID NO: 2773811 - RNA, 20 nt, Human
caaauccuuccaaaaauuau

SEQ ID NO: 2773812 - RNA, 20 nt, Human
caacacgcauggucaacccu

SEQ ID NO: 2773813 - RNA, 17 nt, Human
caaagcacaguuugaac

SEQ ID NO: 2773814 - RNA, 22 nt, Human
caaagcacaguguuaaaugaaa

SEQ ID NO: 2773815 - RNA, 16 nt, Human
caaagcacaguuugaa

SEQ ID NO: 2773816 - RNA, 11 nt, Human
caaagaugcug

SEQ ID NO: 2773817 - RNA, 15 nt, Human
caaagaugcagccgc

SEQ ID NO: 2773818 - RNA, 23 nt, Human
caaagaugcagccgccuuccuug

SEQ ID NO: 2773819 - RNA, 16 nt, Human
caaagaugcugugagu

SEQ ID NO: 2773820 - RNA, 16 nt, Human
caaagauggcucagag

SEQ ID NO: 2773821 - RNA, 17 nt, Human
caaagauggcucagagg

SEQ ID NO: 2773822 - RNA, 18 nt, Human
caaagauggcucagaggg

SEQ ID NO: 2773823 - RNA, 19 nt, Human
caaagauggcucagagggg

SEQ ID NO: 2773824 - RNA, 19 nt, Human
caaagauucaugauuuaua

SEQ ID NO: 2773825 - RNA, 16 nt, Human
caaagauucaugauuu

SEQ ID NO: 2773826 - RNA, 13 nt, Human
caaagauucauga

SEQ ID NO: 2773827 - RNA, 13 nt, Human
caaagcacagugu

SEQ ID NO: 2773828 - RNA, 14 nt, Human
caaagcacaguguu

SEQ ID NO: 2773829 - RNA, 15 nt, Human
caaagcacaguguua

SEQ ID NO: 2773830 - RNA, 19 nt, Human
caaagcacaguguuaaaug

SEQ ID NO: 2773831 - RNA, 18 nt, Human
caaaguaaaacuugcugc

SEQ ID NO: 2773832 - RNA, 16 nt, Human
caaaguaaaacuugcu

SEQ ID NO: 2773833 - RNA, 19 nt, Human
caaagguuuuccucuucua

SEQ ID NO: 2773834 - RNA, 11 nt, Human
caaagguuuuc

SEQ ID NO: 2773835 - RNA, 15 nt, Human
caaagguugagaugu

SEQ ID NO: 2773836 - RNA, 13 nt, Human
caaaggucuuuuu

SEQ ID NO: 2773837 - RNA, 18 nt, Human
caaaggucuuuuuaaacc

SEQ ID NO: 2773838 - RNA, 20 nt, Human
caaaggucuuuuuaaaccag

SEQ ID NO: 2773839 - RNA, 15 nt, Human
caaagcagggucugg

SEQ ID NO: 2773840 - RNA, 12 nt, Human
caaagguucuag

SEQ ID NO: 2773841 - RNA, 14 nt, Human
caaagguucuaggu

SEQ ID NO: 2773842 - RNA, 19 nt, Human
caaagguucuagguuucaa

SEQ ID NO: 2773843 - RNA, 21 nt, Human
caaagguucuagguuucaaag

SEQ ID NO: 2773844 - RNA, 22 nt, Human
caaagguucuagguuucaaaga

SEQ ID NO: 2773845 - RNA, 12 nt, Human
caaagucucuaa

SEQ ID NO: 2773846 - RNA, 13 nt, Human
caaagucucuaau

SEQ ID NO: 2773847 - RNA, 14 nt, Human
caaagucucuaauu

SEQ ID NO: 2773848 - RNA, 13 nt, Human
caaagucugugug

SEQ ID NO: 2773849 - RNA, 15 nt, Human
caaagucucuaauuc

SEQ ID NO: 2773850 - RNA, 14 nt, Human
caaagucuguguga

SEQ ID NO: 2773851 - RNA, 16 nt, Human
caaagucuuugggguc

SEQ ID NO: 2773852 - RNA, 23 nt, Human
caaagugaaggacauagagguau

SEQ ID NO: 2773853 - RNA, 16 nt, Human
caaagugccacucauu

SEQ ID NO: 2773854 - RNA, 22 nt, Human
caaagugccacucauuccugua

SEQ ID NO: 2773855 - RNA, 15 nt, Human
caaagugcugagauu

SEQ ID NO: 2773856 - RNA, 16 nt, Human
caaagugcugagauua

SEQ ID NO: 2773857 - RNA, 16 nt, Human
caaauccgcucucuuc

SEQ ID NO: 2773858 - RNA, 17 nt, Human
caaauccgcucucuucc

SEQ ID NO: 2773859 - RNA, 18 nt, Human
caaauccgcucucuuccu

SEQ ID NO: 2773860 - RNA, 19 nt, Human
caaauccgcucucuuccug

SEQ ID NO: 2773861 - RNA, 20 nt, Human
caaauccgcucucuuccugc

SEQ ID NO: 2773862 - RNA, 21 nt, Human
caaauccgcucucuuccugcc

SEQ ID NO: 2773863 - RNA, 22 nt, Human
caaauccgcucucuuccugccc

SEQ ID NO: 2773864 - RNA, 18 nt, Human
auuuuuuuuuuuugaaaa

SEQ ID NO: 2773865 - RNA, 21 nt, Human
auuuuuuuuuuuugaaaaaag

SEQ ID NO: 2773866 - RNA, 23 nt, Human
auuuuuuuuuuuguuucugagaa

SEQ ID NO: 2773867 - RNA, 19 nt, Human
caaaagaugcucuucugug

SEQ ID NO: 2773868 - RNA, 20 nt, Human
caaaagaugcucuucugugg

SEQ ID NO: 2773869 - RNA, 12 nt, Human
caaaagaugaaa

SEQ ID NO: 2773870 - RNA, 18 nt, Human
caaaaggcuccauauaua

SEQ ID NO: 2773871 - RNA, 19 nt, Human
caaaaggcuccauauauau

SEQ ID NO: 2773872 - RNA, 18 nt, Human
caaaagauugcugaaaaa

SEQ ID NO: 2773873 - RNA, 19 nt, Human
auuuuuuuuuuaaauuauu

SEQ ID NO: 2773874 - RNA, 16 nt, Human
auuuuuuuuuuaaauc

SEQ ID NO: 2773875 - RNA, 21 nt, Human
caaacccacgauuuucuccag

SEQ ID NO: 2773876 - RNA, 22 nt, Human
caaacccacgauuuucuccagc

SEQ ID NO: 2773877 - RNA, 23 nt, Human
caaacccacgauuuucuccagcu

SEQ ID NO: 2773878 - RNA, 24 nt, Human
caaacccacgauuuucuccagcuc

SEQ ID NO: 2773879 - RNA, 21 nt, Human
caaaccauuuuuaaaguagaa

SEQ ID NO: 2773880 - RNA, 13 nt, Human
caaacagccacac

SEQ ID NO: 2773881 - RNA, 20 nt, Human
caaacaggaucaguuaacua

SEQ ID NO: 2773882 - RNA, 11 nt, Human
caaaaggguca

SEQ ID NO: 2773883 - RNA, 13 nt, Human
caaaagggucaga

SEQ ID NO: 2773884 - RNA, 14 nt, Human
caaaagggucagag

SEQ ID NO: 2773885 - RNA, 16 nt, Human
caaaagggucagagga

SEQ ID NO: 2773886 - RNA, 23 nt, Human
caaaagggucagaggaccuguau

SEQ ID NO: 2773887 - RNA, 14 nt, Human
caaaagggaaaaga

SEQ ID NO: 2773888 - RNA, 11 nt, Human
caaacagcaaa

SEQ ID NO: 2773889 - RNA, 14 nt, Human
caaacagcaaacca

SEQ ID NO: 2773890 - RNA, 16 nt, Human
caaacagcaaaccaag

SEQ ID NO: 2773891 - RNA, 17 nt, Human
caaacagcaaaccaaga

SEQ ID NO: 2773892 - RNA, 19 nt, Human
caaacagcaaaccaagaga

SEQ ID NO: 2773893 - RNA, 20 nt, Human
caaacagcaaaccaagagau

SEQ ID NO: 2773894 - RNA, 21 nt, Human
auuugcuagcaguaaaagaug

SEQ ID NO: 2773895 - RNA, 18 nt, Human
auuugcuuuuucaccaga

SEQ ID NO: 2773896 - RNA, 13 nt, Human
auuugcuggggaa

SEQ ID NO: 2773897 - RNA, 18 nt, Human
auuugcuuauuuaauaaa

SEQ ID NO: 2773898 - RNA, 12 nt, Human
auuugcuucauu

SEQ ID NO: 2773899 - RNA, 14 nt, Human
auuugcuucauugu

SEQ ID NO: 2773900 - RNA, 20 nt, Human
auuugcuuucuuuucuccca

SEQ ID NO: 2773901 - RNA, 13 nt, Human
auuuggaaaauaa

SEQ ID NO: 2773902 - RNA, 12 nt, Human
auuuggaaaaua

SEQ ID NO: 2773903 - RNA, 12 nt, Human
auuuggaaaucc

SEQ ID NO: 2773904 - RNA, 14 nt, Human
auuuggaaauccua

SEQ ID NO: 2773905 - RNA, 21 nt, Human
auuuggaaauccuaguuuccu

SEQ ID NO: 2773906 - RNA, 18 nt, Human
auuugugcuauaguauuu

SEQ ID NO: 2773907 - RNA, 21 nt, Human
auuugugcuauaguauuugau

SEQ ID NO: 2773908 - RNA, 14 nt, Human
auuugugccagagg

SEQ ID NO: 2773909 - RNA, 21 nt, Human
auuugugccgacacuguucuc

SEQ ID NO: 2773910 - RNA, 14 nt, Human
auuugugccagaau

SEQ ID NO: 2773911 - RNA, 17 nt, Human
auuugugauauauguau

SEQ ID NO: 2773912 - RNA, 22 nt, Human
auuuguuuguuuguuuuauuca

SEQ ID NO: 2773913 - RNA, 21 nt, Human
auuuuaugaaagguuuacauu

SEQ ID NO: 2773914 - RNA, 15 nt, Human
auuuuaugagaaaug

SEQ ID NO: 2773915 - RNA, 16 nt, Human
auuuuaugagaaaugu

SEQ ID NO: 2773916 - RNA, 17 nt, Human
auuuuaugagaaaugua

SEQ ID NO: 2773917 - RNA, 18 nt, Human
auuuuaugagaaauguaa

SEQ ID NO: 2773918 - RNA, 20 nt, Human
auuuuaugagaaauguaaug

SEQ ID NO: 2773919 - RNA, 21 nt, Human
auuuuaugagaaauguaaugc

SEQ ID NO: 2773920 - RNA, 17 nt, Human
auuuuaugaucaguguu

SEQ ID NO: 2773921 - RNA, 18 nt, Human
auuuuaugaucaguguug

SEQ ID NO: 2773922 - RNA, 15 nt, Human
auuuguuuaaaagga

SEQ ID NO: 2773923 - RNA, 16 nt, Human
auuuguuuaaaaggau

SEQ ID NO: 2773924 - RNA, 12 nt, Human
auuuguuuaaaa

SEQ ID NO: 2773925 - RNA, 15 nt, Human
auuuguuggaaugaa

SEQ ID NO: 2773926 - RNA, 14 nt, Human
auuuguuuaaaagg

SEQ ID NO: 2773927 - RNA, 13 nt, Human
auuuguuuaaaag

SEQ ID NO: 2773928 - RNA, 14 nt, Human
auuuguuggaauga

SEQ ID NO: 2773929 - RNA, 13 nt, Human
auuuguuggaaug

SEQ ID NO: 2773930 - RNA, 22 nt, Human
auuuguguauuuaacagggagg

SEQ ID NO: 2773931 - RNA, 17 nt, Human
auuugugucacaaagaa

SEQ ID NO: 2773932 - RNA, 21 nt, Human
auuugugucacaaagaauuua

SEQ ID NO: 2773933 - RNA, 21 nt, Human
auuuguguaauagaaaacuga

SEQ ID NO: 2773934 - RNA, 19 nt, Human
auuuguugacaaaauuuuc

SEQ ID NO: 2773935 - RNA, 14 nt, Human
auuuguguauuuaa

SEQ ID NO: 2773936 - RNA, 13 nt, Human
auuuguguaauag

SEQ ID NO: 2773937 - RNA, 11 nt, Human
auuuguggaau

SEQ ID NO: 2773938 - RNA, 12 nt, Human
auuuguggaaua

SEQ ID NO: 2773939 - RNA, 20 nt, Human
auuuguggugauauagaauu

SEQ ID NO: 2773940 - RNA, 20 nt, Human
auuugccacugauauucaga

SEQ ID NO: 2773941 - RNA, 22 nt, Human
auuugccacugauauucagaau

SEQ ID NO: 2773942 - RNA, 16 nt, Human
auuugccaauaauaau

SEQ ID NO: 2773943 - RNA, 15 nt, Human
auuugccaugggcuu

SEQ ID NO: 2773944 - RNA, 19 nt, Human
auuugccaugggcuucacu

SEQ ID NO: 2773945 - RNA, 24 nt, Human
auuugccaugggcuucacuguaua

SEQ ID NO: 2773946 - RNA, 12 nt, Human
auuugcccuggg

SEQ ID NO: 2773947 - RNA, 16 nt, Human
auuugcccugggaaac

SEQ ID NO: 2773948 - RNA, 18 nt, Human
auuugcccugggaaaccc

SEQ ID NO: 2773949 - RNA, 15 nt, Human
auuugccaauaauaa

SEQ ID NO: 2773950 - RNA, 22 nt, Human
auuugcauugaacacaaacugu

SEQ ID NO: 2773951 - RNA, 21 nt, Human
auuugcauugaacacaaacug

SEQ ID NO: 2773952 - RNA, 16 nt, Human
auuugcauugaacaca

SEQ ID NO: 2773953 - RNA, 21 nt, Human
auuugccuguuucugcuugcu

SEQ ID NO: 2773954 - RNA, 13 nt, Human
auuugccuugcag

SEQ ID NO: 2773955 - RNA, 14 nt, Human
auuugccuugcaga

SEQ ID NO: 2773956 - RNA, 15 nt, Human
auuugccuugcagaa

SEQ ID NO: 2773957 - RNA, 17 nt, Human
auuugccuugcagaacu

SEQ ID NO: 2773958 - RNA, 18 nt, Human
auuugccuugcagaacug

SEQ ID NO: 2773959 - RNA, 19 nt, Human
auuugccuugcagaacugc

SEQ ID NO: 2773960 - RNA, 21 nt, Human
auuugccuugcagaacugcca

SEQ ID NO: 2773961 - RNA, 22 nt, Human
auuugccuugcagaacugccau

SEQ ID NO: 2773962 - RNA, 23 nt, Human
auuugccuugcagaacugccauu

SEQ ID NO: 2773963 - RNA, 15 nt, Human
auuugccuugcugga

SEQ ID NO: 2773964 - RNA, 14 nt, Human
auuugccuuuaaaa

SEQ ID NO: 2773965 - RNA, 23 nt, Human
auuugccuuuaaaaaaaaaaguu

SEQ ID NO: 2773966 - RNA, 21 nt, Human
auuugccugcagaguuuggau

SEQ ID NO: 2773967 - RNA, 23 nt, Human
auuugcggcgucagucuuuuucu

SEQ ID NO: 2773968 - RNA, 18 nt, Human
auuugcuaaucaaagcca

SEQ ID NO: 2773969 - RNA, 23 nt, Human
auuugcuaaucaaagccaggguc

SEQ ID NO: 2773970 - RNA, 15 nt, Human
auuugcuacuguaca

SEQ ID NO: 2773971 - RNA, 16 nt, Human
auuugcuacuguacau

SEQ ID NO: 2773972 - RNA, 13 nt, Human
auuugauuucuau

SEQ ID NO: 2773973 - RNA, 17 nt, Human
auuugauuucuauucaa

SEQ ID NO: 2773974 - RNA, 22 nt, Human
auuugauuuuucuaaccuugaa

SEQ ID NO: 2773975 - RNA, 18 nt, Human
auuugauuuuugucucaa

SEQ ID NO: 2773976 - RNA, 12 nt, Human
auuugcaacauu

SEQ ID NO: 2773977 - RNA, 14 nt, Human
auuugcaacauuua

SEQ ID NO: 2773978 - RNA, 15 nt, Human
auuugcaacauuuac

SEQ ID NO: 2773979 - RNA, 15 nt, Human
auuugauucaaaaua

SEQ ID NO: 2773980 - RNA, 16 nt, Human
auuugauucaaaauau

SEQ ID NO: 2773981 - RNA, 20 nt, Human
auuugauucaaaauauuuaa

SEQ ID NO: 2773982 - RNA, 16 nt, Human
auuugauugauuugaa

SEQ ID NO: 2773983 - RNA, 13 nt, Human
auuugauugauuu

SEQ ID NO: 2773984 - RNA, 20 nt, Human
auuugauguuuacaggugga

SEQ ID NO: 2773985 - RNA, 14 nt, Human
auuugauuaacaaa

SEQ ID NO: 2773986 - RNA, 16 nt, Human
auuugauuaacaaaua

SEQ ID NO: 2773987 - RNA, 17 nt, Human
auuugauuaacaaauau

SEQ ID NO: 2773988 - RNA, 18 nt, Human
auuugcauuaaauucaca

SEQ ID NO: 2773989 - RNA, 23 nt, Human
auuugcauuaaauucacaaacuu

SEQ ID NO: 2773990 - RNA, 19 nt, Human
auuugcauuaaauucacaa

SEQ ID NO: 2773991 - RNA, 15 nt, Human
auuugcaucugaaau

SEQ ID NO: 2773992 - RNA, 21 nt, Human
auuugcaucugaaauaggaaa

SEQ ID NO: 2773993 - RNA, 21 nt, Human
auuugcauggcuccagaaaug

SEQ ID NO: 2773994 - RNA, 22 nt, Human
auuugcauggcuccagaaaugu

SEQ ID NO: 2773995 - RNA, 15 nt, Human
auuagcugugauuuu

SEQ ID NO: 2773996 - RNA, 22 nt, Human
auuagcugugauuuuuguugau

SEQ ID NO: 2773997 - RNA, 17 nt, Human
auuagcuuggggccagg

SEQ ID NO: 2773998 - RNA, 18 nt, Human
auuagcuuggggccaggg

SEQ ID NO: 2773999 - RNA, 12 nt, Human
auuagcuuugug

SEQ ID NO: 2774000 - RNA, 13 nt, Human
auuagcuuugugu

SEQ ID NO: 2774001 - RNA, 14 nt, Human
auuagcuuuguguu

SEQ ID NO: 2774002 - RNA, 15 nt, Human
auuagcuuuguguuu

SEQ ID NO: 2774003 - RNA, 21 nt, Human
auuagcuuuguguuugguuua

SEQ ID NO: 2774004 - RNA, 15 nt, Human
auuagcuuuuucauc

SEQ ID NO: 2774005 - RNA, 16 nt, Human
auuagcuuuuucaucc

SEQ ID NO: 2774006 - RNA, 16 nt, Human
auuaggguacauuuau

SEQ ID NO: 2774007 - RNA, 15 nt, Human
auuagggaugccucc

SEQ ID NO: 2774008 - RNA, 18 nt, Human
auuagggcaauuggaaca

SEQ ID NO: 2774009 - RNA, 23 nt, Human
auuagggcaauuggaacaaagug

SEQ ID NO: 2774010 - RNA, 22 nt, Human
auucacaaugaaaugcucuccu

SEQ ID NO: 2774011 - RNA, 18 nt, Human
auuagguuaacauuguug

SEQ ID NO: 2774012 - RNA, 16 nt, Human
auucacaauaaaagcu

SEQ ID NO: 2774013 - RNA, 11 nt, Human
auucacacugu

SEQ ID NO: 2774014 - RNA, 22 nt, Human
auucaauguuuaugcaaggaag

SEQ ID NO: 2774015 - RNA, 21 nt, Human
auucaaaucguuuauuucaca

SEQ ID NO: 2774016 - RNA, 14 nt, Human
auucaaauggguga

SEQ ID NO: 2774017 - RNA, 20 nt, Human
auucaaaugggugauauccu

SEQ ID NO: 2774018 - RNA, 23 nt, Human
auucaauguuuaugcaaggaagg

SEQ ID NO: 2774019 - RNA, 16 nt, Human
auuaugaguuugcuua

SEQ ID NO: 2774020 - RNA, 23 nt, Human
auuaugaugaaaaccuacauauu

SEQ ID NO: 2774021 - RNA, 16 nt, Human
auuaugauggaagaca

SEQ ID NO: 2774022 - RNA, 21 nt, Human
auuaugauuuggguuggggaa

SEQ ID NO: 2774023 - RNA, 22 nt, Human
auuaugcaauuagccucauagu

SEQ ID NO: 2774024 - RNA, 16 nt, Human
auuaugcacuaaauau

SEQ ID NO: 2774025 - RNA, 18 nt, Human
auuaugcacuaaauauga

SEQ ID NO: 2774026 - RNA, 16 nt, Human
auuacaggugugaacc

SEQ ID NO: 2774027 - RNA, 22 nt, Human
auuacaggcaccugccaccaug

SEQ ID NO: 2774028 - RNA, 16 nt, Human
auuacaggcaugugcc

SEQ ID NO: 2774029 - RNA, 20 nt, Human
auuacaggcaccugccacca

SEQ ID NO: 2774030 - RNA, 15 nt, Human
auuacagcuggagaa

SEQ ID NO: 2774031 - RNA, 15 nt, Human
auuacagaggaaguu

SEQ ID NO: 2774032 - RNA, 17 nt, Human
auuacagaggaaguuau

SEQ ID NO: 2774033 - RNA, 17 nt, Human
auuagcauucuggcagu

SEQ ID NO: 2774034 - RNA, 18 nt, Human
auuagcaaggucauuucu

SEQ ID NO: 2774035 - RNA, 19 nt, Human
auuagcaaggucauuucuu

SEQ ID NO: 2774036 - RNA, 21 nt, Human
auuagcaaggucauuucuuca

SEQ ID NO: 2774037 - RNA, 17 nt, Human
auuagcaguuugcuuug

SEQ ID NO: 2774038 - RNA, 22 nt, Human
auuagcaauugacugucacugu

SEQ ID NO: 2774039 - RNA, 14 nt, Human
auuagcacagauuu

SEQ ID NO: 2774040 - RNA, 15 nt, Human
auuagcacagauuuu

SEQ ID NO: 2774041 - RNA, 16 nt, Human
auuagcacagauuuua

SEQ ID NO: 2774042 - RNA, 17 nt, Human
auuagcacagauuuuaa

SEQ ID NO: 2774043 - RNA, 18 nt, Human
auuagcacagauuuuaau

SEQ ID NO: 2774044 - RNA, 23 nt, Human
auuagcacagauuuuaauuguca

SEQ ID NO: 2774045 - RNA, 23 nt, Human
auuagauuucucauuugccaaua

SEQ ID NO: 2774046 - RNA, 16 nt, Human
auuagauuuuauuuua

SEQ ID NO: 2774047 - RNA, 18 nt, Human
auuagauuuuauuuuacu

SEQ ID NO: 2774048 - RNA, 20 nt, Human
auuagauuuuauuuuacuau

SEQ ID NO: 2774049 - RNA, 22 nt, Human
auuagauuuuauuuuacuauug

SEQ ID NO: 2774050 - RNA, 13 nt, Human
auuagccaggauc

SEQ ID NO: 2774051 - RNA, 14 nt, Human
auuagccaggauca

SEQ ID NO: 2774052 - RNA, 15 nt, Human
auuagccaggaucau

SEQ ID NO: 2774053 - RNA, 21 nt, Human
auuagccaggaucauggugua

SEQ ID NO: 2774054 - RNA, 22 nt, Human
auuagccaggaucaugguguaa

SEQ ID NO: 2774055 - RNA, 13 nt, Human
auuacaaaugguu

SEQ ID NO: 2774056 - RNA, 10 nt, Human
auuacaaaua

SEQ ID NO: 2774057 - RNA, 22 nt, Human
auuacaaauauauagcacauca

SEQ ID NO: 2774058 - RNA, 16 nt, Human
auuaauuuuuuuucau

SEQ ID NO: 2774059 - RNA, 17 nt, Human
auuaauuuuuuuucauu

SEQ ID NO: 2774060 - RNA, 14 nt, Human
auuaauucuauaag

SEQ ID NO: 2774061 - RNA, 12 nt, Human
auuaauguguug

SEQ ID NO: 2774062 - RNA, 14 nt, Human
auuaauugcugcaa

SEQ ID NO: 2774063 - RNA, 13 nt, Human
auuaauuaaacau

SEQ ID NO: 2774064 - RNA, 16 nt, Human
auuaauuaaacauugu

SEQ ID NO: 2774065 - RNA, 12 nt, Human
auuaauguuucu

SEQ ID NO: 2774066 - RNA, 16 nt, Human
auuaauguuucuaucu

SEQ ID NO: 2774067 - RNA, 18 nt, Human
auuaauguuucuaucuga

SEQ ID NO: 2774068 - RNA, 20 nt, Human
auuaauguuucuaucugauu

SEQ ID NO: 2774069 - RNA, 22 nt, Human
auuaauguuucuaucugauuuu

SEQ ID NO: 2774070 - RNA, 13 nt, Human
auuaauucuauaa

SEQ ID NO: 2774071 - RNA, 19 nt, Human
auguuuggugcauagaacu

SEQ ID NO: 2774072 - RNA, 20 nt, Human
auguuuggugcauagaacug

SEQ ID NO: 2774073 - RNA, 21 nt, Human
auguuuggugcauagaacugg

SEQ ID NO: 2774074 - RNA, 14 nt, Human
auguuuguaaaacu

SEQ ID NO: 2774075 - RNA, 20 nt, Human
auguuugucucaguuggaaa

SEQ ID NO: 2774076 - RNA, 21 nt, Human
auguuugucucaguuggaaau

SEQ ID NO: 2774077 - RNA, 13 nt, Human
auguuuguggccu

SEQ ID NO: 2774078 - RNA, 10 nt, Human
auguuugugg

SEQ ID NO: 2774079 - RNA, 23 nt, Human
auguuugggagacugcugaguca

SEQ ID NO: 2774080 - RNA, 17 nt, Human
auguuuguggccucaga

SEQ ID NO: 2774081 - RNA, 16 nt, Human
auguuuguggccucag

SEQ ID NO: 2774082 - RNA, 15 nt, Human
auguuuguggccuca

SEQ ID NO: 2774083 - RNA, 14 nt, Human
auguuuguggccuc

SEQ ID NO: 2774084 - RNA, 14 nt, Human
auuguaaauaguau

SEQ ID NO: 2774085 - RNA, 14 nt, Human
auuguaaacaaacu

SEQ ID NO: 2774086 - RNA, 17 nt, Human
auuguaaacaaacucuu

SEQ ID NO: 2774087 - RNA, 15 nt, Human
auuguaaacaugugu

SEQ ID NO: 2774088 - RNA, 16 nt, Human
auuguaaacauguguu

SEQ ID NO: 2774089 - RNA, 19 nt, Human
auuguaaaccgcuuuggcc

SEQ ID NO: 2774090 - RNA, 13 nt, Human
auuguuauuuaua

SEQ ID NO: 2774091 - RNA, 17 nt, Human
auuguuauuuucaguga

SEQ ID NO: 2774092 - RNA, 14 nt, Human
auuguucaaacaau

SEQ ID NO: 2774093 - RNA, 15 nt, Human
auuguucaaacaaua

SEQ ID NO: 2774094 - RNA, 16 nt, Human
auuguucaaacaauau

SEQ ID NO: 2774095 - RNA, 19 nt, Human
auuguucaaacaauaucau

SEQ ID NO: 2774096 - RNA, 24 nt, Human
auuguucaaacaauaucauaucau

SEQ ID NO: 2774097 - RNA, 17 nt, Human
auuguuacucuuacgaa

SEQ ID NO: 2774098 - RNA, 18 nt, Human
auuguuagcuuccuuaag

SEQ ID NO: 2774099 - RNA, 18 nt, Human
auuguucaccuuuguagc

SEQ ID NO: 2774100 - RNA, 14 nt, Human
auugcugagccucu

SEQ ID NO: 2774101 - RNA, 16 nt, Human
auugcugagccucugc

SEQ ID NO: 2774102 - RNA, 22 nt, Human
auugcugagccucugcucccca

SEQ ID NO: 2774103 - RNA, 21 nt, Human
auugcugaagggcauucuuuc

SEQ ID NO: 2774104 - RNA, 22 nt, Human
auugcugaagggcauucuuucc

SEQ ID NO: 2774105 - RNA, 12 nt, Human
auugcuccuuga

SEQ ID NO: 2774106 - RNA, 23 nt, Human
auugcucaaguucauugaugacc

SEQ ID NO: 2774107 - RNA, 16 nt, Human
auugcucccuaagacu

SEQ ID NO: 2774108 - RNA, 18 nt, Human
auugcucccuaagacugu

SEQ ID NO: 2774109 - RNA, 19 nt, Human
auugcucccuaagacugug

SEQ ID NO: 2774110 - RNA, 18 nt, Human
auugcuugagcccaggag

SEQ ID NO: 2774111 - RNA, 17 nt, Human
auugcuugagcccagga

SEQ ID NO: 2774112 - RNA, 23 nt, Human
auugcugucaaguuccuuugggu

SEQ ID NO: 2774113 - RNA, 22 nt, Human
auugcuguaggaucuaaggcug

SEQ ID NO: 2774114 - RNA, 16 nt, Human
auugcuuccuccuccc

SEQ ID NO: 2774115 - RNA, 19 nt, Human
auugcuuccuccuccccaa

SEQ ID NO: 2774116 - RNA, 23 nt, Human
auugcugagccucugcuccccag

SEQ ID NO: 2774117 - RNA, 12 nt, Human
auugcugauuuu

SEQ ID NO: 2774118 - RNA, 13 nt, Human
auugcugauuuua

SEQ ID NO: 2774119 - RNA, 15 nt, Human
auugcugauuuuaau

SEQ ID NO: 2774120 - RNA, 17 nt, Human
auugcugauuuuaaugg

SEQ ID NO: 2774121 - RNA, 23 nt, Human
auugcugcaaggacauucuugua

SEQ ID NO: 2774122 - RNA, 14 nt, Human
auugcugccacuuu

SEQ ID NO: 2774123 - RNA, 21 nt, Human
auugcugccacuuuuuaacua

SEQ ID NO: 2774124 - RNA, 18 nt, Human
auuguugacaguucugaa

SEQ ID NO: 2774125 - RNA, 17 nt, Human
auuguugacaguucuga

SEQ ID NO: 2774126 - RNA, 19 nt, Human
auuguugagcuauugcugu

SEQ ID NO: 2774127 - RNA, 16 nt, Human
auuguugagcuauugc

SEQ ID NO: 2774128 - RNA, 21 nt, Human
auuguugacaguucugaagaa

SEQ ID NO: 2774129 - RNA, 22 nt, Human
auuguugacaguucugaagaau

SEQ ID NO: 2774130 - RNA, 21 nt, Human
auuguugaugggcacuugaga

SEQ ID NO: 2774131 - RNA, 14 nt, Human
auuguugcucccug

SEQ ID NO: 2774132 - RNA, 16 nt, Human
auuguugcucccugug

SEQ ID NO: 2774133 - RNA, 16 nt, Human
auuguugcugaaacuu

SEQ ID NO: 2774134 - RNA, 14 nt, Human
auuguuguauaauu

SEQ ID NO: 2774135 - RNA, 15 nt, Human
auuguuguauaauuu

SEQ ID NO: 2774136 - RNA, 15 nt, Human
auugagucaaauggu

SEQ ID NO: 2774137 - RNA, 14 nt, Human
auugaguuuguagg

SEQ ID NO: 2774138 - RNA, 16 nt, Human
auugaguuuguaggua

SEQ ID NO: 2774139 - RNA, 20 nt, Human
auugaguuuguagguaaaau

SEQ ID NO: 2774140 - RNA, 21 nt, Human
auugaguuuguagguaaaaug

SEQ ID NO: 2774141 - RNA, 18 nt, Human
auugauaaugcuuucaca

SEQ ID NO: 2774142 - RNA, 16 nt, Human
auugauaauugcauuc

SEQ ID NO: 2774143 - RNA, 15 nt, Human
auugauacucuuucu

SEQ ID NO: 2774144 - RNA, 21 nt, Human
auugauacucuuucuaaugcu

SEQ ID NO: 2774145 - RNA, 16 nt, Human
auugagguaaguuuuu

SEQ ID NO: 2774146 - RNA, 22 nt, Human
auugcuacuguccuacccaccc

SEQ ID NO: 2774147 - RNA, 20 nt, Human
auugcuacuguccuacccac

SEQ ID NO: 2774148 - RNA, 14 nt, Human
auugcuagauaaaa

SEQ ID NO: 2774149 - RNA, 16 nt, Human
auugcuagauaaaagc

SEQ ID NO: 2774150 - RNA, 17 nt, Human
auugcuagauaaaagcu

SEQ ID NO: 2774151 - RNA, 13 nt, Human
auugcuaguauuu

SEQ ID NO: 2774152 - RNA, 14 nt, Human
auugcuaguauuug

SEQ ID NO: 2774153 - RNA, 15 nt, Human
auugcuaguauuuga

SEQ ID NO: 2774154 - RNA, 16 nt, Human
auugcuaguauuugaa

SEQ ID NO: 2774155 - RNA, 17 nt, Human
auugcuaguauuugaau

SEQ ID NO: 2774156 - RNA, 18 nt, Human
auugcuaguauuugaauu

SEQ ID NO: 2774157 - RNA, 19 nt, Human
auugcuaguauuugaauua

SEQ ID NO: 2774158 - RNA, 20 nt, Human
auugcuaguauuugaauuaa

SEQ ID NO: 2774159 - RNA, 15 nt, Human
auugcuauuguguua

SEQ ID NO: 2774160 - RNA, 22 nt, Human
auugcuaucuggaggccuucca

SEQ ID NO: 2774161 - RNA, 23 nt, Human
auugcuaucuggaggccuuccag

SEQ ID NO: 2774162 - RNA, 15 nt, Human
auugcuauguuacua

SEQ ID NO: 2774163 - RNA, 18 nt, Human
auugcuauguuacuauuu

SEQ ID NO: 2774164 - RNA, 20 nt, Human
auugcuauguuacuauuuuc

SEQ ID NO: 2774165 - RNA, 15 nt, Human
auugcuacuguccua

SEQ ID NO: 2774166 - RNA, 14 nt, Human
auugcuacuguccu

SEQ ID NO: 2774167 - RNA, 12 nt, Human
auucuuucccag

SEQ ID NO: 2774168 - RNA, 15 nt, Human
auucuuucccaguga

SEQ ID NO: 2774169 - RNA, 20 nt, Human
auucuuucccagugagucuc

SEQ ID NO: 2774170 - RNA, 18 nt, Human
auucuugaaggaaaauga

SEQ ID NO: 2774171 - RNA, 19 nt, Human
auucuucuguguuuauaaa

SEQ ID NO: 2774172 - RNA, 15 nt, Human
auucuugaaggaaaa

SEQ ID NO: 2774173 - RNA, 15 nt, Human
auucuucuguguuua

SEQ ID NO: 2774174 - RNA, 14 nt, Human
auucuucuguguuu

SEQ ID NO: 2774175 - RNA, 20 nt, Human
auucuugaaagaauuuuccu

SEQ ID NO: 2774176 - RNA, 14 nt, Human
auucuucugcuuca

SEQ ID NO: 2774177 - RNA, 13 nt, Human
auucuucuguguu

SEQ ID NO: 2774178 - RNA, 13 nt, Human
auucuucuguccu

SEQ ID NO: 2774179 - RNA, 15 nt, Human
auucuucuguccuga

SEQ ID NO: 2774180 - RNA, 12 nt, Human
auucuucugcuu

SEQ ID NO: 2774181 - RNA, 11 nt, Human
auucuucugcu

SEQ ID NO: 2774182 - RNA, 20 nt, Human
auucugaccacccuucucau

SEQ ID NO: 2774183 - RNA, 13 nt, Human
auucugaauauuu

SEQ ID NO: 2774184 - RNA, 16 nt, Human
auucucuuuuaucugu

SEQ ID NO: 2774185 - RNA, 17 nt, Human
auucucuuuuaucuguu

SEQ ID NO: 2774186 - RNA, 19 nt, Human
auucucuuuuaucuguuua

SEQ ID NO: 2774187 - RNA, 14 nt, Human
auucucuuucaaag

SEQ ID NO: 2774188 - RNA, 22 nt, Human
auucucuuguauaagauccuag

SEQ ID NO: 2774189 - RNA, 18 nt, Human
auucauaguaacuucuua

SEQ ID NO: 2774190 - RNA, 20 nt, Human
auucucuuguauaagauccu

SEQ ID NO: 2774191 - RNA, 17 nt, Human
auucauaguaacuucuu

SEQ ID NO: 2774192 - RNA, 16 nt, Human
auucauaguaacuucu

SEQ ID NO: 2774193 - RNA, 15 nt, Human
auucugaagcaacau

SEQ ID NO: 2774194 - RNA, 19 nt, Human
auucugaagcaacauuuua

SEQ ID NO: 2774195 - RNA, 12 nt, Human
cacagccucuga

SEQ ID NO: 2774196 - RNA, 13 nt, Human
cacagccucugac

SEQ ID NO: 2774197 - RNA, 14 nt, Human
cacagccucugacc

SEQ ID NO: 2774198 - RNA, 15 nt, Human
cacagccucugaccc

SEQ ID NO: 2774199 - RNA, 17 nt, Human
cacagccucugaccccu

SEQ ID NO: 2774200 - RNA, 20 nt, Human
cacagccucugaccccuccu

SEQ ID NO: 2774201 - RNA, 14 nt, Human
cacagccugggccc

SEQ ID NO: 2774202 - RNA, 12 nt, Human
cacagccugggc

SEQ ID NO: 2774203 - RNA, 22 nt, Human
cacagccucugaccccuccuca

SEQ ID NO: 2774204 - RNA, 23 nt, Human
cacagccucugaccccuccucac

SEQ ID NO: 2774205 - RNA, 19 nt, Human
cacagcgagggcagcugcu

SEQ ID NO: 2774206 - RNA, 18 nt, Human
cacagcgagggcagcugc

SEQ ID NO: 2774207 - RNA, 23 nt, Human
cacaggcccuuccucuccacugc

SEQ ID NO: 2774208 - RNA, 22 nt, Human
cacaggcccuuccucuccacug

SEQ ID NO: 2774209 - RNA, 17 nt, Human
cacagcgagggcagcug

SEQ ID NO: 2774210 - RNA, 16 nt, Human
cacagcgagggcagcu

SEQ ID NO: 2774211 - RNA, 15 nt, Human
cacagcgagggcagc

SEQ ID NO: 2774212 - RNA, 21 nt, Human
cacagccugggccccagcucg

SEQ ID NO: 2774213 - RNA, 19 nt, Human
cacagccugggccccagcu

SEQ ID NO: 2774214 - RNA, 14 nt, Human
cacagcgagggcag

SEQ ID NO: 2774215 - RNA, 17 nt, Human
cacaggggaggugauag

SEQ ID NO: 2774216 - RNA, 14 nt, Human
cacaggugugagcc

SEQ ID NO: 2774217 - RNA, 16 nt, Human
cacaggugugguguaa

SEQ ID NO: 2774218 - RNA, 19 nt, Human
cacaggugugguguaauuu

SEQ ID NO: 2774219 - RNA, 18 nt, Human
cacaggugggcuucccag

SEQ ID NO: 2774220 - RNA, 16 nt, Human
cacagguggugucacu

SEQ ID NO: 2774221 - RNA, 18 nt, Human
cacagguggugucacugu

SEQ ID NO: 2774222 - RNA, 20 nt, Human
cacagguggugucacugucc

SEQ ID NO: 2774223 - RNA, 21 nt, Human
cacagguggugucacuguccc

SEQ ID NO: 2774224 - RNA, 13 nt, Human
cacaggugucagc

SEQ ID NO: 2774225 - RNA, 14 nt, Human
cacaggugucagcc

SEQ ID NO: 2774226 - RNA, 16 nt, Human
cacaggugucagccau

SEQ ID NO: 2774227 - RNA, 17 nt, Human
cacaggugucagccauu

SEQ ID NO: 2774228 - RNA, 21 nt, Human
cacaguauuacuucugcuaca

SEQ ID NO: 2774229 - RNA, 20 nt, Human
cacaguauuacuucugcuac

SEQ ID NO: 2774230 - RNA, 13 nt, Human
cacaguaaauauc

SEQ ID NO: 2774231 - RNA, 17 nt, Human
cacaguacagcaugugc

SEQ ID NO: 2774232 - RNA, 18 nt, Human
cacaguacagcaugugcc

SEQ ID NO: 2774233 - RNA, 19 nt, Human
cacaguacagcaugugccu

SEQ ID NO: 2774234 - RNA, 20 nt, Human
cacaguacagcaugugccuu

SEQ ID NO: 2774235 - RNA, 16 nt, Human
cacaguacauaauaca

SEQ ID NO: 2774236 - RNA, 23 nt, Human
cacaguacauaauacacuugccc

SEQ ID NO: 2774237 - RNA, 15 nt, Human
cacaguagagccagc

SEQ ID NO: 2774238 - RNA, 14 nt, Human
cacaguagagccag

SEQ ID NO: 2774239 - RNA, 19 nt, Human
cacagguucaugccaccau

SEQ ID NO: 2774240 - RNA, 15 nt, Human
cacagguuggaagag

SEQ ID NO: 2774241 - RNA, 16 nt, Human
cacagguuggaagaga

SEQ ID NO: 2774242 - RNA, 18 nt, Human
cacagguuggaagagaau

SEQ ID NO: 2774243 - RNA, 20 nt, Human
cacagguuggaagagaauca

SEQ ID NO: 2774244 - RNA, 21 nt, Human
cacagguuggaagagaaucac

SEQ ID NO: 2774245 - RNA, 15 nt, Human
cacagguguuuauac

SEQ ID NO: 2774246 - RNA, 20 nt, Human
cacagguucacgugcagcuc

SEQ ID NO: 2774247 - RNA, 17 nt, Human
cacaguagagccagcuu

SEQ ID NO: 2774248 - RNA, 16 nt, Human
cacaguagagccagcu

SEQ ID NO: 2774249 - RNA, 14 nt, Human
cacagucaaaauaa

SEQ ID NO: 2774250 - RNA, 16 nt, Human
cacagucaaaauaauu

SEQ ID NO: 2774251 - RNA, 17 nt, Human
cacagucaaaauaauuc

SEQ ID NO: 2774252 - RNA, 22 nt, Human
cacagucaccuucucggcaacu

SEQ ID NO: 2774253 - RNA, 16 nt, Human
cacagucacugaugua

SEQ ID NO: 2774254 - RNA, 19 nt, Human
cacagucacugauguacaa

SEQ ID NO: 2774255 - RNA, 13 nt, Human
cacaguccaggaa

SEQ ID NO: 2774256 - RNA, 16 nt, Human
cacaguccaggaacaa

SEQ ID NO: 2774257 - RNA, 18 nt, Human
cacaguccaggaacaagc

SEQ ID NO: 2774258 - RNA, 22 nt, Human
cacaguccaggaacaagcuaau

SEQ ID NO: 2774259 - RNA, 17 nt, Human
cacagucccacugugca

SEQ ID NO: 2774260 - RNA, 13 nt, Human
cacacaucaggag

SEQ ID NO: 2774261 - RNA, 14 nt, Human
cacacauccacccc

SEQ ID NO: 2774262 - RNA, 16 nt, Human
cacacauccaccccag

SEQ ID NO: 2774263 - RNA, 12 nt, Human
cacacaucccag

SEQ ID NO: 2774264 - RNA, 13 nt, Human
cacacaucccagc

SEQ ID NO: 2774265 - RNA, 14 nt, Human
cacacaucccagcc

SEQ ID NO: 2774266 - RNA, 16 nt, Human
cacacaucccagccca

SEQ ID NO: 2774267 - RNA, 17 nt, Human
cacacaucccagcccaa

SEQ ID NO: 2774268 - RNA, 23 nt, Human
cacacagugagucgaggacaggg

SEQ ID NO: 2774269 - RNA, 21 nt, Human
cacacagugagucgaggacag

SEQ ID NO: 2774270 - RNA, 15 nt, Human
cacacauacacacac

SEQ ID NO: 2774271 - RNA, 20 nt, Human
cacacauauauauuacaagg

SEQ ID NO: 2774272 - RNA, 22 nt, Human
cacacauagauuaauggcacug

SEQ ID NO: 2774273 - RNA, 23 nt, Human
cacacauagauuaauggcacuga

SEQ ID NO: 2774274 - RNA, 23 nt, Human
cacacauauaaacaucacacaca

SEQ ID NO: 2774275 - RNA, 21 nt, Human
cacacauauaaacaucacaca

SEQ ID NO: 2774276 - RNA, 22 nt, Human
cacacaggggaggugauagcau

SEQ ID NO: 2774277 - RNA, 16 nt, Human
cacacagcucuguccu

SEQ ID NO: 2774278 - RNA, 23 nt, Human
cacacaguauuacuucugcuaca

SEQ ID NO: 2774279 - RNA, 20 nt, Human
cacacaguauuacuucugcu

SEQ ID NO: 2774280 - RNA, 18 nt, Human
cacacagugagucgagga

SEQ ID NO: 2774281 - RNA, 23 nt, Human
cacacagggucugcaaggucuuu

SEQ ID NO: 2774282 - RNA, 18 nt, Human
cacacagguggugucacu

SEQ ID NO: 2774283 - RNA, 20 nt, Human
cacacagguggugucacugu

SEQ ID NO: 2774284 - RNA, 22 nt, Human
cacacagguggugucacugucc

SEQ ID NO: 2774285 - RNA, 14 nt, Human
cacacagguguuga

SEQ ID NO: 2774286 - RNA, 13 nt, Human
cacacaugcacac

SEQ ID NO: 2774287 - RNA, 14 nt, Human
cacacaugcacaca

SEQ ID NO: 2774288 - RNA, 20 nt, Human
cacagaaacacugccuuuuu

SEQ ID NO: 2774289 - RNA, 19 nt, Human
cacagaaacacugccuuuu

SEQ ID NO: 2774290 - RNA, 18 nt, Human
cacagaaacacugccuuu

SEQ ID NO: 2774291 - RNA, 17 nt, Human
cacagaaacacugccuu

SEQ ID NO: 2774292 - RNA, 11 nt, Human
cacagaaacac

SEQ ID NO: 2774293 - RNA, 15 nt, Human
cacagaaacacugcc

SEQ ID NO: 2774294 - RNA, 16 nt, Human
cacagaaacacugccu

SEQ ID NO: 2774295 - RNA, 11 nt, Human
cacagccucug

SEQ ID NO: 2774296 - RNA, 23 nt, Human
caauuuauuaaaaugauuguaaa

SEQ ID NO: 2774297 - RNA, 14 nt, Human
caauuuauuaaaau

SEQ ID NO: 2774298 - RNA, 22 nt, Human
caauuuauuaaaaugauuguaa

SEQ ID NO: 2774299 - RNA, 13 nt, Human
caauggauauuug

SEQ ID NO: 2774300 - RNA, 13 nt, Human
caauggauuugau

SEQ ID NO: 2774301 - RNA, 17 nt, Human
caauggauuugaugcug

SEQ ID NO: 2774302 - RNA, 19 nt, Human
caauggauuugaugcuguu

SEQ ID NO: 2774303 - RNA, 22 nt, Human
caauggauuugaugcuguuuga

SEQ ID NO: 2774304 - RNA, 20 nt, Human
caauggagacugucucaaga

SEQ ID NO: 2774305 - RNA, 12 nt, Human
caauggcagccu

SEQ ID NO: 2774306 - RNA, 11 nt, Human
caauggcagcc

SEQ ID NO: 2774307 - RNA, 11 nt, Human
caauuuaaaug

SEQ ID NO: 2774308 - RNA, 14 nt, Human
caauuuaaauguua

SEQ ID NO: 2774309 - RNA, 13 nt, Human
caauuuaaauguu

SEQ ID NO: 2774310 - RNA, 20 nt, Human
cacacagcucuguccuggga

SEQ ID NO: 2774311 - RNA, 17 nt, Human
cacacagcucuguccug

SEQ ID NO: 2774312 - RNA, 15 nt, Human
caaguccaauaagac

SEQ ID NO: 2774313 - RNA, 18 nt, Human
caaguccaauaagacacu

SEQ ID NO: 2774314 - RNA, 17 nt, Human
caagucaugugcauuuc

SEQ ID NO: 2774315 - RNA, 18 nt, Human
caagucacaugcguaaac

SEQ ID NO: 2774316 - RNA, 14 nt, Human
caagucaaucauuu

SEQ ID NO: 2774317 - RNA, 15 nt, Human
caagucaaucauuuc

SEQ ID NO: 2774318 - RNA, 16 nt, Human
caagucaaucauuucu

SEQ ID NO: 2774319 - RNA, 17 nt, Human
caagucaaucauuucuc

SEQ ID NO: 2774320 - RNA, 23 nt, Human
caagucaaaauauuuuuaaaaga

SEQ ID NO: 2774321 - RNA, 18 nt, Human
caaguauagccuauggca

SEQ ID NO: 2774322 - RNA, 22 nt, Human
caaguauccaaccaacuugguu

SEQ ID NO: 2774323 - RNA, 11 nt, Human
caaguauuuug

SEQ ID NO: 2774324 - RNA, 19 nt, Human
caaguaugaauaaagacac

SEQ ID NO: 2774325 - RNA, 21 nt, Human
caaguaugaauaaagacaccu

SEQ ID NO: 2774326 - RNA, 16 nt, Human
caaguaugaauaaaga

SEQ ID NO: 2774327 - RNA, 19 nt, Human
caaggcacucuagauucca

SEQ ID NO: 2774328 - RNA, 20 nt, Human
caaguauaauuuuuuguaau

SEQ ID NO: 2774329 - RNA, 12 nt, Human
caagcucucuug

SEQ ID NO: 2774330 - RNA, 14 nt, Human
caagcucucuugcc

SEQ ID NO: 2774331 - RNA, 12 nt, Human
caaggcacugcc

SEQ ID NO: 2774332 - RNA, 13 nt, Human
caaggcacugccu

SEQ ID NO: 2774333 - RNA, 16 nt, Human
caaggcacuguacuag

SEQ ID NO: 2774334 - RNA, 15 nt, Human
caaggcacuguacua

SEQ ID NO: 2774335 - RNA, 14 nt, Human
caaggcacugccug

SEQ ID NO: 2774336 - RNA, 15 nt, Human
caaggcacugccuga

SEQ ID NO: 2774337 - RNA, 16 nt, Human
caaggcacugccugau

SEQ ID NO: 2774338 - RNA, 18 nt, Human
caaggcacugccugaugg

SEQ ID NO: 2774339 - RNA, 14 nt, Human
caagcucugcuccu

SEQ ID NO: 2774340 - RNA, 13 nt, Human
caagcucugcucc

SEQ ID NO: 2774341 - RNA, 18 nt, Human
caagcucaggaccaggca

SEQ ID NO: 2774342 - RNA, 19 nt, Human
caagcucuaucaccaagga

SEQ ID NO: 2774343 - RNA, 16 nt, Human
caagcuauuccuuucc

SEQ ID NO: 2774344 - RNA, 17 nt, Human
caagcuauuccuuuccc

SEQ ID NO: 2774345 - RNA, 18 nt, Human
caagcuauuccuuucccu

SEQ ID NO: 2774346 - RNA, 19 nt, Human
caagcuauuccuuucccuu

SEQ ID NO: 2774347 - RNA, 20 nt, Human
caagcuauuccuuucccuuc

SEQ ID NO: 2774348 - RNA, 21 nt, Human
caagcuauuccuuucccuucc

SEQ ID NO: 2774349 - RNA, 23 nt, Human
caagcuauuccuuucccuuccuc

SEQ ID NO: 2774350 - RNA, 15 nt, Human
caagcuauccuggcu

SEQ ID NO: 2774351 - RNA, 16 nt, Human
caagcuauccuggcuc

SEQ ID NO: 2774352 - RNA, 15 nt, Human
caagcuaucuaaagu

SEQ ID NO: 2774353 - RNA, 16 nt, Human
caagcuaucuaaaguu

SEQ ID NO: 2774354 - RNA, 17 nt, Human
caagcuaucuaaaguuu

SEQ ID NO: 2774355 - RNA, 21 nt, Human
caagcuaucuaaaguuuguua

SEQ ID NO: 2774356 - RNA, 21 nt, Human
caagcuaauugggaguccagg

SEQ ID NO: 2774357 - RNA, 23 nt, Human
caagcuaauugggaguccaggca

SEQ ID NO: 2774358 - RNA, 16 nt, Human
caagcucaaagcgugg

SEQ ID NO: 2774359 - RNA, 16 nt, Human
caagcucaggaccagg

SEQ ID NO: 2774360 - RNA, 18 nt, Human
caagucccugacucucug

SEQ ID NO: 2774361 - RNA, 17 nt, Human
caagucccccaagaccu

SEQ ID NO: 2774362 - RNA, 21 nt, Human
caagucccugacucucuguga

SEQ ID NO: 2774363 - RNA, 20 nt, Human
caagucccugacucucugug

SEQ ID NO: 2774364 - RNA, 14 nt, Human
caagcuaagcacug

SEQ ID NO: 2774365 - RNA, 13 nt, Human
caagcuaaccuua

SEQ ID NO: 2774366 - RNA, 22 nt, Human
caagcuaaccuuauccugcauu

SEQ ID NO: 2774367 - RNA, 16 nt, Human
caagcuaagcacugcc

SEQ ID NO: 2774368 - RNA, 22 nt, Human
caagcuaagcacugccacuggg

SEQ ID NO: 2774369 - RNA, 14 nt, Human
cacuaggcuucugg

SEQ ID NO: 2774370 - RNA, 16 nt, Human
cacuccagccugggug

SEQ ID NO: 2774371 - RNA, 15 nt, Human
cacuccagccugggu

SEQ ID NO: 2774372 - RNA, 23 nt, Human
cacuccagccugggcgacagagc

SEQ ID NO: 2774373 - RNA, 15 nt, Human
cacuccagcugggau

SEQ ID NO: 2774374 - RNA, 12 nt, Human
cacuccagcugg

SEQ ID NO: 2774375 - RNA, 11 nt, Human
cacuccagcug

SEQ ID NO: 2774376 - RNA, 17 nt, Human
cacuagguucaauuccc

SEQ ID NO: 2774377 - RNA, 17 nt, Human
cacuaguaaguaauuau

SEQ ID NO: 2774378 - RNA, 21 nt, Human
cacuaguaaguaauuaugcac

SEQ ID NO: 2774379 - RNA, 16 nt, Human
cacucauugcugagcc

SEQ ID NO: 2774380 - RNA, 19 nt, Human
cacucauugcugagccucu

SEQ ID NO: 2774381 - RNA, 21 nt, Human
cacucauugcugagccucugc

SEQ ID NO: 2774382 - RNA, 23 nt, Human
cacucauugcugagccucugcuc

SEQ ID NO: 2774383 - RNA, 22 nt, Human
cacucauuuucuauaacagaua

SEQ ID NO: 2774384 - RNA, 16 nt, Human
cacuccaaccuaaccu

SEQ ID NO: 2774385 - RNA, 21 nt, Human
cacuccaaccuaaccuguguc

SEQ ID NO: 2774386 - RNA, 22 nt, Human
cacuccaaccuaaccugugucu

SEQ ID NO: 2774387 - RNA, 23 nt, Human
cacuccaaccuaaccugugucug

SEQ ID NO: 2774388 - RNA, 21 nt, Human
cacuccaaugucugcugagga

SEQ ID NO: 2774389 - RNA, 23 nt, Human
cacugacacugguauuccugccu

SEQ ID NO: 2774390 - RNA, 13 nt, Human
cacugaauuuaua

SEQ ID NO: 2774391 - RNA, 14 nt, Human
cacugaauuuauaa

SEQ ID NO: 2774392 - RNA, 15 nt, Human
cacugaauuuauaaa

SEQ ID NO: 2774393 - RNA, 19 nt, Human
cacugaauuuauaaaguac

SEQ ID NO: 2774394 - RNA, 14 nt, Human
cacugaauuuugga

SEQ ID NO: 2774395 - RNA, 13 nt, Human
cacugacacaaag

SEQ ID NO: 2774396 - RNA, 14 nt, Human
cacugacacaaagg

SEQ ID NO: 2774397 - RNA, 15 nt, Human
cacugacacaaagga

SEQ ID NO: 2774398 - RNA, 13 nt, Human
cacugacacuggu

SEQ ID NO: 2774399 - RNA, 20 nt, Human
cacugacacugguauuccug

SEQ ID NO: 2774400 - RNA, 15 nt, Human
cacugaauuaaucau

SEQ ID NO: 2774401 - RNA, 14 nt, Human
cacucuuuuauaca

SEQ ID NO: 2774402 - RNA, 15 nt, Human
cacucuuuuauacaa

SEQ ID NO: 2774403 - RNA, 23 nt, Human
cacucuuuugcuuuauuccagaa

SEQ ID NO: 2774404 - RNA, 16 nt, Human
cacucuuuauagugca

SEQ ID NO: 2774405 - RNA, 20 nt, Human
cacucuuuauagugcacaaa

SEQ ID NO: 2774406 - RNA, 15 nt, Human
cacucuuuugcuuua

SEQ ID NO: 2774407 - RNA, 12 nt, Human
cacugcagccuc

SEQ ID NO: 2774408 - RNA, 20 nt, Human
cacugcacuccagccugggc

SEQ ID NO: 2774409 - RNA, 17 nt, Human
cacugcacuccagccug

SEQ ID NO: 2774410 - RNA, 15 nt, Human
cacugcacuccaggc

SEQ ID NO: 2774411 - RNA, 21 nt, Human
cacugcacucaaccuuaagac

SEQ ID NO: 2774412 - RNA, 19 nt, Human
cacugcacuccagccuggg

SEQ ID NO: 2774413 - RNA, 18 nt, Human
cacugcacuccagccugg

SEQ ID NO: 2774414 - RNA, 16 nt, Human
cacugcacuccagccu

SEQ ID NO: 2774415 - RNA, 19 nt, Human
cacugcacuauagccuagg

SEQ ID NO: 2774416 - RNA, 17 nt, Human
cacugcacucaaccuua

SEQ ID NO: 2774417 - RNA, 14 nt, Human
cacuggggccuaca

SEQ ID NO: 2774418 - RNA, 16 nt, Human
cacuggggccuacagc

SEQ ID NO: 2774419 - RNA, 18 nt, Human
cacugggaaacagaggcu

SEQ ID NO: 2774420 - RNA, 13 nt, Human
cacugggaaacag

SEQ ID NO: 2774421 - RNA, 16 nt, Human
cacugcauccuccgcc

SEQ ID NO: 2774422 - RNA, 14 nt, Human
cacugcauccuccg

SEQ ID NO: 2774423 - RNA, 13 nt, Human
cacugcagccuca

SEQ ID NO: 2774424 - RNA, 16 nt, Human
cacugcauaccaaccu

SEQ ID NO: 2774425 - RNA, 20 nt, Human
cacugccagcagcagcaggu

SEQ ID NO: 2774426 - RNA, 19 nt, Human
cacugccagcagcagcagg

SEQ ID NO: 2774427 - RNA, 16 nt, Human
cacugccagcagcagc

SEQ ID NO: 2774428 - RNA, 14 nt, Human
cacugccagcagca

SEQ ID NO: 2774429 - RNA, 22 nt, Human
cacugccagcagcagcagguga

SEQ ID NO: 2774430 - RNA, 21 nt, Human
cacugccagcagcagcaggug

SEQ ID NO: 2774431 - RNA, 13 nt, Human
cacugccagcagc

SEQ ID NO: 2774432 - RNA, 12 nt, Human
cacugccagcag

SEQ ID NO: 2774433 - RNA, 20 nt, Human
cacugccacacucuccauca

SEQ ID NO: 2774434 - RNA, 12 nt, Human
cacugccacugg

SEQ ID NO: 2774435 - RNA, 14 nt, Human
cacugccacuuugc

SEQ ID NO: 2774436 - RNA, 18 nt, Human
cacugccacuuugcacau

SEQ ID NO: 2774437 - RNA, 19 nt, Human
cacugccacuuugcacauu

SEQ ID NO: 2774438 - RNA, 20 nt, Human
cacugccacuuugcacauuu

SEQ ID NO: 2774439 - RNA, 22 nt, Human
cacugccacuuugcacauuuug

SEQ ID NO: 2774440 - RNA, 19 nt, Human
cacugccagagauaaacua

SEQ ID NO: 2774441 - RNA, 18 nt, Human
cacugcauccuccgccuc

SEQ ID NO: 2774442 - RNA, 18 nt, Human
cacugcaugagcuuuuau

SEQ ID NO: 2774443 - RNA, 22 nt, Human
cacugcaugagcuuuuauacua

SEQ ID NO: 2774444 - RNA, 19 nt, Human
cacugcauggcucccacag

SEQ ID NO: 2774445 - RNA, 18 nt, Human
cacugcauuauucucuuu

SEQ ID NO: 2774446 - RNA, 19 nt, Human
cacugcauuauucucuuuu

SEQ ID NO: 2774447 - RNA, 15 nt, Human
cacuuguuccagcuc

SEQ ID NO: 2774448 - RNA, 13 nt, Human
cacuuguuccagc

SEQ ID NO: 2774449 - RNA, 17 nt, Human
cacuuguuccagcucuu

SEQ ID NO: 2774450 - RNA, 16 nt, Human
cacuuguuccagcucu

SEQ ID NO: 2774451 - RNA, 20 nt, Human
cacuugucacugacacaaag

SEQ ID NO: 2774452 - RNA, 22 nt, Human
cacuugucacugacacaaagga

SEQ ID NO: 2774453 - RNA, 14 nt, Human
cacuuguaggauaa

SEQ ID NO: 2774454 - RNA, 23 nt, Human
cacuuguaggauaagugaaaugg

SEQ ID NO: 2774455 - RNA, 12 nt, Human
cacuuguauaaa

SEQ ID NO: 2774456 - RNA, 15 nt, Human
cacuuguauaaaugu

SEQ ID NO: 2774457 - RNA, 19 nt, Human
cacuuguauaaauguauau

SEQ ID NO: 2774458 - RNA, 20 nt, Human
cacuuguauaaauguauaua

SEQ ID NO: 2774459 - RNA, 21 nt, Human
cacuuguauauacgcaucuau

SEQ ID NO: 2774460 - RNA, 19 nt, Human
cacuuguauccucugguuc

SEQ ID NO: 2774461 - RNA, 13 nt, Human
cacuuguauauac

SEQ ID NO: 2774462 - RNA, 16 nt, Human
cacuuguauauacgca

SEQ ID NO: 2774463 - RNA, 17 nt, Human
cacuuguacaaaauaaa

SEQ ID NO: 2774464 - RNA, 20 nt, Human
cacuuauuccccauucuucc

SEQ ID NO: 2774465 - RNA, 24 nt, Human
cacuuagaaauugcauuuccugac

SEQ ID NO: 2774466 - RNA, 23 nt, Human
cacuuaggaacguaaucgugucc

SEQ ID NO: 2774467 - RNA, 15 nt, Human
cacuuagcuaucaga

SEQ ID NO: 2774468 - RNA, 15 nt, Human
cacuuaggcuuugua

SEQ ID NO: 2774469 - RNA, 23 nt, Human
cacuuauaagguguuuucugugu

SEQ ID NO: 2774470 - RNA, 19 nt, Human
cacuuaucauuagaaucuu

SEQ ID NO: 2774471 - RNA, 18 nt, Human
cacugguguuuaggugaa

SEQ ID NO: 2774472 - RNA, 20 nt, Human
cacuggugugaccugagggc

SEQ ID NO: 2774473 - RNA, 19 nt, Human
cacugggguccagggagca

SEQ ID NO: 2774474 - RNA, 23 nt, Human
cacugguggcccgacagccuggc

SEQ ID NO: 2774475 - RNA, 19 nt, Human
cacuggugugaccugaggg

SEQ ID NO: 2774476 - RNA, 12 nt, Human
cacugguucuca

SEQ ID NO: 2774477 - RNA, 13 nt, Human
cacuuacauauau

SEQ ID NO: 2774478 - RNA, 19 nt, Human
cacuuacauauauuuuuaa

SEQ ID NO: 2774479 - RNA, 11 nt, Human
caccccagagc

SEQ ID NO: 2774480 - RNA, 12 nt, Human
caccccagagcc

SEQ ID NO: 2774481 - RNA, 14 nt, Human
caccccagagccac

SEQ ID NO: 2774482 - RNA, 15 nt, Human
caccccagagccaca

SEQ ID NO: 2774483 - RNA, 16 nt, Human
caccccagagccacac

SEQ ID NO: 2774484 - RNA, 17 nt, Human
caccccagagccacaca

SEQ ID NO: 2774485 - RNA, 18 nt, Human
caccccagagccacacau

SEQ ID NO: 2774486 - RNA, 19 nt, Human
caccccagagccacacaug

SEQ ID NO: 2774487 - RNA, 22 nt, Human
caccccagagccacacaugggc

SEQ ID NO: 2774488 - RNA, 18 nt, Human
caccccacgccuuauccc

SEQ ID NO: 2774489 - RNA, 22 nt, Human
caccccacugcaauccugucuu

SEQ ID NO: 2774490 - RNA, 14 nt, Human
caccccaccugcag

SEQ ID NO: 2774491 - RNA, 14 nt, Human
caccccacccuucc

SEQ ID NO: 2774492 - RNA, 15 nt, Human
caccccacccucccu

SEQ ID NO: 2774493 - RNA, 19 nt, Human
caccccacccucccuggag

SEQ ID NO: 2774494 - RNA, 20 nt, Human
caccccacccucccuggagu

SEQ ID NO: 2774495 - RNA, 12 nt, Human
caccccaccugc

SEQ ID NO: 2774496 - RNA, 11 nt, Human
caccccaccug

SEQ ID NO: 2774497 - RNA, 13 nt, Human
caccccacccucc

SEQ ID NO: 2774498 - RNA, 17 nt, Human
cacccuccaccucuuca

SEQ ID NO: 2774499 - RNA, 14 nt, Human
cacccuccaccucu

SEQ ID NO: 2774500 - RNA, 20 nt, Human
cacccucccccgccacuccu

SEQ ID NO: 2774501 - RNA, 13 nt, Human
cacccucccugga

SEQ ID NO: 2774502 - RNA, 16 nt, Human
cacccuggggagaaag

SEQ ID NO: 2774503 - RNA, 15 nt, Human
cacccuggggagaaa

SEQ ID NO: 2774504 - RNA, 14 nt, Human
cacccucuuccugu

SEQ ID NO: 2774505 - RNA, 15 nt, Human
cacccucuuccugug

SEQ ID NO: 2774506 - RNA, 12 nt, Human
cacccucuggcc

SEQ ID NO: 2774507 - RNA, 13 nt, Human
cacccucuggccg

SEQ ID NO: 2774508 - RNA, 13 nt, Human
cacccucuguacc

SEQ ID NO: 2774509 - RNA, 16 nt, Human
cacccucccuggagug

SEQ ID NO: 2774510 - RNA, 11 nt, Human
cacccuccugg

SEQ ID NO: 2774511 - RNA, 12 nt, Human
cacccuccuggc

SEQ ID NO: 2774512 - RNA, 18 nt, Human
cacccuccuggccucaga

SEQ ID NO: 2774513 - RNA, 19 nt, Human
cacccuccuggccucagac

SEQ ID NO: 2774514 - RNA, 22 nt, Human
cacccuccuggccucagacugc

SEQ ID NO: 2774515 - RNA, 14 nt, Human
cacccucccuggag

SEQ ID NO: 2774516 - RNA, 15 nt, Human
cacccucccuggagu

SEQ ID NO: 2774517 - RNA, 15 nt, Human
caccucaggccaggu

SEQ ID NO: 2774518 - RNA, 23 nt, Human
caccugccucggccucccaaagu

SEQ ID NO: 2774519 - RNA, 10 nt, Human
caccugccug

SEQ ID NO: 2774520 - RNA, 11 nt, Human
caccugccugc

SEQ ID NO: 2774521 - RNA, 14 nt, Human
caccugccugcguc

SEQ ID NO: 2774522 - RNA, 15 nt, Human
caccugccugcgucu

SEQ ID NO: 2774523 - RNA, 16 nt, Human
caccugccugcgucuu

SEQ ID NO: 2774524 - RNA, 20 nt, Human
caccugccugcgucuuccgc

SEQ ID NO: 2774525 - RNA, 21 nt, Human
caccugccugcgucuuccgcc

SEQ ID NO: 2774526 - RNA, 23 nt, Human
caccugccugcgucuuccgcccc

SEQ ID NO: 2774527 - RNA, 11 nt, Human
caccugccugg

SEQ ID NO: 2774528 - RNA, 12 nt, Human
caccugccuggc

SEQ ID NO: 2774529 - RNA, 13 nt, Human
caccugccuggcc

SEQ ID NO: 2774530 - RNA, 14 nt, Human
caccugccuggccg

SEQ ID NO: 2774531 - RNA, 16 nt, Human
caccugccuggccggc

SEQ ID NO: 2774532 - RNA, 18 nt, Human
caccugccuggccggcca

SEQ ID NO: 2774533 - RNA, 19 nt, Human
caccugccuggccggccag

SEQ ID NO: 2774534 - RNA, 20 nt, Human
caccugccuggccggccagc

SEQ ID NO: 2774535 - RNA, 21 nt, Human
caccugccuggccggccagcc

SEQ ID NO: 2774536 - RNA, 22 nt, Human
caccugccuggccggccagcca

SEQ ID NO: 2774537 - RNA, 13 nt, Human
caccucagccucc

SEQ ID NO: 2774538 - RNA, 14 nt, Human
caccucagccuccc

SEQ ID NO: 2774539 - RNA, 17 nt, Human
caccucagccugcacag

SEQ ID NO: 2774540 - RNA, 14 nt, Human
caccucagccugca

SEQ ID NO: 2774541 - RNA, 12 nt, Human
caccucagccug

SEQ ID NO: 2774542 - RNA, 16 nt, Human
caccucagccucccaa

SEQ ID NO: 2774543 - RNA, 21 nt, Human
caccuaauucgaugaaggcug

SEQ ID NO: 2774544 - RNA, 22 nt, Human
caccuaauucgaugaaggcugc

SEQ ID NO: 2774545 - RNA, 23 nt, Human
caccuaauucgaugaaggcugcc

SEQ ID NO: 2774546 - RNA, 17 nt, Human
caccuacaauacaucug

SEQ ID NO: 2774547 - RNA, 13 nt, Human
caccuuggcugca

SEQ ID NO: 2774548 - RNA, 15 nt, Human
caccuuggcucaagu

SEQ ID NO: 2774549 - RNA, 14 nt, Human
caccuuggcucaag

SEQ ID NO: 2774550 - RNA, 14 nt, Human
caccuuggcugcag

SEQ ID NO: 2774551 - RNA, 23 nt, Human
caccugccuguuaggagaagcug

SEQ ID NO: 2774552 - RNA, 18 nt, Human
caccugccuguuaggaga

SEQ ID NO: 2774553 - RNA, 14 nt, Human
caccugccuccucg

SEQ ID NO: 2774554 - RNA, 20 nt, Human
caugaauucuuaugcuuaua

SEQ ID NO: 2774555 - RNA, 18 nt, Human
caugaauuuauugcacau

SEQ ID NO: 2774556 - RNA, 22 nt, Human
caugaauuuauugcacauuguu

SEQ ID NO: 2774557 - RNA, 23 nt, Human
caugaauuuauugcacauuguuc

SEQ ID NO: 2774558 - RNA, 18 nt, Human
caugaauucuuaugcuua

SEQ ID NO: 2774559 - RNA, 16 nt, Human
caugacauguuauaua

SEQ ID NO: 2774560 - RNA, 15 nt, Human
caugacauguuauau

SEQ ID NO: 2774561 - RNA, 21 nt, Human
caugacacccgugagcgccug

SEQ ID NO: 2774562 - RNA, 23 nt, Human
caugacacccgugagcgccugug

SEQ ID NO: 2774563 - RNA, 17 nt, Human
caugacauguuauauau

SEQ ID NO: 2774564 - RNA, 19 nt, Human
caugacauguuauauauuu

SEQ ID NO: 2774565 - RNA, 17 nt, Human
caugacauuuaccagca

SEQ ID NO: 2774566 - RNA, 20 nt, Human
caugacauuuaccagcaacu

SEQ ID NO: 2774567 - RNA, 18 nt, Human
caugaccauacugaggga

SEQ ID NO: 2774568 - RNA, 13 nt, Human
caugacccaggcu

SEQ ID NO: 2774569 - RNA, 15 nt, Human
caugacccaggcugg

SEQ ID NO: 2774570 - RNA, 16 nt, Human
caugacccaggcuggg

SEQ ID NO: 2774571 - RNA, 17 nt, Human
caugacccaggcugggc

SEQ ID NO: 2774572 - RNA, 21 nt, Human
caugauuagcagaagaaagga

SEQ ID NO: 2774573 - RNA, 22 nt, Human
caugauuagcagaagaaaggaa

SEQ ID NO: 2774574 - RNA, 19 nt, Human
caugacccaggcugggcaa

SEQ ID NO: 2774575 - RNA, 21 nt, Human
caugauucaugccaauuagca

SEQ ID NO: 2774576 - RNA, 16 nt, Human
caugauucaugccaau

SEQ ID NO: 2774577 - RNA, 12 nt, Human
caugcugccucc

SEQ ID NO: 2774578 - RNA, 14 nt, Human
caugcugccuccag

SEQ ID NO: 2774579 - RNA, 14 nt, Human
caugauucuauuua

SEQ ID NO: 2774580 - RNA, 17 nt, Human
caugcaauucaucccag

SEQ ID NO: 2774581 - RNA, 23 nt, Human
caucagauaagacauaucucuaa

SEQ ID NO: 2774582 - RNA, 19 nt, Human
caucagauggaaauauuuu

SEQ ID NO: 2774583 - RNA, 11 nt, Human
caucagcaaac

SEQ ID NO: 2774584 - RNA, 19 nt, Human
caucaggagaaaaagccuc

SEQ ID NO: 2774585 - RNA, 22 nt, Human
caucaggagaaaaagccuccag

SEQ ID NO: 2774586 - RNA, 14 nt, Human
caucagaaguggua

SEQ ID NO: 2774587 - RNA, 13 nt, Human
caucccagcccca

SEQ ID NO: 2774588 - RNA, 23 nt, Human
cauccuggcacccggccccugcu

SEQ ID NO: 2774589 - RNA, 11 nt, Human
cauccuggcug

SEQ ID NO: 2774590 - RNA, 12 nt, Human
cauccuggcugc

SEQ ID NO: 2774591 - RNA, 13 nt, Human
cauccuggcugcg

SEQ ID NO: 2774592 - RNA, 15 nt, Human
cauccuggcugcggc

SEQ ID NO: 2774593 - RNA, 14 nt, Human
cauccuggcuggag

SEQ ID NO: 2774594 - RNA, 17 nt, Human
cauccuggcuggagaau

SEQ ID NO: 2774595 - RNA, 12 nt, Human
cauccuggguaa

SEQ ID NO: 2774596 - RNA, 13 nt, Human
cauccuggguaau

SEQ ID NO: 2774597 - RNA, 15 nt, Human
cauccuguauaagca

SEQ ID NO: 2774598 - RNA, 19 nt, Human
cauccuguauaagcacuga

SEQ ID NO: 2774599 - RNA, 15 nt, Human
caucccauguauuua

SEQ ID NO: 2774600 - RNA, 18 nt, Human
caucccaugagacccugg

SEQ ID NO: 2774601 - RNA, 19 nt, Human
caucccaucuaagcugcag

SEQ ID NO: 2774602 - RNA, 20 nt, Human
caucccaucuaagcugcagc

SEQ ID NO: 2774603 - RNA, 21 nt, Human
caucccaucuaagcugcagcu

SEQ ID NO: 2774604 - RNA, 21 nt, Human
cauccccaggggucccagcca

SEQ ID NO: 2774605 - RNA, 18 nt, Human
cauccccaggggucccag

SEQ ID NO: 2774606 - RNA, 12 nt, Human
cauccccagggg

SEQ ID NO: 2774607 - RNA, 11 nt, Human
cauccccaggg

SEQ ID NO: 2774608 - RNA, 21 nt, Human
cauccccaaaacaaagucuuu

SEQ ID NO: 2774609 - RNA, 22 nt, Human
cauccccaaaacaaagucuuug

SEQ ID NO: 2774610 - RNA, 19 nt, Human
caucaggaaggaaaugaca

SEQ ID NO: 2774611 - RNA, 14 nt, Human
caucugucuaaaga

SEQ ID NO: 2774612 - RNA, 18 nt, Human
caucugucuaaagauaga

SEQ ID NO: 2774613 - RNA, 23 nt, Human
cauccuugacuuugaacuaauga

SEQ ID NO: 2774614 - RNA, 19 nt, Human
cauccuuggucuuuguauc

SEQ ID NO: 2774615 - RNA, 20 nt, Human
cauccuuggucuuuguaucu

SEQ ID NO: 2774616 - RNA, 21 nt, Human
cauccuuggucuuuguaucuu

SEQ ID NO: 2774617 - RNA, 15 nt, Human
cauccuuuacguguu

SEQ ID NO: 2774618 - RNA, 19 nt, Human
cauccuuuacguguuuaaa

SEQ ID NO: 2774619 - RNA, 17 nt, Human
cauccuuuucugcagag

SEQ ID NO: 2774620 - RNA, 16 nt, Human
cauccuuugcagggca

SEQ ID NO: 2774621 - RNA, 17 nt, Human
cauccuuugcagggcag

SEQ ID NO: 2774622 - RNA, 18 nt, Human
cauccuuugcagggcagc

SEQ ID NO: 2774623 - RNA, 19 nt, Human
cauccuuugcagggcagcc

SEQ ID NO: 2774624 - RNA, 19 nt, Human
cauccuuuucugcagaggg

SEQ ID NO: 2774625 - RNA, 20 nt, Human
caucgaaaauucauuucaca

SEQ ID NO: 2774626 - RNA, 21 nt, Human
caucgaaucuacuaauuccac

SEQ ID NO: 2774627 - RNA, 12 nt, Human
caucgcaaugua

SEQ ID NO: 2774628 - RNA, 22 nt, Human
caucuuacuguaccuguuccuu

SEQ ID NO: 2774629 - RNA, 19 nt, Human
caucuuacuugagccuuua

SEQ ID NO: 2774630 - RNA, 15 nt, Human
caucuuaagagaugc

SEQ ID NO: 2774631 - RNA, 16 nt, Human
cauagauuuauuuuuc

SEQ ID NO: 2774632 - RNA, 20 nt, Human
cauagauuuauuuuucaguu

SEQ ID NO: 2774633 - RNA, 21 nt, Human
cauagauuuauuuuucaguuc

SEQ ID NO: 2774634 - RNA, 22 nt, Human
cauagauuuauuuuucaguucc

SEQ ID NO: 2774635 - RNA, 23 nt, Human
cauagauuuauuuuucaguucca

SEQ ID NO: 2774636 - RNA, 15 nt, Human
cauagcaacaggaaa

SEQ ID NO: 2774637 - RNA, 16 nt, Human
cauagcaacaggaaaa

SEQ ID NO: 2774638 - RNA, 15 nt, Human
cauagccaccccaga

SEQ ID NO: 2774639 - RNA, 11 nt, Human
cauagcauuca

SEQ ID NO: 2774640 - RNA, 15 nt, Human
cauagaugcagguga

SEQ ID NO: 2774641 - RNA, 19 nt, Human
cauagcauccaaguggcau

SEQ ID NO: 2774642 - RNA, 13 nt, Human
cauagcccauccc

SEQ ID NO: 2774643 - RNA, 16 nt, Human
cauagcccaucccugc

SEQ ID NO: 2774644 - RNA, 12 nt, Human
cauagcccucac

SEQ ID NO: 2774645 - RNA, 23 nt, Human
cauagcccaucccugccugguca

SEQ ID NO: 2774646 - RNA, 17 nt, Human
cauagcccaucccugcc

SEQ ID NO: 2774647 - RNA, 18 nt, Human
cauagcccaucccugccu

SEQ ID NO: 2774648 - RNA, 19 nt, Human
cauagcccucacccugggg

SEQ ID NO: 2774649 - RNA, 15 nt, Human
cauagcccucacccu

SEQ ID NO: 2774650 - RNA, 16 nt, Human
cauagauguuuuggua

SEQ ID NO: 2774651 - RNA, 18 nt, Human
cauagauguuuugguaga

SEQ ID NO: 2774652 - RNA, 16 nt, Human
cauagauuaauggcac

SEQ ID NO: 2774653 - RNA, 17 nt, Human
cauagauuaauggcacu

SEQ ID NO: 2774654 - RNA, 18 nt, Human
cauagauuaauggcacug

SEQ ID NO: 2774655 - RNA, 19 nt, Human
cauagauuaauggcacuga

SEQ ID NO: 2774656 - RNA, 20 nt, Human
cauagauuaauggcacugau

SEQ ID NO: 2774657 - RNA, 14 nt, Human
cauagaucuucuga

SEQ ID NO: 2774658 - RNA, 15 nt, Human
cauagaucuucugaa

SEQ ID NO: 2774659 - RNA, 19 nt, Human
cauacaaguuuauaaagag

SEQ ID NO: 2774660 - RNA, 22 nt, Human
caguuuggagagucagaucuuu

SEQ ID NO: 2774661 - RNA, 18 nt, Human
cauacaaagcgugcacaa

SEQ ID NO: 2774662 - RNA, 14 nt, Human
cauaggcccacaca

SEQ ID NO: 2774663 - RNA, 15 nt, Human
cauaggcccacacac

SEQ ID NO: 2774664 - RNA, 16 nt, Human
cauaggcccacacaca

SEQ ID NO: 2774665 - RNA, 17 nt, Human
cauaggcccacacacag

SEQ ID NO: 2774666 - RNA, 18 nt, Human
cauaggcccacacacagg

SEQ ID NO: 2774667 - RNA, 21 nt, Human
cauaggcccacacacaggugg

SEQ ID NO: 2774668 - RNA, 13 nt, Human
cauaggcccagug

SEQ ID NO: 2774669 - RNA, 23 nt, Human
cauagcggacuccuccuuucucc

SEQ ID NO: 2774670 - RNA, 21 nt, Human
cauagcuacccaaaagagaaa

SEQ ID NO: 2774671 - RNA, 22 nt, Human
cauagcuacccaaaagagaaaa

SEQ ID NO: 2774672 - RNA, 23 nt, Human
cauaaucuggacuccucugucca

SEQ ID NO: 2774673 - RNA, 22 nt, Human
cauaaugaaaauauuuuuuaca

SEQ ID NO: 2774674 - RNA, 16 nt, Human
caguuugucacaugaa

SEQ ID NO: 2774675 - RNA, 15 nt, Human
caguuugugugucuu

SEQ ID NO: 2774676 - RNA, 16 nt, Human
caguuugugugucuua

SEQ ID NO: 2774677 - RNA, 19 nt, Human
cauaaucuggacuccucug

SEQ ID NO: 2774678 - RNA, 21 nt, Human
cauaaucuggacuccucuguc

SEQ ID NO: 2774679 - RNA, 22 nt, Human
cauaaucuggacuccucugucc

SEQ ID NO: 2774680 - RNA, 20 nt, Human
cauaaucuggacuccucugu

SEQ ID NO: 2774681 - RNA, 21 nt, Human
caguuugugugucuuaauuau

SEQ ID NO: 2774682 - RNA, 23 nt, Human
caguuugugugucuuaauuauua

SEQ ID NO: 2774683 - RNA, 19 nt, Human
caguuuagauuucaagaaa

SEQ ID NO: 2774684 - RNA, 16 nt, Human
caguuuaucaugaagc

SEQ ID NO: 2774685 - RNA, 17 nt, Human
caguuuaucaugaagcc

SEQ ID NO: 2774686 - RNA, 18 nt, Human
caguuuaucaugaagccu

SEQ ID NO: 2774687 - RNA, 19 nt, Human
caguuuaucaugaagccug

SEQ ID NO: 2774688 - RNA, 20 nt, Human
caguuuaucaugaagccugu

SEQ ID NO: 2774689 - RNA, 22 nt, Human
caguuuaucaugaagccugugg

SEQ ID NO: 2774690 - RNA, 20 nt, Human
caguuugaucacacuauuuu

SEQ ID NO: 2774691 - RNA, 21 nt, Human
caguuugaucacacuauuuua

SEQ ID NO: 2774692 - RNA, 14 nt, Human
caguuuguaaaugu

SEQ ID NO: 2774693 - RNA, 15 nt, Human
caguuuguaaauguu

SEQ ID NO: 2774694 - RNA, 16 nt, Human
caguuuguaaauguua

SEQ ID NO: 2774695 - RNA, 17 nt, Human
caguuuguaaauguuau

SEQ ID NO: 2774696 - RNA, 21 nt, Human
caguuuguaaauguuauuucu

SEQ ID NO: 2774697 - RNA, 22 nt, Human
caguuuguaaauguuauuucug

SEQ ID NO: 2774698 - RNA, 23 nt, Human
caguuuguaaauguuauuucugc

SEQ ID NO: 2774699 - RNA, 16 nt, Human
caguuugguauuugcg

SEQ ID NO: 2774700 - RNA, 15 nt, Human
caguuuggugucaac

SEQ ID NO: 2774701 - RNA, 12 nt, Human
caguuugcuuug

SEQ ID NO: 2774702 - RNA, 14 nt, Human
caguuugcuuugua

SEQ ID NO: 2774703 - RNA, 21 nt, Human
caguuugcuuuguaugcacuu

SEQ ID NO: 2774704 - RNA, 20 nt, Human
caguuuaaccugaugcaguc

SEQ ID NO: 2774705 - RNA, 20 nt, Human
caguuuaagagcagaacaga

SEQ ID NO: 2774706 - RNA, 18 nt, Human
caguuguuuguuuuugcu

SEQ ID NO: 2774707 - RNA, 21 nt, Human
caguuguuuguuuuugcuugu

SEQ ID NO: 2774708 - RNA, 17 nt, Human
caguauuuuggagaaau

SEQ ID NO: 2774709 - RNA, 18 nt, Human
caguauuuuggagaaauu

SEQ ID NO: 2774710 - RNA, 15 nt, Human
cauguucucugagga

SEQ ID NO: 2774711 - RNA, 18 nt, Human
cauuagcaguuugcuuug

SEQ ID NO: 2774712 - RNA, 13 nt, Human
cauguucugcccc

SEQ ID NO: 2774713 - RNA, 15 nt, Human
cauguucugccccca

SEQ ID NO: 2774714 - RNA, 16 nt, Human
cauguucugcccccag

SEQ ID NO: 2774715 - RNA, 17 nt, Human
cauguucugcccccagc

SEQ ID NO: 2774716 - RNA, 18 nt, Human
cauguucugcccccagcc

SEQ ID NO: 2774717 - RNA, 19 nt, Human
cauguucugcccccagccc

SEQ ID NO: 2774718 - RNA, 21 nt, Human
cauuaggaauuaaguuaucuu

SEQ ID NO: 2774719 - RNA, 19 nt, Human
cauggcgugucccucucgg

SEQ ID NO: 2774720 - RNA, 14 nt, Human
cauggcgugucccu

SEQ ID NO: 2774721 - RNA, 16 nt, Human
cauggcuaacuggcga

SEQ ID NO: 2774722 - RNA, 14 nt, Human
cauggcuaacuggc

SEQ ID NO: 2774723 - RNA, 20 nt, Human
cauguucacaccgcugcacu

SEQ ID NO: 2774724 - RNA, 22 nt, Human
cauguucacaccgcugcacuca

SEQ ID NO: 2774725 - RNA, 22 nt, Human
cauguucaaagccacauuauuu

SEQ ID NO: 2774726 - RNA, 12 nt, Human
cauucuccccag

SEQ ID NO: 2774727 - RNA, 15 nt, Human
cauucuccccagugu

SEQ ID NO: 2774728 - RNA, 22 nt, Human
cauucuccccaguguaugucuu

SEQ ID NO: 2774729 - RNA, 11 nt, Human
cauucuccugc

SEQ ID NO: 2774730 - RNA, 13 nt, Human
cauucuccugccu

SEQ ID NO: 2774731 - RNA, 15 nt, Human
cauucuccugccugu

SEQ ID NO: 2774732 - RNA, 22 nt, Human
cauucuccugccuguagcagug

SEQ ID NO: 2774733 - RNA, 23 nt, Human
cauucuccugccuguagcaguga

SEQ ID NO: 2774734 - RNA, 17 nt, Human
cauuagggaugccuccu

SEQ ID NO: 2774735 - RNA, 21 nt, Human
cauuauggguuaggcauuaau

SEQ ID NO: 2774736 - RNA, 13 nt, Human
cauuaugaugugu

SEQ ID NO: 2774737 - RNA, 17 nt, Human
cauuauguaaaauguuu

SEQ ID NO: 2774738 - RNA, 20 nt, Human
cauuauguaaaauguuuuag

SEQ ID NO: 2774739 - RNA, 17 nt, Human
cauuauguccacugugu

SEQ ID NO: 2774740 - RNA, 19 nt, Human
cauuauguccacuguguau

SEQ ID NO: 2774741 - RNA, 20 nt, Human
cauuauguccacuguguaua

SEQ ID NO: 2774742 - RNA, 21 nt, Human
cauuauguccacuguguauag

SEQ ID NO: 2774743 - RNA, 22 nt, Human
cauuauguccacuguguauaga

SEQ ID NO: 2774744 - RNA, 13 nt, Human
cauucucauugca

SEQ ID NO: 2774745 - RNA, 19 nt, Human
cauucucauugcagaauaa

SEQ ID NO: 2774746 - RNA, 16 nt, Human
cauucucauaauuccu

SEQ ID NO: 2774747 - RNA, 17 nt, Human
cauucucauaauuccua

SEQ ID NO: 2774748 - RNA, 18 nt, Human
cauucucauaauuccuac

SEQ ID NO: 2774749 - RNA, 19 nt, Human
cauucucauaauuccuaca

SEQ ID NO: 2774750 - RNA, 21 nt, Human
cauucucauaauuccuacagc

SEQ ID NO: 2774751 - RNA, 23 nt, Human
cauucucauaauuccuacagcac

SEQ ID NO: 2774752 - RNA, 13 nt, Human
cauucucaucugc

SEQ ID NO: 2774753 - RNA, 14 nt, Human
cauucucaucugca

SEQ ID NO: 2774754 - RNA, 15 nt, Human
cauucucaucugcac

SEQ ID NO: 2774755 - RNA, 17 nt, Human
cauucucaucugcaccc

SEQ ID NO: 2774756 - RNA, 20 nt, Human
cauucucaucugcacccuuc

SEQ ID NO: 2774757 - RNA, 21 nt, Human
cauucucaucugcacccuucu

SEQ ID NO: 2774758 - RNA, 23 nt, Human
cauucucaucugcacccuucuuu

SEQ ID NO: 2774759 - RNA, 17 nt, Human
cauucucaggcaccagu

SEQ ID NO: 2774760 - RNA, 16 nt, Human
cauucucaggcaccag

SEQ ID NO: 2774761 - RNA, 15 nt, Human
cauucucaggcacca

SEQ ID NO: 2774762 - RNA, 17 nt, Human
cauucucacuccuaccu

SEQ ID NO: 2774763 - RNA, 14 nt, Human
cauucucacuccua

SEQ ID NO: 2774764 - RNA, 17 nt, Human
cauuaugugguuuuaga

SEQ ID NO: 2774765 - RNA, 14 nt, Human
cauucucaggcacc

SEQ ID NO: 2774766 - RNA, 13 nt, Human
cauucucaggcac

SEQ ID NO: 2774767 - RNA, 16 nt, Human
cauucucacuccuacc

SEQ ID NO: 2774768 - RNA, 21 nt, Human
cauuaugugguuuuagauuuu

SEQ ID NO: 2774769 - RNA, 11 nt, Human
cauuaugugug

SEQ ID NO: 2774770 - RNA, 12 nt, Human
cauuaugugugc

SEQ ID NO: 2774771 - RNA, 13 nt, Human
cauuaugugugca

SEQ ID NO: 2774772 - RNA, 17 nt, Human
cauuaugugugcaugug

SEQ ID NO: 2774773 - RNA, 18 nt, Human
cauuaugugugcaugugu

SEQ ID NO: 2774774 - RNA, 19 nt, Human
cauuaugugugcaugugug

SEQ ID NO: 2774775 - RNA, 20 nt, Human
cauuaugugugcaugugugu

SEQ ID NO: 2774776 - RNA, 21 nt, Human
cauuaugugugcaugugugua

SEQ ID NO: 2774777 - RNA, 22 nt, Human
cauuaugugugcauguguguau

SEQ ID NO: 2774778 - RNA, 23 nt, Human
cauuaugugugcauguguguaua

SEQ ID NO: 2774779 - RNA, 14 nt, Human
cauuuguaaaugcu

SEQ ID NO: 2774780 - RNA, 22 nt, Human
ccaaaaagguugcuguuucaca

SEQ ID NO: 2774781 - RNA, 23 nt, Human
ccaaaaagguugcuguuucacaa

SEQ ID NO: 2774782 - RNA, 19 nt, Human
ccaaaaagauuuucagaaa

SEQ ID NO: 2774783 - RNA, 13 nt, Human
ccaaaaauuauua

SEQ ID NO: 2774784 - RNA, 14 nt, Human
ccaaaaauuauuau

SEQ ID NO: 2774785 - RNA, 16 nt, Human
ccaaaacaagccuggu

SEQ ID NO: 2774786 - RNA, 15 nt, Human
ccaaaacccaugugg

SEQ ID NO: 2774787 - RNA, 20 nt, Human
cauuugguuugauuuucccu

SEQ ID NO: 2774788 - RNA, 11 nt, Human
cauuuguaaaa

SEQ ID NO: 2774789 - RNA, 13 nt, Human
cauuuguaaaacu

SEQ ID NO: 2774790 - RNA, 13 nt, Human
cauuuuucuucca

SEQ ID NO: 2774791 - RNA, 14 nt, Human
cauuuuucuuccag

SEQ ID NO: 2774792 - RNA, 17 nt, Human
cauuuuucuuccaggau

SEQ ID NO: 2774793 - RNA, 21 nt, Human
cauuugguucauuaauucuau

SEQ ID NO: 2774794 - RNA, 19 nt, Human
cauuugguucuaagaaacc

SEQ ID NO: 2774795 - RNA, 20 nt, Human
cauuugguucauuaauucua

SEQ ID NO: 2774796 - RNA, 16 nt, Human
cauuugguucauuaau

SEQ ID NO: 2774797 - RNA, 20 nt, Human
cauuuccaacaccacagaca

SEQ ID NO: 2774798 - RNA, 21 nt, Human
cauuuccaacaccacagacac

SEQ ID NO: 2774799 - RNA, 22 nt, Human
cauuuccaacaccacagacaca

SEQ ID NO: 2774800 - RNA, 17 nt, Human
cauuuuugauuuaugca

SEQ ID NO: 2774801 - RNA, 18 nt, Human
cauuuuugaauacaggca

SEQ ID NO: 2774802 - RNA, 20 nt, Human
cauuuuugaauacaggcaua

SEQ ID NO: 2774803 - RNA, 23 nt, Human
cauuucauuguaugauguguugu

SEQ ID NO: 2774804 - RNA, 13 nt, Human
cauuuccaacacc

SEQ ID NO: 2774805 - RNA, 18 nt, Human
cauuuccaacaccacaga

SEQ ID NO: 2774806 - RNA, 19 nt, Human
cauuuccaacaccacagac

SEQ ID NO: 2774807 - RNA, 16 nt, Human
cauuuauucugcucac

SEQ ID NO: 2774808 - RNA, 23 nt, Human
cauugggaaggggacccccgccc

SEQ ID NO: 2774809 - RNA, 14 nt, Human
cauugcuguuaugu

SEQ ID NO: 2774810 - RNA, 17 nt, Human
cauugcuguuaugucug

SEQ ID NO: 2774811 - RNA, 20 nt, Human
cauugcuguuaugucuguuu

SEQ ID NO: 2774812 - RNA, 22 nt, Human
cauugcuguuaugucuguuuaa

SEQ ID NO: 2774813 - RNA, 17 nt, Human
cauugcuguucuacuuu

SEQ ID NO: 2774814 - RNA, 13 nt, Human
cauugcuguagga

SEQ ID NO: 2774815 - RNA, 14 nt, Human
cauugcuguaggau

SEQ ID NO: 2774816 - RNA, 22 nt, Human
cauugcuguaggaucuaaggcu

SEQ ID NO: 2774817 - RNA, 16 nt, Human
cauugcugucugcagc

SEQ ID NO: 2774818 - RNA, 19 nt, Human
cauugcugucugcagccuu

SEQ ID NO: 2774819 - RNA, 20 nt, Human
cauugcugucugcagccuug

SEQ ID NO: 2774820 - RNA, 21 nt, Human
cauugcugucugcagccuuga

SEQ ID NO: 2774821 - RNA, 12 nt, Human
cauuucauugua

SEQ ID NO: 2774822 - RNA, 13 nt, Human
cauuucauuguau

SEQ ID NO: 2774823 - RNA, 16 nt, Human
cauuucauuguaugau

SEQ ID NO: 2774824 - RNA, 18 nt, Human
cauuucauuugugccaga

SEQ ID NO: 2774825 - RNA, 18 nt, Human
cauuucauuguaugaugu

SEQ ID NO: 2774826 - RNA, 20 nt, Human
cauuucauuguaugaugugu

SEQ ID NO: 2774827 - RNA, 18 nt, Human
cauuucaaaugugcuguc

SEQ ID NO: 2774828 - RNA, 14 nt, Human
cauuucaaaaugcu

SEQ ID NO: 2774829 - RNA, 15 nt, Human
cauuucaaaaugcuu

SEQ ID NO: 2774830 - RNA, 17 nt, Human
cauuuauuuuuuacauu

SEQ ID NO: 2774831 - RNA, 19 nt, Human
cauuuauuuuuuacauuau

SEQ ID NO: 2774832 - RNA, 18 nt, Human
cauuuauuuuucucauga

SEQ ID NO: 2774833 - RNA, 13 nt, Human
cauuuauuguuua

SEQ ID NO: 2774834 - RNA, 18 nt, Human
cauuuauuguuuauguaa

SEQ ID NO: 2774835 - RNA, 15 nt, Human
cauuuauuuuaagca

SEQ ID NO: 2774836 - RNA, 21 nt, Human
cauuuauuuuaagcacucuua

SEQ ID NO: 2774837 - RNA, 13 nt, Human
cauuuauuuuaug

SEQ ID NO: 2774838 - RNA, 14 nt, Human
cauuuauuuuauga

SEQ ID NO: 2774839 - RNA, 15 nt, Human
cauuuauuuuaugag

SEQ ID NO: 2774840 - RNA, 16 nt, Human
cauuuauuuuaugaga

SEQ ID NO: 2774841 - RNA, 17 nt, Human
cauuuauuuuaugagaa

SEQ ID NO: 2774842 - RNA, 18 nt, Human
cauuuauuuuaugagaaa

SEQ ID NO: 2774843 - RNA, 19 nt, Human
cauuuauuuuaugagaaau

SEQ ID NO: 2774844 - RNA, 23 nt, Human
cauuuauuuuaugagaaauguaa

SEQ ID NO: 2774845 - RNA, 16 nt, Human
cauuucaauucucaaa

SEQ ID NO: 2774846 - RNA, 20 nt, Human
cauuucacaaaacagccuuu

SEQ ID NO: 2774847 - RNA, 16 nt, Human
cauuucacaggcuaau

SEQ ID NO: 2774848 - RNA, 12 nt, Human
cauuucacauua

SEQ ID NO: 2774849 - RNA, 13 nt, Human
cauuucacauuaa

SEQ ID NO: 2774850 - RNA, 15 nt, Human
cauuucacauuaaug

SEQ ID NO: 2774851 - RNA, 21 nt, Human
cauugcggacagccacggcca

SEQ ID NO: 2774852 - RNA, 17 nt, Human
cauugcggacagccacg

SEQ ID NO: 2774853 - RNA, 15 nt, Human
cauugcggacagcca

SEQ ID NO: 2774854 - RNA, 14 nt, Human
cauugcggacagcc

SEQ ID NO: 2774855 - RNA, 16 nt, Human
cauugcugagccucug

SEQ ID NO: 2774856 - RNA, 17 nt, Human
cauugcugagccucugc

SEQ ID NO: 2774857 - RNA, 18 nt, Human
cauugcugagccucugcu

SEQ ID NO: 2774858 - RNA, 21 nt, Human
cauugcugagccucugcuccc

SEQ ID NO: 2774859 - RNA, 14 nt, Human
cauugcugagccuc

SEQ ID NO: 2774860 - RNA, 15 nt, Human
cauugcugagccucu

SEQ ID NO: 2774861 - RNA, 15 nt, Human
cauugcuagauaaaa

SEQ ID NO: 2774862 - RNA, 17 nt, Human
cauugcuagauaaaagc

SEQ ID NO: 2774863 - RNA, 19 nt, Human
cauugcucccuaagacugu

SEQ ID NO: 2774864 - RNA, 11 nt, Human
cauugccuggc

SEQ ID NO: 2774865 - RNA, 17 nt, Human
cauugccuggccuuccu

SEQ ID NO: 2774866 - RNA, 14 nt, Human
cauugccuuugaau

SEQ ID NO: 2774867 - RNA, 17 nt, Human
cauugccuuugaauguu

SEQ ID NO: 2774868 - RNA, 22 nt, Human
cauugccuuugaauguuaauuu

SEQ ID NO: 2774869 - RNA, 23 nt, Human
cauugcguuugaccuuuuaugua

SEQ ID NO: 2774870 - RNA, 11 nt, Human
ccaaauuauuu

SEQ ID NO: 2774871 - RNA, 15 nt, Human
ccaaaugcaauuuga

SEQ ID NO: 2774872 - RNA, 16 nt, Human
ccaaaugcaauuugau

SEQ ID NO: 2774873 - RNA, 13 nt, Human
ccaaauccuuccc

SEQ ID NO: 2774874 - RNA, 22 nt, Human
ccaaaucucaaugaagccagcu

SEQ ID NO: 2774875 - RNA, 19 nt, Human
ccaaaucucucaaaucugu

SEQ ID NO: 2774876 - RNA, 18 nt, Human
ccaaaucucuuccacaag

SEQ ID NO: 2774877 - RNA, 15 nt, Human
ccaaauccgcucucu

SEQ ID NO: 2774878 - RNA, 16 nt, Human
ccaaauccgcucucuu

SEQ ID NO: 2774879 - RNA, 18 nt, Human
ccaaauccgcucucuucc

SEQ ID NO: 2774880 - RNA, 19 nt, Human
ccaaauccgcucucuuccu

SEQ ID NO: 2774881 - RNA, 20 nt, Human
ccaaauccgcucucuuccug

SEQ ID NO: 2774882 - RNA, 22 nt, Human
ccaaauccgcucucuuccugcc

SEQ ID NO: 2774883 - RNA, 22 nt, Human
ccaaagugcugggauuacaggu

SEQ ID NO: 2774884 - RNA, 13 nt, Human
ccaacuucccagu

SEQ ID NO: 2774885 - RNA, 19 nt, Human
ccaacuucucuugcuuucu

SEQ ID NO: 2774886 - RNA, 20 nt, Human
ccaacuucucuugcuuucua

SEQ ID NO: 2774887 - RNA, 21 nt, Human
ccaacuguguuguauuaacaa

SEQ ID NO: 2774888 - RNA, 23 nt, Human
ccaacuguguuguauuaacaaaa

SEQ ID NO: 2774889 - RNA, 23 nt, Human
ccaacuguucagcuguccucccu

SEQ ID NO: 2774890 - RNA, 19 nt, Human
ccaacuucuucagagcuga

SEQ ID NO: 2774891 - RNA, 10 nt, Human
ccaacuugag

SEQ ID NO: 2774892 - RNA, 18 nt, Human
ccaacuucuucagagcug

SEQ ID NO: 2774893 - RNA, 19 nt, Human
ccaacuugagggcccagag

SEQ ID NO: 2774894 - RNA, 19 nt, Human
ccaacuugguucugcuuca

SEQ ID NO: 2774895 - RNA, 21 nt, Human
ccaacuugguucugcuucaau

SEQ ID NO: 2774896 - RNA, 11 nt, Human
ccaacuuguaa

SEQ ID NO: 2774897 - RNA, 20 nt, Human
ccaacuugagggcccagagc

SEQ ID NO: 2774898 - RNA, 21 nt, Human
ccaacuugagggcccagagca

SEQ ID NO: 2774899 - RNA, 18 nt, Human
ccaacguuacucagggcu

SEQ ID NO: 2774900 - RNA, 19 nt, Human
ccaacguuacucagggcuc

SEQ ID NO: 2774901 - RNA, 13 nt, Human
ccaacguuuggaa

SEQ ID NO: 2774902 - RNA, 20 nt, Human
ccaacguuuggaagauccug

SEQ ID NO: 2774903 - RNA, 21 nt, Human
ccaacguuuggaagauccugu

SEQ ID NO: 2774904 - RNA, 22 nt, Human
ccaacguuuggaagauccugug

SEQ ID NO: 2774905 - RNA, 23 nt, Human
ccaacguuuggaagauccuguga

SEQ ID NO: 2774906 - RNA, 12 nt, Human
ccaaauuauuug

SEQ ID NO: 2774907 - RNA, 14 nt, Human
ccaaauuauuugug

SEQ ID NO: 2774908 - RNA, 17 nt, Human
ccaaauuauuuguguaa

SEQ ID NO: 2774909 - RNA, 18 nt, Human
ccaaauuauuuguguaau

SEQ ID NO: 2774910 - RNA, 22 nt, Human
ccaaagugcugggauuacaggg

SEQ ID NO: 2774911 - RNA, 22 nt, Human
ccaaagugcugggauuacaggc

SEQ ID NO: 2774912 - RNA, 19 nt, Human
ccaaagugcugggauuaca

SEQ ID NO: 2774913 - RNA, 15 nt, Human
ccaagcuuguuauca

SEQ ID NO: 2774914 - RNA, 17 nt, Human
ccaagcuuguuaucagc

SEQ ID NO: 2774915 - RNA, 20 nt, Human
ccaagcuggucccacucagu

SEQ ID NO: 2774916 - RNA, 13 nt, Human
ccaacuuucugua

SEQ ID NO: 2774917 - RNA, 14 nt, Human
ccaacuuucuguaa

SEQ ID NO: 2774918 - RNA, 17 nt, Human
ccaacuuucuguaaacu

SEQ ID NO: 2774919 - RNA, 18 nt, Human
ccaagcuguuuucuucua

SEQ ID NO: 2774920 - RNA, 17 nt, Human
ccaagcuguuuucuucu

SEQ ID NO: 2774921 - RNA, 14 nt, Human
ccaagcuguuuucu

SEQ ID NO: 2774922 - RNA, 19 nt, Human
ccaauguuagagacuuuuu

SEQ ID NO: 2774923 - RNA, 20 nt, Human
ccaauguuagagacuuuuuu

SEQ ID NO: 2774924 - RNA, 12 nt, Human
ccaauguuuucc

SEQ ID NO: 2774925 - RNA, 18 nt, Human
ccaauguuuuccacccau

SEQ ID NO: 2774926 - RNA, 21 nt, Human
ccaauuaggggguaaggcccc

SEQ ID NO: 2774927 - RNA, 17 nt, Human
ccaacuacuaucucaga

SEQ ID NO: 2774928 - RNA, 13 nt, Human
ccacccugggacc

SEQ ID NO: 2774929 - RNA, 15 nt, Human
ccacccugggagaca

SEQ ID NO: 2774930 - RNA, 17 nt, Human
ccacccugggagacaga

SEQ ID NO: 2774931 - RNA, 12 nt, Human
ccacccugggac

SEQ ID NO: 2774932 - RNA, 11 nt, Human
ccacccuggaa

SEQ ID NO: 2774933 - RNA, 13 nt, Human
ccacccugcucuc

SEQ ID NO: 2774934 - RNA, 15 nt, Human
ccacccugcugccuu

SEQ ID NO: 2774935 - RNA, 16 nt, Human
ccacccugcugccuuc

SEQ ID NO: 2774936 - RNA, 19 nt, Human
ccacccugcugccuucuga

SEQ ID NO: 2774937 - RNA, 22 nt, Human
ccaccgggcugggagcucugca

SEQ ID NO: 2774938 - RNA, 18 nt, Human
ccaccgguccagcuggcc

SEQ ID NO: 2774939 - RNA, 17 nt, Human
ccaccgguccagcuggc

SEQ ID NO: 2774940 - RNA, 15 nt, Human
ccaccgguccagcug

SEQ ID NO: 2774941 - RNA, 23 nt, Human
ccaccgggcugggagcucugcag

SEQ ID NO: 2774942 - RNA, 15 nt, Human
ccaccuuggcucaag

SEQ ID NO: 2774943 - RNA, 14 nt, Human
ccaccuuggcucaa

SEQ ID NO: 2774944 - RNA, 13 nt, Human
ccaccuuggcuca

SEQ ID NO: 2774945 - RNA, 14 nt, Human
ccaccuagaacacu

SEQ ID NO: 2774946 - RNA, 23 nt, Human
ccaccuacuuuucuuuccucaga

SEQ ID NO: 2774947 - RNA, 23 nt, Human
ccaccuaauucgaugaaggcugc

SEQ ID NO: 2774948 - RNA, 19 nt, Human
ccaccuacaauacaucuga

SEQ ID NO: 2774949 - RNA, 19 nt, Human
ccaccaggagaaccacuac

SEQ ID NO: 2774950 - RNA, 14 nt, Human
ccaccaggaucagc

SEQ ID NO: 2774951 - RNA, 18 nt, Human
ccaccaggaucccagggg

SEQ ID NO: 2774952 - RNA, 14 nt, Human
ccaccaggagaacc

SEQ ID NO: 2774953 - RNA, 13 nt, Human
ccaccaggagaac

SEQ ID NO: 2774954 - RNA, 19 nt, Human
ccaccagcaucaccugccu

SEQ ID NO: 2774955 - RNA, 18 nt, Human
ccaccagcaucaccugcc

SEQ ID NO: 2774956 - RNA, 16 nt, Human
ccaccagcucugccgu

SEQ ID NO: 2774957 - RNA, 23 nt, Human
ccaccagacugacaaauguguau

SEQ ID NO: 2774958 - RNA, 17 nt, Human
ccaccagagaccguccu

SEQ ID NO: 2774959 - RNA, 20 nt, Human
ccaccagagaccguccucac

SEQ ID NO: 2774960 - RNA, 21 nt, Human
ccaccagagaccguccucacc

SEQ ID NO: 2774961 - RNA, 22 nt, Human
ccaccagagaccguccucaccc

SEQ ID NO: 2774962 - RNA, 18 nt, Human
ccaccagauagcagaggg

SEQ ID NO: 2774963 - RNA, 21 nt, Human
ccacacuuguuccagcucuuu

SEQ ID NO: 2774964 - RNA, 20 nt, Human
ccacacuuguuccagcucuu

SEQ ID NO: 2774965 - RNA, 22 nt, Human
ccacacuucaggcucuucuccu

SEQ ID NO: 2774966 - RNA, 23 nt, Human
caggacaccacacccagccucag

SEQ ID NO: 2774967 - RNA, 16 nt, Human
caggacagugcuucag

SEQ ID NO: 2774968 - RNA, 21 nt, Human
caggacagugcuucagccuga

SEQ ID NO: 2774969 - RNA, 20 nt, Human
caggacagugcuucagccug

SEQ ID NO: 2774970 - RNA, 22 nt, Human
caggacagugcuucagccugag

SEQ ID NO: 2774971 - RNA, 18 nt, Human
caggaccaggcaauguga

SEQ ID NO: 2774972 - RNA, 23 nt, Human
caggaggauugcuugagcccagg

SEQ ID NO: 2774973 - RNA, 18 nt, Human
caggaggcaagcaagcuc

SEQ ID NO: 2774974 - RNA, 22 nt, Human
caggacaccacacccagccuca

SEQ ID NO: 2774975 - RNA, 15 nt, Human
caggacacggggcag

SEQ ID NO: 2774976 - RNA, 15 nt, Human
caggccagcugccuc

SEQ ID NO: 2774977 - RNA, 20 nt, Human
caggcaaugcuggcuguugg

SEQ ID NO: 2774978 - RNA, 19 nt, Human
caggcaaugcuggcuguug

SEQ ID NO: 2774979 - RNA, 21 nt, Human
caggcaaugcuggcuguuggc

SEQ ID NO: 2774980 - RNA, 20 nt, Human
caggaggcagagguugcagu

SEQ ID NO: 2774981 - RNA, 16 nt, Human
caggcacugcugccca

SEQ ID NO: 2774982 - RNA, 17 nt, Human
caggcacugcugcccag

SEQ ID NO: 2774983 - RNA, 23 nt, Human
caggcacugcugcccagccucca

SEQ ID NO: 2774984 - RNA, 21 nt, Human
caggcacuuaagcacaagcag

SEQ ID NO: 2774985 - RNA, 13 nt, Human
caggaaauaaagu

SEQ ID NO: 2774986 - RNA, 20 nt, Human
caggaaaagcugcugacagu

SEQ ID NO: 2774987 - RNA, 19 nt, Human
caggaaaagcugcugacag

SEQ ID NO: 2774988 - RNA, 22 nt, Human
caggaaaagguagcuuaccuga

SEQ ID NO: 2774989 - RNA, 15 nt, Human
cagcuuaucucuuuu

SEQ ID NO: 2774990 - RNA, 16 nt, Human
cagcuuaucucuuuua

SEQ ID NO: 2774991 - RNA, 18 nt, Human
cagcuuaucucuuuuaua

SEQ ID NO: 2774992 - RNA, 19 nt, Human
cagcuuaucucuuuuauau

SEQ ID NO: 2774993 - RNA, 21 nt, Human
cagcuuaucucuuuuauauuu

SEQ ID NO: 2774994 - RNA, 22 nt, Human
cagcuuaucucuuuuauauuug

SEQ ID NO: 2774995 - RNA, 23 nt, Human
cagcuuaucucuuuuauauuugu

SEQ ID NO: 2774996 - RNA, 18 nt, Human
caggaaaguguuauuuuu

SEQ ID NO: 2774997 - RNA, 14 nt, Human
caggaaaguucaga

SEQ ID NO: 2774998 - RNA, 16 nt, Human
caggaaaguucagagu

SEQ ID NO: 2774999 - RNA, 18 nt, Human
caggaaaguucagaguuu

SEQ ID NO: 2775000 - RNA, 22 nt, Human
caggaaaguucagaguuuucug

SEQ ID NO: 2775001 - RNA, 21 nt, Human
cagggaggagguggcagcccu

SEQ ID NO: 2775002 - RNA, 20 nt, Human
cagggaggagguggcagccc

SEQ ID NO: 2775003 - RNA, 19 nt, Human
cagggaggagguggcagcc

SEQ ID NO: 2775004 - RNA, 18 nt, Human
cagggaggagguggcagc

SEQ ID NO: 2775005 - RNA, 14 nt, Human
caggcugggcuuca

SEQ ID NO: 2775006 - RNA, 23 nt, Human
caggcugggccauguccaaagag

SEQ ID NO: 2775007 - RNA, 22 nt, Human
caggcugggccauguccaaaga

SEQ ID NO: 2775008 - RNA, 20 nt, Human
caggcugggccauguccaaa

SEQ ID NO: 2775009 - RNA, 18 nt, Human
caggcugggccaugucca

SEQ ID NO: 2775010 - RNA, 17 nt, Human
caggcugggccaugucc

SEQ ID NO: 2775011 - RNA, 13 nt, Human
caggcugggccau

SEQ ID NO: 2775012 - RNA, 12 nt, Human
caggcugggcca

SEQ ID NO: 2775013 - RNA, 11 nt, Human
caggcugggcc

SEQ ID NO: 2775014 - RNA, 14 nt, Human
cagggaggucaggc

SEQ ID NO: 2775015 - RNA, 17 nt, Human
cagggaggucaggcccu

SEQ ID NO: 2775016 - RNA, 18 nt, Human
cagggaggucaggcccug

SEQ ID NO: 2775017 - RNA, 19 nt, Human
cagggaggucaggcccugg

SEQ ID NO: 2775018 - RNA, 20 nt, Human
cagggaggucaggcccugga

SEQ ID NO: 2775019 - RNA, 23 nt, Human
cagggaggucaggcccuggaacu

SEQ ID NO: 2775020 - RNA, 16 nt, Human
cagggaggggaagagg

SEQ ID NO: 2775021 - RNA, 18 nt, Human
cagggagggccugggccc

SEQ ID NO: 2775022 - RNA, 17 nt, Human
cagggagggccugggcc

SEQ ID NO: 2775023 - RNA, 20 nt, Human
cagggcucagcggggacagc

SEQ ID NO: 2775024 - RNA, 15 nt, Human
cagggcucagcgggg

SEQ ID NO: 2775025 - RNA, 12 nt, Human
cagggcucagcg

SEQ ID NO: 2775026 - RNA, 12 nt, Human
caggccugggcc

SEQ ID NO: 2775027 - RNA, 17 nt, Human
caggccugggccagagu

SEQ ID NO: 2775028 - RNA, 19 nt, Human
caggcuggcgugcaguggu

SEQ ID NO: 2775029 - RNA, 18 nt, Human
caggcuggcgugcagugg

SEQ ID NO: 2775030 - RNA, 17 nt, Human
caggcuggcgugcagug

SEQ ID NO: 2775031 - RNA, 18 nt, Human
caggcugggcaaggaggc

SEQ ID NO: 2775032 - RNA, 15 nt, Human
cagggcugucaucug

SEQ ID NO: 2775033 - RNA, 13 nt, Human
cagggcugugcac

SEQ ID NO: 2775034 - RNA, 18 nt, Human
cagggcuuaccuguacac

SEQ ID NO: 2775035 - RNA, 19 nt, Human
cagggcuggccccagggca

SEQ ID NO: 2775036 - RNA, 20 nt, Human
cagggcuggccccagggcac

SEQ ID NO: 2775037 - RNA, 23 nt, Human
cagggcuggccccagggcacccu

SEQ ID NO: 2775038 - RNA, 15 nt, Human
caguauuucauugcc

SEQ ID NO: 2775039 - RNA, 19 nt, Human
caguauuucauugccugug

SEQ ID NO: 2775040 - RNA, 16 nt, Human
caguauuuccacuugu

SEQ ID NO: 2775041 - RNA, 16 nt, Human
caguauuuauuuugua

SEQ ID NO: 2775042 - RNA, 17 nt, Human
caguauuuauuuuguaa

SEQ ID NO: 2775043 - RNA, 18 nt, Human
caguauuuauuuuguaau

SEQ ID NO: 2775044 - RNA, 19 nt, Human
caguauuuauuuuguaauu

SEQ ID NO: 2775045 - RNA, 22 nt, Human
caguauuuauuuuguaauuaug

SEQ ID NO: 2775046 - RNA, 11 nt, Human
caguauuucag

SEQ ID NO: 2775047 - RNA, 14 nt, Human
caguauuuuggaga

SEQ ID NO: 2775048 - RNA, 20 nt, Human
caguaaaucuuuuacaacug

SEQ ID NO: 2775049 - RNA, 12 nt, Human
caguaaaucuuu

SEQ ID NO: 2775050 - RNA, 14 nt, Human
caguaaauaacagg

SEQ ID NO: 2775051 - RNA, 19 nt, Human
caguauuacuucugcuaca

SEQ ID NO: 2775052 - RNA, 12 nt, Human
caguauuaugua

SEQ ID NO: 2775053 - RNA, 13 nt, Human
caguauucuuguc

SEQ ID NO: 2775054 - RNA, 16 nt, Human
caguauucuugucaaa

SEQ ID NO: 2775055 - RNA, 19 nt, Human
caguauucuugucaaaaaa

SEQ ID NO: 2775056 - RNA, 21 nt, Human
caggguuggccccugcccggc

SEQ ID NO: 2775057 - RNA, 17 nt, Human
caggguuggccccugcc

SEQ ID NO: 2775058 - RNA, 14 nt, Human
caggguuggccccu

SEQ ID NO: 2775059 - RNA, 13 nt, Human
caggguugggccc

SEQ ID NO: 2775060 - RNA, 17 nt, Human
caggguggacuuagaaa

SEQ ID NO: 2775061 - RNA, 20 nt, Human
caggguugggcccagaucug

SEQ ID NO: 2775062 - RNA, 16 nt, Human
caggguugggcccaga

SEQ ID NO: 2775063 - RNA, 15 nt, Human
caggguugggcccag

SEQ ID NO: 2775064 - RNA, 14 nt, Human
caggguugggccca

SEQ ID NO: 2775065 - RNA, 14 nt, Human
caggugcugccauc

SEQ ID NO: 2775066 - RNA, 13 nt, Human
caggugcugccau

SEQ ID NO: 2775067 - RNA, 21 nt, Human
caggguugggcccagaucugg

SEQ ID NO: 2775068 - RNA, 15 nt, Human
caggguuggugugcu

SEQ ID NO: 2775069 - RNA, 18 nt, Human
caggguuggugugcugag

SEQ ID NO: 2775070 - RNA, 19 nt, Human
caggguuucaccauguugc

SEQ ID NO: 2775071 - RNA, 19 nt, Human
caggugcucaauaaaugau

SEQ ID NO: 2775072 - RNA, 14 nt, Human
caggugcuccccug

SEQ ID NO: 2775073 - RNA, 23 nt, Human
caggugcuccccugacagucccu

SEQ ID NO: 2775074 - RNA, 23 nt, Human
cagguuuuuggucugacccacug

SEQ ID NO: 2775075 - RNA, 22 nt, Human
cagguugaggggcuccuggaaa

SEQ ID NO: 2775076 - RNA, 21 nt, Human
cagguugaggggcuccuggaa

SEQ ID NO: 2775077 - RNA, 20 nt, Human
cagguugaggggcuccugga

SEQ ID NO: 2775078 - RNA, 17 nt, Human
cagguucucucucacug

SEQ ID NO: 2775079 - RNA, 15 nt, Human
cagguucugccugcu

SEQ ID NO: 2775080 - RNA, 23 nt, Human
cagggucucacucugucgcccag

SEQ ID NO: 2775081 - RNA, 22 nt, Human
cagggucucacucugucgccca

SEQ ID NO: 2775082 - RNA, 22 nt, Human
cagggucuucccuaccucaggc

SEQ ID NO: 2775083 - RNA, 21 nt, Human
cagggucuucccuaccucagg

SEQ ID NO: 2775084 - RNA, 19 nt, Human
cagggugacggugacaaag

SEQ ID NO: 2775085 - RNA, 16 nt, Human
caggguuggccccugc

SEQ ID NO: 2775086 - RNA, 15 nt, Human
caggguuggccccug

SEQ ID NO: 2775087 - RNA, 22 nt, Human
caggguggacuuagaaagcagg

SEQ ID NO: 2775088 - RNA, 18 nt, Human
caggguggagugcagugg

SEQ ID NO: 2775089 - RNA, 20 nt, Human
caggguggagugcaguggug

SEQ ID NO: 2775090 - RNA, 22 nt, Human
cagggugcccagaacuucccug

SEQ ID NO: 2775091 - RNA, 13 nt, Human
cagggugcagagg

SEQ ID NO: 2775092 - RNA, 23 nt, Human
cagccucuccaggcaccaucucc

SEQ ID NO: 2775093 - RNA, 14 nt, Human
cagccugcacagug

SEQ ID NO: 2775094 - RNA, 22 nt, Human
cagccugcacagugucccccag

SEQ ID NO: 2775095 - RNA, 20 nt, Human
cagccugcaguuaauuagca

SEQ ID NO: 2775096 - RNA, 19 nt, Human
cagccugaggcugagacug

SEQ ID NO: 2775097 - RNA, 18 nt, Human
cagccugaggcugagacu

SEQ ID NO: 2775098 - RNA, 15 nt, Human
cagccugaggcugag

SEQ ID NO: 2775099 - RNA, 12 nt, Human
cagccugaggcu

SEQ ID NO: 2775100 - RNA, 14 nt, Human
cagccgccuuccuu

SEQ ID NO: 2775101 - RNA, 15 nt, Human
cagccgccuuccuug

SEQ ID NO: 2775102 - RNA, 18 nt, Human
cagccgccuuccuugacc

SEQ ID NO: 2775103 - RNA, 22 nt, Human
cagccgccuuccuugaccuucc

SEQ ID NO: 2775104 - RNA, 23 nt, Human
cagccgccuuccuugaccuuccu

SEQ ID NO: 2775105 - RNA, 18 nt, Human
cagccgccuuaagcugau

SEQ ID NO: 2775106 - RNA, 19 nt, Human
cagccgccuuaagcugauc

SEQ ID NO: 2775107 - RNA, 23 nt, Human
cagccgccauugccaccaggaga

SEQ ID NO: 2775108 - RNA, 22 nt, Human
cagccgccauugccaccaggag

SEQ ID NO: 2775109 - RNA, 21 nt, Human
cagccgccauugccaccagga

SEQ ID NO: 2775110 - RNA, 19 nt, Human
cagccgccauugccaccag

SEQ ID NO: 2775111 - RNA, 18 nt, Human
cagccgccauugccacca

SEQ ID NO: 2775112 - RNA, 17 nt, Human
cagccgccauugccacc

SEQ ID NO: 2775113 - RNA, 18 nt, Human
cagccgccaucagcccaa

SEQ ID NO: 2775114 - RNA, 13 nt, Human
cagcccuuagcag

SEQ ID NO: 2775115 - RNA, 13 nt, Human
cagcccuguucug

SEQ ID NO: 2775116 - RNA, 16 nt, Human
cagcccugucuuccua

SEQ ID NO: 2775117 - RNA, 19 nt, Human
cagccgcagccucccucug

SEQ ID NO: 2775118 - RNA, 20 nt, Human
cagcggccccugcauccccu

SEQ ID NO: 2775119 - RNA, 23 nt, Human
cagccugaggcagccacuucggc

SEQ ID NO: 2775120 - RNA, 21 nt, Human
cagccugcccaagcccaggcc

SEQ ID NO: 2775121 - RNA, 23 nt, Human
cagccugcccaagcccaggccac

SEQ ID NO: 2775122 - RNA, 16 nt, Human
cagcgggaauggcagc

SEQ ID NO: 2775123 - RNA, 13 nt, Human
cagcgggcagguu

SEQ ID NO: 2775124 - RNA, 20 nt, Human
cagcgggcagguucugccug

SEQ ID NO: 2775125 - RNA, 23 nt, Human
cagcgggaauggcagcugccacg

SEQ ID NO: 2775126 - RNA, 22 nt, Human
cagcgggaauggcagcugccac

SEQ ID NO: 2775127 - RNA, 15 nt, Human
cagccccggcccugg

SEQ ID NO: 2775128 - RNA, 16 nt, Human
cagccccggcccuggg

SEQ ID NO: 2775129 - RNA, 17 nt, Human
cagccccggcccugggc

SEQ ID NO: 2775130 - RNA, 19 nt, Human
cagccccggcccugggcuc

SEQ ID NO: 2775131 - RNA, 12 nt, Human
cagccccuagcc

SEQ ID NO: 2775132 - RNA, 13 nt, Human
cagccccuagccc

SEQ ID NO: 2775133 - RNA, 15 nt, Human
cagccccuagcccag

SEQ ID NO: 2775134 - RNA, 12 nt, Human
cagccccuagaa

SEQ ID NO: 2775135 - RNA, 13 nt, Human
cagccccuagaaa

SEQ ID NO: 2775136 - RNA, 16 nt, Human
cagccccuagaaaccc

SEQ ID NO: 2775137 - RNA, 20 nt, Human
cagccccuagaaacccaagc

SEQ ID NO: 2775138 - RNA, 21 nt, Human
cagccccuagaaacccaagcu

SEQ ID NO: 2775139 - RNA, 24 nt, Human
cagccccuagaaacccaagcuccu

SEQ ID NO: 2775140 - RNA, 16 nt, Human
cagccccuagcccagg

SEQ ID NO: 2775141 - RNA, 17 nt, Human
cagccccuagcccagga

SEQ ID NO: 2775142 - RNA, 22 nt, Human
cagccccuagcccaggagagag

SEQ ID NO: 2775143 - RNA, 23 nt, Human
cagccccuagcccaggagagaga

SEQ ID NO: 2775144 - RNA, 24 nt, Human
cagccccuagcccaggagagagaa

SEQ ID NO: 2775145 - RNA, 12 nt, Human
cagccccuagga

SEQ ID NO: 2775146 - RNA, 13 nt, Human
cagccccuaggag

SEQ ID NO: 2775147 - RNA, 15 nt, Human
cagccccuccaucug

SEQ ID NO: 2775148 - RNA, 17 nt, Human
cagccccuccaucugua

SEQ ID NO: 2775149 - RNA, 11 nt, Human
cagccccuccc

SEQ ID NO: 2775150 - RNA, 16 nt, Human
cagccccgagcugucc

SEQ ID NO: 2775151 - RNA, 17 nt, Human
cagccccgagcuguccc

SEQ ID NO: 2775152 - RNA, 18 nt, Human
cagccccgcgccuccuuc

SEQ ID NO: 2775153 - RNA, 16 nt, Human
cagccccgcgccuccu

SEQ ID NO: 2775154 - RNA, 14 nt, Human
cagccccuccccca

SEQ ID NO: 2775155 - RNA, 21 nt, Human
cagccccucccccaucuccca

SEQ ID NO: 2775156 - RNA, 22 nt, Human
cagccccucccccaucucccac

SEQ ID NO: 2775157 - RNA, 20 nt, Human
cagccccugauccugugaag

SEQ ID NO: 2775158 - RNA, 21 nt, Human
cagccccugauccugugaagu

SEQ ID NO: 2775159 - RNA, 18 nt, Human
cagcccuggggcugggcc

SEQ ID NO: 2775160 - RNA, 19 nt, Human
cagcccuggggcugggccc

SEQ ID NO: 2775161 - RNA, 13 nt, Human
cagccccugcaca

SEQ ID NO: 2775162 - RNA, 14 nt, Human
cagccccugauccu

SEQ ID NO: 2775163 - RNA, 19 nt, Human
cagccccugauccugugaa

SEQ ID NO: 2775164 - RNA, 22 nt, Human
cagccccauucugccugcccag

SEQ ID NO: 2775165 - RNA, 20 nt, Human
cagccccauucugccugccc

SEQ ID NO: 2775166 - RNA, 19 nt, Human
cagccccauucugccugcc

SEQ ID NO: 2775167 - RNA, 24 nt, Human
cagccccauucugccugcccaggc

SEQ ID NO: 2775168 - RNA, 23 nt, Human
cagccccauucugccugcccagg

SEQ ID NO: 2775169 - RNA, 14 nt, Human
cagcccccagcccc

SEQ ID NO: 2775170 - RNA, 15 nt, Human
cagcccccagccccu

SEQ ID NO: 2775171 - RNA, 17 nt, Human
cagcccccagccccucc

SEQ ID NO: 2775172 - RNA, 13 nt, Human
cagcaguucuguu

SEQ ID NO: 2775173 - RNA, 14 nt, Human
cagcaguucuguua

SEQ ID NO: 2775174 - RNA, 19 nt, Human
cagcauagcaagacacauc

SEQ ID NO: 2775175 - RNA, 15 nt, Human
cagcacagcucccug

SEQ ID NO: 2775176 - RNA, 16 nt, Human
cagcacagcucccugc

SEQ ID NO: 2775177 - RNA, 17 nt, Human
cagcacagcucccugcc

SEQ ID NO: 2775178 - RNA, 14 nt, Human
cagcacauauuuuc

SEQ ID NO: 2775179 - RNA, 13 nt, Human
cagcaccacccua

SEQ ID NO: 2775180 - RNA, 15 nt, Human
cagcacaugcuggcc

SEQ ID NO: 2775181 - RNA, 16 nt, Human
cagcacaugcuggcca

SEQ ID NO: 2775182 - RNA, 17 nt, Human
cagcacaugcuggccag

SEQ ID NO: 2775183 - RNA, 18 nt, Human
cagcacaugcuggccagc

SEQ ID NO: 2775184 - RNA, 20 nt, Human
cagcacaugcuggccagccu

SEQ ID NO: 2775185 - RNA, 22 nt, Human
cagcacaugcuggccagccugg

SEQ ID NO: 2775186 - RNA, 11 nt, Human
cagcacugaaa

SEQ ID NO: 2775187 - RNA, 12 nt, Human
cagcacugaaaa

SEQ ID NO: 2775188 - RNA, 14 nt, Human
cagcacugaaaaua

SEQ ID NO: 2775189 - RNA, 14 nt, Human
cagauuugagcuca

SEQ ID NO: 2775190 - RNA, 13 nt, Human
cagauuugagcuc

SEQ ID NO: 2775191 - RNA, 20 nt, Human
cagauuugcuaauuuauccu

SEQ ID NO: 2775192 - RNA, 14 nt, Human
cagauuugggcugg

SEQ ID NO: 2775193 - RNA, 15 nt, Human
cagauuugggcugga

SEQ ID NO: 2775194 - RNA, 18 nt, Human
cagauuugggcuggaaca

SEQ ID NO: 2775195 - RNA, 16 nt, Human
cagauuugagcucagc

SEQ ID NO: 2775196 - RNA, 21 nt, Human
cagauugcaacaggcugggcu

SEQ ID NO: 2775197 - RNA, 12 nt, Human
cagauuggaagg

SEQ ID NO: 2775198 - RNA, 15 nt, Human
cagauuggaaggaga

SEQ ID NO: 2775199 - RNA, 21 nt, Human
cagauuggaaggagacacaga

SEQ ID NO: 2775200 - RNA, 22 nt, Human
cagauuggaaggagacacagau

SEQ ID NO: 2775201 - RNA, 23 nt, Human
cagauuggaaggagacacagaug

SEQ ID NO: 2775202 - RNA, 17 nt, Human
cagccagauccucuugg

SEQ ID NO: 2775203 - RNA, 21 nt, Human
cagauaccauacucauuucua

SEQ ID NO: 2775204 - RNA, 15 nt, Human
cagauaccucacccu

SEQ ID NO: 2775205 - RNA, 15 nt, Human
cagauacauuucccu

SEQ ID NO: 2775206 - RNA, 12 nt, Human
cagauacaucac

SEQ ID NO: 2775207 - RNA, 13 nt, Human
cagauacaucacu

SEQ ID NO: 2775208 - RNA, 14 nt, Human
cagauacaucacug

SEQ ID NO: 2775209 - RNA, 15 nt, Human
cagauacaucacugc

SEQ ID NO: 2775210 - RNA, 16 nt, Human
cagauacaucacugcu

SEQ ID NO: 2775211 - RNA, 19 nt, Human
cagauacaucacugcuuga

SEQ ID NO: 2775212 - RNA, 14 nt, Human
cagauacugcugug

SEQ ID NO: 2775213 - RNA, 23 nt, Human
cagauacaggaaaagcugcugac

SEQ ID NO: 2775214 - RNA, 18 nt, Human
cagagguuaucuguccca

SEQ ID NO: 2775215 - RNA, 19 nt, Human
cagagguuaucugucccag

SEQ ID NO: 2775216 - RNA, 21 nt, Human
cagagguuaucugucccaggu

SEQ ID NO: 2775217 - RNA, 21 nt, Human
cagagguucuuugagggacug

SEQ ID NO: 2775218 - RNA, 19 nt, Human
cagagguggccagagcugg

SEQ ID NO: 2775219 - RNA, 21 nt, Human
cagagguggccagagcuggga

SEQ ID NO: 2775220 - RNA, 14 nt, Human
cagaggugcuucac

SEQ ID NO: 2775221 - RNA, 21 nt, Human
cagaggugcuucacccugagu

SEQ ID NO: 2775222 - RNA, 14 nt, Human
cagagguggccaga

SEQ ID NO: 2775223 - RNA, 17 nt, Human
cagagguggccagagcu

SEQ ID NO: 2775224 - RNA, 23 nt, Human
cagagcuggaccaguggugccuu

SEQ ID NO: 2775225 - RNA, 13 nt, Human
cagagcugggagg

SEQ ID NO: 2775226 - RNA, 14 nt, Human
cagagcugggaggc

SEQ ID NO: 2775227 - RNA, 15 nt, Human
cagagcugggaggca

SEQ ID NO: 2775228 - RNA, 23 nt, Human
cagagcugggaggcauggcccug

SEQ ID NO: 2775229 - RNA, 13 nt, Human
cagagguccagcc

SEQ ID NO: 2775230 - RNA, 14 nt, Human
cagagguccagccc

SEQ ID NO: 2775231 - RNA, 15 nt, Human
cagagguccagccca

SEQ ID NO: 2775232 - RNA, 16 nt, Human
cagagguccagcccau

SEQ ID NO: 2775233 - RNA, 17 nt, Human
cagagguccagcccauc

SEQ ID NO: 2775234 - RNA, 20 nt, Human
cagagcugggaggcauggcc

SEQ ID NO: 2775235 - RNA, 16 nt, Human
cagagcuggaccagug

SEQ ID NO: 2775236 - RNA, 21 nt, Human
cagagcguggcugugcucuca

SEQ ID NO: 2775237 - RNA, 17 nt, Human
cagagcggaggcugugu

SEQ ID NO: 2775238 - RNA, 19 nt, Human
cagagcggaggcugugugc

SEQ ID NO: 2775239 - RNA, 20 nt, Human
cagagcuaagggugggugcu

SEQ ID NO: 2775240 - RNA, 21 nt, Human
cagagcuaagggugggugcuc

SEQ ID NO: 2775241 - RNA, 22 nt, Human
cagagcuaagggugggugcuca

SEQ ID NO: 2775242 - RNA, 15 nt, Human
cagagcgagacucca

SEQ ID NO: 2775243 - RNA, 20 nt, Human
cagagcgagagucugucuca

SEQ ID NO: 2775244 - RNA, 14 nt, Human
cagagccugcaguu

SEQ ID NO: 2775245 - RNA, 20 nt, Human
cagagaggccuuuuggaaug

SEQ ID NO: 2775246 - RNA, 13 nt, Human
cagagagagagaa

SEQ ID NO: 2775247 - RNA, 15 nt, Human
cagagagagagaaag

SEQ ID NO: 2775248 - RNA, 17 nt, Human
cagagagagagaaagag

SEQ ID NO: 2775249 - RNA, 21 nt, Human
cagagagccauuuugugaaug

SEQ ID NO: 2775250 - RNA, 23 nt, Human
cagagagccauuuugugaaugga

SEQ ID NO: 2775251 - RNA, 15 nt, Human
cagagagccauuuug

SEQ ID NO: 2775252 - RNA, 18 nt, Human
cagagagccauuuuguga

SEQ ID NO: 2775253 - RNA, 19 nt, Human
cagagagccauuuugugaa

SEQ ID NO: 2775254 - RNA, 20 nt, Human
cagagagccauuuugugaau

SEQ ID NO: 2775255 - RNA, 20 nt, Human
cagagagcaacucugagauc

SEQ ID NO: 2775256 - RNA, 22 nt, Human
cagagagaggggagaagccugg

SEQ ID NO: 2775257 - RNA, 18 nt, Human
cagagagcggucucaggc

SEQ ID NO: 2775258 - RNA, 21 nt, Human
cagagagcggucucaggcugg

SEQ ID NO: 2775259 - RNA, 20 nt, Human
cagagagcuuagccuggagc

SEQ ID NO: 2775260 - RNA, 22 nt, Human
cagagagcggucucaggcuggu

SEQ ID NO: 2775261 - RNA, 17 nt, Human
aaaaauagugucuuugu

SEQ ID NO: 2775262 - RNA, 14 nt, Human
aaaaauauaacuua

SEQ ID NO: 2775263 - RNA, 14 nt, Human
aaaaauagcaacuu

SEQ ID NO: 2775264 - RNA, 15 nt, Human
aaaaauagcaacuug

SEQ ID NO: 2775265 - RNA, 17 nt, Human
aaaaauagcaacuugug

SEQ ID NO: 2775266 - RNA, 16 nt, Human
gggaccaacugggccc

SEQ ID NO: 2775267 - RNA, 12 nt, Human
gggacaggccuc

SEQ ID NO: 2775268 - RNA, 13 nt, Human
gggacaggccuca

SEQ ID NO: 2775269 - RNA, 17 nt, Human
gggacaggccucaccuc

SEQ ID NO: 2775270 - RNA, 21 nt, Human
gggacagcuccuucuguccua

SEQ ID NO: 2775271 - RNA, 18 nt, Human
gggacagaggccugcccg

SEQ ID NO: 2775272 - RNA, 14 nt, Human
gggacagauucagu

SEQ ID NO: 2775273 - RNA, 20 nt, Human
aaaaauauggaacuucuaau

SEQ ID NO: 2775274 - RNA, 12 nt, Human
aaaaaucaucua

SEQ ID NO: 2775275 - RNA, 17 nt, Human
aaaaaucaucuauuuug

SEQ ID NO: 2775276 - RNA, 20 nt, Human
aaaaaucaucuauuuugaug

SEQ ID NO: 2775277 - RNA, 20 nt, Human
aaaaaucacuugauucauaa

SEQ ID NO: 2775278 - RNA, 17 nt, Human
aaaaaucacaaaaauuu

SEQ ID NO: 2775279 - RNA, 18 nt, Human
aaaaaucacaauuuuuaa

SEQ ID NO: 2775280 - RNA, 20 nt, Human
aaaaaucacaauuuuuaaug

SEQ ID NO: 2775281 - RNA, 15 nt, Human
aaaaauauauuuaau

SEQ ID NO: 2775282 - RNA, 13 nt, Human
aaaaauauauuua

SEQ ID NO: 2775283 - RNA, 15 nt, Human
aaaaauauauacuaa

SEQ ID NO: 2775284 - RNA, 19 nt, Human
aaaaauauauuuaaugaua

SEQ ID NO: 2775285 - RNA, 23 nt, Human
aaaaauaugaccacacuccagcu

SEQ ID NO: 2775286 - RNA, 21 nt, Human
aaaaauaugaccacacuccag

SEQ ID NO: 2775287 - RNA, 12 nt, Human
gggaagccuuua

SEQ ID NO: 2775288 - RNA, 18 nt, Human
gggaagcgcucagaacag

SEQ ID NO: 2775289 - RNA, 12 nt, Human
gggaagccagac

SEQ ID NO: 2775290 - RNA, 14 nt, Human
gggaagagggggcg

SEQ ID NO: 2775291 - RNA, 17 nt, Human
gggacagaggccugccc

SEQ ID NO: 2775292 - RNA, 15 nt, Human
gggacagaggccugc

SEQ ID NO: 2775293 - RNA, 23 nt, Human
gggaagcggagguugcagggagc

SEQ ID NO: 2775294 - RNA, 13 nt, Human
gggaagcugcagc

SEQ ID NO: 2775295 - RNA, 16 nt, Human
gggaagcugcagcuug

SEQ ID NO: 2775296 - RNA, 19 nt, Human
gggaagcugcagcuuggga

SEQ ID NO: 2775297 - RNA, 22 nt, Human
gggaagcugcagcuugggagag

SEQ ID NO: 2775298 - RNA, 14 nt, Human
gggaaggacagaaa

SEQ ID NO: 2775299 - RNA, 19 nt, Human
gggaaggacagaaaggaga

SEQ ID NO: 2775300 - RNA, 21 nt, Human
gggaaggaggguacagcuggg

SEQ ID NO: 2775301 - RNA, 16 nt, Human
gggaagcuggccugag

SEQ ID NO: 2775302 - RNA, 15 nt, Human
gggaagcuggccuga

SEQ ID NO: 2775303 - RNA, 16 nt, Human
gggacagcuccuucug

SEQ ID NO: 2775304 - RNA, 21 nt, Human
aaaacauuggauuauccugag

SEQ ID NO: 2775305 - RNA, 22 nt, Human
aaaacauugccuuugaauguua

SEQ ID NO: 2775306 - RNA, 14 nt, Human
aaaacauuggauua

SEQ ID NO: 2775307 - RNA, 19 nt, Human
aaaacauguaauauaaaga

SEQ ID NO: 2775308 - RNA, 16 nt, Human
aaaacauagcaucuca

SEQ ID NO: 2775309 - RNA, 19 nt, Human
aaaacauauucuugugcuu

SEQ ID NO: 2775310 - RNA, 14 nt, Human
aaaaaugcuuugcu

SEQ ID NO: 2775311 - RNA, 15 nt, Human
aaaaauggaacugug

SEQ ID NO: 2775312 - RNA, 12 nt, Human
aaaaauggauau

SEQ ID NO: 2775313 - RNA, 15 nt, Human
aaaaauggauauuau

SEQ ID NO: 2775314 - RNA, 23 nt, Human
aaaaauggauauuauuagaaauu

SEQ ID NO: 2775315 - RNA, 21 nt, Human
aaaacaggucuucaucgaauc

SEQ ID NO: 2775316 - RNA, 18 nt, Human
aaaacagguggagaaauu

SEQ ID NO: 2775317 - RNA, 13 nt, Human
aaaacaguauuua

SEQ ID NO: 2775318 - RNA, 16 nt, Human
aaaacaguauuuauuu

SEQ ID NO: 2775319 - RNA, 17 nt, Human
aaaacaguauuuauuuu

SEQ ID NO: 2775320 - RNA, 18 nt, Human
aaaacaguauuuauuuug

SEQ ID NO: 2775321 - RNA, 19 nt, Human
aaaacaguauuuauuuugu

SEQ ID NO: 2775322 - RNA, 20 nt, Human
aaaacaguauuuauuuugua

SEQ ID NO: 2775323 - RNA, 21 nt, Human
aaaacaguauuuauuuuguaa

SEQ ID NO: 2775324 - RNA, 23 nt, Human
aaaacaguauuuauuuuguaauu

SEQ ID NO: 2775325 - RNA, 14 nt, Human
aaaaaugccuuuga

SEQ ID NO: 2775326 - RNA, 15 nt, Human
aaaaaugccuuugag

SEQ ID NO: 2775327 - RNA, 18 nt, Human
aaaaaugccuuugagaca

SEQ ID NO: 2775328 - RNA, 13 nt, Human
aaaaaugccuuug

SEQ ID NO: 2775329 - RNA, 24 nt, Human
aaaaaugccuuugagacaguuucu

SEQ ID NO: 2775330 - RNA, 12 nt, Human
aaaaaugcuaau

SEQ ID NO: 2775331 - RNA, 13 nt, Human
aaaaaugcuaaua

SEQ ID NO: 2775332 - RNA, 17 nt, Human
aaaaaugcuaauauuaa

SEQ ID NO: 2775333 - RNA, 19 nt, Human
aaaaaugccuuugagacag

SEQ ID NO: 2775334 - RNA, 20 nt, Human
aaaaaugccuuugagacagu

SEQ ID NO: 2775335 - RNA, 21 nt, Human
aaaaaugccuuugagacaguu

SEQ ID NO: 2775336 - RNA, 22 nt, Human
aaaaaugccuuugagacaguuu

SEQ ID NO: 2775337 - RNA, 16 nt, Human
aaaacuccaccuuccc

SEQ ID NO: 2775338 - RNA, 17 nt, Human
aaaacuccaccuuccca

SEQ ID NO: 2775339 - RNA, 16 nt, Human
aaaacucccauuuacg

SEQ ID NO: 2775340 - RNA, 16 nt, Human
aaaacuccgcccccag

SEQ ID NO: 2775341 - RNA, 19 nt, Human
aaaacuccgcccccagccu

SEQ ID NO: 2775342 - RNA, 20 nt, Human
aaaacuccgcccccagccua

SEQ ID NO: 2775343 - RNA, 21 nt, Human
aaaacuggcaacauuccaaga

SEQ ID NO: 2775344 - RNA, 13 nt, Human
aaaacuggccuga

SEQ ID NO: 2775345 - RNA, 19 nt, Human
aaaacugggccuguagcuc

SEQ ID NO: 2775346 - RNA, 17 nt, Human
aaaacuguacauuuaaa

SEQ ID NO: 2775347 - RNA, 20 nt, Human
aaaacuguacauuuaaaauu

SEQ ID NO: 2775348 - RNA, 12 nt, Human
aaaacugcuuuu

SEQ ID NO: 2775349 - RNA, 23 nt, Human
aaaacugcuuuuuuuuuuccagc

SEQ ID NO: 2775350 - RNA, 17 nt, Human
aaaacuggaauaagaag

SEQ ID NO: 2775351 - RNA, 21 nt, Human
aaaacuggaauaagaagcaaa

SEQ ID NO: 2775352 - RNA, 14 nt, Human
aaaaccacaaaggc

SEQ ID NO: 2775353 - RNA, 21 nt, Human
aaaaccacaaaggccaaacug

SEQ ID NO: 2775354 - RNA, 12 nt, Human
aaaaccacacaa

SEQ ID NO: 2775355 - RNA, 15 nt, Human
aaaaccacacaaaga

SEQ ID NO: 2775356 - RNA, 20 nt, Human
aaaaccuaaguccuuuaugu

SEQ ID NO: 2775357 - RNA, 21 nt, Human
aaaaccuaaguccuuuaugug

SEQ ID NO: 2775358 - RNA, 15 nt, Human
aaaaccuacauauuc

SEQ ID NO: 2775359 - RNA, 16 nt, Human
aaaaccuacauauucc

SEQ ID NO: 2775360 - RNA, 15 nt, Human
aaaacccucaagggc

SEQ ID NO: 2775361 - RNA, 12 nt, Human
aaaacucagccu

SEQ ID NO: 2775362 - RNA, 19 nt, Human
aaaacucagccugggacag

SEQ ID NO: 2775363 - RNA, 15 nt, Human
aaaacuauuaaggau

SEQ ID NO: 2775364 - RNA, 16 nt, Human
aaaacuauucaugcua

SEQ ID NO: 2775365 - RNA, 20 nt, Human
aaaacuauucaugcuaccca

SEQ ID NO: 2775366 - RNA, 13 nt, Human
aaaaccugacaaa

SEQ ID NO: 2775367 - RNA, 15 nt, Human
aaaacuaguaguucu

SEQ ID NO: 2775368 - RNA, 12 nt, Human
aaaacuauacaa

SEQ ID NO: 2775369 - RNA, 13 nt, Human
aaaacuauacaac

SEQ ID NO: 2775370 - RNA, 20 nt, Human
aaaacuauacuugaacaaaa

SEQ ID NO: 2775371 - RNA, 21 nt, Human
aaaacuauacuugaacaaaag

SEQ ID NO: 2775372 - RNA, 15 nt, Human
gggauugcugccacu

SEQ ID NO: 2775373 - RNA, 17 nt, Human
gggauugcugccacuuu

SEQ ID NO: 2775374 - RNA, 15 nt, Human
gggauuacaggugug

SEQ ID NO: 2775375 - RNA, 12 nt, Human
gggauuacaggu

SEQ ID NO: 2775376 - RNA, 20 nt, Human
gggauuacaggcgugagcca

SEQ ID NO: 2775377 - RNA, 21 nt, Human
gggauuacaggcuccugccac

SEQ ID NO: 2775378 - RNA, 16 nt, Human
gggauuacaggcuccu

SEQ ID NO: 2775379 - RNA, 13 nt, Human
gggauuacaggcu

SEQ ID NO: 2775380 - RNA, 14 nt, Human
gggauuacaggcgu

SEQ ID NO: 2775381 - RNA, 20 nt, Human
gggcaacaaagugagacucc

SEQ ID NO: 2775382 - RNA, 21 nt, Human
gggcaaaugacaugcacugac

SEQ ID NO: 2775383 - RNA, 22 nt, Human
gggcaaaugacaugcacugacc

SEQ ID NO: 2775384 - RNA, 18 nt, Human
gggcaacccccagccugc

SEQ ID NO: 2775385 - RNA, 16 nt, Human
gggcaacccccagccu

SEQ ID NO: 2775386 - RNA, 22 nt, Human
aaaagguagcuuaccugacaca

SEQ ID NO: 2775387 - RNA, 10 nt, Human
aaaaggguca

SEQ ID NO: 2775388 - RNA, 21 nt, Human
aaaagggucaaugcuauuuuu

SEQ ID NO: 2775389 - RNA, 12 nt, Human
aaaagggucaga

SEQ ID NO: 2775390 - RNA, 13 nt, Human
aaaagggucagag

SEQ ID NO: 2775391 - RNA, 13 nt, Human
gggcaggcugggc

SEQ ID NO: 2775392 - RNA, 12 nt, Human
gggcaggcuggg

SEQ ID NO: 2775393 - RNA, 15 nt, Human
gggcaggcugggcca

SEQ ID NO: 2775394 - RNA, 14 nt, Human
gggcaggcugggcc

SEQ ID NO: 2775395 - RNA, 16 nt, Human
gggcaggcugggccau

SEQ ID NO: 2775396 - RNA, 15 nt, Human
gggcaggcaugaagu

SEQ ID NO: 2775397 - RNA, 18 nt, Human
gggcagccucccccggcu

SEQ ID NO: 2775398 - RNA, 15 nt, Human
gggcagccucccccg

SEQ ID NO: 2775399 - RNA, 22 nt, Human
gggcaacagagcaagauccugu

SEQ ID NO: 2775400 - RNA, 21 nt, Human
gggcaacauuguucaccuuug

SEQ ID NO: 2775401 - RNA, 16 nt, Human
gggcagagucacacgg

SEQ ID NO: 2775402 - RNA, 12 nt, Human
gggcagagucac

SEQ ID NO: 2775403 - RNA, 22 nt, Human
gggcagaucuuggacucaugag

SEQ ID NO: 2775404 - RNA, 20 nt, Human
gggcagaucuuggacucaug

SEQ ID NO: 2775405 - RNA, 18 nt, Human
gggcagaucuuggacuca

SEQ ID NO: 2775406 - RNA, 21 nt, Human
gggagcaggcggugggcaccc

SEQ ID NO: 2775407 - RNA, 15 nt, Human
gggagcaggcggugg

SEQ ID NO: 2775408 - RNA, 21 nt, Human
gggagcaggagauugagaagg

SEQ ID NO: 2775409 - RNA, 12 nt, Human
gggagcaggaga

SEQ ID NO: 2775410 - RNA, 13 nt, Human
gggagcaggagau

SEQ ID NO: 2775411 - RNA, 18 nt, Human
gggagcaggagauugaga

SEQ ID NO: 2775412 - RNA, 15 nt, Human
gggaggccccuucuc

SEQ ID NO: 2775413 - RNA, 20 nt, Human
gggaggcggagcuugcagug

SEQ ID NO: 2775414 - RNA, 14 nt, Human
gggagacacuggcc

SEQ ID NO: 2775415 - RNA, 19 nt, Human
gggagacacuggccccuca

SEQ ID NO: 2775416 - RNA, 19 nt, Human
gggagauggaguucuugug

SEQ ID NO: 2775417 - RNA, 18 nt, Human
gggagagugucaaccaga

SEQ ID NO: 2775418 - RNA, 20 nt, Human
gggagagugucaaccagaca

SEQ ID NO: 2775419 - RNA, 21 nt, Human
gggagagugucaaccagacag

SEQ ID NO: 2775420 - RNA, 16 nt, Human
gggagaguuccagagg

SEQ ID NO: 2775421 - RNA, 16 nt, Human
gggagcagacaggagg

SEQ ID NO: 2775422 - RNA, 16 nt, Human
gggagaaccucaggcu

SEQ ID NO: 2775423 - RNA, 16 nt, Human
aaaagcagcucucccc

SEQ ID NO: 2775424 - RNA, 17 nt, Human
aaaagcagcucuccccu

SEQ ID NO: 2775425 - RNA, 19 nt, Human
aaaagcaguaaauuugcua

SEQ ID NO: 2775426 - RNA, 21 nt, Human
aaaagcacacucauccccuca

SEQ ID NO: 2775427 - RNA, 11 nt, Human
aaaagcaccuc

SEQ ID NO: 2775428 - RNA, 19 nt, Human
gggauggacgaucucccac

SEQ ID NO: 2775429 - RNA, 16 nt, Human
gggaugguccuggggc

SEQ ID NO: 2775430 - RNA, 15 nt, Human
gggaugguccugggg

SEQ ID NO: 2775431 - RNA, 14 nt, Human
gggaugggccuggc

SEQ ID NO: 2775432 - RNA, 15 nt, Human
gggauggaggggagu

SEQ ID NO: 2775433 - RNA, 14 nt, Human
gggaugugggaggg

SEQ ID NO: 2775434 - RNA, 12 nt, Human
gggauggugccc

SEQ ID NO: 2775435 - RNA, 23 nt, Human
gggauggggggggauguggauca

SEQ ID NO: 2775436 - RNA, 19 nt, Human
gggauggugggcuucaggg

SEQ ID NO: 2775437 - RNA, 13 nt, Human
gggauggugcccu

SEQ ID NO: 2775438 - RNA, 22 nt, Human
gggauguacaaggcgaucccau

SEQ ID NO: 2775439 - RNA, 20 nt, Human
aaaaguagguuuacauucau

SEQ ID NO: 2775440 - RNA, 12 nt, Human
aaaaguauuuug

SEQ ID NO: 2775441 - RNA, 13 nt, Human
aaaaguauuuuga

SEQ ID NO: 2775442 - RNA, 14 nt, Human
aaaaguauuuugaa

SEQ ID NO: 2775443 - RNA, 15 nt, Human
aaaaguauuuugaag

SEQ ID NO: 2775444 - RNA, 16 nt, Human
aaaaguauuuugaagu

SEQ ID NO: 2775445 - RNA, 18 nt, Human
aaaaguauuuugaaguuu

SEQ ID NO: 2775446 - RNA, 12 nt, Human
aaaaucugucca

SEQ ID NO: 2775447 - RNA, 18 nt, Human
aaaaucuugugcuagaau

SEQ ID NO: 2775448 - RNA, 19 nt, Human
aaaaucuugugcuagaaua

SEQ ID NO: 2775449 - RNA, 22 nt, Human
aaaaucuugugcuagaauacuu

SEQ ID NO: 2775450 - RNA, 14 nt, Human
aaaaucuuggaagu

SEQ ID NO: 2775451 - RNA, 20 nt, Human
aaaaucuuggagacccugca

SEQ ID NO: 2775452 - RNA, 18 nt, Human
aaaaucuuauaguucuag

SEQ ID NO: 2775453 - RNA, 19 nt, Human
aaaaucuuauaguucuagg

SEQ ID NO: 2775454 - RNA, 20 nt, Human
aaaaucuuauaguucuaggc

SEQ ID NO: 2775455 - RNA, 23 nt, Human
aaaaugaaugaggucugggcuag

SEQ ID NO: 2775456 - RNA, 22 nt, Human
aaaaugagccgugccaaagucu

SEQ ID NO: 2775457 - RNA, 20 nt, Human
aaaaugaguugugaaaguuu

SEQ ID NO: 2775458 - RNA, 16 nt, Human
aaaaugaggacauguu

SEQ ID NO: 2775459 - RNA, 17 nt, Human
aaaaugcccuuaaauca

SEQ ID NO: 2775460 - RNA, 13 nt, Human
aaaaugaaagaug

SEQ ID NO: 2775461 - RNA, 14 nt, Human
aaaaugaaagauga

SEQ ID NO: 2775462 - RNA, 15 nt, Human
aaaaugaaagaugau

SEQ ID NO: 2775463 - RNA, 17 nt, Human
aaaaugaaaauaaguga

SEQ ID NO: 2775464 - RNA, 15 nt, Human
aaaaugaaauauuuu

SEQ ID NO: 2775465 - RNA, 15 nt, Human
aaaaugaaauccuuu

SEQ ID NO: 2775466 - RNA, 14 nt, Human
aaaaugaauaucua

SEQ ID NO: 2775467 - RNA, 18 nt, Human
aaaaugaauaucuauuaa

SEQ ID NO: 2775468 - RNA, 22 nt, Human
aaaaugaauaucuauuaauaua

SEQ ID NO: 2775469 - RNA, 14 nt, Human
gggccaggacugag

SEQ ID NO: 2775470 - RNA, 17 nt, Human
gggccaggacugagccc

SEQ ID NO: 2775471 - RNA, 13 nt, Human
gggccagccccuc

SEQ ID NO: 2775472 - RNA, 16 nt, Human
gggccagccccuccau

SEQ ID NO: 2775473 - RNA, 15 nt, Human
aaaaugccuuugaga

SEQ ID NO: 2775474 - RNA, 17 nt, Human
aaaaugccuuugagaca

SEQ ID NO: 2775475 - RNA, 22 nt, Human
aaaaugccuuugagacaguuuc

SEQ ID NO: 2775476 - RNA, 23 nt, Human
aaaaugccuuugagacaguuucu

SEQ ID NO: 2775477 - RNA, 16 nt, Human
aaaaugcuaauauuaa

SEQ ID NO: 2775478 - RNA, 11 nt, Human
aaaaugccuuu

SEQ ID NO: 2775479 - RNA, 12 nt, Human
aaaaugccuuug

SEQ ID NO: 2775480 - RNA, 14 nt, Human
aaaaugccuuugag

SEQ ID NO: 2775481 - RNA, 22 nt, Human
gggccaguccugccuggccagg

SEQ ID NO: 2775482 - RNA, 21 nt, Human
gggccaguccugccuggccag

SEQ ID NO: 2775483 - RNA, 20 nt, Human
gggccaguccugccuggcca

SEQ ID NO: 2775484 - RNA, 19 nt, Human
gggccaguccugccuggcc

SEQ ID NO: 2775485 - RNA, 18 nt, Human
gggccaguccugccuggc

SEQ ID NO: 2775486 - RNA, 15 nt, Human
gggccaguccugccu

SEQ ID NO: 2775487 - RNA, 18 nt, Human
gggccagggucuguguga

SEQ ID NO: 2775488 - RNA, 20 nt, Human
gggccagggcugcccugaga

SEQ ID NO: 2775489 - RNA, 21 nt, Human
gggccagggcugcccugagaa

SEQ ID NO: 2775490 - RNA, 18 nt, Human
gggccagggcccugcaga

SEQ ID NO: 2775491 - RNA, 13 nt, Human
gggccagggcugc

SEQ ID NO: 2775492 - RNA, 12 nt, Human
gggccagggcug

SEQ ID NO: 2775493 - RNA, 16 nt, Human
gggccagggcccugca

SEQ ID NO: 2775494 - RNA, 14 nt, Human
gggccagggcccug

SEQ ID NO: 2775495 - RNA, 13 nt, Human
gggccagggcccu

SEQ ID NO: 2775496 - RNA, 23 nt, Human
gggcuacaccuuagccugcccuc

SEQ ID NO: 2775497 - RNA, 15 nt, Human
gggcgggaggauguu

SEQ ID NO: 2775498 - RNA, 12 nt, Human
gggcggcugggu

SEQ ID NO: 2775499 - RNA, 11 nt, Human
aaaaguauuuu

SEQ ID NO: 2775500 - RNA, 15 nt, Human
gggcggcucugaagc

SEQ ID NO: 2775501 - RNA, 19 nt, Human
gggccucaaaggcccgcuc

SEQ ID NO: 2775502 - RNA, 13 nt, Human
gggccuccugugu

SEQ ID NO: 2775503 - RNA, 15 nt, Human
gggccuccugugugu

SEQ ID NO: 2775504 - RNA, 14 nt, Human
gggccuccagaacu

SEQ ID NO: 2775505 - RNA, 14 nt, Human
gggccugagagaau

SEQ ID NO: 2775506 - RNA, 18 nt, Human
gggccugagccuggccag

SEQ ID NO: 2775507 - RNA, 18 nt, Human
gggccugcaggaccugcc

SEQ ID NO: 2775508 - RNA, 16 nt, Human
gggccugagccuggcc

SEQ ID NO: 2775509 - RNA, 15 nt, Human
gggccugagccuggc

SEQ ID NO: 2775510 - RNA, 15 nt, Human
gggccaguggggccu

SEQ ID NO: 2775511 - RNA, 16 nt, Human
gggccaguggggccug

SEQ ID NO: 2775512 - RNA, 17 nt, Human
gggccaguggggccugu

SEQ ID NO: 2775513 - RNA, 18 nt, Human
gggccaguggggccugug

SEQ ID NO: 2775514 - RNA, 19 nt, Human
gggccaguggggccugugg

SEQ ID NO: 2775515 - RNA, 20 nt, Human
gggccaguggggccugugga

SEQ ID NO: 2775516 - RNA, 20 nt, Human
gggccgaccagaggagccuu

SEQ ID NO: 2775517 - RNA, 13 nt, Human
gggccgaccagag

SEQ ID NO: 2775518 - RNA, 18 nt, Human
gggccgaauccccucccu

SEQ ID NO: 2775519 - RNA, 12 nt, Human
gggccgaggagg

SEQ ID NO: 2775520 - RNA, 20 nt, Human
gggccgaggaggugccugga

SEQ ID NO: 2775521 - RNA, 19 nt, Human
gggcccugguccuuccagg

SEQ ID NO: 2775522 - RNA, 14 nt, Human
aaacagugagccug

SEQ ID NO: 2775523 - RNA, 21 nt, Human
gggcugggcaaggaaaaagaa

SEQ ID NO: 2775524 - RNA, 14 nt, Human
aaacaccuagcuuu

SEQ ID NO: 2775525 - RNA, 18 nt, Human
aaacaccuccucauguac

SEQ ID NO: 2775526 - RNA, 15 nt, Human
aaacaccucugcuuu

SEQ ID NO: 2775527 - RNA, 15 nt, Human
aaacaccuagcuuua

SEQ ID NO: 2775528 - RNA, 15 nt, Human
aaacaccucacaccu

SEQ ID NO: 2775529 - RNA, 21 nt, Human
aaacaccucacaccucacucu

SEQ ID NO: 2775530 - RNA, 12 nt, Human
aaacaccccuca

SEQ ID NO: 2775531 - RNA, 14 nt, Human
aaacaucacacaca

SEQ ID NO: 2775532 - RNA, 22 nt, Human
aaacaucacacacacagacaga

SEQ ID NO: 2775533 - RNA, 13 nt, Human
aaacauaugauuu

SEQ ID NO: 2775534 - RNA, 15 nt, Human
aaacauaugauuuca

SEQ ID NO: 2775535 - RNA, 17 nt, Human
aaacauaugauuucacu

SEQ ID NO: 2775536 - RNA, 14 nt, Human
aaacauaugcacau

SEQ ID NO: 2775537 - RNA, 19 nt, Human
aaacaagcaaguucugaga

SEQ ID NO: 2775538 - RNA, 19 nt, Human
aaacaagaugcuggauguc

SEQ ID NO: 2775539 - RNA, 22 nt, Human
aaacaagaguuuucuuccuugu

SEQ ID NO: 2775540 - RNA, 9 nt, Human
aaacaaaac

SEQ ID NO: 2775541 - RNA, 13 nt, Human
aaacaaaacaaaa

SEQ ID NO: 2775542 - RNA, 14 nt, Human
aaacaaaacaaaac

SEQ ID NO: 2775543 - RNA, 21 nt, Human
aaaauuuuuuuggucuuuuug

SEQ ID NO: 2775544 - RNA, 13 nt, Human
aaacaaaaacacu

SEQ ID NO: 2775545 - RNA, 12 nt, Human
aaacaaaaacau

SEQ ID NO: 2775546 - RNA, 20 nt, Human
ggggacagcuccuucugucc

SEQ ID NO: 2775547 - RNA, 14 nt, Human
ggggacagcuccuu

SEQ ID NO: 2775548 - RNA, 12 nt, Human
ggggacagcucc

SEQ ID NO: 2775549 - RNA, 12 nt, Human
aaacaugaagug

SEQ ID NO: 2775550 - RNA, 13 nt, Human
aaacaugacacug

SEQ ID NO: 2775551 - RNA, 15 nt, Human
aaacaugacacugac

SEQ ID NO: 2775552 - RNA, 17 nt, Human
aaacaugacacugaccu

SEQ ID NO: 2775553 - RNA, 18 nt, Human
aaacauccuacaagacac

SEQ ID NO: 2775554 - RNA, 20 nt, Human
aaacauccuucaagaacucu

SEQ ID NO: 2775555 - RNA, 13 nt, Human
aaacaucuagaaa

SEQ ID NO: 2775556 - RNA, 18 nt, Human
aaacauccuucaagaacu

SEQ ID NO: 2775557 - RNA, 22 nt, Human
aaacauccuacaagacacagug

SEQ ID NO: 2775558 - RNA, 15 nt, Human
aaacaugagaugugu

SEQ ID NO: 2775559 - RNA, 12 nt, Human
ggggacaggccu

SEQ ID NO: 2775560 - RNA, 13 nt, Human
ggggacaggccuc

SEQ ID NO: 2775561 - RNA, 17 nt, Human
ggggacaggccucaccu

SEQ ID NO: 2775562 - RNA, 19 nt, Human
ggggacaggccucaccucu

SEQ ID NO: 2775563 - RNA, 15 nt, Human
ggggcaugaccagau

SEQ ID NO: 2775564 - RNA, 13 nt, Human
ggggacagggaug

SEQ ID NO: 2775565 - RNA, 20 nt, Human
ggggcaucugccccuccccc

SEQ ID NO: 2775566 - RNA, 17 nt, Human
ggggcaugaccagaugc

SEQ ID NO: 2775567 - RNA, 16 nt, Human
ggggcaugcuggggca

SEQ ID NO: 2775568 - RNA, 16 nt, Human
ggggccaaaaggaaaa

SEQ ID NO: 2775569 - RNA, 14 nt, Human
ggggccaccaaagc

SEQ ID NO: 2775570 - RNA, 18 nt, Human
ggggccaccaaagcugcc

SEQ ID NO: 2775571 - RNA, 19 nt, Human
ggggccaccaaagcugccc

SEQ ID NO: 2775572 - RNA, 15 nt, Human
ggggccaccugccug

SEQ ID NO: 2775573 - RNA, 16 nt, Human
ggggccaccugccugc

SEQ ID NO: 2775574 - RNA, 19 nt, Human
ggggccacuuuugacuagg

SEQ ID NO: 2775575 - RNA, 12 nt, Human
ggggccagagga

SEQ ID NO: 2775576 - RNA, 23 nt, Human
ggggccagaggaacuguccagag

SEQ ID NO: 2775577 - RNA, 14 nt, Human
ggggccuggaccug

SEQ ID NO: 2775578 - RNA, 12 nt, Human
ggggccugagag

SEQ ID NO: 2775579 - RNA, 15 nt, Human
ggggccugagagaau

SEQ ID NO: 2775580 - RNA, 13 nt, Human
aaaauuugagacu

SEQ ID NO: 2775581 - RNA, 19 nt, Human
aaaauuugagacuauuuaa

SEQ ID NO: 2775582 - RNA, 16 nt, Human
aaaauuugaacacugg

SEQ ID NO: 2775583 - RNA, 11 nt, Human
aaaauguguuc

SEQ ID NO: 2775584 - RNA, 13 nt, Human
aaaauguguugaa

SEQ ID NO: 2775585 - RNA, 15 nt, Human
aaaauguguugaaac

SEQ ID NO: 2775586 - RNA, 16 nt, Human
aaaauguguugaaacu

SEQ ID NO: 2775587 - RNA, 12 nt, Human
aaaaugugugug

SEQ ID NO: 2775588 - RNA, 16 nt, Human
aaaauguguguauucu

SEQ ID NO: 2775589 - RNA, 23 nt, Human
aaaauguguguauucuuaaaaug

SEQ ID NO: 2775590 - RNA, 20 nt, Human
aaaauuucacauuaauauuu

SEQ ID NO: 2775591 - RNA, 13 nt, Human
aaaauuucacauu

SEQ ID NO: 2775592 - RNA, 13 nt, Human
aaaauuucuaaga

SEQ ID NO: 2775593 - RNA, 12 nt, Human
aaaaugugaagu

SEQ ID NO: 2775594 - RNA, 15 nt, Human
aaaaugugaggaaga

SEQ ID NO: 2775595 - RNA, 23 nt, Human
aaaaugugaauugcaugacuugu

SEQ ID NO: 2775596 - RNA, 15 nt, Human
aaaaugugauguucu

SEQ ID NO: 2775597 - RNA, 17 nt, Human
aaaaugugauguucuaa

SEQ ID NO: 2775598 - RNA, 19 nt, Human
aaaaugugauguucuaagg

SEQ ID NO: 2775599 - RNA, 20 nt, Human
aaaaugugauguucuaaggc

SEQ ID NO: 2775600 - RNA, 21 nt, Human
aaaaugugauguucuaaggcu

SEQ ID NO: 2775601 - RNA, 23 nt, Human
aaaaugugcaguaauagcacugc

SEQ ID NO: 2775602 - RNA, 15 nt, Human
aaaaugucuucaagg

SEQ ID NO: 2775603 - RNA, 20 nt, Human
gggcuggcuuuucuguuucc

SEQ ID NO: 2775604 - RNA, 21 nt, Human
gggcugggaaacacuccuugc

SEQ ID NO: 2775605 - RNA, 16 nt, Human
gggcugggagcucugc

SEQ ID NO: 2775606 - RNA, 18 nt, Human
gggcugggagcucugcag

SEQ ID NO: 2775607 - RNA, 12 nt, Human
gggcugcccugc

SEQ ID NO: 2775608 - RNA, 13 nt, Human
gggcugcccugag

SEQ ID NO: 2775609 - RNA, 14 nt, Human
gggcugcccugaga

SEQ ID NO: 2775610 - RNA, 16 nt, Human
gggcugcccugagaag

SEQ ID NO: 2775611 - RNA, 13 nt, Human
gggcugcccuggu

SEQ ID NO: 2775612 - RNA, 14 nt, Human
gggcugcccuggug

SEQ ID NO: 2775613 - RNA, 13 nt, Human
gggcugcccugcc

SEQ ID NO: 2775614 - RNA, 18 nt, Human
gggcuggccccagggcac

SEQ ID NO: 2775615 - RNA, 22 nt, Human
gggcuggccccagggcacccug

SEQ ID NO: 2775616 - RNA, 19 nt, Human
gggcuggccucuggcucuc

SEQ ID NO: 2775617 - RNA, 15 nt, Human
gggcugcccuggugc

SEQ ID NO: 2775618 - RNA, 13 nt, Human
gggcuacaagagg

SEQ ID NO: 2775619 - RNA, 22 nt, Human
gggcucaagcaauccucucacc

SEQ ID NO: 2775620 - RNA, 13 nt, Human
gggcuauggacac

SEQ ID NO: 2775621 - RNA, 14 nt, Human
gggcuauggacaca

SEQ ID NO: 2775622 - RNA, 15 nt, Human
gggcuauggacacag

SEQ ID NO: 2775623 - RNA, 16 nt, Human
gggcuauggacacagg

SEQ ID NO: 2775624 - RNA, 17 nt, Human
gggcuauggacacaggg

SEQ ID NO: 2775625 - RNA, 17 nt, Human
gggcuaugguguggacu

SEQ ID NO: 2775626 - RNA, 15 nt, Human
gggcugcagagugcc

SEQ ID NO: 2775627 - RNA, 13 nt, Human
aaauaaugcugca

SEQ ID NO: 2775628 - RNA, 17 nt, Human
aaauaaugcuucagaua

SEQ ID NO: 2775629 - RNA, 21 nt, Human
aaauaaugcuucagauauuau

SEQ ID NO: 2775630 - RNA, 12 nt, Human
aaauaaugcaaa

SEQ ID NO: 2775631 - RNA, 20 nt, Human
aaauaagugguuauuucuca

SEQ ID NO: 2775632 - RNA, 16 nt, Human
aaaguuuugaaaagcu

SEQ ID NO: 2775633 - RNA, 18 nt, Human
aaaguuuugaaaagcuau

SEQ ID NO: 2775634 - RNA, 13 nt, Human
aaaguuuuaucaa

SEQ ID NO: 2775635 - RNA, 15 nt, Human
aaaguuuucccuuga

SEQ ID NO: 2775636 - RNA, 15 nt, Human
aaaguuuuccugaga

SEQ ID NO: 2775637 - RNA, 12 nt, Human
aaaguuuugaaa

SEQ ID NO: 2775638 - RNA, 13 nt, Human
aaaguuuugaaaa

SEQ ID NO: 2775639 - RNA, 14 nt, Human
aaaguuuugaaaag

SEQ ID NO: 2775640 - RNA, 19 nt, Human
aaaguuuugaaaagcuauu

SEQ ID NO: 2775641 - RNA, 19 nt, Human
aaaguuuugaguagauauu

SEQ ID NO: 2775642 - RNA, 21 nt, Human
aaaguuuugaguagauauuac

SEQ ID NO: 2775643 - RNA, 22 nt, Human
aaaguuuugaguagauauuacu

SEQ ID NO: 2775644 - RNA, 23 nt, Human
aaaguuuugaguagauauuacuu

SEQ ID NO: 2775645 - RNA, 24 nt, Human
aaaguuuugaguagauauuacuuu

SEQ ID NO: 2775646 - RNA, 15 nt, Human
aaauaagauucuaac

SEQ ID NO: 2775647 - RNA, 16 nt, Human
aaauaagauucuaacg

SEQ ID NO: 2775648 - RNA, 13 nt, Human
aaauaagauucua

SEQ ID NO: 2775649 - RNA, 14 nt, Human
aaauaagauucuaa

SEQ ID NO: 2775650 - RNA, 19 nt, Human
aaaguugacaccugagaaa

SEQ ID NO: 2775651 - RNA, 18 nt, Human
aaauaagggcagagucac

SEQ ID NO: 2775652 - RNA, 12 nt, Human
aaauaaguauuu

SEQ ID NO: 2775653 - RNA, 14 nt, Human
aaauaaguauuuau

SEQ ID NO: 2775654 - RNA, 22 nt, Human
aaauaaguauuuauaauagcaa

SEQ ID NO: 2775655 - RNA, 15 nt, Human
aaauaaguauuuaua

SEQ ID NO: 2775656 - RNA, 17 nt, Human
aaauaaguauuuauaau

SEQ ID NO: 2775657 - RNA, 17 nt, Human
guaacaaugaagauaaa

SEQ ID NO: 2775658 - RNA, 14 nt, Human
guaaauuaggaggc

SEQ ID NO: 2775659 - RNA, 14 nt, Human
guaaauuauauuug

SEQ ID NO: 2775660 - RNA, 15 nt, Human
guaaauuauauuugu

SEQ ID NO: 2775661 - RNA, 19 nt, Human
guaaauuauauuugugcua

SEQ ID NO: 2775662 - RNA, 20 nt, Human
guaaauuauauuugugcuau

SEQ ID NO: 2775663 - RNA, 23 nt, Human
guaaauuauauuugugcuauagu

SEQ ID NO: 2775664 - RNA, 14 nt, Human
guaaagaaauuuac

SEQ ID NO: 2775665 - RNA, 15 nt, Human
guaaagaaauuuacu

SEQ ID NO: 2775666 - RNA, 19 nt, Human
guaaagaaauuuacuauau

SEQ ID NO: 2775667 - RNA, 22 nt, Human
guaaagaacugcacaugaagaa

SEQ ID NO: 2775668 - RNA, 17 nt, Human
guaaagaacuuuuucuu

SEQ ID NO: 2775669 - RNA, 18 nt, Human
guaaagaucuacaugaau

SEQ ID NO: 2775670 - RNA, 22 nt, Human
guaaaaugugaagugaaugaaa

SEQ ID NO: 2775671 - RNA, 20 nt, Human
guaaaaugugaagugaauga

SEQ ID NO: 2775672 - RNA, 19 nt, Human
guaaaaugugaagugaaug

SEQ ID NO: 2775673 - RNA, 12 nt, Human
guaaaaugugaa

SEQ ID NO: 2775674 - RNA, 15 nt, Human
guaaaauggaggugg

SEQ ID NO: 2775675 - RNA, 17 nt, Human
guaaaauguauuuuucu

SEQ ID NO: 2775676 - RNA, 18 nt, Human
guaaaauguauuuuucua

SEQ ID NO: 2775677 - RNA, 18 nt, Human
aaauaauguaauuguaau

SEQ ID NO: 2775678 - RNA, 14 nt, Human
guaaaauaaaauua

SEQ ID NO: 2775679 - RNA, 19 nt, Human
aaaguuuacaaguguauau

SEQ ID NO: 2775680 - RNA, 12 nt, Human
aaaguuuacaac

SEQ ID NO: 2775681 - RNA, 16 nt, Human
aaaguuuacaacauaa

SEQ ID NO: 2775682 - RNA, 18 nt, Human
aaaguugcacggcugcug

SEQ ID NO: 2775683 - RNA, 23 nt, Human
aaaguucccuacuuccugugacu

SEQ ID NO: 2775684 - RNA, 22 nt, Human
aaaguuccaagagucuaaagau

SEQ ID NO: 2775685 - RNA, 18 nt, Human
aaaguuauuuuuaaaaac

SEQ ID NO: 2775686 - RNA, 18 nt, Human
aaaguucccugaaacacg

SEQ ID NO: 2775687 - RNA, 11 nt, Human
aaaguucuaag

SEQ ID NO: 2775688 - RNA, 12 nt, Human
aaaguucuaaga

SEQ ID NO: 2775689 - RNA, 23 nt, Human
aaaguuucucuuuucaaaacauu

SEQ ID NO: 2775690 - RNA, 21 nt, Human
aaaguuucucuuuucaaaaca

SEQ ID NO: 2775691 - RNA, 12 nt, Human
aaaguuucaaug

SEQ ID NO: 2775692 - RNA, 13 nt, Human
aaaguuucaaugu

SEQ ID NO: 2775693 - RNA, 13 nt, Human
aaaguuuccauau

SEQ ID NO: 2775694 - RNA, 14 nt, Human
aaaguuuccauaug

SEQ ID NO: 2775695 - RNA, 20 nt, Human
aaaguuuccuaaucagaaau

SEQ ID NO: 2775696 - RNA, 12 nt, Human
aaaguuucucag

SEQ ID NO: 2775697 - RNA, 13 nt, Human
aaaguuucucaga

SEQ ID NO: 2775698 - RNA, 17 nt, Human
aaaguuucucagauccu

SEQ ID NO: 2775699 - RNA, 16 nt, Human
aaaguuugcuuagaaa

SEQ ID NO: 2775700 - RNA, 22 nt, Human
aaaguuugcuuguuucuugguc

SEQ ID NO: 2775701 - RNA, 15 nt, Human
aaaguuugcuuagaa

SEQ ID NO: 2775702 - RNA, 15 nt, Human
aaaguuuuacaaagg

SEQ ID NO: 2775703 - RNA, 16 nt, Human
aaaguuuuacaaaggg

SEQ ID NO: 2775704 - RNA, 15 nt, Human
aaaguguaauaauau

SEQ ID NO: 2775705 - RNA, 11 nt, Human
aaaguguuacu

SEQ ID NO: 2775706 - RNA, 13 nt, Human
aaaguguuacuuu

SEQ ID NO: 2775707 - RNA, 14 nt, Human
aaaguguuacuuuu

SEQ ID NO: 2775708 - RNA, 18 nt, Human
aaaguucacaauguggcc

SEQ ID NO: 2775709 - RNA, 15 nt, Human
aaaguucagaguuuu

SEQ ID NO: 2775710 - RNA, 16 nt, Human
aaaguucagaguuuuc

SEQ ID NO: 2775711 - RNA, 20 nt, Human
aaaguucagaguuuucuggg

SEQ ID NO: 2775712 - RNA, 21 nt, Human
aaaguucccuacuuccuguga

SEQ ID NO: 2775713 - RNA, 16 nt, Human
aaaguuccaagagucu

SEQ ID NO: 2775714 - RNA, 18 nt, Human
aaaguuccaagagucuaa

SEQ ID NO: 2775715 - RNA, 20 nt, Human
aaaguuccaagagucuaaag

SEQ ID NO: 2775716 - RNA, 21 nt, Human
aaaguuccaagagucuaaaga

SEQ ID NO: 2775717 - RNA, 23 nt, Human
gguuuggccaucucuggaugccu

SEQ ID NO: 2775718 - RNA, 14 nt, Human
aaagugguuguuag

SEQ ID NO: 2775719 - RNA, 22 nt, Human
gguuugagauugccccaggucu

SEQ ID NO: 2775720 - RNA, 13 nt, Human
gguuugagggugg

SEQ ID NO: 2775721 - RNA, 15 nt, Human
gguuugaucauuucu

SEQ ID NO: 2775722 - RNA, 15 nt, Human
gguuugaagccugga

SEQ ID NO: 2775723 - RNA, 17 nt, Human
gguuugaagccuggaac

SEQ ID NO: 2775724 - RNA, 15 nt, Human
gguuucuggucucua

SEQ ID NO: 2775725 - RNA, 15 nt, Human
gguuucuuucagauu

SEQ ID NO: 2775726 - RNA, 22 nt, Human
gguuucuuucagauuuuuugaa

SEQ ID NO: 2775727 - RNA, 15 nt, Human
gguuucuuuuuaagu

SEQ ID NO: 2775728 - RNA, 21 nt, Human
gguuugaaagugaauaaacuu

SEQ ID NO: 2775729 - RNA, 12 nt, Human
gguucuggcugc

SEQ ID NO: 2775730 - RNA, 21 nt, Human
gguucugaugaugugccuggg

SEQ ID NO: 2775731 - RNA, 13 nt, Human
gguucugccugcu

SEQ ID NO: 2775732 - RNA, 16 nt, Human
gguucugccugcuuug

SEQ ID NO: 2775733 - RNA, 19 nt, Human
gguucugcuucaaggcuuc

SEQ ID NO: 2775734 - RNA, 18 nt, Human
gguucucccccuuucucu

SEQ ID NO: 2775735 - RNA, 11 nt, Human
gguuccucucu

SEQ ID NO: 2775736 - RNA, 13 nt, Human
gguuccucucugg

SEQ ID NO: 2775737 - RNA, 14 nt, Human
gguuccucucuggu

SEQ ID NO: 2775738 - RNA, 19 nt, Human
gguuccuuccucugagccu

SEQ ID NO: 2775739 - RNA, 20 nt, Human
gguuucacccuuaacccaag

SEQ ID NO: 2775740 - RNA, 22 nt, Human
gguuucacccuuaacccaagga

SEQ ID NO: 2775741 - RNA, 15 nt, Human
gguuucucucuacag

SEQ ID NO: 2775742 - RNA, 18 nt, Human
gguuucucucuacagugc

SEQ ID NO: 2775743 - RNA, 20 nt, Human
gguuucucucuacagugcca

SEQ ID NO: 2775744 - RNA, 19 nt, Human
gguuucaccauguuggcca

SEQ ID NO: 2775745 - RNA, 19 nt, Human
gguuucaccauguugccca

SEQ ID NO: 2775746 - RNA, 18 nt, Human
gguuucaaagaugcugug

SEQ ID NO: 2775747 - RNA, 20 nt, Human
gguuucaaagaugcugugag

SEQ ID NO: 2775748 - RNA, 18 nt, Human
gguuuauaauuuucugaa

SEQ ID NO: 2775749 - RNA, 16 nt, Human
gguuucaaagaugcug

SEQ ID NO: 2775750 - RNA, 13 nt, Human
ggugugcucugau

SEQ ID NO: 2775751 - RNA, 12 nt, Human
gguucagcuugu

SEQ ID NO: 2775752 - RNA, 21 nt, Human
gguucaggguuggccccugcc

SEQ ID NO: 2775753 - RNA, 18 nt, Human
gguucaggguuggccccu

SEQ ID NO: 2775754 - RNA, 22 nt, Human
gguucaggguuggccccugccc

SEQ ID NO: 2775755 - RNA, 12 nt, Human
gguucaguuucu

SEQ ID NO: 2775756 - RNA, 14 nt, Human
gguucaguuucuuc

SEQ ID NO: 2775757 - RNA, 16 nt, Human
gguucccggucccgag

SEQ ID NO: 2775758 - RNA, 16 nt, Human
gguuccuccccuccuc

SEQ ID NO: 2775759 - RNA, 13 nt, Human
gguucccuguucu

SEQ ID NO: 2775760 - RNA, 16 nt, Human
gguucccuguucuucc

SEQ ID NO: 2775761 - RNA, 18 nt, Human
gguucccuguucuuccuc

SEQ ID NO: 2775762 - RNA, 22 nt, Human
gguucccuuuccuuccaucccu

SEQ ID NO: 2775763 - RNA, 17 nt, Human
gguucccuuuccuucca

SEQ ID NO: 2775764 - RNA, 18 nt, Human
gguuccaauccuggcucu

SEQ ID NO: 2775765 - RNA, 17 nt, Human
gguucccguuucuccac

SEQ ID NO: 2775766 - RNA, 15 nt, Human
gguuccccuguucac

SEQ ID NO: 2775767 - RNA, 24 nt, Human
gguuccagcaauucuccugccuca

SEQ ID NO: 2775768 - RNA, 13 nt, Human
gguuccacagagu

SEQ ID NO: 2775769 - RNA, 19 nt, Human
gguuccacagaguaagaca

SEQ ID NO: 2775770 - RNA, 22 nt, Human
gguuccacagaguaagacauug

SEQ ID NO: 2775771 - RNA, 13 nt, Human
gguucaugaugca

SEQ ID NO: 2775772 - RNA, 14 nt, Human
gguucaugaugcag

SEQ ID NO: 2775773 - RNA, 15 nt, Human
gguucaugaugcagu

SEQ ID NO: 2775774 - RNA, 21 nt, Human
gguucauguagagaaaagcac

SEQ ID NO: 2775775 - RNA, 16 nt, Human
gguuccaauccuggcu

SEQ ID NO: 2775776 - RNA, 23 nt, Human
gguuccagcaauucuccugccuc

SEQ ID NO: 2775777 - RNA, 15 nt, Human
ggugugaccugaggg

SEQ ID NO: 2775778 - RNA, 20 nt, Human
ggugugaaagucagaugccc

SEQ ID NO: 2775779 - RNA, 18 nt, Human
ggugugagucaccaagcc

SEQ ID NO: 2775780 - RNA, 14 nt, Human
ggugugccugcagc

SEQ ID NO: 2775781 - RNA, 13 nt, Human
ggugugccugcag

SEQ ID NO: 2775782 - RNA, 15 nt, Human
ggugugccugcagcc

SEQ ID NO: 2775783 - RNA, 15 nt, Human
gguggggcgaggcag

SEQ ID NO: 2775784 - RNA, 16 nt, Human
gguggggcgaggcagg

SEQ ID NO: 2775785 - RNA, 17 nt, Human
gguggggcagcuugagg

SEQ ID NO: 2775786 - RNA, 13 nt, Human
gguggggcagcuu

SEQ ID NO: 2775787 - RNA, 17 nt, Human
ggugggcacccacccug

SEQ ID NO: 2775788 - RNA, 18 nt, Human
ggugggcacccacccugg

SEQ ID NO: 2775789 - RNA, 17 nt, Human
aaagccuuuaguaucag

SEQ ID NO: 2775790 - RNA, 19 nt, Human
aaagccuuagggaagcugg

SEQ ID NO: 2775791 - RNA, 11 nt, Human
aaagccuugug

SEQ ID NO: 2775792 - RNA, 12 nt, Human
aaagccuugugu

SEQ ID NO: 2775793 - RNA, 14 nt, Human
aaagccuuguguau

SEQ ID NO: 2775794 - RNA, 18 nt, Human
aaagccuuguguauauuu

SEQ ID NO: 2775795 - RNA, 19 nt, Human
aaagccuuguguauauuug

SEQ ID NO: 2775796 - RNA, 22 nt, Human
aaagccuuguguauauuuguau

SEQ ID NO: 2775797 - RNA, 23 nt, Human
aaagccuuguguauauuuguaua

SEQ ID NO: 2775798 - RNA, 14 nt, Human
aaagcaugaauggu

SEQ ID NO: 2775799 - RNA, 15 nt, Human
aaagccuuagggaag

SEQ ID NO: 2775800 - RNA, 12 nt, Human
aaagcauggacu

SEQ ID NO: 2775801 - RNA, 15 nt, Human
aaagcagcucucccc

SEQ ID NO: 2775802 - RNA, 13 nt, Human
aaagcaugaaugg

SEQ ID NO: 2775803 - RNA, 21 nt, Human
aaagcauauggguuagauguu

SEQ ID NO: 2775804 - RNA, 18 nt, Human
aaagcagcucuccccuca

SEQ ID NO: 2775805 - RNA, 17 nt, Human
aaagcagggaauuucua

SEQ ID NO: 2775806 - RNA, 18 nt, Human
aaagcagggaauuucuau

SEQ ID NO: 2775807 - RNA, 18 nt, Human
aaagcauaaguauacagu

SEQ ID NO: 2775808 - RNA, 17 nt, Human
aaagcauacaugcaaaa

SEQ ID NO: 2775809 - RNA, 17 nt, Human
aaagcauagauguuuug

SEQ ID NO: 2775810 - RNA, 20 nt, Human
aaagcauagauguuuuggua

SEQ ID NO: 2775811 - RNA, 18 nt, Human
aaagcauaaaaacauuuu

SEQ ID NO: 2775812 - RNA, 18 nt, Human
aaagcaucaccucaggcc

SEQ ID NO: 2775813 - RNA, 17 nt, Human
aaagcaucaccucaggc

SEQ ID NO: 2775814 - RNA, 16 nt, Human
aaagcaucaccucagg

SEQ ID NO: 2775815 - RNA, 17 nt, Human
gguggcacaggcccccu

SEQ ID NO: 2775816 - RNA, 13 nt, Human
gguggcaagagcc

SEQ ID NO: 2775817 - RNA, 17 nt, Human
gguggcaaggcugugcu

SEQ ID NO: 2775818 - RNA, 20 nt, Human
gguggcaaggcugugcuccc

SEQ ID NO: 2775819 - RNA, 12 nt, Human
gguggcaagugc

SEQ ID NO: 2775820 - RNA, 14 nt, Human
gguggaugccuggu

SEQ ID NO: 2775821 - RNA, 12 nt, Human
ggucuuccaggg

SEQ ID NO: 2775822 - RNA, 21 nt, Human
gguggaugccugguggcagcu

SEQ ID NO: 2775823 - RNA, 22 nt, Human
ggucuucccuaccucaggcagg

SEQ ID NO: 2775824 - RNA, 20 nt, Human
ggucuucccuaccucaggca

SEQ ID NO: 2775825 - RNA, 15 nt, Human
ggucuguuuaaagug

SEQ ID NO: 2775826 - RNA, 16 nt, Human
ggucugugcauuucug

SEQ ID NO: 2775827 - RNA, 18 nt, Human
ggucuucagccucuuucu

SEQ ID NO: 2775828 - RNA, 17 nt, Human
ggucuucccuaccucag

SEQ ID NO: 2775829 - RNA, 13 nt, Human
ggugcaauuucaa

SEQ ID NO: 2775830 - RNA, 16 nt, Human
ggugccacuuuaccca

SEQ ID NO: 2775831 - RNA, 19 nt, Human
ggugccacuuuacccaccu

SEQ ID NO: 2775832 - RNA, 18 nt, Human
ggugccacaaauaaaaug

SEQ ID NO: 2775833 - RNA, 15 nt, Human
ggugccaacuggugu

SEQ ID NO: 2775834 - RNA, 13 nt, Human
ggugccagccuga

SEQ ID NO: 2775835 - RNA, 17 nt, Human
ggugccagccugaggca

SEQ ID NO: 2775836 - RNA, 14 nt, Human
aaagacuaauuuaa

SEQ ID NO: 2775837 - RNA, 20 nt, Human
aaagacuaauuuaaaaaaua

SEQ ID NO: 2775838 - RNA, 23 nt, Human
aaagacuaauuuaaaaaauaacu

SEQ ID NO: 2775839 - RNA, 21 nt, Human
aaagauucuauaguucuagac

SEQ ID NO: 2775840 - RNA, 20 nt, Human
aaagauucuauaguucuaga

SEQ ID NO: 2775841 - RNA, 12 nt, Human
aaagauuuauca

SEQ ID NO: 2775842 - RNA, 13 nt, Human
aaagauuuaucaa

SEQ ID NO: 2775843 - RNA, 17 nt, Human
aaagauuuaagcacaaa

SEQ ID NO: 2775844 - RNA, 20 nt, Human
aaagauuuaagcacaaacuu

SEQ ID NO: 2775845 - RNA, 21 nt, Human
aaagauuuaagcacaaacuuu

SEQ ID NO: 2775846 - RNA, 15 nt, Human
aaagauuguauugcu

SEQ ID NO: 2775847 - RNA, 12 nt, Human
aaagauucuuuu

SEQ ID NO: 2775848 - RNA, 17 nt, Human
aaagauucuuuuucuga

SEQ ID NO: 2775849 - RNA, 17 nt, Human
aaagauugcugaaaaag

SEQ ID NO: 2775850 - RNA, 17 nt, Human
aaagcaaaauaaaaacu

SEQ ID NO: 2775851 - RNA, 18 nt, Human
aaagcaaaauaaaaacua

SEQ ID NO: 2775852 - RNA, 13 nt, Human
aaagauuuucaga

SEQ ID NO: 2775853 - RNA, 18 nt, Human
aaagcaaaaaugcuaaua

SEQ ID NO: 2775854 - RNA, 19 nt, Human
aaagcaaaaaugcuaauau

SEQ ID NO: 2775855 - RNA, 15 nt, Human
gguccucuggagccc

SEQ ID NO: 2775856 - RNA, 17 nt, Human
gguccugaaaguaacuc

SEQ ID NO: 2775857 - RNA, 18 nt, Human
gguccugaagaauuaaga

SEQ ID NO: 2775858 - RNA, 13 nt, Human
gguccucuggagc

SEQ ID NO: 2775859 - RNA, 14 nt, Human
gguccucagagaau

SEQ ID NO: 2775860 - RNA, 21 nt, Human
gguccucagagaauuucuacc

SEQ ID NO: 2775861 - RNA, 16 nt, Human
gguccucauucaaagg

SEQ ID NO: 2775862 - RNA, 23 nt, Human
gguccuccaucccaacagccaug

SEQ ID NO: 2775863 - RNA, 13 nt, Human
aaagcaaaugucu

SEQ ID NO: 2775864 - RNA, 21 nt, Human
aaagcaacuguuaugaaauaa

SEQ ID NO: 2775865 - RNA, 16 nt, Human
gguccuggcuccugag

SEQ ID NO: 2775866 - RNA, 15 nt, Human
gguccuggcuccuga

SEQ ID NO: 2775867 - RNA, 14 nt, Human
gguccuggcuccug

SEQ ID NO: 2775868 - RNA, 12 nt, Human
gguccuggggcu

SEQ ID NO: 2775869 - RNA, 22 nt, Human
gguccuggggcucugugcaggg

SEQ ID NO: 2775870 - RNA, 15 nt, Human
gguccuggggcucug

SEQ ID NO: 2775871 - RNA, 17 nt, Human
gguccuggagcagacca

SEQ ID NO: 2775872 - RNA, 21 nt, Human
gguccuggagcagaccacccc

SEQ ID NO: 2775873 - RNA, 22 nt, Human
gguccuggccagauggcccgga

SEQ ID NO: 2775874 - RNA, 12 nt, Human
gguccuggcucc

SEQ ID NO: 2775875 - RNA, 23 nt, Human
gguccuggggcucugugcaggga

SEQ ID NO: 2775876 - RNA, 15 nt, Human
ggucuaaaaauaaac

SEQ ID NO: 2775877 - RNA, 14 nt, Human
ggucuauggggaga

SEQ ID NO: 2775878 - RNA, 16 nt, Human
ggucuacacugcaauc

SEQ ID NO: 2775879 - RNA, 21 nt, Human
ggucuacacugcaaucauaug

SEQ ID NO: 2775880 - RNA, 15 nt, Human
ggucugugugaaugu

SEQ ID NO: 2775881 - RNA, 16 nt, Human
ggucugugugaaugug

SEQ ID NO: 2775882 - RNA, 17 nt, Human
ggucugugugaaugugg

SEQ ID NO: 2775883 - RNA, 24 nt, Human
ggucugugugaaugugggcacugg

SEQ ID NO: 2775884 - RNA, 15 nt, Human
ggucggaacccaagc

SEQ ID NO: 2775885 - RNA, 13 nt, Human
aaagacaccuacu

SEQ ID NO: 2775886 - RNA, 19 nt, Human
aaagacaccuacugagugg

SEQ ID NO: 2775887 - RNA, 17 nt, Human
aaagacaccauuuaucu

SEQ ID NO: 2775888 - RNA, 13 nt, Human
aaagaauauucag

SEQ ID NO: 2775889 - RNA, 22 nt, Human
aaagaauauucagagaauauca

SEQ ID NO: 2775890 - RNA, 17 nt, Human
aaagaauauauuuauuu

SEQ ID NO: 2775891 - RNA, 18 nt, Human
aaagaauauauuuauuua

SEQ ID NO: 2775892 - RNA, 22 nt, Human
aaagaaugagaaggagucagaa

SEQ ID NO: 2775893 - RNA, 12 nt, Human
aaagaaucuacu

SEQ ID NO: 2775894 - RNA, 19 nt, Human
aaagaaucuacuauacuuu

SEQ ID NO: 2775895 - RNA, 14 nt, Human
aaagacaacacaac

SEQ ID NO: 2775896 - RNA, 14 nt, Human
aaagacaagaaaau

SEQ ID NO: 2775897 - RNA, 16 nt, Human
aaagacaaaucaaagc

SEQ ID NO: 2775898 - RNA, 19 nt, Human
aaagacaaaucaaagcaga

SEQ ID NO: 2775899 - RNA, 18 nt, Human
gguccaguggaugccaca

SEQ ID NO: 2775900 - RNA, 23 nt, Human
gguccacacccaauuccacucug

SEQ ID NO: 2775901 - RNA, 16 nt, Human
gguccaucagccccuc

SEQ ID NO: 2775902 - RNA, 12 nt, Human
aaagaauagaaa

SEQ ID NO: 2775903 - RNA, 14 nt, Human
aaagaauagaaaga

SEQ ID NO: 2775904 - RNA, 14 nt, Human
aaagaauaagaaaa

SEQ ID NO: 2775905 - RNA, 18 nt, Human
aaagaaguggggacagag

SEQ ID NO: 2775906 - RNA, 16 nt, Human
gguccacccaggagcc

SEQ ID NO: 2775907 - RNA, 15 nt, Human
gguccacccaggagc

SEQ ID NO: 2775908 - RNA, 13 nt, Human
gguccacccagga

SEQ ID NO: 2775909 - RNA, 12 nt, Human
gguccacccagg

SEQ ID NO: 2775910 - RNA, 17 nt, Human
gguccacccaggagccc

SEQ ID NO: 2775911 - RNA, 20 nt, Human
gguccacaggaagugaagaa

SEQ ID NO: 2775912 - RNA, 18 nt, Human
gguccacaggucuagacu

SEQ ID NO: 2775913 - RNA, 17 nt, Human
gguccacaucccgggac

SEQ ID NO: 2775914 - RNA, 12 nt, Human
gguccagggagc

SEQ ID NO: 2775915 - RNA, 16 nt, Human
gguccagggagcaggc

SEQ ID NO: 2775916 - RNA, 21 nt, Human
gguccagggaagcuggccgag

SEQ ID NO: 2775917 - RNA, 11 nt, Human
gguccagggaa

SEQ ID NO: 2775918 - RNA, 22 nt, Human
gguaugaucacggcucacugca

SEQ ID NO: 2775919 - RNA, 16 nt, Human
gguccacaacacacag

SEQ ID NO: 2775920 - RNA, 20 nt, Human
gguccaauucucgagcuugg

SEQ ID NO: 2775921 - RNA, 15 nt, Human
gguauggaacucucu

SEQ ID NO: 2775922 - RNA, 14 nt, Human
gguagcuuuucccu

SEQ ID NO: 2775923 - RNA, 18 nt, Human
gguagcuuaccugacaca

SEQ ID NO: 2775924 - RNA, 12 nt, Human
gguagcugccac

SEQ ID NO: 2775925 - RNA, 18 nt, Human
gguaaguuuuuugaaauu

SEQ ID NO: 2775926 - RNA, 21 nt, Human
gguaacaguucauguuugcuu

SEQ ID NO: 2775927 - RNA, 13 nt, Human
gguaacaggcaga

SEQ ID NO: 2775928 - RNA, 20 nt, Human
gguaacaggcagauacagga

SEQ ID NO: 2775929 - RNA, 14 nt, Human
gguaacaggcagau

SEQ ID NO: 2775930 - RNA, 14 nt, Human
ggguuugaauuguu

SEQ ID NO: 2775931 - RNA, 20 nt, Human
ggguuucacuguguuagcca

SEQ ID NO: 2775932 - RNA, 17 nt, Human
ggguuugccauuugaua

SEQ ID NO: 2775933 - RNA, 14 nt, Human
ggguuuuauauuuu

SEQ ID NO: 2775934 - RNA, 20 nt, Human
gguaaucaaugaauauugaa

SEQ ID NO: 2775935 - RNA, 22 nt, Human
gguaaucaaugaauauugaagu

SEQ ID NO: 2775936 - RNA, 18 nt, Human
gguaauguguuuuagagu

SEQ ID NO: 2775937 - RNA, 18 nt, Human
gguaaucgaccugccucg

SEQ ID NO: 2775938 - RNA, 17 nt, Human
gguaaucgaccugccuc

SEQ ID NO: 2775939 - RNA, 14 nt, Human
gguaaucgaccugc

SEQ ID NO: 2775940 - RNA, 20 nt, Human
gguaauccaggcacagcuga

SEQ ID NO: 2775941 - RNA, 21 nt, Human
gguacaaccuuuauucuuuuc

SEQ ID NO: 2775942 - RNA, 24 nt, Human
gguacaaccuguucugcuuuccuc

SEQ ID NO: 2775943 - RNA, 23 nt, Human
gguacaaccuguucugcuuuccu

SEQ ID NO: 2775944 - RNA, 22 nt, Human
gguaauuguugcuaaucuucuu

SEQ ID NO: 2775945 - RNA, 20 nt, Human
gguaauuuuuacccuaaugu

SEQ ID NO: 2775946 - RNA, 13 nt, Human
gguacaaaaauaa

SEQ ID NO: 2775947 - RNA, 14 nt, Human
gguacaaaaauaaa

SEQ ID NO: 2775948 - RNA, 15 nt, Human
gguacaaaaauaaau

SEQ ID NO: 2775949 - RNA, 19 nt, Human
gguacaaaaauaaauuuau

SEQ ID NO: 2775950 - RNA, 19 nt, Human
gguacauuuauaauugcau

SEQ ID NO: 2775951 - RNA, 19 nt, Human
gguacacaacuaguuuugu

SEQ ID NO: 2775952 - RNA, 15 nt, Human
gguaccaaugcugca

SEQ ID NO: 2775953 - RNA, 19 nt, Human
gggugggagagcccagcca

SEQ ID NO: 2775954 - RNA, 14 nt, Human
gggugggagagccc

SEQ ID NO: 2775955 - RNA, 15 nt, Human
ggggccuggaccugc

SEQ ID NO: 2775956 - RNA, 16 nt, Human
ggggccuggaccugcc

SEQ ID NO: 2775957 - RNA, 13 nt, Human
ggggccuggcagg

SEQ ID NO: 2775958 - RNA, 13 nt, Human
ggguggaugccug

SEQ ID NO: 2775959 - RNA, 11 nt, Human
ggggccuggca

SEQ ID NO: 2775960 - RNA, 12 nt, Human
ggggccuggcag

SEQ ID NO: 2775961 - RNA, 17 nt, Human
ggguggaugccuggugg

SEQ ID NO: 2775962 - RNA, 12 nt, Human
ggguggugaccu

SEQ ID NO: 2775963 - RNA, 17 nt, Human
gggugggguagggcuga

SEQ ID NO: 2775964 - RNA, 16 nt, Human
gggugggguagggcug

SEQ ID NO: 2775965 - RNA, 20 nt, Human
gggugucuuuuuuuggugau

SEQ ID NO: 2775966 - RNA, 14 nt, Human
gggugggugcucag

SEQ ID NO: 2775967 - RNA, 15 nt, Human
gggugggugcucaga

SEQ ID NO: 2775968 - RNA, 16 nt, Human
gggugggugcucagaa

SEQ ID NO: 2775969 - RNA, 11 nt, Human
ggccuguugcc

SEQ ID NO: 2775970 - RNA, 22 nt, Human
ggccugugugugaaaggaagcu

SEQ ID NO: 2775971 - RNA, 12 nt, Human
ggccuucucuga

SEQ ID NO: 2775972 - RNA, 23 nt, Human
ggccuggccaggagcucuucagg

SEQ ID NO: 2775973 - RNA, 22 nt, Human
ggccuggccagggccuggaaga

SEQ ID NO: 2775974 - RNA, 17 nt, Human
ggccuggccagggccug

SEQ ID NO: 2775975 - RNA, 18 nt, Human
ggccuggccagggccugg

SEQ ID NO: 2775976 - RNA, 21 nt, Human
ggccuggccagaugcaccagc

SEQ ID NO: 2775977 - RNA, 14 nt, Human
ggccuggccaggag

SEQ ID NO: 2775978 - RNA, 18 nt, Human
ggccuggccaggagcucu

SEQ ID NO: 2775979 - RNA, 17 nt, Human
ggccuggccaggagcuc

SEQ ID NO: 2775980 - RNA, 16 nt, Human
ggccuggccaggagcu

SEQ ID NO: 2775981 - RNA, 15 nt, Human
ggccuggccaggagc

SEQ ID NO: 2775982 - RNA, 16 nt, Human
ggccuggaagacagag

SEQ ID NO: 2775983 - RNA, 23 nt, Human
ggccuggaauuagcuuggggcca

SEQ ID NO: 2775984 - RNA, 13 nt, Human
ggccuggaccugc

SEQ ID NO: 2775985 - RNA, 15 nt, Human
ggccuggaccugccu

SEQ ID NO: 2775986 - RNA, 16 nt, Human
ggccuggaccugccuc

SEQ ID NO: 2775987 - RNA, 21 nt, Human
ggccuggaccugccuccugcc

SEQ ID NO: 2775988 - RNA, 22 nt, Human
ggccuggaccugccuccugccu

SEQ ID NO: 2775989 - RNA, 17 nt, Human
ggccuuuuaacauuuug

SEQ ID NO: 2775990 - RNA, 21 nt, Human
ggccuuuuaacauuuuguucu

SEQ ID NO: 2775991 - RNA, 20 nt, Human
ggcgacagagcgagacuccg

SEQ ID NO: 2775992 - RNA, 23 nt, Human
ggcgacagagcgagagucugucu

SEQ ID NO: 2775993 - RNA, 17 nt, Human
ggcguacgcuggugcug

SEQ ID NO: 2775994 - RNA, 21 nt, Human
ggcggugggcacccacccugg

SEQ ID NO: 2775995 - RNA, 22 nt, Human
ggcggugggcacccacccuggg

SEQ ID NO: 2775996 - RNA, 16 nt, Human
ggcgaccgcccuccgc

SEQ ID NO: 2775997 - RNA, 15 nt, Human
ggcgagagaggagcc

SEQ ID NO: 2775998 - RNA, 20 nt, Human
ggcggucuucaacauccugc

SEQ ID NO: 2775999 - RNA, 17 nt, Human
ggcggugcccacaccgg

SEQ ID NO: 2776000 - RNA, 23 nt, Human
ggcggugcccacaccggggacag

SEQ ID NO: 2776001 - RNA, 14 nt, Human
ggcgguggacuuga

SEQ ID NO: 2776002 - RNA, 12 nt, Human
ggccuuuccucu

SEQ ID NO: 2776003 - RNA, 13 nt, Human
ggccuuuccucuc

SEQ ID NO: 2776004 - RNA, 14 nt, Human
ggccuuuccucucu

SEQ ID NO: 2776005 - RNA, 20 nt, Human
ggccuuggcuuuucuagccu

SEQ ID NO: 2776006 - RNA, 16 nt, Human
ggccuucucugaagga

SEQ ID NO: 2776007 - RNA, 15 nt, Human
ggccuucucugaagg

SEQ ID NO: 2776008 - RNA, 18 nt, Human
ggccuguguggccacuuc

SEQ ID NO: 2776009 - RNA, 11 nt, Human
ggccuugcuga

SEQ ID NO: 2776010 - RNA, 23 nt, Human
ggccuugacaucaguuccuuugu

SEQ ID NO: 2776011 - RNA, 15 nt, Human
ggccuguugcccuuu

SEQ ID NO: 2776012 - RNA, 15 nt, Human
ggccuccagaacuca

SEQ ID NO: 2776013 - RNA, 20 nt, Human
ggccuccagaacucacuggg

SEQ ID NO: 2776014 - RNA, 10 nt, Human
ggccuccagg

SEQ ID NO: 2776015 - RNA, 13 nt, Human
ggccuccaggccc

SEQ ID NO: 2776016 - RNA, 14 nt, Human
ggccuccaggcccg

SEQ ID NO: 2776017 - RNA, 17 nt, Human
ggccuccaggcccgucu

SEQ ID NO: 2776018 - RNA, 19 nt, Human
ggccuccaggcccgucugu

SEQ ID NO: 2776019 - RNA, 22 nt, Human
ggccuccaggcccgucugucca

SEQ ID NO: 2776020 - RNA, 23 nt, Human
ggccuccaggcccgucuguccau

SEQ ID NO: 2776021 - RNA, 13 nt, Human
ggccggccagccu

SEQ ID NO: 2776022 - RNA, 12 nt, Human
ggccggccagcc

SEQ ID NO: 2776023 - RNA, 13 nt, Human
ggccggccagcca

SEQ ID NO: 2776024 - RNA, 14 nt, Human
ggccggccagccag

SEQ ID NO: 2776025 - RNA, 15 nt, Human
ggccggccagccagc

SEQ ID NO: 2776026 - RNA, 16 nt, Human
ggccggccagccagcc

SEQ ID NO: 2776027 - RNA, 19 nt, Human
ggccggccagccagccacu

SEQ ID NO: 2776028 - RNA, 20 nt, Human
ggcucagcucggggagccuu

SEQ ID NO: 2776029 - RNA, 23 nt, Human
ggcucagcggggacagcuccuuc

SEQ ID NO: 2776030 - RNA, 22 nt, Human
ggcucagcggggacagcuccuu

SEQ ID NO: 2776031 - RNA, 21 nt, Human
ggcucagcggggacagcuccu

SEQ ID NO: 2776032 - RNA, 17 nt, Human
ggcucacugcagccuca

SEQ ID NO: 2776033 - RNA, 19 nt, Human
ggcucacugcauccuccgc

SEQ ID NO: 2776034 - RNA, 16 nt, Human
ggcucacugcauccuc

SEQ ID NO: 2776035 - RNA, 16 nt, Human
ggcucacugcagccuc

SEQ ID NO: 2776036 - RNA, 16 nt, Human
ggcgugguggcgggca

SEQ ID NO: 2776037 - RNA, 22 nt, Human
ggcguguaucugguauauguaa

SEQ ID NO: 2776038 - RNA, 23 nt, Human
ggcguucuuaggcugcugggaug

SEQ ID NO: 2776039 - RNA, 14 nt, Human
ggcgugcaguggug

SEQ ID NO: 2776040 - RNA, 17 nt, Human
ggcguccaggccgcgcc

SEQ ID NO: 2776041 - RNA, 15 nt, Human
ggcgucagucuuuuu

SEQ ID NO: 2776042 - RNA, 14 nt, Human
ggcgucugugugcg

SEQ ID NO: 2776043 - RNA, 19 nt, Human
ggcgugcaguggugcgauc

SEQ ID NO: 2776044 - RNA, 16 nt, Human
ggcguggauuaaacuu

SEQ ID NO: 2776045 - RNA, 16 nt, Human
ggcguggcaaauauaa

SEQ ID NO: 2776046 - RNA, 15 nt, Human
ggcguggagcugccu

SEQ ID NO: 2776047 - RNA, 12 nt, Human
ggcguggagcug

SEQ ID NO: 2776048 - RNA, 20 nt, Human
ggcguggagagcccggcgcc

SEQ ID NO: 2776049 - RNA, 15 nt, Human
ggcguggagcaggcg

SEQ ID NO: 2776050 - RNA, 19 nt, Human
ggcccauagaaacaugaca

SEQ ID NO: 2776051 - RNA, 22 nt, Human
ggcccauagaaacaugacacug

SEQ ID NO: 2776052 - RNA, 23 nt, Human
ggcccauagaaacaugacacuga

SEQ ID NO: 2776053 - RNA, 18 nt, Human
ggcccaggggaggcggca

SEQ ID NO: 2776054 - RNA, 13 nt, Human
ggccccacugaug

SEQ ID NO: 2776055 - RNA, 13 nt, Human
ggcccuuccucuc

SEQ ID NO: 2776056 - RNA, 15 nt, Human
ggcccuuccucucca

SEQ ID NO: 2776057 - RNA, 23 nt, Human
ggccccugggucagucugguggg

SEQ ID NO: 2776058 - RNA, 23 nt, Human
ggccccuucucucccugccagag

SEQ ID NO: 2776059 - RNA, 13 nt, Human
ggccccugugagu

SEQ ID NO: 2776060 - RNA, 17 nt, Human
ggccccuuugggcccug

SEQ ID NO: 2776061 - RNA, 18 nt, Human
ggccccuuugggcccugc

SEQ ID NO: 2776062 - RNA, 19 nt, Human
ggccccuuugggcccugca

SEQ ID NO: 2776063 - RNA, 20 nt, Human
ggccccuuugggcccugcau

SEQ ID NO: 2776064 - RNA, 21 nt, Human
ggccccuuugggcccugcaug

SEQ ID NO: 2776065 - RNA, 16 nt, Human
ggcccuuccuccucca

SEQ ID NO: 2776066 - RNA, 19 nt, Human
ggcccuuccuccuccacca

SEQ ID NO: 2776067 - RNA, 21 nt, Human
ggcccuuccuccuccaccacc

SEQ ID NO: 2776068 - RNA, 17 nt, Human
ggcccuuccucuccacu

SEQ ID NO: 2776069 - RNA, 13 nt, Human
ggccgaggacuuu

SEQ ID NO: 2776070 - RNA, 18 nt, Human
ggccgaggguccuggcuc

SEQ ID NO: 2776071 - RNA, 16 nt, Human
ggccgaggguccuggc

SEQ ID NO: 2776072 - RNA, 19 nt, Human
ggccgcuccaccagcauca

SEQ ID NO: 2776073 - RNA, 16 nt, Human
ggccgcuccaccagca

SEQ ID NO: 2776074 - RNA, 12 nt, Human
ggccgcccccug

SEQ ID NO: 2776075 - RNA, 14 nt, Human
ggccgcuccaccag

SEQ ID NO: 2776076 - RNA, 14 nt, Human
ggccgauggagaca

SEQ ID NO: 2776077 - RNA, 20 nt, Human
ggccgauuugggaaccaagc

SEQ ID NO: 2776078 - RNA, 22 nt, Human
ggccgauuugggaaccaagcua

SEQ ID NO: 2776079 - RNA, 19 nt, Human
ggcagugggagcugccugu

SEQ ID NO: 2776080 - RNA, 18 nt, Human
ggcagugggagcugccug

SEQ ID NO: 2776081 - RNA, 16 nt, Human
ggcaucacagggcaga

SEQ ID NO: 2776082 - RNA, 14 nt, Human
ggcaucacagggca

SEQ ID NO: 2776083 - RNA, 13 nt, Human
ggcaucacagggc

SEQ ID NO: 2776084 - RNA, 22 nt, Human
ggcauauccaccaccucccuca

SEQ ID NO: 2776085 - RNA, 13 nt, Human
ggcauagcuacgu

SEQ ID NO: 2776086 - RNA, 18 nt, Human
ggcauccagcagucucug

SEQ ID NO: 2776087 - RNA, 21 nt, Human
ggcaucaagaggugggagggc

SEQ ID NO: 2776088 - RNA, 18 nt, Human
ggcaucugccccuccccc

SEQ ID NO: 2776089 - RNA, 16 nt, Human
ggcaucugccccuccc

SEQ ID NO: 2776090 - RNA, 19 nt, Human
ggcaucugccccuccccca

SEQ ID NO: 2776091 - RNA, 14 nt, Human
ggcaucugccccuc

SEQ ID NO: 2776092 - RNA, 19 nt, Human
ggcaucugauuugcauauu

SEQ ID NO: 2776093 - RNA, 19 nt, Human
ggcaucuuugccuugggcu

SEQ ID NO: 2776094 - RNA, 17 nt, Human
ggcaucuuugccuuggg

SEQ ID NO: 2776095 - RNA, 16 nt, Human
ggcaucuuugccuugg

SEQ ID NO: 2776096 - RNA, 15 nt, Human
ggcauuuuuauuuua

SEQ ID NO: 2776097 - RNA, 17 nt, Human
ggccaaaagcaguaaau

SEQ ID NO: 2776098 - RNA, 17 nt, Human
ggccaaaagcuagacag

SEQ ID NO: 2776099 - RNA, 17 nt, Human
ggcagugggagcugccu

SEQ ID NO: 2776100 - RNA, 13 nt, Human
ggcacuggcccag

SEQ ID NO: 2776101 - RNA, 14 nt, Human
ggcacuggcccagg

SEQ ID NO: 2776102 - RNA, 21 nt, Human
ggcacugggaugagccgcugu

SEQ ID NO: 2776103 - RNA, 19 nt, Human
ggcacugggaugagccgcu

SEQ ID NO: 2776104 - RNA, 20 nt, Human
ggcacugggaugagccgcug

SEQ ID NO: 2776105 - RNA, 14 nt, Human
ggccaggcuggucu

SEQ ID NO: 2776106 - RNA, 21 nt, Human
ggccagccccacccaggaggg

SEQ ID NO: 2776107 - RNA, 11 nt, Human
ggccagccccg

SEQ ID NO: 2776108 - RNA, 20 nt, Human
ggccagccccacccaggagg

SEQ ID NO: 2776109 - RNA, 16 nt, Human
ggccagccccacccag

SEQ ID NO: 2776110 - RNA, 15 nt, Human
ggccagccccaccca

SEQ ID NO: 2776111 - RNA, 14 nt, Human
ggccagccccaccc

SEQ ID NO: 2776112 - RNA, 13 nt, Human
ggccagccccacc

SEQ ID NO: 2776113 - RNA, 12 nt, Human
ggccaggcuggu

SEQ ID NO: 2776114 - RNA, 19 nt, Human
ggccaggcuggucuaaaac

SEQ ID NO: 2776115 - RNA, 18 nt, Human
ggccaggcuggucucaaa

SEQ ID NO: 2776116 - RNA, 16 nt, Human
ggccaggcuggucuca

SEQ ID NO: 2776117 - RNA, 14 nt, Human
ggccaaaaggaaaa

SEQ ID NO: 2776118 - RNA, 15 nt, Human
ggccaaaaggaaaaa

SEQ ID NO: 2776119 - RNA, 19 nt, Human
ggccaaaaggaaaaagcuc

SEQ ID NO: 2776120 - RNA, 13 nt, Human
ggccagccagcca

SEQ ID NO: 2776121 - RNA, 15 nt, Human
ggccagccagccacu

SEQ ID NO: 2776122 - RNA, 16 nt, Human
ggccagccagccacuc

SEQ ID NO: 2776123 - RNA, 17 nt, Human
ggccagccagccacucu

SEQ ID NO: 2776124 - RNA, 21 nt, Human
ggccagccagccacucuacca

SEQ ID NO: 2776125 - RNA, 22 nt, Human
ggccagaggaacuguccagaga

SEQ ID NO: 2776126 - RNA, 21 nt, Human
ggccagagcugggaggcaugg

SEQ ID NO: 2776127 - RNA, 21 nt, Human
ggccagaggaacuguccagag

SEQ ID NO: 2776128 - RNA, 14 nt, Human
ggccagagcuggga

SEQ ID NO: 2776129 - RNA, 16 nt, Human
ggccagagcugggagg

SEQ ID NO: 2776130 - RNA, 17 nt, Human
ggccagagcugggaggc

SEQ ID NO: 2776131 - RNA, 16 nt, Human
ggccagugugacaagg

SEQ ID NO: 2776132 - RNA, 14 nt, Human
ggccaguggggccu

SEQ ID NO: 2776133 - RNA, 15 nt, Human
ggccaguggggccug

SEQ ID NO: 2776134 - RNA, 16 nt, Human
ggccaguggggccugu

SEQ ID NO: 2776135 - RNA, 17 nt, Human
ggccaguggggccugug

SEQ ID NO: 2776136 - RNA, 18 nt, Human
ggccaguggggccugugg

SEQ ID NO: 2776137 - RNA, 19 nt, Human
ggccaguggggccugugga

SEQ ID NO: 2776138 - RNA, 14 nt, Human
ggccaucccuguga

SEQ ID NO: 2776139 - RNA, 16 nt, Human
ggcauuuuauagacac

SEQ ID NO: 2776140 - RNA, 18 nt, Human
ggccagggcccugcagag

SEQ ID NO: 2776141 - RNA, 12 nt, Human
ggccagggccug

SEQ ID NO: 2776142 - RNA, 17 nt, Human
ggccagggccuggaaga

SEQ ID NO: 2776143 - RNA, 17 nt, Human
ggccagggcccugcaga

SEQ ID NO: 2776144 - RNA, 16 nt, Human
ggccagggcccugcag

SEQ ID NO: 2776145 - RNA, 13 nt, Human
ggccagggcccug

SEQ ID NO: 2776146 - RNA, 19 nt, Human
ggccagggccuggaagaca

SEQ ID NO: 2776147 - RNA, 23 nt, Human
ggccagggccuggaagacagaga

SEQ ID NO: 2776148 - RNA, 14 nt, Human
ggccagggcugccc

SEQ ID NO: 2776149 - RNA, 19 nt, Human
ggccaugcaauucauccca

SEQ ID NO: 2776150 - RNA, 19 nt, Human
ggccaucucuggaugccug

SEQ ID NO: 2776151 - RNA, 13 nt, Human
ggaugggccuggc

SEQ ID NO: 2776152 - RNA, 21 nt, Human
ggauguacaaggacagccccu

SEQ ID NO: 2776153 - RNA, 15 nt, Human
ggauggcccuuccuc

SEQ ID NO: 2776154 - RNA, 20 nt, Human
ggauggcccuuccuccucca

SEQ ID NO: 2776155 - RNA, 23 nt, Human
ggauggcccuuccuccuccacca

SEQ ID NO: 2776156 - RNA, 20 nt, Human
ggauggccgcagggcugugc

SEQ ID NO: 2776157 - RNA, 21 nt, Human
ggauggccuggccagggccug

SEQ ID NO: 2776158 - RNA, 16 nt, Human
ggauggccuggccagg

SEQ ID NO: 2776159 - RNA, 19 nt, Human
ggaucugucacaccagcca

SEQ ID NO: 2776160 - RNA, 15 nt, Human
ggauaagccagcugc

SEQ ID NO: 2776161 - RNA, 20 nt, Human
ggauaagccacucugucccu

SEQ ID NO: 2776162 - RNA, 14 nt, Human
ggauaaccuauaug

SEQ ID NO: 2776163 - RNA, 13 nt, Human
ggauaacaaagau

SEQ ID NO: 2776164 - RNA, 14 nt, Human
ggauaacaaagaua

SEQ ID NO: 2776165 - RNA, 16 nt, Human
ggauaacaaagauauc

SEQ ID NO: 2776166 - RNA, 18 nt, Human
ggauaacaaagauaucuu

SEQ ID NO: 2776167 - RNA, 20 nt, Human
ggauaacaaagauaucuuuu

SEQ ID NO: 2776168 - RNA, 20 nt, Human
ggaguuuuuguuuggagagc

SEQ ID NO: 2776169 - RNA, 17 nt, Human
ggauaaaauaaugcugc

SEQ ID NO: 2776170 - RNA, 19 nt, Human
ggauaaaauaaugcugcaa

SEQ ID NO: 2776171 - RNA, 18 nt, Human
ggauaaaaugacuacuua

SEQ ID NO: 2776172 - RNA, 13 nt, Human
ggauaaagcagcu

SEQ ID NO: 2776173 - RNA, 21 nt, Human
ggaguuuugcucuuguagccc

SEQ ID NO: 2776174 - RNA, 20 nt, Human
ggaguuugaggcugcagcga

SEQ ID NO: 2776175 - RNA, 19 nt, Human
ggaguuugaggcugcagcg

SEQ ID NO: 2776176 - RNA, 22 nt, Human
ggaguugucaagucucugcugg

SEQ ID NO: 2776177 - RNA, 21 nt, Human
ggaguuggaagugugugaucu

SEQ ID NO: 2776178 - RNA, 13 nt, Human
ggaguuugaggcu

SEQ ID NO: 2776179 - RNA, 14 nt, Human
ggaguuucuaaggu

SEQ ID NO: 2776180 - RNA, 12 nt, Human
ggaguuucuaag

SEQ ID NO: 2776181 - RNA, 18 nt, Human
ggaguucgagaccagccu

SEQ ID NO: 2776182 - RNA, 14 nt, Human
ggagugcaguggug

SEQ ID NO: 2776183 - RNA, 19 nt, Human
ggagugcccacccugggag

SEQ ID NO: 2776184 - RNA, 16 nt, Human
ggagugcuggcucaca

SEQ ID NO: 2776185 - RNA, 18 nt, Human
ggagugcuggcucacagu

SEQ ID NO: 2776186 - RNA, 22 nt, Human
ggagugcuggcucacaguacag

SEQ ID NO: 2776187 - RNA, 12 nt, Human
ggagugcagugg

SEQ ID NO: 2776188 - RNA, 21 nt, Human
ggaguucgaggcugcagucag

SEQ ID NO: 2776189 - RNA, 20 nt, Human
ggaguucgaggcugcaguca

SEQ ID NO: 2776190 - RNA, 15 nt, Human
ggaguucgaggcugc

SEQ ID NO: 2776191 - RNA, 20 nt, Human
ggaguucgagaccagccugg

SEQ ID NO: 2776192 - RNA, 22 nt, Human
ggaguucuaacaaaacaaguug

SEQ ID NO: 2776193 - RNA, 16 nt, Human
ggaguucuaugcucuc

SEQ ID NO: 2776194 - RNA, 15 nt, Human
ggagugcagugagcc

SEQ ID NO: 2776195 - RNA, 15 nt, Human
ggauguucugggaca

SEQ ID NO: 2776196 - RNA, 14 nt, Human
ggaugucugccaau

SEQ ID NO: 2776197 - RNA, 14 nt, Human
ggaugucccugggc

SEQ ID NO: 2776198 - RNA, 18 nt, Human
ggaugucccugggccagg

SEQ ID NO: 2776199 - RNA, 19 nt, Human
ggaugucccugggccaggg

SEQ ID NO: 2776200 - RNA, 22 nt, Human
ggaugucccugggccagggucu

SEQ ID NO: 2776201 - RNA, 23 nt, Human
ggaugucccugggccagggucug

SEQ ID NO: 2776202 - RNA, 16 nt, Human
ggauguauggggaauc

SEQ ID NO: 2776203 - RNA, 15 nt, Human
ggaugucacagggcc

SEQ ID NO: 2776204 - RNA, 16 nt, Human
ggaugucacagggcca

SEQ ID NO: 2776205 - RNA, 20 nt, Human
ggauguaugaauacagcagc

SEQ ID NO: 2776206 - RNA, 21 nt, Human
ggauguaugaauacagcagca

SEQ ID NO: 2776207 - RNA, 13 nt, Human
ggauguucuggga

SEQ ID NO: 2776208 - RNA, 20 nt, Human
ggaugucugccaauuuuugc

SEQ ID NO: 2776209 - RNA, 19 nt, Human
ggauguagcuuuucaccuu

SEQ ID NO: 2776210 - RNA, 16 nt, Human
ggauguucugggacac

SEQ ID NO: 2776211 - RNA, 14 nt, Human
ggcaauuuuguaac

SEQ ID NO: 2776212 - RNA, 18 nt, Human
ggcacaaguccuggaugu

SEQ ID NO: 2776213 - RNA, 23 nt, Human
ggcacaaguccuggauguugugu

SEQ ID NO: 2776214 - RNA, 17 nt, Human
ggcacaaagggcccaga

SEQ ID NO: 2776215 - RNA, 15 nt, Human
ggcacaacugcaaua

SEQ ID NO: 2776216 - RNA, 22 nt, Human
ggcacaacugcaauaacuucug

SEQ ID NO: 2776217 - RNA, 15 nt, Human
ggcacaagaaucacu

SEQ ID NO: 2776218 - RNA, 22 nt, Human
ggcacaaucucggcucacugca

SEQ ID NO: 2776219 - RNA, 19 nt, Human
ggcaauuccaauauuucug

SEQ ID NO: 2776220 - RNA, 19 nt, Human
ggcaauucuccugccuuug

SEQ ID NO: 2776221 - RNA, 12 nt, Human
ggcaauuggaac

SEQ ID NO: 2776222 - RNA, 13 nt, Human
ggcaauuggaaca

SEQ ID NO: 2776223 - RNA, 13 nt, Human
ggcaauugucuau

SEQ ID NO: 2776224 - RNA, 18 nt, Human
ggcacagcggggccccag

SEQ ID NO: 2776225 - RNA, 13 nt, Human
ggcacaggacuga

SEQ ID NO: 2776226 - RNA, 22 nt, Human
ggcacaggacugauucugggau

SEQ ID NO: 2776227 - RNA, 20 nt, Human
ggcacagcggagucuguccu

SEQ ID NO: 2776228 - RNA, 22 nt, Human
ggcacagcggagucuguccugu

SEQ ID NO: 2776229 - RNA, 11 nt, Human
ggcacagauug

SEQ ID NO: 2776230 - RNA, 17 nt, Human
ggcacagcaucuguagu

SEQ ID NO: 2776231 - RNA, 22 nt, Human
ggcacagcaucuguagucagcc

SEQ ID NO: 2776232 - RNA, 15 nt, Human
ggcacaggcccccuu

SEQ ID NO: 2776233 - RNA, 14 nt, Human
ggcacagggagaag

SEQ ID NO: 2776234 - RNA, 14 nt, Human
ggcacaggcccccu

SEQ ID NO: 2776235 - RNA, 16 nt, Human
ggcacagggcaguggg

SEQ ID NO: 2776236 - RNA, 14 nt, Human
ggagcaugggccug

SEQ ID NO: 2776237 - RNA, 16 nt, Human
ggagcaugggccuggc

SEQ ID NO: 2776238 - RNA, 19 nt, Human
ggagcauguuuuguauaca

SEQ ID NO: 2776239 - RNA, 20 nt, Human
ggagcauguuuuguauacaa

SEQ ID NO: 2776240 - RNA, 21 nt, Human
ggagcaucucuugaggccagg

SEQ ID NO: 2776241 - RNA, 20 nt, Human
ggagcaucucuugaggccag

SEQ ID NO: 2776242 - RNA, 16 nt, Human
ggagcaucucuugagg

SEQ ID NO: 2776243 - RNA, 13 nt, Human
ggagcaucccgga

SEQ ID NO: 2776244 - RNA, 14 nt, Human
ggagcaucccggag

SEQ ID NO: 2776245 - RNA, 21 nt, Human
ggagcaucccggaggaaaucu

SEQ ID NO: 2776246 - RNA, 16 nt, Human
ggagcaucagugcccu

SEQ ID NO: 2776247 - RNA, 23 nt, Human
ggaggcgcccuuggcuucuguga

SEQ ID NO: 2776248 - RNA, 13 nt, Human
ggaggcgcccuug

SEQ ID NO: 2776249 - RNA, 17 nt, Human
ggaggccuuccagggac

SEQ ID NO: 2776250 - RNA, 17 nt, Human
ggaggccuuccagcugc

SEQ ID NO: 2776251 - RNA, 18 nt, Human
ggaggccuuccagcugcu

SEQ ID NO: 2776252 - RNA, 19 nt, Human
ggaggccuuccagcugcug

SEQ ID NO: 2776253 - RNA, 20 nt, Human
ggaggccuuccagcugcugu

SEQ ID NO: 2776254 - RNA, 21 nt, Human
ggaggccuuccagcugcuguc

SEQ ID NO: 2776255 - RNA, 16 nt, Human
ggaggcccuccugugc

SEQ ID NO: 2776256 - RNA, 23 nt, Human
ggaggcccuccugugcuggggga

SEQ ID NO: 2776257 - RNA, 16 nt, Human
ggaggguacagcuggg

SEQ ID NO: 2776258 - RNA, 18 nt, Human
ggaggguacagcugggcu

SEQ ID NO: 2776259 - RNA, 15 nt, Human
ggagggguguggcuc

SEQ ID NO: 2776260 - RNA, 15 nt, Human
ggaggucaggcccug

SEQ ID NO: 2776261 - RNA, 16 nt, Human
ggaggucaggcccugg

SEQ ID NO: 2776262 - RNA, 14 nt, Human
ggaggugaccccag

SEQ ID NO: 2776263 - RNA, 22 nt, Human
ggaggucgaccccaaagccccu

SEQ ID NO: 2776264 - RNA, 20 nt, Human
ggagguggagguugcauuga

SEQ ID NO: 2776265 - RNA, 13 nt, Human
ggaggugccugga

SEQ ID NO: 2776266 - RNA, 20 nt, Human
ggagguggaggcugcaguga

SEQ ID NO: 2776267 - RNA, 18 nt, Human
ggaggugauagcauugcu

SEQ ID NO: 2776268 - RNA, 16 nt, Human
ggagccaauggagacu

SEQ ID NO: 2776269 - RNA, 13 nt, Human
ggagccagacaga

SEQ ID NO: 2776270 - RNA, 21 nt, Human
ggagccagcucccucuauuua

SEQ ID NO: 2776271 - RNA, 16 nt, Human
ggagcccagcccuccc

SEQ ID NO: 2776272 - RNA, 19 nt, Human
ggagcccagcccuccccau

SEQ ID NO: 2776273 - RNA, 19 nt, Human
ggagcccaggcgggagcgg

SEQ ID NO: 2776274 - RNA, 22 nt, Human
ggagcccaggcgggagcggugg

SEQ ID NO: 2776275 - RNA, 22 nt, Human
ggagccccgaggccuucucuga

SEQ ID NO: 2776276 - RNA, 16 nt, Human
ggagccccgaggccuu

SEQ ID NO: 2776277 - RNA, 19 nt, Human
ggagcccauacucagccug

SEQ ID NO: 2776278 - RNA, 20 nt, Human
ggagcccauacucagccugc

SEQ ID NO: 2776279 - RNA, 21 nt, Human
ggagcccauacucagccugcu

SEQ ID NO: 2776280 - RNA, 12 nt, Human
ggagcugccugu

SEQ ID NO: 2776281 - RNA, 15 nt, Human
ggagcugccccucuc

SEQ ID NO: 2776282 - RNA, 22 nt, Human
ggagcugccccucucugggccu

SEQ ID NO: 2776283 - RNA, 21 nt, Human
ggagcugccuguucagcucca

SEQ ID NO: 2776284 - RNA, 20 nt, Human
ggagcuggccccgccgccug

SEQ ID NO: 2776285 - RNA, 18 nt, Human
ggagcuggccccgccgcc

SEQ ID NO: 2776286 - RNA, 22 nt, Human
ggaggacaggcgggaggaggug

SEQ ID NO: 2776287 - RNA, 17 nt, Human
ggaggaccacaggugug

SEQ ID NO: 2776288 - RNA, 20 nt, Human
ggaggaccacaggugugagc

SEQ ID NO: 2776289 - RNA, 14 nt, Human
ggaggacaaaacuu

SEQ ID NO: 2776290 - RNA, 14 nt, Human
ggaggccccacuga

SEQ ID NO: 2776291 - RNA, 16 nt, Human
ggaggccccacugaug

SEQ ID NO: 2776292 - RNA, 18 nt, Human
ggaggccccacugaugcu

SEQ ID NO: 2776293 - RNA, 13 nt, Human
ggaggaaggauug

SEQ ID NO: 2776294 - RNA, 21 nt, Human
ggaggaaggcuuacacccaca

SEQ ID NO: 2776295 - RNA, 11 nt, Human
ggaggaaggau

SEQ ID NO: 2776296 - RNA, 23 nt, Human
ggagcugguuagaaaugcagaau

SEQ ID NO: 2776297 - RNA, 18 nt, Human
ggagcugguuagaaaugc

SEQ ID NO: 2776298 - RNA, 18 nt, Human
ggagcugucaccaaggaa

SEQ ID NO: 2776299 - RNA, 19 nt, Human
ggagcugucaccaaggaaa

SEQ ID NO: 2776300 - RNA, 20 nt, Human
ggagcuguucucugucguga

SEQ ID NO: 2776301 - RNA, 20 nt, Human
ggagcuggggagaggaaaga

SEQ ID NO: 2776302 - RNA, 21 nt, Human
ggagcuggccgugggccuggg

SEQ ID NO: 2776303 - RNA, 14 nt, Human
gccagccagccacu

SEQ ID NO: 2776304 - RNA, 15 nt, Human
gccagccagccacuc

SEQ ID NO: 2776305 - RNA, 16 nt, Human
gccagccagccacucu

SEQ ID NO: 2776306 - RNA, 17 nt, Human
gccagccccacacagcu

SEQ ID NO: 2776307 - RNA, 18 nt, Human
gccagccccacacagcua

SEQ ID NO: 2776308 - RNA, 22 nt, Human
gccagccccacacagcuacagc

SEQ ID NO: 2776309 - RNA, 15 nt, Human
gccagccccacccag

SEQ ID NO: 2776310 - RNA, 14 nt, Human
gccagccccaccca

SEQ ID NO: 2776311 - RNA, 13 nt, Human
gccagccccaccc

SEQ ID NO: 2776312 - RNA, 19 nt, Human
gccaggcaacuucaguccu

SEQ ID NO: 2776313 - RNA, 22 nt, Human
gccaggcaacuucaguccuggg

SEQ ID NO: 2776314 - RNA, 15 nt, Human
gccaggccagaggga

SEQ ID NO: 2776315 - RNA, 22 nt, Human
gccaggccagagggagugacag

SEQ ID NO: 2776316 - RNA, 12 nt, Human
gccaggccagcu

SEQ ID NO: 2776317 - RNA, 18 nt, Human
gccaggcaggugccugga

SEQ ID NO: 2776318 - RNA, 19 nt, Human
gccaggcagguagccaggg

SEQ ID NO: 2776319 - RNA, 17 nt, Human
gccaggcagguccacag

SEQ ID NO: 2776320 - RNA, 23 nt, Human
gccaggcagaucugugccccaug

SEQ ID NO: 2776321 - RNA, 19 nt, Human
gccaggcaggcgggcgcca

SEQ ID NO: 2776322 - RNA, 21 nt, Human
gccaggcagaucugugcccca

SEQ ID NO: 2776323 - RNA, 15 nt, Human
gccaggcagaucugu

SEQ ID NO: 2776324 - RNA, 14 nt, Human
gccaggcagaucug

SEQ ID NO: 2776325 - RNA, 13 nt, Human
gccaggccagcug

SEQ ID NO: 2776326 - RNA, 17 nt, Human
gccaggcccccaccaca

SEQ ID NO: 2776327 - RNA, 19 nt, Human
gccaggcccccaccacaca

SEQ ID NO: 2776328 - RNA, 20 nt, Human
gccaggcccccaccacacau

SEQ ID NO: 2776329 - RNA, 21 nt, Human
gccaggcccccaccacacauc

SEQ ID NO: 2776330 - RNA, 22 nt, Human
gccaggcccccaccacacaucc

SEQ ID NO: 2776331 - RNA, 23 nt, Human
gccaggcccccaccacacauccc

SEQ ID NO: 2776332 - RNA, 20 nt, Human
gccagugugaucccaagugc

SEQ ID NO: 2776333 - RNA, 13 nt, Human
gccagugugcuga

SEQ ID NO: 2776334 - RNA, 17 nt, Human
gccagugugcugauggg

SEQ ID NO: 2776335 - RNA, 18 nt, Human
gccagugugcugaugggc

SEQ ID NO: 2776336 - RNA, 15 nt, Human
gccaguguugccuaa

SEQ ID NO: 2776337 - RNA, 16 nt, Human
gccaguguugccuaag

SEQ ID NO: 2776338 - RNA, 17 nt, Human
gccaguuagacuagucc

SEQ ID NO: 2776339 - RNA, 18 nt, Human
gccaguguugccuaagua

SEQ ID NO: 2776340 - RNA, 17 nt, Human
gccagugugaucccaag

SEQ ID NO: 2776341 - RNA, 13 nt, Human
gccagugugacaa

SEQ ID NO: 2776342 - RNA, 14 nt, Human
gccaguggggccug

SEQ ID NO: 2776343 - RNA, 15 nt, Human
gccaguggggccugu

SEQ ID NO: 2776344 - RNA, 16 nt, Human
gccaguggggccugug

SEQ ID NO: 2776345 - RNA, 17 nt, Human
gccaguggggccugugg

SEQ ID NO: 2776346 - RNA, 18 nt, Human
gccaguggggccugugga

SEQ ID NO: 2776347 - RNA, 19 nt, Human
gccaguggggccuguggaa

SEQ ID NO: 2776348 - RNA, 21 nt, Human
gccaguggggccuguggaaug

SEQ ID NO: 2776349 - RNA, 17 nt, Human
gccaguguaauccccca

SEQ ID NO: 2776350 - RNA, 18 nt, Human
gccaguguaaucccccag

SEQ ID NO: 2776351 - RNA, 19 nt, Human
gccaguguaaucccccagg

SEQ ID NO: 2776352 - RNA, 20 nt, Human
gccaguguaaucccccagga

SEQ ID NO: 2776353 - RNA, 16 nt, Human
gccagugcuccaggca

SEQ ID NO: 2776354 - RNA, 18 nt, Human
gccaguggaaauucaggu

SEQ ID NO: 2776355 - RNA, 14 nt, Human
gccaguuggaacca

SEQ ID NO: 2776356 - RNA, 22 nt, Human
gccauaaaacagguaauauaaa

SEQ ID NO: 2776357 - RNA, 16 nt, Human
gccauagucacauggc

SEQ ID NO: 2776358 - RNA, 16 nt, Human
gccauauaaguuugaa

SEQ ID NO: 2776359 - RNA, 17 nt, Human
gccauagucaaagagag

SEQ ID NO: 2776360 - RNA, 23 nt, Human
gccauagucaaagagaguuuuua

SEQ ID NO: 2776361 - RNA, 17 nt, Human
gccauauaaguuugaag

SEQ ID NO: 2776362 - RNA, 18 nt, Human
gccauauaaguuugaagg

SEQ ID NO: 2776363 - RNA, 19 nt, Human
gccauauaaguuugaagga

SEQ ID NO: 2776364 - RNA, 22 nt, Human
gccauauaaguuugaaggaaac

SEQ ID NO: 2776365 - RNA, 19 nt, Human
gccauauauaacagauaca

SEQ ID NO: 2776366 - RNA, 21 nt, Human
gccauauauaacagauacauu

SEQ ID NO: 2776367 - RNA, 23 nt, Human
gccauauauaacagauacauuuc

SEQ ID NO: 2776368 - RNA, 23 nt, Human
gccauauaaguuugaaggaaaca

SEQ ID NO: 2776369 - RNA, 14 nt, Human
gccauauuuacuac

SEQ ID NO: 2776370 - RNA, 17 nt, Human
gccauauuuacuaccuu

SEQ ID NO: 2776371 - RNA, 16 nt, Human
gccauacuuugucuga

SEQ ID NO: 2776372 - RNA, 20 nt, Human
gccauacuuaucucucugug

SEQ ID NO: 2776373 - RNA, 21 nt, Human
gccauacuuaucucucugugc

SEQ ID NO: 2776374 - RNA, 22 nt, Human
gccauacuuaucucucugugcu

SEQ ID NO: 2776375 - RNA, 16 nt, Human
gccauagaguuuaaca

SEQ ID NO: 2776376 - RNA, 15 nt, Human
gccauaauacaaaag

SEQ ID NO: 2776377 - RNA, 21 nt, Human
gccauaauacaaaaggcucca

SEQ ID NO: 2776378 - RNA, 18 nt, Human
gccauacuuaucucucug

SEQ ID NO: 2776379 - RNA, 14 nt, Human
gccaugugccaggu

SEQ ID NO: 2776380 - RNA, 19 nt, Human
gccaucaaaaugcuuuuua

SEQ ID NO: 2776381 - RNA, 14 nt, Human
gccaucaaacugua

SEQ ID NO: 2776382 - RNA, 18 nt, Human
gccaucaaaaugcuuuuu

SEQ ID NO: 2776383 - RNA, 16 nt, Human
gccaucaaaaugcuuu

SEQ ID NO: 2776384 - RNA, 15 nt, Human
gccaucaaaaugcuu

SEQ ID NO: 2776385 - RNA, 14 nt, Human
gccaucaaaaugcu

SEQ ID NO: 2776386 - RNA, 17 nt, Human
gccauguuaacaugaca

SEQ ID NO: 2776387 - RNA, 23 nt, Human
gccauguuaauguaaucugaugg

SEQ ID NO: 2776388 - RNA, 22 nt, Human
gcccaggaguuugaggcugcag

SEQ ID NO: 2776389 - RNA, 12 nt, Human
gcccaggcaggu

SEQ ID NO: 2776390 - RNA, 13 nt, Human
gcccaggcagguc

SEQ ID NO: 2776391 - RNA, 13 nt, Human
gcccaggccccug

SEQ ID NO: 2776392 - RNA, 15 nt, Human
gcccaggccccugcc

SEQ ID NO: 2776393 - RNA, 16 nt, Human
gcccaggcaggucuug

SEQ ID NO: 2776394 - RNA, 14 nt, Human
gcccaggcaggucu

SEQ ID NO: 2776395 - RNA, 20 nt, Human
gcccaggagggcauccauac

SEQ ID NO: 2776396 - RNA, 22 nt, Human
gcccaggagggcauccauacca

SEQ ID NO: 2776397 - RNA, 17 nt, Human
gcccaggccccugccac

SEQ ID NO: 2776398 - RNA, 22 nt, Human
gcccauguucugcccccagccc

SEQ ID NO: 2776399 - RNA, 23 nt, Human
gcccauguucugcccccagccca

SEQ ID NO: 2776400 - RNA, 20 nt, Human
gcccauucugcccuguggga

SEQ ID NO: 2776401 - RNA, 20 nt, Human
gcccauuucaauucucaaaa

SEQ ID NO: 2776402 - RNA, 11 nt, Human
gcccauuucau

SEQ ID NO: 2776403 - RNA, 18 nt, Human
gcccauuucauauucuuu

SEQ ID NO: 2776404 - RNA, 15 nt, Human
gcccauuucgugagc

SEQ ID NO: 2776405 - RNA, 19 nt, Human
gcccauuucaauucucaaa

SEQ ID NO: 2776406 - RNA, 18 nt, Human
gcccauuucaauucucaa

SEQ ID NO: 2776407 - RNA, 18 nt, Human
gccccaaucccuuuauua

SEQ ID NO: 2776408 - RNA, 19 nt, Human
gccccaaucccuuuauuac

SEQ ID NO: 2776409 - RNA, 13 nt, Human
gccccaauuuucu

SEQ ID NO: 2776410 - RNA, 16 nt, Human
gccccacacagcuaca

SEQ ID NO: 2776411 - RNA, 14 nt, Human
gccccccucccaga

SEQ ID NO: 2776412 - RNA, 15 nt, Human
gccccccucccagag

SEQ ID NO: 2776413 - RNA, 16 nt, Human
gccccccucccagagg

SEQ ID NO: 2776414 - RNA, 17 nt, Human
gccccccucccagaggc

SEQ ID NO: 2776415 - RNA, 15 nt, Human
gccccccugcccugu

SEQ ID NO: 2776416 - RNA, 14 nt, Human
gccccccugcccug

SEQ ID NO: 2776417 - RNA, 22 nt, Human
gccccugcugguucaggguugg

SEQ ID NO: 2776418 - RNA, 21 nt, Human
gccccugcugguucaggguug

SEQ ID NO: 2776419 - RNA, 15 nt, Human
gccccugcccggcug

SEQ ID NO: 2776420 - RNA, 19 nt, Human
gcccccgucacgugcgcug

SEQ ID NO: 2776421 - RNA, 22 nt, Human
gcccccuccccggcacccucug

SEQ ID NO: 2776422 - RNA, 23 nt, Human
gcccccuccccggcacccucugg

SEQ ID NO: 2776423 - RNA, 14 nt, Human
gcccccggcccccu

SEQ ID NO: 2776424 - RNA, 21 nt, Human
gcccucaucuaugaggaaagg

SEQ ID NO: 2776425 - RNA, 23 nt, Human
gcccucaucuugaagggcccagg

SEQ ID NO: 2776426 - RNA, 16 nt, Human
gcccucauggccccuc

SEQ ID NO: 2776427 - RNA, 19 nt, Human
gcccucagaacccuuggcu

SEQ ID NO: 2776428 - RNA, 15 nt, Human
gcccucacccugggg

SEQ ID NO: 2776429 - RNA, 13 nt, Human
gcccuagagccug

SEQ ID NO: 2776430 - RNA, 14 nt, Human
gcccuagagccugc

SEQ ID NO: 2776431 - RNA, 15 nt, Human
gcccuagagccugcc

SEQ ID NO: 2776432 - RNA, 16 nt, Human
gcccuagagccugccu

SEQ ID NO: 2776433 - RNA, 17 nt, Human
gcccuagagccugccug

SEQ ID NO: 2776434 - RNA, 18 nt, Human
gcccuagagccugccugg

SEQ ID NO: 2776435 - RNA, 19 nt, Human
gcccuagagccugccugga

SEQ ID NO: 2776436 - RNA, 20 nt, Human
gcccuagagccugccuggag

SEQ ID NO: 2776437 - RNA, 23 nt, Human
gcccuagagccugccuggagcgu

SEQ ID NO: 2776438 - RNA, 19 nt, Human
gcccuagcccagcgcucug

SEQ ID NO: 2776439 - RNA, 21 nt, Human
gcccuagcccagcgcucugcc

SEQ ID NO: 2776440 - RNA, 19 nt, Human
gccccuggacaagcagagg

SEQ ID NO: 2776441 - RNA, 21 nt, Human
gcccuagagccugccuggagc

SEQ ID NO: 2776442 - RNA, 16 nt, Human
gcccucacccuggggc

SEQ ID NO: 2776443 - RNA, 17 nt, Human
gcccucacccuggggcu

SEQ ID NO: 2776444 - RNA, 14 nt, Human
gcccucagaacccu

SEQ ID NO: 2776445 - RNA, 15 nt, Human
gcccuauuuuugcaa

SEQ ID NO: 2776446 - RNA, 17 nt, Human
gcccuauuuuugcaaug

SEQ ID NO: 2776447 - RNA, 23 nt, Human
gcccucagaacccuuggcuugcc

SEQ ID NO: 2776448 - RNA, 15 nt, Human
gcccucagauguccc

SEQ ID NO: 2776449 - RNA, 16 nt, Human
gcccucagaugucccu

SEQ ID NO: 2776450 - RNA, 17 nt, Human
gcccucagaugucccuu

SEQ ID NO: 2776451 - RNA, 18 nt, Human
gcccucagaugucccuug

SEQ ID NO: 2776452 - RNA, 18 nt, Human
gcccucagaacccuuggc

SEQ ID NO: 2776453 - RNA, 17 nt, Human
gcccucagaacccuugg

SEQ ID NO: 2776454 - RNA, 17 nt, Human
gcuaauuuuuguaauuu

SEQ ID NO: 2776455 - RNA, 16 nt, Human
gcuaauuuuuguaauu

SEQ ID NO: 2776456 - RNA, 15 nt, Human
gcuaauuuuuguaau

SEQ ID NO: 2776457 - RNA, 15 nt, Human
gcuaauuuaaagaga

SEQ ID NO: 2776458 - RNA, 16 nt, Human
gcuaauuuaaagagac

SEQ ID NO: 2776459 - RNA, 18 nt, Human
gcuacuggcauaguuuca

SEQ ID NO: 2776460 - RNA, 20 nt, Human
gcuacuggcauaguuucaua

SEQ ID NO: 2776461 - RNA, 12 nt, Human
gcuacaacagcc

SEQ ID NO: 2776462 - RNA, 14 nt, Human
gcuacaacagccuc

SEQ ID NO: 2776463 - RNA, 15 nt, Human
gcuacaacagccuca

SEQ ID NO: 2776464 - RNA, 17 nt, Human
gcuacaacagccucacu

SEQ ID NO: 2776465 - RNA, 18 nt, Human
gcuacaaaacgcgcagau

SEQ ID NO: 2776466 - RNA, 22 nt, Human
gcuacaaaacgcgcagaugugc

SEQ ID NO: 2776467 - RNA, 22 nt, Human
gcguugggagggggagaaaagg

SEQ ID NO: 2776468 - RNA, 22 nt, Human
gcguugguccagagcggaggcu

SEQ ID NO: 2776469 - RNA, 14 nt, Human
gcguuggucucugc

SEQ ID NO: 2776470 - RNA, 15 nt, Human
gcguuggucucugca

SEQ ID NO: 2776471 - RNA, 16 nt, Human
gcguugccugucgcuu

SEQ ID NO: 2776472 - RNA, 14 nt, Human
gcguugcuuucacu

SEQ ID NO: 2776473 - RNA, 15 nt, Human
gcguuguuacaggaa

SEQ ID NO: 2776474 - RNA, 16 nt, Human
gcguuguuacaggaag

SEQ ID NO: 2776475 - RNA, 19 nt, Human
gcguuguugcauguuugaa

SEQ ID NO: 2776476 - RNA, 23 nt, Human
gcguuguugcauguuugaaauga

SEQ ID NO: 2776477 - RNA, 14 nt, Human
gcguuuagaccaag

SEQ ID NO: 2776478 - RNA, 16 nt, Human
gcguuuagaccaagga

SEQ ID NO: 2776479 - RNA, 16 nt, Human
gcuaauuuuucauuuu

SEQ ID NO: 2776480 - RNA, 13 nt, Human
gcuaauuuucuca

SEQ ID NO: 2776481 - RNA, 14 nt, Human
gcuaauuuucucaa

SEQ ID NO: 2776482 - RNA, 17 nt, Human
gcuaauuuucucaaaag

SEQ ID NO: 2776483 - RNA, 19 nt, Human
gcuaauuuucucaaaagca

SEQ ID NO: 2776484 - RNA, 22 nt, Human
gcuaauuuucucaaaagcauuu

SEQ ID NO: 2776485 - RNA, 15 nt, Human
gcuaauuugcauuaa

SEQ ID NO: 2776486 - RNA, 13 nt, Human
gcuaauuugcauu

SEQ ID NO: 2776487 - RNA, 12 nt, Human
gcuaauuugcau

SEQ ID NO: 2776488 - RNA, 20 nt, Human
gcuaauuuauccugaaauuu

SEQ ID NO: 2776489 - RNA, 18 nt, Human
gcuaauugcuguugaaag

SEQ ID NO: 2776490 - RNA, 20 nt, Human
gcuaauugcuguugaaagca

SEQ ID NO: 2776491 - RNA, 21 nt, Human
gcuaauugcuguugaaagcaa

SEQ ID NO: 2776492 - RNA, 22 nt, Human
gcuaauugcuguugaaagcaaa

SEQ ID NO: 2776493 - RNA, 23 nt, Human
gcuaauugcuguugaaagcaaaa

SEQ ID NO: 2776494 - RNA, 19 nt, Human
gcuaauugggaguccaggc

SEQ ID NO: 2776495 - RNA, 20 nt, Human
gcuaauugggaguccaggca

SEQ ID NO: 2776496 - RNA, 19 nt, Human
gcuacuuccuccuccccac

SEQ ID NO: 2776497 - RNA, 18 nt, Human
gcuacuuccuccucccca

SEQ ID NO: 2776498 - RNA, 17 nt, Human
gcuaauuuuuacuuuuu

SEQ ID NO: 2776499 - RNA, 15 nt, Human
gcuacuugguuugug

SEQ ID NO: 2776500 - RNA, 18 nt, Human
gcuacuuugguuucuguc

SEQ ID NO: 2776501 - RNA, 22 nt, Human
gcuacuuugguuucugucugua

SEQ ID NO: 2776502 - RNA, 20 nt, Human
gcuacuguccuacccacccu

SEQ ID NO: 2776503 - RNA, 19 nt, Human
gcuacuguccuacccaccc

SEQ ID NO: 2776504 - RNA, 13 nt, Human
gcuacuuaagaga

SEQ ID NO: 2776505 - RNA, 16 nt, Human
gcuacuuaagagaaau

SEQ ID NO: 2776506 - RNA, 21 nt, Human
gcuacuuaagagaaauggcaa

SEQ ID NO: 2776507 - RNA, 21 nt, Human
gcuacugugugugugaaugaa

SEQ ID NO: 2776508 - RNA, 19 nt, Human
gcuacugugugugugaaug

SEQ ID NO: 2776509 - RNA, 18 nt, Human
gcuacugugugugugaau

SEQ ID NO: 2776510 - RNA, 15 nt, Human
gcuacugugugugug

SEQ ID NO: 2776511 - RNA, 12 nt, Human
gcuacugucuca

SEQ ID NO: 2776512 - RNA, 16 nt, Human
gcuacugucucacuga

SEQ ID NO: 2776513 - RNA, 21 nt, Human
gcuacugucucacugaaacau

SEQ ID NO: 2776514 - RNA, 16 nt, Human
gcuacugucuuuggaa

SEQ ID NO: 2776515 - RNA, 14 nt, Human
gcguggugccaucc

SEQ ID NO: 2776516 - RNA, 13 nt, Human
gcguggugccauc

SEQ ID NO: 2776517 - RNA, 13 nt, Human
gcguggauuaaac

SEQ ID NO: 2776518 - RNA, 14 nt, Human
gcguggauuaaacu

SEQ ID NO: 2776519 - RNA, 20 nt, Human
gcguggauuaaacuuaugaa

SEQ ID NO: 2776520 - RNA, 23 nt, Human
gcguggauuaaacuuaugaaugu

SEQ ID NO: 2776521 - RNA, 17 nt, Human
gcguggcaaauauaaaa

SEQ ID NO: 2776522 - RNA, 12 nt, Human
gcgugggucaga

SEQ ID NO: 2776523 - RNA, 13 nt, Human
gcgugggucagaa

SEQ ID NO: 2776524 - RNA, 14 nt, Human
gcgugggucagaag

SEQ ID NO: 2776525 - RNA, 18 nt, Human
gcgugcacacaccagagc

SEQ ID NO: 2776526 - RNA, 14 nt, Human
gcgugcacacacca

SEQ ID NO: 2776527 - RNA, 19 nt, Human
gcgugaucaaagccacacu

SEQ ID NO: 2776528 - RNA, 20 nt, Human
gcgugaucaaagccacacuc

SEQ ID NO: 2776529 - RNA, 16 nt, Human
gcggccccucccgccc

SEQ ID NO: 2776530 - RNA, 13 nt, Human
gcggccccucccg

SEQ ID NO: 2776531 - RNA, 12 nt, Human
gcggagcuggcc

SEQ ID NO: 2776532 - RNA, 16 nt, Human
gcggagcuugcaguga

SEQ ID NO: 2776533 - RNA, 16 nt, Human
gcggagguugcaggga

SEQ ID NO: 2776534 - RNA, 15 nt, Human
gcggagguugcaggg

SEQ ID NO: 2776535 - RNA, 14 nt, Human
gcggagcuggcccc

SEQ ID NO: 2776536 - RNA, 17 nt, Human
gcggagcuggccccgcc

SEQ ID NO: 2776537 - RNA, 14 nt, Human
gcggaggcugugug

SEQ ID NO: 2776538 - RNA, 16 nt, Human
gcggaggcugugugcc

SEQ ID NO: 2776539 - RNA, 18 nt, Human
gcggaggcugugugccug

SEQ ID NO: 2776540 - RNA, 18 nt, Human
gcgagacuccgucucaaa

SEQ ID NO: 2776541 - RNA, 14 nt, Human
gcgagagaggagcc

SEQ ID NO: 2776542 - RNA, 16 nt, Human
gcgagagaggagccag

SEQ ID NO: 2776543 - RNA, 13 nt, Human
gcgauucuucugc

SEQ ID NO: 2776544 - RNA, 13 nt, Human
gcgauagagucuc

SEQ ID NO: 2776545 - RNA, 13 nt, Human
gcgauauacagau

SEQ ID NO: 2776546 - RNA, 14 nt, Human
gcgauauacagaug

SEQ ID NO: 2776547 - RNA, 19 nt, Human
gcgauauacagaugaaaau

SEQ ID NO: 2776548 - RNA, 17 nt, Human
gcgauucuccugccuca

SEQ ID NO: 2776549 - RNA, 16 nt, Human
gcgauccaccugucuc

SEQ ID NO: 2776550 - RNA, 17 nt, Human
gcgaguuguggaaagcc

SEQ ID NO: 2776551 - RNA, 22 nt, Human
gcgagugaaugccagugugcug

SEQ ID NO: 2776552 - RNA, 16 nt, Human
gcgagagucugucuca

SEQ ID NO: 2776553 - RNA, 15 nt, Human
gcgagcaucccccaa

SEQ ID NO: 2776554 - RNA, 14 nt, Human
gcgagggcagcugc

SEQ ID NO: 2776555 - RNA, 13 nt, Human
gcgagggcagcug

SEQ ID NO: 2776556 - RNA, 12 nt, Human
gcgagggcagcu

SEQ ID NO: 2776557 - RNA, 16 nt, Human
gcgagggcagcugcua

SEQ ID NO: 2776558 - RNA, 15 nt, Human
gcgagggcagcugcu

SEQ ID NO: 2776559 - RNA, 17 nt, Human
gcgagggcagcugcuau

SEQ ID NO: 2776560 - RNA, 12 nt, Human
gcgaggcaggcc

SEQ ID NO: 2776561 - RNA, 13 nt, Human
gcgaggcaggccg

SEQ ID NO: 2776562 - RNA, 14 nt, Human
gcgauucuucugcu

SEQ ID NO: 2776563 - RNA, 13 nt, Human
gcgauucuccugc

SEQ ID NO: 2776564 - RNA, 20 nt, Human
gccuccuuccuugcuguccu

SEQ ID NO: 2776565 - RNA, 11 nt, Human
gccuccaucuc

SEQ ID NO: 2776566 - RNA, 12 nt, Human
gccuccacagcg

SEQ ID NO: 2776567 - RNA, 19 nt, Human
gccuccagaacucacuggg

SEQ ID NO: 2776568 - RNA, 17 nt, Human
gccuccagaacucacug

SEQ ID NO: 2776569 - RNA, 22 nt, Human
gccuccagaggggcucagguca

SEQ ID NO: 2776570 - RNA, 11 nt, Human
gccuccagccu

SEQ ID NO: 2776571 - RNA, 16 nt, Human
gccuccagccugccca

SEQ ID NO: 2776572 - RNA, 18 nt, Human
gccuccagccugcccaag

SEQ ID NO: 2776573 - RNA, 14 nt, Human
gccuccaggcccgu

SEQ ID NO: 2776574 - RNA, 20 nt, Human
gccuccaggcccgucugucc

SEQ ID NO: 2776575 - RNA, 21 nt, Human
gccuccaggcccgucugucca

SEQ ID NO: 2776576 - RNA, 17 nt, Human
gccuccaaaugccaacu

SEQ ID NO: 2776577 - RNA, 22 nt, Human
gccuccaaaugccaacuugucc

SEQ ID NO: 2776578 - RNA, 17 nt, Human
gccuccaagcuccaucu

SEQ ID NO: 2776579 - RNA, 23 nt, Human
gccugcuaauuccccagauugca

SEQ ID NO: 2776580 - RNA, 17 nt, Human
gccugcuaauuccccag

SEQ ID NO: 2776581 - RNA, 20 nt, Human
gccugcguuuuggaagcucu

SEQ ID NO: 2776582 - RNA, 18 nt, Human
gccugcguugguccagag

SEQ ID NO: 2776583 - RNA, 19 nt, Human
gccugcguugguccagagc

SEQ ID NO: 2776584 - RNA, 20 nt, Human
gccugcguugguccagagcg

SEQ ID NO: 2776585 - RNA, 13 nt, Human
gccugcgucuucc

SEQ ID NO: 2776586 - RNA, 14 nt, Human
gccugcgucuuccg

SEQ ID NO: 2776587 - RNA, 15 nt, Human
gccugcgucuuccgc

SEQ ID NO: 2776588 - RNA, 16 nt, Human
gccugcgucuuccgcc

SEQ ID NO: 2776589 - RNA, 18 nt, Human
gccugcgucuuccgcccc

SEQ ID NO: 2776590 - RNA, 23 nt, Human
gccugcgucuuccgccccugccu

SEQ ID NO: 2776591 - RNA, 15 nt, Human
gccucgaggugccuu

SEQ ID NO: 2776592 - RNA, 19 nt, Human
gccucgaggugccuucuuc

SEQ ID NO: 2776593 - RNA, 23 nt, Human
gccucgaggugccuucuucaggg

SEQ ID NO: 2776594 - RNA, 13 nt, Human
gccucggacuuag

SEQ ID NO: 2776595 - RNA, 14 nt, Human
gccugccccucucc

SEQ ID NO: 2776596 - RNA, 19 nt, Human
gccucgcucuguuacccag

SEQ ID NO: 2776597 - RNA, 20 nt, Human
gccucgcucuguuacccagg

SEQ ID NO: 2776598 - RNA, 23 nt, Human
gccucgcucuguuacccagggug

SEQ ID NO: 2776599 - RNA, 17 nt, Human
gccugccccucucccgc

SEQ ID NO: 2776600 - RNA, 14 nt, Human
gccugcccgcacag

SEQ ID NO: 2776601 - RNA, 15 nt, Human
gccugcccgcacagc

SEQ ID NO: 2776602 - RNA, 17 nt, Human
gccugcccgcacagcag

SEQ ID NO: 2776603 - RNA, 19 nt, Human
gccugcccgcacagcagcc

SEQ ID NO: 2776604 - RNA, 20 nt, Human
gccugcccgcacagcagccu

SEQ ID NO: 2776605 - RNA, 21 nt, Human
gccugcccgcacagcagccug

SEQ ID NO: 2776606 - RNA, 21 nt, Human
gccugcccguaaacacgccug

SEQ ID NO: 2776607 - RNA, 16 nt, Human
gccugcccguaaacac

SEQ ID NO: 2776608 - RNA, 20 nt, Human
gccugcccucauggccccuc

SEQ ID NO: 2776609 - RNA, 21 nt, Human
gccugcccucauggccccucu

SEQ ID NO: 2776610 - RNA, 22 nt, Human
gccugcccucauggccccucug

SEQ ID NO: 2776611 - RNA, 23 nt, Human
ggaaacgcuaccucucugucccu

SEQ ID NO: 2776612 - RNA, 13 nt, Human
ggaaaugagcagg

SEQ ID NO: 2776613 - RNA, 14 nt, Human
ggaaaugagcaggg

SEQ ID NO: 2776614 - RNA, 16 nt, Human
ggaacaaaaaaaccac

SEQ ID NO: 2776615 - RNA, 17 nt, Human
ggaacaaaaaaaccaca

SEQ ID NO: 2776616 - RNA, 21 nt, Human
ggaacaaaaaaaccacaaagg

SEQ ID NO: 2776617 - RNA, 18 nt, Human
ggaacaaggagucagaca

SEQ ID NO: 2776618 - RNA, 12 nt, Human
ggaaauuaaagu

SEQ ID NO: 2776619 - RNA, 17 nt, Human
ggaaaugucaacaagua

SEQ ID NO: 2776620 - RNA, 14 nt, Human
ggaagaagcagaga

SEQ ID NO: 2776621 - RNA, 16 nt, Human
ggaagaagcagagaga

SEQ ID NO: 2776622 - RNA, 14 nt, Human
ggaagaaaaugguu

SEQ ID NO: 2776623 - RNA, 20 nt, Human
ggaagaaaaugguuuauuuu

SEQ ID NO: 2776624 - RNA, 19 nt, Human
ggaagaaacacuuucucuu

SEQ ID NO: 2776625 - RNA, 17 nt, Human
ggaagaaaaaaaucuuc

SEQ ID NO: 2776626 - RNA, 23 nt, Human
ggaagaaaaaaaucuucuccaga

SEQ ID NO: 2776627 - RNA, 12 nt, Human
ggaacugcagca

SEQ ID NO: 2776628 - RNA, 16 nt, Human
ggaacucugacaaggg

SEQ ID NO: 2776629 - RNA, 19 nt, Human
ggaacucugacaagggcug

SEQ ID NO: 2776630 - RNA, 21 nt, Human
ggaacucugacaagggcugac

SEQ ID NO: 2776631 - RNA, 23 nt, Human
ggaaauucaggugaaaauguuca

SEQ ID NO: 2776632 - RNA, 14 nt, Human
ggaacacacuugga

SEQ ID NO: 2776633 - RNA, 17 nt, Human
ggaacaccauaggucac

SEQ ID NO: 2776634 - RNA, 17 nt, Human
ggaagacaaaauguuuu

SEQ ID NO: 2776635 - RNA, 16 nt, Human
ggaagacgccugagcu

SEQ ID NO: 2776636 - RNA, 15 nt, Human
ggaagacgccugagc

SEQ ID NO: 2776637 - RNA, 14 nt, Human
ggaagaccuggcaa

SEQ ID NO: 2776638 - RNA, 12 nt, Human
gcuuuuggccug

SEQ ID NO: 2776639 - RNA, 14 nt, Human
gcuuuuggccugga

SEQ ID NO: 2776640 - RNA, 18 nt, Human
gcuuuugucuaugggacu

SEQ ID NO: 2776641 - RNA, 15 nt, Human
gcuuuuggucugugu

SEQ ID NO: 2776642 - RNA, 14 nt, Human
gcuuuucucagcug

SEQ ID NO: 2776643 - RNA, 13 nt, Human
ggaaacagacucg

SEQ ID NO: 2776644 - RNA, 15 nt, Human
ggaaacacuccuugc

SEQ ID NO: 2776645 - RNA, 17 nt, Human
ggaaacacuccuugcau

SEQ ID NO: 2776646 - RNA, 22 nt, Human
ggaaacagacucgauucauauu

SEQ ID NO: 2776647 - RNA, 19 nt, Human
ggaaacccauaggcccaca

SEQ ID NO: 2776648 - RNA, 23 nt, Human
ggaaacccauaggcccacacaca

SEQ ID NO: 2776649 - RNA, 24 nt, Human
ggaaacccauaggcccacacacag

SEQ ID NO: 2776650 - RNA, 19 nt, Human
ggaaaccccuucucuguga

SEQ ID NO: 2776651 - RNA, 14 nt, Human
ggaaacccgagggu

SEQ ID NO: 2776652 - RNA, 16 nt, Human
gcuuuuugucuuuucu

SEQ ID NO: 2776653 - RNA, 14 nt, Human
gcuuuuugguguau

SEQ ID NO: 2776654 - RNA, 18 nt, Human
gcuuuuugguguauagaa

SEQ ID NO: 2776655 - RNA, 13 nt, Human
ggaaacaacagcu

SEQ ID NO: 2776656 - RNA, 16 nt, Human
ggaaacaacagcuuua

SEQ ID NO: 2776657 - RNA, 12 nt, Human
ggaaacaauaua

SEQ ID NO: 2776658 - RNA, 14 nt, Human
gcuuuuggucauca

SEQ ID NO: 2776659 - RNA, 20 nt, Human
gcuuuugucuaauuaaaaca

SEQ ID NO: 2776660 - RNA, 21 nt, Human
gcuuuugucuaauuaaaacac

SEQ ID NO: 2776661 - RNA, 13 nt, Human
gcuuuuuaauugu

SEQ ID NO: 2776662 - RNA, 15 nt, Human
gcuuuuuauuucugc

SEQ ID NO: 2776663 - RNA, 20 nt, Human
gcuuuuuaauuguuguuucu

SEQ ID NO: 2776664 - RNA, 21 nt, Human
gcuuuuuaauuguuguuucuu

SEQ ID NO: 2776665 - RNA, 22 nt, Human
gcuuuuuaauuguuguuucuuu

SEQ ID NO: 2776666 - RNA, 21 nt, Human
gcuuuuuauuucugcauaugu

SEQ ID NO: 2776667 - RNA, 13 nt, Human
gcuuuuucacagu

SEQ ID NO: 2776668 - RNA, 15 nt, Human
gcuuuuucacaguca

SEQ ID NO: 2776669 - RNA, 17 nt, Human
gcuuuuuauuucugcau

SEQ ID NO: 2776670 - RNA, 13 nt, Human
gcuuuuuccagag

SEQ ID NO: 2776671 - RNA, 16 nt, Human
gcuuuuuccuccugga

SEQ ID NO: 2776672 - RNA, 12 nt, Human
gcuuuuugaaau

SEQ ID NO: 2776673 - RNA, 13 nt, Human
gcuuuuugaaaug

SEQ ID NO: 2776674 - RNA, 14 nt, Human
gcuuuuugaaauga

SEQ ID NO: 2776675 - RNA, 16 nt, Human
gcuuuuugaaaugaaa

SEQ ID NO: 2776676 - RNA, 17 nt, Human
gcuuuuugaaaugaaau

SEQ ID NO: 2776677 - RNA, 18 nt, Human
gcuuuuugaaaugaaauu

SEQ ID NO: 2776678 - RNA, 14 nt, Human
gcuuugaucccuga

SEQ ID NO: 2776679 - RNA, 15 nt, Human
gcuuugaucccugac

SEQ ID NO: 2776680 - RNA, 14 nt, Human
gcuuccuguuugua

SEQ ID NO: 2776681 - RNA, 20 nt, Human
gcuuccuguccccaucuguc

SEQ ID NO: 2776682 - RNA, 22 nt, Human
gcuuccaucccaaccagugcca

SEQ ID NO: 2776683 - RNA, 23 nt, Human
gcuuccaucccaaccagugccaa

SEQ ID NO: 2776684 - RNA, 19 nt, Human
gcuuccaugauucuauuua

SEQ ID NO: 2776685 - RNA, 14 nt, Human
gcuuccaugauucu

SEQ ID NO: 2776686 - RNA, 18 nt, Human
gcuuccaugauucuauuu

SEQ ID NO: 2776687 - RNA, 15 nt, Human
gcuuccaugauucua

SEQ ID NO: 2776688 - RNA, 18 nt, Human
gcuucuuacugauaauuu

SEQ ID NO: 2776689 - RNA, 13 nt, Human
gcuucuuaauuaa

SEQ ID NO: 2776690 - RNA, 16 nt, Human
gcuucuuaauuaauuu

SEQ ID NO: 2776691 - RNA, 17 nt, Human
gcuucuuaauuaauuug

SEQ ID NO: 2776692 - RNA, 11 nt, Human
gcuugaagcug

SEQ ID NO: 2776693 - RNA, 13 nt, Human
gcuugaacccagg

SEQ ID NO: 2776694 - RNA, 17 nt, Human
gcuuguaaauagcucag

SEQ ID NO: 2776695 - RNA, 19 nt, Human
gcuuguaaauagcucaggu

SEQ ID NO: 2776696 - RNA, 18 nt, Human
gcuuguaaauagcucagg

SEQ ID NO: 2776697 - RNA, 22 nt, Human
gcuuuccccaugucucgacuca

SEQ ID NO: 2776698 - RNA, 13 nt, Human
gcuuguaaauacc

SEQ ID NO: 2776699 - RNA, 15 nt, Human
gcuuguaaauaccag

SEQ ID NO: 2776700 - RNA, 17 nt, Human
gcuuguaaauaccagga

SEQ ID NO: 2776701 - RNA, 21 nt, Human
gcuuuccccaugucucgacuc

SEQ ID NO: 2776702 - RNA, 14 nt, Human
gcuuucucuuuucu

SEQ ID NO: 2776703 - RNA, 19 nt, Human
gcuuucucuuuucucuuuu

SEQ ID NO: 2776704 - RNA, 18 nt, Human
gcuuucuccccaaugaga

SEQ ID NO: 2776705 - RNA, 21 nt, Human
gcuuucuccccaaugagacuu

SEQ ID NO: 2776706 - RNA, 12 nt, Human
gcuuucuagaag

SEQ ID NO: 2776707 - RNA, 18 nt, Human
gcuuucuaugcuguuugu

SEQ ID NO: 2776708 - RNA, 15 nt, Human
gcuuucccuuggaua

SEQ ID NO: 2776709 - RNA, 11 nt, Human
gcuuucugucu

SEQ ID NO: 2776710 - RNA, 13 nt, Human
gcuuucuggagag

SEQ ID NO: 2776711 - RNA, 15 nt, Human
gcuuuccuaaaucag

SEQ ID NO: 2776712 - RNA, 15 nt, Human
gcuuugaguccccca

SEQ ID NO: 2776713 - RNA, 21 nt, Human
gcugugcacccagaagaagau

SEQ ID NO: 2776714 - RNA, 19 nt, Human
gcuguauuagucacagaga

SEQ ID NO: 2776715 - RNA, 23 nt, Human
gcuguacaucuauuuuggauugu

SEQ ID NO: 2776716 - RNA, 20 nt, Human
gcuguacuucgucuucuaau

SEQ ID NO: 2776717 - RNA, 17 nt, Human
gcuguacugcucaggcu

SEQ ID NO: 2776718 - RNA, 23 nt, Human
gcuguacugcucaggcugcagcu

SEQ ID NO: 2776719 - RNA, 22 nt, Human
gcuguacaucuauuuuggauug

SEQ ID NO: 2776720 - RNA, 20 nt, Human
gcuguacaucuauuuuggau

SEQ ID NO: 2776721 - RNA, 16 nt, Human
gcuguacaucuauuuu

SEQ ID NO: 2776722 - RNA, 12 nt, Human
gcuguacaucua

SEQ ID NO: 2776723 - RNA, 23 nt, Human
gcugguucaggguuggccccugc

SEQ ID NO: 2776724 - RNA, 16 nt, Human
gcuggauauuuuacua

SEQ ID NO: 2776725 - RNA, 16 nt, Human
gcuggaguuucaugua

SEQ ID NO: 2776726 - RNA, 15 nt, Human
gcuggaguugucacu

SEQ ID NO: 2776727 - RNA, 20 nt, Human
gcuggagugcagugguguga

SEQ ID NO: 2776728 - RNA, 15 nt, Human
gcuggagugcagugg

SEQ ID NO: 2776729 - RNA, 19 nt, Human
gcuggagugcaguggugca

SEQ ID NO: 2776730 - RNA, 10 nt, Human
gcuucagggc

SEQ ID NO: 2776731 - RNA, 13 nt, Human
gcuucagggcagg

SEQ ID NO: 2776732 - RNA, 19 nt, Human
gcuucagggcagguggggu

SEQ ID NO: 2776733 - RNA, 12 nt, Human
gcuuauuuuaau

SEQ ID NO: 2776734 - RNA, 13 nt, Human
gcuuauuuuaaug

SEQ ID NO: 2776735 - RNA, 15 nt, Human
gcuuauuuuaaugug

SEQ ID NO: 2776736 - RNA, 17 nt, Human
gcuuauuuuaaugugau

SEQ ID NO: 2776737 - RNA, 18 nt, Human
gcuuauuuuaaugugaug

SEQ ID NO: 2776738 - RNA, 21 nt, Human
gcuuauuuuaaugugaugaug

SEQ ID NO: 2776739 - RNA, 22 nt, Human
gcuuauuuuaaugugaugaugu

SEQ ID NO: 2776740 - RNA, 14 nt, Human
gcuucaguggcagc

SEQ ID NO: 2776741 - RNA, 17 nt, Human
gcuucagguuaucgaaa

SEQ ID NO: 2776742 - RNA, 12 nt, Human
gcuucagguuau

SEQ ID NO: 2776743 - RNA, 19 nt, Human
gcuucagguuaucgaaaua

SEQ ID NO: 2776744 - RNA, 20 nt, Human
gcuucagguuaucgaaauaa

SEQ ID NO: 2776745 - RNA, 21 nt, Human
gcuucagguuaucgaaauaac

SEQ ID NO: 2776746 - RNA, 22 nt, Human
gcuucagguuaucgaaauaaca

SEQ ID NO: 2776747 - RNA, 15 nt, Human
gcuucaguggcagcu

SEQ ID NO: 2776748 - RNA, 14 nt, Human
gcuucaguggagaa

SEQ ID NO: 2776749 - RNA, 23 nt, Human
gcuucagguuaucgaaauaacaa

SEQ ID NO: 2776750 - RNA, 23 nt, Human
gcuucaguacuugugaaacacag

SEQ ID NO: 2776751 - RNA, 13 nt, Human
gcuuacaagccag

SEQ ID NO: 2776752 - RNA, 19 nt, Human
gcuuacaagccagcuggag

SEQ ID NO: 2776753 - RNA, 12 nt, Human
gcuuaauuucua

SEQ ID NO: 2776754 - RNA, 13 nt, Human
gcuuaauuucuaa

SEQ ID NO: 2776755 - RNA, 18 nt, Human
gcuuaauuucuaaagaua

SEQ ID NO: 2776756 - RNA, 14 nt, Human
gcuguuuuuguugu

SEQ ID NO: 2776757 - RNA, 15 nt, Human
gcuguuuuuguugug

SEQ ID NO: 2776758 - RNA, 18 nt, Human
gcuguuuguagugaaaua

SEQ ID NO: 2776759 - RNA, 13 nt, Human
gcuguuggcuggg

SEQ ID NO: 2776760 - RNA, 12 nt, Human
gcuguugcuuga

SEQ ID NO: 2776761 - RNA, 16 nt, Human
gcuguuggcagugagu

SEQ ID NO: 2776762 - RNA, 22 nt, Human
gcuguuggcagugagugagccu

SEQ ID NO: 2776763 - RNA, 12 nt, Human
gcugugccucug

SEQ ID NO: 2776764 - RNA, 18 nt, Human
gcugugcagcgcagcugg

SEQ ID NO: 2776765 - RNA, 14 nt, Human
gcucuggagacagc

SEQ ID NO: 2776766 - RNA, 18 nt, Human
gcucuggagacagcccca

SEQ ID NO: 2776767 - RNA, 23 nt, Human
gcucugccaacuucuucagagcu

SEQ ID NO: 2776768 - RNA, 22 nt, Human
gcucugaucauccacugugcca

SEQ ID NO: 2776769 - RNA, 21 nt, Human
gcucugaucauccacugugcc

SEQ ID NO: 2776770 - RNA, 18 nt, Human
gcucucugugucugagag

SEQ ID NO: 2776771 - RNA, 12 nt, Human
gcucucuuccug

SEQ ID NO: 2776772 - RNA, 13 nt, Human
gcucucuuccugc

SEQ ID NO: 2776773 - RNA, 14 nt, Human
gcucucuuccugcc

SEQ ID NO: 2776774 - RNA, 15 nt, Human
gcucucuuccugccc

SEQ ID NO: 2776775 - RNA, 18 nt, Human
gcucucuuccugccccuc

SEQ ID NO: 2776776 - RNA, 19 nt, Human
gcucucuuccugccccucu

SEQ ID NO: 2776777 - RNA, 20 nt, Human
gcucucuuccugccccucuu

SEQ ID NO: 2776778 - RNA, 21 nt, Human
gcucucuuccugccccucuuu

SEQ ID NO: 2776779 - RNA, 22 nt, Human
gcucucuuccugccccucuuuc

SEQ ID NO: 2776780 - RNA, 23 nt, Human
gcucucuuccugccccucuuucu

SEQ ID NO: 2776781 - RNA, 22 nt, Human
gcucucuugccgaggagccagg

SEQ ID NO: 2776782 - RNA, 23 nt, Human
gcucucuugccgaggagccaggc

SEQ ID NO: 2776783 - RNA, 20 nt, Human
gcucugaucauccacugugc

SEQ ID NO: 2776784 - RNA, 22 nt, Human
gcucugaagucacaucacagga

SEQ ID NO: 2776785 - RNA, 17 nt, Human
gcucugaaaucuccuuu

SEQ ID NO: 2776786 - RNA, 19 nt, Human
gcucugaagcaaggcggug

SEQ ID NO: 2776787 - RNA, 23 nt, Human
gcucugaagucacaucacaggac

SEQ ID NO: 2776788 - RNA, 17 nt, Human
gcucucuuuucuguacu

SEQ ID NO: 2776789 - RNA, 18 nt, Human
gcucucuuuucuguacuu

SEQ ID NO: 2776790 - RNA, 19 nt, Human
gcucucuuuucuguacuuc

SEQ ID NO: 2776791 - RNA, 11 nt, Human
gcucucuguau

SEQ ID NO: 2776792 - RNA, 18 nt, Human
gcucucuguauaaacauu

SEQ ID NO: 2776793 - RNA, 23 nt, Human
gcucucuguauaaacauuaaaug

SEQ ID NO: 2776794 - RNA, 20 nt, Human
gcugaaaaccuaaguccuuu

SEQ ID NO: 2776795 - RNA, 24 nt, Human
gcucuguggaugccagggccgacc

SEQ ID NO: 2776796 - RNA, 16 nt, Human
gcucuguggccacauu

SEQ ID NO: 2776797 - RNA, 16 nt, Human
gcucuggacucuaaag

SEQ ID NO: 2776798 - RNA, 11 nt, Human
gcucugugcug

SEQ ID NO: 2776799 - RNA, 19 nt, Human
gcugaaaaccaucuggccu

SEQ ID NO: 2776800 - RNA, 21 nt, Human
gcugaaaaccaucuggccugg

SEQ ID NO: 2776801 - RNA, 22 nt, Human
gcugaaaaccaucuggccuggc

SEQ ID NO: 2776802 - RNA, 23 nt, Human
gcugaaaaccaucuggccuggcc

SEQ ID NO: 2776803 - RNA, 12 nt, Human
gcugaaaauaua

SEQ ID NO: 2776804 - RNA, 15 nt, Human
gcugaaaauauaaaa

SEQ ID NO: 2776805 - RNA, 14 nt, Human
gcucuuuuuuacuc

SEQ ID NO: 2776806 - RNA, 17 nt, Human
gcucuuuuuuacucauu

SEQ ID NO: 2776807 - RNA, 21 nt, Human
gcucuuuuuuacucauugaaa

SEQ ID NO: 2776808 - RNA, 22 nt, Human
gcucuuuuuuacucauugaaau

SEQ ID NO: 2776809 - RNA, 23 nt, Human
gcucuuuuuuacucauugaaaug

SEQ ID NO: 2776810 - RNA, 20 nt, Human
gcucuuuuuuguuuguuucu

SEQ ID NO: 2776811 - RNA, 21 nt, Human
gcucuuuuuuguuuguuucuu

SEQ ID NO: 2776812 - RNA, 22 nt, Human
gcucuuuuuuguuuguuucuuu

SEQ ID NO: 2776813 - RNA, 19 nt, Human
gcucuggagacagccccag

SEQ ID NO: 2776814 - RNA, 20 nt, Human
gcucuggagacagccccaga

SEQ ID NO: 2776815 - RNA, 13 nt, Human
gcucuggagagaa

SEQ ID NO: 2776816 - RNA, 14 nt, Human
gcucuggagagaaa

SEQ ID NO: 2776817 - RNA, 15 nt, Human
gcucuggagagaaac

SEQ ID NO: 2776818 - RNA, 19 nt, Human
gcucuggugauaaggacau

SEQ ID NO: 2776819 - RNA, 14 nt, Human
gcucugugcaggga

SEQ ID NO: 2776820 - RNA, 23 nt, Human
gcucugucgcccaggcuggagug

SEQ ID NO: 2776821 - RNA, 14 nt, Human
gcucugucccccug

SEQ ID NO: 2776822 - RNA, 17 nt, Human
gcugacacaaaccugcc

SEQ ID NO: 2776823 - RNA, 18 nt, Human
gcugacacaaaccugccu

SEQ ID NO: 2776824 - RNA, 19 nt, Human
gcugacacaaaccugccug

SEQ ID NO: 2776825 - RNA, 20 nt, Human
gcugacacaaaccugccugg

SEQ ID NO: 2776826 - RNA, 15 nt, Human
gcugaacucaugaga

SEQ ID NO: 2776827 - RNA, 20 nt, Human
gcugaacuuguuuucuggga

SEQ ID NO: 2776828 - RNA, 13 nt, Human
gcugacagacaca

SEQ ID NO: 2776829 - RNA, 14 nt, Human
gcugagcccuggca

SEQ ID NO: 2776830 - RNA, 13 nt, Human
gcugagcccuggc

SEQ ID NO: 2776831 - RNA, 21 nt, Human
gcugacacuucaaggugacag

SEQ ID NO: 2776832 - RNA, 22 nt, Human
gcugacacuucaaggugacaga

SEQ ID NO: 2776833 - RNA, 21 nt, Human
gcugacacaaaccugccuggg

SEQ ID NO: 2776834 - RNA, 16 nt, Human
gcugagcccuggcagg

SEQ ID NO: 2776835 - RNA, 15 nt, Human
gcugagcccuggcag

SEQ ID NO: 2776836 - RNA, 12 nt, Human
gcugagccucag

SEQ ID NO: 2776837 - RNA, 16 nt, Human
gcugagccucagucuc

SEQ ID NO: 2776838 - RNA, 13 nt, Human
gcugagccucugc

SEQ ID NO: 2776839 - RNA, 19 nt, Human
gcugagccucugcucccca

SEQ ID NO: 2776840 - RNA, 20 nt, Human
gcugagccucugcuccccag

SEQ ID NO: 2776841 - RNA, 20 nt, Human
gcuccagaaaugucuaaaug

SEQ ID NO: 2776842 - RNA, 19 nt, Human
gcuccagaauuuggaaauc

SEQ ID NO: 2776843 - RNA, 21 nt, Human
gcuccagaauuuggaaauccu

SEQ ID NO: 2776844 - RNA, 22 nt, Human
gcuccagcaacacagccugggc

SEQ ID NO: 2776845 - RNA, 19 nt, Human
gcuccagagcaacgaccag

SEQ ID NO: 2776846 - RNA, 19 nt, Human
gcuccagcaacacagccug

SEQ ID NO: 2776847 - RNA, 15 nt, Human
gcuccucuccccagc

SEQ ID NO: 2776848 - RNA, 19 nt, Human
gcuccucccggugcccaag

SEQ ID NO: 2776849 - RNA, 16 nt, Human
gcuccucccggugccc

SEQ ID NO: 2776850 - RNA, 14 nt, Human
gcuccagcucacca

SEQ ID NO: 2776851 - RNA, 13 nt, Human
gcuccagcucacc

SEQ ID NO: 2776852 - RNA, 18 nt, Human
gcuccagccccuuuccaa

SEQ ID NO: 2776853 - RNA, 19 nt, Human
gcuccagccccuuuccaaa

SEQ ID NO: 2776854 - RNA, 23 nt, Human
gcuccagcaacacagccugggcc

SEQ ID NO: 2776855 - RNA, 16 nt, Human
gcucucagcucagcgc

SEQ ID NO: 2776856 - RNA, 21 nt, Human
gcucuaugagucuagauguuu

SEQ ID NO: 2776857 - RNA, 13 nt, Human
gcucuaugagucu

SEQ ID NO: 2776858 - RNA, 14 nt, Human
gcucuaugagucua

SEQ ID NO: 2776859 - RNA, 18 nt, Human
gcucuaugagucuagaug

SEQ ID NO: 2776860 - RNA, 14 nt, Human
gcucuaucucucaa

SEQ ID NO: 2776861 - RNA, 18 nt, Human
gcucuaucucucaaaacu

SEQ ID NO: 2776862 - RNA, 20 nt, Human
gcucuagaucauaaggcuuc

SEQ ID NO: 2776863 - RNA, 19 nt, Human
gcucuaggguugcuggagc

SEQ ID NO: 2776864 - RNA, 21 nt, Human
gcucuaggguugcuggagccu

SEQ ID NO: 2776865 - RNA, 22 nt, Human
gcucuaggguugcuggagccug

SEQ ID NO: 2776866 - RNA, 23 nt, Human
gcucuaggguugcuggagccuga

SEQ ID NO: 2776867 - RNA, 24 nt, Human
gcucuaggguugcuggagccugag

SEQ ID NO: 2776868 - RNA, 23 nt, Human
gcucuagauugagagaagagaca

SEQ ID NO: 2776869 - RNA, 22 nt, Human
gcucuagaucauaaggcuucaa

SEQ ID NO: 2776870 - RNA, 14 nt, Human
gcucuagaugagcu

SEQ ID NO: 2776871 - RNA, 17 nt, Human
gcucuagaugagcuggg

SEQ ID NO: 2776872 - RNA, 18 nt, Human
gcucuagaugagcugggc

SEQ ID NO: 2776873 - RNA, 19 nt, Human
gcuccucuccccagcaagu

SEQ ID NO: 2776874 - RNA, 16 nt, Human
gcuccucuccccagca

SEQ ID NO: 2776875 - RNA, 17 nt, Human
gcucuacaucuucugcc

SEQ ID NO: 2776876 - RNA, 18 nt, Human
gcucuacaucuucugccu

SEQ ID NO: 2776877 - RNA, 15 nt, Human
gcucuacccagggcc

SEQ ID NO: 2776878 - RNA, 14 nt, Human
gcucuacccagggc

SEQ ID NO: 2776879 - RNA, 19 nt, Human
gcucuacaucuucugccuu

SEQ ID NO: 2776880 - RNA, 20 nt, Human
gcucuacaucuucugccuua

SEQ ID NO: 2776881 - RNA, 13 nt, Human
gcucuacgggggc

SEQ ID NO: 2776882 - RNA, 21 nt, Human
gcucuacuggucuuguggaau

SEQ ID NO: 2776883 - RNA, 19 nt, Human
gcucuacccagggccugca

SEQ ID NO: 2776884 - RNA, 18 nt, Human
gcucuacccagggccugc

SEQ ID NO: 2776885 - RNA, 13 nt, Human
gcucuagaaucug

SEQ ID NO: 2776886 - RNA, 17 nt, Human
gcugagguuucacccuu

SEQ ID NO: 2776887 - RNA, 20 nt, Human
gcugaguagaugcgcagccc

SEQ ID NO: 2776888 - RNA, 23 nt, Human
gcugaggcucugacccagugaga

SEQ ID NO: 2776889 - RNA, 20 nt, Human
gcugaguauggagcagccug

SEQ ID NO: 2776890 - RNA, 13 nt, Human
gcugccauccagg

SEQ ID NO: 2776891 - RNA, 12 nt, Human
gcugccauccag

SEQ ID NO: 2776892 - RNA, 12 nt, Human
gcugcaggggcu

SEQ ID NO: 2776893 - RNA, 11 nt, Human
gcugcaggggc

SEQ ID NO: 2776894 - RNA, 13 nt, Human
gcugcaggggcuc

SEQ ID NO: 2776895 - RNA, 15 nt, Human
gcugcaggggcucug

SEQ ID NO: 2776896 - RNA, 16 nt, Human
gcugcaggggcucugg

SEQ ID NO: 2776897 - RNA, 17 nt, Human
gcugcaggggcucugga

SEQ ID NO: 2776898 - RNA, 17 nt, Human
gcugcaggacuugagaa

SEQ ID NO: 2776899 - RNA, 15 nt, Human
gcugcagcugggcug

SEQ ID NO: 2776900 - RNA, 10 nt, Human
gcugcagcuu

SEQ ID NO: 2776901 - RNA, 12 nt, Human
gcugcagcuucc

SEQ ID NO: 2776902 - RNA, 13 nt, Human
gcugcagcuuccu

SEQ ID NO: 2776903 - RNA, 14 nt, Human
gcugcagcuuccug

SEQ ID NO: 2776904 - RNA, 12 nt, Human
gcugcagcuugg

SEQ ID NO: 2776905 - RNA, 13 nt, Human
gcugcagcuuggg

SEQ ID NO: 2776906 - RNA, 14 nt, Human
gcugcagcuuggga

SEQ ID NO: 2776907 - RNA, 22 nt, Human
gcugcagcuugggagagccccu

SEQ ID NO: 2776908 - RNA, 23 nt, Human
gcugcagcuugggagagccccug

SEQ ID NO: 2776909 - RNA, 15 nt, Human
gcugcaggaaucaaa

SEQ ID NO: 2776910 - RNA, 16 nt, Human
gcugcaggaaucaaaa

SEQ ID NO: 2776911 - RNA, 21 nt, Human
gcugcaggaaucaaaaauuga

SEQ ID NO: 2776912 - RNA, 22 nt, Human
gcugcaggaaucaaaaauugaa

SEQ ID NO: 2776913 - RNA, 14 nt, Human
gcugcagcuggaca

SEQ ID NO: 2776914 - RNA, 15 nt, Human
gcugcagcuggacag

SEQ ID NO: 2776915 - RNA, 16 nt, Human
gcugcagcuggacaga

SEQ ID NO: 2776916 - RNA, 17 nt, Human
gcugcagcuggacagag

SEQ ID NO: 2776917 - RNA, 18 nt, Human
gcugcagcuggacagagg

SEQ ID NO: 2776918 - RNA, 13 nt, Human
gcugcaccagagc

SEQ ID NO: 2776919 - RNA, 14 nt, Human
gcugcaccagagca

SEQ ID NO: 2776920 - RNA, 17 nt, Human
gcugcaccagagcaacc

SEQ ID NO: 2776921 - RNA, 22 nt, Human
gcugcaccagagcaaccucuca

SEQ ID NO: 2776922 - RNA, 13 nt, Human
gcuggagccugag

SEQ ID NO: 2776923 - RNA, 19 nt, Human
gcuggagccugagucaggg

SEQ ID NO: 2776924 - RNA, 23 nt, Human
gcuggagccugagucagggccca

SEQ ID NO: 2776925 - RNA, 17 nt, Human
gcuggagccuggugccc

SEQ ID NO: 2776926 - RNA, 17 nt, Human
gcugccauccagguuca

SEQ ID NO: 2776927 - RNA, 12 nt, Human
gcugcugacagu

SEQ ID NO: 2776928 - RNA, 10 nt, Human
gcugcugacc

SEQ ID NO: 2776929 - RNA, 11 nt, Human
gcugcugacca

SEQ ID NO: 2776930 - RNA, 12 nt, Human
gcugcugaccaa

SEQ ID NO: 2776931 - RNA, 21 nt, Human
gcugcugaccaauugugcugc

SEQ ID NO: 2776932 - RNA, 22 nt, Human
gcugcugaccaauugugcugcc

SEQ ID NO: 2776933 - RNA, 23 nt, Human
gcugcugaccaauugugcugcca

SEQ ID NO: 2776934 - RNA, 22 nt, Human
gcugcugucccucccccuuguc

SEQ ID NO: 2776935 - RNA, 23 nt, Human
gcugcugucccucccccuugucc

SEQ ID NO: 2776936 - RNA, 15 nt, Human
gcugcugucccuccc

SEQ ID NO: 2776937 - RNA, 16 nt, Human
gcugcugucaccucuc

SEQ ID NO: 2776938 - RNA, 17 nt, Human
gcugcugucaccucucc

SEQ ID NO: 2776939 - RNA, 21 nt, Human
gcugcugucaccucucccacg

SEQ ID NO: 2776940 - RNA, 16 nt, Human
gcugcugucccucccc

SEQ ID NO: 2776941 - RNA, 18 nt, Human
gcugcugucccucccccu

SEQ ID NO: 2776942 - RNA, 22 nt, Human
gcugcugggggcaacuggccau

SEQ ID NO: 2776943 - RNA, 21 nt, Human
gcugcugggggcaacuggcca

SEQ ID NO: 2776944 - RNA, 18 nt, Human
gcugcuggggccucagac

SEQ ID NO: 2776945 - RNA, 20 nt, Human
gcugcuggggccucagacga

SEQ ID NO: 2776946 - RNA, 15 nt, Human
gcugcuggcuugcag

SEQ ID NO: 2776947 - RNA, 15 nt, Human
gcugcugggauggug

SEQ ID NO: 2776948 - RNA, 20 nt, Human
gcugcugggauggugggcuu

SEQ ID NO: 2776949 - RNA, 23 nt, Human
gcugcugggauggugggcuucag

SEQ ID NO: 2776950 - RNA, 20 nt, Human
gaguuguggaaagccucugc

SEQ ID NO: 2776951 - RNA, 16 nt, Human
gaguuguggaaagccu

SEQ ID NO: 2776952 - RNA, 20 nt, Human
gaguuugagaccagccuggc

SEQ ID NO: 2776953 - RNA, 16 nt, Human
gaguuucuaagguccg

SEQ ID NO: 2776954 - RNA, 12 nt, Human
gaguuucuguuu

SEQ ID NO: 2776955 - RNA, 13 nt, Human
gaguuucuguuug

SEQ ID NO: 2776956 - RNA, 14 nt, Human
gaguuucuguuuga

SEQ ID NO: 2776957 - RNA, 15 nt, Human
gaguuucuguuugau

SEQ ID NO: 2776958 - RNA, 13 nt, Human
gaguuugcccugg

SEQ ID NO: 2776959 - RNA, 14 nt, Human
gaguuugccuuccu

SEQ ID NO: 2776960 - RNA, 14 nt, Human
gaguuuccuuuucu

SEQ ID NO: 2776961 - RNA, 12 nt, Human
gaguuucuaagg

SEQ ID NO: 2776962 - RNA, 13 nt, Human
gaguuucuaaggu

SEQ ID NO: 2776963 - RNA, 18 nt, Human
gaguuucauucuccugcc

SEQ ID NO: 2776964 - RNA, 19 nt, Human
gaguuucauucuccugccu

SEQ ID NO: 2776965 - RNA, 20 nt, Human
gaguuucauucuccugccug

SEQ ID NO: 2776966 - RNA, 18 nt, Human
gaguuucauguacaagau

SEQ ID NO: 2776967 - RNA, 15 nt, Human
gaguuucauguacaa

SEQ ID NO: 2776968 - RNA, 14 nt, Human
gagugcgugcucag

SEQ ID NO: 2776969 - RNA, 11 nt, Human
gagugcuaagu

SEQ ID NO: 2776970 - RNA, 15 nt, Human
gagugcuaaguguag

SEQ ID NO: 2776971 - RNA, 14 nt, Human
gagugcuggcucac

SEQ ID NO: 2776972 - RNA, 18 nt, Human
gagugcuggcucacagua

SEQ ID NO: 2776973 - RNA, 21 nt, Human
gagugcuggcucacaguacag

SEQ ID NO: 2776974 - RNA, 22 nt, Human
gagugcuggcucacaguacagc

SEQ ID NO: 2776975 - RNA, 14 nt, Human
gagugccuuuugca

SEQ ID NO: 2776976 - RNA, 18 nt, Human
gagugccuuuugcagaag

SEQ ID NO: 2776977 - RNA, 14 nt, Human
gaguugucacugcu

SEQ ID NO: 2776978 - RNA, 18 nt, Human
gaguuuguguguugucuu

SEQ ID NO: 2776979 - RNA, 13 nt, Human
gaguuuggucugg

SEQ ID NO: 2776980 - RNA, 16 nt, Human
gaguuuggucuggacu

SEQ ID NO: 2776981 - RNA, 17 nt, Human
gaguuuggucuggacug

SEQ ID NO: 2776982 - RNA, 19 nt, Human
gaguuuggucuggacugac

SEQ ID NO: 2776983 - RNA, 11 nt, Human
gaguuuguagg

SEQ ID NO: 2776984 - RNA, 23 nt, Human
gaguuuguagguaaaauguauuu

SEQ ID NO: 2776985 - RNA, 18 nt, Human
gaguuugcuauuagagca

SEQ ID NO: 2776986 - RNA, 12 nt, Human
gaggucuguuua

SEQ ID NO: 2776987 - RNA, 13 nt, Human
gaggucuguuuaa

SEQ ID NO: 2776988 - RNA, 12 nt, Human
gaggucuugcua

SEQ ID NO: 2776989 - RNA, 22 nt, Human
gaggucuugcuagaaugggaag

SEQ ID NO: 2776990 - RNA, 20 nt, Human
gaggugggaggaucuuuuga

SEQ ID NO: 2776991 - RNA, 17 nt, Human
gaggugggagcaggaga

SEQ ID NO: 2776992 - RNA, 18 nt, Human
gaggugggagcaggagau

SEQ ID NO: 2776993 - RNA, 15 nt, Human
gaggugggagcagga

SEQ ID NO: 2776994 - RNA, 14 nt, Human
gaggugggagcagg

SEQ ID NO: 2776995 - RNA, 14 nt, Human
gaggugggagggcc

SEQ ID NO: 2776996 - RNA, 23 nt, Human
gaggugggagcaggagauugaga

SEQ ID NO: 2776997 - RNA, 13 nt, Human
gaggugggagggc

SEQ ID NO: 2776998 - RNA, 12 nt, Human
gagucacacuca

SEQ ID NO: 2776999 - RNA, 13 nt, Human
gaggugccugucc

SEQ ID NO: 2777000 - RNA, 15 nt, Human
gaggugccuguccca

SEQ ID NO: 2777001 - RNA, 21 nt, Human
gaggugccugucccaccccca

SEQ ID NO: 2777002 - RNA, 12 nt, Human
gaggugccuucu

SEQ ID NO: 2777003 - RNA, 15 nt, Human
gaggugccuucuuca

SEQ ID NO: 2777004 - RNA, 20 nt, Human
gaggugccuucuucagggcc

SEQ ID NO: 2777005 - RNA, 22 nt, Human
gaggugccuucuucagggccug

SEQ ID NO: 2777006 - RNA, 23 nt, Human
gaggugccuucuucagggccugg

SEQ ID NO: 2777007 - RNA, 12 nt, Human
gaggugccugga

SEQ ID NO: 2777008 - RNA, 12 nt, Human
gagugagcuggu

SEQ ID NO: 2777009 - RNA, 13 nt, Human
gagucccaccuug

SEQ ID NO: 2777010 - RNA, 13 nt, Human
gagugagccuggc

SEQ ID NO: 2777011 - RNA, 15 nt, Human
gagugagcuacagag

SEQ ID NO: 2777012 - RNA, 22 nt, Human
gagugagcuacagagccgagca

SEQ ID NO: 2777013 - RNA, 21 nt, Human
gagucccaccuuggcugcagg

SEQ ID NO: 2777014 - RNA, 24 nt, Human
gagugagcacuaaggugugcucug

SEQ ID NO: 2777015 - RNA, 12 nt, Human
gagugcagugag

SEQ ID NO: 2777016 - RNA, 11 nt, Human
gagugcaguga

SEQ ID NO: 2777017 - RNA, 20 nt, Human
gagucccaccuuggcugcag

SEQ ID NO: 2777018 - RNA, 16 nt, Human
gagucccaccuuggcu

SEQ ID NO: 2777019 - RNA, 14 nt, Human
gagucaccaagccc

SEQ ID NO: 2777020 - RNA, 13 nt, Human
gagucaccaagcc

SEQ ID NO: 2777021 - RNA, 14 nt, Human
gaguccaggcacag

SEQ ID NO: 2777022 - RNA, 15 nt, Human
gaguccaggcacagg

SEQ ID NO: 2777023 - RNA, 16 nt, Human
gaguccaggcacagga

SEQ ID NO: 2777024 - RNA, 15 nt, Human
gagucacaagccucg

SEQ ID NO: 2777025 - RNA, 19 nt, Human
gaguccaagguuuaaagag

SEQ ID NO: 2777026 - RNA, 13 nt, Human
gauaugggacuga

SEQ ID NO: 2777027 - RNA, 20 nt, Human
gauaugggacugagccuggc

SEQ ID NO: 2777028 - RNA, 22 nt, Human
gauaugggacugagccuggccc

SEQ ID NO: 2777029 - RNA, 13 nt, Human
gauauuguacaua

SEQ ID NO: 2777030 - RNA, 14 nt, Human
gauauuguacauaa

SEQ ID NO: 2777031 - RNA, 15 nt, Human
gauauuguacauaaa

SEQ ID NO: 2777032 - RNA, 16 nt, Human
gauauuguacauaaaa

SEQ ID NO: 2777033 - RNA, 17 nt, Human
gauauuguacauaaaag

SEQ ID NO: 2777034 - RNA, 18 nt, Human
gauauuguacauaaaaga

SEQ ID NO: 2777035 - RNA, 13 nt, Human
gauauucuaagac

SEQ ID NO: 2777036 - RNA, 12 nt, Human
gauauucuaaga

SEQ ID NO: 2777037 - RNA, 15 nt, Human
gauauuauucuugua

SEQ ID NO: 2777038 - RNA, 17 nt, Human
gauauucagaauuauga

SEQ ID NO: 2777039 - RNA, 12 nt, Human
gauauuacuuua

SEQ ID NO: 2777040 - RNA, 13 nt, Human
gauauuacuuuau

SEQ ID NO: 2777041 - RNA, 14 nt, Human
gauauuacuuuauc

SEQ ID NO: 2777042 - RNA, 15 nt, Human
gauauuacuuuauca

SEQ ID NO: 2777043 - RNA, 16 nt, Human
gauauuacuuuaucac

SEQ ID NO: 2777044 - RNA, 19 nt, Human
gauauuacuuuaucacuuu

SEQ ID NO: 2777045 - RNA, 22 nt, Human
gauauuacuuuaucacuuuuug

SEQ ID NO: 2777046 - RNA, 23 nt, Human
gauauuauuagaaauuagaaaaa

SEQ ID NO: 2777047 - RNA, 18 nt, Human
gauacuucauuuaaaaaa

SEQ ID NO: 2777048 - RNA, 23 nt, Human
gauacuccgcugucggcacauuc

SEQ ID NO: 2777049 - RNA, 14 nt, Human
gauacuuauauuuu

SEQ ID NO: 2777050 - RNA, 19 nt, Human
gauacuuauauuuucguau

SEQ ID NO: 2777051 - RNA, 22 nt, Human
gauacuuauauuuucguaugaa

SEQ ID NO: 2777052 - RNA, 13 nt, Human
gauauggagaauu

SEQ ID NO: 2777053 - RNA, 19 nt, Human
gauauggagaauugcugaa

SEQ ID NO: 2777054 - RNA, 14 nt, Human
gauauggcagaaga

SEQ ID NO: 2777055 - RNA, 15 nt, Human
gauauggcagaagac

SEQ ID NO: 2777056 - RNA, 17 nt, Human
gauauggcagaagacac

SEQ ID NO: 2777057 - RNA, 18 nt, Human
gauaugcaguuuuccuua

SEQ ID NO: 2777058 - RNA, 14 nt, Human
gauaugauuuaaaa

SEQ ID NO: 2777059 - RNA, 20 nt, Human
gauaugauuuaaaacaugua

SEQ ID NO: 2777060 - RNA, 22 nt, Human
gauacuaaaaguucuucuccaa

SEQ ID NO: 2777061 - RNA, 13 nt, Human
gauacuacaucuu

SEQ ID NO: 2777062 - RNA, 20 nt, Human
gauacuaaaaguucuucucc

SEQ ID NO: 2777063 - RNA, 22 nt, Human
gauacgcuacuauaaagagaag

SEQ ID NO: 2777064 - RNA, 21 nt, Human
gauaccccccucugucuugug

SEQ ID NO: 2777065 - RNA, 14 nt, Human
gauaccuaaaacau

SEQ ID NO: 2777066 - RNA, 21 nt, Human
gauaccuaaaacauaagauca

SEQ ID NO: 2777067 - RNA, 18 nt, Human
gauacccaggaccaagcc

SEQ ID NO: 2777068 - RNA, 13 nt, Human
gauaccccccucu

SEQ ID NO: 2777069 - RNA, 22 nt, Human
gauccaugaguuugcccugguu

SEQ ID NO: 2777070 - RNA, 13 nt, Human
gauccauccagcu

SEQ ID NO: 2777071 - RNA, 18 nt, Human
gauccauccagcuugcca

SEQ ID NO: 2777072 - RNA, 13 nt, Human
gaucuccugaccu

SEQ ID NO: 2777073 - RNA, 14 nt, Human
gaucucuuccuguu

SEQ ID NO: 2777074 - RNA, 23 nt, Human
gauauguuuuauuucauugguua

SEQ ID NO: 2777075 - RNA, 22 nt, Human
gauauuuuuaaagaucuguaag

SEQ ID NO: 2777076 - RNA, 19 nt, Human
gauccaggaagcaugagug

SEQ ID NO: 2777077 - RNA, 14 nt, Human
gaucuccuugcccu

SEQ ID NO: 2777078 - RNA, 16 nt, Human
gaucucggcucagugc

SEQ ID NO: 2777079 - RNA, 14 nt, Human
gaugaucuuugcag

SEQ ID NO: 2777080 - RNA, 22 nt, Human
gaugagcccucagaacccuugg

SEQ ID NO: 2777081 - RNA, 19 nt, Human
gaugagcccucagaacccu

SEQ ID NO: 2777082 - RNA, 13 nt, Human
gaugagccgcugu

SEQ ID NO: 2777083 - RNA, 23 nt, Human
gaugagccgcugugagccccugg

SEQ ID NO: 2777084 - RNA, 22 nt, Human
gaugagccuucgugcccccccu

SEQ ID NO: 2777085 - RNA, 15 nt, Human
gaugagcccucagaa

SEQ ID NO: 2777086 - RNA, 21 nt, Human
gaugagcccagcccuguucug

SEQ ID NO: 2777087 - RNA, 20 nt, Human
gaugagcccagcccuguucu

SEQ ID NO: 2777088 - RNA, 20 nt, Human
gaugagauuggcauggcuuu

SEQ ID NO: 2777089 - RNA, 16 nt, Human
gaugagcaucccagga

SEQ ID NO: 2777090 - RNA, 17 nt, Human
gaugagcaucccaggau

SEQ ID NO: 2777091 - RNA, 15 nt, Human
gaugagcauggagcu

SEQ ID NO: 2777092 - RNA, 16 nt, Human
gaugagcauggagcug

SEQ ID NO: 2777093 - RNA, 17 nt, Human
gaugagcauggagcugg

SEQ ID NO: 2777094 - RNA, 21 nt, Human
gaugaucuuugcagacaggca

SEQ ID NO: 2777095 - RNA, 20 nt, Human
gaugaucuuugcagacaggc

SEQ ID NO: 2777096 - RNA, 17 nt, Human
gaugcuggaugucugcc

SEQ ID NO: 2777097 - RNA, 20 nt, Human
gaugcuggaugucugccaau

SEQ ID NO: 2777098 - RNA, 22 nt, Human
gaugcuggaugucugccaauuu

SEQ ID NO: 2777099 - RNA, 18 nt, Human
gauuauuugggagggaaa

SEQ ID NO: 2777100 - RNA, 21 nt, Human
gauuauuugggagggaaaagg

SEQ ID NO: 2777101 - RNA, 21 nt, Human
gauuauuuaauaacauuaccu

SEQ ID NO: 2777102 - RNA, 22 nt, Human
gauuauuuaauaacauuaccuu

SEQ ID NO: 2777103 - RNA, 23 nt, Human
gauuauuuaauaacauuaccuua

SEQ ID NO: 2777104 - RNA, 12 nt, Human
gauuauuuaaua

SEQ ID NO: 2777105 - RNA, 13 nt, Human
gauuauuuaauaa

SEQ ID NO: 2777106 - RNA, 14 nt, Human
gauuauuuaauaac

SEQ ID NO: 2777107 - RNA, 15 nt, Human
gauuauuuaauaaca

SEQ ID NO: 2777108 - RNA, 16 nt, Human
gauuauuuaauaacau

SEQ ID NO: 2777109 - RNA, 17 nt, Human
gauuauuuaauaacauu

SEQ ID NO: 2777110 - RNA, 18 nt, Human
gauuauuuaauaacauua

SEQ ID NO: 2777111 - RNA, 14 nt, Human
gauuauuuucauua

SEQ ID NO: 2777112 - RNA, 11 nt, Human
gauuauuuugg

SEQ ID NO: 2777113 - RNA, 14 nt, Human
gauuauuuuggaaa

SEQ ID NO: 2777114 - RNA, 23 nt, Human
gauuauuuuggaaaguuuuugua

SEQ ID NO: 2777115 - RNA, 23 nt, Human
gauuagcaggccaaggucugagc

SEQ ID NO: 2777116 - RNA, 13 nt, Human
gauuagcuuugug

SEQ ID NO: 2777117 - RNA, 14 nt, Human
gauuagcuuugugu

SEQ ID NO: 2777118 - RNA, 15 nt, Human
gauuagcuuuguguu

SEQ ID NO: 2777119 - RNA, 16 nt, Human
gauuagcuuuguguuu

SEQ ID NO: 2777120 - RNA, 17 nt, Human
gauuagcuuuguguuug

SEQ ID NO: 2777121 - RNA, 19 nt, Human
gauuagcaaggucauuucu

SEQ ID NO: 2777122 - RNA, 20 nt, Human
gauuagcaaggucauuucuu

SEQ ID NO: 2777123 - RNA, 18 nt, Human
gauuaugucuuuuauauu

SEQ ID NO: 2777124 - RNA, 20 nt, Human
gauuaugucuuuuauauuug

SEQ ID NO: 2777125 - RNA, 21 nt, Human
gauuaugucuuuuauauuugu

SEQ ID NO: 2777126 - RNA, 16 nt, Human
gauuaguuuucuuguu

SEQ ID NO: 2777127 - RNA, 22 nt, Human
gauuaguuuucuuguugcuuug

SEQ ID NO: 2777128 - RNA, 23 nt, Human
gauuaguuuucuuguugcuuugu

SEQ ID NO: 2777129 - RNA, 19 nt, Human
gauuauaaaauuaaucaca

SEQ ID NO: 2777130 - RNA, 20 nt, Human
gauuauaaaauuaaucacaa

SEQ ID NO: 2777131 - RNA, 10 nt, Human
gauuagcuuu

SEQ ID NO: 2777132 - RNA, 12 nt, Human
gauuagcuuugu

SEQ ID NO: 2777133 - RNA, 14 nt, Human
gauuacaugcaugu

SEQ ID NO: 2777134 - RNA, 17 nt, Human
gauuagaagcugaaaac

SEQ ID NO: 2777135 - RNA, 19 nt, Human
gauuagaaaaauuccuaag

SEQ ID NO: 2777136 - RNA, 19 nt, Human
gaugcugggaguucuaaca

SEQ ID NO: 2777137 - RNA, 11 nt, Human
gaugcugggau

SEQ ID NO: 2777138 - RNA, 21 nt, Human
gaugcugggcacuucaucuga

SEQ ID NO: 2777139 - RNA, 23 nt, Human
gaugcugggcacuucaucugauc

SEQ ID NO: 2777140 - RNA, 20 nt, Human
gauuacaggugugaaccacc

SEQ ID NO: 2777141 - RNA, 20 nt, Human
gauuacaggugugagccacc

SEQ ID NO: 2777142 - RNA, 19 nt, Human
gaugugaaacacuuugccu

SEQ ID NO: 2777143 - RNA, 22 nt, Human
gauucucuggcuguaaggcucu

SEQ ID NO: 2777144 - RNA, 23 nt, Human
gauucucuggcuguaaggcucua

SEQ ID NO: 2777145 - RNA, 15 nt, Human
gauucucugugucua

SEQ ID NO: 2777146 - RNA, 23 nt, Human
gauucucugugucuaagauucua

SEQ ID NO: 2777147 - RNA, 18 nt, Human
gauucucugugucuaaga

SEQ ID NO: 2777148 - RNA, 22 nt, Human
gauucucugugucuaagauucu

SEQ ID NO: 2777149 - RNA, 12 nt, Human
gcaguuuuucag

SEQ ID NO: 2777150 - RNA, 14 nt, Human
gcaguuuuucagga

SEQ ID NO: 2777151 - RNA, 23 nt, Human
gcaguuuuucaggagcgcaagau

SEQ ID NO: 2777152 - RNA, 17 nt, Human
gcaguuugguauuugcg

SEQ ID NO: 2777153 - RNA, 20 nt, Human
gcaguuuugacaucagccag

SEQ ID NO: 2777154 - RNA, 21 nt, Human
gcaguuuugacaucagccagc

SEQ ID NO: 2777155 - RNA, 22 nt, Human
gcaguuuugacaucagccagcu

SEQ ID NO: 2777156 - RNA, 16 nt, Human
gcaguuucuguccugc

SEQ ID NO: 2777157 - RNA, 20 nt, Human
gcaguuucuguccugcuggu

SEQ ID NO: 2777158 - RNA, 18 nt, Human
gcaguccugccucagccu

SEQ ID NO: 2777159 - RNA, 17 nt, Human
gcaguccugccucagcc

SEQ ID NO: 2777160 - RNA, 23 nt, Human
gcagucccugagaccauuuaaca

SEQ ID NO: 2777161 - RNA, 21 nt, Human
gcaguccguguggauccaaug

SEQ ID NO: 2777162 - RNA, 13 nt, Human
gcaguccuggagc

SEQ ID NO: 2777163 - RNA, 15 nt, Human
gcaguccuuuguaaa

SEQ ID NO: 2777164 - RNA, 22 nt, Human
gcaguccuuuguaaacaguguu

SEQ ID NO: 2777165 - RNA, 23 nt, Human
gcaguccuuuuacuacagcuaug

SEQ ID NO: 2777166 - RNA, 12 nt, Human
gcaguccaugca

SEQ ID NO: 2777167 - RNA, 13 nt, Human
gcaguccaugcau

SEQ ID NO: 2777168 - RNA, 14 nt, Human
gcaguccaugcaug

SEQ ID NO: 2777169 - RNA, 16 nt, Human
gcaguccaugcaugac

SEQ ID NO: 2777170 - RNA, 16 nt, Human
gcaguccauuucuacc

SEQ ID NO: 2777171 - RNA, 19 nt, Human
gcauaccuuucacagcuuu

SEQ ID NO: 2777172 - RNA, 19 nt, Human
gcagcugcgguccacccag

SEQ ID NO: 2777173 - RNA, 17 nt, Human
gcagcugcgguccaccc

SEQ ID NO: 2777174 - RNA, 14 nt, Human
gcaggcuggcccug

SEQ ID NO: 2777175 - RNA, 18 nt, Human
gcaggcuggcccugcccu

SEQ ID NO: 2777176 - RNA, 17 nt, Human
gcaggcuggcccugccc

SEQ ID NO: 2777177 - RNA, 16 nt, Human
gcaggcuggcccugcc

SEQ ID NO: 2777178 - RNA, 15 nt, Human
gcaggcuggcccugc

SEQ ID NO: 2777179 - RNA, 13 nt, Human
gcaggcugggcca

SEQ ID NO: 2777180 - RNA, 12 nt, Human
gcaggcugggcc

SEQ ID NO: 2777181 - RNA, 11 nt, Human
gcaggcugggc

SEQ ID NO: 2777182 - RNA, 10 nt, Human
gcaggcuggg

SEQ ID NO: 2777183 - RNA, 15 nt, Human
gcaggcugggccaug

SEQ ID NO: 2777184 - RNA, 14 nt, Human
gcaggcugggccau

SEQ ID NO: 2777185 - RNA, 23 nt, Human
gcaggcugggccauguccaaaga

SEQ ID NO: 2777186 - RNA, 18 nt, Human
gcaggcuuaauaaaaaug

SEQ ID NO: 2777187 - RNA, 22 nt, Human
gcaggcuuaauaaaaaugacag

SEQ ID NO: 2777188 - RNA, 21 nt, Human
gcaggcuggcccugcccuggu

SEQ ID NO: 2777189 - RNA, 20 nt, Human
gcaggcuggcccugcccugg

SEQ ID NO: 2777190 - RNA, 19 nt, Human
gcaggcuggcccugcccug

SEQ ID NO: 2777191 - RNA, 13 nt, Human
gcagggaaacagc

SEQ ID NO: 2777192 - RNA, 15 nt, Human
gcagcugcgcgggcu

SEQ ID NO: 2777193 - RNA, 22 nt, Human
gcagggagccgagaucacgcca

SEQ ID NO: 2777194 - RNA, 22 nt, Human
gcagguugaggggcuccuggaa

SEQ ID NO: 2777195 - RNA, 21 nt, Human
gcagguugaggggcuccugga

SEQ ID NO: 2777196 - RNA, 20 nt, Human
gcagguugaggggcuccugg

SEQ ID NO: 2777197 - RNA, 19 nt, Human
gcagguugaggggcuccug

SEQ ID NO: 2777198 - RNA, 14 nt, Human
gcagguuggacccc

SEQ ID NO: 2777199 - RNA, 15 nt, Human
gcagguuggacccca

SEQ ID NO: 2777200 - RNA, 18 nt, Human
gcagguuggaccccagag

SEQ ID NO: 2777201 - RNA, 19 nt, Human
gcagguuggaccccagaga

SEQ ID NO: 2777202 - RNA, 16 nt, Human
gcagguugaggggcuc

SEQ ID NO: 2777203 - RNA, 14 nt, Human
gcagggagggcagu

SEQ ID NO: 2777204 - RNA, 18 nt, Human
gcagggagggcaguuuuc

SEQ ID NO: 2777205 - RNA, 13 nt, Human
gcagggagggccu

SEQ ID NO: 2777206 - RNA, 10 nt, Human
gcagggaggg

SEQ ID NO: 2777207 - RNA, 16 nt, Human
gcaguacaauaaaagu

SEQ ID NO: 2777208 - RNA, 17 nt, Human
gcaguacaauaaaagua

SEQ ID NO: 2777209 - RNA, 13 nt, Human
gcaguacauggga

SEQ ID NO: 2777210 - RNA, 15 nt, Human
gcaguaaauuugcua

SEQ ID NO: 2777211 - RNA, 19 nt, Human
gcaguagaaauaauaugca

SEQ ID NO: 2777212 - RNA, 20 nt, Human
gcaguagaaauaauaugcau

SEQ ID NO: 2777213 - RNA, 21 nt, Human
gcaguagaaauaauaugcauu

SEQ ID NO: 2777214 - RNA, 13 nt, Human
gcaguagacauuu

SEQ ID NO: 2777215 - RNA, 16 nt, Human
gcaguagacauuuuaa

SEQ ID NO: 2777216 - RNA, 19 nt, Human
gcaguagacauuuuaacaa

SEQ ID NO: 2777217 - RNA, 21 nt, Human
gcaguagacauuuuaacaaga

SEQ ID NO: 2777218 - RNA, 21 nt, Human
gcagucacuucggccagagcu

SEQ ID NO: 2777219 - RNA, 14 nt, Human
gcagucaucagaag

SEQ ID NO: 2777220 - RNA, 24 nt, Human
gcagucacguggaggagcagugca

SEQ ID NO: 2777221 - RNA, 12 nt, Human
gcaguauauuuc

SEQ ID NO: 2777222 - RNA, 21 nt, Human
gcaguagaggcuauggacagg

SEQ ID NO: 2777223 - RNA, 20 nt, Human
gcaguaggccggugugccug

SEQ ID NO: 2777224 - RNA, 13 nt, Human
gcaguaggggagg

SEQ ID NO: 2777225 - RNA, 13 nt, Human
gcagccaccagcg

SEQ ID NO: 2777226 - RNA, 15 nt, Human
gcagagcccccagga

SEQ ID NO: 2777227 - RNA, 17 nt, Human
gcagagcccccaggaag

SEQ ID NO: 2777228 - RNA, 21 nt, Human
gcagagcaccuuugcacagga

SEQ ID NO: 2777229 - RNA, 22 nt, Human
gcagagcaccuuugcacaggau

SEQ ID NO: 2777230 - RNA, 18 nt, Human
gcagcccagagacuuugu

SEQ ID NO: 2777231 - RNA, 14 nt, Human
gcagcccagagacu

SEQ ID NO: 2777232 - RNA, 22 nt, Human
gcagcccagagacuuuguagau

SEQ ID NO: 2777233 - RNA, 13 nt, Human
gcagcccagagac

SEQ ID NO: 2777234 - RNA, 17 nt, Human
gcagccccaucugugca

SEQ ID NO: 2777235 - RNA, 20 nt, Human
gcagagccucccaaggagaa

SEQ ID NO: 2777236 - RNA, 20 nt, Human
gcagcccaugcccaccugcc

SEQ ID NO: 2777237 - RNA, 22 nt, Human
gcagcccaugcccaccugccca

SEQ ID NO: 2777238 - RNA, 18 nt, Human
gcagcccauuucuccaga

SEQ ID NO: 2777239 - RNA, 19 nt, Human
gcagcccauuucuccagaa

SEQ ID NO: 2777240 - RNA, 21 nt, Human
gcagcccauuucuccagaacc

SEQ ID NO: 2777241 - RNA, 22 nt, Human
gcagcccauuucuccagaaccc

SEQ ID NO: 2777242 - RNA, 18 nt, Human
gcagcccaugcccaccug

SEQ ID NO: 2777243 - RNA, 17 nt, Human
gcagcccaugcccaccu

SEQ ID NO: 2777244 - RNA, 15 nt, Human
gcagcccaugcccac

SEQ ID NO: 2777245 - RNA, 13 nt, Human
gcagcccaugccc

SEQ ID NO: 2777246 - RNA, 17 nt, Human
gcagcccaggccggggu

SEQ ID NO: 2777247 - RNA, 13 nt, Human
gcacauauggacu

SEQ ID NO: 2777248 - RNA, 18 nt, Human
gcacauauggacucugca

SEQ ID NO: 2777249 - RNA, 12 nt, Human
gcacaguuugaa

SEQ ID NO: 2777250 - RNA, 13 nt, Human
gcacaguuugaac

SEQ ID NO: 2777251 - RNA, 14 nt, Human
gcacaguuugaaca

SEQ ID NO: 2777252 - RNA, 19 nt, Human
gcacaauuugcacuaaauc

SEQ ID NO: 2777253 - RNA, 14 nt, Human
gcacaauuugcacu

SEQ ID NO: 2777254 - RNA, 12 nt, Human
gcacaauuugca

SEQ ID NO: 2777255 - RNA, 16 nt, Human
gcacaauucuguuuua

SEQ ID NO: 2777256 - RNA, 12 nt, Human
gcacacacacaa

SEQ ID NO: 2777257 - RNA, 10 nt, Human
gcacacacac

SEQ ID NO: 2777258 - RNA, 15 nt, Human
gcacacacacacaua

SEQ ID NO: 2777259 - RNA, 21 nt, Human
gcacacacacacacaugcaca

SEQ ID NO: 2777260 - RNA, 22 nt, Human
gcacacacacacacaugcacac

SEQ ID NO: 2777261 - RNA, 14 nt, Human
gcacacacacacau

SEQ ID NO: 2777262 - RNA, 21 nt, Human
gcacacacacacacacacauc

SEQ ID NO: 2777263 - RNA, 14 nt, Human
gcacaauucuguuu

SEQ ID NO: 2777264 - RNA, 22 nt, Human
gcacaaucucggcucacugcau

SEQ ID NO: 2777265 - RNA, 21 nt, Human
gcacaaucucggcucacugca

SEQ ID NO: 2777266 - RNA, 13 nt, Human
gcacaugaagaaa

SEQ ID NO: 2777267 - RNA, 15 nt, Human
gcacaugaagaaaua

SEQ ID NO: 2777268 - RNA, 16 nt, Human
gcacaugaagaaauac

SEQ ID NO: 2777269 - RNA, 21 nt, Human
gcacaucugcauuuucacccc

SEQ ID NO: 2777270 - RNA, 13 nt, Human
gcacaucugcauu

SEQ ID NO: 2777271 - RNA, 15 nt, Human
gcacaguuugaacaa

SEQ ID NO: 2777272 - RNA, 16 nt, Human
gcacccuccgccuuca

SEQ ID NO: 2777273 - RNA, 12 nt, Human
gcacccucuggc

SEQ ID NO: 2777274 - RNA, 14 nt, Human
gcacccuggggccu

SEQ ID NO: 2777275 - RNA, 15 nt, Human
gcacccuggggccug

SEQ ID NO: 2777276 - RNA, 17 nt, Human
gcacaugcaccuaccca

SEQ ID NO: 2777277 - RNA, 22 nt, Human
gcaccgcggcgcuucccagcac

SEQ ID NO: 2777278 - RNA, 20 nt, Human
gcaccgcuuuuguucucgca

SEQ ID NO: 2777279 - RNA, 22 nt, Human
gcaccgcuuuuguucucgcaaa

SEQ ID NO: 2777280 - RNA, 12 nt, Human
gcacccuucuuu

SEQ ID NO: 2777281 - RNA, 17 nt, Human
gcacccuggggccugga

SEQ ID NO: 2777282 - RNA, 20 nt, Human
gcacccuggggccuggaccu

SEQ ID NO: 2777283 - RNA, 21 nt, Human
gcacccuggggccuggaccug

SEQ ID NO: 2777284 - RNA, 17 nt, Human
gcacccuguggcccugg

SEQ ID NO: 2777285 - RNA, 18 nt, Human
gcacccuguggcccuggc

SEQ ID NO: 2777286 - RNA, 19 nt, Human
gcacccuguggcccuggcu

SEQ ID NO: 2777287 - RNA, 15 nt, Human
gcacccuucuuuucu

SEQ ID NO: 2777288 - RNA, 18 nt, Human
gcacccuucuuuucucau

SEQ ID NO: 2777289 - RNA, 14 nt, Human
gcaccguacugugg

SEQ ID NO: 2777290 - RNA, 13 nt, Human
gcaagugagagcu

SEQ ID NO: 2777291 - RNA, 21 nt, Human
gcaagucuuuaggucuuugua

SEQ ID NO: 2777292 - RNA, 22 nt, Human
gcaagucuuuaggucuuuguaa

SEQ ID NO: 2777293 - RNA, 18 nt, Human
gcaagucugagggucugg

SEQ ID NO: 2777294 - RNA, 15 nt, Human
gcaaguccuuuugua

SEQ ID NO: 2777295 - RNA, 17 nt, Human
gcaaguccuuuuguaaa

SEQ ID NO: 2777296 - RNA, 18 nt, Human
gcaaguccuuuuguaaag

SEQ ID NO: 2777297 - RNA, 19 nt, Human
gcaaguccuuuuguaaagu

SEQ ID NO: 2777298 - RNA, 17 nt, Human
gcaagugagagagaugg

SEQ ID NO: 2777299 - RNA, 22 nt, Human
gcaagugagagagaugggagcu

SEQ ID NO: 2777300 - RNA, 12 nt, Human
gcaauaacuucu

SEQ ID NO: 2777301 - RNA, 14 nt, Human
gcaauaacuucuga

SEQ ID NO: 2777302 - RNA, 15 nt, Human
gcaauaacuucugac

SEQ ID NO: 2777303 - RNA, 17 nt, Human
gcaauaacuucugaccu

SEQ ID NO: 2777304 - RNA, 19 nt, Human
gcaccuaaaccaccagugc

SEQ ID NO: 2777305 - RNA, 21 nt, Human
gcaccuaaaccaccagugccc

SEQ ID NO: 2777306 - RNA, 23 nt, Human
gcaccuaaaccaccagugcccaa

SEQ ID NO: 2777307 - RNA, 18 nt, Human
gcagaaauagguuagagu

SEQ ID NO: 2777308 - RNA, 21 nt, Human
gcagagagccauuuugugaau

SEQ ID NO: 2777309 - RNA, 19 nt, Human
gcagagagcggucucaggc

SEQ ID NO: 2777310 - RNA, 10 nt, Human
gcagagagag

SEQ ID NO: 2777311 - RNA, 17 nt, Human
gcagagagagagaaaga

SEQ ID NO: 2777312 - RNA, 20 nt, Human
gcagagagaugcggccaaga

SEQ ID NO: 2777313 - RNA, 15 nt, Human
gcagagagccauuuu

SEQ ID NO: 2777314 - RNA, 19 nt, Human
gcagagagccauuuuguga

SEQ ID NO: 2777315 - RNA, 22 nt, Human
gcagagauuggaaugggcagcu

SEQ ID NO: 2777316 - RNA, 23 nt, Human
gcagagauuggaaugggcagcuc

SEQ ID NO: 2777317 - RNA, 20 nt, Human
gcagagcaggggcaggguga

SEQ ID NO: 2777318 - RNA, 14 nt, Human
gcagagcaggggca

SEQ ID NO: 2777319 - RNA, 14 nt, Human
gcacugacccuucc

SEQ ID NO: 2777320 - RNA, 15 nt, Human
gcacugacccuucca

SEQ ID NO: 2777321 - RNA, 16 nt, Human
gcacugacccuuccag

SEQ ID NO: 2777322 - RNA, 17 nt, Human
gcacugacccuuccaga

SEQ ID NO: 2777323 - RNA, 20 nt, Human
gcacugacccuuccagacau

SEQ ID NO: 2777324 - RNA, 21 nt, Human
gcacugacccuuccagacaua

SEQ ID NO: 2777325 - RNA, 20 nt, Human
gcacuugugauuauuuauua

SEQ ID NO: 2777326 - RNA, 21 nt, Human
gcacuugugauuauuuauuau

SEQ ID NO: 2777327 - RNA, 23 nt, Human
gcacuugugauuauuuauuauuu

SEQ ID NO: 2777328 - RNA, 15 nt, Human
gcacuuguauauacg

SEQ ID NO: 2777329 - RNA, 18 nt, Human
gcacuuuaaaugaagcua

SEQ ID NO: 2777330 - RNA, 17 nt, Human
gcacuugugauuauuua

SEQ ID NO: 2777331 - RNA, 21 nt, Human
gcacuugucucauuuuaaugu

SEQ ID NO: 2777332 - RNA, 23 nt, Human
gcacuugucucauuuuaauguaa

SEQ ID NO: 2777333 - RNA, 12 nt, Human
gcacuuguauau

SEQ ID NO: 2777334 - RNA, 18 nt, Human
gcagaaagguucugcccg

SEQ ID NO: 2777335 - RNA, 21 nt, Human
gcagaaagcugugaacaggcu

SEQ ID NO: 2777336 - RNA, 21 nt, Human
gcagaaaggaaaaccugaaga

SEQ ID NO: 2777337 - RNA, 23 nt, Human
gcagaaaggaaaaccugaagacu

SEQ ID NO: 2777338 - RNA, 21 nt, Human
gcagaaagguucugcccggga

SEQ ID NO: 2777339 - RNA, 19 nt, Human
gcagaaauccugcaaugaa

SEQ ID NO: 2777340 - RNA, 16 nt, Human
gcacuuucuaauguuu

SEQ ID NO: 2777341 - RNA, 17 nt, Human
gcacuuucuaauguuuc

SEQ ID NO: 2777342 - RNA, 19 nt, Human
gcacuuuccacuucuuccu

SEQ ID NO: 2777343 - RNA, 20 nt, Human
gcacuuuccacuucuuccuu

SEQ ID NO: 2777344 - RNA, 23 nt, Human
gcacuuuccacuucuuccuuucu

SEQ ID NO: 2777345 - RNA, 23 nt, Human
gcacuuuccgucaacguuguacu

SEQ ID NO: 2777346 - RNA, 17 nt, Human
gcacugaagugcuuagu

SEQ ID NO: 2777347 - RNA, 12 nt, Human
gcacugacauug

SEQ ID NO: 2777348 - RNA, 23 nt, Human
gacugggucucgcuuuguugccc

SEQ ID NO: 2777349 - RNA, 15 nt, Human
gacugguccugugug

SEQ ID NO: 2777350 - RNA, 11 nt, Human
gacuuuccucu

SEQ ID NO: 2777351 - RNA, 21 nt, Human
gacuuuucuuuguggcuuccu

SEQ ID NO: 2777352 - RNA, 15 nt, Human
gacuuuuguacaucu

SEQ ID NO: 2777353 - RNA, 19 nt, Human
gacuuuuguacaucuggcu

SEQ ID NO: 2777354 - RNA, 20 nt, Human
gacuuuuguacaucuggcuu

SEQ ID NO: 2777355 - RNA, 22 nt, Human
gacuuuucuuaacaaccuggcc

SEQ ID NO: 2777356 - RNA, 18 nt, Human
gagaagucuuucaagaau

SEQ ID NO: 2777357 - RNA, 20 nt, Human
gagaagucuuucaagaauga

SEQ ID NO: 2777358 - RNA, 21 nt, Human
gagaaucauacuuagcaaagu

SEQ ID NO: 2777359 - RNA, 14 nt, Human
gagacccccacacc

SEQ ID NO: 2777360 - RNA, 13 nt, Human
gagacccccacac

SEQ ID NO: 2777361 - RNA, 12 nt, Human
gagacccccaca

SEQ ID NO: 2777362 - RNA, 12 nt, Human
gagacccaggac

SEQ ID NO: 2777363 - RNA, 15 nt, Human
gagacccaagggcag

SEQ ID NO: 2777364 - RNA, 17 nt, Human
gagacccaccccaccug

SEQ ID NO: 2777365 - RNA, 19 nt, Human
gagacccaccccaccugca

SEQ ID NO: 2777366 - RNA, 20 nt, Human
gagacccaccccaccugcag

SEQ ID NO: 2777367 - RNA, 22 nt, Human
gagacguuuuuggaagaguagu

SEQ ID NO: 2777368 - RNA, 16 nt, Human
gagacuagauugccuu

SEQ ID NO: 2777369 - RNA, 15 nt, Human
gagacuacuaagagg

SEQ ID NO: 2777370 - RNA, 12 nt, Human
gagaccugcccc

SEQ ID NO: 2777371 - RNA, 11 nt, Human
gagaccugccc

SEQ ID NO: 2777372 - RNA, 13 nt, Human
gagaccuccugcc

SEQ ID NO: 2777373 - RNA, 15 nt, Human
gagaccuccugccuc

SEQ ID NO: 2777374 - RNA, 16 nt, Human
gagaccuccugccucc

SEQ ID NO: 2777375 - RNA, 15 nt, Human
gagaccugaagugug

SEQ ID NO: 2777376 - RNA, 16 nt, Human
gagaccucccuguuca

SEQ ID NO: 2777377 - RNA, 23 nt, Human
gagaccucccuguucaaggcccc

SEQ ID NO: 2777378 - RNA, 15 nt, Human
gagacccucugccac

SEQ ID NO: 2777379 - RNA, 21 nt, Human
gagacccucugccaccagaga

SEQ ID NO: 2777380 - RNA, 22 nt, Human
gagacccugcaaacagaacagg

SEQ ID NO: 2777381 - RNA, 23 nt, Human
gagacccccacaccucaguuccc

SEQ ID NO: 2777382 - RNA, 15 nt, Human
gagacccccacaccu

SEQ ID NO: 2777383 - RNA, 23 nt, Human
gagacccucgcccaacuccacca

SEQ ID NO: 2777384 - RNA, 16 nt, Human
gagaccuauguaagaa

SEQ ID NO: 2777385 - RNA, 20 nt, Human
gagaaggacccggaggggcc

SEQ ID NO: 2777386 - RNA, 15 nt, Human
gagaaggaaagcuuu

SEQ ID NO: 2777387 - RNA, 22 nt, Human
gagaaggacccggaggggccug

SEQ ID NO: 2777388 - RNA, 13 nt, Human
gagaagccuucag

SEQ ID NO: 2777389 - RNA, 14 nt, Human
gagaagccuucagc

SEQ ID NO: 2777390 - RNA, 18 nt, Human
gagaagccuucagcucca

SEQ ID NO: 2777391 - RNA, 16 nt, Human
gagaagcggauuucca

SEQ ID NO: 2777392 - RNA, 23 nt, Human
gacuagccccuguggagacuggg

SEQ ID NO: 2777393 - RNA, 19 nt, Human
gacuaugaacuucucucag

SEQ ID NO: 2777394 - RNA, 20 nt, Human
gacuaugaacuucucucaga

SEQ ID NO: 2777395 - RNA, 20 nt, Human
gacuauuuaaacuuauaaau

SEQ ID NO: 2777396 - RNA, 21 nt, Human
gacuauuuaaacuuauaaauc

SEQ ID NO: 2777397 - RNA, 23 nt, Human
gacuauuuaaacuuauaaaucau

SEQ ID NO: 2777398 - RNA, 22 nt, Human
gacuauuugcuuauuuaauaaa

SEQ ID NO: 2777399 - RNA, 13 nt, Human
gacuaucagccca

SEQ ID NO: 2777400 - RNA, 21 nt, Human
gacuaucccaacagucauguu

SEQ ID NO: 2777401 - RNA, 22 nt, Human
gacuaucccaacagucauguuu

SEQ ID NO: 2777402 - RNA, 21 nt, Human
gacuagggauucaggcugcuu

SEQ ID NO: 2777403 - RNA, 18 nt, Human
gacuaggguccuggggaa

SEQ ID NO: 2777404 - RNA, 16 nt, Human
gacuaggguccugggg

SEQ ID NO: 2777405 - RNA, 15 nt, Human
gacuaggguccuggg

SEQ ID NO: 2777406 - RNA, 21 nt, Human
gacuagccccuguggagacug

SEQ ID NO: 2777407 - RNA, 20 nt, Human
gacuagggauucaggcugcu

SEQ ID NO: 2777408 - RNA, 19 nt, Human
gacuagggauucaggcugc

SEQ ID NO: 2777409 - RNA, 18 nt, Human
gacuagggauucaggcug

SEQ ID NO: 2777410 - RNA, 17 nt, Human
gacuagggauucaggcu

SEQ ID NO: 2777411 - RNA, 20 nt, Human
gacugaaaaccucuccucau

SEQ ID NO: 2777412 - RNA, 20 nt, Human
gacugaaaauauauaagcuc

SEQ ID NO: 2777413 - RNA, 18 nt, Human
gacugaaaaccucuccuc

SEQ ID NO: 2777414 - RNA, 17 nt, Human
gacugaaaaccucuccu

SEQ ID NO: 2777415 - RNA, 16 nt, Human
gacugaaaaccucucc

SEQ ID NO: 2777416 - RNA, 19 nt, Human
gacucuuuuuagggccagg

SEQ ID NO: 2777417 - RNA, 20 nt, Human
gacucuuuuuagggccaggc

SEQ ID NO: 2777418 - RNA, 22 nt, Human
gacucuuuuuagggccaggcag

SEQ ID NO: 2777419 - RNA, 19 nt, Human
gacuauucuguaucuuuca

SEQ ID NO: 2777420 - RNA, 19 nt, Human
gacucuuguuuucaguuuc

SEQ ID NO: 2777421 - RNA, 20 nt, Human
gacucuuuagcaaaaaaaac

SEQ ID NO: 2777422 - RNA, 18 nt, Human
gacucuggugccuccaga

SEQ ID NO: 2777423 - RNA, 19 nt, Human
gacucugguuucucauucu

SEQ ID NO: 2777424 - RNA, 17 nt, Human
gacucuguaacaucacu

SEQ ID NO: 2777425 - RNA, 12 nt, Human
gacucugucuca

SEQ ID NO: 2777426 - RNA, 16 nt, Human
gacucuggcuuggccu

SEQ ID NO: 2777427 - RNA, 17 nt, Human
gacucuggcuuggccua

SEQ ID NO: 2777428 - RNA, 18 nt, Human
gacucugggcuauggaca

SEQ ID NO: 2777429 - RNA, 19 nt, Human
gacucugggcuauggacac

SEQ ID NO: 2777430 - RNA, 20 nt, Human
gacucugggcuauggacaca

SEQ ID NO: 2777431 - RNA, 21 nt, Human
gacucugggcuauggacacag

SEQ ID NO: 2777432 - RNA, 22 nt, Human
gacucugggcuauggacacagg

SEQ ID NO: 2777433 - RNA, 16 nt, Human
gacucugccuccucuu

SEQ ID NO: 2777434 - RNA, 14 nt, Human
gacucugcacauga

SEQ ID NO: 2777435 - RNA, 15 nt, Human
gacucugcacauguc

SEQ ID NO: 2777436 - RNA, 14 nt, Human
gacucucugugacc

SEQ ID NO: 2777437 - RNA, 15 nt, Human
gacucucugugaccu

SEQ ID NO: 2777438 - RNA, 22 nt, Human
gacucaaaacccaucugggcuc

SEQ ID NO: 2777439 - RNA, 23 nt, Human
gacucaaaacccaucugggcucc

SEQ ID NO: 2777440 - RNA, 19 nt, Human
gacucucugugaccugccc

SEQ ID NO: 2777441 - RNA, 19 nt, Human
gacucugaggcucuuucug

SEQ ID NO: 2777442 - RNA, 17 nt, Human
gacucugagcgggaggc

SEQ ID NO: 2777443 - RNA, 19 nt, Human
gacucugagcgggaggcag

SEQ ID NO: 2777444 - RNA, 20 nt, Human
gacucugagcgggaggcaga

SEQ ID NO: 2777445 - RNA, 21 nt, Human
gacucugagcgggaggcagag

SEQ ID NO: 2777446 - RNA, 22 nt, Human
gacucugagcgggaggcagagu

SEQ ID NO: 2777447 - RNA, 22 nt, Human
gacucugaggcucuuucugggc

SEQ ID NO: 2777448 - RNA, 12 nt, Human
gacucugcacau

SEQ ID NO: 2777449 - RNA, 15 nt, Human
gacucugaagccucu

SEQ ID NO: 2777450 - RNA, 16 nt, Human
gacucugaagccucug

SEQ ID NO: 2777451 - RNA, 17 nt, Human
gacucugaagccucugg

SEQ ID NO: 2777452 - RNA, 18 nt, Human
gacucugaagccucuggg

SEQ ID NO: 2777453 - RNA, 19 nt, Human
gacucugaagccucuggga

SEQ ID NO: 2777454 - RNA, 14 nt, Human
gagcagggcucagc

SEQ ID NO: 2777455 - RNA, 18 nt, Human
gagcagggaaggccugac

SEQ ID NO: 2777456 - RNA, 17 nt, Human
gagcagggaaggccuga

SEQ ID NO: 2777457 - RNA, 16 nt, Human
gagcagggaaggccug

SEQ ID NO: 2777458 - RNA, 14 nt, Human
gagcagggaaggcc

SEQ ID NO: 2777459 - RNA, 13 nt, Human
gagcagggaaggc

SEQ ID NO: 2777460 - RNA, 14 nt, Human
gagcauggagcugg

SEQ ID NO: 2777461 - RNA, 19 nt, Human
gagcauguaaaagcggaaa

SEQ ID NO: 2777462 - RNA, 22 nt, Human
gagcauggggauaaaggagaag

SEQ ID NO: 2777463 - RNA, 21 nt, Human
gagcauggggauaaaggagaa

SEQ ID NO: 2777464 - RNA, 15 nt, Human
gagcauggagcuggc

SEQ ID NO: 2777465 - RNA, 17 nt, Human
gagcauggagcuggccg

SEQ ID NO: 2777466 - RNA, 15 nt, Human
gagcaugggccuggc

SEQ ID NO: 2777467 - RNA, 16 nt, Human
gagcauaguccaaaaa

SEQ ID NO: 2777468 - RNA, 22 nt, Human
gagcauaguccaaaaagcuccu

SEQ ID NO: 2777469 - RNA, 22 nt, Human
gagcaguuucuguccugcuggu

SEQ ID NO: 2777470 - RNA, 21 nt, Human
gagcauacaucuuaaaucuuu

SEQ ID NO: 2777471 - RNA, 20 nt, Human
gagcaguuucuguccugcug

SEQ ID NO: 2777472 - RNA, 21 nt, Human
gagcaguuucuguccugcugg

SEQ ID NO: 2777473 - RNA, 17 nt, Human
gagcaguuucuguccug

SEQ ID NO: 2777474 - RNA, 24 nt, Human
gagccccagggucuucccuaccuc

SEQ ID NO: 2777475 - RNA, 19 nt, Human
gagccccagggugcccaga

SEQ ID NO: 2777476 - RNA, 19 nt, Human
gagccccagggucuucccu

SEQ ID NO: 2777477 - RNA, 12 nt, Human
gagccccaucug

SEQ ID NO: 2777478 - RNA, 12 nt, Human
gagccccaucuu

SEQ ID NO: 2777479 - RNA, 13 nt, Human
gagccccaucuuc

SEQ ID NO: 2777480 - RNA, 18 nt, Human
gagccccaucuucaccca

SEQ ID NO: 2777481 - RNA, 19 nt, Human
gagccccaucuucacccag

SEQ ID NO: 2777482 - RNA, 20 nt, Human
gagccccaucuucacccagg

SEQ ID NO: 2777483 - RNA, 14 nt, Human
gagccccagggucu

SEQ ID NO: 2777484 - RNA, 13 nt, Human
gagccccaggguc

SEQ ID NO: 2777485 - RNA, 12 nt, Human
gagccccagggu

SEQ ID NO: 2777486 - RNA, 18 nt, Human
gagccccaggccucugug

SEQ ID NO: 2777487 - RNA, 16 nt, Human
gagccccagcuacccu

SEQ ID NO: 2777488 - RNA, 13 nt, Human
gagccccaggccu

SEQ ID NO: 2777489 - RNA, 16 nt, Human
gagccccaggccucug

SEQ ID NO: 2777490 - RNA, 17 nt, Human
gagccccaggccucugu

SEQ ID NO: 2777491 - RNA, 17 nt, Human
gagcaugggccuggcca

SEQ ID NO: 2777492 - RNA, 18 nt, Human
gagcugggugucaagagg

SEQ ID NO: 2777493 - RNA, 19 nt, Human
gagcuggggaccugguacc

SEQ ID NO: 2777494 - RNA, 14 nt, Human
gagcugggcauggu

SEQ ID NO: 2777495 - RNA, 13 nt, Human
gagcuggggaccu

SEQ ID NO: 2777496 - RNA, 15 nt, Human
gagcuggggaccugg

SEQ ID NO: 2777497 - RNA, 12 nt, Human
gagcugggaggc

SEQ ID NO: 2777498 - RNA, 17 nt, Human
gagcugggaggcauggc

SEQ ID NO: 2777499 - RNA, 18 nt, Human
gagcugggaggcauggcc

SEQ ID NO: 2777500 - RNA, 23 nt, Human
gagccuuugguucuggccagaau

SEQ ID NO: 2777501 - RNA, 18 nt, Human
gagccuuuuaacugugca

SEQ ID NO: 2777502 - RNA, 19 nt, Human
gagccuuuuaacugugcaa

SEQ ID NO: 2777503 - RNA, 23 nt, Human
gagccuuuucccucuuuggcucc

SEQ ID NO: 2777504 - RNA, 20 nt, Human
gagccuuuuuaaaacacaug

SEQ ID NO: 2777505 - RNA, 18 nt, Human
gagccuuugguucuggcc

SEQ ID NO: 2777506 - RNA, 22 nt, Human
gagcugccuguucagcuccagc

SEQ ID NO: 2777507 - RNA, 21 nt, Human
gagcugccuguucagcuccag

SEQ ID NO: 2777508 - RNA, 20 nt, Human
gagcugccuguucagcucca

SEQ ID NO: 2777509 - RNA, 16 nt, Human
gagcggucucaggcug

SEQ ID NO: 2777510 - RNA, 14 nt, Human
gagcggucucaggc

SEQ ID NO: 2777511 - RNA, 12 nt, Human
gagcgggaggca

SEQ ID NO: 2777512 - RNA, 13 nt, Human
gagcgggaggcag

SEQ ID NO: 2777513 - RNA, 14 nt, Human
gagcgggaggcaga

SEQ ID NO: 2777514 - RNA, 15 nt, Human
gagcgggaggcagag

SEQ ID NO: 2777515 - RNA, 16 nt, Human
gagcgggaggcagagu

SEQ ID NO: 2777516 - RNA, 16 nt, Human
gagcgggguaugaaga

SEQ ID NO: 2777517 - RNA, 14 nt, Human
gagacuauggagcc

SEQ ID NO: 2777518 - RNA, 21 nt, Human
gagacuauggagccuggcaca

SEQ ID NO: 2777519 - RNA, 22 nt, Human
gagacuauggagccuggcacag

SEQ ID NO: 2777520 - RNA, 13 nt, Human
gagacuauuuaaa

SEQ ID NO: 2777521 - RNA, 22 nt, Human
gagacuauuuaaacuuauaaau

SEQ ID NO: 2777522 - RNA, 15 nt, Human
gagacucacaggaag

SEQ ID NO: 2777523 - RNA, 12 nt, Human
gagaggcagaga

SEQ ID NO: 2777524 - RNA, 22 nt, Human
gagaggcagacuucccugaaug

SEQ ID NO: 2777525 - RNA, 13 nt, Human
gagaggcagagag

SEQ ID NO: 2777526 - RNA, 14 nt, Human
gagaggcagagagc

SEQ ID NO: 2777527 - RNA, 16 nt, Human
gagaggcagagagcgg

SEQ ID NO: 2777528 - RNA, 15 nt, Human
gagauggaucacaua

SEQ ID NO: 2777529 - RNA, 17 nt, Human
gagauggagucuugcua

SEQ ID NO: 2777530 - RNA, 18 nt, Human
gagauggaguucuugugc

SEQ ID NO: 2777531 - RNA, 22 nt, Human
gagauggacaguucacacccug

SEQ ID NO: 2777532 - RNA, 18 nt, Human
gagaugcuggagaagaga

SEQ ID NO: 2777533 - RNA, 23 nt, Human
gagaugcauucuugguuggcugg

SEQ ID NO: 2777534 - RNA, 19 nt, Human
gagaugcuggagaagagag

SEQ ID NO: 2777535 - RNA, 20 nt, Human
gagaugcuggagaagagagg

SEQ ID NO: 2777536 - RNA, 21 nt, Human
gagaugcuggagaagagagga

SEQ ID NO: 2777537 - RNA, 17 nt, Human
gagaugcuguaacuuaa

SEQ ID NO: 2777538 - RNA, 23 nt, Human
gagauuguuguuugccauacuuu

SEQ ID NO: 2777539 - RNA, 21 nt, Human
gagaugucaucagagcuccuc

SEQ ID NO: 2777540 - RNA, 17 nt, Human
gagauucaguuuucauu

SEQ ID NO: 2777541 - RNA, 16 nt, Human
gagauguaugaaggcu

SEQ ID NO: 2777542 - RNA, 18 nt, Human
gagauguaugaaggcuuu

SEQ ID NO: 2777543 - RNA, 23 nt, Human
gagauguaugaaggcuuuugguc

SEQ ID NO: 2777544 - RNA, 14 nt, Human
gagauucccaagcc

SEQ ID NO: 2777545 - RNA, 16 nt, Human
gagauucccgcggguu

SEQ ID NO: 2777546 - RNA, 23 nt, Human
gagauucccgcggguuccgcagg

SEQ ID NO: 2777547 - RNA, 15 nt, Human
gagauucugugaucu

SEQ ID NO: 2777548 - RNA, 16 nt, Human
gagauugaacuccaag

SEQ ID NO: 2777549 - RNA, 16 nt, Human
gagaugggaaggcaca

SEQ ID NO: 2777550 - RNA, 14 nt, Human
gagaugggagcucc

SEQ ID NO: 2777551 - RNA, 15 nt, Human
gagaugggagcuccu

SEQ ID NO: 2777552 - RNA, 22 nt, Human
gagaugggagcuccucuccugg

SEQ ID NO: 2777553 - RNA, 23 nt, Human
gagaugggagcuccucuccugga

SEQ ID NO: 2777554 - RNA, 18 nt, Human
gagauggggauaaaauga

SEQ ID NO: 2777555 - RNA, 17 nt, Human
gagauguaaaagguauu

SEQ ID NO: 2777556 - RNA, 16 nt, Human
gagauguaaaagguau

SEQ ID NO: 2777557 - RNA, 13 nt, Human
gagauugagaagg

SEQ ID NO: 2777558 - RNA, 17 nt, Human
gagauugagaaggagag

SEQ ID NO: 2777559 - RNA, 18 nt, Human
gagauugagaaggagaga

SEQ ID NO: 2777560 - RNA, 20 nt, Human
gagauugagaaggagagaaa

SEQ ID NO: 2777561 - RNA, 22 nt, Human
gagauuuaccagggauguagau

SEQ ID NO: 2777562 - RNA, 14 nt, Human
gagauuuauauaaa

SEQ ID NO: 2777563 - RNA, 16 nt, Human
gagauuuauauaaaug

SEQ ID NO: 2777564 - RNA, 16 nt, Human
gagauuuccuccuggc

SEQ ID NO: 2777565 - RNA, 12 nt, Human
gagauuugucua

SEQ ID NO: 2777566 - RNA, 14 nt, Human
gacacugccugggc

SEQ ID NO: 2777567 - RNA, 16 nt, Human
gacacugugcccagcc

SEQ ID NO: 2777568 - RNA, 23 nt, Human
gacacugugcccagcccggaccu

SEQ ID NO: 2777569 - RNA, 22 nt, Human
gacacuguucucccuucggugg

SEQ ID NO: 2777570 - RNA, 20 nt, Human
gacacugugcccagcccgga

SEQ ID NO: 2777571 - RNA, 15 nt, Human
gacacugaugggcaa

SEQ ID NO: 2777572 - RNA, 13 nt, Human
gacacugccuggg

SEQ ID NO: 2777573 - RNA, 12 nt, Human
gacacugccugg

SEQ ID NO: 2777574 - RNA, 16 nt, Human
gacacugccacacagg

SEQ ID NO: 2777575 - RNA, 12 nt, Human
gacacuguacaa

SEQ ID NO: 2777576 - RNA, 13 nt, Human
gacacuguacaag

SEQ ID NO: 2777577 - RNA, 13 nt, Human
gacacugaugggc

SEQ ID NO: 2777578 - RNA, 23 nt, Human
gacagacaacacugggaaacaga

SEQ ID NO: 2777579 - RNA, 15 nt, Human
gacagaauguaucug

SEQ ID NO: 2777580 - RNA, 18 nt, Human
gacagaauguaucuguga

SEQ ID NO: 2777581 - RNA, 20 nt, Human
gacagaauguaucugugaag

SEQ ID NO: 2777582 - RNA, 13 nt, Human
gacagaauuuuuu

SEQ ID NO: 2777583 - RNA, 18 nt, Human
gacagaauuuuuuuuguu

SEQ ID NO: 2777584 - RNA, 21 nt, Human
gacagaauuuuuuuuguuguu

SEQ ID NO: 2777585 - RNA, 23 nt, Human
gacagaaggugccacuuuaccca

SEQ ID NO: 2777586 - RNA, 15 nt, Human
gacagaagucuccuc

SEQ ID NO: 2777587 - RNA, 16 nt, Human
gacagaagucuccuca

SEQ ID NO: 2777588 - RNA, 17 nt, Human
gacagaagucuccucaa

SEQ ID NO: 2777589 - RNA, 14 nt, Human
gacagaaggugcca

SEQ ID NO: 2777590 - RNA, 20 nt, Human
gacacuuaauacuaccuuga

SEQ ID NO: 2777591 - RNA, 19 nt, Human
gacacuucaaggugacaga

SEQ ID NO: 2777592 - RNA, 21 nt, Human
gacacuucaaggugacagaag

SEQ ID NO: 2777593 - RNA, 15 nt, Human
gacagaaggaccagc

SEQ ID NO: 2777594 - RNA, 16 nt, Human
gacagaaggaccagcc

SEQ ID NO: 2777595 - RNA, 14 nt, Human
gacaguccugggag

SEQ ID NO: 2777596 - RNA, 13 nt, Human
gacaguccuggga

SEQ ID NO: 2777597 - RNA, 14 nt, Human
gacagucaccccag

SEQ ID NO: 2777598 - RNA, 16 nt, Human
gacagucaccccagga

SEQ ID NO: 2777599 - RNA, 15 nt, Human
gacagucuugugcuu

SEQ ID NO: 2777600 - RNA, 18 nt, Human
gacauguuuuuguuuucu

SEQ ID NO: 2777601 - RNA, 18 nt, Human
gacaguccugggagaacc

SEQ ID NO: 2777602 - RNA, 15 nt, Human
gacaguccugggaga

SEQ ID NO: 2777603 - RNA, 23 nt, Human
gacaguccugggagaaccucagg

SEQ ID NO: 2777604 - RNA, 13 nt, Human
gacagucuugugc

SEQ ID NO: 2777605 - RNA, 13 nt, Human
gacagucucacuu

SEQ ID NO: 2777606 - RNA, 12 nt, Human
gacagucugcuc

SEQ ID NO: 2777607 - RNA, 23 nt, Human
gacagucugcucuagaugagcug

SEQ ID NO: 2777608 - RNA, 11 nt, Human
gacagcuccuu

SEQ ID NO: 2777609 - RNA, 13 nt, Human
gacagacacacac

SEQ ID NO: 2777610 - RNA, 15 nt, Human
gacagacacacacac

SEQ ID NO: 2777611 - RNA, 13 nt, Human
gacagccuggcac

SEQ ID NO: 2777612 - RNA, 19 nt, Human
gacagccuggcacagggca

SEQ ID NO: 2777613 - RNA, 22 nt, Human
gacaggguuuugccauguuggc

SEQ ID NO: 2777614 - RNA, 20 nt, Human
gacaggguuuugccauguug

SEQ ID NO: 2777615 - RNA, 14 nt, Human
gacagguaaauuaa

SEQ ID NO: 2777616 - RNA, 16 nt, Human
gacaggugugccgaca

SEQ ID NO: 2777617 - RNA, 16 nt, Human
gacaggucccuccccu

SEQ ID NO: 2777618 - RNA, 17 nt, Human
gacauuaugugguuuua

SEQ ID NO: 2777619 - RNA, 16 nt, Human
gacauuaagaauguug

SEQ ID NO: 2777620 - RNA, 19 nt, Human
gacauuaagaauguugguu

SEQ ID NO: 2777621 - RNA, 20 nt, Human
gacauuaguaacauaauaaa

SEQ ID NO: 2777622 - RNA, 23 nt, Human
gacauuaguaacauaauaaauua

SEQ ID NO: 2777623 - RNA, 14 nt, Human
gacauuauagacau

SEQ ID NO: 2777624 - RNA, 15 nt, Human
gacauuauagacauu

SEQ ID NO: 2777625 - RNA, 20 nt, Human
gacauuauagacauugagga

SEQ ID NO: 2777626 - RNA, 23 nt, Human
gacauuaugugguuuuagauuuu

SEQ ID NO: 2777627 - RNA, 13 nt, Human
gacauuaugugug

SEQ ID NO: 2777628 - RNA, 16 nt, Human
gacauuaugugugcau

SEQ ID NO: 2777629 - RNA, 20 nt, Human
gacauuaugugugcaugugu

SEQ ID NO: 2777630 - RNA, 21 nt, Human
gacauuaugugugcaugugug

SEQ ID NO: 2777631 - RNA, 22 nt, Human
gacauuaugugugcaugugugu

SEQ ID NO: 2777632 - RNA, 23 nt, Human
gacauuaugugugcaugugugua

SEQ ID NO: 2777633 - RNA, 16 nt, Human
gacaaacaccucccag

SEQ ID NO: 2777634 - RNA, 21 nt, Human
gacacacagcucuguccuggg

SEQ ID NO: 2777635 - RNA, 16 nt, Human
gacacacuacaccaca

SEQ ID NO: 2777636 - RNA, 19 nt, Human
gacacacuacaccacacac

SEQ ID NO: 2777637 - RNA, 20 nt, Human
gacacacuacaccacacaca

SEQ ID NO: 2777638 - RNA, 21 nt, Human
gacacacuacaccacacacaa

SEQ ID NO: 2777639 - RNA, 22 nt, Human
gacacacuaucauaguuaacau

SEQ ID NO: 2777640 - RNA, 19 nt, Human
gaaugaggucccaggcaga

SEQ ID NO: 2777641 - RNA, 18 nt, Human
gaaugaggucccaggcag

SEQ ID NO: 2777642 - RNA, 17 nt, Human
gaaugaggucccaggca

SEQ ID NO: 2777643 - RNA, 16 nt, Human
gaaugaggucccaggc

SEQ ID NO: 2777644 - RNA, 15 nt, Human
gaaugaggucccagg

SEQ ID NO: 2777645 - RNA, 14 nt, Human
gaaugaggucccag

SEQ ID NO: 2777646 - RNA, 13 nt, Human
gaauuuguuauca

SEQ ID NO: 2777647 - RNA, 22 nt, Human
gaaugaggucccaggcagagaa

SEQ ID NO: 2777648 - RNA, 15 nt, Human
gaaugaggucugggc

SEQ ID NO: 2777649 - RNA, 18 nt, Human
gaaugaggucugggcuag

SEQ ID NO: 2777650 - RNA, 21 nt, Human
gaaugaggucccaggcagaga

SEQ ID NO: 2777651 - RNA, 22 nt, Human
gaauuauccuauuucaguacuu

SEQ ID NO: 2777652 - RNA, 22 nt, Human
gaauuuuccugagacaaauuuu

SEQ ID NO: 2777653 - RNA, 23 nt, Human
gaauuuucuuuguguagcuuugc

SEQ ID NO: 2777654 - RNA, 21 nt, Human
gaauuuucuuuguguagcuuu

SEQ ID NO: 2777655 - RNA, 21 nt, Human
gaauuuuauuuuuugggaaaa

SEQ ID NO: 2777656 - RNA, 15 nt, Human
gaauuuuacauggua

SEQ ID NO: 2777657 - RNA, 14 nt, Human
gaauuuuaggaacu

SEQ ID NO: 2777658 - RNA, 19 nt, Human
gaauuuuaggaacuucaga

SEQ ID NO: 2777659 - RNA, 15 nt, Human
gaauuuuguugcugu

SEQ ID NO: 2777660 - RNA, 16 nt, Human
gacaaaaaguuuccau

SEQ ID NO: 2777661 - RNA, 19 nt, Human
gacacacagcucuguccug

SEQ ID NO: 2777662 - RNA, 18 nt, Human
gacacacagcucuguccu

SEQ ID NO: 2777663 - RNA, 17 nt, Human
gacacacagcucugucc

SEQ ID NO: 2777664 - RNA, 15 nt, Human
gacacacagcucugu

SEQ ID NO: 2777665 - RNA, 13 nt, Human
gacacacagcucu

SEQ ID NO: 2777666 - RNA, 13 nt, Human
gacaaaauguuuu

SEQ ID NO: 2777667 - RNA, 22 nt, Human
gacaaaauuuuaguccaaauaa

SEQ ID NO: 2777668 - RNA, 18 nt, Human
gacaaaauuuuauaagca

SEQ ID NO: 2777669 - RNA, 14 nt, Human
gacacacagcucug

SEQ ID NO: 2777670 - RNA, 16 nt, Human
gacaaaauauuuccca

SEQ ID NO: 2777671 - RNA, 18 nt, Human
gacaaaaaguuuccauau

SEQ ID NO: 2777672 - RNA, 17 nt, Human
gacaaaaccuaacuugc

SEQ ID NO: 2777673 - RNA, 18 nt, Human
gacaaaaccuaacuugcg

SEQ ID NO: 2777674 - RNA, 12 nt, Human
gacaaaacuucu

SEQ ID NO: 2777675 - RNA, 13 nt, Human
gacaaaacuucuu

SEQ ID NO: 2777676 - RNA, 14 nt, Human
gacaaaacuucuug

SEQ ID NO: 2777677 - RNA, 19 nt, Human
gacaaaacuucuugucaga

SEQ ID NO: 2777678 - RNA, 21 nt, Human
gacaaaacuucuugucagaca

SEQ ID NO: 2777679 - RNA, 22 nt, Human
gacaaaacuucuugucagacau

SEQ ID NO: 2777680 - RNA, 19 nt, Human
gaaugagaaguagccacag

SEQ ID NO: 2777681 - RNA, 13 nt, Human
gaaugagccucgg

SEQ ID NO: 2777682 - RNA, 11 nt, Human
gaaugagccuc

SEQ ID NO: 2777683 - RNA, 12 nt, Human
gaaugagcccag

SEQ ID NO: 2777684 - RNA, 13 nt, Human
gaaugagcccaga

SEQ ID NO: 2777685 - RNA, 14 nt, Human
gaaugagcccagag

SEQ ID NO: 2777686 - RNA, 16 nt, Human
gaaugagcccagagaa

SEQ ID NO: 2777687 - RNA, 19 nt, Human
gaaugagcccagagaacag

SEQ ID NO: 2777688 - RNA, 20 nt, Human
gaaugagcccagagaacagc

SEQ ID NO: 2777689 - RNA, 14 nt, Human
gaaugaauuaaaua

SEQ ID NO: 2777690 - RNA, 16 nt, Human
gaaugaauuaaauaaa

SEQ ID NO: 2777691 - RNA, 16 nt, Human
gaaugacaacagaagc

SEQ ID NO: 2777692 - RNA, 13 nt, Human
gaagugucauguu

SEQ ID NO: 2777693 - RNA, 14 nt, Human
gaagugucauguuu

SEQ ID NO: 2777694 - RNA, 21 nt, Human
gaagugcuuaguguacuugga

SEQ ID NO: 2777695 - RNA, 20 nt, Human
gaagugcuggcaaccacuaa

SEQ ID NO: 2777696 - RNA, 15 nt, Human
gaagugcgugaaugu

SEQ ID NO: 2777697 - RNA, 16 nt, Human
gaagugcgugaaugua

SEQ ID NO: 2777698 - RNA, 21 nt, Human
gaagugcgugaauguauguaa

SEQ ID NO: 2777699 - RNA, 19 nt, Human
gaagugcuccccucugaaa

SEQ ID NO: 2777700 - RNA, 20 nt, Human
gaagugcuccccucugaaag

SEQ ID NO: 2777701 - RNA, 17 nt, Human
gaaguggacuggccccu

SEQ ID NO: 2777702 - RNA, 18 nt, Human
gaaguggacuggccccug

SEQ ID NO: 2777703 - RNA, 20 nt, Human
gaaguggacuggccccuggg

SEQ ID NO: 2777704 - RNA, 14 nt, Human
gaaguggggagagg

SEQ ID NO: 2777705 - RNA, 18 nt, Human
gaagugguaggaaagccu

SEQ ID NO: 2777706 - RNA, 14 nt, Human
gaagugguccaucu

SEQ ID NO: 2777707 - RNA, 15 nt, Human
gaaguggggacagag

SEQ ID NO: 2777708 - RNA, 22 nt, Human
gaagugauacuauccaguuacu

SEQ ID NO: 2777709 - RNA, 18 nt, Human
gaagugcaaauuugauac

SEQ ID NO: 2777710 - RNA, 14 nt, Human
gaagugcauuucug

SEQ ID NO: 2777711 - RNA, 16 nt, Human
gaagugcauuucugaa

SEQ ID NO: 2777712 - RNA, 23 nt, Human
gaagugcauuucugaauagaaau

SEQ ID NO: 2777713 - RNA, 16 nt, Human
gaagugcccccucccc

SEQ ID NO: 2777714 - RNA, 16 nt, Human
gaagugagcacagccu

SEQ ID NO: 2777715 - RNA, 23 nt, Human
gaagggcaggaaggagagccugc

SEQ ID NO: 2777716 - RNA, 21 nt, Human
gaagggcauaaaacagcuuug

SEQ ID NO: 2777717 - RNA, 14 nt, Human
gaagugaacauuuc

SEQ ID NO: 2777718 - RNA, 20 nt, Human
gaagggauuuuagucacacg

SEQ ID NO: 2777719 - RNA, 16 nt, Human
gaagggcauucuuucc

SEQ ID NO: 2777720 - RNA, 14 nt, Human
gaagucuuuuguuc

SEQ ID NO: 2777721 - RNA, 23 nt, Human
gaagcuguaguagcccuuucugu

SEQ ID NO: 2777722 - RNA, 18 nt, Human
gaaggccucuuggagacc

SEQ ID NO: 2777723 - RNA, 20 nt, Human
gaaggccugacuucugcugg

SEQ ID NO: 2777724 - RNA, 13 nt, Human
gaaggccugacuu

SEQ ID NO: 2777725 - RNA, 18 nt, Human
gaagcugcauccagaggc

SEQ ID NO: 2777726 - RNA, 16 nt, Human
gaagcugcccugccca

SEQ ID NO: 2777727 - RNA, 13 nt, Human
gaagcugcaucca

SEQ ID NO: 2777728 - RNA, 13 nt, Human
gaagcugcuccag

SEQ ID NO: 2777729 - RNA, 14 nt, Human
gaagcugcuccagg

SEQ ID NO: 2777730 - RNA, 18 nt, Human
gaagcugcuccaggccug

SEQ ID NO: 2777731 - RNA, 20 nt, Human
gaagcugcuccaggccugca

SEQ ID NO: 2777732 - RNA, 10 nt, Human
gaagcugcug

SEQ ID NO: 2777733 - RNA, 11 nt, Human
gaagcugcuga

SEQ ID NO: 2777734 - RNA, 12 nt, Human
gaagcugcugac

SEQ ID NO: 2777735 - RNA, 13 nt, Human
gaagcugcugacc

SEQ ID NO: 2777736 - RNA, 14 nt, Human
gaagcugcugacca

SEQ ID NO: 2777737 - RNA, 22 nt, Human
gaagcugcugaccaauugugcu

SEQ ID NO: 2777738 - RNA, 23 nt, Human
gaagcuggccgaggguccuggcu

SEQ ID NO: 2777739 - RNA, 17 nt, Human
gaagcuggccgaggguc

SEQ ID NO: 2777740 - RNA, 22 nt, Human
gaagcuggccugagaggggaag

SEQ ID NO: 2777741 - RNA, 19 nt, Human
gaagcuggccugagagggg

SEQ ID NO: 2777742 - RNA, 15 nt, Human
gaagcuggccugaga

SEQ ID NO: 2777743 - RNA, 14 nt, Human
gaagcuggccugag

SEQ ID NO: 2777744 - RNA, 19 nt, Human
gaagggaauccuccuccag

SEQ ID NO: 2777745 - RNA, 20 nt, Human
gaagggaauccuccuccagg

SEQ ID NO: 2777746 - RNA, 12 nt, Human
gaaggcuuugug

SEQ ID NO: 2777747 - RNA, 17 nt, Human
gaaggcuuuuggucucc

SEQ ID NO: 2777748 - RNA, 19 nt, Human
gaaggcuuuuggucucccu

SEQ ID NO: 2777749 - RNA, 22 nt, Human
gaagggcaggaaggagagccug

SEQ ID NO: 2777750 - RNA, 13 nt, Human
gaagggagguggc

SEQ ID NO: 2777751 - RNA, 15 nt, Human
gaagggagcagcaca

SEQ ID NO: 2777752 - RNA, 16 nt, Human
gaagggagcagcacac

SEQ ID NO: 2777753 - RNA, 13 nt, Human
gaagcuccacugu

SEQ ID NO: 2777754 - RNA, 14 nt, Human
gaagcuccacuguc

SEQ ID NO: 2777755 - RNA, 15 nt, Human
gaagcuccacuguca

SEQ ID NO: 2777756 - RNA, 16 nt, Human
gaagcuccacugucac

SEQ ID NO: 2777757 - RNA, 18 nt, Human
gaagcuccacugucaccc

SEQ ID NO: 2777758 - RNA, 19 nt, Human
gaagcuccacugucacccu

SEQ ID NO: 2777759 - RNA, 23 nt, Human
gaagcuccacugucacccuccac

SEQ ID NO: 2777760 - RNA, 23 nt, Human
gaagcuacugugugugugaauga

SEQ ID NO: 2777761 - RNA, 15 nt, Human
gaagcuacuucucca

SEQ ID NO: 2777762 - RNA, 22 nt, Human
gaagcuacugugugugugaaug

SEQ ID NO: 2777763 - RNA, 20 nt, Human
gaagcuacugugugugugaa

SEQ ID NO: 2777764 - RNA, 15 nt, Human
gaagcuacugugugu

SEQ ID NO: 2777765 - RNA, 17 nt, Human
gaagcuaauuugcauua

SEQ ID NO: 2777766 - RNA, 16 nt, Human
gaagcuaauuugcauu

SEQ ID NO: 2777767 - RNA, 15 nt, Human
gaagcuaauuugcau

SEQ ID NO: 2777768 - RNA, 14 nt, Human
gaagcuaauuugca

SEQ ID NO: 2777769 - RNA, 18 nt, Human
gaaauccagggugguggu

SEQ ID NO: 2777770 - RNA, 13 nt, Human
gaaauccagggug

SEQ ID NO: 2777771 - RNA, 14 nt, Human
gaaauccaaucaga

SEQ ID NO: 2777772 - RNA, 18 nt, Human
gaaaucaucgaaaauuca

SEQ ID NO: 2777773 - RNA, 21 nt, Human
gaaaucaucggagucagccag

SEQ ID NO: 2777774 - RNA, 21 nt, Human
cuugaugaccaaaguccuuuu

SEQ ID NO: 2777775 - RNA, 13 nt, Human
cuugaugaagcaa

SEQ ID NO: 2777776 - RNA, 14 nt, Human
cuugaugaagcaag

SEQ ID NO: 2777777 - RNA, 18 nt, Human
cuugaugaccaaaguccu

SEQ ID NO: 2777778 - RNA, 13 nt, Human
cuugaugcaugug

SEQ ID NO: 2777779 - RNA, 14 nt, Human
cuugaugcacagag

SEQ ID NO: 2777780 - RNA, 15 nt, Human
cuugaugcacagaga

SEQ ID NO: 2777781 - RNA, 18 nt, Human
cuugaugcacagagaagc

SEQ ID NO: 2777782 - RNA, 19 nt, Human
cuugaugcacagagaagcu

SEQ ID NO: 2777783 - RNA, 16 nt, Human
cuugccugggucacac

SEQ ID NO: 2777784 - RNA, 10 nt, Human
cuugccuggg

SEQ ID NO: 2777785 - RNA, 15 nt, Human
cuugccuuacacaaa

SEQ ID NO: 2777786 - RNA, 12 nt, Human
cuugccugcagg

SEQ ID NO: 2777787 - RNA, 23 nt, Human
cuugaugccauaugccuugggga

SEQ ID NO: 2777788 - RNA, 20 nt, Human
cuugccuggagacguggaac

SEQ ID NO: 2777789 - RNA, 13 nt, Human
cuugccugcaggc

SEQ ID NO: 2777790 - RNA, 15 nt, Human
cuugccuuccuaagc

SEQ ID NO: 2777791 - RNA, 20 nt, Human
cuugccuuccuaagccugug

SEQ ID NO: 2777792 - RNA, 21 nt, Human
cuugccuuccuaagccugugg

SEQ ID NO: 2777793 - RNA, 22 nt, Human
cuugccuuccuaagccuguggc

SEQ ID NO: 2777794 - RNA, 23 nt, Human
cuugccuuccuaagccuguggcu

SEQ ID NO: 2777795 - RNA, 23 nt, Human
cuugccuuuagccccucccaagc

SEQ ID NO: 2777796 - RNA, 19 nt, Human
cuugcgaacuagagaugug

SEQ ID NO: 2777797 - RNA, 23 nt, Human
cuugcgaacuagagaugugcaau

SEQ ID NO: 2777798 - RNA, 14 nt, Human
cuugcgaauaacag

SEQ ID NO: 2777799 - RNA, 14 nt, Human
cuugcgaauccaag

SEQ ID NO: 2777800 - RNA, 16 nt, Human
cuugcgaauccaagcu

SEQ ID NO: 2777801 - RNA, 19 nt, Human
cuugcgaauccaagcuccc

SEQ ID NO: 2777802 - RNA, 20 nt, Human
cuugcgaauccaagcucccu

SEQ ID NO: 2777803 - RNA, 20 nt, Human
cuugcggaaucacucugucc

SEQ ID NO: 2777804 - RNA, 23 nt, Human
cuuggcacauuuaagagacaguc

SEQ ID NO: 2777805 - RNA, 12 nt, Human
cuuggcaccaaa

SEQ ID NO: 2777806 - RNA, 13 nt, Human
cuuggcaccaaag

SEQ ID NO: 2777807 - RNA, 16 nt, Human
cuuggcaccaaagaug

SEQ ID NO: 2777808 - RNA, 19 nt, Human
cuuggcaccaaagaugcag

SEQ ID NO: 2777809 - RNA, 22 nt, Human
cuuggcaccaaagaugcagccg

SEQ ID NO: 2777810 - RNA, 18 nt, Human
cuuggcagcaccugucuc

SEQ ID NO: 2777811 - RNA, 19 nt, Human
cuuggcagcccaggccggg

SEQ ID NO: 2777812 - RNA, 18 nt, Human
cuuggcaauauuccuuag

SEQ ID NO: 2777813 - RNA, 20 nt, Human
cuuggcagcaccugucuccu

SEQ ID NO: 2777814 - RNA, 19 nt, Human
cuuggcagcaccugucucc

SEQ ID NO: 2777815 - RNA, 18 nt, Human
cuuggcaucacagggcag

SEQ ID NO: 2777816 - RNA, 15 nt, Human
cuuggcauagacaug

SEQ ID NO: 2777817 - RNA, 15 nt, Human
cuuggcagcugaacu

SEQ ID NO: 2777818 - RNA, 22 nt, Human
cuugaucuguauauacaauaac

SEQ ID NO: 2777819 - RNA, 20 nt, Human
cuugaucuguauauacaaua

SEQ ID NO: 2777820 - RNA, 15 nt, Human
cuugaucuguauaua

SEQ ID NO: 2777821 - RNA, 22 nt, Human
cuugauacuaaaaguucuucuc

SEQ ID NO: 2777822 - RNA, 23 nt, Human
cuugauacuaaaaguucuucucc

SEQ ID NO: 2777823 - RNA, 16 nt, Human
cuugauaccccccucu

SEQ ID NO: 2777824 - RNA, 17 nt, Human
cuugauaccccccucug

SEQ ID NO: 2777825 - RNA, 18 nt, Human
cuugauaccccccucugu

SEQ ID NO: 2777826 - RNA, 19 nt, Human
cuugauaccccccucuguc

SEQ ID NO: 2777827 - RNA, 20 nt, Human
cuugauaccccccucugucu

SEQ ID NO: 2777828 - RNA, 21 nt, Human
cuugauaccccccucugucuu

SEQ ID NO: 2777829 - RNA, 19 nt, Human
cuugacaaaaccuaacuug

SEQ ID NO: 2777830 - RNA, 20 nt, Human
cuugacaaaaccuaacuugc

SEQ ID NO: 2777831 - RNA, 13 nt, Human
cuugacagggcac

SEQ ID NO: 2777832 - RNA, 15 nt, Human
cuugacagggcacac

SEQ ID NO: 2777833 - RNA, 14 nt, Human
cuugacagggcaca

SEQ ID NO: 2777834 - RNA, 20 nt, Human
cuugaauuucuaaaaaacag

SEQ ID NO: 2777835 - RNA, 11 nt, Human
cuugaagcugu

SEQ ID NO: 2777836 - RNA, 21 nt, Human
cuugaagccacugaagcuggg

SEQ ID NO: 2777837 - RNA, 19 nt, Human
cuugaagccacugaagcug

SEQ ID NO: 2777838 - RNA, 18 nt, Human
cuugaagccacugaagcu

SEQ ID NO: 2777839 - RNA, 17 nt, Human
cuugaagccacugaagc

SEQ ID NO: 2777840 - RNA, 16 nt, Human
cuugaagccacugaag

SEQ ID NO: 2777841 - RNA, 13 nt, Human
cuugaagccacug

SEQ ID NO: 2777842 - RNA, 15 nt, Human
cuuccugcaauuuuc

SEQ ID NO: 2777843 - RNA, 17 nt, Human
cuuccugcaauuuucua

SEQ ID NO: 2777844 - RNA, 10 nt, Human
cuuccuccug

SEQ ID NO: 2777845 - RNA, 11 nt, Human
cuuccuccuga

SEQ ID NO: 2777846 - RNA, 18 nt, Human
cuucuaggguaugggaaa

SEQ ID NO: 2777847 - RNA, 17 nt, Human
cuucuauuuuguaaacu

SEQ ID NO: 2777848 - RNA, 16 nt, Human
cuucucaaaagaacuu

SEQ ID NO: 2777849 - RNA, 13 nt, Human
cuucuauuuuauu

SEQ ID NO: 2777850 - RNA, 14 nt, Human
cuucuauuuuguaa

SEQ ID NO: 2777851 - RNA, 16 nt, Human
cuucuauuuuguaaac

SEQ ID NO: 2777852 - RNA, 15 nt, Human
cuucuauuuuguaaa

SEQ ID NO: 2777853 - RNA, 16 nt, Human
cuucuaggacgccacc

SEQ ID NO: 2777854 - RNA, 19 nt, Human
cuucuaggacgccacccag

SEQ ID NO: 2777855 - RNA, 17 nt, Human
cuucuagaaccaggcaa

SEQ ID NO: 2777856 - RNA, 9 nt, Human
cuucuagag

SEQ ID NO: 2777857 - RNA, 15 nt, Human
cuucuagaauuauaa

SEQ ID NO: 2777858 - RNA, 23 nt, Human
cuucuagaauuauaagucacaaa

SEQ ID NO: 2777859 - RNA, 13 nt, Human
cuucuagaguuca

SEQ ID NO: 2777860 - RNA, 14 nt, Human
cuucuagaguucag

SEQ ID NO: 2777861 - RNA, 12 nt, Human
cuucuaauauau

SEQ ID NO: 2777862 - RNA, 14 nt, Human
cuucuaauauauuu

SEQ ID NO: 2777863 - RNA, 15 nt, Human
cuucuaauauauuuu

SEQ ID NO: 2777864 - RNA, 18 nt, Human
cuucuaauauauuuuuau

SEQ ID NO: 2777865 - RNA, 13 nt, Human
cuucuagaaccag

SEQ ID NO: 2777866 - RNA, 11 nt, Human
cuucuaauaua

SEQ ID NO: 2777867 - RNA, 13 nt, Human
cuucuaauaaauu

SEQ ID NO: 2777868 - RNA, 15 nt, Human
cuucuaauaaauuau

SEQ ID NO: 2777869 - RNA, 17 nt, Human
cuucuaauaaauuauac

SEQ ID NO: 2777870 - RNA, 21 nt, Human
cuucuaauaaauuauacaaau

SEQ ID NO: 2777871 - RNA, 15 nt, Human
cuuccuccuccacca

SEQ ID NO: 2777872 - RNA, 16 nt, Human
cuuccuccuccccacu

SEQ ID NO: 2777873 - RNA, 17 nt, Human
cuuccuccuccccacuu

SEQ ID NO: 2777874 - RNA, 15 nt, Human
cuucuguugcugccu

SEQ ID NO: 2777875 - RNA, 21 nt, Human
cuucuguugcugccucaugcu

SEQ ID NO: 2777876 - RNA, 14 nt, Human
cuucuucagagcug

SEQ ID NO: 2777877 - RNA, 16 nt, Human
cuucuucagagcugac

SEQ ID NO: 2777878 - RNA, 21 nt, Human
cuucuucagccaccucucuuu

SEQ ID NO: 2777879 - RNA, 17 nt, Human
cuucuucagccaccucu

SEQ ID NO: 2777880 - RNA, 12 nt, Human
cuucuucagggc

SEQ ID NO: 2777881 - RNA, 14 nt, Human
cuucuucagggccu

SEQ ID NO: 2777882 - RNA, 15 nt, Human
cuucuucagggccug

SEQ ID NO: 2777883 - RNA, 16 nt, Human
cuucuucagggccugg

SEQ ID NO: 2777884 - RNA, 16 nt, Human
cuucuucauauucuaa

SEQ ID NO: 2777885 - RNA, 14 nt, Human
cuucugccaagaga

SEQ ID NO: 2777886 - RNA, 20 nt, Human
cuucuguugcugccucaugc

SEQ ID NO: 2777887 - RNA, 19 nt, Human
cuucuguugcugccucaug

SEQ ID NO: 2777888 - RNA, 18 nt, Human
cuucuguugcugccucau

SEQ ID NO: 2777889 - RNA, 17 nt, Human
cuucuguugcugccuca

SEQ ID NO: 2777890 - RNA, 14 nt, Human
cuucucaaguucua

SEQ ID NO: 2777891 - RNA, 15 nt, Human
cuucucaaguucuaa

SEQ ID NO: 2777892 - RNA, 16 nt, Human
cuucucaaguucuaag

SEQ ID NO: 2777893 - RNA, 17 nt, Human
cuucucaaguucuaaga

SEQ ID NO: 2777894 - RNA, 18 nt, Human
cuucucaaguucuaagau

SEQ ID NO: 2777895 - RNA, 23 nt, Human
cuucucaaguucuaagauucuaa

SEQ ID NO: 2777896 - RNA, 13 nt, Human
cuucucacagcac

SEQ ID NO: 2777897 - RNA, 15 nt, Human
cuucucacagcacau

SEQ ID NO: 2777898 - RNA, 21 nt, Human
cuucucaaguucuaagauucu

SEQ ID NO: 2777899 - RNA, 22 nt, Human
cuucugcaaaaauggauauuau

SEQ ID NO: 2777900 - RNA, 16 nt, Human
cuucuucauucuauca

SEQ ID NO: 2777901 - RNA, 15 nt, Human
cuucuuccuuucucu

SEQ ID NO: 2777902 - RNA, 19 nt, Human
cuucuuccuuucucuuucu

SEQ ID NO: 2777903 - RNA, 18 nt, Human
cuucuuccaucccaggac

SEQ ID NO: 2777904 - RNA, 20 nt, Human
cuucuuccaucccaggacac

SEQ ID NO: 2777905 - RNA, 20 nt, Human
cuucuuccccuucccugacu

SEQ ID NO: 2777906 - RNA, 21 nt, Human
cuucuuccccuucccugacug

SEQ ID NO: 2777907 - RNA, 19 nt, Human
cuucuuccaggugcccagc

SEQ ID NO: 2777908 - RNA, 14 nt, Human
cuucuuccauccca

SEQ ID NO: 2777909 - RNA, 15 nt, Human
cuucuuccaucccag

SEQ ID NO: 2777910 - RNA, 13 nt, Human
cuucacuguauaa

SEQ ID NO: 2777911 - RNA, 16 nt, Human
cuucacuguauaaaua

SEQ ID NO: 2777912 - RNA, 20 nt, Human
cuucacuccagccuggguga

SEQ ID NO: 2777913 - RNA, 12 nt, Human
cuucacuacuuu

SEQ ID NO: 2777914 - RNA, 18 nt, Human
cuucacuacuuuaauaaa

SEQ ID NO: 2777915 - RNA, 18 nt, Human
cuuauuguaaauuuuaga

SEQ ID NO: 2777916 - RNA, 15 nt, Human
cuucacucacuguca

SEQ ID NO: 2777917 - RNA, 20 nt, Human
cuucacucugggcacacucu

SEQ ID NO: 2777918 - RNA, 24 nt, Human
cuucacuccggugugccugcagcc

SEQ ID NO: 2777919 - RNA, 23 nt, Human
cuucacuccggugugccugcagc

SEQ ID NO: 2777920 - RNA, 22 nt, Human
cuucacuccggugugccugcag

SEQ ID NO: 2777921 - RNA, 19 nt, Human
cuucacuccggugugccug

SEQ ID NO: 2777922 - RNA, 14 nt, Human
cuucacuccggugu

SEQ ID NO: 2777923 - RNA, 17 nt, Human
cuucacuguauaaauag

SEQ ID NO: 2777924 - RNA, 23 nt, Human
cuucacuguauaaauaggagagg

SEQ ID NO: 2777925 - RNA, 14 nt, Human
cuucaguugguugu

SEQ ID NO: 2777926 - RNA, 15 nt, Human
cuucaguugguugug

SEQ ID NO: 2777927 - RNA, 20 nt, Human
cuucaguugguugugucuuu

SEQ ID NO: 2777928 - RNA, 21 nt, Human
cuucaguugguugugucuuuu

SEQ ID NO: 2777929 - RNA, 22 nt, Human
cuucaguugguugugucuuuuu

SEQ ID NO: 2777930 - RNA, 17 nt, Human
cuucaguuauuggugga

SEQ ID NO: 2777931 - RNA, 19 nt, Human
cuucaguuauugguggaau

SEQ ID NO: 2777932 - RNA, 14 nt, Human
cuucauaaaugaag

SEQ ID NO: 2777933 - RNA, 12 nt, Human
cuucaucuuuua

SEQ ID NO: 2777934 - RNA, 15 nt, Human
cuucaucuuuuaaag

SEQ ID NO: 2777935 - RNA, 20 nt, Human
cuucauauucuaaaaccauu

SEQ ID NO: 2777936 - RNA, 14 nt, Human
cuucaucuggcugc

SEQ ID NO: 2777937 - RNA, 20 nt, Human
cuucaucuggcugccuuugc

SEQ ID NO: 2777938 - RNA, 17 nt, Human
cuucaucuucccaggua

SEQ ID NO: 2777939 - RNA, 14 nt, Human
cuucaucugcccaa

SEQ ID NO: 2777940 - RNA, 15 nt, Human
cuucaucugcccaac

SEQ ID NO: 2777941 - RNA, 21 nt, Human
cuucauacuuuuuuucacagu

SEQ ID NO: 2777942 - RNA, 15 nt, Human
cuucauaauggccug

SEQ ID NO: 2777943 - RNA, 18 nt, Human
cuuccauaaugcuacugu

SEQ ID NO: 2777944 - RNA, 22 nt, Human
cuuccauaaugcuacugucuca

SEQ ID NO: 2777945 - RNA, 11 nt, Human
cuuccauaauc

SEQ ID NO: 2777946 - RNA, 21 nt, Human
cuuccauaaucuggacuccuc

SEQ ID NO: 2777947 - RNA, 15 nt, Human
cuucccaccucccug

SEQ ID NO: 2777948 - RNA, 16 nt, Human
cuucccaccucccugc

SEQ ID NO: 2777949 - RNA, 17 nt, Human
cuucccaccucccugcc

SEQ ID NO: 2777950 - RNA, 19 nt, Human
cuucccaccucccugccca

SEQ ID NO: 2777951 - RNA, 21 nt, Human
cuucccaccucccugcccagg

SEQ ID NO: 2777952 - RNA, 15 nt, Human
cuucccacucacccc

SEQ ID NO: 2777953 - RNA, 21 nt, Human
cugugcucggaggccaucucg

SEQ ID NO: 2777954 - RNA, 16 nt, Human
cugugcucucaccagc

SEQ ID NO: 2777955 - RNA, 14 nt, Human
cugugcugaaugcu

SEQ ID NO: 2777956 - RNA, 21 nt, Human
cugugcugacauggcucugga

SEQ ID NO: 2777957 - RNA, 21 nt, Human
cuuaugccauguuaauuucau

SEQ ID NO: 2777958 - RNA, 15 nt, Human
cuuauuauugaagga

SEQ ID NO: 2777959 - RNA, 12 nt, Human
cuuauucuguag

SEQ ID NO: 2777960 - RNA, 14 nt, Human
cuuauucuguagau

SEQ ID NO: 2777961 - RNA, 12 nt, Human
cuuauugcaaaa

SEQ ID NO: 2777962 - RNA, 19 nt, Human
cuuauugcugauuuuaaug

SEQ ID NO: 2777963 - RNA, 14 nt, Human
cuuauugcuuagua

SEQ ID NO: 2777964 - RNA, 16 nt, Human
cuuauugcuuaguaaa

SEQ ID NO: 2777965 - RNA, 15 nt, Human
gaaacuuuuguaaag

SEQ ID NO: 2777966 - RNA, 16 nt, Human
gaaacuuuuguaaaga

SEQ ID NO: 2777967 - RNA, 21 nt, Human
gaaacuuuuguaaagaaauuu

SEQ ID NO: 2777968 - RNA, 23 nt, Human
gaaacuuuuguaaagaaauuuac

SEQ ID NO: 2777969 - RNA, 12 nt, Human
gaaacuuuuauc

SEQ ID NO: 2777970 - RNA, 14 nt, Human
gaaacuuuuaacug

SEQ ID NO: 2777971 - RNA, 19 nt, Human
gaaacuuuuaacugagaaa

SEQ ID NO: 2777972 - RNA, 15 nt, Human
gaaacuuuauacauu

SEQ ID NO: 2777973 - RNA, 16 nt, Human
gaaacuuuauacauua

SEQ ID NO: 2777974 - RNA, 17 nt, Human
gaaacuuuauacauuag

SEQ ID NO: 2777975 - RNA, 18 nt, Human
gaaacuuuauacauuagu

SEQ ID NO: 2777976 - RNA, 19 nt, Human
gaaacuuuauacauuagua

SEQ ID NO: 2777977 - RNA, 20 nt, Human
gaaacuuuauacauuaguaa

SEQ ID NO: 2777978 - RNA, 14 nt, Human
gaaagggguugggg

SEQ ID NO: 2777979 - RNA, 16 nt, Human
gaaagggguuggggug

SEQ ID NO: 2777980 - RNA, 21 nt, Human
gaaagggguuggggugacagu

SEQ ID NO: 2777981 - RNA, 18 nt, Human
gaaagguacuauauuugc

SEQ ID NO: 2777982 - RNA, 21 nt, Human
gaaagguacuauauuugcuag

SEQ ID NO: 2777983 - RNA, 22 nt, Human
gaaagggacuuggaagcuccgc

SEQ ID NO: 2777984 - RNA, 22 nt, Human
gaaagggagcuaucaggaacag

SEQ ID NO: 2777985 - RNA, 14 nt, Human
gaaaggcuuuuaaa

SEQ ID NO: 2777986 - RNA, 16 nt, Human
gaaagggaacagaaag

SEQ ID NO: 2777987 - RNA, 16 nt, Human
gaaagggacaaugaua

SEQ ID NO: 2777988 - RNA, 19 nt, Human
gaaagggacuuggaagcuc

SEQ ID NO: 2777989 - RNA, 18 nt, Human
gaaagguuacccuguaac

SEQ ID NO: 2777990 - RNA, 20 nt, Human
gaaaucaguaauauuuauau

SEQ ID NO: 2777991 - RNA, 18 nt, Human
gaaaucaguaauauuuau

SEQ ID NO: 2777992 - RNA, 13 nt, Human
cuuuugccauuga

SEQ ID NO: 2777993 - RNA, 13 nt, Human
cuuuuggagucag

SEQ ID NO: 2777994 - RNA, 21 nt, Human
cuuuugugaagaacuauuuua

SEQ ID NO: 2777995 - RNA, 18 nt, Human
cuuuugucuaugggacuc

SEQ ID NO: 2777996 - RNA, 12 nt, Human
cuuuuguacauc

SEQ ID NO: 2777997 - RNA, 13 nt, Human
cuuuuguacaucu

SEQ ID NO: 2777998 - RNA, 14 nt, Human
cuuuuguacaucug

SEQ ID NO: 2777999 - RNA, 17 nt, Human
cuuuuguacaucuggcu

SEQ ID NO: 2778000 - RNA, 20 nt, Human
cuuuuguaagacaaagguuu

SEQ ID NO: 2778001 - RNA, 14 nt, Human
cuuuuguaauaaac

SEQ ID NO: 2778002 - RNA, 12 nt, Human
cuuuuguaauaa

SEQ ID NO: 2778003 - RNA, 13 nt, Human
cuuuuguaagaca

SEQ ID NO: 2778004 - RNA, 10 nt, Human
cuuuuguaag

SEQ ID NO: 2778005 - RNA, 14 nt, Human
cuuuuggcuuccau

SEQ ID NO: 2778006 - RNA, 13 nt, Human
cuuuuguaaaugu

SEQ ID NO: 2778007 - RNA, 14 nt, Human
cuuuuguaaauuaa

SEQ ID NO: 2778008 - RNA, 15 nt, Human
cuuuuguaaauuaaa

SEQ ID NO: 2778009 - RNA, 12 nt, Human
cuuuuguaaaga

SEQ ID NO: 2778010 - RNA, 15 nt, Human
cuuuuguaaagaaau

SEQ ID NO: 2778011 - RNA, 21 nt, Human
cuuuuguaaagaaauuuacua

SEQ ID NO: 2778012 - RNA, 22 nt, Human
cuuuuguaaagaaauuuacuau

SEQ ID NO: 2778013 - RNA, 23 nt, Human
cuuuuguaaagaaauuuacuaua

SEQ ID NO: 2778014 - RNA, 12 nt, Human
cuuuuguaaagu

SEQ ID NO: 2778015 - RNA, 19 nt, Human
cuuuuguaaagugaagaau

SEQ ID NO: 2778016 - RNA, 15 nt, Human
cuuuuggcuuccaug

SEQ ID NO: 2778017 - RNA, 15 nt, Human
cuuuugggggaaacu

SEQ ID NO: 2778018 - RNA, 11 nt, Human
cuuuuuuuccc

SEQ ID NO: 2778019 - RNA, 13 nt, Human
cuuuuuuuccuuu

SEQ ID NO: 2778020 - RNA, 19 nt, Human
cuuuuuuuccaucuuuaca

SEQ ID NO: 2778021 - RNA, 12 nt, Human
cuuuuuuucaau

SEQ ID NO: 2778022 - RNA, 13 nt, Human
cuuuuuuucaaug

SEQ ID NO: 2778023 - RNA, 14 nt, Human
cuuuuuuucaaugu

SEQ ID NO: 2778024 - RNA, 15 nt, Human
cuuuuuuucaaugug

SEQ ID NO: 2778025 - RNA, 20 nt, Human
cuuuuuuuuuuuugagacag

SEQ ID NO: 2778026 - RNA, 16 nt, Human
cuuuuuuguuuuuuca

SEQ ID NO: 2778027 - RNA, 21 nt, Human
cuuuuuuguuuuuucaaaaua

SEQ ID NO: 2778028 - RNA, 22 nt, Human
cuuuuuuguuuuuucaaaauag

SEQ ID NO: 2778029 - RNA, 10 nt, Human
cuuuuuuguc

SEQ ID NO: 2778030 - RNA, 11 nt, Human
cuuuuuugucc

SEQ ID NO: 2778031 - RNA, 19 nt, Human
cuuuuuugucccccaacuu

SEQ ID NO: 2778032 - RNA, 22 nt, Human
cuuuuuugucccccaacuugag

SEQ ID NO: 2778033 - RNA, 15 nt, Human
cuuuuuuguuuguuu

SEQ ID NO: 2778034 - RNA, 17 nt, Human
cuuuuuuguuuguuucu

SEQ ID NO: 2778035 - RNA, 18 nt, Human
cuuuuuuguuuguuucuu

SEQ ID NO: 2778036 - RNA, 22 nt, Human
cuuuuuuguuuguuucuuugug

SEQ ID NO: 2778037 - RNA, 13 nt, Human
gaaaaaaaucauc

SEQ ID NO: 2778038 - RNA, 15 nt, Human
gaaaaaaaucaucua

SEQ ID NO: 2778039 - RNA, 17 nt, Human
gaaaaaaauaaauaaaa

SEQ ID NO: 2778040 - RNA, 18 nt, Human
gaaaaaaauaauuuuaaa

SEQ ID NO: 2778041 - RNA, 22 nt, Human
gaaaaaaauaauuuuaaaaaug

SEQ ID NO: 2778042 - RNA, 10 nt, Human
gaaaaaaaga

SEQ ID NO: 2778043 - RNA, 12 nt, Human
gaaaaaaagacu

SEQ ID NO: 2778044 - RNA, 14 nt, Human
gaaaaaaagcaugu

SEQ ID NO: 2778045 - RNA, 13 nt, Human
gaaaaaaaucuuc

SEQ ID NO: 2778046 - RNA, 22 nt, Human
gaaaaaaaucuucuccagauuu

SEQ ID NO: 2778047 - RNA, 20 nt, Human
gaaaaacacauggggaaaaa

SEQ ID NO: 2778048 - RNA, 23 nt, Human
gaaaaacacauggggaaaaaaau

SEQ ID NO: 2778049 - RNA, 23 nt, Human
gaaaaacaccgcuucugccuuuu

SEQ ID NO: 2778050 - RNA, 19 nt, Human
gaaaaacaaauucaucaaa

SEQ ID NO: 2778051 - RNA, 20 nt, Human
gaaaaacaacaacacaauaa

SEQ ID NO: 2778052 - RNA, 15 nt, Human
gaaaaaccauuugaa

SEQ ID NO: 2778053 - RNA, 20 nt, Human
gaaaaaccacucccaguccc

SEQ ID NO: 2778054 - RNA, 11 nt, Human
gaaaaacaggu

SEQ ID NO: 2778055 - RNA, 16 nt, Human
gaaaaaaaccacacaa

SEQ ID NO: 2778056 - RNA, 18 nt, Human
gaaaaaaaccacacaaag

SEQ ID NO: 2778057 - RNA, 21 nt, Human
gaaaaaaaccacacaaagaca

SEQ ID NO: 2778058 - RNA, 17 nt, Human
gaaaaaaacgaaaacag

SEQ ID NO: 2778059 - RNA, 14 nt, Human
gaaaaaaacuucau

SEQ ID NO: 2778060 - RNA, 18 nt, Human
cuuuuuuuuuuuguuuga

SEQ ID NO: 2778061 - RNA, 23 nt, Human
cuuuuuuuuuuuguuugaugcag

SEQ ID NO: 2778062 - RNA, 22 nt, Human
cuuuuuuuuuuuuuaaagacag

SEQ ID NO: 2778063 - RNA, 21 nt, Human
cuuuuuuuuuuuugagacaga

SEQ ID NO: 2778064 - RNA, 21 nt, Human
gaaaaaaaaagucagacugcu

SEQ ID NO: 2778065 - RNA, 13 nt, Human
gaaaaaaaaaugc

SEQ ID NO: 2778066 - RNA, 14 nt, Human
gaaaaaaaaaugcc

SEQ ID NO: 2778067 - RNA, 15 nt, Human
gaaaaaaaaaugcca

SEQ ID NO: 2778068 - RNA, 20 nt, Human
gaaaaaaaaaugccauaaua

SEQ ID NO: 2778069 - RNA, 21 nt, Human
gaaaaaaaaaugccauaauac

SEQ ID NO: 2778070 - RNA, 22 nt, Human
gaaaaaaaaaugccauaauaca

SEQ ID NO: 2778071 - RNA, 16 nt, Human
gaaaauucauuucaca

SEQ ID NO: 2778072 - RNA, 22 nt, Human
gaaaauucauuucacauuaaug

SEQ ID NO: 2778073 - RNA, 22 nt, Human
gaaaauucaaaaaguguuuauu

SEQ ID NO: 2778074 - RNA, 20 nt, Human
gaaaaugguuuauuuuguau

SEQ ID NO: 2778075 - RNA, 23 nt, Human
gaaaaugguuuauuuuguauugu

SEQ ID NO: 2778076 - RNA, 12 nt, Human
gaaaauguacug

SEQ ID NO: 2778077 - RNA, 19 nt, Human
gaaaauguacugagauuuu

SEQ ID NO: 2778078 - RNA, 19 nt, Human
gaaaaacucuuuauuuucc

SEQ ID NO: 2778079 - RNA, 17 nt, Human
gaaaaacuggcaacauu

SEQ ID NO: 2778080 - RNA, 12 nt, Human
gaaaagaaaaaa

SEQ ID NO: 2778081 - RNA, 11 nt, Human
gaaaagaaaaa

SEQ ID NO: 2778082 - RNA, 16 nt, Human
gaaaacuuuucucaga

SEQ ID NO: 2778083 - RNA, 17 nt, Human
gaaaacuuuucucagau

SEQ ID NO: 2778084 - RNA, 15 nt, Human
gaaaacuuuucucag

SEQ ID NO: 2778085 - RNA, 23 nt, Human
gaaaaugcuguauuagucacaga

SEQ ID NO: 2778086 - RNA, 19 nt, Human
gaaaaugcuagaagaaaac

SEQ ID NO: 2778087 - RNA, 20 nt, Human
gaaaaugcuagaagaaaaca

SEQ ID NO: 2778088 - RNA, 18 nt, Human
gaaaagaaaaaaaaaaga

SEQ ID NO: 2778089 - RNA, 22 nt, Human
gaaaagaaaaaaaaaagaagaa

SEQ ID NO: 2778090 - RNA, 23 nt, Human
gaaaagaaaaaaaaaagaagaag

SEQ ID NO: 2778091 - RNA, 20 nt, Human
cuuuguaguguuuggugcuc

SEQ ID NO: 2778092 - RNA, 13 nt, Human
cuuuguauauuac

SEQ ID NO: 2778093 - RNA, 21 nt, Human
cuuuguagauccuuagagguc

SEQ ID NO: 2778094 - RNA, 15 nt, Human
cuuuguagcacucag

SEQ ID NO: 2778095 - RNA, 18 nt, Human
cuuuguagcacucaggcu

SEQ ID NO: 2778096 - RNA, 21 nt, Human
cuuuguagcacucaggcucuc

SEQ ID NO: 2778097 - RNA, 13 nt, Human
cuuuguagauccu

SEQ ID NO: 2778098 - RNA, 14 nt, Human
cuuuguauacuuua

SEQ ID NO: 2778099 - RNA, 16 nt, Human
cuuuguauacuuuaaa

SEQ ID NO: 2778100 - RNA, 17 nt, Human
cuuuguauacuuuaaau

SEQ ID NO: 2778101 - RNA, 19 nt, Human
cuuuguauacuuuaaauaa

SEQ ID NO: 2778102 - RNA, 20 nt, Human
cuuuguauacuuuaaauaau

SEQ ID NO: 2778103 - RNA, 23 nt, Human
cuuuguaagaguguagaagcauu

SEQ ID NO: 2778104 - RNA, 14 nt, Human
cuuuguauauuaca

SEQ ID NO: 2778105 - RNA, 21 nt, Human
cuuuuaugcagauagaaucaa

SEQ ID NO: 2778106 - RNA, 13 nt, Human
cuuuuauguagca

SEQ ID NO: 2778107 - RNA, 14 nt, Human
cuuuuauguagcac

SEQ ID NO: 2778108 - RNA, 23 nt, Human
cuuuuauguaguaauugacaugu

SEQ ID NO: 2778109 - RNA, 22 nt, Human
cuuuuauguaguaauugacaug

SEQ ID NO: 2778110 - RNA, 18 nt, Human
cuuuuauguaguaauuga

SEQ ID NO: 2778111 - RNA, 15 nt, Human
cuuuuauguaguaau

SEQ ID NO: 2778112 - RNA, 22 nt, Human
cuuuuaucuguuuaaagcauau

SEQ ID NO: 2778113 - RNA, 16 nt, Human
cuuuuaugagcagaag

SEQ ID NO: 2778114 - RNA, 23 nt, Human
cuuuuaucuauucugagaaaaca

SEQ ID NO: 2778115 - RNA, 24 nt, Human
cuuuuaucuauucugagaaaacaa

SEQ ID NO: 2778116 - RNA, 13 nt, Human
cuuuuaucaaaca

SEQ ID NO: 2778117 - RNA, 17 nt, Human
cuuuuauccacuuaccu

SEQ ID NO: 2778118 - RNA, 19 nt, Human
cuuuuaucacgauauuauu

SEQ ID NO: 2778119 - RNA, 19 nt, Human
cuuuuauaggugagaaaaa

SEQ ID NO: 2778120 - RNA, 20 nt, Human
cuuuuauaggugagaaaaaa

SEQ ID NO: 2778121 - RNA, 21 nt, Human
cuuuuauaggugagaaaaaaa

SEQ ID NO: 2778122 - RNA, 22 nt, Human
cuuuuauaggugagaaaaaaac

SEQ ID NO: 2778123 - RNA, 12 nt, Human
cuuuuauagugg

SEQ ID NO: 2778124 - RNA, 15 nt, Human
cuuuuauaguggaaa

SEQ ID NO: 2778125 - RNA, 20 nt, Human
cuuuuauaguggaaaaacac

SEQ ID NO: 2778126 - RNA, 21 nt, Human
cuuuuauaguggaaaaacaca

SEQ ID NO: 2778127 - RNA, 14 nt, Human
cuuuuauaucugua

SEQ ID NO: 2778128 - RNA, 15 nt, Human
cuuuuauaucuguau

SEQ ID NO: 2778129 - RNA, 23 nt, Human
cuuuuauaucuguauguauuagu

SEQ ID NO: 2778130 - RNA, 13 nt, Human
cuuuuauauuugu

SEQ ID NO: 2778131 - RNA, 14 nt, Human
cuuuuauauuugua

SEQ ID NO: 2778132 - RNA, 15 nt, Human
cuuuuauauuuguau

SEQ ID NO: 2778133 - RNA, 16 nt, Human
cuuuuauauuuguauc

SEQ ID NO: 2778134 - RNA, 17 nt, Human
cuuuuauauuuguaucg

SEQ ID NO: 2778135 - RNA, 20 nt, Human
cuuuuauacucuuucuguau

SEQ ID NO: 2778136 - RNA, 19 nt, Human
cuuuuauacucuuucugua

SEQ ID NO: 2778137 - RNA, 17 nt, Human
cuuuuauacucuuucug

SEQ ID NO: 2778138 - RNA, 12 nt, Human
cuuuuauacucu

SEQ ID NO: 2778139 - RNA, 16 nt, Human
cuuuuauagaugguca

SEQ ID NO: 2778140 - RNA, 12 nt, Human
cuuuuauagcua

SEQ ID NO: 2778141 - RNA, 14 nt, Human
cuuuuauagcuauu

SEQ ID NO: 2778142 - RNA, 17 nt, Human
cuuuuauagcuauuacu

SEQ ID NO: 2778143 - RNA, 18 nt, Human
cuuuuauagcuauuacug

SEQ ID NO: 2778144 - RNA, 19 nt, Human
cuuuuauagcuauuacugu

SEQ ID NO: 2778145 - RNA, 23 nt, Human
cuuucuagaaguuucccuuccuc

SEQ ID NO: 2778146 - RNA, 21 nt, Human
cuuugauaauguuaaauuugu

SEQ ID NO: 2778147 - RNA, 16 nt, Human
cuuugauaauguuaaa

SEQ ID NO: 2778148 - RNA, 22 nt, Human
cuuugauauuuucaacgcagcc

SEQ ID NO: 2778149 - RNA, 22 nt, Human
cuuugauaauguuaaauuugua

SEQ ID NO: 2778150 - RNA, 22 nt, Human
cuuugauacagucaacaagccu

SEQ ID NO: 2778151 - RNA, 17 nt, Human
cuuuccuuuccccagcc

SEQ ID NO: 2778152 - RNA, 19 nt, Human
cuuuccuuguuccccauca

SEQ ID NO: 2778153 - RNA, 16 nt, Human
cuuuccuuuccccagc

SEQ ID NO: 2778154 - RNA, 17 nt, Human
cuuucuacccagcgagc

SEQ ID NO: 2778155 - RNA, 17 nt, Human
cuuuccuuguggcagag

SEQ ID NO: 2778156 - RNA, 18 nt, Human
cuuuccuuguggcagagg

SEQ ID NO: 2778157 - RNA, 19 nt, Human
cuuuccuuguggcagagga

SEQ ID NO: 2778158 - RNA, 14 nt, Human
cuuugggcugcccu

SEQ ID NO: 2778159 - RNA, 18 nt, Human
cuuugaugucauauggaa

SEQ ID NO: 2778160 - RNA, 16 nt, Human
cuuugaugucaugugu

SEQ ID NO: 2778161 - RNA, 18 nt, Human
cuuugaugucauguguuc

SEQ ID NO: 2778162 - RNA, 15 nt, Human
cuuugggcugcccug

SEQ ID NO: 2778163 - RNA, 19 nt, Human
cuuugggcugcccuggugc

SEQ ID NO: 2778164 - RNA, 20 nt, Human
cuuugggcugcccuggugcu

SEQ ID NO: 2778165 - RNA, 21 nt, Human
cuuugggcugcccuggugcug

SEQ ID NO: 2778166 - RNA, 15 nt, Human
cuuuguaagaacuaa

SEQ ID NO: 2778167 - RNA, 18 nt, Human
cuuuguaagaacuaaaga

SEQ ID NO: 2778168 - RNA, 15 nt, Human
cuuuguaaauuguca

SEQ ID NO: 2778169 - RNA, 21 nt, Human
cuuuguaagaguguagaagca

SEQ ID NO: 2778170 - RNA, 22 nt, Human
cuuuguaagaguguagaagcau

SEQ ID NO: 2778171 - RNA, 21 nt, Human
cuuuguaagucaguguugaga

SEQ ID NO: 2778172 - RNA, 22 nt, Human
cuuuguaagucaguguugagau

SEQ ID NO: 2778173 - RNA, 17 nt, Human
cuuuguaagaguguaga

SEQ ID NO: 2778174 - RNA, 18 nt, Human
cuuuguaagaguguagaa

SEQ ID NO: 2778175 - RNA, 19 nt, Human
cuuuguaagaguguagaag

SEQ ID NO: 2778176 - RNA, 20 nt, Human
cuuuguaagaguguagaagc

SEQ ID NO: 2778177 - RNA, 16 nt, Human
cuuuguacagcccaga

SEQ ID NO: 2778178 - RNA, 17 nt, Human
cuuuguacagcccagag

SEQ ID NO: 2778179 - RNA, 13 nt, Human
cuuucaauucugu

SEQ ID NO: 2778180 - RNA, 17 nt, Human
cuuucacaaaauuuuau

SEQ ID NO: 2778181 - RNA, 14 nt, Human
cuuucacaaccuuc

SEQ ID NO: 2778182 - RNA, 20 nt, Human
cuuucacaaaauuuuauucc

SEQ ID NO: 2778183 - RNA, 20 nt, Human
cuuucacaacauuugcagau

SEQ ID NO: 2778184 - RNA, 20 nt, Human
cuuucagggaauuucaggaa

SEQ ID NO: 2778185 - RNA, 16 nt, Human
cuuucagggccauggu

SEQ ID NO: 2778186 - RNA, 19 nt, Human
cuuuccugauggcaggaug

SEQ ID NO: 2778187 - RNA, 22 nt, Human
cuuuccugaugguacaggaaag

SEQ ID NO: 2778188 - RNA, 13 nt, Human
cuuuccuuccuaa

SEQ ID NO: 2778189 - RNA, 14 nt, Human
cuuuccuuccuaau

SEQ ID NO: 2778190 - RNA, 15 nt, Human
cuuuccuuccauccc

SEQ ID NO: 2778191 - RNA, 13 nt, Human
cuuuccuggaugu

SEQ ID NO: 2778192 - RNA, 16 nt, Human
cuuuccuggaugucug

SEQ ID NO: 2778193 - RNA, 23 nt, Human
cuuuccuggaugucugaacuuug

SEQ ID NO: 2778194 - RNA, 20 nt, Human
cuuuccuggacacucagacc

SEQ ID NO: 2778195 - RNA, 23 nt, Human
cuuuccuggacacucagaccuga

SEQ ID NO: 2778196 - RNA, 17 nt, Human
cugugcucaggacucag

SEQ ID NO: 2778197 - RNA, 19 nt, Human
cugugagacccccacaccu

SEQ ID NO: 2778198 - RNA, 18 nt, Human
cugugagacccccacacc

SEQ ID NO: 2778199 - RNA, 17 nt, Human
cugugagacccccacac

SEQ ID NO: 2778200 - RNA, 16 nt, Human
cugugagacccccaca

SEQ ID NO: 2778201 - RNA, 23 nt, Human
cugugagacccccacaccucagu

SEQ ID NO: 2778202 - RNA, 20 nt, Human
cugugagacccccacaccuc

SEQ ID NO: 2778203 - RNA, 14 nt, Human
cugugcucuggaca

SEQ ID NO: 2778204 - RNA, 14 nt, Human
cugugcucccuggu

SEQ ID NO: 2778205 - RNA, 19 nt, Human
cugugcucaggacucagaa

SEQ ID NO: 2778206 - RNA, 18 nt, Human
cugugcucaggacucaga

SEQ ID NO: 2778207 - RNA, 23 nt, Human
cugugcucaggacucagaagccu

SEQ ID NO: 2778208 - RNA, 22 nt, Human
cugugcucccugguucugauga

SEQ ID NO: 2778209 - RNA, 14 nt, Human
cugugaagaucuca

SEQ ID NO: 2778210 - RNA, 21 nt, Human
cugugaagaucucacucugcc

SEQ ID NO: 2778211 - RNA, 20 nt, Human
cugugaagaucucacucugc

SEQ ID NO: 2778212 - RNA, 15 nt, Human
cugugagacccccac

SEQ ID NO: 2778213 - RNA, 14 nt, Human
cugugaaguaagga

SEQ ID NO: 2778214 - RNA, 13 nt, Human
cugucgcccaguc

SEQ ID NO: 2778215 - RNA, 16 nt, Human
cugucgcccaggcugg

SEQ ID NO: 2778216 - RNA, 22 nt, Human
cugucgaguucggcucugggug

SEQ ID NO: 2778217 - RNA, 23 nt, Human
cugucgaguucggcucugggugg

SEQ ID NO: 2778218 - RNA, 13 nt, Human
cuguccugcuggu

SEQ ID NO: 2778219 - RNA, 16 nt, Human
cugucauuugagcagg

SEQ ID NO: 2778220 - RNA, 18 nt, Human
cugucauuugagcagggc

SEQ ID NO: 2778221 - RNA, 17 nt, Human
cugucauuugagcaggg

SEQ ID NO: 2778222 - RNA, 12 nt, Human
cuguccugccua

SEQ ID NO: 2778223 - RNA, 20 nt, Human
cuguccugccaugcaagaac

SEQ ID NO: 2778224 - RNA, 12 nt, Human
cuguccugaucu

SEQ ID NO: 2778225 - RNA, 16 nt, Human
cuguccugaucuguga

SEQ ID NO: 2778226 - RNA, 17 nt, Human
cuguccugaucugugau

SEQ ID NO: 2778227 - RNA, 17 nt, Human
cugucagcgcagguuua

SEQ ID NO: 2778228 - RNA, 19 nt, Human
cuguaggaucuaaggcugu

SEQ ID NO: 2778229 - RNA, 22 nt, Human
cugucacucauugcugagccuc

SEQ ID NO: 2778230 - RNA, 23 nt, Human
cugucacucauugcugagccucu

SEQ ID NO: 2778231 - RNA, 16 nt, Human
cugucacccuccaccu

SEQ ID NO: 2778232 - RNA, 12 nt, Human
cugucagaaugc

SEQ ID NO: 2778233 - RNA, 17 nt, Human
cugucagaaugcuauug

SEQ ID NO: 2778234 - RNA, 16 nt, Human
cugucagaugagaaca

SEQ ID NO: 2778235 - RNA, 17 nt, Human
cugucagaugagaacaa

SEQ ID NO: 2778236 - RNA, 18 nt, Human
cugucagaugagaacaaa

SEQ ID NO: 2778237 - RNA, 19 nt, Human
cugucagaugagaacaaag

SEQ ID NO: 2778238 - RNA, 20 nt, Human
cugucagaugagaacaaagc

SEQ ID NO: 2778239 - RNA, 21 nt, Human
cugucagaugagaacaaagcu

SEQ ID NO: 2778240 - RNA, 22 nt, Human
cugucagaugagaacaaagcug

SEQ ID NO: 2778241 - RNA, 23 nt, Human
cugucagaugagaacaaagcugu

SEQ ID NO: 2778242 - RNA, 19 nt, Human
cuguacuuuucccauuugu

SEQ ID NO: 2778243 - RNA, 22 nt, Human
cuguaggagcuacccuuuuccu

SEQ ID NO: 2778244 - RNA, 14 nt, Human
cugucacucauugc

SEQ ID NO: 2778245 - RNA, 21 nt, Human
cugucacucauugcugagccu

SEQ ID NO: 2778246 - RNA, 14 nt, Human
cugucacggaggga

SEQ ID NO: 2778247 - RNA, 16 nt, Human
cugucacucaggcugg

SEQ ID NO: 2778248 - RNA, 17 nt, Human
cugucacucaggcugga

SEQ ID NO: 2778249 - RNA, 18 nt, Human
cugucacucaggcuggag

SEQ ID NO: 2778250 - RNA, 19 nt, Human
cugucacucaggcuggagu

SEQ ID NO: 2778251 - RNA, 14 nt, Human
cugucacccuccac

SEQ ID NO: 2778252 - RNA, 18 nt, Human
cugucacccuccaccucu

SEQ ID NO: 2778253 - RNA, 16 nt, Human
cugucaccucucccac

SEQ ID NO: 2778254 - RNA, 17 nt, Human
cugucaccucucccacg

SEQ ID NO: 2778255 - RNA, 13 nt, Human
cugucacauugca

SEQ ID NO: 2778256 - RNA, 14 nt, Human
cugucacauugcau

SEQ ID NO: 2778257 - RNA, 15 nt, Human
cugucacauugcauu

SEQ ID NO: 2778258 - RNA, 18 nt, Human
cugucacauugcauucua

SEQ ID NO: 2778259 - RNA, 19 nt, Human
cugucacauugcauucuau

SEQ ID NO: 2778260 - RNA, 15 nt, Human
cugucaccaaggaaa

SEQ ID NO: 2778261 - RNA, 16 nt, Human
cugucaccaaggaaac

SEQ ID NO: 2778262 - RNA, 14 nt, Human
cuguacuuggucca

SEQ ID NO: 2778263 - RNA, 17 nt, Human
cuguacuugguccaacu

SEQ ID NO: 2778264 - RNA, 20 nt, Human
cuguacuugguccaacugca

SEQ ID NO: 2778265 - RNA, 21 nt, Human
cuguacuugguccaacugcaa

SEQ ID NO: 2778266 - RNA, 23 nt, Human
cuguacuugguccaacugcaacu

SEQ ID NO: 2778267 - RNA, 22 nt, Human
cuguaaaccccuuuaguggcuu

SEQ ID NO: 2778268 - RNA, 20 nt, Human
cuguaaaccucucgagggca

SEQ ID NO: 2778269 - RNA, 12 nt, Human
cuguaaaacgcu

SEQ ID NO: 2778270 - RNA, 13 nt, Human
cuguaaaacgcug

SEQ ID NO: 2778271 - RNA, 16 nt, Human
cuguaaaacgcuguca

SEQ ID NO: 2778272 - RNA, 19 nt, Human
cuguaaaagagccuaguuu

SEQ ID NO: 2778273 - RNA, 18 nt, Human
cuguaaaagauuaaacug

SEQ ID NO: 2778274 - RNA, 23 nt, Human
cuguaaaauauacuuaaauggaa

SEQ ID NO: 2778275 - RNA, 22 nt, Human
cugguuuccugcccugggaggc

SEQ ID NO: 2778276 - RNA, 16 nt, Human
cugguuuccugcccug

SEQ ID NO: 2778277 - RNA, 15 nt, Human
cugguuucucauucu

SEQ ID NO: 2778278 - RNA, 16 nt, Human
cugguuucucauucuu

SEQ ID NO: 2778279 - RNA, 18 nt, Human
cugguuucucauucuugu

SEQ ID NO: 2778280 - RNA, 21 nt, Human
cugguuuccugcccugggagg

SEQ ID NO: 2778281 - RNA, 18 nt, Human
cugguuuccugcccuggg

SEQ ID NO: 2778282 - RNA, 13 nt, Human
cugggcagaccuu

SEQ ID NO: 2778283 - RNA, 20 nt, Human
cuggggaaagacacugccug

SEQ ID NO: 2778284 - RNA, 22 nt, Human
cuggggaaagacacugccuggg

SEQ ID NO: 2778285 - RNA, 21 nt, Human
cuggggaaagacacugccugg

SEQ ID NO: 2778286 - RNA, 23 nt, Human
cuggggaaagacacugccugggc

SEQ ID NO: 2778287 - RNA, 15 nt, Human
cuggggaaccugacc

SEQ ID NO: 2778288 - RNA, 17 nt, Human
cuggggaaccugacccc

SEQ ID NO: 2778289 - RNA, 16 nt, Human
cuggggaaccugaccc

SEQ ID NO: 2778290 - RNA, 16 nt, Human
cuggggcaagucccug

SEQ ID NO: 2778291 - RNA, 21 nt, Human
cuggggcaagucccugacucu

SEQ ID NO: 2778292 - RNA, 12 nt, Human
cuggggcacagu

SEQ ID NO: 2778293 - RNA, 16 nt, Human
cuggggcacaguccag

SEQ ID NO: 2778294 - RNA, 17 nt, Human
cuggggcacaguccagg

SEQ ID NO: 2778295 - RNA, 19 nt, Human
cuggggcacaguccaggaa

SEQ ID NO: 2778296 - RNA, 21 nt, Human
cuggggcacaguccaggaaca

SEQ ID NO: 2778297 - RNA, 14 nt, Human
cuggggcaaguccc

SEQ ID NO: 2778298 - RNA, 17 nt, Human
cuggggaugugggaggg

SEQ ID NO: 2778299 - RNA, 22 nt, Human
cuggggaugugggagggagcag

SEQ ID NO: 2778300 - RNA, 15 nt, Human
cuggggaugugggag

SEQ ID NO: 2778301 - RNA, 16 nt, Human
cuggggaugugggagg

SEQ ID NO: 2778302 - RNA, 14 nt, Human
cuggggaacauuuc

SEQ ID NO: 2778303 - RNA, 23 nt, Human
cuggguuccuuccucugagccuu

SEQ ID NO: 2778304 - RNA, 14 nt, Human
cuggguucacugca

SEQ ID NO: 2778305 - RNA, 14 nt, Human
cuggguucccuuuc

SEQ ID NO: 2778306 - RNA, 22 nt, Human
cuggguuccagcaauucuccug

SEQ ID NO: 2778307 - RNA, 20 nt, Human
cuggguucccuuuccuucca

SEQ ID NO: 2778308 - RNA, 16 nt, Human
cuggguucccuuuccu

SEQ ID NO: 2778309 - RNA, 21 nt, Human
cuggguucccuuuccuuccau

SEQ ID NO: 2778310 - RNA, 22 nt, Human
cuggguuccuuccucugagccu

SEQ ID NO: 2778311 - RNA, 18 nt, Human
cuggguuccuuccucuga

SEQ ID NO: 2778312 - RNA, 15 nt, Human
cuggggccucagacg

SEQ ID NO: 2778313 - RNA, 14 nt, Human
cuggguggcacugc

SEQ ID NO: 2778314 - RNA, 15 nt, Human
cuggguggcacugcc

SEQ ID NO: 2778315 - RNA, 16 nt, Human
cuggguggcacugcca

SEQ ID NO: 2778316 - RNA, 20 nt, Human
cuggguggcacugccaugca

SEQ ID NO: 2778317 - RNA, 11 nt, Human
cuggggccucc

SEQ ID NO: 2778318 - RNA, 12 nt, Human
cuggggccucca

SEQ ID NO: 2778319 - RNA, 15 nt, Human
cuggggccuccagaa

SEQ ID NO: 2778320 - RNA, 17 nt, Human
cuggggccuccagaacu

SEQ ID NO: 2778321 - RNA, 13 nt, Human
cuggguggccucg

SEQ ID NO: 2778322 - RNA, 19 nt, Human
cuggggccuagacucugua

SEQ ID NO: 2778323 - RNA, 21 nt, Human
cuggguggcacugccaugcag

SEQ ID NO: 2778324 - RNA, 16 nt, Human
cuggugauaaggacau

SEQ ID NO: 2778325 - RNA, 14 nt, Human
cuggugaggagcac

SEQ ID NO: 2778326 - RNA, 16 nt, Human
cuggugcacuuuguaa

SEQ ID NO: 2778327 - RNA, 13 nt, Human
cugggacacaguu

SEQ ID NO: 2778328 - RNA, 12 nt, Human
cugggacacagu

SEQ ID NO: 2778329 - RNA, 15 nt, Human
cuggcucccacaggc

SEQ ID NO: 2778330 - RNA, 20 nt, Human
cuggcuccagcuggccggga

SEQ ID NO: 2778331 - RNA, 18 nt, Human
cuggcuccagcuggccgg

SEQ ID NO: 2778332 - RNA, 14 nt, Human
cuggcuccagcugg

SEQ ID NO: 2778333 - RNA, 13 nt, Human
cuggcuccagcug

SEQ ID NO: 2778334 - RNA, 13 nt, Human
cuggcucaucucu

SEQ ID NO: 2778335 - RNA, 20 nt, Human
cuggagacuccuaggcagga

SEQ ID NO: 2778336 - RNA, 18 nt, Human
cuggagacuccuaggcag

SEQ ID NO: 2778337 - RNA, 19 nt, Human
cuggagacuccuaggcagg

SEQ ID NO: 2778338 - RNA, 17 nt, Human
cuggagaccagggagcc

SEQ ID NO: 2778339 - RNA, 18 nt, Human
cuggagaccagggagccu

SEQ ID NO: 2778340 - RNA, 19 nt, Human
cuggagaccagggagccuu

SEQ ID NO: 2778341 - RNA, 20 nt, Human
cuggagacguggaaccucug

SEQ ID NO: 2778342 - RNA, 21 nt, Human
cuggagacguggaaccucugu

SEQ ID NO: 2778343 - RNA, 22 nt, Human
cuggagacguggaaccucuguc

SEQ ID NO: 2778344 - RNA, 17 nt, Human
cuggagacccaccccac

SEQ ID NO: 2778345 - RNA, 19 nt, Human
cuggagacccaccccaccu

SEQ ID NO: 2778346 - RNA, 20 nt, Human
cuggagacccaccccaccug

SEQ ID NO: 2778347 - RNA, 21 nt, Human
cuggagacccaccccaccugc

SEQ ID NO: 2778348 - RNA, 23 nt, Human
cuggagacccaccccaccugcag

SEQ ID NO: 2778349 - RNA, 22 nt, Human
cuggagacagccccagagcagg

SEQ ID NO: 2778350 - RNA, 23 nt, Human
cuggagacagccccagagcaggg

SEQ ID NO: 2778351 - RNA, 21 nt, Human
cuggagacagccccagagcag

SEQ ID NO: 2778352 - RNA, 20 nt, Human
cuggacugucauagaaauua

SEQ ID NO: 2778353 - RNA, 19 nt, Human
cuggacugucauagaaauu

SEQ ID NO: 2778354 - RNA, 20 nt, Human
cuggcaggaugacccugcga

SEQ ID NO: 2778355 - RNA, 18 nt, Human
cuggcaggaugacccugc

SEQ ID NO: 2778356 - RNA, 23 nt, Human
cuggccccgccgccugguacuca

SEQ ID NO: 2778357 - RNA, 18 nt, Human
cuggccccggaucagagc

SEQ ID NO: 2778358 - RNA, 19 nt, Human
cuggccccggaucagagca

SEQ ID NO: 2778359 - RNA, 20 nt, Human
cuggccccggaucagagcag

SEQ ID NO: 2778360 - RNA, 21 nt, Human
cuggccccggaucagagcagg

SEQ ID NO: 2778361 - RNA, 23 nt, Human
cuggccccggaucagagcaggac

SEQ ID NO: 2778362 - RNA, 24 nt, Human
cuggccccggaucagagcaggacc

SEQ ID NO: 2778363 - RNA, 18 nt, Human
cuggccccucaaccuccu

SEQ ID NO: 2778364 - RNA, 15 nt, Human
cuggcagggggcaug

SEQ ID NO: 2778365 - RNA, 17 nt, Human
cuggcagggaggucagg

SEQ ID NO: 2778366 - RNA, 21 nt, Human
cuggcagggaggucaggcccu

SEQ ID NO: 2778367 - RNA, 22 nt, Human
cuggcagggaggucaggcccug

SEQ ID NO: 2778368 - RNA, 23 nt, Human
cuggcagggaggucaggcccugg

SEQ ID NO: 2778369 - RNA, 13 nt, Human
cuggcagggcugg

SEQ ID NO: 2778370 - RNA, 23 nt, Human
cuggcagggcuggccccagggca

SEQ ID NO: 2778371 - RNA, 12 nt, Human
cuggccccgccg

SEQ ID NO: 2778372 - RNA, 14 nt, Human
cuggccccgccgcc

SEQ ID NO: 2778373 - RNA, 16 nt, Human
cuggccccgccgccug

SEQ ID NO: 2778374 - RNA, 22 nt, Human
cuggccccgccgccugguacuc

SEQ ID NO: 2778375 - RNA, 16 nt, Human
cugggaccacgugaga

SEQ ID NO: 2778376 - RNA, 13 nt, Human
cugcuuuuugaaa

SEQ ID NO: 2778377 - RNA, 14 nt, Human
cugcuuuuugaaau

SEQ ID NO: 2778378 - RNA, 15 nt, Human
cugcuuuuugaaaug

SEQ ID NO: 2778379 - RNA, 16 nt, Human
cugcuuuuugaaauga

SEQ ID NO: 2778380 - RNA, 18 nt, Human
cugcuuuuugaaaugaaa

SEQ ID NO: 2778381 - RNA, 17 nt, Human
cugcuuuuuuuuuucca

SEQ ID NO: 2778382 - RNA, 18 nt, Human
cugcuuuuuuuuuuccag

SEQ ID NO: 2778383 - RNA, 19 nt, Human
cugcuuuuuuuuuuccagc

SEQ ID NO: 2778384 - RNA, 21 nt, Human
cugcuuuuuuuuuuccagcaa

SEQ ID NO: 2778385 - RNA, 22 nt, Human
cugcuuuuuuuuuuccagcaag

SEQ ID NO: 2778386 - RNA, 23 nt, Human
cugcuuuuuuuuuuccagcaagu

SEQ ID NO: 2778387 - RNA, 21 nt, Human
cuggaacagauucacacuguc

SEQ ID NO: 2778388 - RNA, 14 nt, Human
cuggaacagauuca

SEQ ID NO: 2778389 - RNA, 20 nt, Human
cuggaacaucaucaaggcac

SEQ ID NO: 2778390 - RNA, 17 nt, Human
cuggaacauccuuugca

SEQ ID NO: 2778391 - RNA, 18 nt, Human
cuggaacauccuuugcag

SEQ ID NO: 2778392 - RNA, 22 nt, Human
cuggaacauccuuugcagggca

SEQ ID NO: 2778393 - RNA, 23 nt, Human
cuggaacauccuuugcagggcag

SEQ ID NO: 2778394 - RNA, 24 nt, Human
cuggaacauccuuugcagggcagc

SEQ ID NO: 2778395 - RNA, 15 nt, Human
cuggaaccugcaaaa

SEQ ID NO: 2778396 - RNA, 16 nt, Human
cuggaaccugcaaaaa

SEQ ID NO: 2778397 - RNA, 18 nt, Human
cuggaaccugcaaaaaau

SEQ ID NO: 2778398 - RNA, 21 nt, Human
cuggaaccugcaaaaaauacu

SEQ ID NO: 2778399 - RNA, 15 nt, Human
cuggaaccuugcugu

SEQ ID NO: 2778400 - RNA, 16 nt, Human
cuggaaccuugcuguc

SEQ ID NO: 2778401 - RNA, 17 nt, Human
cuggaaccuugcugucc

SEQ ID NO: 2778402 - RNA, 18 nt, Human
cuggaaccuugcuguccu

SEQ ID NO: 2778403 - RNA, 19 nt, Human
cuggaaccuugcuguccug

SEQ ID NO: 2778404 - RNA, 20 nt, Human
cuggaaccuugcuguccuga

SEQ ID NO: 2778405 - RNA, 16 nt, Human
cuggaacggugaaggu

SEQ ID NO: 2778406 - RNA, 22 nt, Human
cuggaacggugaaggugacagc

SEQ ID NO: 2778407 - RNA, 13 nt, Human
cuggacugggagg

SEQ ID NO: 2778408 - RNA, 14 nt, Human
cuggacugggaggu

SEQ ID NO: 2778409 - RNA, 16 nt, Human
cuggacugggagguag

SEQ ID NO: 2778410 - RNA, 17 nt, Human
cuggacugggagguaga

SEQ ID NO: 2778411 - RNA, 18 nt, Human
cuggacugucauagaaau

SEQ ID NO: 2778412 - RNA, 21 nt, Human
cuggacuggcuagaguccuca

SEQ ID NO: 2778413 - RNA, 15 nt, Human
cuggacuggcuagag

SEQ ID NO: 2778414 - RNA, 19 nt, Human
cuggaacuccuaaaccuuu

SEQ ID NO: 2778415 - RNA, 19 nt, Human
cuggaacucuaucugggcc

SEQ ID NO: 2778416 - RNA, 20 nt, Human
cuggaacucuaucugggccu

SEQ ID NO: 2778417 - RNA, 22 nt, Human
cuggaacucuaucugggccugg

SEQ ID NO: 2778418 - RNA, 23 nt, Human
cuggaacucuaucugggccuggg

SEQ ID NO: 2778419 - RNA, 16 nt, Human
cugcuucagccucccg

SEQ ID NO: 2778420 - RNA, 14 nt, Human
cugcuucagccucc

SEQ ID NO: 2778421 - RNA, 13 nt, Human
cugcuucagccuc

SEQ ID NO: 2778422 - RNA, 23 nt, Human
cugcuucagauguggagccaggc

SEQ ID NO: 2778423 - RNA, 20 nt, Human
cugcugacagacacaggccc

SEQ ID NO: 2778424 - RNA, 19 nt, Human
cugcugacagacacaggcc

SEQ ID NO: 2778425 - RNA, 18 nt, Human
cugcugacagacacaggc

SEQ ID NO: 2778426 - RNA, 15 nt, Human
cugcugacagacaca

SEQ ID NO: 2778427 - RNA, 23 nt, Human
cugcugacagacacaggcccggc

SEQ ID NO: 2778428 - RNA, 21 nt, Human
cugcugacagacacaggcccg

SEQ ID NO: 2778429 - RNA, 18 nt, Human
cugcucagcaaccuuuca

SEQ ID NO: 2778430 - RNA, 18 nt, Human
cugccucgaacuggcugc

SEQ ID NO: 2778431 - RNA, 17 nt, Human
cugccucgaacuggcug

SEQ ID NO: 2778432 - RNA, 15 nt, Human
cugccucgaacuggc

SEQ ID NO: 2778433 - RNA, 15 nt, Human
cugccuguucagcuc

SEQ ID NO: 2778434 - RNA, 14 nt, Human
cugccuguucagcu

SEQ ID NO: 2778435 - RNA, 22 nt, Human
cugccuguuaggagaagcugca

SEQ ID NO: 2778436 - RNA, 14 nt, Human
cugccugugcugug

SEQ ID NO: 2778437 - RNA, 12 nt, Human
cugccugugcug

SEQ ID NO: 2778438 - RNA, 12 nt, Human
cugccugggcug

SEQ ID NO: 2778439 - RNA, 23 nt, Human
cugccugggcugaccccgguggc

SEQ ID NO: 2778440 - RNA, 11 nt, Human
cugccugggcu

SEQ ID NO: 2778441 - RNA, 22 nt, Human
cugccuggguuccaauccuggc

SEQ ID NO: 2778442 - RNA, 21 nt, Human
cugcuaccguugacuuccagg

SEQ ID NO: 2778443 - RNA, 16 nt, Human
cugcuacacauacagg

SEQ ID NO: 2778444 - RNA, 17 nt, Human
cugcuacccagaaauca

SEQ ID NO: 2778445 - RNA, 15 nt, Human
cugcuacccuagaug

SEQ ID NO: 2778446 - RNA, 11 nt, Human
cugcucagcca

SEQ ID NO: 2778447 - RNA, 15 nt, Human
cugcucagccaagcu

SEQ ID NO: 2778448 - RNA, 16 nt, Human
cugcucagccaagcuu

SEQ ID NO: 2778449 - RNA, 12 nt, Human
cugcucacuuua

SEQ ID NO: 2778450 - RNA, 18 nt, Human
cugcucacuuuaaaccug

SEQ ID NO: 2778451 - RNA, 13 nt, Human
cugcucagacaga

SEQ ID NO: 2778452 - RNA, 16 nt, Human
cugcuaauuccccaga

SEQ ID NO: 2778453 - RNA, 20 nt, Human
cugagacucacaggaaggag

SEQ ID NO: 2778454 - RNA, 14 nt, Human
cugaccuuggagag

SEQ ID NO: 2778455 - RNA, 19 nt, Human
cugaccuuggagagacaca

SEQ ID NO: 2778456 - RNA, 20 nt, Human
cugaccuuggagagacacag

SEQ ID NO: 2778457 - RNA, 21 nt, Human
cugaccuuggagagacacagc

SEQ ID NO: 2778458 - RNA, 15 nt, Human
cugccaaggccagag

SEQ ID NO: 2778459 - RNA, 22 nt, Human
cugccaacuucuucagagcuga

SEQ ID NO: 2778460 - RNA, 12 nt, Human
cugccaagagag

SEQ ID NO: 2778461 - RNA, 22 nt, Human
cugccaaggccagaguggccug

SEQ ID NO: 2778462 - RNA, 21 nt, Human
cugccaaggccagaguggccu

SEQ ID NO: 2778463 - RNA, 18 nt, Human
cugccaaggccagagugg

SEQ ID NO: 2778464 - RNA, 15 nt, Human
cugcauuuuucugca

SEQ ID NO: 2778465 - RNA, 16 nt, Human
cugcauuuuucugcag

SEQ ID NO: 2778466 - RNA, 17 nt, Human
cugcauuuuucugcaga

SEQ ID NO: 2778467 - RNA, 21 nt, Human
cugccaaagggaaauaucauu

SEQ ID NO: 2778468 - RNA, 21 nt, Human
cugccaacuucuucagagcug

SEQ ID NO: 2778469 - RNA, 14 nt, Human
cugcauuucugagu

SEQ ID NO: 2778470 - RNA, 18 nt, Human
cugcauuuucaccccacc

SEQ ID NO: 2778471 - RNA, 17 nt, Human
cugcauuuucaccccac

SEQ ID NO: 2778472 - RNA, 14 nt, Human
cugcauuugugaaa

SEQ ID NO: 2778473 - RNA, 15 nt, Human
cugcauuugugaaau

SEQ ID NO: 2778474 - RNA, 17 nt, Human
cugcauuugugaaauga

SEQ ID NO: 2778475 - RNA, 22 nt, Human
cugcauuugugaaaugauggug

SEQ ID NO: 2778476 - RNA, 12 nt, Human
cugcauuagaaa

SEQ ID NO: 2778477 - RNA, 13 nt, Human
cugcauuagaaaa

SEQ ID NO: 2778478 - RNA, 14 nt, Human
cugcauuagaaaaa

SEQ ID NO: 2778479 - RNA, 15 nt, Human
cugcauuagaaaaag

SEQ ID NO: 2778480 - RNA, 21 nt, Human
cugcauguggcuuuuuuaaaa

SEQ ID NO: 2778481 - RNA, 22 nt, Human
cugcauguggcuuuuuuaaaaa

SEQ ID NO: 2778482 - RNA, 15 nt, Human
cugcauuauucucuu

SEQ ID NO: 2778483 - RNA, 17 nt, Human
cugcauuauucucuuuu

SEQ ID NO: 2778484 - RNA, 18 nt, Human
cugcauuauucucuuuua

SEQ ID NO: 2778485 - RNA, 13 nt, Human
cugcauuucugag

SEQ ID NO: 2778486 - RNA, 13 nt, Human
cugcauuugugaa

SEQ ID NO: 2778487 - RNA, 20 nt, Human
cugcauucaggaucaaaccc

SEQ ID NO: 2778488 - RNA, 21 nt, Human
cugcauucugccucucuagga

SEQ ID NO: 2778489 - RNA, 17 nt, Human
cugcauugcuagauaaa

SEQ ID NO: 2778490 - RNA, 18 nt, Human
cugcauugcuagauaaaa

SEQ ID NO: 2778491 - RNA, 19 nt, Human
cugcauugcuagauaaaag

SEQ ID NO: 2778492 - RNA, 21 nt, Human
cugcauugcuagauaaaagcu

SEQ ID NO: 2778493 - RNA, 17 nt, Human
cugcauugcccagucuu

SEQ ID NO: 2778494 - RNA, 18 nt, Human
cugcccccucugcccugc

SEQ ID NO: 2778495 - RNA, 17 nt, Human
cugcccccucugcccug

SEQ ID NO: 2778496 - RNA, 16 nt, Human
cugcccccucugcccu

SEQ ID NO: 2778497 - RNA, 17 nt, Human
cugcccuggugcugcca

SEQ ID NO: 2778498 - RNA, 16 nt, Human
cugcccuggugcugcc

SEQ ID NO: 2778499 - RNA, 18 nt, Human
cugcccuggugcugccac

SEQ ID NO: 2778500 - RNA, 19 nt, Human
cugcccuggugcugccaca

SEQ ID NO: 2778501 - RNA, 22 nt, Human
cugccccucccccaacccccac

SEQ ID NO: 2778502 - RNA, 14 nt, Human
cugccccuccccca

SEQ ID NO: 2778503 - RNA, 13 nt, Human
cugccccuccccc

SEQ ID NO: 2778504 - RNA, 21 nt, Human
cugcccugguuuccugcccug

SEQ ID NO: 2778505 - RNA, 13 nt, Human
cugcccuguaccc

SEQ ID NO: 2778506 - RNA, 21 nt, Human
cugcccuguaccccagcacuu

SEQ ID NO: 2778507 - RNA, 20 nt, Human
cugcccuggugcugccacac

SEQ ID NO: 2778508 - RNA, 21 nt, Human
cugcccuggugcugccacacu

SEQ ID NO: 2778509 - RNA, 23 nt, Human
cugcccugguuuccugcccuggg

SEQ ID NO: 2778510 - RNA, 22 nt, Human
cugcccugguuuccugcccugg

SEQ ID NO: 2778511 - RNA, 23 nt, Human
cugccauauucuguuggccagug

SEQ ID NO: 2778512 - RNA, 22 nt, Human
cugccauauucuguuggccagu

SEQ ID NO: 2778513 - RNA, 21 nt, Human
cugccauauucuguuggccag

SEQ ID NO: 2778514 - RNA, 20 nt, Human
cugccauauucuguuggcca

SEQ ID NO: 2778515 - RNA, 15 nt, Human
cugccaggcccccac

SEQ ID NO: 2778516 - RNA, 19 nt, Human
cugccaggcccccaccaca

SEQ ID NO: 2778517 - RNA, 20 nt, Human
cugccaggcccccaccacac

SEQ ID NO: 2778518 - RNA, 21 nt, Human
cugccaggcccccaccacaca

SEQ ID NO: 2778519 - RNA, 22 nt, Human
cugccaggcccccaccacacau

SEQ ID NO: 2778520 - RNA, 23 nt, Human
cugccaggcccccaccacacauc

SEQ ID NO: 2778521 - RNA, 14 nt, Human
cugccaggccccca

SEQ ID NO: 2778522 - RNA, 23 nt, Human
cugccaaggccagaguggccugg

SEQ ID NO: 2778523 - RNA, 17 nt, Human
cugccaauaacauucuu

SEQ ID NO: 2778524 - RNA, 12 nt, Human
cugccauccagg

SEQ ID NO: 2778525 - RNA, 16 nt, Human
cugccccagcucuggc

SEQ ID NO: 2778526 - RNA, 19 nt, Human
cugccccagcucuggcuuc

SEQ ID NO: 2778527 - RNA, 18 nt, Human
cugccccagcucuggcuu

SEQ ID NO: 2778528 - RNA, 15 nt, Human
cugccccagcucugg

SEQ ID NO: 2778529 - RNA, 15 nt, Human
cugcccccucugccc

SEQ ID NO: 2778530 - RNA, 14 nt, Human
cugcccccucugcc

SEQ ID NO: 2778531 - RNA, 19 nt, Human
cugccccagggcucccggc

SEQ ID NO: 2778532 - RNA, 15 nt, Human
cugcauguuaccauc

SEQ ID NO: 2778533 - RNA, 23 nt, Human
cugccccagucguuagaauauag

SEQ ID NO: 2778534 - RNA, 20 nt, Human
aacuagagaugacugagucc

SEQ ID NO: 2778535 - RNA, 16 nt, Human
aacuagagaugugcaa

SEQ ID NO: 2778536 - RNA, 21 nt, Human
aacuagagaugugcaauugau

SEQ ID NO: 2778537 - RNA, 23 nt, Human
aacuagacucccaagcuggacua

SEQ ID NO: 2778538 - RNA, 20 nt, Human
aacuagacucccaagcugga

SEQ ID NO: 2778539 - RNA, 15 nt, Human
aacuacauuuaugag

SEQ ID NO: 2778540 - RNA, 14 nt, Human
aacuagaugaccuc

SEQ ID NO: 2778541 - RNA, 23 nt, Human
aacuaugagcuugcucauuaauu

SEQ ID NO: 2778542 - RNA, 11 nt, Human
aacuaucuugg

SEQ ID NO: 2778543 - RNA, 18 nt, Human
aacuaucuuggugaauuu

SEQ ID NO: 2778544 - RNA, 13 nt, Human
aacuaucuugugu

SEQ ID NO: 2778545 - RNA, 15 nt, Human
aacuaugaaaccuuu

SEQ ID NO: 2778546 - RNA, 16 nt, Human
aacuaugauuuggaaa

SEQ ID NO: 2778547 - RNA, 21 nt, Human
aacuaugauuuggaaaauaaa

SEQ ID NO: 2778548 - RNA, 17 nt, Human
aaccuucuggccuccca

SEQ ID NO: 2778549 - RNA, 16 nt, Human
aaccugugaguaaaua

SEQ ID NO: 2778550 - RNA, 18 nt, Human
aaccugugaguaaauauu

SEQ ID NO: 2778551 - RNA, 13 nt, Human
aaccuugaaugcu

SEQ ID NO: 2778552 - RNA, 14 nt, Human
aaccuugaaugcug

SEQ ID NO: 2778553 - RNA, 15 nt, Human
aaccuugaaugcugc

SEQ ID NO: 2778554 - RNA, 16 nt, Human
aaccuugaaugcugcc

SEQ ID NO: 2778555 - RNA, 17 nt, Human
aaccuugaaugcugcca

SEQ ID NO: 2778556 - RNA, 18 nt, Human
aaccuugaaugcugccag

SEQ ID NO: 2778557 - RNA, 19 nt, Human
aaccuugaaugcugccagu

SEQ ID NO: 2778558 - RNA, 20 nt, Human
aaccuugaaugcugccagug

SEQ ID NO: 2778559 - RNA, 19 nt, Human
aacuacgcuugcucauuuu

SEQ ID NO: 2778560 - RNA, 18 nt, Human
aacuacuaucucagagau

SEQ ID NO: 2778561 - RNA, 15 nt, Human
aacuacuauucaaaa

SEQ ID NO: 2778562 - RNA, 13 nt, Human
aacuacucuuuga

SEQ ID NO: 2778563 - RNA, 14 nt, Human
aacuacucuuugau

SEQ ID NO: 2778564 - RNA, 15 nt, Human
aacuacucuuugauu

SEQ ID NO: 2778565 - RNA, 16 nt, Human
aacuacucuuugauuu

SEQ ID NO: 2778566 - RNA, 11 nt, Human
aaccuugcugu

SEQ ID NO: 2778567 - RNA, 13 nt, Human
aaccuugcugucc

SEQ ID NO: 2778568 - RNA, 16 nt, Human
aaccuugcuguccuga

SEQ ID NO: 2778569 - RNA, 22 nt, Human
aacuacaugagaacaaacagau

SEQ ID NO: 2778570 - RNA, 16 nt, Human
aacuacccaaaacaag

SEQ ID NO: 2778571 - RNA, 21 nt, Human
aacuacccaaaacaagccugg

SEQ ID NO: 2778572 - RNA, 17 nt, Human
aacuacccuuaauuacu

SEQ ID NO: 2778573 - RNA, 18 nt, Human
aacuacccuuaauuacuu

SEQ ID NO: 2778574 - RNA, 21 nt, Human
aacuacccuuaauuacuuaaa

SEQ ID NO: 2778575 - RNA, 20 nt, Human
aacuaccucgcaucauugca

SEQ ID NO: 2778576 - RNA, 23 nt, Human
aacuaccucgcaucauugcagau

SEQ ID NO: 2778577 - RNA, 12 nt, Human
aacuccuggccu

SEQ ID NO: 2778578 - RNA, 19 nt, Human
aacuaucuggccauauuua

SEQ ID NO: 2778579 - RNA, 19 nt, Human
aacucuaucugggccuggg

SEQ ID NO: 2778580 - RNA, 21 nt, Human
aacucuaucugggccugggcu

SEQ ID NO: 2778581 - RNA, 19 nt, Human
aacucauuuguuaaaauua

SEQ ID NO: 2778582 - RNA, 17 nt, Human
aacucauuuuugccaua

SEQ ID NO: 2778583 - RNA, 19 nt, Human
aacucauuuuugccauaca

SEQ ID NO: 2778584 - RNA, 11 nt, Human
aacuccuuggc

SEQ ID NO: 2778585 - RNA, 12 nt, Human
aacuccuuggcc

SEQ ID NO: 2778586 - RNA, 13 nt, Human
aacuccuuggccu

SEQ ID NO: 2778587 - RNA, 23 nt, Human
gugaaccaccacacccagcccac

SEQ ID NO: 2778588 - RNA, 22 nt, Human
gugaaccaccacacccagccca

SEQ ID NO: 2778589 - RNA, 17 nt, Human
gugaacuagggaagcuc

SEQ ID NO: 2778590 - RNA, 19 nt, Human
gugaacuauuucuacacag

SEQ ID NO: 2778591 - RNA, 20 nt, Human
gugaacuauuucuacacagu

SEQ ID NO: 2778592 - RNA, 21 nt, Human
gugaacguccacaugaaaccu

SEQ ID NO: 2778593 - RNA, 15 nt, Human
gugaaccucaccccg

SEQ ID NO: 2778594 - RNA, 22 nt, Human
gugaaccucaccccgaggcccu

SEQ ID NO: 2778595 - RNA, 23 nt, Human
gugaaccucaccccgaggcccug

SEQ ID NO: 2778596 - RNA, 15 nt, Human
aacucuccagugccu

SEQ ID NO: 2778597 - RNA, 15 nt, Human
gucuuugguucagcu

SEQ ID NO: 2778598 - RNA, 22 nt, Human
gucuuuggggucuacacugcaa

SEQ ID NO: 2778599 - RNA, 15 nt, Human
gucuuugguucuaag

SEQ ID NO: 2778600 - RNA, 17 nt, Human
gucuuugguucuaagga

SEQ ID NO: 2778601 - RNA, 11 nt, Human
gucuuuguaag

SEQ ID NO: 2778602 - RNA, 18 nt, Human
gucuuuaggucuuuguaa

SEQ ID NO: 2778603 - RNA, 21 nt, Human
gucuuuaggucuuuguaagaa

SEQ ID NO: 2778604 - RNA, 22 nt, Human
gucuuuaggucuuuguaagaac

SEQ ID NO: 2778605 - RNA, 15 nt, Human
gucuuucaagaauga

SEQ ID NO: 2778606 - RNA, 15 nt, Human
gucuuucacagcucc

SEQ ID NO: 2778607 - RNA, 16 nt, Human
gucuuucacagcuccu

SEQ ID NO: 2778608 - RNA, 23 nt, Human
gucuuuaauuucugucagaaugc

SEQ ID NO: 2778609 - RNA, 18 nt, Human
gucuuuacuccucacacu

SEQ ID NO: 2778610 - RNA, 23 nt, Human
gucuucuaaacuuccccaucuuc

SEQ ID NO: 2778611 - RNA, 14 nt, Human
gucuucuaaacuuc

SEQ ID NO: 2778612 - RNA, 13 nt, Human
gucuucuaauuuc

SEQ ID NO: 2778613 - RNA, 15 nt, Human
gucuucuaauuucaa

SEQ ID NO: 2778614 - RNA, 23 nt, Human
gucuucuaauuucaaaaauauaa

SEQ ID NO: 2778615 - RNA, 19 nt, Human
gucuuuugaauauucccaa

SEQ ID NO: 2778616 - RNA, 22 nt, Human
gucuuuguaagaguguagaagc

SEQ ID NO: 2778617 - RNA, 20 nt, Human
gucuuuguaagaguguagaa

SEQ ID NO: 2778618 - RNA, 21 nt, Human
gucuuuguaagaguguagaag

SEQ ID NO: 2778619 - RNA, 15 nt, Human
gucuuuguaagucag

SEQ ID NO: 2778620 - RNA, 21 nt, Human
gucuuuguaagucaguguuga

SEQ ID NO: 2778621 - RNA, 23 nt, Human
gucuuuguaagucaguguugaga

SEQ ID NO: 2778622 - RNA, 12 nt, Human
gucuuuguaaga

SEQ ID NO: 2778623 - RNA, 13 nt, Human
gucuuuguaagag

SEQ ID NO: 2778624 - RNA, 14 nt, Human
gucuuuguaagagu

SEQ ID NO: 2778625 - RNA, 15 nt, Human
gucuuuguaagagug

SEQ ID NO: 2778626 - RNA, 15 nt, Human
gucuuuuguucgcau

SEQ ID NO: 2778627 - RNA, 17 nt, Human
gucuuuuucuguuguaa

SEQ ID NO: 2778628 - RNA, 19 nt, Human
gucuuuuucuguuguaacu

SEQ ID NO: 2778629 - RNA, 20 nt, Human
gucuuuuucuguuguaacuu

SEQ ID NO: 2778630 - RNA, 22 nt, Human
gucuuuuucuguuguaacuuau

SEQ ID NO: 2778631 - RNA, 11 nt, Human
gucuuuuugua

SEQ ID NO: 2778632 - RNA, 14 nt, Human
gucuuuuuguaagu

SEQ ID NO: 2778633 - RNA, 16 nt, Human
gucuuuuuaugcauuu

SEQ ID NO: 2778634 - RNA, 23 nt, Human
aaccuggucacaggacucugccu

SEQ ID NO: 2778635 - RNA, 22 nt, Human
aaccuguauaacccuguuacaa

SEQ ID NO: 2778636 - RNA, 13 nt, Human
aaccuguaucuuu

SEQ ID NO: 2778637 - RNA, 16 nt, Human
aaccuguaucuuucua

SEQ ID NO: 2778638 - RNA, 15 nt, Human
aaccugucuccacug

SEQ ID NO: 2778639 - RNA, 18 nt, Human
aaccugucuccacugugc

SEQ ID NO: 2778640 - RNA, 22 nt, Human
aaccugucuccacugugccuuu

SEQ ID NO: 2778641 - RNA, 24 nt, Human
aaccugucuccacugugccuuugc

SEQ ID NO: 2778642 - RNA, 23 nt, Human
aaccuguccuaaggaaccuuccu

SEQ ID NO: 2778643 - RNA, 15 nt, Human
aaccuguccuaagga

SEQ ID NO: 2778644 - RNA, 16 nt, Human
gucugguuuuaacaau

SEQ ID NO: 2778645 - RNA, 18 nt, Human
gucugguuuuaacaauuu

SEQ ID NO: 2778646 - RNA, 21 nt, Human
gucugguuuuaacaauuuccu

SEQ ID NO: 2778647 - RNA, 14 nt, Human
gucuguacacgugu

SEQ ID NO: 2778648 - RNA, 19 nt, Human
gucuguacacguguccugu

SEQ ID NO: 2778649 - RNA, 20 nt, Human
gucuguacacguguccugua

SEQ ID NO: 2778650 - RNA, 21 nt, Human
gucuguacacguguccuguag

SEQ ID NO: 2778651 - RNA, 15 nt, Human
gucuguacuaaaaau

SEQ ID NO: 2778652 - RNA, 19 nt, Human
gucuguauuuaugugugag

SEQ ID NO: 2778653 - RNA, 23 nt, Human
gucuguauuuaugugugaggagc

SEQ ID NO: 2778654 - RNA, 12 nt, Human
gucuguauuuca

SEQ ID NO: 2778655 - RNA, 14 nt, Human
gucuguauuucaug

SEQ ID NO: 2778656 - RNA, 17 nt, Human
gucuguauuucaugugg

SEQ ID NO: 2778657 - RNA, 18 nt, Human
gucuguauuucauguggc

SEQ ID NO: 2778658 - RNA, 20 nt, Human
gucuguauuucauguggcug

SEQ ID NO: 2778659 - RNA, 21 nt, Human
gucuguauuucauguggcugu

SEQ ID NO: 2778660 - RNA, 16 nt, Human
gucugucgugaugggg

SEQ ID NO: 2778661 - RNA, 13 nt, Human
gucuguccaucug

SEQ ID NO: 2778662 - RNA, 14 nt, Human
gucuguccaucugc

SEQ ID NO: 2778663 - RNA, 22 nt, Human
gucuguccaucugcccgccugc

SEQ ID NO: 2778664 - RNA, 21 nt, Human
aaccugaaaaaaaguuuacaa

SEQ ID NO: 2778665 - RNA, 19 nt, Human
aaccugacaaaaaaaaagu

SEQ ID NO: 2778666 - RNA, 11 nt, Human
aaccugacccc

SEQ ID NO: 2778667 - RNA, 11 nt, Human
aaccugaaaaa

SEQ ID NO: 2778668 - RNA, 20 nt, Human
aaccccuuaagcccuggccc

SEQ ID NO: 2778669 - RNA, 12 nt, Human
aaccccuguccc

SEQ ID NO: 2778670 - RNA, 23 nt, Human
aaccccugucccaugcaggcccu

SEQ ID NO: 2778671 - RNA, 15 nt, Human
aaccccuucucugug

SEQ ID NO: 2778672 - RNA, 16 nt, Human
aaccccuucucuguga

SEQ ID NO: 2778673 - RNA, 18 nt, Human
aaccccuucucugugacc

SEQ ID NO: 2778674 - RNA, 20 nt, Human
aaccccuucucugugaccca

SEQ ID NO: 2778675 - RNA, 21 nt, Human
aaccucauugacaagaacuga

SEQ ID NO: 2778676 - RNA, 16 nt, Human
aaccucauugacaaga

SEQ ID NO: 2778677 - RNA, 22 nt, Human
aaccuccauucuauuuuagaau

SEQ ID NO: 2778678 - RNA, 15 nt, Human
aaccucccaacccag

SEQ ID NO: 2778679 - RNA, 11 nt, Human
aaccucccaga

SEQ ID NO: 2778680 - RNA, 12 nt, Human
aaccucccagag

SEQ ID NO: 2778681 - RNA, 13 nt, Human
aaccucccagagg

SEQ ID NO: 2778682 - RNA, 17 nt, Human
aaccucccagaggucca

SEQ ID NO: 2778683 - RNA, 18 nt, Human
aaccucccagagguccag

SEQ ID NO: 2778684 - RNA, 20 nt, Human
aaccucccagagguccagcc

SEQ ID NO: 2778685 - RNA, 21 nt, Human
aaccucccagagguccagccc

SEQ ID NO: 2778686 - RNA, 23 nt, Human
aaccucccagagguccagcccau

SEQ ID NO: 2778687 - RNA, 24 nt, Human
aaccucccagagguccagcccauc

SEQ ID NO: 2778688 - RNA, 18 nt, Human
aaccucaggcuuccuugg

SEQ ID NO: 2778689 - RNA, 17 nt, Human
aacccagcaguucuguu

SEQ ID NO: 2778690 - RNA, 20 nt, Human
aacccacuugucacugacac

SEQ ID NO: 2778691 - RNA, 21 nt, Human
aacccacuugucacugacaca

SEQ ID NO: 2778692 - RNA, 22 nt, Human
aaccccgucgaggggcucucag

SEQ ID NO: 2778693 - RNA, 21 nt, Human
aaccccuacaugaaacagaaa

SEQ ID NO: 2778694 - RNA, 19 nt, Human
aacccccaccccacacuug

SEQ ID NO: 2778695 - RNA, 17 nt, Human
aaccccauguccucagc

SEQ ID NO: 2778696 - RNA, 18 nt, Human
aaccccauguccucagca

SEQ ID NO: 2778697 - RNA, 18 nt, Human
aacccccaccccacacuu

SEQ ID NO: 2778698 - RNA, 17 nt, Human
aacccccaccccacacu

SEQ ID NO: 2778699 - RNA, 15 nt, Human
aacccccaccccaca

SEQ ID NO: 2778700 - RNA, 13 nt, Human
aacccccacccca

SEQ ID NO: 2778701 - RNA, 12 nt, Human
aacccccacccc

SEQ ID NO: 2778702 - RNA, 11 nt, Human
aacccccaccc

SEQ ID NO: 2778703 - RNA, 10 nt, Human
aacccccacc

SEQ ID NO: 2778704 - RNA, 23 nt, Human
aaccauuugaaguguaccugugu

SEQ ID NO: 2778705 - RNA, 14 nt, Human
aaccauuuuauaaa

SEQ ID NO: 2778706 - RNA, 17 nt, Human
aaccauuuuauaaagug

SEQ ID NO: 2778707 - RNA, 20 nt, Human
aaccauuuuauaaagugcuu

SEQ ID NO: 2778708 - RNA, 22 nt, Human
aaccauuuuauaaagugcuugu

SEQ ID NO: 2778709 - RNA, 15 nt, Human
aacccaagcuuagaa

SEQ ID NO: 2778710 - RNA, 16 nt, Human
aacccaagcuuagaac

SEQ ID NO: 2778711 - RNA, 13 nt, Human
aacccaagcuccu

SEQ ID NO: 2778712 - RNA, 14 nt, Human
aacccaagcuccuc

SEQ ID NO: 2778713 - RNA, 15 nt, Human
aacccaagcuccucc

SEQ ID NO: 2778714 - RNA, 16 nt, Human
aacccaagcuccuccu

SEQ ID NO: 2778715 - RNA, 14 nt, Human
aacccaauccaaau

SEQ ID NO: 2778716 - RNA, 13 nt, Human
aacccaauaguug

SEQ ID NO: 2778717 - RNA, 18 nt, Human
aacccaaggacugaggga

SEQ ID NO: 2778718 - RNA, 13 nt, Human
aacccaaggagca

SEQ ID NO: 2778719 - RNA, 16 nt, Human
aacccaaggagcacag

SEQ ID NO: 2778720 - RNA, 17 nt, Human
aacccaaggagcacagg

SEQ ID NO: 2778721 - RNA, 20 nt, Human
aacccaaggagcacaggucc

SEQ ID NO: 2778722 - RNA, 21 nt, Human
aacccaaggagcacagguccc

SEQ ID NO: 2778723 - RNA, 22 nt, Human
aacccaaggagcacagguccca

SEQ ID NO: 2778724 - RNA, 17 nt, Human
aaccauuccauuuccaa

SEQ ID NO: 2778725 - RNA, 23 nt, Human
aaccauuccauuuccaagcacuu

SEQ ID NO: 2778726 - RNA, 14 nt, Human
aaccauauuuagca

SEQ ID NO: 2778727 - RNA, 13 nt, Human
aaccauaugauac

SEQ ID NO: 2778728 - RNA, 14 nt, Human
aaccauaugauacu

SEQ ID NO: 2778729 - RNA, 12 nt, Human
aaccauaugccc

SEQ ID NO: 2778730 - RNA, 21 nt, Human
aaccaccacacccagcccacu

SEQ ID NO: 2778731 - RNA, 20 nt, Human
aaccaagucaugugcauuuc

SEQ ID NO: 2778732 - RNA, 21 nt, Human
aaccaagucggaacagcagau

SEQ ID NO: 2778733 - RNA, 16 nt, Human
aacaguuagcuggagc

SEQ ID NO: 2778734 - RNA, 16 nt, Human
aacaguucauguuugc

SEQ ID NO: 2778735 - RNA, 14 nt, Human
aacaguuccuucag

SEQ ID NO: 2778736 - RNA, 23 nt, Human
aacaguucauguuugcuucauaa

SEQ ID NO: 2778737 - RNA, 19 nt, Human
aacaguuaauaccauuuuu

SEQ ID NO: 2778738 - RNA, 13 nt, Human
gucucccugggag

SEQ ID NO: 2778739 - RNA, 14 nt, Human
gucucccuucuguu

SEQ ID NO: 2778740 - RNA, 16 nt, Human
gucuccuuaacacuga

SEQ ID NO: 2778741 - RNA, 18 nt, Human
gucuccuuucaccccagg

SEQ ID NO: 2778742 - RNA, 22 nt, Human
gucuccuuaacacugagcuguc

SEQ ID NO: 2778743 - RNA, 16 nt, Human
gucuccuuuaagagcu

SEQ ID NO: 2778744 - RNA, 19 nt, Human
aaccaccacacccagccca

SEQ ID NO: 2778745 - RNA, 16 nt, Human
aaccaagucaugugca

SEQ ID NO: 2778746 - RNA, 21 nt, Human
aaccaaggaaauauauuuuac

SEQ ID NO: 2778747 - RNA, 16 nt, Human
aaccaagccguggcuu

SEQ ID NO: 2778748 - RNA, 19 nt, Human
gucucgaacuccugaccuu

SEQ ID NO: 2778749 - RNA, 20 nt, Human
aaccaagcuauuccuuuccc

SEQ ID NO: 2778750 - RNA, 18 nt, Human
aaccaagccguggcuucc

SEQ ID NO: 2778751 - RNA, 18 nt, Human
gucucgaacuccugaccu

SEQ ID NO: 2778752 - RNA, 13 nt, Human
gucucgaacuccu

SEQ ID NO: 2778753 - RNA, 20 nt, Human
gucuccuuucaccccagggc

SEQ ID NO: 2778754 - RNA, 21 nt, Human
gucuccuuucucagccacaaa

SEQ ID NO: 2778755 - RNA, 14 nt, Human
aacuguacauuuaa

SEQ ID NO: 2778756 - RNA, 18 nt, Human
aacuguacauuuaaaauu

SEQ ID NO: 2778757 - RNA, 13 nt, Human
aacuguacauuuc

SEQ ID NO: 2778758 - RNA, 23 nt, Human
aacuguacauuucacaggcuaau

SEQ ID NO: 2778759 - RNA, 18 nt, Human
aacuguacuuuuaaggca

SEQ ID NO: 2778760 - RNA, 23 nt, Human
aacuggguaaaugcaaaguucug

SEQ ID NO: 2778761 - RNA, 18 nt, Human
aacuggugcacuuuguaa

SEQ ID NO: 2778762 - RNA, 20 nt, Human
aacuggugcacuuuguaaau

SEQ ID NO: 2778763 - RNA, 21 nt, Human
aacuggugcacuuuguaaauu

SEQ ID NO: 2778764 - RNA, 17 nt, Human
aacuguaacguuuucuu

SEQ ID NO: 2778765 - RNA, 13 nt, Human
aacuguaaauaaa

SEQ ID NO: 2778766 - RNA, 20 nt, Human
aacuguaaaaaaugugugua

SEQ ID NO: 2778767 - RNA, 18 nt, Human
aacuucccagugaauucu

SEQ ID NO: 2778768 - RNA, 12 nt, Human
aacuucauucuc

SEQ ID NO: 2778769 - RNA, 19 nt, Human
aacuuccagguguuacugu

SEQ ID NO: 2778770 - RNA, 11 nt, Human
aacuucccuga

SEQ ID NO: 2778771 - RNA, 22 nt, Human
aacuuccagguguuacuguaau

SEQ ID NO: 2778772 - RNA, 18 nt, Human
aacuuccccaucuucuaa

SEQ ID NO: 2778773 - RNA, 17 nt, Human
aacuuccccaucuucua

SEQ ID NO: 2778774 - RNA, 14 nt, Human
aacuucauguaacu

SEQ ID NO: 2778775 - RNA, 20 nt, Human
aacuucauauaugaggacuu

SEQ ID NO: 2778776 - RNA, 21 nt, Human
aacuucaggauaauaaagugu

SEQ ID NO: 2778777 - RNA, 13 nt, Human
aacuucaguccug

SEQ ID NO: 2778778 - RNA, 15 nt, Human
aacuucaguccuggg

SEQ ID NO: 2778779 - RNA, 20 nt, Human
aacuguagauaaagugguuu

SEQ ID NO: 2778780 - RNA, 14 nt, Human
aacuguauauauuc

SEQ ID NO: 2778781 - RNA, 20 nt, Human
aacuguagaugauguauuuu

SEQ ID NO: 2778782 - RNA, 11 nt, Human
aacuguaucuu

SEQ ID NO: 2778783 - RNA, 13 nt, Human
aacuguaucuuga

SEQ ID NO: 2778784 - RNA, 17 nt, Human
aacuucagcuguacuuc

SEQ ID NO: 2778785 - RNA, 19 nt, Human
gugaugcuugauauuuucu

SEQ ID NO: 2778786 - RNA, 13 nt, Human
gugaugcggcaga

SEQ ID NO: 2778787 - RNA, 16 nt, Human
gugaugggcuuucucu

SEQ ID NO: 2778788 - RNA, 14 nt, Human
gugauggggcaagg

SEQ ID NO: 2778789 - RNA, 12 nt, Human
gugaugcggcag

SEQ ID NO: 2778790 - RNA, 21 nt, Human
aacuucuucuccaucccucua

SEQ ID NO: 2778791 - RNA, 19 nt, Human
aacuucuucagagcugaca

SEQ ID NO: 2778792 - RNA, 11 nt, Human
aacuucuucag

SEQ ID NO: 2778793 - RNA, 14 nt, Human
aacuucucucagac

SEQ ID NO: 2778794 - RNA, 19 nt, Human
aacuucucuugcuuucuau

SEQ ID NO: 2778795 - RNA, 15 nt, Human
aacuucuuauggaau

SEQ ID NO: 2778796 - RNA, 13 nt, Human
aacuucuuaaaua

SEQ ID NO: 2778797 - RNA, 15 nt, Human
aacuucuuaaauauc

SEQ ID NO: 2778798 - RNA, 17 nt, Human
aacuucuuaaauaucuu

SEQ ID NO: 2778799 - RNA, 18 nt, Human
aacuucuuaaauaucuuu

SEQ ID NO: 2778800 - RNA, 20 nt, Human
aacuucuuaaauaucuuuua

SEQ ID NO: 2778801 - RNA, 24 nt, Human
aacuucuuauggaauugauuugca

SEQ ID NO: 2778802 - RNA, 19 nt, Human
aacuucuuauggaauugau

SEQ ID NO: 2778803 - RNA, 17 nt, Human
aacuucuuauggaauug

SEQ ID NO: 2778804 - RNA, 16 nt, Human
aacuucuuauggaauu

SEQ ID NO: 2778805 - RNA, 12 nt, Human
gugaugagcuga

SEQ ID NO: 2778806 - RNA, 13 nt, Human
gugaugacauauu

SEQ ID NO: 2778807 - RNA, 15 nt, Human
gugaugaacuuucuc

SEQ ID NO: 2778808 - RNA, 15 nt, Human
gugaugauguaauug

SEQ ID NO: 2778809 - RNA, 23 nt, Human
gugccacuuuacccaccuagaac

SEQ ID NO: 2778810 - RNA, 23 nt, Human
gugccuccagaggggcucagguc

SEQ ID NO: 2778811 - RNA, 22 nt, Human
gugccucggcuuuucucagcug

SEQ ID NO: 2778812 - RNA, 15 nt, Human
gugccugucccaccc

SEQ ID NO: 2778813 - RNA, 20 nt, Human
gugccugucccacccccacc

SEQ ID NO: 2778814 - RNA, 23 nt, Human
gugcauguaugucuuggacacug

SEQ ID NO: 2778815 - RNA, 14 nt, Human
gugcauguccuuug

SEQ ID NO: 2778816 - RNA, 14 nt, Human
gugcauguguguau

SEQ ID NO: 2778817 - RNA, 18 nt, Human
gugcauuagcacagauuu

SEQ ID NO: 2778818 - RNA, 21 nt, Human
gugcauuagcacagauuuuaa

SEQ ID NO: 2778819 - RNA, 22 nt, Human
gugcauuagcacagauuuuaau

SEQ ID NO: 2778820 - RNA, 23 nt, Human
gugcauuagcacagauuuuaauu

SEQ ID NO: 2778821 - RNA, 12 nt, Human
gugcauucuccu

SEQ ID NO: 2778822 - RNA, 18 nt, Human
gugccacaacgccuggcu

SEQ ID NO: 2778823 - RNA, 19 nt, Human
gugccacagaguguagcca

SEQ ID NO: 2778824 - RNA, 19 nt, Human
gugccacugcacuccaggc

SEQ ID NO: 2778825 - RNA, 15 nt, Human
gugcaagccccugcu

SEQ ID NO: 2778826 - RNA, 19 nt, Human
gugcaagcgacgacagaug

SEQ ID NO: 2778827 - RNA, 22 nt, Human
gugcaacccaaggacugaggga

SEQ ID NO: 2778828 - RNA, 14 nt, Human
gugaugguuccccu

SEQ ID NO: 2778829 - RNA, 16 nt, Human
gugaugguuccccugu

SEQ ID NO: 2778830 - RNA, 16 nt, Human
gugcaacgccgugggc

SEQ ID NO: 2778831 - RNA, 13 nt, Human
gugcaacugacac

SEQ ID NO: 2778832 - RNA, 13 nt, Human
gugcaaccucugc

SEQ ID NO: 2778833 - RNA, 17 nt, Human
gugcaaccucugcuucc

SEQ ID NO: 2778834 - RNA, 21 nt, Human
gugcaaccucugcuucccagg

SEQ ID NO: 2778835 - RNA, 23 nt, Human
gugcaacccuuaccccuuagccu

SEQ ID NO: 2778836 - RNA, 13 nt, Human
gugcaacccaagg

SEQ ID NO: 2778837 - RNA, 14 nt, Human
gugcaacccuuacc

SEQ ID NO: 2778838 - RNA, 21 nt, Human
gugcacacaccagagcccacc

SEQ ID NO: 2778839 - RNA, 11 nt, Human
gugcacacaga

SEQ ID NO: 2778840 - RNA, 21 nt, Human
gugcacacagaaauauauaua

SEQ ID NO: 2778841 - RNA, 22 nt, Human
gugcacacagaaauauauauac

SEQ ID NO: 2778842 - RNA, 23 nt, Human
gugcacacagaaauauauauaca

SEQ ID NO: 2778843 - RNA, 15 nt, Human
gugcacaaauauuua

SEQ ID NO: 2778844 - RNA, 13 nt, Human
gugcacaaaauga

SEQ ID NO: 2778845 - RNA, 18 nt, Human
gugcaauuucaagguucu

SEQ ID NO: 2778846 - RNA, 19 nt, Human
gugcaauuucaagguucua

SEQ ID NO: 2778847 - RNA, 20 nt, Human
gugcaauuucaagguucuaa

SEQ ID NO: 2778848 - RNA, 16 nt, Human
gugcauguaugucuug

SEQ ID NO: 2778849 - RNA, 16 nt, Human
gugcauggaggcccuc

SEQ ID NO: 2778850 - RNA, 21 nt, Human
gugcauggaggcccuccugug

SEQ ID NO: 2778851 - RNA, 11 nt, Human
gugcacagcug

SEQ ID NO: 2778852 - RNA, 12 nt, Human
gugcacagcugu

SEQ ID NO: 2778853 - RNA, 13 nt, Human
gugcacagcuguc

SEQ ID NO: 2778854 - RNA, 14 nt, Human
gugcacagcugucc

SEQ ID NO: 2778855 - RNA, 21 nt, Human
aacuggguacuuguggacaca

SEQ ID NO: 2778856 - RNA, 16 nt, Human
aacuggguacuugugg

SEQ ID NO: 2778857 - RNA, 11 nt, Human
aacuggcugca

SEQ ID NO: 2778858 - RNA, 19 nt, Human
aacuggcaauugucuauuu

SEQ ID NO: 2778859 - RNA, 20 nt, Human
aacuggccccggaucagagc

SEQ ID NO: 2778860 - RNA, 21 nt, Human
aacuggccccggaucagagca

SEQ ID NO: 2778861 - RNA, 14 nt, Human
aacuggagucugga

SEQ ID NO: 2778862 - RNA, 16 nt, Human
aacuggagucuggagu

SEQ ID NO: 2778863 - RNA, 20 nt, Human
aacuggagucuggagugggc

SEQ ID NO: 2778864 - RNA, 10 nt, Human
aacugcagca

SEQ ID NO: 2778865 - RNA, 20 nt, Human
aacugcagcaaucuuugaaa

SEQ ID NO: 2778866 - RNA, 22 nt, Human
aacugcagcaaucuuugaaaga

SEQ ID NO: 2778867 - RNA, 14 nt, Human
aacugcaaagaaag

SEQ ID NO: 2778868 - RNA, 17 nt, Human
aacugcaauaacuucug

SEQ ID NO: 2778869 - RNA, 18 nt, Human
aacugcaauaacuucuga

SEQ ID NO: 2778870 - RNA, 19 nt, Human
aacugcaauaacuucugac

SEQ ID NO: 2778871 - RNA, 21 nt, Human
aacugcaauaacuucugaccu

SEQ ID NO: 2778872 - RNA, 17 nt, Human
aacugcacaugaagaaa

SEQ ID NO: 2778873 - RNA, 19 nt, Human
aacugcacaugaagaaaua

SEQ ID NO: 2778874 - RNA, 21 nt, Human
aacugcacaugaagaaauacu

SEQ ID NO: 2778875 - RNA, 20 nt, Human
aacugccucgaaacacagaa

SEQ ID NO: 2778876 - RNA, 20 nt, Human
aacugcuggacgucuuucuu

SEQ ID NO: 2778877 - RNA, 23 nt, Human
aacugcuggacgucuuucuuuuu

SEQ ID NO: 2778878 - RNA, 14 nt, Human
aacuggaauaagaa

SEQ ID NO: 2778879 - RNA, 15 nt, Human
aacuggaauaagaag

SEQ ID NO: 2778880 - RNA, 21 nt, Human
aacuggaauaagaagcaaaua

SEQ ID NO: 2778881 - RNA, 14 nt, Human
aacuggaauuaaaa

SEQ ID NO: 2778882 - RNA, 20 nt, Human
aacuggaauuaaaaggauag

SEQ ID NO: 2778883 - RNA, 19 nt, Human
aacuggaacggugaaggug

SEQ ID NO: 2778884 - RNA, 20 nt, Human
aacugcuuuuuuuuuuccag

SEQ ID NO: 2778885 - RNA, 22 nt, Human
aacugcuuuuuuuuuuccagca

SEQ ID NO: 2778886 - RNA, 13 nt, Human
aacugaaagugaa

SEQ ID NO: 2778887 - RNA, 19 nt, Human
aacugaaaaucuaauauua

SEQ ID NO: 2778888 - RNA, 21 nt, Human
aacugaaaacucccauuuacg

SEQ ID NO: 2778889 - RNA, 13 nt, Human
aacugaaaagaga

SEQ ID NO: 2778890 - RNA, 14 nt, Human
aacugaaaagagag

SEQ ID NO: 2778891 - RNA, 15 nt, Human
aacugaaaagagagc

SEQ ID NO: 2778892 - RNA, 19 nt, Human
aacugaaaagagagcagag

SEQ ID NO: 2778893 - RNA, 20 nt, Human
aacugaaaagagagcagaga

SEQ ID NO: 2778894 - RNA, 21 nt, Human
aacugaaaagagagcagagaa

SEQ ID NO: 2778895 - RNA, 22 nt, Human
aacugaaaagagagcagagaau

SEQ ID NO: 2778896 - RNA, 15 nt, Human
aacucuuaucucagu

SEQ ID NO: 2778897 - RNA, 14 nt, Human
aacucuuaucucag

SEQ ID NO: 2778898 - RNA, 13 nt, Human
aacucuuaucuca

SEQ ID NO: 2778899 - RNA, 17 nt, Human
aacucuuagaaaugaag

SEQ ID NO: 2778900 - RNA, 13 nt, Human
aacucuuaaaaau

SEQ ID NO: 2778901 - RNA, 22 nt, Human
gugagucgaggacagggaggug

SEQ ID NO: 2778902 - RNA, 15 nt, Human
gugagucgaggacag

SEQ ID NO: 2778903 - RNA, 13 nt, Human
gugagugagccug

SEQ ID NO: 2778904 - RNA, 17 nt, Human
gugagucuuugguucua

SEQ ID NO: 2778905 - RNA, 19 nt, Human
gugagucuuugguucuaag

SEQ ID NO: 2778906 - RNA, 20 nt, Human
aacucugacaacagacuucu

SEQ ID NO: 2778907 - RNA, 14 nt, Human
gugagugagccugg

SEQ ID NO: 2778908 - RNA, 15 nt, Human
gugagugagccuggc

SEQ ID NO: 2778909 - RNA, 18 nt, Human
gugagugagccuggcucu

SEQ ID NO: 2778910 - RNA, 12 nt, Human
gugagugccuuu

SEQ ID NO: 2778911 - RNA, 13 nt, Human
gugagugccuuuu

SEQ ID NO: 2778912 - RNA, 17 nt, Human
gugagugccuuuugcag

SEQ ID NO: 2778913 - RNA, 23 nt, Human
aacucugacaacagacuucugaa

SEQ ID NO: 2778914 - RNA, 22 nt, Human
aacucugacaacagacuucuga

SEQ ID NO: 2778915 - RNA, 12 nt, Human
aacucugagccc

SEQ ID NO: 2778916 - RNA, 13 nt, Human
aacucugagccca

SEQ ID NO: 2778917 - RNA, 14 nt, Human
aacucugagcccau

SEQ ID NO: 2778918 - RNA, 15 nt, Human
aacucugacaagggc

SEQ ID NO: 2778919 - RNA, 17 nt, Human
aacucugacaagggcug

SEQ ID NO: 2778920 - RNA, 19 nt, Human
aacucugacaagggcugac

SEQ ID NO: 2778921 - RNA, 21 nt, Human
aacucugacaagggcugaccu

SEQ ID NO: 2778922 - RNA, 22 nt, Human
aacucugacaagggcugaccug

SEQ ID NO: 2778923 - RNA, 12 nt, Human
gugaacuuguag

SEQ ID NO: 2778924 - RNA, 13 nt, Human
gugaacuuguagc

SEQ ID NO: 2778925 - RNA, 15 nt, Human
gugaacuuguagcug

SEQ ID NO: 2778926 - RNA, 18 nt, Human
gugaacuuguagcuguaa

SEQ ID NO: 2778927 - RNA, 20 nt, Human
gugaacuuguagcuguaaaa

SEQ ID NO: 2778928 - RNA, 21 nt, Human
gugaacuuguagcuguaaaac

SEQ ID NO: 2778929 - RNA, 22 nt, Human
gugagaugagggaugggccugg

SEQ ID NO: 2778930 - RNA, 18 nt, Human
gugaaccacuucauucug

SEQ ID NO: 2778931 - RNA, 13 nt, Human
gugaacugaaauu

SEQ ID NO: 2778932 - RNA, 12 nt, Human
gugagauuuuuu

SEQ ID NO: 2778933 - RNA, 13 nt, Human
gugagauuuuuua

SEQ ID NO: 2778934 - RNA, 14 nt, Human
gugagauuuuuuau

SEQ ID NO: 2778935 - RNA, 15 nt, Human
gugagauuuuuuauu

SEQ ID NO: 2778936 - RNA, 18 nt, Human
gugagauuuuuuauugcu

SEQ ID NO: 2778937 - RNA, 19 nt, Human
gugagauuuuuuauugcua

SEQ ID NO: 2778938 - RNA, 21 nt, Human
gugagauuuuuuauugcuagu

SEQ ID NO: 2778939 - RNA, 15 nt, Human
gugagaugcuggaga

SEQ ID NO: 2778940 - RNA, 17 nt, Human
gugagaugcuggagaag

SEQ ID NO: 2778941 - RNA, 18 nt, Human
gugagaugcuggagaaga

SEQ ID NO: 2778942 - RNA, 19 nt, Human
gugagaugcuggagaagag

SEQ ID NO: 2778943 - RNA, 20 nt, Human
gugagaugcuggagaagaga

SEQ ID NO: 2778944 - RNA, 21 nt, Human
gugagggguauaucugggcug

SEQ ID NO: 2778945 - RNA, 15 nt, Human
gugagggucccaugu

SEQ ID NO: 2778946 - RNA, 16 nt, Human
gugagggucccaugug

SEQ ID NO: 2778947 - RNA, 22 nt, Human
gugagaugcuggagaagagagg

SEQ ID NO: 2778948 - RNA, 13 nt, Human
gugaggccccugg

SEQ ID NO: 2778949 - RNA, 11 nt, Human
gugaggccugu

SEQ ID NO: 2778950 - RNA, 14 nt, Human
gugaggccugucug

SEQ ID NO: 2778951 - RNA, 15 nt, Human
gugaggccugucugu

SEQ ID NO: 2778952 - RNA, 21 nt, Human
gugagcaagaagucaaaguaa

SEQ ID NO: 2778953 - RNA, 22 nt, Human
aaauuuugcuuuuaauuaaaua

SEQ ID NO: 2778954 - RNA, 12 nt, Human
aaauuuugcaaa

SEQ ID NO: 2778955 - RNA, 13 nt, Human
aaauuuugcaaau

SEQ ID NO: 2778956 - RNA, 14 nt, Human
aaauuuugcaaaua

SEQ ID NO: 2778957 - RNA, 15 nt, Human
aaauuuugcaaauau

SEQ ID NO: 2778958 - RNA, 16 nt, Human
aaauuuugcaaauaua

SEQ ID NO: 2778959 - RNA, 20 nt, Human
aaauuuugcaaauauaaaca

SEQ ID NO: 2778960 - RNA, 20 nt, Human
aaauuuucuagacuuucugu

SEQ ID NO: 2778961 - RNA, 17 nt, Human
aaauuuucuugauuuga

SEQ ID NO: 2778962 - RNA, 16 nt, Human
aaauuuuauuuugugc

SEQ ID NO: 2778963 - RNA, 14 nt, Human
aaauuuucuagacu

SEQ ID NO: 2778964 - RNA, 18 nt, Human
aaauuuucuagacuuucu

SEQ ID NO: 2778965 - RNA, 19 nt, Human
aaauuuucuagacuuucug

SEQ ID NO: 2778966 - RNA, 15 nt, Human
aaauuuuaguccaaa

SEQ ID NO: 2778967 - RNA, 13 nt, Human
aaauuuuauuccu

SEQ ID NO: 2778968 - RNA, 12 nt, Human
aaauuuuauucc

SEQ ID NO: 2778969 - RNA, 14 nt, Human
aaauuuuaauuuau

SEQ ID NO: 2778970 - RNA, 21 nt, Human
aaauuuuauaaaauuaagcaa

SEQ ID NO: 2778971 - RNA, 22 nt, Human
aaauuuuauaagcaaauuucaa

SEQ ID NO: 2778972 - RNA, 22 nt, Human
aacaagaugcuggaugucugcc

SEQ ID NO: 2778973 - RNA, 12 nt, Human
aacaagauuucc

SEQ ID NO: 2778974 - RNA, 20 nt, Human
aacaagauuuccuugugcaa

SEQ ID NO: 2778975 - RNA, 19 nt, Human
aacaagagcacuacauuca

SEQ ID NO: 2778976 - RNA, 19 nt, Human
aacaagaccccgucucaaa

SEQ ID NO: 2778977 - RNA, 20 nt, Human
aaauuuuuguaguagcguuu

SEQ ID NO: 2778978 - RNA, 16 nt, Human
aaauuuuuuaaaagag

SEQ ID NO: 2778979 - RNA, 18 nt, Human
aaauuuuuuaaaagagac

SEQ ID NO: 2778980 - RNA, 14 nt, Human
aaauuuuuuugguc

SEQ ID NO: 2778981 - RNA, 23 nt, Human
aaauuuuuuuggucuuuuuguaa

SEQ ID NO: 2778982 - RNA, 18 nt, Human
aacaagccaagaaagaug

SEQ ID NO: 2778983 - RNA, 14 nt, Human
aacaagcccaaagc

SEQ ID NO: 2778984 - RNA, 19 nt, Human
aacaagcaagcucccaagg

SEQ ID NO: 2778985 - RNA, 21 nt, Human
aacaagugaaauaacaaaaug

SEQ ID NO: 2778986 - RNA, 23 nt, Human
aacaagugaaauaacaaaaugga

SEQ ID NO: 2778987 - RNA, 17 nt, Human
aacaaguuuuaauguau

SEQ ID NO: 2778988 - RNA, 20 nt, Human
aacaaguuuuaauguauagu

SEQ ID NO: 2778989 - RNA, 13 nt, Human
aacaauguuaagg

SEQ ID NO: 2778990 - RNA, 18 nt, Human
aacaauguuaaggaaacu

SEQ ID NO: 2778991 - RNA, 21 nt, Human
aacaauguuaaggaaacucuu

SEQ ID NO: 2778992 - RNA, 22 nt, Human
aacaauguuaaggaaacucuua

SEQ ID NO: 2778993 - RNA, 17 nt, Human
aacaaguuuuucuguca

SEQ ID NO: 2778994 - RNA, 15 nt, Human
aacaauaaaacauua

SEQ ID NO: 2778995 - RNA, 16 nt, Human
aacaauaaaacauuau

SEQ ID NO: 2778996 - RNA, 17 nt, Human
aacaauaaaacauuaug

SEQ ID NO: 2778997 - RNA, 17 nt, Human
aaauuuuuguaguagcg

SEQ ID NO: 2778998 - RNA, 14 nt, Human
aacaauaaagagau

SEQ ID NO: 2778999 - RNA, 12 nt, Human
aacaauguuaag

SEQ ID NO: 2779000 - RNA, 11 nt, Human
aacaauguuaa

SEQ ID NO: 2779001 - RNA, 14 nt, Human
gucacagccuccuc

SEQ ID NO: 2779002 - RNA, 16 nt, Human
gucacagccuccucug

SEQ ID NO: 2779003 - RNA, 15 nt, Human
gucagaaugcuauug

SEQ ID NO: 2779004 - RNA, 21 nt, Human
gucacagccuccucugucugc

SEQ ID NO: 2779005 - RNA, 23 nt, Human
gucacagccuccucugucugccc

SEQ ID NO: 2779006 - RNA, 21 nt, Human
gucacacaguauuacuucugc

SEQ ID NO: 2779007 - RNA, 22 nt, Human
gucacacaguauuacuucugcu

SEQ ID NO: 2779008 - RNA, 13 nt, Human
gucacaccagcca

SEQ ID NO: 2779009 - RNA, 13 nt, Human
gucaggccugugu

SEQ ID NO: 2779010 - RNA, 15 nt, Human
gucaggccugugugu

SEQ ID NO: 2779011 - RNA, 23 nt, Human
gucaggccugugugugaaaggaa

SEQ ID NO: 2779012 - RNA, 21 nt, Human
gucaggcccuuauuuucaaga

SEQ ID NO: 2779013 - RNA, 11 nt, Human
gucaggcccug

SEQ ID NO: 2779014 - RNA, 12 nt, Human
gucaggcccugg

SEQ ID NO: 2779015 - RNA, 13 nt, Human
gucaggcccugga

SEQ ID NO: 2779016 - RNA, 15 nt, Human
gucaggcccuggaac

SEQ ID NO: 2779017 - RNA, 13 nt, Human
gucaggcccuggu

SEQ ID NO: 2779018 - RNA, 22 nt, Human
gucaggcccuuauuuucaagaa

SEQ ID NO: 2779019 - RNA, 18 nt, Human
gucagacagaacuugaau

SEQ ID NO: 2779020 - RNA, 12 nt, Human
gucagacauaaa

SEQ ID NO: 2779021 - RNA, 13 nt, Human
gucagacauaaag

SEQ ID NO: 2779022 - RNA, 14 nt, Human
gucagacauaaagc

SEQ ID NO: 2779023 - RNA, 15 nt, Human
gucagacauaaagcc

SEQ ID NO: 2779024 - RNA, 16 nt, Human
gucagacauaaagcca

SEQ ID NO: 2779025 - RNA, 17 nt, Human
gucagacauaaagccau

SEQ ID NO: 2779026 - RNA, 20 nt, Human
gucagacauaaagccauguu

SEQ ID NO: 2779027 - RNA, 18 nt, Human
gucagacauccauguuug

SEQ ID NO: 2779028 - RNA, 20 nt, Human
gucagacauccauguuugua

SEQ ID NO: 2779029 - RNA, 23 nt, Human
gucaggaguucgagaccagccug

SEQ ID NO: 2779030 - RNA, 14 nt, Human
gucaggcagccagu

SEQ ID NO: 2779031 - RNA, 20 nt, Human
gucaggcagccagugagaug

SEQ ID NO: 2779032 - RNA, 13 nt, Human
gucaguuucuaca

SEQ ID NO: 2779033 - RNA, 18 nt, Human
aaauuuguggguuuuuuu

SEQ ID NO: 2779034 - RNA, 23 nt, Human
aaauuugucuugccuuauuaaag

SEQ ID NO: 2779035 - RNA, 14 nt, Human
aaauuuguuugaaa

SEQ ID NO: 2779036 - RNA, 18 nt, Human
aaauuuguuugaaaucuu

SEQ ID NO: 2779037 - RNA, 20 nt, Human
aaauuuggggacagauucag

SEQ ID NO: 2779038 - RNA, 21 nt, Human
aaauuuggggacagauucagu

SEQ ID NO: 2779039 - RNA, 14 nt, Human
aaauuugauuucua

SEQ ID NO: 2779040 - RNA, 13 nt, Human
aaauuugcuagca

SEQ ID NO: 2779041 - RNA, 14 nt, Human
aaauuugcuagcag

SEQ ID NO: 2779042 - RNA, 17 nt, Human
aaauuugauugauuuga

SEQ ID NO: 2779043 - RNA, 22 nt, Human
aaauuugauuuacauauauuau

SEQ ID NO: 2779044 - RNA, 15 nt, Human
aaauuugauugauuu

SEQ ID NO: 2779045 - RNA, 22 nt, Human
aaauuuguaaguuucaggugac

SEQ ID NO: 2779046 - RNA, 12 nt, Human
aaauuuguaagu

SEQ ID NO: 2779047 - RNA, 13 nt, Human
aaauuuguaaguu

SEQ ID NO: 2779048 - RNA, 14 nt, Human
aaauuuguaaguuu

SEQ ID NO: 2779049 - RNA, 15 nt, Human
aaauuuguaaguuuc

SEQ ID NO: 2779050 - RNA, 16 nt, Human
aaauuuguaaguuuca

SEQ ID NO: 2779051 - RNA, 17 nt, Human
aaauuuguaaguuucag

SEQ ID NO: 2779052 - RNA, 19 nt, Human
aaauuuguaaguuucaggu

SEQ ID NO: 2779053 - RNA, 20 nt, Human
aaauuuguaaguuucaggug

SEQ ID NO: 2779054 - RNA, 14 nt, Human
gucaguguugagau

SEQ ID NO: 2779055 - RNA, 14 nt, Human
aaauuugauugauu

SEQ ID NO: 2779056 - RNA, 16 nt, Human
aaauuugauacuuaua

SEQ ID NO: 2779057 - RNA, 18 nt, Human
aaauuugauacuuauauu

SEQ ID NO: 2779058 - RNA, 16 nt, Human
gucaguauccaggcuu

SEQ ID NO: 2779059 - RNA, 14 nt, Human
gucaguauccaggc

SEQ ID NO: 2779060 - RNA, 11 nt, Human
gucaggcuggu

SEQ ID NO: 2779061 - RNA, 19 nt, Human
aacacagaaaccuuuuuaa

SEQ ID NO: 2779062 - RNA, 18 nt, Human
aacacacuguuguuuagu

SEQ ID NO: 2779063 - RNA, 12 nt, Human
aacacacugaaa

SEQ ID NO: 2779064 - RNA, 20 nt, Human
aacacacgcgcgcacacaca

SEQ ID NO: 2779065 - RNA, 13 nt, Human
aacacaaaugcag

SEQ ID NO: 2779066 - RNA, 20 nt, Human
aacacaaaugcagggauugc

SEQ ID NO: 2779067 - RNA, 12 nt, Human
aacacaccuggu

SEQ ID NO: 2779068 - RNA, 19 nt, Human
aacacacgcgcgcacacac

SEQ ID NO: 2779069 - RNA, 22 nt, Human
aacacagagaagcggauuucca

SEQ ID NO: 2779070 - RNA, 23 nt, Human
aacacagagaagcggauuuccag

SEQ ID NO: 2779071 - RNA, 22 nt, Human
aacacagaggaauuuauaccuc

SEQ ID NO: 2779072 - RNA, 15 nt, Human
guccaacugcaacuc

SEQ ID NO: 2779073 - RNA, 14 nt, Human
guccaacuaaaaac

SEQ ID NO: 2779074 - RNA, 22 nt, Human
guccaagaauccacauuucuaa

SEQ ID NO: 2779075 - RNA, 20 nt, Human
guccaaaaagcuccuggggc

SEQ ID NO: 2779076 - RNA, 16 nt, Human
gucccaccuuggcugc

SEQ ID NO: 2779077 - RNA, 15 nt, Human
gucccaccuuggcug

SEQ ID NO: 2779078 - RNA, 14 nt, Human
gucccaccuuggcu

SEQ ID NO: 2779079 - RNA, 16 nt, Human
gucccaccccucccuc

SEQ ID NO: 2779080 - RNA, 17 nt, Human
gucccaccccucccucu

SEQ ID NO: 2779081 - RNA, 23 nt, Human
gucccacccccacccccagcuca

SEQ ID NO: 2779082 - RNA, 12 nt, Human
guccccaucugu

SEQ ID NO: 2779083 - RNA, 14 nt, Human
guccccaucugucg

SEQ ID NO: 2779084 - RNA, 23 nt, Human
guccccagggcugucaucugaau

SEQ ID NO: 2779085 - RNA, 15 nt, Human
gucccccaacuugag

SEQ ID NO: 2779086 - RNA, 16 nt, Human
gucccccaacuugaga

SEQ ID NO: 2779087 - RNA, 19 nt, Human
guccccauggcacccugcu

SEQ ID NO: 2779088 - RNA, 16 nt, Human
gucccccaacucugag

SEQ ID NO: 2779089 - RNA, 19 nt, Human
gucccccaacucugagccc

SEQ ID NO: 2779090 - RNA, 20 nt, Human
gucccccaacucugagccca

SEQ ID NO: 2779091 - RNA, 21 nt, Human
gucccacccccacccccagcu

SEQ ID NO: 2779092 - RNA, 22 nt, Human
gucccacccccacccccagcuc

SEQ ID NO: 2779093 - RNA, 15 nt, Human
gucccaccuccagcc

SEQ ID NO: 2779094 - RNA, 16 nt, Human
gucccaccuccagccc

SEQ ID NO: 2779095 - RNA, 17 nt, Human
gucccaccuccagcccg

SEQ ID NO: 2779096 - RNA, 22 nt, Human
gucccaccuccagcccgggagc

SEQ ID NO: 2779097 - RNA, 14 nt, Human
gucccacccccacc

SEQ ID NO: 2779098 - RNA, 15 nt, Human
gucccacccccaccc

SEQ ID NO: 2779099 - RNA, 19 nt, Human
gucccacccccacccccag

SEQ ID NO: 2779100 - RNA, 17 nt, Human
guccagugaccugcugg

SEQ ID NO: 2779101 - RNA, 20 nt, Human
guccagugcaaccacacacc

SEQ ID NO: 2779102 - RNA, 23 nt, Human
guccaagaauccacauuucuaaa

SEQ ID NO: 2779103 - RNA, 21 nt, Human
guccaagaccagacucgccaa

SEQ ID NO: 2779104 - RNA, 16 nt, Human
guccaagauuccggau

SEQ ID NO: 2779105 - RNA, 20 nt, Human
guccaagauuccggauccua

SEQ ID NO: 2779106 - RNA, 18 nt, Human
aacagguaauauaaaaag

SEQ ID NO: 2779107 - RNA, 20 nt, Human
aacagugcagggcaaaauau

SEQ ID NO: 2779108 - RNA, 11 nt, Human
aacagggaggg

SEQ ID NO: 2779109 - RNA, 15 nt, Human
aacagguaauauaaa

SEQ ID NO: 2779110 - RNA, 13 nt, Human
aacagauaaucag

SEQ ID NO: 2779111 - RNA, 17 nt, Human
aacagacaagugacugu

SEQ ID NO: 2779112 - RNA, 21 nt, Human
aacagacaauaugugagugcc

SEQ ID NO: 2779113 - RNA, 11 nt, Human
aacagacaagu

SEQ ID NO: 2779114 - RNA, 22 nt, Human
aacagauaccauacucauuucu

SEQ ID NO: 2779115 - RNA, 20 nt, Human
aacagauaguuguguuuuua

SEQ ID NO: 2779116 - RNA, 14 nt, Human
aacagaucuuuuac

SEQ ID NO: 2779117 - RNA, 15 nt, Human
aacagaacuuuuccu

SEQ ID NO: 2779118 - RNA, 15 nt, Human
aacagaagcauuugu

SEQ ID NO: 2779119 - RNA, 16 nt, Human
aacagaagcauuugua

SEQ ID NO: 2779120 - RNA, 17 nt, Human
aacagaagcauuuguau

SEQ ID NO: 2779121 - RNA, 21 nt, Human
aacagaagcauuuguauuuug

SEQ ID NO: 2779122 - RNA, 13 nt, Human
aacagaaggauga

SEQ ID NO: 2779123 - RNA, 18 nt, Human
aacagacaacagaaguca

SEQ ID NO: 2779124 - RNA, 16 nt, Human
aacagacaacagaagu

SEQ ID NO: 2779125 - RNA, 13 nt, Human
aacagaauuuuaa

SEQ ID NO: 2779126 - RNA, 12 nt, Human
aacagaaugaaa

SEQ ID NO: 2779127 - RNA, 14 nt, Human
aacagaaugaaaaa

SEQ ID NO: 2779128 - RNA, 15 nt, Human
aacagaaugaaaaau

SEQ ID NO: 2779129 - RNA, 16 nt, Human
aacagaaugaaaaaug

SEQ ID NO: 2779130 - RNA, 17 nt, Human
aacagaaugaaaaauga

SEQ ID NO: 2779131 - RNA, 18 nt, Human
aacagaaugaaaaaugaa

SEQ ID NO: 2779132 - RNA, 19 nt, Human
aacagaaugaaaaaugaaa

SEQ ID NO: 2779133 - RNA, 21 nt, Human
aacagaaugaaaaaugaaaga

SEQ ID NO: 2779134 - RNA, 14 nt, Human
aacagaauguuuua

SEQ ID NO: 2779135 - RNA, 13 nt, Human
aacagaacuaaau

SEQ ID NO: 2779136 - RNA, 14 nt, Human
aacagaacuaaaug

SEQ ID NO: 2779137 - RNA, 15 nt, Human
aacagaacuaaaugu

SEQ ID NO: 2779138 - RNA, 16 nt, Human
aacagaacuaaauguu

SEQ ID NO: 2779139 - RNA, 17 nt, Human
aacagaacuaaauguuc

SEQ ID NO: 2779140 - RNA, 18 nt, Human
aacagaacuaaauguucu

SEQ ID NO: 2779141 - RNA, 21 nt, Human
aacagaacuaaauguucuaug

SEQ ID NO: 2779142 - RNA, 12 nt, Human
guccuacucugu

SEQ ID NO: 2779143 - RNA, 20 nt, Human
guccuacuaucacugaacaa

SEQ ID NO: 2779144 - RNA, 15 nt, Human
guccuacccacccuc

SEQ ID NO: 2779145 - RNA, 16 nt, Human
guccuacccacccucc

SEQ ID NO: 2779146 - RNA, 12 nt, Human
gucccccugcag

SEQ ID NO: 2779147 - RNA, 13 nt, Human
gucccccugcagc

SEQ ID NO: 2779148 - RNA, 14 nt, Human
gucccccugcagcu

SEQ ID NO: 2779149 - RNA, 15 nt, Human
gucccccugcagcua

SEQ ID NO: 2779150 - RNA, 17 nt, Human
gucccuuucagagacag

SEQ ID NO: 2779151 - RNA, 11 nt, Human
gucccuugcug

SEQ ID NO: 2779152 - RNA, 16 nt, Human
gucccuugcuguaugc

SEQ ID NO: 2779153 - RNA, 16 nt, Human
gucccuugaugcacag

SEQ ID NO: 2779154 - RNA, 17 nt, Human
gucccuugaugcacaga

SEQ ID NO: 2779155 - RNA, 18 nt, Human
gucccuugaugcacagag

SEQ ID NO: 2779156 - RNA, 19 nt, Human
gucccuugaugcacagaga

SEQ ID NO: 2779157 - RNA, 22 nt, Human
gucccuugaugcacagagaagc

SEQ ID NO: 2779158 - RNA, 23 nt, Human
gucccuugaugcacagagaagcu

SEQ ID NO: 2779159 - RNA, 13 nt, Human
gucccuugcagcu

SEQ ID NO: 2779160 - RNA, 13 nt, Human
guauguaucuauu

SEQ ID NO: 2779161 - RNA, 13 nt, Human
guauguauuagug

SEQ ID NO: 2779162 - RNA, 14 nt, Human
guauguaaacagga

SEQ ID NO: 2779163 - RNA, 22 nt, Human
guauguaaugugugguggccuc

SEQ ID NO: 2779164 - RNA, 23 nt, Human
guauguaaugugugguggccuca

SEQ ID NO: 2779165 - RNA, 14 nt, Human
guaugucauuuccu

SEQ ID NO: 2779166 - RNA, 17 nt, Human
guaugucauuuccuuca

SEQ ID NO: 2779167 - RNA, 12 nt, Human
aaauguauuuuu

SEQ ID NO: 2779168 - RNA, 14 nt, Human
aaauguauuuuucu

SEQ ID NO: 2779169 - RNA, 15 nt, Human
aaauguauuuuucua

SEQ ID NO: 2779170 - RNA, 10 nt, Human
aaauguauuu

SEQ ID NO: 2779171 - RNA, 22 nt, Human
aaauguccuccagaagccucug

SEQ ID NO: 2779172 - RNA, 22 nt, Human
aaaugucagauacaauguauuu

SEQ ID NO: 2779173 - RNA, 15 nt, Human
aaaugucagauacaa

SEQ ID NO: 2779174 - RNA, 20 nt, Human
aaaugucagauacaauguau

SEQ ID NO: 2779175 - RNA, 13 nt, Human
aaaugucuuugua

SEQ ID NO: 2779176 - RNA, 14 nt, Human
aaaugucuuuguaa

SEQ ID NO: 2779177 - RNA, 15 nt, Human
aaaugucuuuguaag

SEQ ID NO: 2779178 - RNA, 16 nt, Human
aaaugucuuuguaagu

SEQ ID NO: 2779179 - RNA, 17 nt, Human
aaaugucuuuguaaguc

SEQ ID NO: 2779180 - RNA, 21 nt, Human
aaaugucuuuguaagucagug

SEQ ID NO: 2779181 - RNA, 17 nt, Human
aaaugucuuuuagaaga

SEQ ID NO: 2779182 - RNA, 18 nt, Human
aaaugucuuuuagaagau

SEQ ID NO: 2779183 - RNA, 14 nt, Human
aaaugugaggaaga

SEQ ID NO: 2779184 - RNA, 15 nt, Human
aaaugugaagaugca

SEQ ID NO: 2779185 - RNA, 17 nt, Human
aaaugugaagaugcauu

SEQ ID NO: 2779186 - RNA, 22 nt, Human
aaaugugaagaugcauuguagu

SEQ ID NO: 2779187 - RNA, 18 nt, Human
aaauguguguauucuuaa

SEQ ID NO: 2779188 - RNA, 12 nt, Human
aaauguguacau

SEQ ID NO: 2779189 - RNA, 20 nt, Human
aaauguguccuaucuaucuu

SEQ ID NO: 2779190 - RNA, 21 nt, Human
aaauguguccuaucuaucuuc

SEQ ID NO: 2779191 - RNA, 12 nt, Human
aaaugugugugu

SEQ ID NO: 2779192 - RNA, 20 nt, Human
aaauguguaucggaugcuuu

SEQ ID NO: 2779193 - RNA, 23 nt, Human
aaauguguacaauguacacacug

SEQ ID NO: 2779194 - RNA, 22 nt, Human
aaaugugguuuuccugaaauca

SEQ ID NO: 2779195 - RNA, 22 nt, Human
aaaugugauguucuaaggcucu

SEQ ID NO: 2779196 - RNA, 19 nt, Human
aaaugugauguucuaaggc

SEQ ID NO: 2779197 - RNA, 20 nt, Human
aaaugugauguucuaaggcu

SEQ ID NO: 2779198 - RNA, 15 nt, Human
aaaugugauguucua

SEQ ID NO: 2779199 - RNA, 18 nt, Human
aaaugugauguucuaagg

SEQ ID NO: 2779200 - RNA, 19 nt, Human
aaauguguuggacaaaugu

SEQ ID NO: 2779201 - RNA, 20 nt, Human
aaauguguuggacaaaugug

SEQ ID NO: 2779202 - RNA, 21 nt, Human
aaauguguuggacaaauguga

SEQ ID NO: 2779203 - RNA, 12 nt, Human
aaauuaagacau

SEQ ID NO: 2779204 - RNA, 17 nt, Human
aaauuaagauguucaga

SEQ ID NO: 2779205 - RNA, 15 nt, Human
aaauuaagaaggcaa

SEQ ID NO: 2779206 - RNA, 14 nt, Human
aaauuaagaaggca

SEQ ID NO: 2779207 - RNA, 23 nt, Human
aaauuaggguugguuccuuucca

SEQ ID NO: 2779208 - RNA, 15 nt, Human
aaauuauaaagauaa

SEQ ID NO: 2779209 - RNA, 19 nt, Human
aaauuauuaguuuacauca

SEQ ID NO: 2779210 - RNA, 23 nt, Human
aaauuauuaguuuacaucauuuu

SEQ ID NO: 2779211 - RNA, 16 nt, Human
aaauuauuauaagcau

SEQ ID NO: 2779212 - RNA, 19 nt, Human
aaauuauuauaagcauuga

SEQ ID NO: 2779213 - RNA, 22 nt, Human
aaauuauuauaagcauugaaau

SEQ ID NO: 2779214 - RNA, 15 nt, Human
aaauuauuuaauaaa

SEQ ID NO: 2779215 - RNA, 14 nt, Human
aaauuauguuuuua

SEQ ID NO: 2779216 - RNA, 16 nt, Human
aaauuauguuuuuauu

SEQ ID NO: 2779217 - RNA, 19 nt, Human
aaauuauguuuuuauuaag

SEQ ID NO: 2779218 - RNA, 13 nt, Human
gucaaaguaaaac

SEQ ID NO: 2779219 - RNA, 16 nt, Human
gucaaagaaaugcuga

SEQ ID NO: 2779220 - RNA, 13 nt, Human
gucaacagaauga

SEQ ID NO: 2779221 - RNA, 14 nt, Human
gucaacagaaugaa

SEQ ID NO: 2779222 - RNA, 15 nt, Human
gucaacagaaugaaa

SEQ ID NO: 2779223 - RNA, 16 nt, Human
gucaacagaaugaaaa

SEQ ID NO: 2779224 - RNA, 17 nt, Human
gucaacagaaugaaaaa

SEQ ID NO: 2779225 - RNA, 20 nt, Human
gucaacagaaugaaaaauga

SEQ ID NO: 2779226 - RNA, 21 nt, Human
gucaacaaguaugaauaaaga

SEQ ID NO: 2779227 - RNA, 12 nt, Human
gucaaagaaaug

SEQ ID NO: 2779228 - RNA, 15 nt, Human
gucaaacgugaaaau

SEQ ID NO: 2779229 - RNA, 17 nt, Human
gucaaacgugaaaaugc

SEQ ID NO: 2779230 - RNA, 14 nt, Human
gucaaacgugaaaa

SEQ ID NO: 2779231 - RNA, 15 nt, Human
gucaaacaugaagug

SEQ ID NO: 2779232 - RNA, 16 nt, Human
gucaaacaugaagugu

SEQ ID NO: 2779233 - RNA, 21 nt, Human
gucaaaacacuguggaacuaa

SEQ ID NO: 2779234 - RNA, 15 nt, Human
gucaaaagcuggauu

SEQ ID NO: 2779235 - RNA, 20 nt, Human
gucaaacaaacucucugaac

SEQ ID NO: 2779236 - RNA, 18 nt, Human
gucaaaauauuuuuaaaa

SEQ ID NO: 2779237 - RNA, 17 nt, Human
gucaaaauuguuuaaaa

SEQ ID NO: 2779238 - RNA, 15 nt, Human
gucaaaaguuggacu

SEQ ID NO: 2779239 - RNA, 16 nt, Human
gucaaaaguuggacua

SEQ ID NO: 2779240 - RNA, 19 nt, Human
gucaaaaguuggacuaaau

SEQ ID NO: 2779241 - RNA, 21 nt, Human
gucaaaaguuggacuaaaugc

SEQ ID NO: 2779242 - RNA, 20 nt, Human
aaauuuauuuaaugugaguu

SEQ ID NO: 2779243 - RNA, 13 nt, Human
aaauuucaaaaga

SEQ ID NO: 2779244 - RNA, 16 nt, Human
aaauuucaaaagacau

SEQ ID NO: 2779245 - RNA, 19 nt, Human
aaauuucaaaagacauguu

SEQ ID NO: 2779246 - RNA, 21 nt, Human
aaauuucaaaagacauguugu

SEQ ID NO: 2779247 - RNA, 18 nt, Human
guauuuuuauacaaaccu

SEQ ID NO: 2779248 - RNA, 14 nt, Human
guauuuuuauauaa

SEQ ID NO: 2779249 - RNA, 13 nt, Human
guauuuuuaucca

SEQ ID NO: 2779250 - RNA, 19 nt, Human
guauuuuucaauaauaaaa

SEQ ID NO: 2779251 - RNA, 17 nt, Human
guauuuuucagagauuu

SEQ ID NO: 2779252 - RNA, 17 nt, Human
guauuuuucuguuagcu

SEQ ID NO: 2779253 - RNA, 14 nt, Human
guauuuuuauaaau

SEQ ID NO: 2779254 - RNA, 12 nt, Human
aaauuguacaua

SEQ ID NO: 2779255 - RNA, 22 nt, Human
aaauuguacauauuuguggaau

SEQ ID NO: 2779256 - RNA, 15 nt, Human
aaauuguaccuuuuu

SEQ ID NO: 2779257 - RNA, 15 nt, Human
aaauuguacauauuu

SEQ ID NO: 2779258 - RNA, 17 nt, Human
aaauugugcuucucccc

SEQ ID NO: 2779259 - RNA, 21 nt, Human
aaauugugcuucuccccagaa

SEQ ID NO: 2779260 - RNA, 22 nt, Human
aaauugugcuucuccccagaau

SEQ ID NO: 2779261 - RNA, 18 nt, Human
aaauugucuuuugucaug

SEQ ID NO: 2779262 - RNA, 21 nt, Human
aaauugucuuuugucaugugg

SEQ ID NO: 2779263 - RNA, 19 nt, Human
aaauugugaacucauugcu

SEQ ID NO: 2779264 - RNA, 14 nt, Human
aaauugucuucaug

SEQ ID NO: 2779265 - RNA, 23 nt, Human
aaauuuaucaaagcauagauguu

SEQ ID NO: 2779266 - RNA, 11 nt, Human
aaauucugugg

SEQ ID NO: 2779267 - RNA, 10 nt, Human
aaauucuguu

SEQ ID NO: 2779268 - RNA, 17 nt, Human
aaauucuguuaaaaucu

SEQ ID NO: 2779269 - RNA, 19 nt, Human
aaauucuguuaaaaucuau

SEQ ID NO: 2779270 - RNA, 20 nt, Human
aaauucuguuaaaaucuauu

SEQ ID NO: 2779271 - RNA, 9 nt, Human
aaauucugu

SEQ ID NO: 2779272 - RNA, 16 nt, Human
aaauucugaauauuuu

SEQ ID NO: 2779273 - RNA, 14 nt, Human
aaauuauuugcagg

SEQ ID NO: 2779274 - RNA, 13 nt, Human
aaauuauuugugu

SEQ ID NO: 2779275 - RNA, 16 nt, Human
aaauuauuuguguaau

SEQ ID NO: 2779276 - RNA, 21 nt, Human
aaauuauuuguguaauagaaa

SEQ ID NO: 2779277 - RNA, 20 nt, Human
aaauucugagacauguguca

SEQ ID NO: 2779278 - RNA, 20 nt, Human
aaauggguuggugcuucuaa

SEQ ID NO: 2779279 - RNA, 18 nt, Human
guaacaguucauguuugc

SEQ ID NO: 2779280 - RNA, 20 nt, Human
guaacaguucauguuugcuu

SEQ ID NO: 2779281 - RNA, 22 nt, Human
aaauggguuggugcuucuaacc

SEQ ID NO: 2779282 - RNA, 17 nt, Human
aaauggucgcccaggag

SEQ ID NO: 2779283 - RNA, 16 nt, Human
aaauggucgcccagga

SEQ ID NO: 2779284 - RNA, 19 nt, Human
aaaugguaggcauuuccua

SEQ ID NO: 2779285 - RNA, 18 nt, Human
aaauggucgcccaggaga

SEQ ID NO: 2779286 - RNA, 23 nt, Human
aaauggugaaaauaaaauaaagc

SEQ ID NO: 2779287 - RNA, 19 nt, Human
aaauggugcucaccaugcu

SEQ ID NO: 2779288 - RNA, 17 nt, Human
aaaugguggcuucagcu

SEQ ID NO: 2779289 - RNA, 18 nt, Human
aaaugguggcuucagcuc

SEQ ID NO: 2779290 - RNA, 19 nt, Human
aaaugguggcuucagcucc

SEQ ID NO: 2779291 - RNA, 20 nt, Human
aaaugguggcuucagcucca

SEQ ID NO: 2779292 - RNA, 22 nt, Human
aaaugguggcuucagcuccagc

SEQ ID NO: 2779293 - RNA, 17 nt, Human
guaacaguucauguuug

SEQ ID NO: 2779294 - RNA, 14 nt, Human
guaacagaacagcu

SEQ ID NO: 2779295 - RNA, 22 nt, Human
guaacagguauuuuguuucuuu

SEQ ID NO: 2779296 - RNA, 12 nt, Human
guaacaggcaga

SEQ ID NO: 2779297 - RNA, 22 nt, Human
guaacacagcugagagacuuuu

SEQ ID NO: 2779298 - RNA, 14 nt, Human
guaguuaggaaaua

SEQ ID NO: 2779299 - RNA, 13 nt, Human
guaguuaggaaau

SEQ ID NO: 2779300 - RNA, 11 nt, Human
guaguuaggaa

SEQ ID NO: 2779301 - RNA, 21 nt, Human
guaguuaaaaaaaaaaaaagg

SEQ ID NO: 2779302 - RNA, 23 nt, Human
guaguuaaaaaaaaaaaaaggaa

SEQ ID NO: 2779303 - RNA, 13 nt, Human
guaguuaauuuau

SEQ ID NO: 2779304 - RNA, 15 nt, Human
guaguuaauuuaucu

SEQ ID NO: 2779305 - RNA, 18 nt, Human
guaguugcaauagaacag

SEQ ID NO: 2779306 - RNA, 22 nt, Human
guaguuaggaaauaaaaccuuu

SEQ ID NO: 2779307 - RNA, 20 nt, Human
guaguuaggaaauaaaaccu

SEQ ID NO: 2779308 - RNA, 16 nt, Human
guaguuaggaaauaaa

SEQ ID NO: 2779309 - RNA, 15 nt, Human
guaguuaggaaauaa

SEQ ID NO: 2779310 - RNA, 20 nt, Human
guaguuuuauuuuauguuua

SEQ ID NO: 2779311 - RNA, 22 nt, Human
guaguuuuuacagcuguguuau

SEQ ID NO: 2779312 - RNA, 12 nt, Human
guaguugucuuu

SEQ ID NO: 2779313 - RNA, 16 nt, Human
guaguugucuuuccug

SEQ ID NO: 2779314 - RNA, 23 nt, Human
guaguuuuuuuuuuuuuuaugug

SEQ ID NO: 2779315 - RNA, 14 nt, Human
aaauguaagaucgu

SEQ ID NO: 2779316 - RNA, 22 nt, Human
aaauguaagaucguucucugcc

SEQ ID NO: 2779317 - RNA, 18 nt, Human
aaauguaacuuuuguaag

SEQ ID NO: 2779318 - RNA, 20 nt, Human
aaauguaagauuauagauuc

SEQ ID NO: 2779319 - RNA, 21 nt, Human
aaauguaagauuauagauucu

SEQ ID NO: 2779320 - RNA, 22 nt, Human
aaauguaagauuauagauucua

SEQ ID NO: 2779321 - RNA, 13 nt, Human
aaauguaaacugc

SEQ ID NO: 2779322 - RNA, 14 nt, Human
aaauguaaacugcc

SEQ ID NO: 2779323 - RNA, 15 nt, Human
aaauguaaacugcca

SEQ ID NO: 2779324 - RNA, 16 nt, Human
aaauguaaacugccau

SEQ ID NO: 2779325 - RNA, 19 nt, Human
aaauguaaaaauaauaauu

SEQ ID NO: 2779326 - RNA, 15 nt, Human
aaauguaaacauuuu

SEQ ID NO: 2779327 - RNA, 17 nt, Human
aaaugguuuauuuugua

SEQ ID NO: 2779328 - RNA, 23 nt, Human
aaaugguuuauuuuguauugugg

SEQ ID NO: 2779329 - RNA, 17 nt, Human
aaauguaacuuuuguaa

SEQ ID NO: 2779330 - RNA, 15 nt, Human
aaauguaaauauucu

SEQ ID NO: 2779331 - RNA, 17 nt, Human
aaauguaaauauucuau

SEQ ID NO: 2779332 - RNA, 14 nt, Human
guauauuuguauau

SEQ ID NO: 2779333 - RNA, 16 nt, Human
guauauuuccgcacuu

SEQ ID NO: 2779334 - RNA, 12 nt, Human
guauauuugaaa

SEQ ID NO: 2779335 - RNA, 22 nt, Human
guauauuuaaacucaagacaau

SEQ ID NO: 2779336 - RNA, 18 nt, Human
guaucaggugcugccauc

SEQ ID NO: 2779337 - RNA, 16 nt, Human
guaucaggugcugcca

SEQ ID NO: 2779338 - RNA, 19 nt, Human
guauauuuuuuuaauuuaa

SEQ ID NO: 2779339 - RNA, 15 nt, Human
guaucaaauaaaauu

SEQ ID NO: 2779340 - RNA, 15 nt, Human
guaucaaacccacga

SEQ ID NO: 2779341 - RNA, 17 nt, Human
guauaagugcacacaga

SEQ ID NO: 2779342 - RNA, 15 nt, Human
guauaaguggugugu

SEQ ID NO: 2779343 - RNA, 12 nt, Human
guauauuggaag

SEQ ID NO: 2779344 - RNA, 13 nt, Human
guauauuguguuu

SEQ ID NO: 2779345 - RNA, 20 nt, Human
guauauuguguuuguguauu

SEQ ID NO: 2779346 - RNA, 19 nt, Human
guauauuguguuuguguau

SEQ ID NO: 2779347 - RNA, 23 nt, Human
guauaaugguugacuggguuucu

SEQ ID NO: 2779348 - RNA, 21 nt, Human
guauaaugguugacuggguuu

SEQ ID NO: 2779349 - RNA, 19 nt, Human
guauaaugguugacugggu

SEQ ID NO: 2779350 - RNA, 14 nt, Human
guauccaugcucuu

SEQ ID NO: 2779351 - RNA, 19 nt, Human
guauccaaccaacuugguu

SEQ ID NO: 2779352 - RNA, 19 nt, Human
guauccacuuugcacagcu

SEQ ID NO: 2779353 - RNA, 14 nt, Human
guauccacuuugca

SEQ ID NO: 2779354 - RNA, 19 nt, Human
guaucccaugagccucagc

SEQ ID NO: 2779355 - RNA, 22 nt, Human
guaucaggugcugccauccagg

SEQ ID NO: 2779356 - RNA, 15 nt, Human
guaucaguguuuuaa

SEQ ID NO: 2779357 - RNA, 17 nt, Human
guaucaguguuuuaaau

SEQ ID NO: 2779358 - RNA, 19 nt, Human
guaucaguguuuuaaauuc

SEQ ID NO: 2779359 - RNA, 20 nt, Human
guaucaguguuuuaaauucu

SEQ ID NO: 2779360 - RNA, 22 nt, Human
guaucaguguuuuaaauucuga

SEQ ID NO: 2779361 - RNA, 23 nt, Human
guaucaguguuuuaaauucugag

SEQ ID NO: 2779362 - RNA, 15 nt, Human
guaucauagaaaugu

SEQ ID NO: 2779363 - RNA, 12 nt, Human
guaucauagaaa

SEQ ID NO: 2779364 - RNA, 15 nt, Human
guaucaggucuccca

SEQ ID NO: 2779365 - RNA, 14 nt, Human
guaucaucuggaua

SEQ ID NO: 2779366 - RNA, 24 nt, Human
guaucaucuggauaggagccugcu

SEQ ID NO: 2779367 - RNA, 14 nt, Human
guaugguggcuggg

SEQ ID NO: 2779368 - RNA, 16 nt, Human
guaugguggcuggguu

SEQ ID NO: 2779369 - RNA, 15 nt, Human
guaugguggcugggu

SEQ ID NO: 2779370 - RNA, 15 nt, Human
guaugcgugugugug

SEQ ID NO: 2779371 - RNA, 13 nt, Human
guaugcugaucau

SEQ ID NO: 2779372 - RNA, 19 nt, Human
guaugcugaucaucgccag

SEQ ID NO: 2779373 - RNA, 21 nt, Human
guaugcugaucaucgccagag

SEQ ID NO: 2779374 - RNA, 22 nt, Human
aagggucgaaagcucuagaauc

SEQ ID NO: 2779375 - RNA, 18 nt, Human
aagggucgaaagcucuag

SEQ ID NO: 2779376 - RNA, 19 nt, Human
aagggucgaaagcucuaga

SEQ ID NO: 2779377 - RNA, 21 nt, Human
aagggucgaaagcucuagaau

SEQ ID NO: 2779378 - RNA, 17 nt, Human
aagguagaaccucaccu

SEQ ID NO: 2779379 - RNA, 23 nt, Human
aaggcucugagcaaauguggcuc

SEQ ID NO: 2779380 - RNA, 17 nt, Human
aaggcucuucuccccag

SEQ ID NO: 2779381 - RNA, 19 nt, Human
aaggcucuucuccccagag

SEQ ID NO: 2779382 - RNA, 22 nt, Human
aaggcucugagagucuagauuc

SEQ ID NO: 2779383 - RNA, 12 nt, Human
aaggcucugaga

SEQ ID NO: 2779384 - RNA, 13 nt, Human
aaggcucugagag

SEQ ID NO: 2779385 - RNA, 14 nt, Human
aaggcucugagagu

SEQ ID NO: 2779386 - RNA, 16 nt, Human
aaggcucugagagucu

SEQ ID NO: 2779387 - RNA, 17 nt, Human
aaggcucugagagucua

SEQ ID NO: 2779388 - RNA, 20 nt, Human
aaggcucugagagucuagau

SEQ ID NO: 2779389 - RNA, 21 nt, Human
aaggcucugagagucuagauu

SEQ ID NO: 2779390 - RNA, 21 nt, Human
aaggcucuaugagucuagaug

SEQ ID NO: 2779391 - RNA, 16 nt, Human
aaggcucuaugagucu

SEQ ID NO: 2779392 - RNA, 20 nt, Human
aaggcucuaugagucuagau

SEQ ID NO: 2779393 - RNA, 11 nt, Human
aaggcucuaga

SEQ ID NO: 2779394 - RNA, 12 nt, Human
aaggcucuagau

SEQ ID NO: 2779395 - RNA, 13 nt, Human
aaggcucuagauc

SEQ ID NO: 2779396 - RNA, 13 nt, Human
aaggggcccuggu

SEQ ID NO: 2779397 - RNA, 23 nt, Human
aaggggccauuuggcauaccuuu

SEQ ID NO: 2779398 - RNA, 21 nt, Human
aaggggcccugguccuuccag

SEQ ID NO: 2779399 - RNA, 14 nt, Human
aaggggcccugguc

SEQ ID NO: 2779400 - RNA, 23 nt, Human
aaggggccucaccgagugggggc

SEQ ID NO: 2779401 - RNA, 20 nt, Human
aaggggcggugcccacaccg

SEQ ID NO: 2779402 - RNA, 18 nt, Human
guuucucuugagcuggcc

SEQ ID NO: 2779403 - RNA, 17 nt, Human
guuucucuugagcuggc

SEQ ID NO: 2779404 - RNA, 12 nt, Human
guuucugaaaag

SEQ ID NO: 2779405 - RNA, 13 nt, Human
guuucugaaaaga

SEQ ID NO: 2779406 - RNA, 14 nt, Human
guuucugaaaagaa

SEQ ID NO: 2779407 - RNA, 22 nt, Human
guuucugaaaagaaauaauaau

SEQ ID NO: 2779408 - RNA, 20 nt, Human
guuucucuugagcuggccuc

SEQ ID NO: 2779409 - RNA, 22 nt, Human
guuucugaggcuuuaugauaau

SEQ ID NO: 2779410 - RNA, 13 nt, Human
guuucugagaaaa

SEQ ID NO: 2779411 - RNA, 14 nt, Human
guuucugagaaaag

SEQ ID NO: 2779412 - RNA, 17 nt, Human
guuucugagaaaagaac

SEQ ID NO: 2779413 - RNA, 19 nt, Human
guuucuauguguagggcgg

SEQ ID NO: 2779414 - RNA, 20 nt, Human
guuucuaugaguggaaaaag

SEQ ID NO: 2779415 - RNA, 14 nt, Human
guuucucagauccu

SEQ ID NO: 2779416 - RNA, 14 nt, Human
guuucucaaaucuu

SEQ ID NO: 2779417 - RNA, 21 nt, Human
aaguaaguaccacucaggcca

SEQ ID NO: 2779418 - RNA, 20 nt, Human
aaguaaguaccacucaggcc

SEQ ID NO: 2779419 - RNA, 18 nt, Human
aaguaaguaccacucagg

SEQ ID NO: 2779420 - RNA, 15 nt, Human
aaguaagagacucag

SEQ ID NO: 2779421 - RNA, 15 nt, Human
aaguaagaggcugga

SEQ ID NO: 2779422 - RNA, 13 nt, Human
aaguaagcaaaga

SEQ ID NO: 2779423 - RNA, 19 nt, Human
aaggucaccagcaccaaca

SEQ ID NO: 2779424 - RNA, 17 nt, Human
aagguauuugggaaacu

SEQ ID NO: 2779425 - RNA, 19 nt, Human
aagguauuugggaaacuug

SEQ ID NO: 2779426 - RNA, 21 nt, Human
aagguauuugggaaacuuguc

SEQ ID NO: 2779427 - RNA, 22 nt, Human
aagguauuugggaaacuuguca

SEQ ID NO: 2779428 - RNA, 15 nt, Human
aagguauuuugaaua

SEQ ID NO: 2779429 - RNA, 19 nt, Human
aagguauuuugaauaccau

SEQ ID NO: 2779430 - RNA, 23 nt, Human
aaggucauggccacacugugaca

SEQ ID NO: 2779431 - RNA, 14 nt, Human
aaggucauuucuuc

SEQ ID NO: 2779432 - RNA, 17 nt, Human
aaggucauuucuucagu

SEQ ID NO: 2779433 - RNA, 17 nt, Human
guugggcccagaucugg

SEQ ID NO: 2779434 - RNA, 16 nt, Human
guugggcccagaucug

SEQ ID NO: 2779435 - RNA, 15 nt, Human
guugggcccagaucu

SEQ ID NO: 2779436 - RNA, 21 nt, Human
guuuaauauuaccuaaugaaa

SEQ ID NO: 2779437 - RNA, 17 nt, Human
guuuaauauuuaaacag

SEQ ID NO: 2779438 - RNA, 14 nt, Human
guuuaaucuguuau

SEQ ID NO: 2779439 - RNA, 12 nt, Human
guuuaauauuua

SEQ ID NO: 2779440 - RNA, 15 nt, Human
guuuaauauuuaaac

SEQ ID NO: 2779441 - RNA, 13 nt, Human
guugggcuggugu

SEQ ID NO: 2779442 - RNA, 13 nt, Human
guugggcccagau

SEQ ID NO: 2779443 - RNA, 22 nt, Human
guugggcagggugacccugaag

SEQ ID NO: 2779444 - RNA, 12 nt, Human
guugggcaugug

SEQ ID NO: 2779445 - RNA, 16 nt, Human
guuuauuucacuugau

SEQ ID NO: 2779446 - RNA, 12 nt, Human
guuuauuucauu

SEQ ID NO: 2779447 - RNA, 13 nt, Human
guuuauuucacac

SEQ ID NO: 2779448 - RNA, 12 nt, Human
guuuauuuccaa

SEQ ID NO: 2779449 - RNA, 21 nt, Human
guuuauuuccaaauaaaauga

SEQ ID NO: 2779450 - RNA, 19 nt, Human
guuuauuucuguuucucau

SEQ ID NO: 2779451 - RNA, 13 nt, Human
guuuacaugugua

SEQ ID NO: 2779452 - RNA, 21 nt, Human
guuuacauguguagccuaugu

SEQ ID NO: 2779453 - RNA, 22 nt, Human
guuuacauguguagccuauguu

SEQ ID NO: 2779454 - RNA, 11 nt, Human
guuuacauuua

SEQ ID NO: 2779455 - RNA, 22 nt, Human
guuuauugaguuuguagguaaa

SEQ ID NO: 2779456 - RNA, 13 nt, Human
guuuacagaaaaa

SEQ ID NO: 2779457 - RNA, 14 nt, Human
guuuacagaaaaau

SEQ ID NO: 2779458 - RNA, 18 nt, Human
guuuacagaaaaaucuug

SEQ ID NO: 2779459 - RNA, 19 nt, Human
guuuacagcucugacuuua

SEQ ID NO: 2779460 - RNA, 14 nt, Human
guuuacaggcccug

SEQ ID NO: 2779461 - RNA, 18 nt, Human
guuuacaggcccugcucc

SEQ ID NO: 2779462 - RNA, 19 nt, Human
guuuacaggcccugcuccu

SEQ ID NO: 2779463 - RNA, 17 nt, Human
guuuacagguggacaca

SEQ ID NO: 2779464 - RNA, 13 nt, Human
guuuauuuuaaga

SEQ ID NO: 2779465 - RNA, 15 nt, Human
aaggcuccauauaua

SEQ ID NO: 2779466 - RNA, 16 nt, Human
aaggcuccauauauau

SEQ ID NO: 2779467 - RNA, 18 nt, Human
aaggcuccugaucauucu

SEQ ID NO: 2779468 - RNA, 18 nt, Human
guugccuaagcauugccu

SEQ ID NO: 2779469 - RNA, 21 nt, Human
guugccuaagcauugccuggc

SEQ ID NO: 2779470 - RNA, 17 nt, Human
guugccuaaguauuaaa

SEQ ID NO: 2779471 - RNA, 14 nt, Human
guugccugucgcuu

SEQ ID NO: 2779472 - RNA, 15 nt, Human
guugccugucgcuuu

SEQ ID NO: 2779473 - RNA, 16 nt, Human
guugccuaauaaacau

SEQ ID NO: 2779474 - RNA, 18 nt, Human
guugccuaaguauuaaaa

SEQ ID NO: 2779475 - RNA, 21 nt, Human
guugccuaaguauuaaaacau

SEQ ID NO: 2779476 - RNA, 22 nt, Human
guugccuaaguauuaaaacauu

SEQ ID NO: 2779477 - RNA, 18 nt, Human
guugccuuaaagaaaguc

SEQ ID NO: 2779478 - RNA, 20 nt, Human
guugccuuuuucauuuucca

SEQ ID NO: 2779479 - RNA, 24 nt, Human
guugccuuuuucauuuuccaauac

SEQ ID NO: 2779480 - RNA, 13 nt, Human
guugcccaggcug

SEQ ID NO: 2779481 - RNA, 12 nt, Human
guugcccaggcu

SEQ ID NO: 2779482 - RNA, 23 nt, Human
guugcccaggcaggucuugaacu

SEQ ID NO: 2779483 - RNA, 18 nt, Human
aaggccuaggauucuaaa

SEQ ID NO: 2779484 - RNA, 15 nt, Human
aaggccuaggauucu

SEQ ID NO: 2779485 - RNA, 16 nt, Human
aaggccuaggauucua

SEQ ID NO: 2779486 - RNA, 14 nt, Human
guugcuuucacucu

SEQ ID NO: 2779487 - RNA, 15 nt, Human
guugcuuucacucuc

SEQ ID NO: 2779488 - RNA, 16 nt, Human
guugcuucuugugaag

SEQ ID NO: 2779489 - RNA, 17 nt, Human
guugcuucuugugaagg

SEQ ID NO: 2779490 - RNA, 20 nt, Human
guugcuucuugugaaggcca

SEQ ID NO: 2779491 - RNA, 23 nt, Human
guugcguggacucugcacauguc

SEQ ID NO: 2779492 - RNA, 18 nt, Human
guugcgugacacucuccu

SEQ ID NO: 2779493 - RNA, 23 nt, Human
guugcgugacacucuccuugcag

SEQ ID NO: 2779494 - RNA, 13 nt, Human
guugcuaaacacu

SEQ ID NO: 2779495 - RNA, 14 nt, Human
guugcuaaacacug

SEQ ID NO: 2779496 - RNA, 15 nt, Human
guugcuaaacacugc

SEQ ID NO: 2779497 - RNA, 19 nt, Human
guugcuaaacacugcgcuu

SEQ ID NO: 2779498 - RNA, 11 nt, Human
guugcuuuguu

SEQ ID NO: 2779499 - RNA, 14 nt, Human
guugcuuuguugca

SEQ ID NO: 2779500 - RNA, 16 nt, Human
guugcuuuguugcacu

SEQ ID NO: 2779501 - RNA, 21 nt, Human
guugcuuuugaaggaauacaa

SEQ ID NO: 2779502 - RNA, 20 nt, Human
guuggaagcuuguuuuccag

SEQ ID NO: 2779503 - RNA, 13 nt, Human
guugggagcugau

SEQ ID NO: 2779504 - RNA, 18 nt, Human
guuggaaauauucaugcu

SEQ ID NO: 2779505 - RNA, 14 nt, Human
guuggaagagaauc

SEQ ID NO: 2779506 - RNA, 16 nt, Human
guuggaagagaaucac

SEQ ID NO: 2779507 - RNA, 15 nt, Human
guuggaagaggaaca

SEQ ID NO: 2779508 - RNA, 22 nt, Human
guuggaaugaauuaaauaaacc

SEQ ID NO: 2779509 - RNA, 18 nt, Human
guugggauacugcagggc

SEQ ID NO: 2779510 - RNA, 18 nt, Human
guugggaucgcauugcau

SEQ ID NO: 2779511 - RNA, 21 nt, Human
guugggauacugcagggccag

SEQ ID NO: 2779512 - RNA, 17 nt, Human
aaggccaaacugcugga

SEQ ID NO: 2779513 - RNA, 15 nt, Human
aaggcauuguuugag

SEQ ID NO: 2779514 - RNA, 24 nt, Human
aaggccauaaaacagguaauauaa

SEQ ID NO: 2779515 - RNA, 18 nt, Human
aaggccauaaaacaggua

SEQ ID NO: 2779516 - RNA, 18 nt, Human
aaggccaguggaaauuca

SEQ ID NO: 2779517 - RNA, 21 nt, Human
aaggccaguggaaauucaggu

SEQ ID NO: 2779518 - RNA, 17 nt, Human
aaggaauagaagcaaau

SEQ ID NO: 2779519 - RNA, 23 nt, Human
aaggccagaguggccuggccagg

SEQ ID NO: 2779520 - RNA, 17 nt, Human
aaggccauaaaacaggu

SEQ ID NO: 2779521 - RNA, 14 nt, Human
aaggccauaaaaca

SEQ ID NO: 2779522 - RNA, 21 nt, Human
aaggcccacgagcuuguucuu

SEQ ID NO: 2779523 - RNA, 21 nt, Human
aaggccauggagagcuggagc

SEQ ID NO: 2779524 - RNA, 18 nt, Human
aaggccauggagagcugg

SEQ ID NO: 2779525 - RNA, 22 nt, Human
aaggccauggagagcuggagcc

SEQ ID NO: 2779526 - RNA, 15 nt, Human
aaggcccacaggagg

SEQ ID NO: 2779527 - RNA, 14 nt, Human
aaggcccagccccu

SEQ ID NO: 2779528 - RNA, 15 nt, Human
aaggcccagccccua

SEQ ID NO: 2779529 - RNA, 16 nt, Human
aaggcccagccccuag

SEQ ID NO: 2779530 - RNA, 18 nt, Human
aaggcccagccccuagaa

SEQ ID NO: 2779531 - RNA, 15 nt, Human
aaggcccugcugccc

SEQ ID NO: 2779532 - RNA, 16 nt, Human
aaggaguuggaaguga

SEQ ID NO: 2779533 - RNA, 20 nt, Human
aaggagucagacauuuuaag

SEQ ID NO: 2779534 - RNA, 20 nt, Human
aaggcaucagucccuaugua

SEQ ID NO: 2779535 - RNA, 19 nt, Human
aaggauagaucaaagucaa

SEQ ID NO: 2779536 - RNA, 16 nt, Human
aaggcauguuccucug

SEQ ID NO: 2779537 - RNA, 15 nt, Human
aaggcaugugugaaa

SEQ ID NO: 2779538 - RNA, 18 nt, Human
aaggcaugugugaaacau

SEQ ID NO: 2779539 - RNA, 19 nt, Human
aaggcaugugugaaacaua

SEQ ID NO: 2779540 - RNA, 20 nt, Human
aaggcauaucaugcuuugaa

SEQ ID NO: 2779541 - RNA, 14 nt, Human
aaggauacauaaug

SEQ ID NO: 2779542 - RNA, 12 nt, Human
aaggagggugag

SEQ ID NO: 2779543 - RNA, 17 nt, Human
aaggagucaaaacuaca

SEQ ID NO: 2779544 - RNA, 20 nt, Human
aaggaggggauagagagaga

SEQ ID NO: 2779545 - RNA, 17 nt, Human
aaggaggggaaaaaaau

SEQ ID NO: 2779546 - RNA, 18 nt, Human
aaggaggggaaaaaaaug

SEQ ID NO: 2779547 - RNA, 19 nt, Human
aaggaggggaaaaaaaugu

SEQ ID NO: 2779548 - RNA, 20 nt, Human
aaggaggggaaaaaaauguu

SEQ ID NO: 2779549 - RNA, 21 nt, Human
aaggaggggaaaaaaauguug

SEQ ID NO: 2779550 - RNA, 22 nt, Human
aaggaggggaaaaaaauguugu

SEQ ID NO: 2779551 - RNA, 18 nt, Human
aaggaggguacagcuggg

SEQ ID NO: 2779552 - RNA, 19 nt, Human
aaggaggguacagcugggc

SEQ ID NO: 2779553 - RNA, 15 nt, Human
aaggaggggaagcug

SEQ ID NO: 2779554 - RNA, 18 nt, Human
aaggaggggaagcugcag

SEQ ID NO: 2779555 - RNA, 14 nt, Human
aaggaggcuggcag

SEQ ID NO: 2779556 - RNA, 17 nt, Human
aaggagggaaggauuua

SEQ ID NO: 2779557 - RNA, 14 nt, Human
aaggagaggaggca

SEQ ID NO: 2779558 - RNA, 20 nt, Human
aaggagcccuuaucugugcu

SEQ ID NO: 2779559 - RNA, 15 nt, Human
aaggagaguggccau

SEQ ID NO: 2779560 - RNA, 20 nt, Human
aaggagaggcaacauccaaa

SEQ ID NO: 2779561 - RNA, 13 nt, Human
aaggagaggaggc

SEQ ID NO: 2779562 - RNA, 20 nt, Human
aaggaauacaauauauagcu

SEQ ID NO: 2779563 - RNA, 14 nt, Human
aaggaagugaagag

SEQ ID NO: 2779564 - RNA, 16 nt, Human
aaggaagugcccccuc

SEQ ID NO: 2779565 - RNA, 14 nt, Human
aaggaacugcagca

SEQ ID NO: 2779566 - RNA, 17 nt, Human
aaggaacuugaaaaaua

SEQ ID NO: 2779567 - RNA, 18 nt, Human
aaggaacuugaaaaauac

SEQ ID NO: 2779568 - RNA, 16 nt, Human
aaggaagcuccacugu

SEQ ID NO: 2779569 - RNA, 21 nt, Human
aaggaauaaauugcuccuuga

SEQ ID NO: 2779570 - RNA, 16 nt, Human
aaggaagccaaauuua

SEQ ID NO: 2779571 - RNA, 18 nt, Human
aaggaagccaaauuuauc

SEQ ID NO: 2779572 - RNA, 19 nt, Human
aaggaagccaaauuuauca

SEQ ID NO: 2779573 - RNA, 21 nt, Human
aaggaagagccaauguuuucc

SEQ ID NO: 2779574 - RNA, 18 nt, Human
aaggaagauauacaugaa

SEQ ID NO: 2779575 - RNA, 19 nt, Human
aagcuccacugucacccuc

SEQ ID NO: 2779576 - RNA, 21 nt, Human
aagcuccacugucacccucca

SEQ ID NO: 2779577 - RNA, 15 nt, Human
aagcuccacugucac

SEQ ID NO: 2779578 - RNA, 16 nt, Human
aagcuccacugucacc

SEQ ID NO: 2779579 - RNA, 14 nt, Human
aagcuccaucucca

SEQ ID NO: 2779580 - RNA, 23 nt, Human
aaggaacaaaaaaaccacaaagg

SEQ ID NO: 2779581 - RNA, 20 nt, Human
aaggaaauacccuucuuuua

SEQ ID NO: 2779582 - RNA, 23 nt, Human
aaggaaauacccuucuuuuauga

SEQ ID NO: 2779583 - RNA, 15 nt, Human
aaggaaauauauuuu

SEQ ID NO: 2779584 - RNA, 22 nt, Human
aaggaaaucucaccccauccca

SEQ ID NO: 2779585 - RNA, 16 nt, Human
aaggaaaucucacccc

SEQ ID NO: 2779586 - RNA, 13 nt, Human
aaggaaaggcaaa

SEQ ID NO: 2779587 - RNA, 14 nt, Human
aaggaaaggccuga

SEQ ID NO: 2779588 - RNA, 23 nt, Human
aaggaaccuuccuuccugcuuga

SEQ ID NO: 2779589 - RNA, 21 nt, Human
aaggaaccuuccuuccugcuu

SEQ ID NO: 2779590 - RNA, 13 nt, Human
aaggaaccuuccu

SEQ ID NO: 2779591 - RNA, 12 nt, Human
aaggaaccuucc

SEQ ID NO: 2779592 - RNA, 17 nt, Human
aaggaacagcaauggug

SEQ ID NO: 2779593 - RNA, 19 nt, Human
aagucauuccuucuuuuua

SEQ ID NO: 2779594 - RNA, 17 nt, Human
aagucauguaaauacug

SEQ ID NO: 2779595 - RNA, 19 nt, Human
aagucauguaaauacuguu

SEQ ID NO: 2779596 - RNA, 20 nt, Human
aagucaugcaaaggcuggga

SEQ ID NO: 2779597 - RNA, 19 nt, Human
aagucaugcaaaggcuggg

SEQ ID NO: 2779598 - RNA, 14 nt, Human
aagucaugugcauu

SEQ ID NO: 2779599 - RNA, 15 nt, Human
aagucaugugcauuu

SEQ ID NO: 2779600 - RNA, 21 nt, Human
aagucaugcguuuaaucacau

SEQ ID NO: 2779601 - RNA, 23 nt, Human
aaguauuuauauauuuauaacuc

SEQ ID NO: 2779602 - RNA, 22 nt, Human
aaguauuuauauauuuauaacu

SEQ ID NO: 2779603 - RNA, 21 nt, Human
aaguauuuauauauuuauaac

SEQ ID NO: 2779604 - RNA, 20 nt, Human
aaguauuuauauauuuauaa

SEQ ID NO: 2779605 - RNA, 13 nt, Human
aaguauuugggaa

SEQ ID NO: 2779606 - RNA, 20 nt, Human
aagucauggcagguacagua

SEQ ID NO: 2779607 - RNA, 14 nt, Human
aagucuuuuguucg

SEQ ID NO: 2779608 - RNA, 18 nt, Human
aagucuuuaggucuuugu

SEQ ID NO: 2779609 - RNA, 23 nt, Human
aagucuuuaggucuuuguaagaa

SEQ ID NO: 2779610 - RNA, 16 nt, Human
aagucuuucaagaaug

SEQ ID NO: 2779611 - RNA, 17 nt, Human
aagucuuucaagaauga

SEQ ID NO: 2779612 - RNA, 9 nt, Human
aagucuugu

SEQ ID NO: 2779613 - RNA, 10 nt, Human
aagucuugua

SEQ ID NO: 2779614 - RNA, 11 nt, Human
aagucuuguau

SEQ ID NO: 2779615 - RNA, 16 nt, Human
aagucuuguauaacua

SEQ ID NO: 2779616 - RNA, 16 nt, Human
aagucuuaucaagcag

SEQ ID NO: 2779617 - RNA, 17 nt, Human
aagucuuaucaagcagc

SEQ ID NO: 2779618 - RNA, 22 nt, Human
aagugagacaguccagccugga

SEQ ID NO: 2779619 - RNA, 17 nt, Human
guuuuuccuuauuugcu

SEQ ID NO: 2779620 - RNA, 16 nt, Human
guuuuucuggguggcc

SEQ ID NO: 2779621 - RNA, 14 nt, Human
guuuuuccuuuaaa

SEQ ID NO: 2779622 - RNA, 15 nt, Human
guuuuuccuuuaaaa

SEQ ID NO: 2779623 - RNA, 20 nt, Human
aagugagacaguccagccug

SEQ ID NO: 2779624 - RNA, 12 nt, Human
guuuuucauuca

SEQ ID NO: 2779625 - RNA, 14 nt, Human
aagugagagcuggg

SEQ ID NO: 2779626 - RNA, 15 nt, Human
aagugagagcugggu

SEQ ID NO: 2779627 - RNA, 15 nt, Human
aagugagacagucca

SEQ ID NO: 2779628 - RNA, 13 nt, Human
aagugaaauuucu

SEQ ID NO: 2779629 - RNA, 18 nt, Human
aagugaaauuucuagccu

SEQ ID NO: 2779630 - RNA, 23 nt, Human
aagugaagaauccuuuuguagaa

SEQ ID NO: 2779631 - RNA, 16 nt, Human
aagugaagacuggaag

SEQ ID NO: 2779632 - RNA, 13 nt, Human
aagugaagacugg

SEQ ID NO: 2779633 - RNA, 18 nt, Human
aagucuuuuguucgcaug

SEQ ID NO: 2779634 - RNA, 13 nt, Human
aagugaaaaucuu

SEQ ID NO: 2779635 - RNA, 14 nt, Human
aagugaaaaucuua

SEQ ID NO: 2779636 - RNA, 18 nt, Human
aagugaaauaacaaaaug

SEQ ID NO: 2779637 - RNA, 19 nt, Human
aagugaaauaacaaaaugg

SEQ ID NO: 2779638 - RNA, 16 nt, Human
aagugaaaucaaaggu

SEQ ID NO: 2779639 - RNA, 17 nt, Human
aagugaaauggauacua

SEQ ID NO: 2779640 - RNA, 12 nt, Human
aaguauuuauaa

SEQ ID NO: 2779641 - RNA, 13 nt, Human
aaguauuuauaau

SEQ ID NO: 2779642 - RNA, 12 nt, Human
aaguauuuauau

SEQ ID NO: 2779643 - RNA, 14 nt, Human
aaguauuuauauau

SEQ ID NO: 2779644 - RNA, 13 nt, Human
aaguauuuauaua

SEQ ID NO: 2779645 - RNA, 18 nt, Human
aaguauuuauauauuuau

SEQ ID NO: 2779646 - RNA, 17 nt, Human
aaguauuuauauauuua

SEQ ID NO: 2779647 - RNA, 16 nt, Human
aaguauuuauauauuu

SEQ ID NO: 2779648 - RNA, 15 nt, Human
aaguauuuauauauu

SEQ ID NO: 2779649 - RNA, 10 nt, Human
aaguauuuag

SEQ ID NO: 2779650 - RNA, 16 nt, Human
aaguauuuagguuuuu

SEQ ID NO: 2779651 - RNA, 11 nt, Human
aaguauuuagg

SEQ ID NO: 2779652 - RNA, 16 nt, Human
aaguaccaaaguuuua

SEQ ID NO: 2779653 - RNA, 17 nt, Human
aaguaccacucaggcca

SEQ ID NO: 2779654 - RNA, 13 nt, Human
aaguacauauuua

SEQ ID NO: 2779655 - RNA, 21 nt, Human
aaguacauauuuauuuucuuu

SEQ ID NO: 2779656 - RNA, 17 nt, Human
aaguacaugaauacaaa

SEQ ID NO: 2779657 - RNA, 16 nt, Human
aaguaauccuagggaa

SEQ ID NO: 2779658 - RNA, 21 nt, Human
aaguaauccaccugccucggc

SEQ ID NO: 2779659 - RNA, 16 nt, Human
guuuugcuguuuccuu

SEQ ID NO: 2779660 - RNA, 18 nt, Human
guuuugcucuuguagccc

SEQ ID NO: 2779661 - RNA, 13 nt, Human
guuuugcacuuuu

SEQ ID NO: 2779662 - RNA, 16 nt, Human
guuuuggaagcucuga

SEQ ID NO: 2779663 - RNA, 16 nt, Human
guuuuggacuccaucu

SEQ ID NO: 2779664 - RNA, 18 nt, Human
guuuuggaucuugaaugu

SEQ ID NO: 2779665 - RNA, 19 nt, Human
guuuuggaucuugaaugug

SEQ ID NO: 2779666 - RNA, 22 nt, Human
guuuugccauguuggccaggcu

SEQ ID NO: 2779667 - RNA, 21 nt, Human
guuuugccauguuggccaggc

SEQ ID NO: 2779668 - RNA, 20 nt, Human
guuuugccauguuggccagg

SEQ ID NO: 2779669 - RNA, 16 nt, Human
guuuugccauguuggc

SEQ ID NO: 2779670 - RNA, 21 nt, Human
guuucugcccacauuggaccc

SEQ ID NO: 2779671 - RNA, 22 nt, Human
guuucugcaugaauaucauaca

SEQ ID NO: 2779672 - RNA, 13 nt, Human
uaaaagaauuuuu

SEQ ID NO: 2779673 - RNA, 19 nt, Human
uaaaagaauuuuuuugucu

SEQ ID NO: 2779674 - RNA, 20 nt, Human
uaaaagaauuuuuuugucuu

SEQ ID NO: 2779675 - RNA, 11 nt, Human
uaaaagacaaa

SEQ ID NO: 2779676 - RNA, 12 nt, Human
uaaaagacaaau

SEQ ID NO: 2779677 - RNA, 13 nt, Human
uaaaacuugcugc

SEQ ID NO: 2779678 - RNA, 15 nt, Human
uaaaaccugucaaug

SEQ ID NO: 2779679 - RNA, 19 nt, Human
uaaaaccccaucucuacua

SEQ ID NO: 2779680 - RNA, 21 nt, Human
uaaaaccccagccaacucauu

SEQ ID NO: 2779681 - RNA, 13 nt, Human
uaaaaccuuucaa

SEQ ID NO: 2779682 - RNA, 11 nt, Human
uaaaaccuuuc

SEQ ID NO: 2779683 - RNA, 10 nt, Human
uaaaaccuuu

SEQ ID NO: 2779684 - RNA, 16 nt, Human
uaaaaccugucaauga

SEQ ID NO: 2779685 - RNA, 21 nt, Human
uaaaaccuuucaaauuucaca

SEQ ID NO: 2779686 - RNA, 20 nt, Human
uaaaaccuuucaaauuucac

SEQ ID NO: 2779687 - RNA, 16 nt, Human
uaaaaccuuucaaauu

SEQ ID NO: 2779688 - RNA, 14 nt, Human
uaaaaccuuucaaa

SEQ ID NO: 2779689 - RNA, 20 nt, Human
uaaaacgcugucaaaaguug

SEQ ID NO: 2779690 - RNA, 15 nt, Human
uaaaacuucuuaaau

SEQ ID NO: 2779691 - RNA, 18 nt, Human
uaaaacuucuuaaauauc

SEQ ID NO: 2779692 - RNA, 19 nt, Human
uaaaacuucuuaaauaucu

SEQ ID NO: 2779693 - RNA, 20 nt, Human
uaaaacuucuuaaauaucuu

SEQ ID NO: 2779694 - RNA, 21 nt, Human
uaaaacuucuuaaauaucuuu

SEQ ID NO: 2779695 - RNA, 22 nt, Human
uaaaacuucuuaaauaucuuuu

SEQ ID NO: 2779696 - RNA, 14 nt, Human
guuuuucuuguaaa

SEQ ID NO: 2779697 - RNA, 12 nt, Human
uaaaaaguggaa

SEQ ID NO: 2779698 - RNA, 17 nt, Human
uaaaaaguggaauuucu

SEQ ID NO: 2779699 - RNA, 18 nt, Human
uaaaaaguggaauuucuu

SEQ ID NO: 2779700 - RNA, 14 nt, Human
uaaaaaucacacug

SEQ ID NO: 2779701 - RNA, 15 nt, Human
uaaaaaucacacugu

SEQ ID NO: 2779702 - RNA, 16 nt, Human
uaaaaaucacacugua

SEQ ID NO: 2779703 - RNA, 17 nt, Human
uaaaaauaaauagaaaa

SEQ ID NO: 2779704 - RNA, 21 nt, Human
uaaaaauaaauagaaaaguag

SEQ ID NO: 2779705 - RNA, 14 nt, Human
uaaaaauaaauccc

SEQ ID NO: 2779706 - RNA, 19 nt, Human
uaaaaauaaaucccaugga

SEQ ID NO: 2779707 - RNA, 12 nt, Human
uaaaaaguuaau

SEQ ID NO: 2779708 - RNA, 14 nt, Human
uaaaaaguuguuca

SEQ ID NO: 2779709 - RNA, 15 nt, Human
uaaaaaguuguucaa

SEQ ID NO: 2779710 - RNA, 20 nt, Human
uaaaagacaaaucaaagcag

SEQ ID NO: 2779711 - RNA, 22 nt, Human
uaaaagacaaaucaaagcagau

SEQ ID NO: 2779712 - RNA, 19 nt, Human
uaaaagagacaaacuguaa

SEQ ID NO: 2779713 - RNA, 22 nt, Human
uaaaagugggcuugauucugca

SEQ ID NO: 2779714 - RNA, 14 nt, Human
uaaaauaaacaguu

SEQ ID NO: 2779715 - RNA, 15 nt, Human
uaaaauaaacaguug

SEQ ID NO: 2779716 - RNA, 19 nt, Human
uaaaaguuucaaugugauu

SEQ ID NO: 2779717 - RNA, 15 nt, Human
uaaaauaauucuaaa

SEQ ID NO: 2779718 - RNA, 14 nt, Human
uaaaaguugugauu

SEQ ID NO: 2779719 - RNA, 15 nt, Human
uaaaaguugugauuc

SEQ ID NO: 2779720 - RNA, 21 nt, Human
uaaaaguugugauuccagaua

SEQ ID NO: 2779721 - RNA, 13 nt, Human
uaaaaguuucaau

SEQ ID NO: 2779722 - RNA, 15 nt, Human
uaaaaguuucaaugu

SEQ ID NO: 2779723 - RNA, 18 nt, Human
uaaaaguuucaaugugau

SEQ ID NO: 2779724 - RNA, 23 nt, Human
uaaaagugggcuugauucugcag

SEQ ID NO: 2779725 - RNA, 22 nt, Human
uaaaagugucaccuuuucuugc

SEQ ID NO: 2779726 - RNA, 16 nt, Human
uaaaauaauucuaaag

SEQ ID NO: 2779727 - RNA, 17 nt, Human
uaaaauaauucuaaagg

SEQ ID NO: 2779728 - RNA, 23 nt, Human
uaaaauagaguguaguuuacaga

SEQ ID NO: 2779729 - RNA, 21 nt, Human
uaaaauagaguguaguuuaca

SEQ ID NO: 2779730 - RNA, 17 nt, Human
uaaaauagaguguaguu

SEQ ID NO: 2779731 - RNA, 16 nt, Human
uaaaauagaguguagu

SEQ ID NO: 2779732 - RNA, 17 nt, Human
uaaaauagaaauaagug

SEQ ID NO: 2779733 - RNA, 18 nt, Human
uaaaauaauuucucuaca

SEQ ID NO: 2779734 - RNA, 18 nt, Human
aagugauucuccugccuc

SEQ ID NO: 2779735 - RNA, 17 nt, Human
aagugauucuccugccu

SEQ ID NO: 2779736 - RNA, 16 nt, Human
aagugauucuccugcc

SEQ ID NO: 2779737 - RNA, 15 nt, Human
aagugauucuccugc

SEQ ID NO: 2779738 - RNA, 19 nt, Human
aagugauucuccugccuca

SEQ ID NO: 2779739 - RNA, 21 nt, Human
aagugauucucaugccucagc

SEQ ID NO: 2779740 - RNA, 15 nt, Human
aagugccgcaaauug

SEQ ID NO: 2779741 - RNA, 16 nt, Human
aagugccgcaaauugu

SEQ ID NO: 2779742 - RNA, 19 nt, Human
aagugccgcaaauuguacc

SEQ ID NO: 2779743 - RNA, 19 nt, Human
aagugauucucaugccuca

SEQ ID NO: 2779744 - RNA, 15 nt, Human
aagugauaauuucug

SEQ ID NO: 2779745 - RNA, 20 nt, Human
aagugauucucaugccucag

SEQ ID NO: 2779746 - RNA, 17 nt, Human
aagugagugugcugcug

SEQ ID NO: 2779747 - RNA, 19 nt, Human
aagugagugugcugcugua

SEQ ID NO: 2779748 - RNA, 18 nt, Human
aagugaguguuucuauga

SEQ ID NO: 2779749 - RNA, 21 nt, Human
uaaaagacuucccuaacacuu

SEQ ID NO: 2779750 - RNA, 12 nt, Human
uaaaauauuuau

SEQ ID NO: 2779751 - RNA, 15 nt, Human
uaaaauauuuaucug

SEQ ID NO: 2779752 - RNA, 13 nt, Human
uaaaauauuccug

SEQ ID NO: 2779753 - RNA, 22 nt, Human
uaaaauauuccugcauuuguga

SEQ ID NO: 2779754 - RNA, 13 nt, Human
guguauuucaguu

SEQ ID NO: 2779755 - RNA, 14 nt, Human
guguauuucaguuc

SEQ ID NO: 2779756 - RNA, 19 nt, Human
guguauuucuuauacgcuu

SEQ ID NO: 2779757 - RNA, 16 nt, Human
aagaugguacaaccuu

SEQ ID NO: 2779758 - RNA, 17 nt, Human
guguauuuacgcuuuga

SEQ ID NO: 2779759 - RNA, 21 nt, Human
guguauuuacgcuuugauuca

SEQ ID NO: 2779760 - RNA, 17 nt, Human
guguauuuauugaagaa

SEQ ID NO: 2779761 - RNA, 20 nt, Human
guguauuuauugaagaaaca

SEQ ID NO: 2779762 - RNA, 21 nt, Human
gugucaacaccccugugugga

SEQ ID NO: 2779763 - RNA, 14 nt, Human
gugucaaccagaca

SEQ ID NO: 2779764 - RNA, 15 nt, Human
gugucaaccagacag

SEQ ID NO: 2779765 - RNA, 16 nt, Human
gugucaaccagacaga

SEQ ID NO: 2779766 - RNA, 19 nt, Human
gugucaaccagacagaggg

SEQ ID NO: 2779767 - RNA, 20 nt, Human
gugucaagagggucugagga

SEQ ID NO: 2779768 - RNA, 14 nt, Human
gugucacugucccu

SEQ ID NO: 2779769 - RNA, 17 nt, Human
gugucacugucccuccu

SEQ ID NO: 2779770 - RNA, 18 nt, Human
gugucacugucccuccug

SEQ ID NO: 2779771 - RNA, 20 nt, Human
gugucacugucccuccuggu

SEQ ID NO: 2779772 - RNA, 15 nt, Human
gugucacuugugcuu

SEQ ID NO: 2779773 - RNA, 12 nt, Human
gugucagccauu

SEQ ID NO: 2779774 - RNA, 23 nt, Human
gugucagcgccuggccuacccag

SEQ ID NO: 2779775 - RNA, 17 nt, Human
aagauguaccuggugga

SEQ ID NO: 2779776 - RNA, 15 nt, Human
gugucaacuucaaca

SEQ ID NO: 2779777 - RNA, 17 nt, Human
guguggguaccuguauu

SEQ ID NO: 2779778 - RNA, 18 nt, Human
gugugggguucugcuggg

SEQ ID NO: 2779779 - RNA, 16 nt, Human
guguggguaccuguau

SEQ ID NO: 2779780 - RNA, 20 nt, Human
gugugugaaaaugugugugu

SEQ ID NO: 2779781 - RNA, 23 nt, Human
gugucauaaacagaugaauaaac

SEQ ID NO: 2779782 - RNA, 14 nt, Human
guguguauucuuaa

SEQ ID NO: 2779783 - RNA, 22 nt, Human
guguguauucuuaaaaugcaau

SEQ ID NO: 2779784 - RNA, 14 nt, Human
guguguauguguau

SEQ ID NO: 2779785 - RNA, 15 nt, Human
guguguauguguauu

SEQ ID NO: 2779786 - RNA, 20 nt, Human
gugucagguggggcagcuug

SEQ ID NO: 2779787 - RNA, 16 nt, Human
gugucaguauccaggc

SEQ ID NO: 2779788 - RNA, 20 nt, Human
gugucaguggggcucucuga

SEQ ID NO: 2779789 - RNA, 13 nt, Human
guguccaaagcag

SEQ ID NO: 2779790 - RNA, 21 nt, Human
gugucaugauucacccccaaa

SEQ ID NO: 2779791 - RNA, 16 nt, Human
gugucauuucauucca

SEQ ID NO: 2779792 - RNA, 17 nt, Human
gugucauuucauuccau

SEQ ID NO: 2779793 - RNA, 22 nt, Human
gugugacaaggauugcuacugu

SEQ ID NO: 2779794 - RNA, 13 nt, Human
gugugaaugaaca

SEQ ID NO: 2779795 - RNA, 14 nt, Human
gugugaaugaacac

SEQ ID NO: 2779796 - RNA, 13 nt, Human
gugugacagggcc

SEQ ID NO: 2779797 - RNA, 14 nt, Human
gugugacagggcca

SEQ ID NO: 2779798 - RNA, 18 nt, Human
gugugacagggccagugg

SEQ ID NO: 2779799 - RNA, 23 nt, Human
gugugacagggccaguggggccu

SEQ ID NO: 2779800 - RNA, 14 nt, Human
gugugacauuccag

SEQ ID NO: 2779801 - RNA, 15 nt, Human
gugugacauuccagg

SEQ ID NO: 2779802 - RNA, 15 nt, Human
gugugaaugaacacu

SEQ ID NO: 2779803 - RNA, 11 nt, Human
gugugaaugug

SEQ ID NO: 2779804 - RNA, 15 nt, Human
gugugaaugugggca

SEQ ID NO: 2779805 - RNA, 19 nt, Human
gugugaaugugggcacugg

SEQ ID NO: 2779806 - RNA, 21 nt, Human
gugugaaugugggcacuggcc

SEQ ID NO: 2779807 - RNA, 23 nt, Human
gugugaaugugggcacuggccca

SEQ ID NO: 2779808 - RNA, 14 nt, Human
gugugaccaacugu

SEQ ID NO: 2779809 - RNA, 15 nt, Human
gugugaccaacugug

SEQ ID NO: 2779810 - RNA, 16 nt, Human
gugugaccaacugugu

SEQ ID NO: 2779811 - RNA, 23 nt, Human
aagaucugcagggggugugucug

SEQ ID NO: 2779812 - RNA, 21 nt, Human
aagaucucacucugccccccc

SEQ ID NO: 2779813 - RNA, 13 nt, Human
aagaucuacauga

SEQ ID NO: 2779814 - RNA, 14 nt, Human
aagaucuacaugaa

SEQ ID NO: 2779815 - RNA, 16 nt, Human
aagaucuauaaagcga

SEQ ID NO: 2779816 - RNA, 11 nt, Human
aagauccugug

SEQ ID NO: 2779817 - RNA, 14 nt, Human
aagauccugugagg

SEQ ID NO: 2779818 - RNA, 16 nt, Human
aagaucguucucugcc

SEQ ID NO: 2779819 - RNA, 17 nt, Human
aagaucguucucugccu

SEQ ID NO: 2779820 - RNA, 23 nt, Human
aagaugaaggagaggcaacaucc

SEQ ID NO: 2779821 - RNA, 14 nt, Human
aagaugaaguuuua

SEQ ID NO: 2779822 - RNA, 19 nt, Human
aagaugaauacauuuuguu

SEQ ID NO: 2779823 - RNA, 14 nt, Human
aagaugaacucuga

SEQ ID NO: 2779824 - RNA, 18 nt, Human
aagauggcugugccucug

SEQ ID NO: 2779825 - RNA, 15 nt, Human
aagauggaaaggauu

SEQ ID NO: 2779826 - RNA, 20 nt, Human
aagauggcugugccucugcc

SEQ ID NO: 2779827 - RNA, 21 nt, Human
aagauggcugugccucugccu

SEQ ID NO: 2779828 - RNA, 21 nt, Human
aagaugggaacgcagaugauc

SEQ ID NO: 2779829 - RNA, 18 nt, Human
aagaugggcagcuaguuc

SEQ ID NO: 2779830 - RNA, 14 nt, Human
aagauggaguuucu

SEQ ID NO: 2779831 - RNA, 23 nt, Human
aagauggcugugccucugccugu

SEQ ID NO: 2779832 - RNA, 23 nt, Human
aagaggcugccccucucaccaaa

SEQ ID NO: 2779833 - RNA, 22 nt, Human
aagaggcugccccucucaccaa

SEQ ID NO: 2779834 - RNA, 16 nt, Human
aagagggcacacacug

SEQ ID NO: 2779835 - RNA, 17 nt, Human
aagagggcacacacugu

SEQ ID NO: 2779836 - RNA, 21 nt, Human
aagaggcugccccucucacca

SEQ ID NO: 2779837 - RNA, 17 nt, Human
aagaggcugccccucuc

SEQ ID NO: 2779838 - RNA, 15 nt, Human
aagaguagaauugca

SEQ ID NO: 2779839 - RNA, 22 nt, Human
gugggguccugccggagaggaa

SEQ ID NO: 2779840 - RNA, 16 nt, Human
aagaggcugagacagg

SEQ ID NO: 2779841 - RNA, 17 nt, Human
aagaggcguugcuuuca

SEQ ID NO: 2779842 - RNA, 20 nt, Human
aagaggcguugcuuucacuc

SEQ ID NO: 2779843 - RNA, 22 nt, Human
aagaggcguugcuuucacucuc

SEQ ID NO: 2779844 - RNA, 16 nt, Human
aagacuaauuuaaaaa

SEQ ID NO: 2779845 - RNA, 19 nt, Human
aagacuaauuuaaaaaaua

SEQ ID NO: 2779846 - RNA, 23 nt, Human
aagacguguuuguguuugugugu

SEQ ID NO: 2779847 - RNA, 15 nt, Human
aagacguguuugugu

SEQ ID NO: 2779848 - RNA, 16 nt, Human
aagacguguuuguguu

SEQ ID NO: 2779849 - RNA, 14 nt, Human
aagacgccugagcu

SEQ ID NO: 2779850 - RNA, 15 nt, Human
aagacgccugagcuc

SEQ ID NO: 2779851 - RNA, 19 nt, Human
aagacgguuaaauacugug

SEQ ID NO: 2779852 - RNA, 17 nt, Human
aagacuuggcaacagaa

SEQ ID NO: 2779853 - RNA, 20 nt, Human
aagacuuggcaacagaagca

SEQ ID NO: 2779854 - RNA, 19 nt, Human
aagacuuguaauauuuuua

SEQ ID NO: 2779855 - RNA, 18 nt, Human
aagacuuggcaacagaag

SEQ ID NO: 2779856 - RNA, 19 nt, Human
aagacuuggcaacagaagc

SEQ ID NO: 2779857 - RNA, 16 nt, Human
aagacuuggcaacaga

SEQ ID NO: 2779858 - RNA, 18 nt, Human
aagacuucccuaacacuu

SEQ ID NO: 2779859 - RNA, 21 nt, Human
aagacuucauugucccucuuc

SEQ ID NO: 2779860 - RNA, 18 nt, Human
aagacuuccaaagaaugu

SEQ ID NO: 2779861 - RNA, 18 nt, Human
aagagcaugaaauuuuua

SEQ ID NO: 2779862 - RNA, 11 nt, Human
aagagccacag

SEQ ID NO: 2779863 - RNA, 16 nt, Human
aagagcagccuguggc

SEQ ID NO: 2779864 - RNA, 14 nt, Human
aagagcagccugug

SEQ ID NO: 2779865 - RNA, 12 nt, Human
aagacuuguuuu

SEQ ID NO: 2779866 - RNA, 13 nt, Human
aagagcagccugu

SEQ ID NO: 2779867 - RNA, 18 nt, Human
aagagcagccuguggcau

SEQ ID NO: 2779868 - RNA, 17 nt, Human
aagagcagccuguggca

SEQ ID NO: 2779869 - RNA, 19 nt, Human
aagagcagccuguggcauc

SEQ ID NO: 2779870 - RNA, 22 nt, Human
aacuugagggcccagagcagga

SEQ ID NO: 2779871 - RNA, 19 nt, Human
aacuugagguggccuccuu

SEQ ID NO: 2779872 - RNA, 23 nt, Human
aacuugagguggccuccuugcuu

SEQ ID NO: 2779873 - RNA, 20 nt, Human
aacuugagggcccagagcag

SEQ ID NO: 2779874 - RNA, 15 nt, Human
aacuugcauggagca

SEQ ID NO: 2779875 - RNA, 21 nt, Human
aacuugcauccaacuccagga

SEQ ID NO: 2779876 - RNA, 11 nt, Human
aacuugaugca

SEQ ID NO: 2779877 - RNA, 12 nt, Human
aacuugaugcau

SEQ ID NO: 2779878 - RNA, 14 nt, Human
aacuugaugcaugu

SEQ ID NO: 2779879 - RNA, 15 nt, Human
aacuugaugcaugug

SEQ ID NO: 2779880 - RNA, 23 nt, Human
aagaccuugcuuaugauugcaga

SEQ ID NO: 2779881 - RNA, 21 nt, Human
aagaccuuuggagcaaagcug

SEQ ID NO: 2779882 - RNA, 19 nt, Human
aagagccauauaaguuuga

SEQ ID NO: 2779883 - RNA, 20 nt, Human
aagagccauauaaguuugaa

SEQ ID NO: 2779884 - RNA, 9 nt, Human
aagagccau

SEQ ID NO: 2779885 - RNA, 19 nt, Human
aagaggacucgcuuguaaa

SEQ ID NO: 2779886 - RNA, 20 nt, Human
aagaggacucgcuuguaaau

SEQ ID NO: 2779887 - RNA, 22 nt, Human
aagaggacucgcuuguaaauac

SEQ ID NO: 2779888 - RNA, 23 nt, Human
aagaggacucgcuuguaaauacc

SEQ ID NO: 2779889 - RNA, 13 nt, Human
aagaggagcacuu

SEQ ID NO: 2779890 - RNA, 18 nt, Human
aagaggagcacuuccaaa

SEQ ID NO: 2779891 - RNA, 21 nt, Human
aagaggagcacuuccaaaauu

SEQ ID NO: 2779892 - RNA, 19 nt, Human
aagaggaucuccuguccau

SEQ ID NO: 2779893 - RNA, 17 nt, Human
guggccgcccaaggccc

SEQ ID NO: 2779894 - RNA, 9 nt, Human
guggccuca

SEQ ID NO: 2779895 - RNA, 21 nt, Human
guggcccugucccucccaccu

SEQ ID NO: 2779896 - RNA, 22 nt, Human
guggcccugucccucccaccuc

SEQ ID NO: 2779897 - RNA, 23 nt, Human
guggcccugucccucccaccucu

SEQ ID NO: 2779898 - RNA, 14 nt, Human
guggcccuguccug

SEQ ID NO: 2779899 - RNA, 19 nt, Human
guggcccuguccugccaug

SEQ ID NO: 2779900 - RNA, 11 nt, Human
guggcccuugc

SEQ ID NO: 2779901 - RNA, 23 nt, Human
guggccucuccuuguggccuggg

SEQ ID NO: 2779902 - RNA, 17 nt, Human
guggccuccuugcuugu

SEQ ID NO: 2779903 - RNA, 21 nt, Human
guggccuccuugcuuguuaca

SEQ ID NO: 2779904 - RNA, 22 nt, Human
guggccucgggacaccugcccu

SEQ ID NO: 2779905 - RNA, 21 nt, Human
guggccucuccuuguggccug

SEQ ID NO: 2779906 - RNA, 22 nt, Human
guggccucuccuuguggccugg

SEQ ID NO: 2779907 - RNA, 22 nt, Human
guggccuguagaauagccugug

SEQ ID NO: 2779908 - RNA, 12 nt, Human
guggccugggcc

SEQ ID NO: 2779909 - RNA, 15 nt, Human
guggccugggccucc

SEQ ID NO: 2779910 - RNA, 14 nt, Human
guggccugggcaag

SEQ ID NO: 2779911 - RNA, 12 nt, Human
guggccugggca

SEQ ID NO: 2779912 - RNA, 21 nt, Human
guggccuggccaggagcucuu

SEQ ID NO: 2779913 - RNA, 20 nt, Human
guggccuggccaggagcucu

SEQ ID NO: 2779914 - RNA, 18 nt, Human
guggccuggccaggagcu

SEQ ID NO: 2779915 - RNA, 16 nt, Human
guggccuggccaggag

SEQ ID NO: 2779916 - RNA, 13 nt, Human
guggccuggccag

SEQ ID NO: 2779917 - RNA, 12 nt, Human
guggccuggcca

SEQ ID NO: 2779918 - RNA, 14 nt, Human
gugggagcugccug

SEQ ID NO: 2779919 - RNA, 12 nt, Human
guggccugugug

SEQ ID NO: 2779920 - RNA, 13 nt, Human
guggccugugugg

SEQ ID NO: 2779921 - RNA, 15 nt, Human
guggccuguguggcc

SEQ ID NO: 2779922 - RNA, 19 nt, Human
guggccuuggccggcugug

SEQ ID NO: 2779923 - RNA, 21 nt, Human
guggccuuggccggcugugcu

SEQ ID NO: 2779924 - RNA, 15 nt, Human
gugggggaaaaauaa

SEQ ID NO: 2779925 - RNA, 17 nt, Human
gugggggaagaccuggc

SEQ ID NO: 2779926 - RNA, 12 nt, Human
guggggcuuggc

SEQ ID NO: 2779927 - RNA, 13 nt, Human
guggggcuuggcg

SEQ ID NO: 2779928 - RNA, 15 nt, Human
guggggcuuggcgug

SEQ ID NO: 2779929 - RNA, 17 nt, Human
guggggcuuggcgugga

SEQ ID NO: 2779930 - RNA, 13 nt, Human
guggggccugugg

SEQ ID NO: 2779931 - RNA, 19 nt, Human
guggggccuguggaaugag

SEQ ID NO: 2779932 - RNA, 13 nt, Human
guggggccuuggu

SEQ ID NO: 2779933 - RNA, 14 nt, Human
guggggcgaggcag

SEQ ID NO: 2779934 - RNA, 18 nt, Human
gugggagcugccuguuca

SEQ ID NO: 2779935 - RNA, 15 nt, Human
gugggagcugccugu

SEQ ID NO: 2779936 - RNA, 17 nt, Human
gugggaagggcuacacc

SEQ ID NO: 2779937 - RNA, 22 nt, Human
guuauucauucugugaucauuu

SEQ ID NO: 2779938 - RNA, 23 nt, Human
guuauucauucugugaucauuua

SEQ ID NO: 2779939 - RNA, 17 nt, Human
guuauuccuugaucauu

SEQ ID NO: 2779940 - RNA, 18 nt, Human
guuauuccuugaucauuu

SEQ ID NO: 2779941 - RNA, 13 nt, Human
guuauucuggagu

SEQ ID NO: 2779942 - RNA, 17 nt, Human
guuauuuuucaaggaag

SEQ ID NO: 2779943 - RNA, 18 nt, Human
guuauuuuucaaggaagg

SEQ ID NO: 2779944 - RNA, 16 nt, Human
guucaaacaauaucau

SEQ ID NO: 2779945 - RNA, 14 nt, Human
guucaaaaagucua

SEQ ID NO: 2779946 - RNA, 18 nt, Human
guucaagcgauucuucug

SEQ ID NO: 2779947 - RNA, 15 nt, Human
guucaacuuccagaa

SEQ ID NO: 2779948 - RNA, 15 nt, Human
guucaacccacagcu

SEQ ID NO: 2779949 - RNA, 16 nt, Human
guucaacccacagcua

SEQ ID NO: 2779950 - RNA, 12 nt, Human
guucaacuauuu

SEQ ID NO: 2779951 - RNA, 14 nt, Human
guucaacuauuuua

SEQ ID NO: 2779952 - RNA, 20 nt, Human
guuaggagugggugacaaga

SEQ ID NO: 2779953 - RNA, 18 nt, Human
guuaggcauuaauguuuc

SEQ ID NO: 2779954 - RNA, 14 nt, Human
guuaggaaauaaaa

SEQ ID NO: 2779955 - RNA, 11 nt, Human
guuagcuggag

SEQ ID NO: 2779956 - RNA, 19 nt, Human
guuagcuuuuuaaaacauu

SEQ ID NO: 2779957 - RNA, 18 nt, Human
guuacuuucuuaauguga

SEQ ID NO: 2779958 - RNA, 15 nt, Human
guuaggaguucgaga

SEQ ID NO: 2779959 - RNA, 17 nt, Human
guuaggaugcucaguug

SEQ ID NO: 2779960 - RNA, 23 nt, Human
guuaggaaauaaaaccuuucaaa

SEQ ID NO: 2779961 - RNA, 15 nt, Human
guuaggaaugagaag

SEQ ID NO: 2779962 - RNA, 22 nt, Human
guuaggaaauaaaaccuuucaa

SEQ ID NO: 2779963 - RNA, 21 nt, Human
guuaggaaauaaaaccuuuca

SEQ ID NO: 2779964 - RNA, 19 nt, Human
guuaggaaauaaaaccuuu

SEQ ID NO: 2779965 - RNA, 18 nt, Human
guuaggaaauaaaaccuu

SEQ ID NO: 2779966 - RNA, 17 nt, Human
guuaggaaauaaaaccu

SEQ ID NO: 2779967 - RNA, 16 nt, Human
guuaggaaauaaaacc

SEQ ID NO: 2779968 - RNA, 10 nt, Human
guuaagagaa

SEQ ID NO: 2779969 - RNA, 12 nt, Human
guuaagagaaac

SEQ ID NO: 2779970 - RNA, 14 nt, Human
guuaagagaaacuu

SEQ ID NO: 2779971 - RNA, 15 nt, Human
guuaagagaaacuuu

SEQ ID NO: 2779972 - RNA, 17 nt, Human
guuaagagaaacuuuau

SEQ ID NO: 2779973 - RNA, 19 nt, Human
guuaagagaaacuuuauac

SEQ ID NO: 2779974 - RNA, 22 nt, Human
guuaagagaaacuuuauacauu

SEQ ID NO: 2779975 - RNA, 18 nt, Human
guuaagcauuaccacuca

SEQ ID NO: 2779976 - RNA, 16 nt, Human
guuaagcauuaccacu

SEQ ID NO: 2779977 - RNA, 21 nt, Human
guuacuuuauguuugucuuuu

SEQ ID NO: 2779978 - RNA, 19 nt, Human
guuagaaaugcagaauccu

SEQ ID NO: 2779979 - RNA, 22 nt, Human
guuagaauauaggucucuucuc

SEQ ID NO: 2779980 - RNA, 14 nt, Human
guuagaaucuauuu

SEQ ID NO: 2779981 - RNA, 17 nt, Human
guuagaaucuauuuucu

SEQ ID NO: 2779982 - RNA, 18 nt, Human
guuagaaucuauuuucua

SEQ ID NO: 2779983 - RNA, 19 nt, Human
guuagaaucuauuuucuau

SEQ ID NO: 2779984 - RNA, 22 nt, Human
guuagaaucuauuuucuaugua

SEQ ID NO: 2779985 - RNA, 19 nt, Human
guuagaaugagaucugaau

SEQ ID NO: 2779986 - RNA, 17 nt, Human
aagcucaggaccaggca

SEQ ID NO: 2779987 - RNA, 12 nt, Human
aagcucauauuu

SEQ ID NO: 2779988 - RNA, 20 nt, Human
aagcucauauuuuguauaua

SEQ ID NO: 2779989 - RNA, 21 nt, Human
aagcucauauuuuguauauau

SEQ ID NO: 2779990 - RNA, 22 nt, Human
aagcucauauuuuguauauauc

SEQ ID NO: 2779991 - RNA, 23 nt, Human
aagcucauauuuuguauauaucu

SEQ ID NO: 2779992 - RNA, 15 nt, Human
aagcucauuucaugc

SEQ ID NO: 2779993 - RNA, 18 nt, Human
aagcucauuucaugcucu

SEQ ID NO: 2779994 - RNA, 19 nt, Human
aagcucauuucaugcucug

SEQ ID NO: 2779995 - RNA, 17 nt, Human
aagcucagcuacugauu

SEQ ID NO: 2779996 - RNA, 19 nt, Human
aagcucaaguguucacaac

SEQ ID NO: 2779997 - RNA, 16 nt, Human
aagcucacaccaaauu

SEQ ID NO: 2779998 - RNA, 18 nt, Human
aagcucaaauaaaaauaa

SEQ ID NO: 2779999 - RNA, 12 nt, Human
aagcuaggccug

SEQ ID NO: 2780000 - RNA, 13 nt, Human
aagcuauuccuuu

SEQ ID NO: 2780001 - RNA, 14 nt, Human
aagcuauuccuuuc

SEQ ID NO: 2780002 - RNA, 19 nt, Human
aagcuauuccuuucccuuc

SEQ ID NO: 2780003 - RNA, 20 nt, Human
aagcuauuccuuucccuucc

SEQ ID NO: 2780004 - RNA, 21 nt, Human
aagcuauuccuuucccuuccu

SEQ ID NO: 2780005 - RNA, 22 nt, Human
aagcuauuccuuucccuuccuc

SEQ ID NO: 2780006 - RNA, 23 nt, Human
aagcuauuccuuucccuuccucu

SEQ ID NO: 2780007 - RNA, 14 nt, Human
aagcuaggaaugaa

SEQ ID NO: 2780008 - RNA, 22 nt, Human
aagccugcaauuucauaugcug

SEQ ID NO: 2780009 - RNA, 17 nt, Human
aagccugcaauuucaua

SEQ ID NO: 2780010 - RNA, 15 nt, Human
aagccugaggcuggg

SEQ ID NO: 2780011 - RNA, 13 nt, Human
guucagcuccagc

SEQ ID NO: 2780012 - RNA, 23 nt, Human
aagccuaaaagugggcuugauuc

SEQ ID NO: 2780013 - RNA, 22 nt, Human
guucagcuaagcuaggaaugaa

SEQ ID NO: 2780014 - RNA, 23 nt, Human
guucaaagccacauuauuucuag

SEQ ID NO: 2780015 - RNA, 20 nt, Human
guucaagcgauucuccugcc

SEQ ID NO: 2780016 - RNA, 19 nt, Human
guucagcuaagcuaggaau

SEQ ID NO: 2780017 - RNA, 14 nt, Human
aagccuaccugcuc

SEQ ID NO: 2780018 - RNA, 16 nt, Human
aagccuaaaugccuua

SEQ ID NO: 2780019 - RNA, 23 nt, Human
aagccuaaaugccuuagaaaugu

SEQ ID NO: 2780020 - RNA, 20 nt, Human
aagccuagaagagcuucuga

SEQ ID NO: 2780021 - RNA, 16 nt, Human
aagccuaccugcucuc

SEQ ID NO: 2780022 - RNA, 19 nt, Human
aagccuaccugcucuccaa

SEQ ID NO: 2780023 - RNA, 22 nt, Human
aagccucaaagagagaaaguuu

SEQ ID NO: 2780024 - RNA, 23 nt, Human
aagccucaagguuuuagguucua

SEQ ID NO: 2780025 - RNA, 22 nt, Human
aagccucaacuagucauuuuuu

SEQ ID NO: 2780026 - RNA, 21 nt, Human
aagccucaagguuuuagguuc

SEQ ID NO: 2780027 - RNA, 16 nt, Human
aagcauuuacuuugug

SEQ ID NO: 2780028 - RNA, 13 nt, Human
aagcauugaaauu

SEQ ID NO: 2780029 - RNA, 14 nt, Human
aagcauugaaauua

SEQ ID NO: 2780030 - RNA, 17 nt, Human
aagcauugaaauuauag

SEQ ID NO: 2780031 - RNA, 13 nt, Human
aagcauugccugg

SEQ ID NO: 2780032 - RNA, 14 nt, Human
aagcauugccuggc

SEQ ID NO: 2780033 - RNA, 21 nt, Human
aagcauugccuggccuuccug

SEQ ID NO: 2780034 - RNA, 21 nt, Human
aagcauugcuguuaugucugu

SEQ ID NO: 2780035 - RNA, 20 nt, Human
aagcauugcuuuuauuuuga

SEQ ID NO: 2780036 - RNA, 22 nt, Human
aagcauugcuuuuauuuugaaa

SEQ ID NO: 2780037 - RNA, 17 nt, Human
aagccaaaaaccuuagc

SEQ ID NO: 2780038 - RNA, 21 nt, Human
aagccaaaaaccuuagcuccc

SEQ ID NO: 2780039 - RNA, 22 nt, Human
aagccaaaaaccuuagcucccu

SEQ ID NO: 2780040 - RNA, 15 nt, Human
aagcauuuaucauuc

SEQ ID NO: 2780041 - RNA, 19 nt, Human
aagcauuuaucauucuugu

SEQ ID NO: 2780042 - RNA, 13 nt, Human
aagcaucuaaguu

SEQ ID NO: 2780043 - RNA, 18 nt, Human
aagcaucuaaguuauaag

SEQ ID NO: 2780044 - RNA, 18 nt, Human
aagcauuaccacucaggc

SEQ ID NO: 2780045 - RNA, 19 nt, Human
aagcauuaccacucaggca

SEQ ID NO: 2780046 - RNA, 15 nt, Human
aagcauucagagagc

SEQ ID NO: 2780047 - RNA, 17 nt, Human
aagcauucagagagcag

SEQ ID NO: 2780048 - RNA, 22 nt, Human
aagcauuccuucuuugauaaug

SEQ ID NO: 2780049 - RNA, 23 nt, Human
aagcauuccuucuuugauaaugu

SEQ ID NO: 2780050 - RNA, 14 nt, Human
aagcauucucccca

SEQ ID NO: 2780051 - RNA, 18 nt, Human
aagcauucuccccagugu

SEQ ID NO: 2780052 - RNA, 23 nt, Human
aagcauucuccccaguguauguc

SEQ ID NO: 2780053 - RNA, 13 nt, Human
aagcauuccuucu

SEQ ID NO: 2780054 - RNA, 14 nt, Human
aagcauuccuucuu

SEQ ID NO: 2780055 - RNA, 16 nt, Human
aagcauuccuucuuug

SEQ ID NO: 2780056 - RNA, 17 nt, Human
aagcauuccuucuuuga

SEQ ID NO: 2780057 - RNA, 18 nt, Human
aagcauuccuucuuugau

SEQ ID NO: 2780058 - RNA, 20 nt, Human
aagcauuccuucuuugauaa

SEQ ID NO: 2780059 - RNA, 21 nt, Human
aagcauuccuucuuugauaau

SEQ ID NO: 2780060 - RNA, 11 nt, Human
gugugugcccu

SEQ ID NO: 2780061 - RNA, 22 nt, Human
aagcaguugaaaugaggcauga

SEQ ID NO: 2780062 - RNA, 15 nt, Human
aagcaguugugucag

SEQ ID NO: 2780063 - RNA, 15 nt, Human
aagcauaaaaacauu

SEQ ID NO: 2780064 - RNA, 17 nt, Human
aagcauaaaaacauuuu

SEQ ID NO: 2780065 - RNA, 22 nt, Human
aagcauaaaaacauuuuaaaaa

SEQ ID NO: 2780066 - RNA, 14 nt, Human
aagcauagauguuu

SEQ ID NO: 2780067 - RNA, 15 nt, Human
aagcauagauguuuu

SEQ ID NO: 2780068 - RNA, 16 nt, Human
aagcauagauguuuug

SEQ ID NO: 2780069 - RNA, 17 nt, Human
aagcauagauguuuugg

SEQ ID NO: 2780070 - RNA, 22 nt, Human
aagcauacaugcaaaaagaaau

SEQ ID NO: 2780071 - RNA, 23 nt, Human
aagcauacaugcaaaaagaaaug

SEQ ID NO: 2780072 - RNA, 21 nt, Human
gugugugcgccuacaggagug

SEQ ID NO: 2780073 - RNA, 17 nt, Human
gugugugaccccuccug

SEQ ID NO: 2780074 - RNA, 22 nt, Human
gugugugaccccuccuggggcc

SEQ ID NO: 2780075 - RNA, 14 nt, Human
gugugugaaaggaa

SEQ ID NO: 2780076 - RNA, 17 nt, Human
gugugugaaugaacacu

SEQ ID NO: 2780077 - RNA, 17 nt, Human
guguguggcagagagag

SEQ ID NO: 2780078 - RNA, 22 nt, Human
aagcagguugaggggcuccugg

SEQ ID NO: 2780079 - RNA, 17 nt, Human
aagcaguaaauuugcua

SEQ ID NO: 2780080 - RNA, 14 nt, Human
aagcaguagacaag

SEQ ID NO: 2780081 - RNA, 21 nt, Human
aagcaguagaaauaauaugca

SEQ ID NO: 2780082 - RNA, 22 nt, Human
aagcaguagaaauaauaugcau

SEQ ID NO: 2780083 - RNA, 16 nt, Human
aagcagguuuuucucc

SEQ ID NO: 2780084 - RNA, 20 nt, Human
aagcaguagaaauaauaugc

SEQ ID NO: 2780085 - RNA, 23 nt, Human
aagcccuuccaugucgccucugc

SEQ ID NO: 2780086 - RNA, 15 nt, Human
aagcccuuccauguc

SEQ ID NO: 2780087 - RNA, 20 nt, Human
aagcccuuccaugucgccuc

SEQ ID NO: 2780088 - RNA, 18 nt, Human
aagcccuguugugccaca

SEQ ID NO: 2780089 - RNA, 22 nt, Human
aagcccuguugugccacagagu

SEQ ID NO: 2780090 - RNA, 12 nt, Human
aagcccuggccc

SEQ ID NO: 2780091 - RNA, 14 nt, Human
aagccgggaacaga

SEQ ID NO: 2780092 - RNA, 15 nt, Human
aagccgaccuuagau

SEQ ID NO: 2780093 - RNA, 19 nt, Human
guuaagaagcuguuguaca

SEQ ID NO: 2780094 - RNA, 20 nt, Human
guuaagaagcuguuguacau

SEQ ID NO: 2780095 - RNA, 13 nt, Human
guuaagaagcugu

SEQ ID NO: 2780096 - RNA, 15 nt, Human
guuaagaagcuguug

SEQ ID NO: 2780097 - RNA, 17 nt, Human
guuaagaagcuguugua

SEQ ID NO: 2780098 - RNA, 22 nt, Human
guuaagacaugauuuccuugaa

SEQ ID NO: 2780099 - RNA, 19 nt, Human
guuaagacaugauuuccuu

SEQ ID NO: 2780100 - RNA, 17 nt, Human
guuaagacaugauuucc

SEQ ID NO: 2780101 - RNA, 21 nt, Human
guuaagaagcuguuguacauu

SEQ ID NO: 2780102 - RNA, 23 nt, Human
aagcccugauuguguauauucau

SEQ ID NO: 2780103 - RNA, 13 nt, Human
aagcccuggagac

SEQ ID NO: 2780104 - RNA, 13 nt, Human
aagcccucccagg

SEQ ID NO: 2780105 - RNA, 20 nt, Human
aagcccucccagguguuaac

SEQ ID NO: 2780106 - RNA, 19 nt, Human
aagcccgccugacagaaac

SEQ ID NO: 2780107 - RNA, 16 nt, Human
aagcccuacagagcug

SEQ ID NO: 2780108 - RNA, 17 nt, Human
aagcccuacagagcugu

SEQ ID NO: 2780109 - RNA, 19 nt, Human
aagcccuacagagcugugg

SEQ ID NO: 2780110 - RNA, 16 nt, Human
aagcccccccuuccac

SEQ ID NO: 2780111 - RNA, 21 nt, Human
aagccccuugcucuccccugc

SEQ ID NO: 2780112 - RNA, 23 nt, Human
aagcccccccuuauaguuugggc

SEQ ID NO: 2780113 - RNA, 14 nt, Human
aagccaagaaagau

SEQ ID NO: 2780114 - RNA, 21 nt, Human
aagcccaggugccagccugag

SEQ ID NO: 2780115 - RNA, 22 nt, Human
aagcccaugaguccuugaaaau

SEQ ID NO: 2780116 - RNA, 19 nt, Human
aagcccaugaguccuugaa

SEQ ID NO: 2780117 - RNA, 20 nt, Human
aagcccaugaguccuugaaa

SEQ ID NO: 2780118 - RNA, 16 nt, Human
aagccaacacccuguc

SEQ ID NO: 2780119 - RNA, 16 nt, Human
aagccaacgacaaagc

SEQ ID NO: 2780120 - RNA, 22 nt, Human
aagccaaagcuaggccuggcca

SEQ ID NO: 2780121 - RNA, 22 nt, Human
aagccaaaguggcauguuuugu

SEQ ID NO: 2780122 - RNA, 13 nt, Human
aagccaaauuuau

SEQ ID NO: 2780123 - RNA, 14 nt, Human
aagccaaauuuauc

SEQ ID NO: 2780124 - RNA, 16 nt, Human
aagccaaauuuaucaa

SEQ ID NO: 2780125 - RNA, 15 nt, Human
aagccaaagaaauga

SEQ ID NO: 2780126 - RNA, 14 nt, Human
aagccaaacucugc

SEQ ID NO: 2780127 - RNA, 12 nt, Human
aagccaaagaaa

SEQ ID NO: 2780128 - RNA, 20 nt, Human
aagccaaacucugccagcca

SEQ ID NO: 2780129 - RNA, 16 nt, Human
aagccaaacucugcca

SEQ ID NO: 2780130 - RNA, 15 nt, Human
aagccaaacucugcc

SEQ ID NO: 2780131 - RNA, 14 nt, Human
uaaaugaauauuuu

SEQ ID NO: 2780132 - RNA, 15 nt, Human
uaaaugaauauuuug

SEQ ID NO: 2780133 - RNA, 16 nt, Human
uaaaugaauauuuuga

SEQ ID NO: 2780134 - RNA, 21 nt, Human
uaaaugaauauuuugauaaua

SEQ ID NO: 2780135 - RNA, 16 nt, Human
uaaaugaagcagcuuu

SEQ ID NO: 2780136 - RNA, 17 nt, Human
uaaaugaagcagcuuua

SEQ ID NO: 2780137 - RNA, 13 nt, Human
uaaaugugguaaa

SEQ ID NO: 2780138 - RNA, 22 nt, Human
uaaaugaagcagcuuuaaacaa

SEQ ID NO: 2780139 - RNA, 23 nt, Human
uaaaugaagcagcuuuaaacaaa

SEQ ID NO: 2780140 - RNA, 14 nt, Human
uaaauguguacaau

SEQ ID NO: 2780141 - RNA, 11 nt, Human
uaaauguguug

SEQ ID NO: 2780142 - RNA, 19 nt, Human
uaaauguguuggacaaaug

SEQ ID NO: 2780143 - RNA, 20 nt, Human
uaaauguguuggacaaaugu

SEQ ID NO: 2780144 - RNA, 22 nt, Human
uaaauguguuggacaaauguga

SEQ ID NO: 2780145 - RNA, 18 nt, Human
uaaauguuaguuucuugg

SEQ ID NO: 2780146 - RNA, 19 nt, Human
uaaauguuaguuucuuggu

SEQ ID NO: 2780147 - RNA, 21 nt, Human
uaaauguuaguuucuugguaa

SEQ ID NO: 2780148 - RNA, 22 nt, Human
uaaauguuaguuucuugguaaa

SEQ ID NO: 2780149 - RNA, 19 nt, Human
uaaauguuaugacuaugua

SEQ ID NO: 2780150 - RNA, 21 nt, Human
uaaauguuaugacuauguaaa

SEQ ID NO: 2780151 - RNA, 23 nt, Human
aaguguauaucagaaaagggaag

SEQ ID NO: 2780152 - RNA, 19 nt, Human
aagugcguguguagaguua

SEQ ID NO: 2780153 - RNA, 21 nt, Human
aagugcguguguagaguuaag

SEQ ID NO: 2780154 - RNA, 17 nt, Human
aagugccuuucugcagu

SEQ ID NO: 2780155 - RNA, 18 nt, Human
aagugccuuucugcaguu

SEQ ID NO: 2780156 - RNA, 23 nt, Human
aagugccuuucugcaguuuuuca

SEQ ID NO: 2780157 - RNA, 15 nt, Human
aagugcgugaaugua

SEQ ID NO: 2780158 - RNA, 16 nt, Human
aagugcgugccgugug

SEQ ID NO: 2780159 - RNA, 20 nt, Human
aagugcgugccgugugagug

SEQ ID NO: 2780160 - RNA, 15 nt, Human
aagugcguguguaga

SEQ ID NO: 2780161 - RNA, 16 nt, Human
aagugcguguguagag

SEQ ID NO: 2780162 - RNA, 17 nt, Human
aagugcguguguagagu

SEQ ID NO: 2780163 - RNA, 18 nt, Human
aagugcguguguagaguu

SEQ ID NO: 2780164 - RNA, 18 nt, Human
uaaaugaaaaucgugaca

SEQ ID NO: 2780165 - RNA, 16 nt, Human
uaaaugaaauuguaaa

SEQ ID NO: 2780166 - RNA, 14 nt, Human
uaaaugaaauugua

SEQ ID NO: 2780167 - RNA, 15 nt, Human
uaaaugaaauuguaa

SEQ ID NO: 2780168 - RNA, 15 nt, Human
uaaauuauacaaauu

SEQ ID NO: 2780169 - RNA, 22 nt, Human
uaaauuauacaaauuaaaaaga

SEQ ID NO: 2780170 - RNA, 17 nt, Human
uaaauuauauuugugcu

SEQ ID NO: 2780171 - RNA, 21 nt, Human
uaaauuauauuugugcuauag

SEQ ID NO: 2780172 - RNA, 20 nt, Human
uaaauguuaugacuauguaa

SEQ ID NO: 2780173 - RNA, 16 nt, Human
uaaauuaugguauuaa

SEQ ID NO: 2780174 - RNA, 17 nt, Human
uaaauuauguaaugcaa

SEQ ID NO: 2780175 - RNA, 18 nt, Human
uaaauuauguaaugcaaa

SEQ ID NO: 2780176 - RNA, 19 nt, Human
uaaauuauguaaugcaaaa

SEQ ID NO: 2780177 - RNA, 11 nt, Human
uaacaaaaugg

SEQ ID NO: 2780178 - RNA, 12 nt, Human
uaacaaaaugga

SEQ ID NO: 2780179 - RNA, 13 nt, Human
uaacaaaauggac

SEQ ID NO: 2780180 - RNA, 15 nt, Human
uaacaaaauggacau

SEQ ID NO: 2780181 - RNA, 19 nt, Human
uaaauuauuaguuuacauc

SEQ ID NO: 2780182 - RNA, 12 nt, Human
uaacaaagauau

SEQ ID NO: 2780183 - RNA, 14 nt, Human
uaacaaagauaucu

SEQ ID NO: 2780184 - RNA, 22 nt, Human
uaacaaagauaucuuuucuuua

SEQ ID NO: 2780185 - RNA, 22 nt, Human
uaacaaacaucacucugcugcu

SEQ ID NO: 2780186 - RNA, 21 nt, Human
uaacaaacaucacucugcugc

SEQ ID NO: 2780187 - RNA, 17 nt, Human
uaacaaugaagauaaaa

SEQ ID NO: 2780188 - RNA, 20 nt, Human
uaacaaugcagcaaggcccu

SEQ ID NO: 2780189 - RNA, 21 nt, Human
uaacaaugcagcaaggcccug

SEQ ID NO: 2780190 - RNA, 14 nt, Human
aauacacuugcccu

SEQ ID NO: 2780191 - RNA, 16 nt, Human
aauacacuugcccugc

SEQ ID NO: 2780192 - RNA, 17 nt, Human
aauacacuugcccugcu

SEQ ID NO: 2780193 - RNA, 22 nt, Human
aauacacuugugauuauaaaau

SEQ ID NO: 2780194 - RNA, 20 nt, Human
aauacacuaauuccuuucua

SEQ ID NO: 2780195 - RNA, 19 nt, Human
aauacagaaauuagccggg

SEQ ID NO: 2780196 - RNA, 21 nt, Human
uaacaaugacacuagaaaacu

SEQ ID NO: 2780197 - RNA, 13 nt, Human
aauacaugcaucu

SEQ ID NO: 2780198 - RNA, 13 nt, Human
aauacagcuuucu

SEQ ID NO: 2780199 - RNA, 14 nt, Human
aauacagcuuucug

SEQ ID NO: 2780200 - RNA, 16 nt, Human
aauacagcuuucugac

SEQ ID NO: 2780201 - RNA, 19 nt, Human
aauacagcuuucugaccuu

SEQ ID NO: 2780202 - RNA, 14 nt, Human
aauacagcagcaag

SEQ ID NO: 2780203 - RNA, 15 nt, Human
aauacagcagcaaga

SEQ ID NO: 2780204 - RNA, 16 nt, Human
aauacagcagcaagaa

SEQ ID NO: 2780205 - RNA, 17 nt, Human
aauacagcagcaagaaa

SEQ ID NO: 2780206 - RNA, 18 nt, Human
aauacagcagcaagaaaa

SEQ ID NO: 2780207 - RNA, 21 nt, Human
aauacagcagcaagaaaaaaa

SEQ ID NO: 2780208 - RNA, 12 nt, Human
aauacagauaac

SEQ ID NO: 2780209 - RNA, 17 nt, Human
aauacagauaacauuag

SEQ ID NO: 2780210 - RNA, 16 nt, Human
aauaccaaguauuuau

SEQ ID NO: 2780211 - RNA, 16 nt, Human
aauacauuuaaaacuu

SEQ ID NO: 2780212 - RNA, 17 nt, Human
aauacauuuaaaacuua

SEQ ID NO: 2780213 - RNA, 22 nt, Human
aauagagcaaaauugauguguu

SEQ ID NO: 2780214 - RNA, 20 nt, Human
aauagagcaaaauugaugug

SEQ ID NO: 2780215 - RNA, 23 nt, Human
aauagaguguaguuuacagaaaa

SEQ ID NO: 2780216 - RNA, 18 nt, Human
aauagaguauaugcacuu

SEQ ID NO: 2780217 - RNA, 15 nt, Human
aauagaguauaugca

SEQ ID NO: 2780218 - RNA, 19 nt, Human
aauagagcuguucaacauc

SEQ ID NO: 2780219 - RNA, 16 nt, Human
aauagaguauaugcac

SEQ ID NO: 2780220 - RNA, 17 nt, Human
aauagaguauaugcacu

SEQ ID NO: 2780221 - RNA, 13 nt, Human
aauagcaacuuuu

SEQ ID NO: 2780222 - RNA, 19 nt, Human
aauagcaacuuuuguguaa

SEQ ID NO: 2780223 - RNA, 16 nt, Human
aauagcaauagcaugg

SEQ ID NO: 2780224 - RNA, 15 nt, Human
aauagcaacuuuugu

SEQ ID NO: 2780225 - RNA, 17 nt, Human
aauagcaacuuuugugu

SEQ ID NO: 2780226 - RNA, 12 nt, Human
aauagcaucugu

SEQ ID NO: 2780227 - RNA, 16 nt, Human
aauagcaucuguacaa

SEQ ID NO: 2780228 - RNA, 19 nt, Human
aauagcaucuguacaaagg

SEQ ID NO: 2780229 - RNA, 20 nt, Human
aauagcaucuguacaaaggg

SEQ ID NO: 2780230 - RNA, 18 nt, Human
aauagacccacaagaggc

SEQ ID NO: 2780231 - RNA, 20 nt, Human
aauaccauuuuuuaaggaaa

SEQ ID NO: 2780232 - RNA, 22 nt, Human
aauaccauuuuuuaaggaaaca

SEQ ID NO: 2780233 - RNA, 23 nt, Human
aauaccauuuuuuaaggaaacaa

SEQ ID NO: 2780234 - RNA, 14 nt, Human
aauacccuucuuuu

SEQ ID NO: 2780235 - RNA, 15 nt, Human
aauaccucaauguuu

SEQ ID NO: 2780236 - RNA, 17 nt, Human
aauaccucaauguuuga

SEQ ID NO: 2780237 - RNA, 16 nt, Human
aauaccucaggaaaga

SEQ ID NO: 2780238 - RNA, 15 nt, Human
aauaccucaugcuuc

SEQ ID NO: 2780239 - RNA, 14 nt, Human
aauaccucauguuu

SEQ ID NO: 2780240 - RNA, 15 nt, Human
aauaccucauguuua

SEQ ID NO: 2780241 - RNA, 19 nt, Human
aauaccucauguuuaugaa

SEQ ID NO: 2780242 - RNA, 21 nt, Human
aauaccucauguuuaugaaaa

SEQ ID NO: 2780243 - RNA, 22 nt, Human
aauaccucauguuuaugaaaau

SEQ ID NO: 2780244 - RNA, 23 nt, Human
aauaccucauguuuaugaaaaua

SEQ ID NO: 2780245 - RNA, 13 nt, Human
aauaccaggauuu

SEQ ID NO: 2780246 - RNA, 16 nt, Human
aauaccagacugcagg

SEQ ID NO: 2780247 - RNA, 15 nt, Human
aauaccauuaaaacu

SEQ ID NO: 2780248 - RNA, 18 nt, Human
aauaccauuaaaacugcu

SEQ ID NO: 2780249 - RNA, 20 nt, Human
aauaccauuaaaacugcuuu

SEQ ID NO: 2780250 - RNA, 21 nt, Human
aauaccauuaaaacugcuuuu

SEQ ID NO: 2780251 - RNA, 16 nt, Human
aauaccauugacacau

SEQ ID NO: 2780252 - RNA, 14 nt, Human
aauaccucugugug

SEQ ID NO: 2780253 - RNA, 13 nt, Human
aauaccucugugu

SEQ ID NO: 2780254 - RNA, 15 nt, Human
aauaccucugugugc

SEQ ID NO: 2780255 - RNA, 16 nt, Human
aauaccucugugugcu

SEQ ID NO: 2780256 - RNA, 16 nt, Human
aauagcuaauaauguu

SEQ ID NO: 2780257 - RNA, 18 nt, Human
aauagcuaauaauguuaa

SEQ ID NO: 2780258 - RNA, 14 nt, Human
aauagccuguggcc

SEQ ID NO: 2780259 - RNA, 22 nt, Human
aauagcgcuguuuuuguugugu

SEQ ID NO: 2780260 - RNA, 14 nt, Human
aauagucuguguga

SEQ ID NO: 2780261 - RNA, 13 nt, Human
aauagucugugug

SEQ ID NO: 2780262 - RNA, 16 nt, Human
aauagucauuccaaau

SEQ ID NO: 2780263 - RNA, 18 nt, Human
aauagucauuccaaauau

SEQ ID NO: 2780264 - RNA, 15 nt, Human
aauagucugugugaa

SEQ ID NO: 2780265 - RNA, 19 nt, Human
aauagugcagaaucucaua

SEQ ID NO: 2780266 - RNA, 21 nt, Human
aauaguucagguaacaggcag

SEQ ID NO: 2780267 - RNA, 21 nt, Human
aauaguuaagacaugauuucc

SEQ ID NO: 2780268 - RNA, 23 nt, Human
aauaguuaagacaugauuuccuu

SEQ ID NO: 2780269 - RNA, 22 nt, Human
aauaguuaagacaugauuuccu

SEQ ID NO: 2780270 - RNA, 14 nt, Human
aauauauuuaauga

SEQ ID NO: 2780271 - RNA, 12 nt, Human
aauaguucaagg

SEQ ID NO: 2780272 - RNA, 23 nt, Human
aauauauuccugagauuuccucc

SEQ ID NO: 2780273 - RNA, 13 nt, Human
aauauauuguuaa

SEQ ID NO: 2780274 - RNA, 17 nt, Human
uaacgcccuauuuuugc

SEQ ID NO: 2780275 - RNA, 20 nt, Human
uaacgcccuauuuuugcaau

SEQ ID NO: 2780276 - RNA, 23 nt, Human
uaacgcaauaaacgcauuaucag

SEQ ID NO: 2780277 - RNA, 21 nt, Human
uaacaguccuaacugguauag

SEQ ID NO: 2780278 - RNA, 15 nt, Human
uaacaguaacgcagg

SEQ ID NO: 2780279 - RNA, 23 nt, Human
uaacaguccccguggccaucccu

SEQ ID NO: 2780280 - RNA, 14 nt, Human
uaacagguauuuug

SEQ ID NO: 2780281 - RNA, 19 nt, Human
uaacagguauuuuguuucu

SEQ ID NO: 2780282 - RNA, 20 nt, Human
uaacagguauuuuguuucuu

SEQ ID NO: 2780283 - RNA, 23 nt, Human
uaacagguauuuuguuucuuuua

SEQ ID NO: 2780284 - RNA, 22 nt, Human
uaacaggucuagaaaaccagcu

SEQ ID NO: 2780285 - RNA, 19 nt, Human
aauauauuuauuuaaagca

SEQ ID NO: 2780286 - RNA, 20 nt, Human
aauauauuuauuuaaagcau

SEQ ID NO: 2780287 - RNA, 14 nt, Human
aauauauuuuuaga

SEQ ID NO: 2780288 - RNA, 16 nt, Human
aauauauuuuaccaua

SEQ ID NO: 2780289 - RNA, 14 nt, Human
aauaucaaaugcag

SEQ ID NO: 2780290 - RNA, 20 nt, Human
aauaucaaaugcaguauauu

SEQ ID NO: 2780291 - RNA, 21 nt, Human
aauaucaaaugcaguauauuu

SEQ ID NO: 2780292 - RNA, 22 nt, Human
aauaucaaaugcaguauauuuc

SEQ ID NO: 2780293 - RNA, 19 nt, Human
aauauauuuuuauauuuag

SEQ ID NO: 2780294 - RNA, 20 nt, Human
aauauauuuuuauauuuagu

SEQ ID NO: 2780295 - RNA, 18 nt, Human
aauauauuuuuagacuca

SEQ ID NO: 2780296 - RNA, 15 nt, Human
aauauauuuuuauau

SEQ ID NO: 2780297 - RNA, 15 nt, Human
aauauauuuuuagac

SEQ ID NO: 2780298 - RNA, 14 nt, Human
uaacuuccuguacu

SEQ ID NO: 2780299 - RNA, 22 nt, Human
uaacguguaucuuuaagaaaaa

SEQ ID NO: 2780300 - RNA, 17 nt, Human
uaacuucuuauggaauu

SEQ ID NO: 2780301 - RNA, 18 nt, Human
uaacuucuuaaaaguugu

SEQ ID NO: 2780302 - RNA, 15 nt, Human
uaacuuggcuuucau

SEQ ID NO: 2780303 - RNA, 19 nt, Human
uaacuucuuauggaauuga

SEQ ID NO: 2780304 - RNA, 18 nt, Human
uaacuucuuauggaauug

SEQ ID NO: 2780305 - RNA, 13 nt, Human
uaagaagcuguug

SEQ ID NO: 2780306 - RNA, 15 nt, Human
uaagaagcuguugua

SEQ ID NO: 2780307 - RNA, 18 nt, Human
uaagaagcuguuguacau

SEQ ID NO: 2780308 - RNA, 19 nt, Human
uaagaagcuguuguacauu

SEQ ID NO: 2780309 - RNA, 17 nt, Human
uaagaaggcaaaaaugu

SEQ ID NO: 2780310 - RNA, 13 nt, Human
uaagaaggcaaaa

SEQ ID NO: 2780311 - RNA, 22 nt, Human
uaagaagcuguuguacauuuau

SEQ ID NO: 2780312 - RNA, 14 nt, Human
uaagaagcuucuaa

SEQ ID NO: 2780313 - RNA, 16 nt, Human
uaagaagcuucuaaua

SEQ ID NO: 2780314 - RNA, 19 nt, Human
uaagaagcuucuaauaaau

SEQ ID NO: 2780315 - RNA, 20 nt, Human
uaagaagcuucuaauaaauu

SEQ ID NO: 2780316 - RNA, 22 nt, Human
uaagaagcuucuaauaaauuau

SEQ ID NO: 2780317 - RNA, 21 nt, Human
uaagaagcuguuguacauuua

SEQ ID NO: 2780318 - RNA, 18 nt, Human
uaagaaggcaaaaaugua

SEQ ID NO: 2780319 - RNA, 14 nt, Human
uaagaauucaaacu

SEQ ID NO: 2780320 - RNA, 18 nt, Human
uaagaauucaaacugggg

SEQ ID NO: 2780321 - RNA, 20 nt, Human
uaagacgguuaaauacugug

SEQ ID NO: 2780322 - RNA, 13 nt, Human
uaagaauugacca

SEQ ID NO: 2780323 - RNA, 19 nt, Human
uaagaauugaccaucugcu

SEQ ID NO: 2780324 - RNA, 22 nt, Human
uaagaauugaccaucugcuuuu

SEQ ID NO: 2780325 - RNA, 22 nt, Human
uaagaauucaaacuggggccuc

SEQ ID NO: 2780326 - RNA, 15 nt, Human
uaacguaaauacaca

SEQ ID NO: 2780327 - RNA, 23 nt, Human
uaacggucuguucuguuucaagg

SEQ ID NO: 2780328 - RNA, 22 nt, Human
uaacggucuguucuguuucaag

SEQ ID NO: 2780329 - RNA, 16 nt, Human
uaacguugagccccug

SEQ ID NO: 2780330 - RNA, 20 nt, Human
uaacguuuuuccuuuaaaaa

SEQ ID NO: 2780331 - RNA, 18 nt, Human
uaacguuuuuccuuuaaa

SEQ ID NO: 2780332 - RNA, 19 nt, Human
uaacguuuuuccuuuaaaa

SEQ ID NO: 2780333 - RNA, 15 nt, Human
uaacguuuuuccuuu

SEQ ID NO: 2780334 - RNA, 14 nt, Human
uaacuuauauugaa

SEQ ID NO: 2780335 - RNA, 16 nt, Human
uaacuuauauugaaga

SEQ ID NO: 2780336 - RNA, 15 nt, Human
uaacuuauguagaua

SEQ ID NO: 2780337 - RNA, 17 nt, Human
uaacuuauguagauauu

SEQ ID NO: 2780338 - RNA, 19 nt, Human
uaacuuauguagauauuug

SEQ ID NO: 2780339 - RNA, 21 nt, Human
uaacuuauguagauauuuggc

SEQ ID NO: 2780340 - RNA, 22 nt, Human
uaacuuauguagauauuuggcu

SEQ ID NO: 2780341 - RNA, 14 nt, Human
uaacuuauugcuga

SEQ ID NO: 2780342 - RNA, 19 nt, Human
uaacuuauugcugauuuua

SEQ ID NO: 2780343 - RNA, 22 nt, Human
uaacuuauugcugauuuuaaug

SEQ ID NO: 2780344 - RNA, 23 nt, Human
uaacuuauugcugauuuuaaugg

SEQ ID NO: 2780345 - RNA, 15 nt, Human
uaacuuauuuagaga

SEQ ID NO: 2780346 - RNA, 16 nt, Human
uaacuuauuuagagau

SEQ ID NO: 2780347 - RNA, 21 nt, Human
uaacuuauuuauguuaaaaga

SEQ ID NO: 2780348 - RNA, 23 nt, Human
uaacuuauuuauguuaaaagauu

SEQ ID NO: 2780349 - RNA, 15 nt, Human
uaacuaggcucagag

SEQ ID NO: 2780350 - RNA, 17 nt, Human
uaacuaguccuuuacua

SEQ ID NO: 2780351 - RNA, 13 nt, Human
uaacuaguggcuc

SEQ ID NO: 2780352 - RNA, 16 nt, Human
uaacuaggcucagaga

SEQ ID NO: 2780353 - RNA, 17 nt, Human
uaacuaguguugcuugg

SEQ ID NO: 2780354 - RNA, 17 nt, Human
uaacuauaaauauguac

SEQ ID NO: 2780355 - RNA, 18 nt, Human
uaacuauauuugcuuuuu

SEQ ID NO: 2780356 - RNA, 19 nt, Human
uaacuaggcucagagaugu

SEQ ID NO: 2780357 - RNA, 17 nt, Human
uaacuauauuugcuuuu

SEQ ID NO: 2780358 - RNA, 13 nt, Human
aaucccuguuuaa

SEQ ID NO: 2780359 - RNA, 19 nt, Human
aaucccucaccuucugagu

SEQ ID NO: 2780360 - RNA, 23 nt, Human
aaucccuagacuuuaggcuuuca

SEQ ID NO: 2780361 - RNA, 23 nt, Human
aaucccuagggcuggcagaaagg

SEQ ID NO: 2780362 - RNA, 23 nt, Human
aauccccaguucgccuggagccc

SEQ ID NO: 2780363 - RNA, 22 nt, Human
aauccccaugccuguggcugcg

SEQ ID NO: 2780364 - RNA, 13 nt, Human
aaucccccaggag

SEQ ID NO: 2780365 - RNA, 14 nt, Human
aaucccccaggaga

SEQ ID NO: 2780366 - RNA, 18 nt, Human
aaucccccuugccacccc

SEQ ID NO: 2780367 - RNA, 15 nt, Human
aaucccccuugccac

SEQ ID NO: 2780368 - RNA, 21 nt, Human
aauccccucccugucaaagcu

SEQ ID NO: 2780369 - RNA, 15 nt, Human
aauccccuuaugacu

SEQ ID NO: 2780370 - RNA, 17 nt, Human
aauccccuuaugacuug

SEQ ID NO: 2780371 - RNA, 23 nt, Human
aaucccagccggccaauggaaac

SEQ ID NO: 2780372 - RNA, 12 nt, Human
aaucccaggaug

SEQ ID NO: 2780373 - RNA, 15 nt, Human
aaucccagcacuuug

SEQ ID NO: 2780374 - RNA, 18 nt, Human
aaucccacccacauguga

SEQ ID NO: 2780375 - RNA, 14 nt, Human
aaucccacuguaug

SEQ ID NO: 2780376 - RNA, 17 nt, Human
aaucccacccacaugug

SEQ ID NO: 2780377 - RNA, 22 nt, Human
aaucagugugucuaaauuugaa

SEQ ID NO: 2780378 - RNA, 18 nt, Human
aaucagugugucuaaauu

SEQ ID NO: 2780379 - RNA, 17 nt, Human
aaucagugugucuaaau

SEQ ID NO: 2780380 - RNA, 14 nt, Human
aaucagugugucua

SEQ ID NO: 2780381 - RNA, 15 nt, Human
aaucaguuaguuuuu

SEQ ID NO: 2780382 - RNA, 21 nt, Human
aaucccaaauuugauugauuu

SEQ ID NO: 2780383 - RNA, 11 nt, Human
aaucuauuuaa

SEQ ID NO: 2780384 - RNA, 13 nt, Human
aaucuauucugug

SEQ ID NO: 2780385 - RNA, 16 nt, Human
aaucuauucuguguug

SEQ ID NO: 2780386 - RNA, 21 nt, Human
aaucuauucuguguugcauua

SEQ ID NO: 2780387 - RNA, 16 nt, Human
aaucuauuuauuaaua

SEQ ID NO: 2780388 - RNA, 12 nt, Human
aaucuauuuaag

SEQ ID NO: 2780389 - RNA, 20 nt, Human
aaucuauuuaauuaggaaaa

SEQ ID NO: 2780390 - RNA, 17 nt, Human
aaucuauuuauuaauau

SEQ ID NO: 2780391 - RNA, 18 nt, Human
aaucuauuuauuaauauu

SEQ ID NO: 2780392 - RNA, 20 nt, Human
aaucuauuuauuaauauuua

SEQ ID NO: 2780393 - RNA, 21 nt, Human
aaucuauuuauuaauauuuaa

SEQ ID NO: 2780394 - RNA, 13 nt, Human
aaucuauuuucua

SEQ ID NO: 2780395 - RNA, 17 nt, Human
aaucuauuuucuaugua

SEQ ID NO: 2780396 - RNA, 19 nt, Human
aaucuauuuucuauguacu

SEQ ID NO: 2780397 - RNA, 20 nt, Human
aaucuauuuucuauguacua

SEQ ID NO: 2780398 - RNA, 21 nt, Human
aaucuauuuucuauguacuag

SEQ ID NO: 2780399 - RNA, 17 nt, Human
aaucuauuucacuuauu

SEQ ID NO: 2780400 - RNA, 23 nt, Human
aaucuauuucacuuauuuuggcu

SEQ ID NO: 2780401 - RNA, 18 nt, Human
aaucugggccagaauuuc

SEQ ID NO: 2780402 - RNA, 14 nt, Human
aaucccuguuuaau

SEQ ID NO: 2780403 - RNA, 9 nt, Human
aauccuccu

SEQ ID NO: 2780404 - RNA, 11 nt, Human
aauccuccucc

SEQ ID NO: 2780405 - RNA, 13 nt, Human
aauccuccuccag

SEQ ID NO: 2780406 - RNA, 20 nt, Human
aauccucucaccucagccuc

SEQ ID NO: 2780407 - RNA, 13 nt, Human
aauccuggcagcc

SEQ ID NO: 2780408 - RNA, 12 nt, Human
aauccuggcagc

SEQ ID NO: 2780409 - RNA, 14 nt, Human
aauccugcaaugaa

SEQ ID NO: 2780410 - RNA, 17 nt, Human
aauccugcaaugaaagg

SEQ ID NO: 2780411 - RNA, 16 nt, Human
aauccugccauuuaaa

SEQ ID NO: 2780412 - RNA, 14 nt, Human
aaucuaaaucuauu

SEQ ID NO: 2780413 - RNA, 15 nt, Human
aaucuaaaucuauuu

SEQ ID NO: 2780414 - RNA, 14 nt, Human
aaucuaaagccagu

SEQ ID NO: 2780415 - RNA, 21 nt, Human
aaucuauccaaaucugaagau

SEQ ID NO: 2780416 - RNA, 19 nt, Human
aaucuaaaucuauuuauua

SEQ ID NO: 2780417 - RNA, 16 nt, Human
aaucuaaaucuauuua

SEQ ID NO: 2780418 - RNA, 17 nt, Human
aaucuaaaucuauuuau

SEQ ID NO: 2780419 - RNA, 12 nt, Human
uaaguaauuaug

SEQ ID NO: 2780420 - RNA, 15 nt, Human
uaaguaauguggaag

SEQ ID NO: 2780421 - RNA, 22 nt, Human
uaaguaauguggaagaaaaugg

SEQ ID NO: 2780422 - RNA, 19 nt, Human
uaagguuucguuucuguau

SEQ ID NO: 2780423 - RNA, 20 nt, Human
uaagguuucguuucuguaua

SEQ ID NO: 2780424 - RNA, 22 nt, Human
uaagguuucguuucuguauaca

SEQ ID NO: 2780425 - RNA, 16 nt, Human
uaaguaauucaagaaa

SEQ ID NO: 2780426 - RNA, 18 nt, Human
uaaguacacaauaagcaa

SEQ ID NO: 2780427 - RNA, 17 nt, Human
uaaguaccacucaggcc

SEQ ID NO: 2780428 - RNA, 15 nt, Human
uaagguucuaaggcc

SEQ ID NO: 2780429 - RNA, 17 nt, Human
uaaggauacuuuacaug

SEQ ID NO: 2780430 - RNA, 20 nt, Human
uaaggaggggaaaaaaaugu

SEQ ID NO: 2780431 - RNA, 22 nt, Human
uaaggaggggaaaaaaauguug

SEQ ID NO: 2780432 - RNA, 21 nt, Human
uaaguuucuaagauucuaaag

SEQ ID NO: 2780433 - RNA, 23 nt, Human
uaaguuucuaagauucuaaaggu

SEQ ID NO: 2780434 - RNA, 21 nt, Human
uaauaaaaaauggaaagaauc

SEQ ID NO: 2780435 - RNA, 15 nt, Human
uaauaaaaaauuaug

SEQ ID NO: 2780436 - RNA, 14 nt, Human
uaauaaaaaaugga

SEQ ID NO: 2780437 - RNA, 15 nt, Human
uaauaaaaaauggaa

SEQ ID NO: 2780438 - RNA, 19 nt, Human
uaauaaaaaauggaaagaa

SEQ ID NO: 2780439 - RNA, 20 nt, Human
uaauaaaaaauggaaagaau

SEQ ID NO: 2780440 - RNA, 19 nt, Human
uaauaaaaagcuuuuuccu

SEQ ID NO: 2780441 - RNA, 23 nt, Human
uaauaaaaagcuuuuuccuccug

SEQ ID NO: 2780442 - RNA, 14 nt, Human
uaaggagaauggcc

SEQ ID NO: 2780443 - RNA, 14 nt, Human
uaaguuauaagacu

SEQ ID NO: 2780444 - RNA, 20 nt, Human
uaaguuucaaacuuacuauu

SEQ ID NO: 2780445 - RNA, 23 nt, Human
uaaguuucaaacuuacuauuuug

SEQ ID NO: 2780446 - RNA, 16 nt, Human
uaaguuucaggugaca

SEQ ID NO: 2780447 - RNA, 17 nt, Human
uaaguuucaggugacau

SEQ ID NO: 2780448 - RNA, 18 nt, Human
uaaguuucaggugacaug

SEQ ID NO: 2780449 - RNA, 19 nt, Human
uaaguuucaggugacaugu

SEQ ID NO: 2780450 - RNA, 20 nt, Human
uaaguuucaggugacaugug

SEQ ID NO: 2780451 - RNA, 22 nt, Human
uaaguuucaggugacaugugaa

SEQ ID NO: 2780452 - RNA, 12 nt, Human
uaaguuucuaag

SEQ ID NO: 2780453 - RNA, 13 nt, Human
uaaguuucuaaga

SEQ ID NO: 2780454 - RNA, 14 nt, Human
uaaguuucuaagau

SEQ ID NO: 2780455 - RNA, 15 nt, Human
uaaguuucuaagauu

SEQ ID NO: 2780456 - RNA, 16 nt, Human
uaaguuucuaagauuc

SEQ ID NO: 2780457 - RNA, 17 nt, Human
uaaguuucuaagauucu

SEQ ID NO: 2780458 - RNA, 18 nt, Human
uaaguuucuaagauucua

SEQ ID NO: 2780459 - RNA, 19 nt, Human
uaaguuucuaagauucuaa

SEQ ID NO: 2780460 - RNA, 20 nt, Human
uaaguuucuaagauucuaaa

SEQ ID NO: 2780461 - RNA, 12 nt, Human
uaaguauuuagg

SEQ ID NO: 2780462 - RNA, 14 nt, Human
uaaguauuuauaau

SEQ ID NO: 2780463 - RNA, 20 nt, Human
uaaguauuuagguuuuuguu

SEQ ID NO: 2780464 - RNA, 14 nt, Human
uaaguauuuauaua

SEQ ID NO: 2780465 - RNA, 13 nt, Human
uaaguauuuauau

SEQ ID NO: 2780466 - RNA, 19 nt, Human
uaaguauuuauauauuuau

SEQ ID NO: 2780467 - RNA, 18 nt, Human
uaaguauuuauauauuua

SEQ ID NO: 2780468 - RNA, 17 nt, Human
uaaguauuuauauauuu

SEQ ID NO: 2780469 - RNA, 15 nt, Human
uaaguauuuauauau

SEQ ID NO: 2780470 - RNA, 23 nt, Human
uaaguauuuauauauuuauaacu

SEQ ID NO: 2780471 - RNA, 16 nt, Human
uaaguuaauaagcaaa

SEQ ID NO: 2780472 - RNA, 15 nt, Human
uaagauuauagauuc

SEQ ID NO: 2780473 - RNA, 16 nt, Human
uaagauuauagauucu

SEQ ID NO: 2780474 - RNA, 17 nt, Human
uaagauuauagauucua

SEQ ID NO: 2780475 - RNA, 18 nt, Human
uaagauuauagauucuaa

SEQ ID NO: 2780476 - RNA, 18 nt, Human
aaucagugggcaggauaa

SEQ ID NO: 2780477 - RNA, 19 nt, Human
aaucagugggcaggauaaa

SEQ ID NO: 2780478 - RNA, 24 nt, Human
aaucagugggcaggauaaacugaa

SEQ ID NO: 2780479 - RNA, 22 nt, Human
uaagcagauggaaugcuguguu

SEQ ID NO: 2780480 - RNA, 19 nt, Human
uaagauuauagauucuaaa

SEQ ID NO: 2780481 - RNA, 20 nt, Human
uaagauuauagauucuaaag

SEQ ID NO: 2780482 - RNA, 21 nt, Human
uaagauuauagauucuaaaga

SEQ ID NO: 2780483 - RNA, 22 nt, Human
uaagauuauagauucuaaagau

SEQ ID NO: 2780484 - RNA, 15 nt, Human
uaagcaaaagaaaaa

SEQ ID NO: 2780485 - RNA, 23 nt, Human
uaagauuauagauucuaaagauu

SEQ ID NO: 2780486 - RNA, 16 nt, Human
uaagcagcuaaauuuu

SEQ ID NO: 2780487 - RNA, 17 nt, Human
uaagcagcuaaauuuuc

SEQ ID NO: 2780488 - RNA, 22 nt, Human
uaagcagcuaaauuuucugaaa

SEQ ID NO: 2780489 - RNA, 21 nt, Human
uaagcaggagagaaauuucuc

SEQ ID NO: 2780490 - RNA, 11 nt, Human
uaaggaaacaa

SEQ ID NO: 2780491 - RNA, 10 nt, Human
uaaggaaacu

SEQ ID NO: 2780492 - RNA, 15 nt, Human
uaaggaaacucuuau

SEQ ID NO: 2780493 - RNA, 17 nt, Human
uaaggaaacucuuaucu

SEQ ID NO: 2780494 - RNA, 19 nt, Human
uaaggaaacucuuaucuca

SEQ ID NO: 2780495 - RNA, 20 nt, Human
uaaggaaacucuuaucucag

SEQ ID NO: 2780496 - RNA, 14 nt, Human
uaaggaagaaacag

SEQ ID NO: 2780497 - RNA, 19 nt, Human
uaaggaaccuuccuuccug

SEQ ID NO: 2780498 - RNA, 15 nt, Human
uaaggaaccuuccuu

SEQ ID NO: 2780499 - RNA, 21 nt, Human
uaaggaccguggcccugcccu

SEQ ID NO: 2780500 - RNA, 23 nt, Human
uaaggaccguggcccugcccucu

SEQ ID NO: 2780501 - RNA, 19 nt, Human
uaaggacaugaugcuuuua

SEQ ID NO: 2780502 - RNA, 15 nt, Human
uaaggaccugaaauu

SEQ ID NO: 2780503 - RNA, 21 nt, Human
uaaggaccugaaauuccaaag

SEQ ID NO: 2780504 - RNA, 22 nt, Human
uaaggaccugaaauuccaaagu

SEQ ID NO: 2780505 - RNA, 12 nt, Human
uaagcagucccu

SEQ ID NO: 2780506 - RNA, 15 nt, Human
uaaggaagauaucua

SEQ ID NO: 2780507 - RNA, 16 nt, Human
aaucagccucuuaaag

SEQ ID NO: 2780508 - RNA, 12 nt, Human
aaucagccucuu

SEQ ID NO: 2780509 - RNA, 13 nt, Human
aaucagccagaca

SEQ ID NO: 2780510 - RNA, 18 nt, Human
aaucacucuguccuugga

SEQ ID NO: 2780511 - RNA, 12 nt, Human
aaucagcauucu

SEQ ID NO: 2780512 - RNA, 19 nt, Human
aaucagcauucucacuccu

SEQ ID NO: 2780513 - RNA, 18 nt, Human
aaucagcauucucacucc

SEQ ID NO: 2780514 - RNA, 23 nt, Human
aaucagcuauuuacugccaaagg

SEQ ID NO: 2780515 - RNA, 21 nt, Human
aaucaguaauauuuauauauu

SEQ ID NO: 2780516 - RNA, 19 nt, Human
aaucagucagugcaaaugu

SEQ ID NO: 2780517 - RNA, 21 nt, Human
aaucagucagugcaaauguca

SEQ ID NO: 2780518 - RNA, 13 nt, Human
aauauuuauuuau

SEQ ID NO: 2780519 - RNA, 15 nt, Human
aauauuuucuggguu

SEQ ID NO: 2780520 - RNA, 11 nt, Human
aauauuuauuu

SEQ ID NO: 2780521 - RNA, 14 nt, Human
aauauuuugauaau

SEQ ID NO: 2780522 - RNA, 15 nt, Human
aauauuuugauaaua

SEQ ID NO: 2780523 - RNA, 16 nt, Human
aauauuuugauaauaa

SEQ ID NO: 2780524 - RNA, 20 nt, Human
aauauuuugauaauaaauug

SEQ ID NO: 2780525 - RNA, 18 nt, Human
aauauuuugauaauaaua

SEQ ID NO: 2780526 - RNA, 12 nt, Human
aauauuuauuaa

SEQ ID NO: 2780527 - RNA, 23 nt, Human
aauauuuaugucuauuuaagccu

SEQ ID NO: 2780528 - RNA, 11 nt, Human
aauauuuauua

SEQ ID NO: 2780529 - RNA, 21 nt, Human
aauauuuaugucuauuuaagc

SEQ ID NO: 2780530 - RNA, 17 nt, Human
aauauuuauuaaauaaa

SEQ ID NO: 2780531 - RNA, 18 nt, Human
aauauuuauuaaauaaaa

SEQ ID NO: 2780532 - RNA, 21 nt, Human
aauauuuauuaaauaaaauca

SEQ ID NO: 2780533 - RNA, 22 nt, Human
aauauuuauuaaauaaaaucaa

SEQ ID NO: 2780534 - RNA, 19 nt, Human
aauauuuaugucuauuuaa

SEQ ID NO: 2780535 - RNA, 12 nt, Human
aauauuuaugga

SEQ ID NO: 2780536 - RNA, 13 nt, Human
aauauuuauggau

SEQ ID NO: 2780537 - RNA, 19 nt, Human
aauauuuauggaugcaaca

SEQ ID NO: 2780538 - RNA, 15 nt, Human
aauauuuauagguca

SEQ ID NO: 2780539 - RNA, 17 nt, Human
aauauuuauauauuuau

SEQ ID NO: 2780540 - RNA, 14 nt, Human
aauauuuauauauu

SEQ ID NO: 2780541 - RNA, 17 nt, Human
uaagacuuacucuaaga

SEQ ID NO: 2780542 - RNA, 18 nt, Human
uaagacuuacucuaagau

SEQ ID NO: 2780543 - RNA, 15 nt, Human
uaagacguguuugug

SEQ ID NO: 2780544 - RNA, 14 nt, Human
uaagacgacaagga

SEQ ID NO: 2780545 - RNA, 15 nt, Human
uaagacucaaauguu

SEQ ID NO: 2780546 - RNA, 18 nt, Human
uaagacucaaauguucua

SEQ ID NO: 2780547 - RNA, 19 nt, Human
uaagacucaaauguucuaa

SEQ ID NO: 2780548 - RNA, 16 nt, Human
uaagacucucacacuc

SEQ ID NO: 2780549 - RNA, 18 nt, Human
uaagacucauucccuaga

SEQ ID NO: 2780550 - RNA, 21 nt, Human
uaagacucaaauguucuaagu

SEQ ID NO: 2780551 - RNA, 22 nt, Human
uaagacucaaauguucuaaguu

SEQ ID NO: 2780552 - RNA, 21 nt, Human
uacaaugaacacuuauaagug

SEQ ID NO: 2780553 - RNA, 15 nt, Human
uacaaugaacacuua

SEQ ID NO: 2780554 - RNA, 22 nt, Human
uaauuuuuuuuuuccuuuuaaa

SEQ ID NO: 2780555 - RNA, 18 nt, Human
uaauuuuuuugagacaga

SEQ ID NO: 2780556 - RNA, 16 nt, Human
uaauuuuuuuuaguau

SEQ ID NO: 2780557 - RNA, 18 nt, Human
uaauuuuuuuuucauaga

SEQ ID NO: 2780558 - RNA, 21 nt, Human
uaauuuuuuucaccuagauuu

SEQ ID NO: 2780559 - RNA, 22 nt, Human
uaauuuuucagcucucuguaua

SEQ ID NO: 2780560 - RNA, 15 nt, Human
uaauuuuuguauuuu

SEQ ID NO: 2780561 - RNA, 14 nt, Human
uaauuuuuguaauu

SEQ ID NO: 2780562 - RNA, 18 nt, Human
uacaauucuacauuguca

SEQ ID NO: 2780563 - RNA, 22 nt, Human
uacaauuaaaaaaaaagaucug

SEQ ID NO: 2780564 - RNA, 21 nt, Human
uacaauuaauaguuugucuau

SEQ ID NO: 2780565 - RNA, 22 nt, Human
uacaauuaauaguuugucuauu

SEQ ID NO: 2780566 - RNA, 13 nt, Human
uacaauguguuuu

SEQ ID NO: 2780567 - RNA, 17 nt, Human
uacaauguguuuuucuc

SEQ ID NO: 2780568 - RNA, 19 nt, Human
uacaauguguuuuucucca

SEQ ID NO: 2780569 - RNA, 20 nt, Human
uacaauguguuuuucuccag

SEQ ID NO: 2780570 - RNA, 21 nt, Human
uacaauguguuuuucuccagu

SEQ ID NO: 2780571 - RNA, 18 nt, Human
uacaauuaaaaaaaaaga

SEQ ID NO: 2780572 - RNA, 13 nt, Human
aauggaagacaca

SEQ ID NO: 2780573 - RNA, 22 nt, Human
aaugcuggcuguuggcuggggg

SEQ ID NO: 2780574 - RNA, 18 nt, Human
aaugcauguuaggaaaau

SEQ ID NO: 2780575 - RNA, 13 nt, Human
aaugcauuaaacc

SEQ ID NO: 2780576 - RNA, 15 nt, Human
aaugcauuaaaccug

SEQ ID NO: 2780577 - RNA, 18 nt, Human
aaugcauuaaaccugucu

SEQ ID NO: 2780578 - RNA, 21 nt, Human
aaugcuggcuguuggcugggg

SEQ ID NO: 2780579 - RNA, 21 nt, Human
aaugcaugaacaaguuuuaau

SEQ ID NO: 2780580 - RNA, 13 nt, Human
aaugcaugaguaa

SEQ ID NO: 2780581 - RNA, 18 nt, Human
aaugcaugaguaaaaaaa

SEQ ID NO: 2780582 - RNA, 15 nt, Human
aaugcaucagguccu

SEQ ID NO: 2780583 - RNA, 21 nt, Human
aaugcauccagcaguacaaua

SEQ ID NO: 2780584 - RNA, 12 nt, Human
aauguaaauauu

SEQ ID NO: 2780585 - RNA, 12 nt, Human
aauguaaauaaa

SEQ ID NO: 2780586 - RNA, 18 nt, Human
aauguaaauauucuauau

SEQ ID NO: 2780587 - RNA, 17 nt, Human
aauguaaaauguugaau

SEQ ID NO: 2780588 - RNA, 13 nt, Human
aauguaaacauuu

SEQ ID NO: 2780589 - RNA, 14 nt, Human
aauguaaacauuuu

SEQ ID NO: 2780590 - RNA, 14 nt, Human
aauguaaacugcca

SEQ ID NO: 2780591 - RNA, 15 nt, Human
aauguaaacugccau

SEQ ID NO: 2780592 - RNA, 16 nt, Human
aauguaaacugccaua

SEQ ID NO: 2780593 - RNA, 16 nt, Human
aaugguuuguccugau

SEQ ID NO: 2780594 - RNA, 15 nt, Human
aauguaaagauuugc

SEQ ID NO: 2780595 - RNA, 23 nt, Human
aauguaaaggagucaaaacuaca

SEQ ID NO: 2780596 - RNA, 21 nt, Human
aauguaaaggagucaaaacua

SEQ ID NO: 2780597 - RNA, 20 nt, Human
aauguaaaggagucaaaacu

SEQ ID NO: 2780598 - RNA, 19 nt, Human
aauggagucaguuugcagu

SEQ ID NO: 2780599 - RNA, 14 nt, Human
aauggaagacacau

SEQ ID NO: 2780600 - RNA, 16 nt, Human
aauggauuggauuauu

SEQ ID NO: 2780601 - RNA, 18 nt, Human
aauggauuggauuauuua

SEQ ID NO: 2780602 - RNA, 20 nt, Human
aauggauuggauuauuuaau

SEQ ID NO: 2780603 - RNA, 17 nt, Human
aauggaugccuugaaua

SEQ ID NO: 2780604 - RNA, 22 nt, Human
aauggaugccuugaauaauaag

SEQ ID NO: 2780605 - RNA, 14 nt, Human
aauggauucuauuu

SEQ ID NO: 2780606 - RNA, 19 nt, Human
aauggauacuacaucuuua

SEQ ID NO: 2780607 - RNA, 14 nt, Human
aauggauagcucau

SEQ ID NO: 2780608 - RNA, 14 nt, Human
aauggauauuauua

SEQ ID NO: 2780609 - RNA, 17 nt, Human
aauggauauuauuagaa

SEQ ID NO: 2780610 - RNA, 19 nt, Human
aauggauauuauuagaaau

SEQ ID NO: 2780611 - RNA, 22 nt, Human
aauggauauuuguacuguuuaa

SEQ ID NO: 2780612 - RNA, 15 nt, Human
uacaccuaaaggugu

SEQ ID NO: 2780613 - RNA, 23 nt, Human
uacaccuaaagguguauuuaaac

SEQ ID NO: 2780614 - RNA, 13 nt, Human
aauguaauuguaa

SEQ ID NO: 2780615 - RNA, 15 nt, Human
aauguaauuguaauu

SEQ ID NO: 2780616 - RNA, 23 nt, Human
aauguaauuguaauuuugaaaug

SEQ ID NO: 2780617 - RNA, 13 nt, Human
aauguaaugcgau

SEQ ID NO: 2780618 - RNA, 16 nt, Human
uacaccgacuagccag

SEQ ID NO: 2780619 - RNA, 17 nt, Human
uacaccgacuagccagg

SEQ ID NO: 2780620 - RNA, 22 nt, Human
uacacccccucuucugagcaca

SEQ ID NO: 2780621 - RNA, 20 nt, Human
uacacccccucuucugagca

SEQ ID NO: 2780622 - RNA, 14 nt, Human
uacacccaaagagg

SEQ ID NO: 2780623 - RNA, 14 nt, Human
uacacccagacccc

SEQ ID NO: 2780624 - RNA, 15 nt, Human
uacacccagacccca

SEQ ID NO: 2780625 - RNA, 19 nt, Human
uacacccagaccccaggcu

SEQ ID NO: 2780626 - RNA, 20 nt, Human
uacacccagaccccaggcug

SEQ ID NO: 2780627 - RNA, 15 nt, Human
uacaccgggccugga

SEQ ID NO: 2780628 - RNA, 17 nt, Human
uacaccgggccuggaga

SEQ ID NO: 2780629 - RNA, 14 nt, Human
uaauuauuauuugu

SEQ ID NO: 2780630 - RNA, 17 nt, Human
uaauuauuauuuguguu

SEQ ID NO: 2780631 - RNA, 13 nt, Human
uaauuuaaagaga

SEQ ID NO: 2780632 - RNA, 14 nt, Human
uaauuuaaagagac

SEQ ID NO: 2780633 - RNA, 11 nt, Human
uaauuuaaaca

SEQ ID NO: 2780634 - RNA, 17 nt, Human
uaauuuaaacaccuccu

SEQ ID NO: 2780635 - RNA, 19 nt, Human
uaauuuaaacaccuccuca

SEQ ID NO: 2780636 - RNA, 21 nt, Human
uaauuccuauauccugugacu

SEQ ID NO: 2780637 - RNA, 13 nt, Human
uaauuccuacagc

SEQ ID NO: 2780638 - RNA, 16 nt, Human
uaauuccuacagcacu

SEQ ID NO: 2780639 - RNA, 21 nt, Human
uaauuccuacagcacuacugg

SEQ ID NO: 2780640 - RNA, 13 nt, Human
uaauuuauaaaau

SEQ ID NO: 2780641 - RNA, 21 nt, Human
uaauuuaagagcuaaccaguu

SEQ ID NO: 2780642 - RNA, 15 nt, Human
uaauuuaguuauuga

SEQ ID NO: 2780643 - RNA, 16 nt, Human
uaauuuaguuauugau

SEQ ID NO: 2780644 - RNA, 16 nt, Human
uaauuuagauuguaaa

SEQ ID NO: 2780645 - RNA, 18 nt, Human
uaauuuaggguacuaaau

SEQ ID NO: 2780646 - RNA, 19 nt, Human
uaauuuaggguacuaaauu

SEQ ID NO: 2780647 - RNA, 21 nt, Human
uaauuuaggguacuaaauuua

SEQ ID NO: 2780648 - RNA, 23 nt, Human
uaauuuaggguacuaaauuuaaa

SEQ ID NO: 2780649 - RNA, 15 nt, Human
uaauuuaguaaaugu

SEQ ID NO: 2780650 - RNA, 16 nt, Human
uaauuuaguaaauguu

SEQ ID NO: 2780651 - RNA, 17 nt, Human
uaauuuaguaaauguua

SEQ ID NO: 2780652 - RNA, 20 nt, Human
uaauuuaguaaauguuaucu

SEQ ID NO: 2780653 - RNA, 16 nt, Human
uaauuuagugaucuua

SEQ ID NO: 2780654 - RNA, 21 nt, Human
uaauuuagugaucuuagcaua

SEQ ID NO: 2780655 - RNA, 14 nt, Human
aaugauuuuuagau

SEQ ID NO: 2780656 - RNA, 16 nt, Human
aaugcacagauauacu

SEQ ID NO: 2780657 - RNA, 17 nt, Human
aaugcacagauauacuu

SEQ ID NO: 2780658 - RNA, 18 nt, Human
aaugcacagauauacuuu

SEQ ID NO: 2780659 - RNA, 19 nt, Human
aaugcaccuagcugugcaa

SEQ ID NO: 2780660 - RNA, 16 nt, Human
aaugcacauccauucc

SEQ ID NO: 2780661 - RNA, 17 nt, Human
aaugcacauccauuccc

SEQ ID NO: 2780662 - RNA, 18 nt, Human
aaugcacauccauuccca

SEQ ID NO: 2780663 - RNA, 14 nt, Human
aaugcaaaaccuuu

SEQ ID NO: 2780664 - RNA, 20 nt, Human
aaugcaaaauuuuuuuaauc

SEQ ID NO: 2780665 - RNA, 13 nt, Human
uaauuauuauuaa

SEQ ID NO: 2780666 - RNA, 19 nt, Human
uaauuauuaacuacauuua

SEQ ID NO: 2780667 - RNA, 20 nt, Human
uaauuauuaacuacauuuau

SEQ ID NO: 2780668 - RNA, 11 nt, Human
aaugcacggcc

SEQ ID NO: 2780669 - RNA, 13 nt, Human
aaugcacggccuc

SEQ ID NO: 2780670 - RNA, 13 nt, Human
aaugagcccagag

SEQ ID NO: 2780671 - RNA, 14 nt, Human
aaugagcccagaga

SEQ ID NO: 2780672 - RNA, 19 nt, Human
aaugagcccagagaacagc

SEQ ID NO: 2780673 - RNA, 23 nt, Human
aaugagcacccauuccaaagcuu

SEQ ID NO: 2780674 - RNA, 13 nt, Human
aaugagcaccucc

SEQ ID NO: 2780675 - RNA, 14 nt, Human
aaugagcaccucca

SEQ ID NO: 2780676 - RNA, 17 nt, Human
aaugagagguuccuaag

SEQ ID NO: 2780677 - RNA, 11 nt, Human
aaucuguacau

SEQ ID NO: 2780678 - RNA, 12 nt, Human
aaucuguacauu

SEQ ID NO: 2780679 - RNA, 13 nt, Human
aaucuguacauuu

SEQ ID NO: 2780680 - RNA, 14 nt, Human
aaucuguacauuuu

SEQ ID NO: 2780681 - RNA, 19 nt, Human
aaucuguacauuuuguugu

SEQ ID NO: 2780682 - RNA, 22 nt, Human
aaucuguacauuuuguuguaaa

SEQ ID NO: 2780683 - RNA, 21 nt, Human
aaucuguaacagguauuuugu

SEQ ID NO: 2780684 - RNA, 14 nt, Human
aaucuggucuuguu

SEQ ID NO: 2780685 - RNA, 19 nt, Human
aaucuggucuuguuagaaa

SEQ ID NO: 2780686 - RNA, 20 nt, Human
aaucuggucuuguuagaaaa

SEQ ID NO: 2780687 - RNA, 20 nt, Human
aaugacucagaauauugcuu

SEQ ID NO: 2780688 - RNA, 22 nt, Human
aaugacuuauuguggauaacaa

SEQ ID NO: 2780689 - RNA, 23 nt, Human
aaugacuuauuguggauaacaaa

SEQ ID NO: 2780690 - RNA, 24 nt, Human
aaugacuuauuguggauaacaaag

SEQ ID NO: 2780691 - RNA, 12 nt, Human
aaugacuacuua

SEQ ID NO: 2780692 - RNA, 14 nt, Human
aaugacuacuuagc

SEQ ID NO: 2780693 - RNA, 16 nt, Human
aaugacuaauuagggu

SEQ ID NO: 2780694 - RNA, 23 nt, Human
aaugacuaauuaggguacauuua

SEQ ID NO: 2780695 - RNA, 12 nt, Human
aaucugucaaaa

SEQ ID NO: 2780696 - RNA, 14 nt, Human
aaucugucaaaaca

SEQ ID NO: 2780697 - RNA, 16 nt, Human
aaucugucaaaacacu

SEQ ID NO: 2780698 - RNA, 17 nt, Human
aaucugucaaaacacug

SEQ ID NO: 2780699 - RNA, 18 nt, Human
aaucugucaaaacacugu

SEQ ID NO: 2780700 - RNA, 12 nt, Human
aaugauaaaaca

SEQ ID NO: 2780701 - RNA, 13 nt, Human
aaugauaaaacac

SEQ ID NO: 2780702 - RNA, 14 nt, Human
aaugauaaaacacc

SEQ ID NO: 2780703 - RNA, 14 nt, Human
aaugauuauuuuca

SEQ ID NO: 2780704 - RNA, 15 nt, Human
aaugauuauuuucau

SEQ ID NO: 2780705 - RNA, 18 nt, Human
aaugauuauuuucauuac

SEQ ID NO: 2780706 - RNA, 19 nt, Human
aaugauuauuuucauuaca

SEQ ID NO: 2780707 - RNA, 21 nt, Human
aaugauuauuuucauuacaau

SEQ ID NO: 2780708 - RNA, 23 nt, Human
aaugauuauuuucauuacaaugg

SEQ ID NO: 2780709 - RNA, 14 nt, Human
aaugagucuguugu

SEQ ID NO: 2780710 - RNA, 16 nt, Human
aaugaggucugggcua

SEQ ID NO: 2780711 - RNA, 14 nt, Human
aaugaggucuguuu

SEQ ID NO: 2780712 - RNA, 15 nt, Human
aaugaggucuguuua

SEQ ID NO: 2780713 - RNA, 16 nt, Human
aaugaggucuguuuaa

SEQ ID NO: 2780714 - RNA, 19 nt, Human
aaugagucuguuguguguc

SEQ ID NO: 2780715 - RNA, 14 nt, Human
aaugagugugaagg

SEQ ID NO: 2780716 - RNA, 13 nt, Human
aaugagugugcau

SEQ ID NO: 2780717 - RNA, 13 nt, Human
aaugaguugugaa

SEQ ID NO: 2780718 - RNA, 14 nt, Human
aaugaguugugaaa

SEQ ID NO: 2780719 - RNA, 14 nt, Human
aaugauucauguua

SEQ ID NO: 2780720 - RNA, 15 nt, Human
aaugauucauguuau

SEQ ID NO: 2780721 - RNA, 16 nt, Human
aaugauucauguuaua

SEQ ID NO: 2780722 - RNA, 13 nt, Human
aaugauuguaaaa

SEQ ID NO: 2780723 - RNA, 14 nt, Human
aaugauuguaaaau

SEQ ID NO: 2780724 - RNA, 20 nt, Human
aaugauuguaaaauagcuug

SEQ ID NO: 2780725 - RNA, 24 nt, Human
aaugauuucagcucacugcaaccu

SEQ ID NO: 2780726 - RNA, 22 nt, Human
aaugauuucaugcuaucucugu

SEQ ID NO: 2780727 - RNA, 13 nt, Human
aaugauuucaugc

SEQ ID NO: 2780728 - RNA, 18 nt, Human
aaugaggucagagccugc

SEQ ID NO: 2780729 - RNA, 16 nt, Human
aaugaggucagagccu

SEQ ID NO: 2780730 - RNA, 16 nt, Human
aaugaggucccaggca

SEQ ID NO: 2780731 - RNA, 15 nt, Human
aaugaggucccaggc

SEQ ID NO: 2780732 - RNA, 16 nt, Human
aaugaggagagaaaau

SEQ ID NO: 2780733 - RNA, 19 nt, Human
aaugaggagagaaaauaua

SEQ ID NO: 2780734 - RNA, 22 nt, Human
aaugaggagagaaaauauaugu

SEQ ID NO: 2780735 - RNA, 15 nt, Human
aaugaggauuauuga

SEQ ID NO: 2780736 - RNA, 17 nt, Human
aaugaggauuauugaua

SEQ ID NO: 2780737 - RNA, 22 nt, Human
aauguuauuuguuauuuucagu

SEQ ID NO: 2780738 - RNA, 13 nt, Human
aauguugguuuac

SEQ ID NO: 2780739 - RNA, 15 nt, Human
aauguugguuuacuu

SEQ ID NO: 2780740 - RNA, 18 nt, Human
aauguugguuuacuuuca

SEQ ID NO: 2780741 - RNA, 21 nt, Human
aauguugguuuacuuucaaau

SEQ ID NO: 2780742 - RNA, 21 nt, Human
aauguuggacaccuuuagguu

SEQ ID NO: 2780743 - RNA, 20 nt, Human
aauguuggacaccuuuaggu

SEQ ID NO: 2780744 - RNA, 21 nt, Human
aauguucuaaguuucuaagau

SEQ ID NO: 2780745 - RNA, 22 nt, Human
aauguucuaaguuucuaagauu

SEQ ID NO: 2780746 - RNA, 23 nt, Human
aauguucuaaguuucuaagauuc

SEQ ID NO: 2780747 - RNA, 20 nt, Human
aauguucuaugguuaugaaa

SEQ ID NO: 2780748 - RNA, 21 nt, Human
aauguucuaugguuaugaaag

SEQ ID NO: 2780749 - RNA, 17 nt, Human
aauguucaucaauuccc

SEQ ID NO: 2780750 - RNA, 15 nt, Human
aauguuccuuuugcu

SEQ ID NO: 2780751 - RNA, 13 nt, Human
aauguucuaaguu

SEQ ID NO: 2780752 - RNA, 14 nt, Human
aauguucuaaguuu

SEQ ID NO: 2780753 - RNA, 16 nt, Human
aauguucuaaguuucu

SEQ ID NO: 2780754 - RNA, 17 nt, Human
aauguucuaaguuucua

SEQ ID NO: 2780755 - RNA, 19 nt, Human
aauguucuaaguuucuaag

SEQ ID NO: 2780756 - RNA, 20 nt, Human
aauguucuaaguuucuaaga

SEQ ID NO: 2780757 - RNA, 12 nt, Human
aauguuguuucc

SEQ ID NO: 2780758 - RNA, 22 nt, Human
aauguuguuuccuaauaucaaa

SEQ ID NO: 2780759 - RNA, 23 nt, Human
aauguuguuuccuaauaucaaau

SEQ ID NO: 2780760 - RNA, 18 nt, Human
aauguuguuaugcuauua

SEQ ID NO: 2780761 - RNA, 19 nt, Human
aauguucacgcaacuugaa

SEQ ID NO: 2780762 - RNA, 12 nt, Human
aauguuauuucu

SEQ ID NO: 2780763 - RNA, 15 nt, Human
aauguuauuucugca

SEQ ID NO: 2780764 - RNA, 17 nt, Human
aauguuauuucugcaaa

SEQ ID NO: 2780765 - RNA, 19 nt, Human
aauguuauuucugcaaaca

SEQ ID NO: 2780766 - RNA, 21 nt, Human
aauguuauuuguuauuuucag

SEQ ID NO: 2780767 - RNA, 23 nt, Human
aauguuauuuguuauuuucagua

SEQ ID NO: 2780768 - RNA, 18 nt, Human
aauguuauuuucuucuaa

SEQ ID NO: 2780769 - RNA, 20 nt, Human
aauguuauuuucuucuaagu

SEQ ID NO: 2780770 - RNA, 21 nt, Human
aauguuauuuucuucuaagug

SEQ ID NO: 2780771 - RNA, 22 nt, Human
aauguuaugacuauguaaacua

SEQ ID NO: 2780772 - RNA, 19 nt, Human
aauguuaugacuauguaaa

SEQ ID NO: 2780773 - RNA, 16 nt, Human
aauguuaucuucucaa

SEQ ID NO: 2780774 - RNA, 17 nt, Human
aauguuaucuucucaag

SEQ ID NO: 2780775 - RNA, 22 nt, Human
aauguuaucuucucaaguucua

SEQ ID NO: 2780776 - RNA, 23 nt, Human
aauguuaucuucucaaguucuaa

SEQ ID NO: 2780777 - RNA, 22 nt, Human
aauguuaauuuuuugguacaaa

SEQ ID NO: 2780778 - RNA, 17 nt, Human
aauguggccuaaaaaug

SEQ ID NO: 2780779 - RNA, 15 nt, Human
aauguuagagacuuu

SEQ ID NO: 2780780 - RNA, 13 nt, Human
aauguuagagcac

SEQ ID NO: 2780781 - RNA, 16 nt, Human
aauguuagagcacagu

SEQ ID NO: 2780782 - RNA, 16 nt, Human
aauguuagucauuguu

SEQ ID NO: 2780783 - RNA, 17 nt, Human
aauguuauaucauaugu

SEQ ID NO: 2780784 - RNA, 19 nt, Human
aauguuaucuuauacugua

SEQ ID NO: 2780785 - RNA, 21 nt, Human
aauguuaucuuauacuguaca

SEQ ID NO: 2780786 - RNA, 22 nt, Human
aauguuaucuuauacuguacaa

SEQ ID NO: 2780787 - RNA, 23 nt, Human
aauguuaucuuauacuguacaau

SEQ ID NO: 2780788 - RNA, 13 nt, Human
uacaggguuuuua

SEQ ID NO: 2780789 - RNA, 15 nt, Human
uacaggguuuuuacc

SEQ ID NO: 2780790 - RNA, 17 nt, Human
uacaggguuuuuaccug

SEQ ID NO: 2780791 - RNA, 23 nt, Human
uacaggguuuuuaccugucacau

SEQ ID NO: 2780792 - RNA, 22 nt, Human
aauguggcaaggaaaaacaggu

SEQ ID NO: 2780793 - RNA, 21 nt, Human
aauguggccccugaacaagaa

SEQ ID NO: 2780794 - RNA, 17 nt, Human
aauguggccgaggacuu

SEQ ID NO: 2780795 - RNA, 15 nt, Human
aauguggaagaaaau

SEQ ID NO: 2780796 - RNA, 16 nt, Human
aauguggaagaaaaug

SEQ ID NO: 2780797 - RNA, 21 nt, Human
aauguggacucaaucccuagg

SEQ ID NO: 2780798 - RNA, 19 nt, Human
aauguggagaacuaaaggu

SEQ ID NO: 2780799 - RNA, 19 nt, Human
uacaggguaacugugcuga

SEQ ID NO: 2780800 - RNA, 20 nt, Human
uacaggguaacugugcugaa

SEQ ID NO: 2780801 - RNA, 24 nt, Human
uacaggguaacugugcugaaugcu

SEQ ID NO: 2780802 - RNA, 13 nt, Human
uaccagcuuuuaa

SEQ ID NO: 2780803 - RNA, 16 nt, Human
uaccagcuuuuaacca

SEQ ID NO: 2780804 - RNA, 17 nt, Human
uaccagcuuuuaaccau

SEQ ID NO: 2780805 - RNA, 16 nt, Human
uaccaggaacuauaaa

SEQ ID NO: 2780806 - RNA, 14 nt, Human
uaccaggauuuuuu

SEQ ID NO: 2780807 - RNA, 21 nt, Human
uaccagcguauauauaagaaa

SEQ ID NO: 2780808 - RNA, 22 nt, Human
uaccagcguauauauaagaaag

SEQ ID NO: 2780809 - RNA, 17 nt, Human
uaccagcuacccugugu

SEQ ID NO: 2780810 - RNA, 21 nt, Human
uaccagcaagaauaaaaaaga

SEQ ID NO: 2780811 - RNA, 20 nt, Human
uaccagcagaaggauuuuuu

SEQ ID NO: 2780812 - RNA, 16 nt, Human
uaccagcccuggggcu

SEQ ID NO: 2780813 - RNA, 17 nt, Human
uaccagcccuggggcug

SEQ ID NO: 2780814 - RNA, 19 nt, Human
uaccagcccuggggcuggg

SEQ ID NO: 2780815 - RNA, 20 nt, Human
uaccagcccuggggcugggc

SEQ ID NO: 2780816 - RNA, 21 nt, Human
uaccagcccuggggcugggcc

SEQ ID NO: 2780817 - RNA, 22 nt, Human
uaccagcccuggggcugggccc

SEQ ID NO: 2780818 - RNA, 21 nt, Human
uaccagucuuuaaaggcccag

SEQ ID NO: 2780819 - RNA, 23 nt, Human
uaccagucuuuaaaggcccagcc

SEQ ID NO: 2780820 - RNA, 14 nt, Human
uaccagugcaggcu

SEQ ID NO: 2780821 - RNA, 18 nt, Human
uaccagugcaggcuggcc

SEQ ID NO: 2780822 - RNA, 19 nt, Human
uaccagugcaggcuggcca

SEQ ID NO: 2780823 - RNA, 20 nt, Human
uaccagugcaggcuggccag

SEQ ID NO: 2780824 - RNA, 21 nt, Human
uaccagugcaggcuggccagc

SEQ ID NO: 2780825 - RNA, 22 nt, Human
uaccagugcaggcuggccagcc

SEQ ID NO: 2780826 - RNA, 23 nt, Human
uaccagugcaggcuggccagccg

SEQ ID NO: 2780827 - RNA, 16 nt, Human
uaccagggauguagau

SEQ ID NO: 2780828 - RNA, 17 nt, Human
uaccagggauguagauu

SEQ ID NO: 2780829 - RNA, 19 nt, Human
uaccagguauuauuaucuu

SEQ ID NO: 2780830 - RNA, 15 nt, Human
uaccaguuaauuacu

SEQ ID NO: 2780831 - RNA, 14 nt, Human
uaccauuaaaacug

SEQ ID NO: 2780832 - RNA, 16 nt, Human
uaccauuaaaacugcu

SEQ ID NO: 2780833 - RNA, 17 nt, Human
uaccauuaaaacugcuu

SEQ ID NO: 2780834 - RNA, 18 nt, Human
uaccauuaaaacugcuuu

SEQ ID NO: 2780835 - RNA, 19 nt, Human
uaccauuaaaacugcuuuu

SEQ ID NO: 2780836 - RNA, 20 nt, Human
uaccauuaaaacugcuuuuu

SEQ ID NO: 2780837 - RNA, 13 nt, Human
uacccccuccuuc

SEQ ID NO: 2780838 - RNA, 16 nt, Human
uacccccuaagagcca

SEQ ID NO: 2780839 - RNA, 17 nt, Human
uaccauucacaauaaaa

SEQ ID NO: 2780840 - RNA, 21 nt, Human
uaccauucacaauaaaagcuu

SEQ ID NO: 2780841 - RNA, 13 nt, Human
uaccauucagauc

SEQ ID NO: 2780842 - RNA, 15 nt, Human
uaccauucagaucac

SEQ ID NO: 2780843 - RNA, 20 nt, Human
uaccauucagaucacugaau

SEQ ID NO: 2780844 - RNA, 22 nt, Human
uaccauucagaucacugaauuu

SEQ ID NO: 2780845 - RNA, 16 nt, Human
uacccccuccuucaga

SEQ ID NO: 2780846 - RNA, 17 nt, Human
uacccccuccuucagac

SEQ ID NO: 2780847 - RNA, 15 nt, Human
uacccccugcaaagc

SEQ ID NO: 2780848 - RNA, 23 nt, Human
uacccccugcaaagcccagcuug

SEQ ID NO: 2780849 - RNA, 19 nt, Human
uacccccugcaaagcccag

SEQ ID NO: 2780850 - RNA, 17 nt, Human
uacauuuaugauuuaau

SEQ ID NO: 2780851 - RNA, 21 nt, Human
uacauucucuaauaagaaaac

SEQ ID NO: 2780852 - RNA, 18 nt, Human
uacauuucacaggcuaau

SEQ ID NO: 2780853 - RNA, 23 nt, Human
uacauuuaugauuuaauaaaaua

SEQ ID NO: 2780854 - RNA, 18 nt, Human
uacauuuaugauuuaaua

SEQ ID NO: 2780855 - RNA, 19 nt, Human
uacauuuaugauuuaauaa

SEQ ID NO: 2780856 - RNA, 20 nt, Human
uacauuuaugauuuaauaaa

SEQ ID NO: 2780857 - RNA, 22 nt, Human
uacauuuaugauuuaauaaaau

SEQ ID NO: 2780858 - RNA, 15 nt, Human
uacauucaauguuua

SEQ ID NO: 2780859 - RNA, 15 nt, Human
uacauucauuuagcu

SEQ ID NO: 2780860 - RNA, 13 nt, Human
uacauucauuuag

SEQ ID NO: 2780861 - RNA, 14 nt, Human
uacauuauugcuua

SEQ ID NO: 2780862 - RNA, 13 nt, Human
uacauuauaaacg

SEQ ID NO: 2780863 - RNA, 12 nt, Human
uacauuaguaaa

SEQ ID NO: 2780864 - RNA, 13 nt, Human
uacauuaguaaau

SEQ ID NO: 2780865 - RNA, 14 nt, Human
uacauuaguaaaug

SEQ ID NO: 2780866 - RNA, 15 nt, Human
uacauuaguaaaugu

SEQ ID NO: 2780867 - RNA, 17 nt, Human
uacauuaguaaaugucu

SEQ ID NO: 2780868 - RNA, 18 nt, Human
uacauuaguaaaugucuu

SEQ ID NO: 2780869 - RNA, 19 nt, Human
uacauuaguaaaugucuuu

SEQ ID NO: 2780870 - RNA, 20 nt, Human
uacauuaguaaaugucuuug

SEQ ID NO: 2780871 - RNA, 21 nt, Human
uacauuaguaaaugucuuugu

SEQ ID NO: 2780872 - RNA, 22 nt, Human
uacauuaguaaaugucuuugua

SEQ ID NO: 2780873 - RNA, 23 nt, Human
uacauuaguaaaugucuuuguaa

SEQ ID NO: 2780874 - RNA, 14 nt, Human
aauuaaguuaucuu

SEQ ID NO: 2780875 - RNA, 23 nt, Human
aauuaauaaaaaauggaaagaau

SEQ ID NO: 2780876 - RNA, 15 nt, Human
aauguuuaaacauuu

SEQ ID NO: 2780877 - RNA, 16 nt, Human
uacauuuaugauuuaa

SEQ ID NO: 2780878 - RNA, 22 nt, Human
uacauuucuuagacuacauuua

SEQ ID NO: 2780879 - RNA, 17 nt, Human
aauuacauguaaaacau

SEQ ID NO: 2780880 - RNA, 12 nt, Human
uaccuuacugug

SEQ ID NO: 2780881 - RNA, 16 nt, Human
uaccugaccucuugcu

SEQ ID NO: 2780882 - RNA, 17 nt, Human
uaccugaccucuugcug

SEQ ID NO: 2780883 - RNA, 18 nt, Human
uaccugaccucuugcugu

SEQ ID NO: 2780884 - RNA, 19 nt, Human
uaccugaccucuugcuguc

SEQ ID NO: 2780885 - RNA, 20 nt, Human
uaccugaccucuugcugucu

SEQ ID NO: 2780886 - RNA, 22 nt, Human
uaccugaccucuugcugucucu

SEQ ID NO: 2780887 - RNA, 21 nt, Human
uaccugauuucuucagggcug

SEQ ID NO: 2780888 - RNA, 23 nt, Human
uaccugauggaaguaaagccuca

SEQ ID NO: 2780889 - RNA, 14 nt, Human
uaccuguguacaua

SEQ ID NO: 2780890 - RNA, 14 nt, Human
uaccuguguauaua

SEQ ID NO: 2780891 - RNA, 20 nt, Human
uaccugugcguuacuaauug

SEQ ID NO: 2780892 - RNA, 16 nt, Human
uaccugugccucggcu

SEQ ID NO: 2780893 - RNA, 12 nt, Human
uaccugugccug

SEQ ID NO: 2780894 - RNA, 18 nt, Human
uaccugcaggcugagcca

SEQ ID NO: 2780895 - RNA, 22 nt, Human
uaccugcaggcugagccacucu

SEQ ID NO: 2780896 - RNA, 21 nt, Human
uaccugugugguacucugaaa

SEQ ID NO: 2780897 - RNA, 13 nt, Human
uaccuguuccuua

SEQ ID NO: 2780898 - RNA, 13 nt, Human
uaccugacacaag

SEQ ID NO: 2780899 - RNA, 16 nt, Human
uacccuauucucucuu

SEQ ID NO: 2780900 - RNA, 18 nt, Human
uacccccuccuucagaca

SEQ ID NO: 2780901 - RNA, 13 nt, Human
uacccguuccaaa

SEQ ID NO: 2780902 - RNA, 13 nt, Human
uacccuaaugucu

SEQ ID NO: 2780903 - RNA, 14 nt, Human
uacccuaaugucuu

SEQ ID NO: 2780904 - RNA, 16 nt, Human
uacccuaaugucuuca

SEQ ID NO: 2780905 - RNA, 17 nt, Human
uacccuaaugucuucau

SEQ ID NO: 2780906 - RNA, 19 nt, Human
uacccuaaugucuucauaa

SEQ ID NO: 2780907 - RNA, 22 nt, Human
uacccuaaugucuucauaaagu

SEQ ID NO: 2780908 - RNA, 23 nt, Human
aauuacuuuuuuccaauuuuaga

SEQ ID NO: 2780909 - RNA, 20 nt, Human
aauuagaaaaaaauuacuaa

SEQ ID NO: 2780910 - RNA, 18 nt, Human
aauuagaaauuggcugga

SEQ ID NO: 2780911 - RNA, 22 nt, Human
aauuacuuaucauccacauugu

SEQ ID NO: 2780912 - RNA, 19 nt, Human
aauuacuuaucccugccca

SEQ ID NO: 2780913 - RNA, 21 nt, Human
aauuacuuaucccugcccauu

SEQ ID NO: 2780914 - RNA, 15 nt, Human
aauuaugugacauuu

SEQ ID NO: 2780915 - RNA, 20 nt, Human
aauuaugugacauuuuacau

SEQ ID NO: 2780916 - RNA, 17 nt, Human
aauuaugugacauuuua

SEQ ID NO: 2780917 - RNA, 22 nt, Human
aauuaugugacauuuuacauua

SEQ ID NO: 2780918 - RNA, 14 nt, Human
aauuauuuaauaaa

SEQ ID NO: 2780919 - RNA, 18 nt, Human
aauuauuauaagcauuga

SEQ ID NO: 2780920 - RNA, 20 nt, Human
aauuauuaguuuacaucauu

SEQ ID NO: 2780921 - RNA, 22 nt, Human
aauuauguuuuuauuaagauua

SEQ ID NO: 2780922 - RNA, 16 nt, Human
aauuauuaacuacauu

SEQ ID NO: 2780923 - RNA, 18 nt, Human
aauuauuaacuacauuua

SEQ ID NO: 2780924 - RNA, 19 nt, Human
aauuauuaacuacauuuau

SEQ ID NO: 2780925 - RNA, 20 nt, Human
aauuauuaacuacauuuaug

SEQ ID NO: 2780926 - RNA, 23 nt, Human
aauuauuaacuacauuuaugagu

SEQ ID NO: 2780927 - RNA, 20 nt, Human
aauucaagaaaacaacuuca

SEQ ID NO: 2780928 - RNA, 12 nt, Human
aauucaagaaaa

SEQ ID NO: 2780929 - RNA, 14 nt, Human
aauuauuuuaaaca

SEQ ID NO: 2780930 - RNA, 18 nt, Human
aauuauuuuaaacaaaau

SEQ ID NO: 2780931 - RNA, 19 nt, Human
aauuauuucacaaauaaua

SEQ ID NO: 2780932 - RNA, 19 nt, Human
aauuauuuauuuaauaaca

SEQ ID NO: 2780933 - RNA, 19 nt, Human
aauuauuugcaggucuuua

SEQ ID NO: 2780934 - RNA, 14 nt, Human
aauuauuuguguaa

SEQ ID NO: 2780935 - RNA, 21 nt, Human
aauuauuugacuuuaauuuau

SEQ ID NO: 2780936 - RNA, 15 nt, Human
aauuauuuguguaau

SEQ ID NO: 2780937 - RNA, 18 nt, Human
aauuauuuguguaauaga

SEQ ID NO: 2780938 - RNA, 19 nt, Human
aauuauuuguguaauagaa

SEQ ID NO: 2780939 - RNA, 21 nt, Human
aauuauuuguguaauagaaaa

SEQ ID NO: 2780940 - RNA, 15 nt, Human
aauucagcaaaccau

SEQ ID NO: 2780941 - RNA, 16 nt, Human
aauucagcaaaccauu

SEQ ID NO: 2780942 - RNA, 15 nt, Human
aauucaauuuuaaag

SEQ ID NO: 2780943 - RNA, 17 nt, Human
aauucaauuuuaaagac

SEQ ID NO: 2780944 - RNA, 18 nt, Human
aauucagccauguacaga

SEQ ID NO: 2780945 - RNA, 15 nt, Human
aauucaauacaaaca

SEQ ID NO: 2780946 - RNA, 21 nt, Human
aauucaggugaaaauguucau

SEQ ID NO: 2780947 - RNA, 13 nt, Human
aauucauauucug

SEQ ID NO: 2780948 - RNA, 13 nt, Human
aauucauauucuu

SEQ ID NO: 2780949 - RNA, 23 nt, Human
aauucaucaaauggaagacacau

SEQ ID NO: 2780950 - RNA, 16 nt, Human
aauucagugcuguacu

SEQ ID NO: 2780951 - RNA, 17 nt, Human
aauucaguguauuucag

SEQ ID NO: 2780952 - RNA, 18 nt, Human
aauucaguguauuucagu

SEQ ID NO: 2780953 - RNA, 19 nt, Human
aauucaguguauuucaguu

SEQ ID NO: 2780954 - RNA, 16 nt, Human
aauucaguauguuuua

SEQ ID NO: 2780955 - RNA, 23 nt, Human
aauucaguauguuuuacacugua

SEQ ID NO: 2780956 - RNA, 12 nt, Human
acacuaauuccu

SEQ ID NO: 2780957 - RNA, 21 nt, Human
uauaacucaucauaaaauaaa

SEQ ID NO: 2780958 - RNA, 20 nt, Human
uauaacucaucauaaaauaa

SEQ ID NO: 2780959 - RNA, 19 nt, Human
uauaacucaucauaaaaua

SEQ ID NO: 2780960 - RNA, 18 nt, Human
uauaacucaucauaaaau

SEQ ID NO: 2780961 - RNA, 17 nt, Human
uauaacucaucauaaaa

SEQ ID NO: 2780962 - RNA, 16 nt, Human
uauaacucaucauaaa

SEQ ID NO: 2780963 - RNA, 19 nt, Human
uauaacuauguugauaaaa

SEQ ID NO: 2780964 - RNA, 17 nt, Human
acacuaauuccuuucua

SEQ ID NO: 2780965 - RNA, 14 nt, Human
uauaagugaaguga

SEQ ID NO: 2780966 - RNA, 15 nt, Human
uauaagugaagugau

SEQ ID NO: 2780967 - RNA, 17 nt, Human
uauaagugcacacagaa

SEQ ID NO: 2780968 - RNA, 21 nt, Human
uauaagugcacacagaaauau

SEQ ID NO: 2780969 - RNA, 22 nt, Human
uauaagugcacacagaaauaua

SEQ ID NO: 2780970 - RNA, 23 nt, Human
uauaagugcacacagaaauauau

SEQ ID NO: 2780971 - RNA, 22 nt, Human
uauaacuuaaaaauguaaauau

SEQ ID NO: 2780972 - RNA, 18 nt, Human
uauaagucauuguauguu

SEQ ID NO: 2780973 - RNA, 20 nt, Human
uauaacuuaaaaauguaaau

SEQ ID NO: 2780974 - RNA, 19 nt, Human
uagucaccccaaguagucu

SEQ ID NO: 2780975 - RNA, 13 nt, Human
uauacagaggaaa

SEQ ID NO: 2780976 - RNA, 20 nt, Human
uauacagaggaaaucuguaa

SEQ ID NO: 2780977 - RNA, 12 nt, Human
uauacagaugaa

SEQ ID NO: 2780978 - RNA, 13 nt, Human
uauacagaugaaa

SEQ ID NO: 2780979 - RNA, 14 nt, Human
uauacagaugaaaa

SEQ ID NO: 2780980 - RNA, 15 nt, Human
uauacagaugaaaau

SEQ ID NO: 2780981 - RNA, 18 nt, Human
uauacagaugaaaauuug

SEQ ID NO: 2780982 - RNA, 19 nt, Human
uauacagaugaaaauuuga

SEQ ID NO: 2780983 - RNA, 21 nt, Human
uauacagaugaaaauuugaga

SEQ ID NO: 2780984 - RNA, 18 nt, Human
uauacaggcauaaaauag

SEQ ID NO: 2780985 - RNA, 15 nt, Human
uauacauacacuugu

SEQ ID NO: 2780986 - RNA, 19 nt, Human
uauacauacacuuguauaa

SEQ ID NO: 2780987 - RNA, 20 nt, Human
uauacauacacuuguauaaa

SEQ ID NO: 2780988 - RNA, 12 nt, Human
uauacaugugug

SEQ ID NO: 2780989 - RNA, 13 nt, Human
uauacaugugugu

SEQ ID NO: 2780990 - RNA, 14 nt, Human
uauacaugugugua

SEQ ID NO: 2780991 - RNA, 15 nt, Human
uauacauguguguau

SEQ ID NO: 2780992 - RNA, 16 nt, Human
uauacauguguguaua

SEQ ID NO: 2780993 - RNA, 17 nt, Human
uauacauguguguauau

SEQ ID NO: 2780994 - RNA, 18 nt, Human
uauacauguguguauaua

SEQ ID NO: 2780995 - RNA, 19 nt, Human
uauacauguguguauauau

SEQ ID NO: 2780996 - RNA, 20 nt, Human
uauacauguguguauauaug

SEQ ID NO: 2780997 - RNA, 22 nt, Human
uauacauguguguauauaugug

SEQ ID NO: 2780998 - RNA, 15 nt, Human
uauacauccugggua

SEQ ID NO: 2780999 - RNA, 16 nt, Human
uauacauccuggguaa

SEQ ID NO: 2781000 - RNA, 21 nt, Human
uauacauccuggguaaugaga

SEQ ID NO: 2781001 - RNA, 15 nt, Human
uauacaugaaaauuu

SEQ ID NO: 2781002 - RNA, 19 nt, Human
uauacaugaaaauuuuaaa

SEQ ID NO: 2781003 - RNA, 13 nt, Human
uauacauauguag

SEQ ID NO: 2781004 - RNA, 15 nt, Human
uauacauauguagac

SEQ ID NO: 2781005 - RNA, 16 nt, Human
uauacauauguagacu

SEQ ID NO: 2781006 - RNA, 19 nt, Human
uauacauauguagacuaua

SEQ ID NO: 2781007 - RNA, 23 nt, Human
uauacauauguagacuauauaca

SEQ ID NO: 2781008 - RNA, 16 nt, Human
uauaauuuaaugcaug

SEQ ID NO: 2781009 - RNA, 11 nt, Human
uauaauuuaau

SEQ ID NO: 2781010 - RNA, 18 nt, Human
uauaagugaagugauacu

SEQ ID NO: 2781011 - RNA, 15 nt, Human
uauaggcaccuacca

SEQ ID NO: 2781012 - RNA, 20 nt, Human
uauaggucucuucucccaga

SEQ ID NO: 2781013 - RNA, 22 nt, Human
uauaggucucuucucccagaau

SEQ ID NO: 2781014 - RNA, 17 nt, Human
uauaggugauguuugcu

SEQ ID NO: 2781015 - RNA, 20 nt, Human
uauaggugauguuugcucuu

SEQ ID NO: 2781016 - RNA, 18 nt, Human
uauauagcagcaaaaaua

SEQ ID NO: 2781017 - RNA, 21 nt, Human
uauauagcagcaaaaauauaa

SEQ ID NO: 2781018 - RNA, 22 nt, Human
uauauagcagcaaaaauauaaa

SEQ ID NO: 2781019 - RNA, 18 nt, Human
uauaggagccuuaauuuu

SEQ ID NO: 2781020 - RNA, 15 nt, Human
uauaggaucauuugu

SEQ ID NO: 2781021 - RNA, 16 nt, Human
uauagauuagaaaaau

SEQ ID NO: 2781022 - RNA, 17 nt, Human
uauagauuagaaaaauu

SEQ ID NO: 2781023 - RNA, 21 nt, Human
uauagauuagaaaaauuccua

SEQ ID NO: 2781024 - RNA, 18 nt, Human
uauagcacaucaccuggg

SEQ ID NO: 2781025 - RNA, 13 nt, Human
uauagcacuuuga

SEQ ID NO: 2781026 - RNA, 14 nt, Human
uauagcacuuugaa

SEQ ID NO: 2781027 - RNA, 15 nt, Human
uauagcacuuugaaa

SEQ ID NO: 2781028 - RNA, 20 nt, Human
uauagcacuuugaaauaccu

SEQ ID NO: 2781029 - RNA, 21 nt, Human
uauagcacuuugaaauaccuc

SEQ ID NO: 2781030 - RNA, 22 nt, Human
uauagcacuuugaaauaccuca

SEQ ID NO: 2781031 - RNA, 23 nt, Human
uauagcacuuugaaauaccucau

SEQ ID NO: 2781032 - RNA, 18 nt, Human
uauagcagcaaaaauaua

SEQ ID NO: 2781033 - RNA, 20 nt, Human
uauagcagcaaaaauauaaa

SEQ ID NO: 2781034 - RNA, 21 nt, Human
uauagcagcaaaaauauaaaa

SEQ ID NO: 2781035 - RNA, 22 nt, Human
uauagcagcaaaaauauaaaau

SEQ ID NO: 2781036 - RNA, 12 nt, Human
uauagaugucua

SEQ ID NO: 2781037 - RNA, 18 nt, Human
uauagccuaggugacaga

SEQ ID NO: 2781038 - RNA, 18 nt, Human
uauagcuggcaagaaugg

SEQ ID NO: 2781039 - RNA, 16 nt, Human
acacucaguuguucaa

SEQ ID NO: 2781040 - RNA, 15 nt, Human
uauauauuuauaacu

SEQ ID NO: 2781041 - RNA, 14 nt, Human
uauauauuuauaac

SEQ ID NO: 2781042 - RNA, 20 nt, Human
uauauccuuucuaacaaaaa

SEQ ID NO: 2781043 - RNA, 17 nt, Human
uauauccuuucuaacaa

SEQ ID NO: 2781044 - RNA, 20 nt, Human
uauauccuuuucuucuaugu

SEQ ID NO: 2781045 - RNA, 21 nt, Human
uauauccuuuucuucuaugua

SEQ ID NO: 2781046 - RNA, 14 nt, Human
uauauagcuggcaa

SEQ ID NO: 2781047 - RNA, 18 nt, Human
uauauagcuggcaagaau

SEQ ID NO: 2781048 - RNA, 19 nt, Human
uauauagcuggcaagaaug

SEQ ID NO: 2781049 - RNA, 20 nt, Human
uauauagcuggcaagaaugg

SEQ ID NO: 2781050 - RNA, 14 nt, Human
uauauagugcuaua

SEQ ID NO: 2781051 - RNA, 15 nt, Human
uauauagugcuauau

SEQ ID NO: 2781052 - RNA, 17 nt, Human
uauauagugcuauauau

SEQ ID NO: 2781053 - RNA, 17 nt, Human
uauauagguugugcaaa

SEQ ID NO: 2781054 - RNA, 22 nt, Human
uauauaguuuauugacaauaau

SEQ ID NO: 2781055 - RNA, 19 nt, Human
uauauaucugcuucagugg

SEQ ID NO: 2781056 - RNA, 21 nt, Human
uauauaucugcuucaguggag

SEQ ID NO: 2781057 - RNA, 13 nt, Human
uauauaugaaaac

SEQ ID NO: 2781058 - RNA, 15 nt, Human
uauauaugaaaacua

SEQ ID NO: 2781059 - RNA, 16 nt, Human
uauauaugaaaacuau

SEQ ID NO: 2781060 - RNA, 22 nt, Human
uauauaugaaaacuauacaaca

SEQ ID NO: 2781061 - RNA, 15 nt, Human
uauauaugccuuuuu

SEQ ID NO: 2781062 - RNA, 19 nt, Human
uauauaugccuuuuuccua

SEQ ID NO: 2781063 - RNA, 21 nt, Human
uauauaugccuuuuuccuagc

SEQ ID NO: 2781064 - RNA, 13 nt, Human
uauauauggacau

SEQ ID NO: 2781065 - RNA, 16 nt, Human
uauauauguguaugua

SEQ ID NO: 2781066 - RNA, 14 nt, Human
uauauauguguaug

SEQ ID NO: 2781067 - RNA, 18 nt, Human
uauauauguauaaauaaa

SEQ ID NO: 2781068 - RNA, 14 nt, Human
uauauaugugagga

SEQ ID NO: 2781069 - RNA, 12 nt, Human
uauauaugugua

SEQ ID NO: 2781070 - RNA, 16 nt, Human
uauauauguguauaua

SEQ ID NO: 2781071 - RNA, 19 nt, Human
uauauauguguauauauac

SEQ ID NO: 2781072 - RNA, 20 nt, Human
uauauauguguauauauaca

SEQ ID NO: 2781073 - RNA, 21 nt, Human
uauauauguguauauauacau

SEQ ID NO: 2781074 - RNA, 22 nt, Human
uauauauguguauauauacaua

SEQ ID NO: 2781075 - RNA, 23 nt, Human
uauauauguguauauauacauac

SEQ ID NO: 2781076 - RNA, 13 nt, Human
uauauauuuauaa

SEQ ID NO: 2781077 - RNA, 17 nt, Human
uauauauucuuauaaaa

SEQ ID NO: 2781078 - RNA, 20 nt, Human
uauauauucuuauaaaaaug

SEQ ID NO: 2781079 - RNA, 16 nt, Human
acagaaagguuuucuu

SEQ ID NO: 2781080 - RNA, 19 nt, Human
acagaaagucauuccuucu

SEQ ID NO: 2781081 - RNA, 22 nt, Human
acagaaagucauuccuucuuuu

SEQ ID NO: 2781082 - RNA, 13 nt, Human
acagaaauacuau

SEQ ID NO: 2781083 - RNA, 17 nt, Human
acagaaauauaauaaaa

SEQ ID NO: 2781084 - RNA, 19 nt, Human
acagaaauauaauaaaaug

SEQ ID NO: 2781085 - RNA, 14 nt, Human
acagaaauauauau

SEQ ID NO: 2781086 - RNA, 17 nt, Human
acagaaauauauauaca

SEQ ID NO: 2781087 - RNA, 18 nt, Human
acagaaauauauauacau

SEQ ID NO: 2781088 - RNA, 19 nt, Human
acagaaauauauauacaua

SEQ ID NO: 2781089 - RNA, 20 nt, Human
acagaaauauauauacauau

SEQ ID NO: 2781090 - RNA, 22 nt, Human
acagaaauauauauacauaugu

SEQ ID NO: 2781091 - RNA, 13 nt, Human
acagaaaagcaua

SEQ ID NO: 2781092 - RNA, 22 nt, Human
acagaaaacauucugauuugga

SEQ ID NO: 2781093 - RNA, 19 nt, Human
acagaaauggggaauucuc

SEQ ID NO: 2781094 - RNA, 22 nt, Human
acagaaauggggaauucucuaa

SEQ ID NO: 2781095 - RNA, 15 nt, Human
acagacagcccucca

SEQ ID NO: 2781096 - RNA, 18 nt, Human
acacuugaaccugggagg

SEQ ID NO: 2781097 - RNA, 22 nt, Human
acacuugaaccugggaggugga

SEQ ID NO: 2781098 - RNA, 23 nt, Human
acacuucugugagacccccacac

SEQ ID NO: 2781099 - RNA, 13 nt, Human
acacuugcccugc

SEQ ID NO: 2781100 - RNA, 14 nt, Human
acacuugcccugcu

SEQ ID NO: 2781101 - RNA, 15 nt, Human
acacuugcccugcuc

SEQ ID NO: 2781102 - RNA, 17 nt, Human
acacuugcccugcuccc

SEQ ID NO: 2781103 - RNA, 20 nt, Human
acacuugcccugcucccucu

SEQ ID NO: 2781104 - RNA, 21 nt, Human
acacuugcccugcucccucuc

SEQ ID NO: 2781105 - RNA, 20 nt, Human
acacuucugugagaccccca

SEQ ID NO: 2781106 - RNA, 14 nt, Human
acacuucuguccug

SEQ ID NO: 2781107 - RNA, 17 nt, Human
acacuucuguccuguga

SEQ ID NO: 2781108 - RNA, 16 nt, Human
acacuuguauaaaugu

SEQ ID NO: 2781109 - RNA, 17 nt, Human
acacuuguauaaaugua

SEQ ID NO: 2781110 - RNA, 22 nt, Human
acacuuggcccaaguggcagag

SEQ ID NO: 2781111 - RNA, 20 nt, Human
acacuuggggagauuugcca

SEQ ID NO: 2781112 - RNA, 15 nt, Human
acacuuggugcuggg

SEQ ID NO: 2781113 - RNA, 16 nt, Human
acacuuggugcuggga

SEQ ID NO: 2781114 - RNA, 17 nt, Human
acacuuggugcugggaa

SEQ ID NO: 2781115 - RNA, 18 nt, Human
acacuuggugcugggaac

SEQ ID NO: 2781116 - RNA, 19 nt, Human
acacuuggugcugggaacc

SEQ ID NO: 2781117 - RNA, 15 nt, Human
acagaaaaagacuuu

SEQ ID NO: 2781118 - RNA, 15 nt, Human
acagaaaaaucuugu

SEQ ID NO: 2781119 - RNA, 22 nt, Human
acagaaaaaucuugugcuagaa

SEQ ID NO: 2781120 - RNA, 14 nt, Human
acacuuaauacuac

SEQ ID NO: 2781121 - RNA, 14 nt, Human
acacuuauaaguga

SEQ ID NO: 2781122 - RNA, 18 nt, Human
acacuucaaggugacaga

SEQ ID NO: 2781123 - RNA, 19 nt, Human
acacuucaauaauugucca

SEQ ID NO: 2781124 - RNA, 18 nt, Human
acacuuaccccauggcug

SEQ ID NO: 2781125 - RNA, 17 nt, Human
acacuuacuguaagaca

SEQ ID NO: 2781126 - RNA, 18 nt, Human
acacuuacuguaagacau

SEQ ID NO: 2781127 - RNA, 19 nt, Human
acacuuacuguaagacauu

SEQ ID NO: 2781128 - RNA, 21 nt, Human
acacuuacuguaagacauuag

SEQ ID NO: 2781129 - RNA, 15 nt, Human
acacuucaggcucuu

SEQ ID NO: 2781130 - RNA, 19 nt, Human
acacuucaggcucuucucc

SEQ ID NO: 2781131 - RNA, 22 nt, Human
acacuucaggcucuucuccuuu

SEQ ID NO: 2781132 - RNA, 14 nt, Human
acacuuccauaauc

SEQ ID NO: 2781133 - RNA, 12 nt, Human
acacuuccagac

SEQ ID NO: 2781134 - RNA, 15 nt, Human
acagacaucucugca

SEQ ID NO: 2781135 - RNA, 15 nt, Human
acagaccugcuuuuu

SEQ ID NO: 2781136 - RNA, 16 nt, Human
acagaccugcuuuuug

SEQ ID NO: 2781137 - RNA, 17 nt, Human
acagaccugcuuuuuga

SEQ ID NO: 2781138 - RNA, 21 nt, Human
acagaccugcuuuuugaaaug

SEQ ID NO: 2781139 - RNA, 21 nt, Human
uaucaaacuucagcuguacuu

SEQ ID NO: 2781140 - RNA, 18 nt, Human
uaucaaagaauaagaaaa

SEQ ID NO: 2781141 - RNA, 12 nt, Human
uaucaaagcaua

SEQ ID NO: 2781142 - RNA, 19 nt, Human
uaucaaaugcaguauauuu

SEQ ID NO: 2781143 - RNA, 21 nt, Human
uaucaaaugcaguauauuucu

SEQ ID NO: 2781144 - RNA, 23 nt, Human
uaucaaaugcaguauauuucuuc

SEQ ID NO: 2781145 - RNA, 14 nt, Human
acagacauauuuaa

SEQ ID NO: 2781146 - RNA, 23 nt, Human
uaucacaaccaccguuacaagua

SEQ ID NO: 2781147 - RNA, 13 nt, Human
uauccccugcuac

SEQ ID NO: 2781148 - RNA, 14 nt, Human
uauccccugcuacc

SEQ ID NO: 2781149 - RNA, 14 nt, Human
uaucccgagucugg

SEQ ID NO: 2781150 - RNA, 17 nt, Human
uaucccgagucugggac

SEQ ID NO: 2781151 - RNA, 19 nt, Human
uaucccgagucugggacac

SEQ ID NO: 2781152 - RNA, 13 nt, Human
uaucuauagcuaa

SEQ ID NO: 2781153 - RNA, 13 nt, Human
uaucuauauaugu

SEQ ID NO: 2781154 - RNA, 15 nt, Human
uaucuauauaugugu

SEQ ID NO: 2781155 - RNA, 16 nt, Human
uaucuauauaugugua

SEQ ID NO: 2781156 - RNA, 17 nt, Human
uaucuauauauguguau

SEQ ID NO: 2781157 - RNA, 22 nt, Human
uaucuauauauguguauguacg

SEQ ID NO: 2781158 - RNA, 19 nt, Human
uauccccccccuguauagu

SEQ ID NO: 2781159 - RNA, 21 nt, Human
uauccccccccuguauaguua

SEQ ID NO: 2781160 - RNA, 16 nt, Human
uaucccacauccaacu

SEQ ID NO: 2781161 - RNA, 20 nt, Human
uaucccaccuccaucccaga

SEQ ID NO: 2781162 - RNA, 13 nt, Human
uauccccaaauua

SEQ ID NO: 2781163 - RNA, 16 nt, Human
uaucccaaucauuguu

SEQ ID NO: 2781164 - RNA, 14 nt, Human
uaucccagaaauua

SEQ ID NO: 2781165 - RNA, 18 nt, Human
uaucagaauugaaacacu

SEQ ID NO: 2781166 - RNA, 19 nt, Human
uaucagaauugaaacacuu

SEQ ID NO: 2781167 - RNA, 13 nt, Human
uaucagauacauc

SEQ ID NO: 2781168 - RNA, 15 nt, Human
uaucagauacaucac

SEQ ID NO: 2781169 - RNA, 16 nt, Human
uaucagauacaucacu

SEQ ID NO: 2781170 - RNA, 18 nt, Human
uaucagauacaucacugc

SEQ ID NO: 2781171 - RNA, 19 nt, Human
uaucagauacaucacugcu

SEQ ID NO: 2781172 - RNA, 20 nt, Human
uaucagcacauauuuucugu

SEQ ID NO: 2781173 - RNA, 14 nt, Human
uaucagcaaaaaag

SEQ ID NO: 2781174 - RNA, 15 nt, Human
uauccaccaccuccc

SEQ ID NO: 2781175 - RNA, 13 nt, Human
uauccaccaccuc

SEQ ID NO: 2781176 - RNA, 18 nt, Human
uauccaaccaacuugguu

SEQ ID NO: 2781177 - RNA, 12 nt, Human
acagcuguguua

SEQ ID NO: 2781178 - RNA, 22 nt, Human
acagcuguguuauucuuugcgu

SEQ ID NO: 2781179 - RNA, 16 nt, Human
acagcuguucuucugu

SEQ ID NO: 2781180 - RNA, 21 nt, Human
acagcuguucuucuguucugc

SEQ ID NO: 2781181 - RNA, 19 nt, Human
acagcuguuuaagaugggc

SEQ ID NO: 2781182 - RNA, 15 nt, Human
acagcuguuuaagau

SEQ ID NO: 2781183 - RNA, 17 nt, Human
acagcuguuuaagaugg

SEQ ID NO: 2781184 - RNA, 14 nt, Human
acagcuguuuaaga

SEQ ID NO: 2781185 - RNA, 19 nt, Human
acagcuaaugggacacuaa

SEQ ID NO: 2781186 - RNA, 17 nt, Human
acagcuaaugggacacu

SEQ ID NO: 2781187 - RNA, 16 nt, Human
acagcuaaugggacac

SEQ ID NO: 2781188 - RNA, 15 nt, Human
acagcuaaugggaca

SEQ ID NO: 2781189 - RNA, 21 nt, Human
acagcuacuugguuuguguuc

SEQ ID NO: 2781190 - RNA, 16 nt, Human
acagcuaugggagccc

SEQ ID NO: 2781191 - RNA, 21 nt, Human
acagcuaugggagccccaggg

SEQ ID NO: 2781192 - RNA, 17 nt, Human
acagcuaugggagcccc

SEQ ID NO: 2781193 - RNA, 14 nt, Human
acagcuacaacagc

SEQ ID NO: 2781194 - RNA, 16 nt, Human
acagcuacaacagccu

SEQ ID NO: 2781195 - RNA, 18 nt, Human
acagcuacaacagccuca

SEQ ID NO: 2781196 - RNA, 21 nt, Human
acagcuacaacagccucacuu

SEQ ID NO: 2781197 - RNA, 22 nt, Human
acagcuaucgaacuucacaacu

SEQ ID NO: 2781198 - RNA, 14 nt, Human
acagcuaugaagaa

SEQ ID NO: 2781199 - RNA, 21 nt, Human
acagcuucauuuccugugucu

SEQ ID NO: 2781200 - RNA, 19 nt, Human
acagcuucauuuccugugu

SEQ ID NO: 2781201 - RNA, 17 nt, Human
acagcuucauuuccugu

SEQ ID NO: 2781202 - RNA, 13 nt, Human
acagcuucagguu

SEQ ID NO: 2781203 - RNA, 15 nt, Human
acagcuucagguuau

SEQ ID NO: 2781204 - RNA, 20 nt, Human
acagcuucagguuaucgaaa

SEQ ID NO: 2781205 - RNA, 20 nt, Human
acagcuucucauccugcagg

SEQ ID NO: 2781206 - RNA, 11 nt, Human
acagcuuccug

SEQ ID NO: 2781207 - RNA, 15 nt, Human
acagcuuccuguccc

SEQ ID NO: 2781208 - RNA, 22 nt, Human
acagcuuccuguccccaucugu

SEQ ID NO: 2781209 - RNA, 22 nt, Human
acagcuucagguuaucgaaaua

SEQ ID NO: 2781210 - RNA, 21 nt, Human
acaggaaaagcugcugacagu

SEQ ID NO: 2781211 - RNA, 20 nt, Human
acaggaaaagcugcugacag

SEQ ID NO: 2781212 - RNA, 19 nt, Human
acaggaaaagcugcugaca

SEQ ID NO: 2781213 - RNA, 18 nt, Human
acaggaaaagcugcugac

SEQ ID NO: 2781214 - RNA, 21 nt, Human
acagcuucucauccugcaggc

SEQ ID NO: 2781215 - RNA, 22 nt, Human
acaggcccggcuccaggcuccu

SEQ ID NO: 2781216 - RNA, 21 nt, Human
acaggcccggcuccaggcucc

SEQ ID NO: 2781217 - RNA, 20 nt, Human
acaggcccggcuccaggcuc

SEQ ID NO: 2781218 - RNA, 18 nt, Human
acaggcccggcuccaggc

SEQ ID NO: 2781219 - RNA, 13 nt, Human
acaggcccuuccu

SEQ ID NO: 2781220 - RNA, 14 nt, Human
acaggcccugcucc

SEQ ID NO: 2781221 - RNA, 15 nt, Human
acaggcccugcuccu

SEQ ID NO: 2781222 - RNA, 17 nt, Human
acaggcccugcuccugc

SEQ ID NO: 2781223 - RNA, 19 nt, Human
acaggcccugcuccugcag

SEQ ID NO: 2781224 - RNA, 20 nt, Human
acaggcccugcuccugcagc

SEQ ID NO: 2781225 - RNA, 21 nt, Human
acaggcccugcuccugcagca

SEQ ID NO: 2781226 - RNA, 12 nt, Human
acaggcccuggc

SEQ ID NO: 2781227 - RNA, 17 nt, Human
acaggcccuggcugagg

SEQ ID NO: 2781228 - RNA, 13 nt, Human
acaggccucaccu

SEQ ID NO: 2781229 - RNA, 14 nt, Human
acaggccucaccuc

SEQ ID NO: 2781230 - RNA, 15 nt, Human
acaggccucaccucu

SEQ ID NO: 2781231 - RNA, 19 nt, Human
acaggccucaccucuaccc

SEQ ID NO: 2781232 - RNA, 20 nt, Human
acaggccucaccucuaccca

SEQ ID NO: 2781233 - RNA, 21 nt, Human
acaggccucaccucuacccaa

SEQ ID NO: 2781234 - RNA, 15 nt, Human
acaggcccuuccucu

SEQ ID NO: 2781235 - RNA, 22 nt, Human
acaggcccuuccucuccacugc

SEQ ID NO: 2781236 - RNA, 14 nt, Human
acaggccugaagau

SEQ ID NO: 2781237 - RNA, 15 nt, Human
acaggccugaagaua

SEQ ID NO: 2781238 - RNA, 20 nt, Human
acaggccugaagauauuacu

SEQ ID NO: 2781239 - RNA, 15 nt, Human
uaugucccuugcugu

SEQ ID NO: 2781240 - RNA, 17 nt, Human
uauguccacuguguaua

SEQ ID NO: 2781241 - RNA, 23 nt, Human
uauguccacuguguauagaagua

SEQ ID NO: 2781242 - RNA, 13 nt, Human
acaggcgagagag

SEQ ID NO: 2781243 - RNA, 14 nt, Human
acaggcgagagagg

SEQ ID NO: 2781244 - RNA, 19 nt, Human
acaggcgagagaggagcca

SEQ ID NO: 2781245 - RNA, 21 nt, Human
acaggcgagagaggagccaga

SEQ ID NO: 2781246 - RNA, 13 nt, Human
uaugugauuacaa

SEQ ID NO: 2781247 - RNA, 13 nt, Human
uaugucuguuuaa

SEQ ID NO: 2781248 - RNA, 14 nt, Human
uaugucuguuuaag

SEQ ID NO: 2781249 - RNA, 16 nt, Human
uaugucuguuuaagaa

SEQ ID NO: 2781250 - RNA, 18 nt, Human
uaugugaucugucuugua

SEQ ID NO: 2781251 - RNA, 19 nt, Human
uaugugaucugucuuguaa

SEQ ID NO: 2781252 - RNA, 16 nt, Human
uaugucugucauugua

SEQ ID NO: 2781253 - RNA, 12 nt, Human
uaugucuauuua

SEQ ID NO: 2781254 - RNA, 13 nt, Human
uaugucuauuuaa

SEQ ID NO: 2781255 - RNA, 12 nt, Human
uaugucugaugg

SEQ ID NO: 2781256 - RNA, 18 nt, Human
uaugucugcuccuuuccc

SEQ ID NO: 2781257 - RNA, 15 nt, Human
uaugucuauuuaagc

SEQ ID NO: 2781258 - RNA, 19 nt, Human
uaugucucgcuagugaugu

SEQ ID NO: 2781259 - RNA, 17 nt, Human
acaggcccggcuccagg

SEQ ID NO: 2781260 - RNA, 16 nt, Human
acaggcccggcuccag

SEQ ID NO: 2781261 - RNA, 21 nt, Human
acaggcccccuugaguggggu

SEQ ID NO: 2781262 - RNA, 12 nt, Human
acaggcccccuu

SEQ ID NO: 2781263 - RNA, 15 nt, Human
acaggcagcuuucua

SEQ ID NO: 2781264 - RNA, 17 nt, Human
acaggcagcuuucuaga

SEQ ID NO: 2781265 - RNA, 18 nt, Human
acaggcagcuuucuagaa

SEQ ID NO: 2781266 - RNA, 19 nt, Human
acaggcagcuuucuagaag

SEQ ID NO: 2781267 - RNA, 22 nt, Human
acaggcagcgauggucucagaa

SEQ ID NO: 2781268 - RNA, 15 nt, Human
acaggcagauacagg

SEQ ID NO: 2781269 - RNA, 14 nt, Human
acaggagacacugu

SEQ ID NO: 2781270 - RNA, 16 nt, Human
acaggacugauucugg

SEQ ID NO: 2781271 - RNA, 23 nt, Human
acaggacugauucugggaugcuc

SEQ ID NO: 2781272 - RNA, 16 nt, Human
acaggacucugccucc

SEQ ID NO: 2781273 - RNA, 15 nt, Human
acaggacucugccuc

SEQ ID NO: 2781274 - RNA, 16 nt, Human
acaggaaaguguuauu

SEQ ID NO: 2781275 - RNA, 18 nt, Human
acaggaaaguucagaguu

SEQ ID NO: 2781276 - RNA, 22 nt, Human
acaggaaaguucagaguuuucu

SEQ ID NO: 2781277 - RNA, 14 nt, Human
uaugaaagaauaua

SEQ ID NO: 2781278 - RNA, 16 nt, Human
uaugaaaacuauacaa

SEQ ID NO: 2781279 - RNA, 17 nt, Human
uaugaaaacuauacaac

SEQ ID NO: 2781280 - RNA, 22 nt, Human
uaugaaaacuauacaacaaagg

SEQ ID NO: 2781281 - RNA, 19 nt, Human
uaugaaaaugaguugugaa

SEQ ID NO: 2781282 - RNA, 20 nt, Human
uaugaaaaugaguugugaaa

SEQ ID NO: 2781283 - RNA, 16 nt, Human
uaugauaauagauucu

SEQ ID NO: 2781284 - RNA, 14 nt, Human
uaugaaguaaagaa

SEQ ID NO: 2781285 - RNA, 20 nt, Human
uaugaaguaaagaacugcac

SEQ ID NO: 2781286 - RNA, 23 nt, Human
uaugaaguaaagaacugcacaug

SEQ ID NO: 2781287 - RNA, 16 nt, Human
uaugaaguaucuaaaa

SEQ ID NO: 2781288 - RNA, 20 nt, Human
uaugaaguaucuaaaagugu

SEQ ID NO: 2781289 - RNA, 13 nt, Human
uaugaagugcgug

SEQ ID NO: 2781290 - RNA, 19 nt, Human
uaugaagugcgugaaugua

SEQ ID NO: 2781291 - RNA, 20 nt, Human
uaugaaguuacuuucuuaau

SEQ ID NO: 2781292 - RNA, 21 nt, Human
uaugaaguuacuuucuuaaug

SEQ ID NO: 2781293 - RNA, 15 nt, Human
acagcaaguagauaa

SEQ ID NO: 2781294 - RNA, 21 nt, Human
acagcaaguagauaaauauuu

SEQ ID NO: 2781295 - RNA, 16 nt, Human
acagcacagcucccug

SEQ ID NO: 2781296 - RNA, 17 nt, Human
acagcacagcucccugc

SEQ ID NO: 2781297 - RNA, 18 nt, Human
acagcacagcucccugcc

SEQ ID NO: 2781298 - RNA, 20 nt, Human
acagcacagcucccugccaa

SEQ ID NO: 2781299 - RNA, 12 nt, Human
acagcacaugcu

SEQ ID NO: 2781300 - RNA, 15 nt, Human
acagcacaugcuggc

SEQ ID NO: 2781301 - RNA, 17 nt, Human
acagcacaugcuggcca

SEQ ID NO: 2781302 - RNA, 18 nt, Human
acagcacaugcuggccag

SEQ ID NO: 2781303 - RNA, 21 nt, Human
acagcacaugcuggccagccu

SEQ ID NO: 2781304 - RNA, 22 nt, Human
acagauuugagcucagcccugg

SEQ ID NO: 2781305 - RNA, 15 nt, Human
acagauuugagcuca

SEQ ID NO: 2781306 - RNA, 20 nt, Human
acagauuuugggguuguguu

SEQ ID NO: 2781307 - RNA, 22 nt, Human
acagauuuugggguuguguugu

SEQ ID NO: 2781308 - RNA, 11 nt, Human
acagauuuuaa

SEQ ID NO: 2781309 - RNA, 14 nt, Human
acagauuuuaauug

SEQ ID NO: 2781310 - RNA, 17 nt, Human
acagauuuuaauuguca

SEQ ID NO: 2781311 - RNA, 18 nt, Human
acagauuuuaauugucau

SEQ ID NO: 2781312 - RNA, 19 nt, Human
acagauuuuaauugucaug

SEQ ID NO: 2781313 - RNA, 20 nt, Human
acagauuuuaauugucaugg

SEQ ID NO: 2781314 - RNA, 23 nt, Human
acagcccuccaucuaaacugccc

SEQ ID NO: 2781315 - RNA, 16 nt, Human
acagccccuccuccau

SEQ ID NO: 2781316 - RNA, 14 nt, Human
acagccccuccucc

SEQ ID NO: 2781317 - RNA, 17 nt, Human
acagcagccccugcaca

SEQ ID NO: 2781318 - RNA, 17 nt, Human
acagccccagagcaggg

SEQ ID NO: 2781319 - RNA, 12 nt, Human
acagcagcauuu

SEQ ID NO: 2781320 - RNA, 13 nt, Human
acagcagcauuuu

SEQ ID NO: 2781321 - RNA, 14 nt, Human
acagcagcauuuuu

SEQ ID NO: 2781322 - RNA, 19 nt, Human
acagcagcauuuuuauuuc

SEQ ID NO: 2781323 - RNA, 22 nt, Human
acagcagcauuuuuauuucaga

SEQ ID NO: 2781324 - RNA, 21 nt, Human
acagcagauaacaaugcagca

SEQ ID NO: 2781325 - RNA, 14 nt, Human
acagcagcaagaaa

SEQ ID NO: 2781326 - RNA, 15 nt, Human
acagcagcaagaaaa

SEQ ID NO: 2781327 - RNA, 16 nt, Human
acagcagcaagaaaaa

SEQ ID NO: 2781328 - RNA, 17 nt, Human
acagcagcaagaaaaaa

SEQ ID NO: 2781329 - RNA, 21 nt, Human
acagcagcaagaaaaaaaaau

SEQ ID NO: 2781330 - RNA, 22 nt, Human
acagcagcaagaaaaaaaaaug

SEQ ID NO: 2781331 - RNA, 23 nt, Human
acagcagcaagaaaaaaaaaugc

SEQ ID NO: 2781332 - RNA, 14 nt, Human
acagcacuggggag

SEQ ID NO: 2781333 - RNA, 19 nt, Human
acagcacgggggccaagga

SEQ ID NO: 2781334 - RNA, 16 nt, Human
acagcacuacugggug

SEQ ID NO: 2781335 - RNA, 17 nt, Human
acagcacuacugggugu

SEQ ID NO: 2781336 - RNA, 18 nt, Human
acagcacuacuggguguc

SEQ ID NO: 2781337 - RNA, 19 nt, Human
acagcacuacuggguguca

SEQ ID NO: 2781338 - RNA, 20 nt, Human
acagcacuacugggugucau

SEQ ID NO: 2781339 - RNA, 21 nt, Human
acagcacuacugggugucauu

SEQ ID NO: 2781340 - RNA, 22 nt, Human
acagcacuacugggugucauuu

SEQ ID NO: 2781341 - RNA, 15 nt, Human
uaugccccaaauaua

SEQ ID NO: 2781342 - RNA, 15 nt, Human
uaugcccacauuuag

SEQ ID NO: 2781343 - RNA, 18 nt, Human
uaugcccacauuuagucu

SEQ ID NO: 2781344 - RNA, 23 nt, Human
uaugcccacauuuagucucuuua

SEQ ID NO: 2781345 - RNA, 17 nt, Human
uaugccagcucaguccc

SEQ ID NO: 2781346 - RNA, 13 nt, Human
uaugccauagaaa

SEQ ID NO: 2781347 - RNA, 14 nt, Human
uaugccagcucagu

SEQ ID NO: 2781348 - RNA, 22 nt, Human
uaugccauagcaagauugcuua

SEQ ID NO: 2781349 - RNA, 20 nt, Human
uaugcauggaaaccugaaaa

SEQ ID NO: 2781350 - RNA, 17 nt, Human
uaugauaauagauucuc

SEQ ID NO: 2781351 - RNA, 13 nt, Human
uaugauaucccug

SEQ ID NO: 2781352 - RNA, 19 nt, Human
uaugcucucgcaccuuucc

SEQ ID NO: 2781353 - RNA, 13 nt, Human
uauggcauuugca

SEQ ID NO: 2781354 - RNA, 19 nt, Human
uauggcauuugcagauuuu

SEQ ID NO: 2781355 - RNA, 19 nt, Human
uauggccacauuuaauauc

SEQ ID NO: 2781356 - RNA, 23 nt, Human
uaugggacucaaugcacugacau

SEQ ID NO: 2781357 - RNA, 16 nt, Human
uaugggacucaaugca

SEQ ID NO: 2781358 - RNA, 18 nt, Human
uaugggaacacuggcaga

SEQ ID NO: 2781359 - RNA, 18 nt, Human
uaugggacugagccuggc

SEQ ID NO: 2781360 - RNA, 18 nt, Human
acagcggagucuguccug

SEQ ID NO: 2781361 - RNA, 13 nt, Human
acagcggccccug

SEQ ID NO: 2781362 - RNA, 22 nt, Human
acagcuaaucagcauucucacu

SEQ ID NO: 2781363 - RNA, 19 nt, Human
acagcggccccugcauccc

SEQ ID NO: 2781364 - RNA, 15 nt, Human
acagcggccccugca

SEQ ID NO: 2781365 - RNA, 16 nt, Human
acagcggccccugcau

SEQ ID NO: 2781366 - RNA, 17 nt, Human
acagcgagggcagcugc

SEQ ID NO: 2781367 - RNA, 16 nt, Human
acagcgagggcagcug

SEQ ID NO: 2781368 - RNA, 15 nt, Human
acagcgagggcagcu

SEQ ID NO: 2781369 - RNA, 14 nt, Human
acagcgagggcagc

SEQ ID NO: 2781370 - RNA, 23 nt, Human
acagcgagggcagcugcuauuua

SEQ ID NO: 2781371 - RNA, 19 nt, Human
acagcgagggcagcugcua

SEQ ID NO: 2781372 - RNA, 18 nt, Human
acagcgagggcagcugcu

SEQ ID NO: 2781373 - RNA, 16 nt, Human
uauggugaacccacaa

SEQ ID NO: 2781374 - RNA, 20 nt, Human
acagcgacauagcccauccc

SEQ ID NO: 2781375 - RNA, 14 nt, Human
acagcgacauagcc

SEQ ID NO: 2781376 - RNA, 19 nt, Human
uaugguccuaaaagcaaaa

SEQ ID NO: 2781377 - RNA, 20 nt, Human
uaugguauaaugguugacug

SEQ ID NO: 2781378 - RNA, 13 nt, Human
uaugguauaaugg

SEQ ID NO: 2781379 - RNA, 21 nt, Human
uauggucaaucccaaaaguca

SEQ ID NO: 2781380 - RNA, 15 nt, Human
uagaaacauugaaga

SEQ ID NO: 2781381 - RNA, 15 nt, Human
uagaaacccaagcuc

SEQ ID NO: 2781382 - RNA, 18 nt, Human
uagaaacccaagcuccuc

SEQ ID NO: 2781383 - RNA, 20 nt, Human
uagaaacccaagcuccuccu

SEQ ID NO: 2781384 - RNA, 21 nt, Human
uagaaacccaagcuccuccuc

SEQ ID NO: 2781385 - RNA, 14 nt, Human
uagaaaccuuaaua

SEQ ID NO: 2781386 - RNA, 15 nt, Human
uagaaaccuuaauau

SEQ ID NO: 2781387 - RNA, 19 nt, Human
uagaaacuaauugacuuua

SEQ ID NO: 2781388 - RNA, 19 nt, Human
uagaacuuuaagcaacaag

SEQ ID NO: 2781389 - RNA, 12 nt, Human
uagaacuuuuuu

SEQ ID NO: 2781390 - RNA, 15 nt, Human
uagaacuuuuuuaaa

SEQ ID NO: 2781391 - RNA, 16 nt, Human
uagaacuuuuuuaaau

SEQ ID NO: 2781392 - RNA, 17 nt, Human
uagaacuuuuuuaaaua

SEQ ID NO: 2781393 - RNA, 18 nt, Human
uagaacuuuuuuaaauaa

SEQ ID NO: 2781394 - RNA, 19 nt, Human
uagaacuuuuuuaaauaaa

SEQ ID NO: 2781395 - RNA, 20 nt, Human
uagaacuuuuuuaaauaaac

SEQ ID NO: 2781396 - RNA, 21 nt, Human
uagaacuuuuuuaaauaaacu

SEQ ID NO: 2781397 - RNA, 22 nt, Human
uagaacuuuuuuaaauaaacuu

SEQ ID NO: 2781398 - RNA, 23 nt, Human
uagaacuuuuuuaaauaaacuuu

SEQ ID NO: 2781399 - RNA, 18 nt, Human
uagaagaagcuaugucaa

SEQ ID NO: 2781400 - RNA, 13 nt, Human
uagaaacaugaca

SEQ ID NO: 2781401 - RNA, 14 nt, Human
uagaaacaugacac

SEQ ID NO: 2781402 - RNA, 16 nt, Human
uagaaacaugacacug

SEQ ID NO: 2781403 - RNA, 17 nt, Human
uagaaacaugacacuga

SEQ ID NO: 2781404 - RNA, 19 nt, Human
uagaaacaugacacugacc

SEQ ID NO: 2781405 - RNA, 15 nt, Human
uagaaaauucauaac

SEQ ID NO: 2781406 - RNA, 12 nt, Human
uagaaaaugugu

SEQ ID NO: 2781407 - RNA, 24 nt, Human
uagaaaauguguccuaucuaucuu

SEQ ID NO: 2781408 - RNA, 12 nt, Human
uagaaaaguuau

SEQ ID NO: 2781409 - RNA, 14 nt, Human
uagaaaaguuauua

SEQ ID NO: 2781410 - RNA, 21 nt, Human
uagaaaauagagcuuuuaaaa

SEQ ID NO: 2781411 - RNA, 23 nt, Human
uagaaaaucaagcagguuagaga

SEQ ID NO: 2781412 - RNA, 20 nt, Human
uagaaaagcugaucauaagu

SEQ ID NO: 2781413 - RNA, 21 nt, Human
uagaaaaggcuagguacacag

SEQ ID NO: 2781414 - RNA, 22 nt, Human
uagaaaacugaaaaucuaauau

SEQ ID NO: 2781415 - RNA, 15 nt, Human
uagaaaacugaaaau

SEQ ID NO: 2781416 - RNA, 16 nt, Human
uagaaaacugaaaauc

SEQ ID NO: 2781417 - RNA, 20 nt, Human
uagaaaacugaaaaucuaau

SEQ ID NO: 2781418 - RNA, 21 nt, Human
uagaaaacugaaaaucuaaua

SEQ ID NO: 2781419 - RNA, 17 nt, Human
aauuccaauuauaugag

SEQ ID NO: 2781420 - RNA, 16 nt, Human
aauuccacaccuuuua

SEQ ID NO: 2781421 - RNA, 13 nt, Human
aauuccacagcug

SEQ ID NO: 2781422 - RNA, 12 nt, Human
aauuccacagcu

SEQ ID NO: 2781423 - RNA, 14 nt, Human
aauuccacagcugc

SEQ ID NO: 2781424 - RNA, 20 nt, Human
aauuccacaccuuuuauuga

SEQ ID NO: 2781425 - RNA, 15 nt, Human
aauuccacucugaua

SEQ ID NO: 2781426 - RNA, 23 nt, Human
uacuuugauauuuucaacgcagc

SEQ ID NO: 2781427 - RNA, 18 nt, Human
uacuuugguuucugucug

SEQ ID NO: 2781428 - RNA, 19 nt, Human
uacuuugguuucugucugu

SEQ ID NO: 2781429 - RNA, 15 nt, Human
uagaaaaaaauuacu

SEQ ID NO: 2781430 - RNA, 18 nt, Human
uagaaaaaaguuuacaac

SEQ ID NO: 2781431 - RNA, 14 nt, Human
uacuuuuuuucaca

SEQ ID NO: 2781432 - RNA, 21 nt, Human
uacuuuuuuuuuuuuuuggua

SEQ ID NO: 2781433 - RNA, 18 nt, Human
uagaaaaauagcaacuug

SEQ ID NO: 2781434 - RNA, 13 nt, Human
uagaaaaaggguc

SEQ ID NO: 2781435 - RNA, 14 nt, Human
uagaaaaaggguca

SEQ ID NO: 2781436 - RNA, 21 nt, Human
uagaaaaagggucaaugcuau

SEQ ID NO: 2781437 - RNA, 13 nt, Human
uagaaaacugaaa

SEQ ID NO: 2781438 - RNA, 20 nt, Human
uagaaaaauucagcaaacca

SEQ ID NO: 2781439 - RNA, 15 nt, Human
uagaaaacaaugcaa

SEQ ID NO: 2781440 - RNA, 20 nt, Human
uagaaaacaaugcaaaaccu

SEQ ID NO: 2781441 - RNA, 20 nt, Human
uacuuuuuaaaagguauuuu

SEQ ID NO: 2781442 - RNA, 16 nt, Human
aauuccaauaugauga

SEQ ID NO: 2781443 - RNA, 16 nt, Human
uacuuuuccuuaccuu

SEQ ID NO: 2781444 - RNA, 13 nt, Human
uacuuuugagugu

SEQ ID NO: 2781445 - RNA, 14 nt, Human
uacuuuugagugug

SEQ ID NO: 2781446 - RNA, 16 nt, Human
uacuuuugagugugug

SEQ ID NO: 2781447 - RNA, 17 nt, Human
uacuuuugagugugugu

SEQ ID NO: 2781448 - RNA, 19 nt, Human
uacuuuucccauuuguaau

SEQ ID NO: 2781449 - RNA, 23 nt, Human
uacuuuuauuuuacacagaaaca

SEQ ID NO: 2781450 - RNA, 19 nt, Human
uacuuuuauuugcaacauu

SEQ ID NO: 2781451 - RNA, 21 nt, Human
uacuuuuauuugcaacauuua

SEQ ID NO: 2781452 - RNA, 16 nt, Human
uagaaaaguagacaau

SEQ ID NO: 2781453 - RNA, 13 nt, Human
uagacacagauaa

SEQ ID NO: 2781454 - RNA, 14 nt, Human
uagacacauuuaag

SEQ ID NO: 2781455 - RNA, 15 nt, Human
uagacacauuuaagg

SEQ ID NO: 2781456 - RNA, 17 nt, Human
uagacacauuuaaggau

SEQ ID NO: 2781457 - RNA, 14 nt, Human
uagacaccaaaguu

SEQ ID NO: 2781458 - RNA, 17 nt, Human
uagacaccaaaguucua

SEQ ID NO: 2781459 - RNA, 18 nt, Human
uagacaccaaaguucuaa

SEQ ID NO: 2781460 - RNA, 20 nt, Human
uagacaccaaaguucuaaua

SEQ ID NO: 2781461 - RNA, 21 nt, Human
uagacaccaaaguucuaauaa

SEQ ID NO: 2781462 - RNA, 21 nt, Human
uagacacuccccgaagucuuu

SEQ ID NO: 2781463 - RNA, 17 nt, Human
uagacacccauuuucac

SEQ ID NO: 2781464 - RNA, 18 nt, Human
uagacacccauuuucaca

SEQ ID NO: 2781465 - RNA, 14 nt, Human
uagacacccuggca

SEQ ID NO: 2781466 - RNA, 10 nt, Human
uagacagagu

SEQ ID NO: 2781467 - RNA, 22 nt, Human
uagaagggccaguccugccugg

SEQ ID NO: 2781468 - RNA, 19 nt, Human
uagaagggccaguccugcc

SEQ ID NO: 2781469 - RNA, 19 nt, Human
uagaagguucucuccuccc

SEQ ID NO: 2781470 - RNA, 19 nt, Human
uagaagguugacacaguug

SEQ ID NO: 2781471 - RNA, 14 nt, Human
uagaaguagauucu

SEQ ID NO: 2781472 - RNA, 16 nt, Human
uagaagcuguaguagc

SEQ ID NO: 2781473 - RNA, 23 nt, Human
uagaaggaaaaaaguuccuuccu

SEQ ID NO: 2781474 - RNA, 16 nt, Human
aauuugucuugccuua

SEQ ID NO: 2781475 - RNA, 22 nt, Human
aauuugggaagguuuguguuuu

SEQ ID NO: 2781476 - RNA, 17 nt, Human
aauuugggacccugcuu

SEQ ID NO: 2781477 - RNA, 18 nt, Human
aauuugggacccugcuuu

SEQ ID NO: 2781478 - RNA, 21 nt, Human
aauuugggacccugcuuuaga

SEQ ID NO: 2781479 - RNA, 15 nt, Human
aauuuuaauuuauuu

SEQ ID NO: 2781480 - RNA, 13 nt, Human
aauuuuaauuuau

SEQ ID NO: 2781481 - RNA, 12 nt, Human
aauuuuaauuua

SEQ ID NO: 2781482 - RNA, 14 nt, Human
aauuuuaauuuagu

SEQ ID NO: 2781483 - RNA, 16 nt, Human
aauuuggauugcuaau

SEQ ID NO: 2781484 - RNA, 18 nt, Human
aauuuggccugcacuaau

SEQ ID NO: 2781485 - RNA, 16 nt, Human
aauuugggcuuccugu

SEQ ID NO: 2781486 - RNA, 20 nt, Human
aauuugggcuuccuguuugu

SEQ ID NO: 2781487 - RNA, 11 nt, Human
aauuuggggac

SEQ ID NO: 2781488 - RNA, 20 nt, Human
aauuuggggacagauucagu

SEQ ID NO: 2781489 - RNA, 22 nt, Human
aauuuggggacagauucagucu

SEQ ID NO: 2781490 - RNA, 23 nt, Human
aauuuggggacagauucagucuu

SEQ ID NO: 2781491 - RNA, 24 nt, Human
aauuuggggacagauucagucuug

SEQ ID NO: 2781492 - RNA, 17 nt, Human
uagacauggagguucua

SEQ ID NO: 2781493 - RNA, 13 nt, Human
uagacauaacaaa

SEQ ID NO: 2781494 - RNA, 18 nt, Human
uagacagucucacuuugu

SEQ ID NO: 2781495 - RNA, 13 nt, Human
uagacaguuugua

SEQ ID NO: 2781496 - RNA, 15 nt, Human
uagacaguuuguaaa

SEQ ID NO: 2781497 - RNA, 18 nt, Human
uagacaguuuguaaaugu

SEQ ID NO: 2781498 - RNA, 20 nt, Human
uagacaguuuguaaauguua

SEQ ID NO: 2781499 - RNA, 21 nt, Human
uagacaguuuguaaauguuau

SEQ ID NO: 2781500 - RNA, 22 nt, Human
uagacaguuuguaaauguuauu

SEQ ID NO: 2781501 - RNA, 16 nt, Human
uagacaguuuugagaa

SEQ ID NO: 2781502 - RNA, 16 nt, Human
uagacauuuuaacaag

SEQ ID NO: 2781503 - RNA, 17 nt, Human
uagacauuuuaacaaga

SEQ ID NO: 2781504 - RNA, 18 nt, Human
uagacauuuuaacaagaa

SEQ ID NO: 2781505 - RNA, 19 nt, Human
uagacauuuuaacaagaag

SEQ ID NO: 2781506 - RNA, 21 nt, Human
uagacauuuuaacaagaagau

SEQ ID NO: 2781507 - RNA, 23 nt, Human
uagacauuuuaacaagaagauga

SEQ ID NO: 2781508 - RNA, 15 nt, Human
uagacauugaggacc

SEQ ID NO: 2781509 - RNA, 22 nt, Human
uagacauggagguucuaaggcc

SEQ ID NO: 2781510 - RNA, 23 nt, Human
uagacauggagguucuaaggccu

SEQ ID NO: 2781511 - RNA, 18 nt, Human
uagacauggagguucuaa

SEQ ID NO: 2781512 - RNA, 19 nt, Human
uagacauggagguucuaag

SEQ ID NO: 2781513 - RNA, 20 nt, Human
uagacauggagguucuaagg

SEQ ID NO: 2781514 - RNA, 21 nt, Human
uagacauggagguucuaaggc

SEQ ID NO: 2781515 - RNA, 14 nt, Human
uagaccaaaauaaa

SEQ ID NO: 2781516 - RNA, 13 nt, Human
uagaccaaaauaa

SEQ ID NO: 2781517 - RNA, 14 nt, Human
aauuuggaaauccu

SEQ ID NO: 2781518 - RNA, 18 nt, Human
aauuuuacccuuuagacu

SEQ ID NO: 2781519 - RNA, 15 nt, Human
acaaaaaacuccccu

SEQ ID NO: 2781520 - RNA, 17 nt, Human
aauuuuacccuuuagac

SEQ ID NO: 2781521 - RNA, 21 nt, Human
aauuuuacccuuuagacugua

SEQ ID NO: 2781522 - RNA, 23 nt, Human
aauuuuacuccauaaacagacug

SEQ ID NO: 2781523 - RNA, 13 nt, Human
aauuuuacacauu

SEQ ID NO: 2781524 - RNA, 14 nt, Human
acaaaaagcuuccc

SEQ ID NO: 2781525 - RNA, 15 nt, Human
acaaaaagcuucccc

SEQ ID NO: 2781526 - RNA, 19 nt, Human
acaaaaggcuccauauaua

SEQ ID NO: 2781527 - RNA, 11 nt, Human
acaaaaggguc

SEQ ID NO: 2781528 - RNA, 13 nt, Human
acaaaagggucag

SEQ ID NO: 2781529 - RNA, 14 nt, Human
acaaaagggucaga

SEQ ID NO: 2781530 - RNA, 15 nt, Human
acaaaacuacaugag

SEQ ID NO: 2781531 - RNA, 17 nt, Human
acaaaacccaugcauuu

SEQ ID NO: 2781532 - RNA, 14 nt, Human
acaaaauaaacaaa

SEQ ID NO: 2781533 - RNA, 12 nt, Human
acaaaauaaaca

SEQ ID NO: 2781534 - RNA, 23 nt, Human
acaaaacacucggcauuucaaau

SEQ ID NO: 2781535 - RNA, 16 nt, Human
acaaaaccuaacuugc

SEQ ID NO: 2781536 - RNA, 21 nt, Human
acaaaaccuaacuugcgcaga

SEQ ID NO: 2781537 - RNA, 16 nt, Human
acaaaacgcgcagaug

SEQ ID NO: 2781538 - RNA, 17 nt, Human
acaaaacgcgcagaugu

SEQ ID NO: 2781539 - RNA, 15 nt, Human
acaaaaaucagccag

SEQ ID NO: 2781540 - RNA, 17 nt, Human
acaaaaaucagccagac

SEQ ID NO: 2781541 - RNA, 18 nt, Human
acaaaaaucagccagaca

SEQ ID NO: 2781542 - RNA, 18 nt, Human
acaaaaaguuuccauaug

SEQ ID NO: 2781543 - RNA, 10 nt, Human
acaaaaauaa

SEQ ID NO: 2781544 - RNA, 12 nt, Human
acaaaaauaaau

SEQ ID NO: 2781545 - RNA, 14 nt, Human
acaaaaauaaauuu

SEQ ID NO: 2781546 - RNA, 20 nt, Human
acaaaaauaaauuuauauga

SEQ ID NO: 2781547 - RNA, 15 nt, Human
acaaaaauugacuca

SEQ ID NO: 2781548 - RNA, 13 nt, Human
acaaaaauuugaa

SEQ ID NO: 2781549 - RNA, 11 nt, Human
acaaaacaaaa

SEQ ID NO: 2781550 - RNA, 12 nt, Human
acaaaacaaaac

SEQ ID NO: 2781551 - RNA, 14 nt, Human
acaaaacaaaacaa

SEQ ID NO: 2781552 - RNA, 15 nt, Human
acaaaacaaaacaaa

SEQ ID NO: 2781553 - RNA, 16 nt, Human
acaaaacaaaacaaaa

SEQ ID NO: 2781554 - RNA, 18 nt, Human
acaaaacaaaacaaaacu

SEQ ID NO: 2781555 - RNA, 17 nt, Human
acaaaacaaaacaacau

SEQ ID NO: 2781556 - RNA, 14 nt, Human
acaaaacaaaacua

SEQ ID NO: 2781557 - RNA, 15 nt, Human
acaaaacaaaacuau

SEQ ID NO: 2781558 - RNA, 21 nt, Human
acaaagguuuuccucuucuau

SEQ ID NO: 2781559 - RNA, 14 nt, Human
acaaaguaauuccu

SEQ ID NO: 2781560 - RNA, 16 nt, Human
acaaauaauaagcaaa

SEQ ID NO: 2781561 - RNA, 12 nt, Human
acaaauaaucac

SEQ ID NO: 2781562 - RNA, 13 nt, Human
acaaauaaucaca

SEQ ID NO: 2781563 - RNA, 16 nt, Human
acaaauaacaaugugc

SEQ ID NO: 2781564 - RNA, 15 nt, Human
acaaauaauuuuagu

SEQ ID NO: 2781565 - RNA, 16 nt, Human
acaaaauauuucccau

SEQ ID NO: 2781566 - RNA, 20 nt, Human
acaaaauccagcuaugaaua

SEQ ID NO: 2781567 - RNA, 15 nt, Human
acaaaauagaagcug

SEQ ID NO: 2781568 - RNA, 18 nt, Human
acaaaauagaagcuguag

SEQ ID NO: 2781569 - RNA, 12 nt, Human
acaaaauagaag

SEQ ID NO: 2781570 - RNA, 24 nt, Human
acaaagguugagauguaaaaggua

SEQ ID NO: 2781571 - RNA, 14 nt, Human
acaaaaucuccucu

SEQ ID NO: 2781572 - RNA, 17 nt, Human
acaaaaucuguugccac

SEQ ID NO: 2781573 - RNA, 14 nt, Human
uagagccagggucu

SEQ ID NO: 2781574 - RNA, 17 nt, Human
uagagccugccuggagc

SEQ ID NO: 2781575 - RNA, 18 nt, Human
uagagccugccuggagcg

SEQ ID NO: 2781576 - RNA, 22 nt, Human
uagagccuucugaugucucuaa

SEQ ID NO: 2781577 - RNA, 12 nt, Human
uagagccugccu

SEQ ID NO: 2781578 - RNA, 13 nt, Human
uagagccugccug

SEQ ID NO: 2781579 - RNA, 16 nt, Human
uagagccugccuggag

SEQ ID NO: 2781580 - RNA, 23 nt, Human
uagagggaggagaaugagccucg

SEQ ID NO: 2781581 - RNA, 20 nt, Human
uagagggaccucucccaggg

SEQ ID NO: 2781582 - RNA, 19 nt, Human
uagagggaccucucccagg

SEQ ID NO: 2781583 - RNA, 15 nt, Human
uagagggaccucucc

SEQ ID NO: 2781584 - RNA, 14 nt, Human
uagcaaaaaguggg

SEQ ID NO: 2781585 - RNA, 18 nt, Human
uagcaaaaaguggggcag

SEQ ID NO: 2781586 - RNA, 22 nt, Human
uagcaaaacuaaauacuugcuc

SEQ ID NO: 2781587 - RNA, 15 nt, Human
uagcaaaacuuuuaa

SEQ ID NO: 2781588 - RNA, 16 nt, Human
uagcaaaacuuuuaaa

SEQ ID NO: 2781589 - RNA, 18 nt, Human
uagcaaaacuuuuaaacu

SEQ ID NO: 2781590 - RNA, 19 nt, Human
uagcaaaacuuuuaaacua

SEQ ID NO: 2781591 - RNA, 21 nt, Human
uagcaaaacuuuuaaacuaca

SEQ ID NO: 2781592 - RNA, 23 nt, Human
uagaggggggauuuccagccagg

SEQ ID NO: 2781593 - RNA, 12 nt, Human
uagauuuuuuca

SEQ ID NO: 2781594 - RNA, 18 nt, Human
uagcaaaaaaaacccaug

SEQ ID NO: 2781595 - RNA, 16 nt, Human
uagcaauuccaucacc

SEQ ID NO: 2781596 - RNA, 12 nt, Human
uagcaaacagag

SEQ ID NO: 2781597 - RNA, 15 nt, Human
uagcaaacagaggaa

SEQ ID NO: 2781598 - RNA, 14 nt, Human
uagcaaacuuugua

SEQ ID NO: 2781599 - RNA, 16 nt, Human
acaaaucaacagaagc

SEQ ID NO: 2781600 - RNA, 17 nt, Human
acaaaucaacagaagca

SEQ ID NO: 2781601 - RNA, 19 nt, Human
acaaaucaacagaagcauu

SEQ ID NO: 2781602 - RNA, 21 nt, Human
acaaaucaacagaagcauuug

SEQ ID NO: 2781603 - RNA, 23 nt, Human
acaaaucaacagaagcauuugua

SEQ ID NO: 2781604 - RNA, 14 nt, Human
uagccacucaggag

SEQ ID NO: 2781605 - RNA, 13 nt, Human
uagccacucagga

SEQ ID NO: 2781606 - RNA, 22 nt, Human
uagccacuaguaaguaauuaug

SEQ ID NO: 2781607 - RNA, 19 nt, Human
uagccaccccagaaauggu

SEQ ID NO: 2781608 - RNA, 16 nt, Human
uagccacauuuggaau

SEQ ID NO: 2781609 - RNA, 20 nt, Human
uagccacauuuggaauacuu

SEQ ID NO: 2781610 - RNA, 21 nt, Human
uagccacauuuggaauacuuu

SEQ ID NO: 2781611 - RNA, 20 nt, Human
uagcacuaccacuccugcca

SEQ ID NO: 2781612 - RNA, 14 nt, Human
uagcacuaggcacc

SEQ ID NO: 2781613 - RNA, 16 nt, Human
uagcacuaggcaccca

SEQ ID NO: 2781614 - RNA, 16 nt, Human
uagcacuaccacuccu

SEQ ID NO: 2781615 - RNA, 15 nt, Human
uagcacucaggcucu

SEQ ID NO: 2781616 - RNA, 19 nt, Human
uagcacucauuuucuauaa

SEQ ID NO: 2781617 - RNA, 11 nt, Human
uagcacuguug

SEQ ID NO: 2781618 - RNA, 16 nt, Human
uagcacuguugaugua

SEQ ID NO: 2781619 - RNA, 17 nt, Human
uagcacuguugauguau

SEQ ID NO: 2781620 - RNA, 18 nt, Human
uagcacuguugauguauc

SEQ ID NO: 2781621 - RNA, 19 nt, Human
uagcacuguugauguaucu

SEQ ID NO: 2781622 - RNA, 20 nt, Human
uagcacuguugauguaucug

SEQ ID NO: 2781623 - RNA, 23 nt, Human
uagcacuguugauguaucugagu

SEQ ID NO: 2781624 - RNA, 14 nt, Human
uagcacuuugaaau

SEQ ID NO: 2781625 - RNA, 15 nt, Human
uagcacuuugaaaua

SEQ ID NO: 2781626 - RNA, 17 nt, Human
uagcacuuugaaauacc

SEQ ID NO: 2781627 - RNA, 19 nt, Human
uagcacuuugaaauaccuc

SEQ ID NO: 2781628 - RNA, 20 nt, Human
uagcacuuugaaauaccuca

SEQ ID NO: 2781629 - RNA, 21 nt, Human
uagcacuuugaaauaccucau

SEQ ID NO: 2781630 - RNA, 18 nt, Human
uaggauuugaacacuugg

SEQ ID NO: 2781631 - RNA, 20 nt, Human
uaggcaaauguuuaaacauu

SEQ ID NO: 2781632 - RNA, 14 nt, Human
uaggauucuaaaau

SEQ ID NO: 2781633 - RNA, 12 nt, Human
uaggauucuaaa

SEQ ID NO: 2781634 - RNA, 16 nt, Human
uaggcauuaacacaaa

SEQ ID NO: 2781635 - RNA, 18 nt, Human
uaggcauuaacacaaagg

SEQ ID NO: 2781636 - RNA, 20 nt, Human
uaggcauuaacacaaaggag

SEQ ID NO: 2781637 - RNA, 19 nt, Human
uaggcauuaauguuucuau

SEQ ID NO: 2781638 - RNA, 17 nt, Human
uaggcaucucuguacuu

SEQ ID NO: 2781639 - RNA, 20 nt, Human
uaggcaugaagagcaaaaau

SEQ ID NO: 2781640 - RNA, 23 nt, Human
uaggcaugaagagcaaaaauauc

SEQ ID NO: 2781641 - RNA, 20 nt, Human
uaggcaguaggccggugugc

SEQ ID NO: 2781642 - RNA, 24 nt, Human
uaggcaguaggccggugugccuga

SEQ ID NO: 2781643 - RNA, 17 nt, Human
uaggcaggacaugcuga

SEQ ID NO: 2781644 - RNA, 22 nt, Human
uaggcaggacaugcugaagcca

SEQ ID NO: 2781645 - RNA, 16 nt, Human
uaggcaggacaugcug

SEQ ID NO: 2781646 - RNA, 21 nt, Human
uaggaaaaucacuuugucuaa

SEQ ID NO: 2781647 - RNA, 16 nt, Human
uaggaaauaaaaccuu

SEQ ID NO: 2781648 - RNA, 14 nt, Human
uaggaaauaaaacc

SEQ ID NO: 2781649 - RNA, 19 nt, Human
uaggaaagccucacugaua

SEQ ID NO: 2781650 - RNA, 21 nt, Human
uaggaaagccucacugauaua

SEQ ID NO: 2781651 - RNA, 11 nt, Human
uaggaaaggau

SEQ ID NO: 2781652 - RNA, 18 nt, Human
uaggagugugugacauuc

SEQ ID NO: 2781653 - RNA, 20 nt, Human
uaggagugugugacauucca

SEQ ID NO: 2781654 - RNA, 13 nt, Human
uaggaaacaagug

SEQ ID NO: 2781655 - RNA, 21 nt, Human
uaggagugggugacaagagcc

SEQ ID NO: 2781656 - RNA, 17 nt, Human
uaggaaauaaaaccuuu

SEQ ID NO: 2781657 - RNA, 21 nt, Human
uaggaguucgagaccagccug

SEQ ID NO: 2781658 - RNA, 17 nt, Human
uaggaguucgagaccag

SEQ ID NO: 2781659 - RNA, 23 nt, Human
uaggaguucgagaccagccuggc

SEQ ID NO: 2781660 - RNA, 22 nt, Human
uaggaaaaaaacuauuaaggau

SEQ ID NO: 2781661 - RNA, 16 nt, Human
uaggaugguaaaguua

SEQ ID NO: 2781662 - RNA, 18 nt, Human
uaggaugaaaagauucuu

SEQ ID NO: 2781663 - RNA, 18 nt, Human
uaggaugcucaguugcua

SEQ ID NO: 2781664 - RNA, 20 nt, Human
uaggaucuaaggcuguuugc

SEQ ID NO: 2781665 - RNA, 21 nt, Human
uaggaucuaaggcuguuugcu

SEQ ID NO: 2781666 - RNA, 20 nt, Human
uaggaucauuuguuggaaug

SEQ ID NO: 2781667 - RNA, 13 nt, Human
uaggauagcauuu

SEQ ID NO: 2781668 - RNA, 13 nt, Human
uagggaaagaaag

SEQ ID NO: 2781669 - RNA, 19 nt, Human
uagggaagcuggccugaga

SEQ ID NO: 2781670 - RNA, 19 nt, Human
uagggauggggcugugggg

SEQ ID NO: 2781671 - RNA, 14 nt, Human
uagggaugccuccu

SEQ ID NO: 2781672 - RNA, 15 nt, Human
uagggaugccuccuu

SEQ ID NO: 2781673 - RNA, 15 nt, Human
uagggcaauuggaac

SEQ ID NO: 2781674 - RNA, 15 nt, Human
uagggauucaggcug

SEQ ID NO: 2781675 - RNA, 16 nt, Human
uagggaugccuccuuu

SEQ ID NO: 2781676 - RNA, 16 nt, Human
uagggauucaggcugc

SEQ ID NO: 2781677 - RNA, 18 nt, Human
uagggauuuauuuucaau

SEQ ID NO: 2781678 - RNA, 23 nt, Human
uaggggcuuauaauaaaggacug

SEQ ID NO: 2781679 - RNA, 22 nt, Human
uaggggcuuauaauaaaggacu

SEQ ID NO: 2781680 - RNA, 21 nt, Human
uaggggcuuauaauaaaggac

SEQ ID NO: 2781681 - RNA, 13 nt, Human
uaggguaaaaauu

SEQ ID NO: 2781682 - RNA, 14 nt, Human
uaggguaaaaauug

SEQ ID NO: 2781683 - RNA, 14 nt, Human
uaggggucaaagaa

SEQ ID NO: 2781684 - RNA, 14 nt, Human
uaggggucacugua

SEQ ID NO: 2781685 - RNA, 11 nt, Human
uagggccaggc

SEQ ID NO: 2781686 - RNA, 14 nt, Human
uagggccaggcagg

SEQ ID NO: 2781687 - RNA, 14 nt, Human
uagggcugggaaac

SEQ ID NO: 2781688 - RNA, 16 nt, Human
uagggcugggaaacac

SEQ ID NO: 2781689 - RNA, 19 nt, Human
uagggcugggcaaggaaaa

SEQ ID NO: 2781690 - RNA, 20 nt, Human
uagggcugggcaaggaaaaa

SEQ ID NO: 2781691 - RNA, 21 nt, Human
uagggcugggcaaggaaaaag

SEQ ID NO: 2781692 - RNA, 14 nt, Human
uagggcuuaguguu

SEQ ID NO: 2781693 - RNA, 21 nt, Human
uagggccaggcaggugccugg

SEQ ID NO: 2781694 - RNA, 15 nt, Human
uagggccaggcaggu

SEQ ID NO: 2781695 - RNA, 17 nt, Human
acaaaucaguuaguuuu

SEQ ID NO: 2781696 - RNA, 21 nt, Human
acaaauccaaaggaaagaaua

SEQ ID NO: 2781697 - RNA, 14 nt, Human
acaaaucuauuuaa

SEQ ID NO: 2781698 - RNA, 20 nt, Human
acaaaucuauuuaauuagga

SEQ ID NO: 2781699 - RNA, 17 nt, Human
acaaaucuguguauauu

SEQ ID NO: 2781700 - RNA, 19 nt, Human
acaaaucuguguauauuau

SEQ ID NO: 2781701 - RNA, 20 nt, Human
acaaaucuguguauauuauu

SEQ ID NO: 2781702 - RNA, 15 nt, Human
acaauauuuauaaag

SEQ ID NO: 2781703 - RNA, 20 nt, Human
uagccuuagaagucacacag

SEQ ID NO: 2781704 - RNA, 19 nt, Human
acaaucagccacauucuag

SEQ ID NO: 2781705 - RNA, 12 nt, Human
acaaucacacuc

SEQ ID NO: 2781706 - RNA, 21 nt, Human
uagccuuagaagucacacagu

SEQ ID NO: 2781707 - RNA, 12 nt, Human
uagccuguggcc

SEQ ID NO: 2781708 - RNA, 13 nt, Human
uagccuguggccc

SEQ ID NO: 2781709 - RNA, 16 nt, Human
uagccuguggcccugu

SEQ ID NO: 2781710 - RNA, 20 nt, Human
uagccuguggcccuguccug

SEQ ID NO: 2781711 - RNA, 13 nt, Human
uagccuguggccu

SEQ ID NO: 2781712 - RNA, 15 nt, Human
uagccuguuucuucc

SEQ ID NO: 2781713 - RNA, 20 nt, Human
uagccuguuucuuccuguua

SEQ ID NO: 2781714 - RNA, 14 nt, Human
uagcgcccaguugg

SEQ ID NO: 2781715 - RNA, 17 nt, Human
uagcgcccaguugggug

SEQ ID NO: 2781716 - RNA, 13 nt, Human
uagcgcuguuuuu

SEQ ID NO: 2781717 - RNA, 19 nt, Human
uagcgugcccgugugcaug

SEQ ID NO: 2781718 - RNA, 16 nt, Human
uagcguuuuuuaaaug

SEQ ID NO: 2781719 - RNA, 18 nt, Human
uagcguuuuuuaaaugua

SEQ ID NO: 2781720 - RNA, 17 nt, Human
uagcguuuuuuaaaugu

SEQ ID NO: 2781721 - RNA, 13 nt, Human
uagcguucccaac

SEQ ID NO: 2781722 - RNA, 18 nt, Human
uagcguucccaacaacau

SEQ ID NO: 2781723 - RNA, 14 nt, Human
uagcuuuuuaauug

SEQ ID NO: 2781724 - RNA, 15 nt, Human
uagcuuuuuaauugu

SEQ ID NO: 2781725 - RNA, 16 nt, Human
uagcuuuuuaauuguu

SEQ ID NO: 2781726 - RNA, 20 nt, Human
uagcuuuuucauccccuuac

SEQ ID NO: 2781727 - RNA, 15 nt, Human
uagcuuuuuaaaaca

SEQ ID NO: 2781728 - RNA, 17 nt, Human
uagcuuuuuaaaacauu

SEQ ID NO: 2781729 - RNA, 18 nt, Human
uagcuuuuuaaaacauua

SEQ ID NO: 2781730 - RNA, 13 nt, Human
uagcuuuucccuu

SEQ ID NO: 2781731 - RNA, 18 nt, Human
uagcuuuuauuguauaaa

SEQ ID NO: 2781732 - RNA, 13 nt, Human
uagcuuuucaaac

SEQ ID NO: 2781733 - RNA, 13 nt, Human
uagcuuuucaccu

SEQ ID NO: 2781734 - RNA, 14 nt, Human
uagcuuuucaccuu

SEQ ID NO: 2781735 - RNA, 16 nt, Human
uagcuuuucaccuuua

SEQ ID NO: 2781736 - RNA, 15 nt, Human
uagcuuugcucuuug

SEQ ID NO: 2781737 - RNA, 14 nt, Human
uagcuuuuauugua

SEQ ID NO: 2781738 - RNA, 13 nt, Human
uagcuuuguguuu

SEQ ID NO: 2781739 - RNA, 14 nt, Human
uagcuuuguguuug

SEQ ID NO: 2781740 - RNA, 15 nt, Human
uagcuuuguguuugg

SEQ ID NO: 2781741 - RNA, 21 nt, Human
uagcuuuguguuugguuuaca

SEQ ID NO: 2781742 - RNA, 22 nt, Human
uagcuuuguguuugguuuacau

SEQ ID NO: 2781743 - RNA, 23 nt, Human
uagcuuuguguuugguuuacauu

SEQ ID NO: 2781744 - RNA, 14 nt, Human
uagcuuuuaggaaa

SEQ ID NO: 2781745 - RNA, 20 nt, Human
uagcuuuuaggaaaaucacu

SEQ ID NO: 2781746 - RNA, 20 nt, Human
uagcuuuauuuuuuaaguau

SEQ ID NO: 2781747 - RNA, 19 nt, Human
uagcuuuauuuuuuaagua

SEQ ID NO: 2781748 - RNA, 22 nt, Human
uagcuuuauuuuuuaaguauuu

SEQ ID NO: 2781749 - RNA, 15 nt, Human
uagcuuuauucuuca

SEQ ID NO: 2781750 - RNA, 19 nt, Human
uagcuuucccaaauaaacu

SEQ ID NO: 2781751 - RNA, 11 nt, Human
uagcuuugcuc

SEQ ID NO: 2781752 - RNA, 14 nt, Human
uagcuuugcucugc

SEQ ID NO: 2781753 - RNA, 16 nt, Human
uagcuuugcucugcca

SEQ ID NO: 2781754 - RNA, 23 nt, Human
uagcuaacauuuuaaauaaaaga

SEQ ID NO: 2781755 - RNA, 20 nt, Human
uagcuaacauuuuaaauaaa

SEQ ID NO: 2781756 - RNA, 14 nt, Human
uagcuaaguacaca

SEQ ID NO: 2781757 - RNA, 20 nt, Human
uagcuaaacggauuccaaag

SEQ ID NO: 2781758 - RNA, 19 nt, Human
uagcuaaacggauuccaaa

SEQ ID NO: 2781759 - RNA, 18 nt, Human
uagcuaaacggauuccaa

SEQ ID NO: 2781760 - RNA, 22 nt, Human
uagcguuuuuuaaauguauacu

SEQ ID NO: 2781761 - RNA, 21 nt, Human
uagcuucaccccaaucccagc

SEQ ID NO: 2781762 - RNA, 21 nt, Human
uagcuucuaccaugaacagaa

SEQ ID NO: 2781763 - RNA, 18 nt, Human
uagcuuuauauauggaca

SEQ ID NO: 2781764 - RNA, 19 nt, Human
uagcuuuauauauggacau

SEQ ID NO: 2781765 - RNA, 20 nt, Human
uagcuuuauauauggacaug

SEQ ID NO: 2781766 - RNA, 21 nt, Human
uagcuuuauauauggacaugg

SEQ ID NO: 2781767 - RNA, 18 nt, Human
uagcuuuauuuuuuaagu

SEQ ID NO: 2781768 - RNA, 13 nt, Human
uagcuuuauucuu

SEQ ID NO: 2781769 - RNA, 14 nt, Human
uagcuuuauucuuc

SEQ ID NO: 2781770 - RNA, 19 nt, Human
uagcuugggaggcuucccc

SEQ ID NO: 2781771 - RNA, 15 nt, Human
uagcuuggggccagg

SEQ ID NO: 2781772 - RNA, 17 nt, Human
uagcuuggggccaggga

SEQ ID NO: 2781773 - RNA, 13 nt, Human
uagcuuguauagu

SEQ ID NO: 2781774 - RNA, 17 nt, Human
uagcuuguauaguguaa

SEQ ID NO: 2781775 - RNA, 19 nt, Human
uagcuuguauaguguaaaa

SEQ ID NO: 2781776 - RNA, 15 nt, Human
uagcuuguucccugu

SEQ ID NO: 2781777 - RNA, 16 nt, Human
uagcuugcaccuuguc

SEQ ID NO: 2781778 - RNA, 13 nt, Human
acacaacacacac

SEQ ID NO: 2781779 - RNA, 13 nt, Human
acacaacagccaa

SEQ ID NO: 2781780 - RNA, 14 nt, Human
acacaacagccaac

SEQ ID NO: 2781781 - RNA, 18 nt, Human
acacaacagccaacagcu

SEQ ID NO: 2781782 - RNA, 19 nt, Human
acacaacagccaacagcua

SEQ ID NO: 2781783 - RNA, 14 nt, Human
acacaaaugcaggg

SEQ ID NO: 2781784 - RNA, 13 nt, Human
acacaaaugcaug

SEQ ID NO: 2781785 - RNA, 13 nt, Human
acacaaaggaagu

SEQ ID NO: 2781786 - RNA, 20 nt, Human
acacaaaggaagugcccccu

SEQ ID NO: 2781787 - RNA, 21 nt, Human
acacaaaggaagugcccccuc

SEQ ID NO: 2781788 - RNA, 13 nt, Human
acacaaaggggau

SEQ ID NO: 2781789 - RNA, 23 nt, Human
acacaaaggggaucauaaaguua

SEQ ID NO: 2781790 - RNA, 12 nt, Human
acaaugcaaaac

SEQ ID NO: 2781791 - RNA, 16 nt, Human
acaaugcaaaaccuuu

SEQ ID NO: 2781792 - RNA, 19 nt, Human
acaaugcaccuagcugugc

SEQ ID NO: 2781793 - RNA, 22 nt, Human
acaaugcaccuagcugugcaag

SEQ ID NO: 2781794 - RNA, 20 nt, Human
acaaugaugcccugcuccag

SEQ ID NO: 2781795 - RNA, 14 nt, Human
acacaauaagcaaa

SEQ ID NO: 2781796 - RNA, 15 nt, Human
acacaaguaagagac

SEQ ID NO: 2781797 - RNA, 16 nt, Human
acacaaguaagagacu

SEQ ID NO: 2781798 - RNA, 19 nt, Human
acacaaguaagagacucag

SEQ ID NO: 2781799 - RNA, 23 nt, Human
acacaaguaagagacucagccug

SEQ ID NO: 2781800 - RNA, 15 nt, Human
acacaaguccuguga

SEQ ID NO: 2781801 - RNA, 16 nt, Human
acacaaguccugugaa

SEQ ID NO: 2781802 - RNA, 13 nt, Human
acacaauaagcaa

SEQ ID NO: 2781803 - RNA, 17 nt, Human
acacaagcccacagcac

SEQ ID NO: 2781804 - RNA, 18 nt, Human
acacaagcccacagcaca

SEQ ID NO: 2781805 - RNA, 16 nt, Human
acacaaggucauggcc

SEQ ID NO: 2781806 - RNA, 20 nt, Human
acacaaggucauggccacac

SEQ ID NO: 2781807 - RNA, 21 nt, Human
acacaaggucauggccacacu

SEQ ID NO: 2781808 - RNA, 23 nt, Human
acacaaggucauggccacacugu

SEQ ID NO: 2781809 - RNA, 12 nt, Human
acacacacacau

SEQ ID NO: 2781810 - RNA, 13 nt, Human
acacacacacaua

SEQ ID NO: 2781811 - RNA, 14 nt, Human
acacacacacauac

SEQ ID NO: 2781812 - RNA, 15 nt, Human
acacacacacauaca

SEQ ID NO: 2781813 - RNA, 13 nt, Human
acacacacacaug

SEQ ID NO: 2781814 - RNA, 15 nt, Human
acacacacacacaug

SEQ ID NO: 2781815 - RNA, 12 nt, Human
uaggguggcccu

SEQ ID NO: 2781816 - RNA, 15 nt, Human
uagggugggccuuca

SEQ ID NO: 2781817 - RNA, 18 nt, Human
uaggguugcuggagccug

SEQ ID NO: 2781818 - RNA, 19 nt, Human
uaggguugguuccuuucca

SEQ ID NO: 2781819 - RNA, 15 nt, Human
uagggucggaaccca

SEQ ID NO: 2781820 - RNA, 22 nt, Human
uagggugaaccacuucauucug

SEQ ID NO: 2781821 - RNA, 13 nt, Human
uagggugcagcca

SEQ ID NO: 2781822 - RNA, 13 nt, Human
uaggguccugggg

SEQ ID NO: 2781823 - RNA, 16 nt, Human
uaggguacauuuauaa

SEQ ID NO: 2781824 - RNA, 18 nt, Human
uaggguacauuuauaauu

SEQ ID NO: 2781825 - RNA, 22 nt, Human
uaggguacauuuauaauugcau

SEQ ID NO: 2781826 - RNA, 14 nt, Human
uaggguacuaaauu

SEQ ID NO: 2781827 - RNA, 16 nt, Human
uaggguacuaaauuua

SEQ ID NO: 2781828 - RNA, 18 nt, Human
uaggguacuaaauuuaaa

SEQ ID NO: 2781829 - RNA, 19 nt, Human
uaggguacuaaauuuaaau

SEQ ID NO: 2781830 - RNA, 20 nt, Human
uaggguacuaaauuuaaauu

SEQ ID NO: 2781831 - RNA, 14 nt, Human
uagguaaaauguau

SEQ ID NO: 2781832 - RNA, 15 nt, Human
uagguaaaauguauu

SEQ ID NO: 2781833 - RNA, 16 nt, Human
uagguaaaauguauuu

SEQ ID NO: 2781834 - RNA, 21 nt, Human
uagguaaaauguauuuuucua

SEQ ID NO: 2781835 - RNA, 11 nt, Human
acacaggcagc

SEQ ID NO: 2781836 - RNA, 12 nt, Human
acacaggcagcu

SEQ ID NO: 2781837 - RNA, 15 nt, Human
acacaggcagcuuuc

SEQ ID NO: 2781838 - RNA, 16 nt, Human
acacaggcccggcucc

SEQ ID NO: 2781839 - RNA, 18 nt, Human
acacaggcccggcuccag

SEQ ID NO: 2781840 - RNA, 17 nt, Human
acacaggcccggcucca

SEQ ID NO: 2781841 - RNA, 15 nt, Human
acacacagauacaca

SEQ ID NO: 2781842 - RNA, 19 nt, Human
acacacagauacacacaca

SEQ ID NO: 2781843 - RNA, 23 nt, Human
acacacagauuugagcucagccc

SEQ ID NO: 2781844 - RNA, 15 nt, Human
acacacacacacauc

SEQ ID NO: 2781845 - RNA, 13 nt, Human
acacacacacauc

SEQ ID NO: 2781846 - RNA, 22 nt, Human
acacaggcccggcuccaggcuc

SEQ ID NO: 2781847 - RNA, 21 nt, Human
acacaggcccggcuccaggcu

SEQ ID NO: 2781848 - RNA, 20 nt, Human
acacaggcccggcuccaggc

SEQ ID NO: 2781849 - RNA, 19 nt, Human
acacaggcccggcuccagg

SEQ ID NO: 2781850 - RNA, 24 nt, Human
acacaggcccggcuccaggcuccu

SEQ ID NO: 2781851 - RNA, 23 nt, Human
acacaggcccggcuccaggcucc

SEQ ID NO: 2781852 - RNA, 12 nt, Human
acacaggcuggc

SEQ ID NO: 2781853 - RNA, 17 nt, Human
acacaggggaggugaua

SEQ ID NO: 2781854 - RNA, 21 nt, Human
acacaggggaggugauagcau

SEQ ID NO: 2781855 - RNA, 20 nt, Human
acacagggugacggugacaa

SEQ ID NO: 2781856 - RNA, 23 nt, Human
acacagggugacggugacaaaga

SEQ ID NO: 2781857 - RNA, 17 nt, Human
acacagguggugucacu

SEQ ID NO: 2781858 - RNA, 18 nt, Human
acacagguggugucacug

SEQ ID NO: 2781859 - RNA, 19 nt, Human
acacagguggugucacugu

SEQ ID NO: 2781860 - RNA, 20 nt, Human
acacagguggugucacuguc

SEQ ID NO: 2781861 - RNA, 21 nt, Human
acacagguggugucacugucc

SEQ ID NO: 2781862 - RNA, 22 nt, Human
acacagguggugucacuguccc

SEQ ID NO: 2781863 - RNA, 16 nt, Human
acacagguucacgugc

SEQ ID NO: 2781864 - RNA, 15 nt, Human
uaguaaaaauacaaa

SEQ ID NO: 2781865 - RNA, 16 nt, Human
acacacagaaaagcau

SEQ ID NO: 2781866 - RNA, 14 nt, Human
uaguaaaacacaga

SEQ ID NO: 2781867 - RNA, 15 nt, Human
uaguaaaacacagag

SEQ ID NO: 2781868 - RNA, 16 nt, Human
uaguaaaacacagagg

SEQ ID NO: 2781869 - RNA, 14 nt, Human
uaguaaucacaguu

SEQ ID NO: 2781870 - RNA, 19 nt, Human
uagguuuuuuuguauagua

SEQ ID NO: 2781871 - RNA, 15 nt, Human
uagguuuuuuuguau

SEQ ID NO: 2781872 - RNA, 21 nt, Human
uagguuuuuccuuauuugcuu

SEQ ID NO: 2781873 - RNA, 15 nt, Human
uagguuuuuguuugu

SEQ ID NO: 2781874 - RNA, 13 nt, Human
uaguaaaaauaaa

SEQ ID NO: 2781875 - RNA, 16 nt, Human
uaguaaaaauaaaauu

SEQ ID NO: 2781876 - RNA, 14 nt, Human
uaguagagacaggg

SEQ ID NO: 2781877 - RNA, 14 nt, Human
uaguaauugacaug

SEQ ID NO: 2781878 - RNA, 14 nt, Human
uaguaauucucagg

SEQ ID NO: 2781879 - RNA, 15 nt, Human
uaguaauucucaggc

SEQ ID NO: 2781880 - RNA, 15 nt, Human
uaguaaucacaguug

SEQ ID NO: 2781881 - RNA, 12 nt, Human
uaguaaucugua

SEQ ID NO: 2781882 - RNA, 15 nt, Human
uaguaaucuguacau

SEQ ID NO: 2781883 - RNA, 16 nt, Human
uaguaaucuguacauu

SEQ ID NO: 2781884 - RNA, 22 nt, Human
uaguagagacaggguuuugcca

SEQ ID NO: 2781885 - RNA, 15 nt, Human
uaguagagacagggu

SEQ ID NO: 2781886 - RNA, 23 nt, Human
uagucacauggccuaugcacaua

SEQ ID NO: 2781887 - RNA, 13 nt, Human
uaguagagacggg

SEQ ID NO: 2781888 - RNA, 13 nt, Human
acuauguugauaa

SEQ ID NO: 2781889 - RNA, 11 nt, Human
acuauuauuau

SEQ ID NO: 2781890 - RNA, 20 nt, Human
acuauuauuauagguaauca

SEQ ID NO: 2781891 - RNA, 15 nt, Human
acuauguauauacau

SEQ ID NO: 2781892 - RNA, 16 nt, Human
acuauguaaacuacuu

SEQ ID NO: 2781893 - RNA, 14 nt, Human
acuauguaaacuac

SEQ ID NO: 2781894 - RNA, 12 nt, Human
acuauguaaacu

SEQ ID NO: 2781895 - RNA, 11 nt, Human
acuauguaaac

SEQ ID NO: 2781896 - RNA, 15 nt, Human
acuaugauuuggaaa

SEQ ID NO: 2781897 - RNA, 15 nt, Human
acuaugacugcuccc

SEQ ID NO: 2781898 - RNA, 16 nt, Human
acuaugauuuggaaaa

SEQ ID NO: 2781899 - RNA, 13 nt, Human
acuagaugaccuc

SEQ ID NO: 2781900 - RNA, 14 nt, Human
acuagaugaccuca

SEQ ID NO: 2781901 - RNA, 15 nt, Human
acuagaugaccucau

SEQ ID NO: 2781902 - RNA, 17 nt, Human
acuagaugaccucauua

SEQ ID NO: 2781903 - RNA, 18 nt, Human
acuagaugaccucauuaa

SEQ ID NO: 2781904 - RNA, 15 nt, Human
uccccgucucauucc

SEQ ID NO: 2781905 - RNA, 13 nt, Human
uccccguggucuc

SEQ ID NO: 2781906 - RNA, 14 nt, Human
uccccguuccugac

SEQ ID NO: 2781907 - RNA, 15 nt, Human
uccccguuccugaca

SEQ ID NO: 2781908 - RNA, 17 nt, Human
uccccguuccugacauc

SEQ ID NO: 2781909 - RNA, 20 nt, Human
uccccguuccugacaucaca

SEQ ID NO: 2781910 - RNA, 13 nt, Human
uccccggcucgag

SEQ ID NO: 2781911 - RNA, 16 nt, Human
uccccgggcaucuuug

SEQ ID NO: 2781912 - RNA, 17 nt, Human
uccccgggcaucuuugg

SEQ ID NO: 2781913 - RNA, 21 nt, Human
uccccgggcaucuuuggggag

SEQ ID NO: 2781914 - RNA, 11 nt, Human
uccccggggcc

SEQ ID NO: 2781915 - RNA, 13 nt, Human
uccccggggccca

SEQ ID NO: 2781916 - RNA, 15 nt, Human
uccccggggcccagg

SEQ ID NO: 2781917 - RNA, 16 nt, Human
uccccggggcccaggg

SEQ ID NO: 2781918 - RNA, 17 nt, Human
uccccggggcccagggg

SEQ ID NO: 2781919 - RNA, 18 nt, Human
uccccuccuucucccuuu

SEQ ID NO: 2781920 - RNA, 14 nt, Human
uccccuccuucucc

SEQ ID NO: 2781921 - RNA, 14 nt, Human
uccccucucugcac

SEQ ID NO: 2781922 - RNA, 20 nt, Human
uccccucugcugcugucccu

SEQ ID NO: 2781923 - RNA, 17 nt, Human
uccccucuucccuucaa

SEQ ID NO: 2781924 - RNA, 18 nt, Human
uccccucuucccuucaac

SEQ ID NO: 2781925 - RNA, 15 nt, Human
uccccucugcugcug

SEQ ID NO: 2781926 - RNA, 17 nt, Human
uccccucugcugcuguc

SEQ ID NO: 2781927 - RNA, 15 nt, Human
uccccucugaaaguu

SEQ ID NO: 2781928 - RNA, 21 nt, Human
uccccucugaaaguuguacau

SEQ ID NO: 2781929 - RNA, 22 nt, Human
uccccucugaaaguuguacaug

SEQ ID NO: 2781930 - RNA, 13 nt, Human
uccccucugcugc

SEQ ID NO: 2781931 - RNA, 14 nt, Human
uccccucugcugcu

SEQ ID NO: 2781932 - RNA, 14 nt, Human
acucaaugcacuga

SEQ ID NO: 2781933 - RNA, 23 nt, Human
acucaaucuccccuugcacuaaa

SEQ ID NO: 2781934 - RNA, 16 nt, Human
acuagacacagauaau

SEQ ID NO: 2781935 - RNA, 20 nt, Human
acucacauuuauucugcuca

SEQ ID NO: 2781936 - RNA, 19 nt, Human
acucacauuuauucugcuc

SEQ ID NO: 2781937 - RNA, 14 nt, Human
uccccggcacccuc

SEQ ID NO: 2781938 - RNA, 17 nt, Human
uccccggcacccucugg

SEQ ID NO: 2781939 - RNA, 18 nt, Human
uccccggcacccucuggc

SEQ ID NO: 2781940 - RNA, 19 nt, Human
uccccggcacccucuggcc

SEQ ID NO: 2781941 - RNA, 20 nt, Human
uccccggcacccucuggccg

SEQ ID NO: 2781942 - RNA, 22 nt, Human
acuagagggaccucucccaggg

SEQ ID NO: 2781943 - RNA, 19 nt, Human
acuagagggaccucuccca

SEQ ID NO: 2781944 - RNA, 17 nt, Human
acuagacaccaaaguuc

SEQ ID NO: 2781945 - RNA, 18 nt, Human
acuagacaccaaaguucu

SEQ ID NO: 2781946 - RNA, 21 nt, Human
acuagagggaccucucccagg

SEQ ID NO: 2781947 - RNA, 20 nt, Human
acuagagggaccucucccag

SEQ ID NO: 2781948 - RNA, 23 nt, Human
acuagaagggccaguccugccug

SEQ ID NO: 2781949 - RNA, 14 nt, Human
acuagaagggccag

SEQ ID NO: 2781950 - RNA, 16 nt, Human
acuagaacucuccauc

SEQ ID NO: 2781951 - RNA, 13 nt, Human
acuagaauucugu

SEQ ID NO: 2781952 - RNA, 19 nt, Human
acuacuugauuuuauugua

SEQ ID NO: 2781953 - RNA, 13 nt, Human
acuacuuugccuu

SEQ ID NO: 2781954 - RNA, 21 nt, Human
acuacuuugccuucuuuugua

SEQ ID NO: 2781955 - RNA, 20 nt, Human
acuacuuuaauaaagaauua

SEQ ID NO: 2781956 - RNA, 17 nt, Human
acuacuuagcauccuaa

SEQ ID NO: 2781957 - RNA, 21 nt, Human
acuacuuagcauccuaagaaa

SEQ ID NO: 2781958 - RNA, 22 nt, Human
acuacuuagcauccuaagaaau

SEQ ID NO: 2781959 - RNA, 16 nt, Human
acuacuucucucugua

SEQ ID NO: 2781960 - RNA, 15 nt, Human
acuagaaaucugcca

SEQ ID NO: 2781961 - RNA, 15 nt, Human
acuagaacucuccau

SEQ ID NO: 2781962 - RNA, 13 nt, Human
acuagaacucucc

SEQ ID NO: 2781963 - RNA, 18 nt, Human
acuacggaauaguuggcu

SEQ ID NO: 2781964 - RNA, 12 nt, Human
acuaccugugua

SEQ ID NO: 2781965 - RNA, 15 nt, Human
acuaccuuaucacug

SEQ ID NO: 2781966 - RNA, 17 nt, Human
acuaccuugaaaauaag

SEQ ID NO: 2781967 - RNA, 13 nt, Human
acguacacacaca

SEQ ID NO: 2781968 - RNA, 19 nt, Human
uccccacugacagccuccc

SEQ ID NO: 2781969 - RNA, 16 nt, Human
uccccacugacagccu

SEQ ID NO: 2781970 - RNA, 23 nt, Human
uccccacggggccucgggaccuc

SEQ ID NO: 2781971 - RNA, 22 nt, Human
uccccacggggccucgggaccu

SEQ ID NO: 2781972 - RNA, 15 nt, Human
acggucagguuuaac

SEQ ID NO: 2781973 - RNA, 16 nt, Human
acggucagguuuaaca

SEQ ID NO: 2781974 - RNA, 17 nt, Human
acggucagguuuaacau

SEQ ID NO: 2781975 - RNA, 20 nt, Human
acggucagguuuaacauuug

SEQ ID NO: 2781976 - RNA, 23 nt, Human
acggucagguuuaacauuugccu

SEQ ID NO: 2781977 - RNA, 13 nt, Human
acggucaguuugg

SEQ ID NO: 2781978 - RNA, 18 nt, Human
uccccacgcccuccccuc

SEQ ID NO: 2781979 - RNA, 19 nt, Human
uccccacgcccuccccucc

SEQ ID NO: 2781980 - RNA, 22 nt, Human
ucccccaacccccaccccacac

SEQ ID NO: 2781981 - RNA, 14 nt, Human
uccccaucuggguc

SEQ ID NO: 2781982 - RNA, 15 nt, Human
uccccaucugucggc

SEQ ID NO: 2781983 - RNA, 17 nt, Human
uccccaucugucggccu

SEQ ID NO: 2781984 - RNA, 12 nt, Human
ucccccaacucu

SEQ ID NO: 2781985 - RNA, 17 nt, Human
ucccccaacucugagcc

SEQ ID NO: 2781986 - RNA, 18 nt, Human
ucccccaacucugagccc

SEQ ID NO: 2781987 - RNA, 21 nt, Human
ucccccaacucugagcccaug

SEQ ID NO: 2781988 - RNA, 19 nt, Human
ucccccacaguuugauguc

SEQ ID NO: 2781989 - RNA, 14 nt, Human
uccccacgcccucc

SEQ ID NO: 2781990 - RNA, 14 nt, Human
ucccccaacuugag

SEQ ID NO: 2781991 - RNA, 23 nt, Human
ucccccaccgguccagcuggccu

SEQ ID NO: 2781992 - RNA, 22 nt, Human
ucccccaccgguccagcuggcc

SEQ ID NO: 2781993 - RNA, 21 nt, Human
ucccccaccgguccagcuggc

SEQ ID NO: 2781994 - RNA, 20 nt, Human
ucccccaccgguccagcugg

SEQ ID NO: 2781995 - RNA, 19 nt, Human
ucccccaccgguccagcug

SEQ ID NO: 2781996 - RNA, 23 nt, Human
uccccaguucgccuggagcccuc

SEQ ID NO: 2781997 - RNA, 18 nt, Human
uccccaucaucuguggaa

SEQ ID NO: 2781998 - RNA, 17 nt, Human
uccccauaacucaaugg

SEQ ID NO: 2781999 - RNA, 16 nt, Human
uccccagucccaaugc

SEQ ID NO: 2782000 - RNA, 22 nt, Human
uccccagucucucuuaaaguug

SEQ ID NO: 2782001 - RNA, 19 nt, Human
acucauuuuuuuaauuuau

SEQ ID NO: 2782002 - RNA, 18 nt, Human
acuccaaaacccaugugg

SEQ ID NO: 2782003 - RNA, 16 nt, Human
acucauuuuuuuaauu

SEQ ID NO: 2782004 - RNA, 15 nt, Human
acucauuuuugccau

SEQ ID NO: 2782005 - RNA, 19 nt, Human
acucauuuuugccauacau

SEQ ID NO: 2782006 - RNA, 21 nt, Human
acucauuuuugccauacauca

SEQ ID NO: 2782007 - RNA, 19 nt, Human
acuccaccagauagcagag

SEQ ID NO: 2782008 - RNA, 19 nt, Human
acucaucuuacuguaccug

SEQ ID NO: 2782009 - RNA, 15 nt, Human
acucauuuucuauaa

SEQ ID NO: 2782010 - RNA, 16 nt, Human
acucauuuucuauaac

SEQ ID NO: 2782011 - RNA, 21 nt, Human
acucauuuucuauaacagaua

SEQ ID NO: 2782012 - RNA, 22 nt, Human
acucagaguucuauacuguaaa

SEQ ID NO: 2782013 - RNA, 12 nt, Human
acucagaccuga

SEQ ID NO: 2782014 - RNA, 15 nt, Human
acucagaccagagaa

SEQ ID NO: 2782015 - RNA, 17 nt, Human
acucagaauuauuuuua

SEQ ID NO: 2782016 - RNA, 18 nt, Human
acucagaauuauuuuuaa

SEQ ID NO: 2782017 - RNA, 18 nt, Human
acucagaagacacugaug

SEQ ID NO: 2782018 - RNA, 20 nt, Human
acucagaagccucuggguca

SEQ ID NO: 2782019 - RNA, 16 nt, Human
acucagaagccucugg

SEQ ID NO: 2782020 - RNA, 15 nt, Human
acucagaagccucug

SEQ ID NO: 2782021 - RNA, 12 nt, Human
acucagaagccu

SEQ ID NO: 2782022 - RNA, 18 nt, Human
acucagaagccugaggcu

SEQ ID NO: 2782023 - RNA, 17 nt, Human
acucagaagccugaggc

SEQ ID NO: 2782024 - RNA, 16 nt, Human
acucagaagccugagg

SEQ ID NO: 2782025 - RNA, 15 nt, Human
acucagaagccugag

SEQ ID NO: 2782026 - RNA, 14 nt, Human
acucagaagccuga

SEQ ID NO: 2782027 - RNA, 13 nt, Human
acucagaagccug

SEQ ID NO: 2782028 - RNA, 14 nt, Human
acucagaauauugc

SEQ ID NO: 2782029 - RNA, 17 nt, Human
acucagaagacacugau

SEQ ID NO: 2782030 - RNA, 16 nt, Human
acucagaagacacuga

SEQ ID NO: 2782031 - RNA, 15 nt, Human
acucagaagacacug

SEQ ID NO: 2782032 - RNA, 14 nt, Human
acucagaagacacu

SEQ ID NO: 2782033 - RNA, 21 nt, Human
acucagaacugucggaggaaa

SEQ ID NO: 2782034 - RNA, 22 nt, Human
acucagaacugucggaggaaag

SEQ ID NO: 2782035 - RNA, 23 nt, Human
acucagaacugucggaggaaaga

SEQ ID NO: 2782036 - RNA, 23 nt, Human
ucccucauuucaggagcagccuc

SEQ ID NO: 2782037 - RNA, 15 nt, Human
ucccucauuucagga

SEQ ID NO: 2782038 - RNA, 19 nt, Human
ucccucauuucaggagcag

SEQ ID NO: 2782039 - RNA, 13 nt, Human
ucccucccaggac

SEQ ID NO: 2782040 - RNA, 14 nt, Human
ucccucccaggacu

SEQ ID NO: 2782041 - RNA, 18 nt, Human
ucccucccaucaugcccg

SEQ ID NO: 2782042 - RNA, 15 nt, Human
ucccuccccagcucc

SEQ ID NO: 2782043 - RNA, 14 nt, Human
ucccuccccugccc

SEQ ID NO: 2782044 - RNA, 16 nt, Human
ucccuccccugccauu

SEQ ID NO: 2782045 - RNA, 13 nt, Human
ucccuccccugcc

SEQ ID NO: 2782046 - RNA, 14 nt, Human
ucccucccccuugu

SEQ ID NO: 2782047 - RNA, 12 nt, Human
ucccucccccuu

SEQ ID NO: 2782048 - RNA, 19 nt, Human
ucccuccccugcccugguc

SEQ ID NO: 2782049 - RNA, 17 nt, Human
ucccuccccugcccugg

SEQ ID NO: 2782050 - RNA, 16 nt, Human
ucccuccccugcccug

SEQ ID NO: 2782051 - RNA, 15 nt, Human
ucccuccccugcccu

SEQ ID NO: 2782052 - RNA, 16 nt, Human
ucccucuucuuucaga

SEQ ID NO: 2782053 - RNA, 20 nt, Human
ucccucuucuuucagacuug

SEQ ID NO: 2782054 - RNA, 22 nt, Human
ucccuccccuggggacagcaag

SEQ ID NO: 2782055 - RNA, 14 nt, Human
ucccuccaccuacc

SEQ ID NO: 2782056 - RNA, 23 nt, Human
ucccucauuccaccuucccaugc

SEQ ID NO: 2782057 - RNA, 23 nt, Human
uccccucuuuuguuaaauaauau

SEQ ID NO: 2782058 - RNA, 12 nt, Human
uccccugagccc

SEQ ID NO: 2782059 - RNA, 16 nt, Human
ucccugaagccagccu

SEQ ID NO: 2782060 - RNA, 17 nt, Human
ucccugaagccagccuu

SEQ ID NO: 2782061 - RNA, 18 nt, Human
ucccugaagccagccuuc

SEQ ID NO: 2782062 - RNA, 17 nt, Human
ucccugaaaauguuuuu

SEQ ID NO: 2782063 - RNA, 13 nt, Human
ucccugaaacacg

SEQ ID NO: 2782064 - RNA, 21 nt, Human
ucccugaaacacgaaacuugu

SEQ ID NO: 2782065 - RNA, 22 nt, Human
ucccugaaacacgaaacuuguu

SEQ ID NO: 2782066 - RNA, 12 nt, Human
ucccugaagcca

SEQ ID NO: 2782067 - RNA, 15 nt, Human
ucccugaagccagcc

SEQ ID NO: 2782068 - RNA, 12 nt, Human
ucccucuuguuu

SEQ ID NO: 2782069 - RNA, 13 nt, Human
ucccucuuguuuu

SEQ ID NO: 2782070 - RNA, 15 nt, Human
ucccucuuguuuugu

SEQ ID NO: 2782071 - RNA, 16 nt, Human
ucccucuuguuuuguu

SEQ ID NO: 2782072 - RNA, 17 nt, Human
ucccucuuguuuuguuu

SEQ ID NO: 2782073 - RNA, 19 nt, Human
ucccucuuguuuuguuugu

SEQ ID NO: 2782074 - RNA, 20 nt, Human
ucccucuuguuuuguuuguc

SEQ ID NO: 2782075 - RNA, 21 nt, Human
ucccucuuguuuuguuugucu

SEQ ID NO: 2782076 - RNA, 22 nt, Human
ucccucuuguuuuguuugucuc

SEQ ID NO: 2782077 - RNA, 18 nt, Human
ucccucuuuggcuccccu

SEQ ID NO: 2782078 - RNA, 23 nt, Human
ucccucuuuggcuccccuguacc

SEQ ID NO: 2782079 - RNA, 10 nt, Human
ucccucuuuu

SEQ ID NO: 2782080 - RNA, 13 nt, Human
ucccucuuuucuu

SEQ ID NO: 2782081 - RNA, 14 nt, Human
ucccucuuuucuua

SEQ ID NO: 2782082 - RNA, 16 nt, Human
ucccucuuuucuuacu

SEQ ID NO: 2782083 - RNA, 18 nt, Human
ucccucuuuucuuacucc

SEQ ID NO: 2782084 - RNA, 22 nt, Human
ucccucuuuucuuacuccuccu

SEQ ID NO: 2782085 - RNA, 19 nt, Human
acucaccccggcagacgcc

SEQ ID NO: 2782086 - RNA, 20 nt, Human
acucaccucccccaucucuu

SEQ ID NO: 2782087 - RNA, 19 nt, Human
acucaccucccccaucucu

SEQ ID NO: 2782088 - RNA, 14 nt, Human
ucccugacccgucu

SEQ ID NO: 2782089 - RNA, 21 nt, Human
ucccugaaucccccuugccac

SEQ ID NO: 2782090 - RNA, 13 nt, Human
acuccaccuuccc

SEQ ID NO: 2782091 - RNA, 18 nt, Human
acuccacgauccugccac

SEQ ID NO: 2782092 - RNA, 19 nt, Human
acuccacgauccugccacc

SEQ ID NO: 2782093 - RNA, 21 nt, Human
uccggcccuccuacccugcgc

SEQ ID NO: 2782094 - RNA, 23 nt, Human
uccggcccuccuacccugcgccc

SEQ ID NO: 2782095 - RNA, 15 nt, Human
uccguggguugcuaa

SEQ ID NO: 2782096 - RNA, 16 nt, Human
uccguggguugcuaac

SEQ ID NO: 2782097 - RNA, 20 nt, Human
uccguggguugcuaacugaa

SEQ ID NO: 2782098 - RNA, 21 nt, Human
uccguggguugcuaacugaac

SEQ ID NO: 2782099 - RNA, 18 nt, Human
uccgugucaccgccaccc

SEQ ID NO: 2782100 - RNA, 16 nt, Human
uccguguggauccaau

SEQ ID NO: 2782101 - RNA, 17 nt, Human
uccguguggauccaaug

SEQ ID NO: 2782102 - RNA, 13 nt, Human
uccuacccuuuuc

SEQ ID NO: 2782103 - RNA, 14 nt, Human
uccuacccuuuucu

SEQ ID NO: 2782104 - RNA, 13 nt, Human
uccuaccucagcc

SEQ ID NO: 2782105 - RNA, 12 nt, Human
uccuaccucagc

SEQ ID NO: 2782106 - RNA, 15 nt, Human
uccuacccugcgccc

SEQ ID NO: 2782107 - RNA, 20 nt, Human
uccuacccugcgcccagucc

SEQ ID NO: 2782108 - RNA, 17 nt, Human
uccuagccacucaggag

SEQ ID NO: 2782109 - RNA, 13 nt, Human
uccuagccacuca

SEQ ID NO: 2782110 - RNA, 14 nt, Human
uccuagccuguuuc

SEQ ID NO: 2782111 - RNA, 15 nt, Human
uccuagccuguuucu

SEQ ID NO: 2782112 - RNA, 16 nt, Human
uccuagccuguuucuu

SEQ ID NO: 2782113 - RNA, 17 nt, Human
uccuagccuguuucuuc

SEQ ID NO: 2782114 - RNA, 19 nt, Human
uccuagccuguuucuuccu

SEQ ID NO: 2782115 - RNA, 22 nt, Human
uccuacucucacacugguucuc

SEQ ID NO: 2782116 - RNA, 20 nt, Human
uccuacgucaaacaugaagu

SEQ ID NO: 2782117 - RNA, 12 nt, Human
uccuacuccuga

SEQ ID NO: 2782118 - RNA, 13 nt, Human
uccuacuccugac

SEQ ID NO: 2782119 - RNA, 14 nt, Human
uccuacuccugacu

SEQ ID NO: 2782120 - RNA, 17 nt, Human
uccuaccucagccuaga

SEQ ID NO: 2782121 - RNA, 14 nt, Human
uccuaccugcccug

SEQ ID NO: 2782122 - RNA, 15 nt, Human
uccuaccugcccugg

SEQ ID NO: 2782123 - RNA, 16 nt, Human
uccuaccugcccugga

SEQ ID NO: 2782124 - RNA, 18 nt, Human
uccuaccugcccuggaac

SEQ ID NO: 2782125 - RNA, 16 nt, Human
uccuaccucagccuag

SEQ ID NO: 2782126 - RNA, 14 nt, Human
uccuaccucagccu

SEQ ID NO: 2782127 - RNA, 19 nt, Human
acucgauucauauugaaua

SEQ ID NO: 2782128 - RNA, 18 nt, Human
acucgagucacacucaag

SEQ ID NO: 2782129 - RNA, 21 nt, Human
acuccuuuugguguguuggac

SEQ ID NO: 2782130 - RNA, 11 nt, Human
acuccuugcau

SEQ ID NO: 2782131 - RNA, 12 nt, Human
acuccuugcauc

SEQ ID NO: 2782132 - RNA, 15 nt, Human
acuccuugcaucaag

SEQ ID NO: 2782133 - RNA, 17 nt, Human
acuccuugcaucaaggg

SEQ ID NO: 2782134 - RNA, 19 nt, Human
acuccuugcaucaaggggu

SEQ ID NO: 2782135 - RNA, 20 nt, Human
acuccuugcaucaagggguc

SEQ ID NO: 2782136 - RNA, 11 nt, Human
acuccuuggcc

SEQ ID NO: 2782137 - RNA, 12 nt, Human
acuccuuggccu

SEQ ID NO: 2782138 - RNA, 14 nt, Human
acuccuuggccuag

SEQ ID NO: 2782139 - RNA, 16 nt, Human
acuccuuggccuagcc

SEQ ID NO: 2782140 - RNA, 18 nt, Human
acuccuuggccuagccca

SEQ ID NO: 2782141 - RNA, 21 nt, Human
acucuuauugcccacgcugga

SEQ ID NO: 2782142 - RNA, 18 nt, Human
acucuucaaaaacuguuu

SEQ ID NO: 2782143 - RNA, 14 nt, Human
acucugcugcuuag

SEQ ID NO: 2782144 - RNA, 15 nt, Human
acucugcugcuuaga

SEQ ID NO: 2782145 - RNA, 20 nt, Human
acucuucgaagccuugccua

SEQ ID NO: 2782146 - RNA, 16 nt, Human
acucuucuaugaccca

SEQ ID NO: 2782147 - RNA, 18 nt, Human
acucuucuaugacccagc

SEQ ID NO: 2782148 - RNA, 22 nt, Human
acucuuccuauuuuuguaguga

SEQ ID NO: 2782149 - RNA, 21 nt, Human
acucuucaguuaagccuuugg

SEQ ID NO: 2782150 - RNA, 20 nt, Human
acucuucaguuaagccuuug

SEQ ID NO: 2782151 - RNA, 12 nt, Human
acucuucacugu

SEQ ID NO: 2782152 - RNA, 13 nt, Human
acucuucacuguu

SEQ ID NO: 2782153 - RNA, 20 nt, Human
acucuucuuaacuuaaauuu

SEQ ID NO: 2782154 - RNA, 19 nt, Human
acucuucuuaacuuaaauu

SEQ ID NO: 2782155 - RNA, 16 nt, Human
acucgugugcaacaga

SEQ ID NO: 2782156 - RNA, 21 nt, Human
acucucacacugguucucaau

SEQ ID NO: 2782157 - RNA, 22 nt, Human
acucucacacugguucucaaug

SEQ ID NO: 2782158 - RNA, 21 nt, Human
acuccuggucugaaaauguug

SEQ ID NO: 2782159 - RNA, 14 nt, Human
acucguauaugucu

SEQ ID NO: 2782160 - RNA, 17 nt, Human
acucugacaacagacuu

SEQ ID NO: 2782161 - RNA, 13 nt, Human
acucugacaacag

SEQ ID NO: 2782162 - RNA, 15 nt, Human
acucucagcccagaa

SEQ ID NO: 2782163 - RNA, 16 nt, Human
acucucagcccagaag

SEQ ID NO: 2782164 - RNA, 21 nt, Human
acucucagcccagaagaaaau

SEQ ID NO: 2782165 - RNA, 22 nt, Human
acucucagcccagaagaaaauu

SEQ ID NO: 2782166 - RNA, 16 nt, Human
acucugccuccucuuc

SEQ ID NO: 2782167 - RNA, 14 nt, Human
acucugacaagggc

SEQ ID NO: 2782168 - RNA, 18 nt, Human
acucugacaagggcugac

SEQ ID NO: 2782169 - RNA, 19 nt, Human
acucugacaagggcugacc

SEQ ID NO: 2782170 - RNA, 20 nt, Human
acucugacaagggcugaccu

SEQ ID NO: 2782171 - RNA, 21 nt, Human
acucugacaagggcugaccug

SEQ ID NO: 2782172 - RNA, 19 nt, Human
acucugacgcaaaaccacu

SEQ ID NO: 2782173 - RNA, 18 nt, Human
acucugcucgccuuagca

SEQ ID NO: 2782174 - RNA, 23 nt, Human
acucugacaacagacuucugaaa

SEQ ID NO: 2782175 - RNA, 22 nt, Human
acucugacaacagacuucugaa

SEQ ID NO: 2782176 - RNA, 20 nt, Human
acucugacaacagacuucug

SEQ ID NO: 2782177 - RNA, 18 nt, Human
acucugacaacagacuuc

SEQ ID NO: 2782178 - RNA, 23 nt, Human
uccugaaccgcacagcucaggag

SEQ ID NO: 2782179 - RNA, 13 nt, Human
uccugaagaauua

SEQ ID NO: 2782180 - RNA, 14 nt, Human
uccugaagaauuaa

SEQ ID NO: 2782181 - RNA, 15 nt, Human
uccucuuuaaaacaa

SEQ ID NO: 2782182 - RNA, 17 nt, Human
uccucuuuaaaacaaaa

SEQ ID NO: 2782183 - RNA, 18 nt, Human
uccucuuuaaaacaaaac

SEQ ID NO: 2782184 - RNA, 19 nt, Human
uccucuuuaaaacaaaaca

SEQ ID NO: 2782185 - RNA, 14 nt, Human
uccucugaggcuga

SEQ ID NO: 2782186 - RNA, 19 nt, Human
uccucuugccacugccucu

SEQ ID NO: 2782187 - RNA, 13 nt, Human
acugaaacuuccc

SEQ ID NO: 2782188 - RNA, 21 nt, Human
acugaaagacaccauuuaucu

SEQ ID NO: 2782189 - RNA, 20 nt, Human
acugaaagccuuagggaagc

SEQ ID NO: 2782190 - RNA, 19 nt, Human
acugaaaccuuuaagaaaa

SEQ ID NO: 2782191 - RNA, 23 nt, Human
acugaaaaucuaauauuaaaaau

SEQ ID NO: 2782192 - RNA, 13 nt, Human
acugaaacagauu

SEQ ID NO: 2782193 - RNA, 14 nt, Human
acugaaacagauuu

SEQ ID NO: 2782194 - RNA, 18 nt, Human
acugaaacagauuucaua

SEQ ID NO: 2782195 - RNA, 20 nt, Human
acugaaaagguucuucaucc

SEQ ID NO: 2782196 - RNA, 19 nt, Human
acugaaaauaccaucaggc

SEQ ID NO: 2782197 - RNA, 15 nt, Human
acugaaaaucuaaua

SEQ ID NO: 2782198 - RNA, 16 nt, Human
acugaaaaucuaauau

SEQ ID NO: 2782199 - RNA, 17 nt, Human
acugaaaaccucuccuc

SEQ ID NO: 2782200 - RNA, 13 nt, Human
acugaaaagagag

SEQ ID NO: 2782201 - RNA, 14 nt, Human
acugaaaagagagc

SEQ ID NO: 2782202 - RNA, 15 nt, Human
acugaaaagagagca

SEQ ID NO: 2782203 - RNA, 17 nt, Human
acugaaaagagagcaga

SEQ ID NO: 2782204 - RNA, 20 nt, Human
acugaaaagagagcagagaa

SEQ ID NO: 2782205 - RNA, 23 nt, Human
acugaaaagagagcagagaauau

SEQ ID NO: 2782206 - RNA, 22 nt, Human
acucuuucuguauauacuuuuu

SEQ ID NO: 2782207 - RNA, 21 nt, Human
acucuuucuguauauacuuuu

SEQ ID NO: 2782208 - RNA, 16 nt, Human
acugaaaaccucuccu

SEQ ID NO: 2782209 - RNA, 15 nt, Human
acugaaaaccucucc

SEQ ID NO: 2782210 - RNA, 16 nt, Human
acugaaaaauuauacu

SEQ ID NO: 2782211 - RNA, 14 nt, Human
acucuuucuguaua

SEQ ID NO: 2782212 - RNA, 18 nt, Human
uccugacgaaacuggccc

SEQ ID NO: 2782213 - RNA, 20 nt, Human
uccugacgaaacuggccccg

SEQ ID NO: 2782214 - RNA, 21 nt, Human
uccugacgaaacuggccccgg

SEQ ID NO: 2782215 - RNA, 22 nt, Human
uccugacgaaacuggccccgga

SEQ ID NO: 2782216 - RNA, 16 nt, Human
uccugaccucagguga

SEQ ID NO: 2782217 - RNA, 19 nt, Human
uccugaacucuucugcaaa

SEQ ID NO: 2782218 - RNA, 13 nt, Human
uccucuccccucc

SEQ ID NO: 2782219 - RNA, 14 nt, Human
uccucuccccucca

SEQ ID NO: 2782220 - RNA, 16 nt, Human
uccucuccccuccagc

SEQ ID NO: 2782221 - RNA, 17 nt, Human
uccucuccccuccagcc

SEQ ID NO: 2782222 - RNA, 18 nt, Human
uccucuccccuccagccu

SEQ ID NO: 2782223 - RNA, 12 nt, Human
uccucuccugga

SEQ ID NO: 2782224 - RNA, 13 nt, Human
uccucuccuggag

SEQ ID NO: 2782225 - RNA, 14 nt, Human
uccucuccuggagg

SEQ ID NO: 2782226 - RNA, 17 nt, Human
uccucucccaaguccac

SEQ ID NO: 2782227 - RNA, 17 nt, Human
uccucuccacugccuuc

SEQ ID NO: 2782228 - RNA, 18 nt, Human
uccucuccacugccuucg

SEQ ID NO: 2782229 - RNA, 16 nt, Human
uccucuccacugccuu

SEQ ID NO: 2782230 - RNA, 17 nt, Human
uccucucugguggcucu

SEQ ID NO: 2782231 - RNA, 17 nt, Human
uccucugagccuuggga

SEQ ID NO: 2782232 - RNA, 13 nt, Human
uccucugagccuu

SEQ ID NO: 2782233 - RNA, 12 nt, Human
uccucugagccu

SEQ ID NO: 2782234 - RNA, 14 nt, Human
uccucucuccagau

SEQ ID NO: 2782235 - RNA, 19 nt, Human
uccucucuccagauguuuc

SEQ ID NO: 2782236 - RNA, 15 nt, Human
uccucuccuggagga

SEQ ID NO: 2782237 - RNA, 16 nt, Human
uccucuccuggaggau

SEQ ID NO: 2782238 - RNA, 15 nt, Human
uccucuccuuccuug

SEQ ID NO: 2782239 - RNA, 17 nt, Human
uccucuccuuugaaacc

SEQ ID NO: 2782240 - RNA, 23 nt, Human
uccucuccuuugaaaccugcucu

SEQ ID NO: 2782241 - RNA, 15 nt, Human
uccucucugcccuaa

SEQ ID NO: 2782242 - RNA, 14 nt, Human
uccucucugcccua

SEQ ID NO: 2782243 - RNA, 13 nt, Human
uccucucugcccu

SEQ ID NO: 2782244 - RNA, 12 nt, Human
uccucucugccc

SEQ ID NO: 2782245 - RNA, 20 nt, Human
uccucccaccucagccuccc

SEQ ID NO: 2782246 - RNA, 18 nt, Human
uccucccaccucagccuc

SEQ ID NO: 2782247 - RNA, 16 nt, Human
uccucccaccucagcc

SEQ ID NO: 2782248 - RNA, 15 nt, Human
uccucccaccucagc

SEQ ID NO: 2782249 - RNA, 14 nt, Human
uccucccaccucag

SEQ ID NO: 2782250 - RNA, 13 nt, Human
uccucccaccuca

SEQ ID NO: 2782251 - RNA, 21 nt, Human
uccucccaccucagccucccg

SEQ ID NO: 2782252 - RNA, 22 nt, Human
uccuccccauuagagucagccu

SEQ ID NO: 2782253 - RNA, 21 nt, Human
uccuccccacuuguccgcugg

SEQ ID NO: 2782254 - RNA, 19 nt, Human
uccuccccaaggagacaca

SEQ ID NO: 2782255 - RNA, 14 nt, Human
uccuccccacccuc

SEQ ID NO: 2782256 - RNA, 18 nt, Human
uccuccccacccuccugg

SEQ ID NO: 2782257 - RNA, 19 nt, Human
uccuccccacccuccuggc

SEQ ID NO: 2782258 - RNA, 12 nt, Human
uccucccuguua

SEQ ID NO: 2782259 - RNA, 13 nt, Human
uccucccuguuau

SEQ ID NO: 2782260 - RNA, 16 nt, Human
uccuccccucacagcc

SEQ ID NO: 2782261 - RNA, 14 nt, Human
uccuccccucacag

SEQ ID NO: 2782262 - RNA, 17 nt, Human
uccuccccucacagccu

SEQ ID NO: 2782263 - RNA, 18 nt, Human
uccuccccucacagccuc

SEQ ID NO: 2782264 - RNA, 19 nt, Human
uccuccccucacagccucu

SEQ ID NO: 2782265 - RNA, 21 nt, Human
uccuccccucacagccucuga

SEQ ID NO: 2782266 - RNA, 23 nt, Human
uccuccccucacagccucugacc

SEQ ID NO: 2782267 - RNA, 16 nt, Human
accugaaauuccaaag

SEQ ID NO: 2782268 - RNA, 20 nt, Human
ucauaaggcuucaaaauguu

SEQ ID NO: 2782269 - RNA, 13 nt, Human
accugaagacuga

SEQ ID NO: 2782270 - RNA, 16 nt, Human
accugaagacugagga

SEQ ID NO: 2782271 - RNA, 19 nt, Human
accugaagacugaggacaa

SEQ ID NO: 2782272 - RNA, 18 nt, Human
accugaagacucauucuu

SEQ ID NO: 2782273 - RNA, 19 nt, Human
accugaaauuccaaagucu

SEQ ID NO: 2782274 - RNA, 20 nt, Human
accugaaauuccaaagucuc

SEQ ID NO: 2782275 - RNA, 22 nt, Human
accugaaauuccaaagucucua

SEQ ID NO: 2782276 - RNA, 12 nt, Human
accugacacaag

SEQ ID NO: 2782277 - RNA, 15 nt, Human
accugacacaagagg

SEQ ID NO: 2782278 - RNA, 16 nt, Human
accugacacaagagga

SEQ ID NO: 2782279 - RNA, 18 nt, Human
accugagcaggaccucug

SEQ ID NO: 2782280 - RNA, 17 nt, Human
accugaccccugacccc

SEQ ID NO: 2782281 - RNA, 13 nt, Human
accugccuccucg

SEQ ID NO: 2782282 - RNA, 18 nt, Human
accugccuccucguuccu

SEQ ID NO: 2782283 - RNA, 20 nt, Human
accugccuccucguuccuuu

SEQ ID NO: 2782284 - RNA, 13 nt, Human
accugccuccugc

SEQ ID NO: 2782285 - RNA, 17 nt, Human
accugccucggccuccc

SEQ ID NO: 2782286 - RNA, 15 nt, Human
accugcaaucccagc

SEQ ID NO: 2782287 - RNA, 17 nt, Human
accugcaaucccagcua

SEQ ID NO: 2782288 - RNA, 18 nt, Human
accugcaaucccagcuac

SEQ ID NO: 2782289 - RNA, 23 nt, Human
accugagggcagaaagguucugc

SEQ ID NO: 2782290 - RNA, 19 nt, Human
accugaucacuagccuguc

SEQ ID NO: 2782291 - RNA, 22 nt, Human
accugaucacuagccugucauc

SEQ ID NO: 2782292 - RNA, 15 nt, Human
accugaggccugaag

SEQ ID NO: 2782293 - RNA, 21 nt, Human
accugauggcacuuagcuauc

SEQ ID NO: 2782294 - RNA, 22 nt, Human
accugauggaaguaaagccuca

SEQ ID NO: 2782295 - RNA, 14 nt, Human
accugauuguaaac

SEQ ID NO: 2782296 - RNA, 16 nt, Human
accugauuguaaacuu

SEQ ID NO: 2782297 - RNA, 13 nt, Human
accugcaaaaaau

SEQ ID NO: 2782298 - RNA, 15 nt, Human
accugcaaaaaauac

SEQ ID NO: 2782299 - RNA, 17 nt, Human
accugcuggguaaacug

SEQ ID NO: 2782300 - RNA, 12 nt, Human
accugcucuccu

SEQ ID NO: 2782301 - RNA, 14 nt, Human
accugccuguagcc

SEQ ID NO: 2782302 - RNA, 11 nt, Human
accugccugua

SEQ ID NO: 2782303 - RNA, 18 nt, Human
accugccuccugccugcc

SEQ ID NO: 2782304 - RNA, 13 nt, Human
accugccuggguu

SEQ ID NO: 2782305 - RNA, 23 nt, Human
accugccucggccucccaaagug

SEQ ID NO: 2782306 - RNA, 11 nt, Human
accugccucuc

SEQ ID NO: 2782307 - RNA, 15 nt, Human
accugccucucacac

SEQ ID NO: 2782308 - RNA, 19 nt, Human
accugccucucacacacau

SEQ ID NO: 2782309 - RNA, 22 nt, Human
accugccucucacacacauaga

SEQ ID NO: 2782310 - RNA, 23 nt, Human
accugccucucacacacauagau

SEQ ID NO: 2782311 - RNA, 21 nt, Human
accugccucggccucccaaag

SEQ ID NO: 2782312 - RNA, 14 nt, Human
accugccuccugcc

SEQ ID NO: 2782313 - RNA, 17 nt, Human
accugccuccugccugc

SEQ ID NO: 2782314 - RNA, 10 nt, Human
accugccugc

SEQ ID NO: 2782315 - RNA, 11 nt, Human
accugccugcg

SEQ ID NO: 2782316 - RNA, 13 nt, Human
accugccugcguc

SEQ ID NO: 2782317 - RNA, 17 nt, Human
accugccugcgucuucc

SEQ ID NO: 2782318 - RNA, 18 nt, Human
accugccugcgucuuccg

SEQ ID NO: 2782319 - RNA, 20 nt, Human
accugccugcgucuuccgcc

SEQ ID NO: 2782320 - RNA, 22 nt, Human
accugccugcgucuuccgcccc

SEQ ID NO: 2782321 - RNA, 10 nt, Human
accugccugg

SEQ ID NO: 2782322 - RNA, 13 nt, Human
accugccuggccg

SEQ ID NO: 2782323 - RNA, 14 nt, Human
accugccuggccgg

SEQ ID NO: 2782324 - RNA, 15 nt, Human
accugccuggccggc

SEQ ID NO: 2782325 - RNA, 17 nt, Human
accugccuggccggcca

SEQ ID NO: 2782326 - RNA, 18 nt, Human
accugccuggccggccag

SEQ ID NO: 2782327 - RNA, 20 nt, Human
accugccuggccggccagcc

SEQ ID NO: 2782328 - RNA, 21 nt, Human
accugccuggccggccagcca

SEQ ID NO: 2782329 - RNA, 15 nt, Human
accugcuaucagcag

SEQ ID NO: 2782330 - RNA, 15 nt, Human
accugcuccgcugcu

SEQ ID NO: 2782331 - RNA, 16 nt, Human
accugcuccgcugcuc

SEQ ID NO: 2782332 - RNA, 17 nt, Human
accugcuccgcugcucc

SEQ ID NO: 2782333 - RNA, 18 nt, Human
accugcuccgcugcuccu

SEQ ID NO: 2782334 - RNA, 22 nt, Human
accugcuccgcugcuccuuggc

SEQ ID NO: 2782335 - RNA, 19 nt, Human
uccaaaaagauuuucagaa

SEQ ID NO: 2782336 - RNA, 23 nt, Human
ucauuuugggacaauuguuuuaa

SEQ ID NO: 2782337 - RNA, 17 nt, Human
ucauuuuugccauacau

SEQ ID NO: 2782338 - RNA, 14 nt, Human
ucauuuuugaauac

SEQ ID NO: 2782339 - RNA, 19 nt, Human
ucauuuuuaguagagacag

SEQ ID NO: 2782340 - RNA, 18 nt, Human
ucauuuuuaaucaugaaa

SEQ ID NO: 2782341 - RNA, 19 nt, Human
ucauuuuuaaucaugaaau

SEQ ID NO: 2782342 - RNA, 12 nt, Human
ucauuuuuaauc

SEQ ID NO: 2782343 - RNA, 16 nt, Human
ucauuuuuaaucauga

SEQ ID NO: 2782344 - RNA, 19 nt, Human
ucauuuuccccccacucuc

SEQ ID NO: 2782345 - RNA, 14 nt, Human
ucauuugucacaca

SEQ ID NO: 2782346 - RNA, 18 nt, Human
ucauuugguucauuaauu

SEQ ID NO: 2782347 - RNA, 13 nt, Human
ucauuugcuuuuu

SEQ ID NO: 2782348 - RNA, 22 nt, Human
ucauuuggaggaaaaaaagcau

SEQ ID NO: 2782349 - RNA, 23 nt, Human
ucauuuggaggaaaaaaagcaug

SEQ ID NO: 2782350 - RNA, 16 nt, Human
ucauuugucacacacu

SEQ ID NO: 2782351 - RNA, 20 nt, Human
ucauuugguucauuaauucu

SEQ ID NO: 2782352 - RNA, 14 nt, Human
ucauuuucuauaac

SEQ ID NO: 2782353 - RNA, 15 nt, Human
ucauuuucuauaaca

SEQ ID NO: 2782354 - RNA, 16 nt, Human
ucauuuucuauaacag

SEQ ID NO: 2782355 - RNA, 20 nt, Human
ucauuuucuauaacagauau

SEQ ID NO: 2782356 - RNA, 12 nt, Human
ucauuuugaggg

SEQ ID NO: 2782357 - RNA, 16 nt, Human
accuugacagggcaca

SEQ ID NO: 2782358 - RNA, 17 nt, Human
accuugacuugauuagu

SEQ ID NO: 2782359 - RNA, 17 nt, Human
accuugaccuuuguaca

SEQ ID NO: 2782360 - RNA, 18 nt, Human
accuugaccuuuguacag

SEQ ID NO: 2782361 - RNA, 19 nt, Human
accuugaccuuuguacagc

SEQ ID NO: 2782362 - RNA, 16 nt, Human
accuugacuguugaug

SEQ ID NO: 2782363 - RNA, 19 nt, Human
accuugacuguugauguac

SEQ ID NO: 2782364 - RNA, 23 nt, Human
accuugauuggggaauuaaaagu

SEQ ID NO: 2782365 - RNA, 23 nt, Human
accuucguuuacuaugccugugu

SEQ ID NO: 2782366 - RNA, 15 nt, Human
accuucuagaauuau

SEQ ID NO: 2782367 - RNA, 16 nt, Human
accuucuagaauuaua

SEQ ID NO: 2782368 - RNA, 17 nt, Human
accuucuagaauuauaa

SEQ ID NO: 2782369 - RNA, 22 nt, Human
accuucguuuacuaugccugug

SEQ ID NO: 2782370 - RNA, 18 nt, Human
accuucuggccucccaca

SEQ ID NO: 2782371 - RNA, 15 nt, Human
accuucugaguacag

SEQ ID NO: 2782372 - RNA, 22 nt, Human
accuucuggccucccacagacu

SEQ ID NO: 2782373 - RNA, 19 nt, Human
accuucuggcuuccuucuc

SEQ ID NO: 2782374 - RNA, 12 nt, Human
accuucugccuu

SEQ ID NO: 2782375 - RNA, 19 nt, Human
accuucugccuuugauguu

SEQ ID NO: 2782376 - RNA, 17 nt, Human
accuucaauuccugggc

SEQ ID NO: 2782377 - RNA, 16 nt, Human
accugggguugucagc

SEQ ID NO: 2782378 - RNA, 21 nt, Human
accugggguugucagcucuca

SEQ ID NO: 2782379 - RNA, 20 nt, Human
accuggggcugcuggccuga

SEQ ID NO: 2782380 - RNA, 15 nt, Human
accuggggcugcugg

SEQ ID NO: 2782381 - RNA, 18 nt, Human
accuggggcugcuggccu

SEQ ID NO: 2782382 - RNA, 14 nt, Human
accuggggcugcug

SEQ ID NO: 2782383 - RNA, 14 nt, Human
accuggggcacagu

SEQ ID NO: 2782384 - RNA, 18 nt, Human
accuggggcacaguccag

SEQ ID NO: 2782385 - RNA, 19 nt, Human
accuggggcacaguccagg

SEQ ID NO: 2782386 - RNA, 20 nt, Human
accuggggcacaguccagga

SEQ ID NO: 2782387 - RNA, 21 nt, Human
accuggggcacaguccaggaa

SEQ ID NO: 2782388 - RNA, 22 nt, Human
accuggggcacaguccaggaac

SEQ ID NO: 2782389 - RNA, 20 nt, Human
accuucauucugagaccaaa

SEQ ID NO: 2782390 - RNA, 14 nt, Human
accuucauuucaug

SEQ ID NO: 2782391 - RNA, 15 nt, Human
accuucauuucaugu

SEQ ID NO: 2782392 - RNA, 22 nt, Human
accuucauuucauguauaguuu

SEQ ID NO: 2782393 - RNA, 13 nt, Human
accuucauuuuga

SEQ ID NO: 2782394 - RNA, 15 nt, Human
accuucauuuugagg

SEQ ID NO: 2782395 - RNA, 17 nt, Human
accuucauuuugagggg

SEQ ID NO: 2782396 - RNA, 19 nt, Human
accuggguaaaugcagcgu

SEQ ID NO: 2782397 - RNA, 18 nt, Human
accuucaauuccugggcc

SEQ ID NO: 2782398 - RNA, 12 nt, Human
accuucagcuca

SEQ ID NO: 2782399 - RNA, 16 nt, Human
accuucagcucacgcu

SEQ ID NO: 2782400 - RNA, 17 nt, Human
accuucagcucacgcuu

SEQ ID NO: 2782401 - RNA, 21 nt, Human
accuucguuuacuaugccugu

SEQ ID NO: 2782402 - RNA, 17 nt, Human
accuucgccaccugggu

SEQ ID NO: 2782403 - RNA, 15 nt, Human
accuucgccaccugg

SEQ ID NO: 2782404 - RNA, 17 nt, Human
accuucccaugcccugg

SEQ ID NO: 2782405 - RNA, 14 nt, Human
accuucccuugcca

SEQ ID NO: 2782406 - RNA, 12 nt, Human
accuuccuuccu

SEQ ID NO: 2782407 - RNA, 16 nt, Human
accuuccuuccugcuu

SEQ ID NO: 2782408 - RNA, 14 nt, Human
accuuccuuccugu

SEQ ID NO: 2782409 - RNA, 15 nt, Human
accuuccuuccuguu

SEQ ID NO: 2782410 - RNA, 15 nt, Human
accuuccucuggggc

SEQ ID NO: 2782411 - RNA, 16 nt, Human
accuuccucuggggcu

SEQ ID NO: 2782412 - RNA, 22 nt, Human
accuggccgcguuuagaccaag

SEQ ID NO: 2782413 - RNA, 18 nt, Human
accugggauucaggaaug

SEQ ID NO: 2782414 - RNA, 15 nt, Human
accugggcauaucca

SEQ ID NO: 2782415 - RNA, 15 nt, Human
accuggcuuguuuau

SEQ ID NO: 2782416 - RNA, 20 nt, Human
accuggcuuguuuauuuugu

SEQ ID NO: 2782417 - RNA, 22 nt, Human
accuggcuuguuuauuuugugg

SEQ ID NO: 2782418 - RNA, 17 nt, Human
uccacccaggagccccg

SEQ ID NO: 2782419 - RNA, 13 nt, Human
uccacccaccuca

SEQ ID NO: 2782420 - RNA, 12 nt, Human
uccacccaccuc

SEQ ID NO: 2782421 - RNA, 20 nt, Human
uccacccaggagccccgagg

SEQ ID NO: 2782422 - RNA, 15 nt, Human
uccacccaacccuau

SEQ ID NO: 2782423 - RNA, 16 nt, Human
uccacauuguuuuaaa

SEQ ID NO: 2782424 - RNA, 17 nt, Human
uccacauuguuuuaaaa

SEQ ID NO: 2782425 - RNA, 23 nt, Human
uccacccaacccuaucuccugac

SEQ ID NO: 2782426 - RNA, 19 nt, Human
uccacccaacccuaucucc

SEQ ID NO: 2782427 - RNA, 20 nt, Human
uccacccauaauccuuucug

SEQ ID NO: 2782428 - RNA, 22 nt, Human
uccacccauaauccuuucugcc

SEQ ID NO: 2782429 - RNA, 22 nt, Human
uccaccccaucccuccccaguu

SEQ ID NO: 2782430 - RNA, 12 nt, Human
uccaccccaucc

SEQ ID NO: 2782431 - RNA, 20 nt, Human
uccaccccaucccuccccag

SEQ ID NO: 2782432 - RNA, 20 nt, Human
uccaaaaagauuuucagaaa

SEQ ID NO: 2782433 - RNA, 19 nt, Human
uccaaaugcagcuuuaaaa

SEQ ID NO: 2782434 - RNA, 20 nt, Human
uccaaauggcgucuggaagu

SEQ ID NO: 2782435 - RNA, 18 nt, Human
uccaaauggcgucuggaa

SEQ ID NO: 2782436 - RNA, 22 nt, Human
uccaaauguccuccagaagccu

SEQ ID NO: 2782437 - RNA, 20 nt, Human
uccaaauguccuccagaagc

SEQ ID NO: 2782438 - RNA, 19 nt, Human
uccaaauguccuccagaag

SEQ ID NO: 2782439 - RNA, 17 nt, Human
uccaaauguccuccaga

SEQ ID NO: 2782440 - RNA, 14 nt, Human
uccaaauugugcuu

SEQ ID NO: 2782441 - RNA, 15 nt, Human
uccaaauugugcuuc

SEQ ID NO: 2782442 - RNA, 22 nt, Human
uccaaauugugcuucuccccag

SEQ ID NO: 2782443 - RNA, 23 nt, Human
uccaaauugugcuucuccccaga

SEQ ID NO: 2782444 - RNA, 23 nt, Human
uccaaggaaaccacagcugcugg

SEQ ID NO: 2782445 - RNA, 19 nt, Human
uccaaggaacuaauuucuu

SEQ ID NO: 2782446 - RNA, 15 nt, Human
uccaacacaaggcuc

SEQ ID NO: 2782447 - RNA, 23 nt, Human
uccaacacaaggcuccaagaccu

SEQ ID NO: 2782448 - RNA, 21 nt, Human
uccaaggaaaccacagcugcu

SEQ ID NO: 2782449 - RNA, 14 nt, Human
uccaaggggcaaau

SEQ ID NO: 2782450 - RNA, 12 nt, Human
uccacaugcucu

SEQ ID NO: 2782451 - RNA, 13 nt, Human
uccacaugcucug

SEQ ID NO: 2782452 - RNA, 14 nt, Human
uccacaugcucuga

SEQ ID NO: 2782453 - RNA, 14 nt, Human
uccacauuguuuua

SEQ ID NO: 2782454 - RNA, 15 nt, Human
uccacauuguuuuaa

SEQ ID NO: 2782455 - RNA, 14 nt, Human
uccacaucccggga

SEQ ID NO: 2782456 - RNA, 23 nt, Human
uccaauuauuugacuuuaauuua

SEQ ID NO: 2782457 - RNA, 18 nt, Human
uccaauguggcaaggaaa

SEQ ID NO: 2782458 - RNA, 20 nt, Human
uccaauguuagagacuuuuu

SEQ ID NO: 2782459 - RNA, 20 nt, Human
uccaaugccacauacuugca

SEQ ID NO: 2782460 - RNA, 22 nt, Human
uccaaugccacauacuugcagc

SEQ ID NO: 2782461 - RNA, 19 nt, Human
uccaaugucugcugaggag

SEQ ID NO: 2782462 - RNA, 16 nt, Human
acgcugauacauaacu

SEQ ID NO: 2782463 - RNA, 14 nt, Human
acgcugcagagcac

SEQ ID NO: 2782464 - RNA, 14 nt, Human
acgcugccugcccg

SEQ ID NO: 2782465 - RNA, 15 nt, Human
acgcugccugcccac

SEQ ID NO: 2782466 - RNA, 13 nt, Human
acgcugccugccc

SEQ ID NO: 2782467 - RNA, 12 nt, Human
acgcugccugcc

SEQ ID NO: 2782468 - RNA, 19 nt, Human
acggagucccaccuuggcu

SEQ ID NO: 2782469 - RNA, 18 nt, Human
acggaggcauccuacccu

SEQ ID NO: 2782470 - RNA, 23 nt, Human
acggaggcaaagcuggcucaccu

SEQ ID NO: 2782471 - RNA, 18 nt, Human
acggagccccaggccucu

SEQ ID NO: 2782472 - RNA, 21 nt, Human
acggagccccaggccucugug

SEQ ID NO: 2782473 - RNA, 15 nt, Human
acggagcccagcccu

SEQ ID NO: 2782474 - RNA, 20 nt, Human
acggagcccagcccucccca

SEQ ID NO: 2782475 - RNA, 21 nt, Human
acggagucccaccuuggcugc

SEQ ID NO: 2782476 - RNA, 12 nt, Human
acggauuccaaa

SEQ ID NO: 2782477 - RNA, 16 nt, Human
acggccaggccagagg

SEQ ID NO: 2782478 - RNA, 18 nt, Human
acggcacggucuucccuc

SEQ ID NO: 2782479 - RNA, 19 nt, Human
acggcacggucuucccucu

SEQ ID NO: 2782480 - RNA, 22 nt, Human
acggcacggucuucccucuucc

SEQ ID NO: 2782481 - RNA, 13 nt, Human
acggccaggccag

SEQ ID NO: 2782482 - RNA, 15 nt, Human
acggccaucucuuug

SEQ ID NO: 2782483 - RNA, 20 nt, Human
acggccaucucuuuguacag

SEQ ID NO: 2782484 - RNA, 22 nt, Human
acggccaucucuuuguacagga

SEQ ID NO: 2782485 - RNA, 23 nt, Human
acgcgugcacacaccagagccca

SEQ ID NO: 2782486 - RNA, 20 nt, Human
acgcgugcacacaccagagc

SEQ ID NO: 2782487 - RNA, 21 nt, Human
acgccggggacagaggccugc

SEQ ID NO: 2782488 - RNA, 22 nt, Human
acgccggggacagaggccugcc

SEQ ID NO: 2782489 - RNA, 20 nt, Human
acgccgcccuaaaagcacac

SEQ ID NO: 2782490 - RNA, 23 nt, Human
acgcccuccccuccccugcugca

SEQ ID NO: 2782491 - RNA, 20 nt, Human
acgccggggacagaggccug

SEQ ID NO: 2782492 - RNA, 18 nt, Human
acgcccuccccuccccug

SEQ ID NO: 2782493 - RNA, 19 nt, Human
acgcccuccccuccccugc

SEQ ID NO: 2782494 - RNA, 21 nt, Human
acgcccuccccuccccugcug

SEQ ID NO: 2782495 - RNA, 22 nt, Human
acgcccuccccuccccugcugc

SEQ ID NO: 2782496 - RNA, 14 nt, Human
acgcccucucccca

SEQ ID NO: 2782497 - RNA, 15 nt, Human
acgcccucuccccac

SEQ ID NO: 2782498 - RNA, 18 nt, Human
acgcccucuccccacccc

SEQ ID NO: 2782499 - RNA, 21 nt, Human
acgcccucuccccaccccuac

SEQ ID NO: 2782500 - RNA, 23 nt, Human
acgcccucuccccaccccuaccc

SEQ ID NO: 2782501 - RNA, 13 nt, Human
acgcccuauuuuu

SEQ ID NO: 2782502 - RNA, 12 nt, Human
acgcccuccccu

SEQ ID NO: 2782503 - RNA, 13 nt, Human
acgcccuccccuc

SEQ ID NO: 2782504 - RNA, 14 nt, Human
acgcccuccccucc

SEQ ID NO: 2782505 - RNA, 15 nt, Human
acgcccuccccuccc

SEQ ID NO: 2782506 - RNA, 16 nt, Human
acgagucaccuuccag

SEQ ID NO: 2782507 - RNA, 13 nt, Human
acgagugcuaagu

SEQ ID NO: 2782508 - RNA, 14 nt, Human
acgauaaggaagaa

SEQ ID NO: 2782509 - RNA, 17 nt, Human
acgauaaggaagaaaca

SEQ ID NO: 2782510 - RNA, 23 nt, Human
acgauaaggaagaaacagaagag

SEQ ID NO: 2782511 - RNA, 23 nt, Human
acgauacgcuacuauaaagagaa

SEQ ID NO: 2782512 - RNA, 19 nt, Human
acgacaaggaaaggcaaau

SEQ ID NO: 2782513 - RNA, 22 nt, Human
acgacaaagccaaacucugcca

SEQ ID NO: 2782514 - RNA, 16 nt, Human
acgaccagggccgagg

SEQ ID NO: 2782515 - RNA, 16 nt, Human
acgaccggggccagca

SEQ ID NO: 2782516 - RNA, 21 nt, Human
acgaccggggccagcaccacu

SEQ ID NO: 2782517 - RNA, 21 nt, Human
acgaccuaggcaguaggccgg

SEQ ID NO: 2782518 - RNA, 13 nt, Human
acgacgcccucuc

SEQ ID NO: 2782519 - RNA, 14 nt, Human
acgacgcccucucc

SEQ ID NO: 2782520 - RNA, 16 nt, Human
acgacgcccucucccc

SEQ ID NO: 2782521 - RNA, 14 nt, Human
acgacgcugcagag

SEQ ID NO: 2782522 - RNA, 20 nt, Human
acgcccacccaaccccaagc

SEQ ID NO: 2782523 - RNA, 17 nt, Human
acgaagaagagccacag

SEQ ID NO: 2782524 - RNA, 18 nt, Human
acgaagaagagccacagu

SEQ ID NO: 2782525 - RNA, 15 nt, Human
acgaagaagagccac

SEQ ID NO: 2782526 - RNA, 14 nt, Human
acgacaaggaaagg

SEQ ID NO: 2782527 - RNA, 20 nt, Human
uccagggaauccaagccucc

SEQ ID NO: 2782528 - RNA, 19 nt, Human
uccagggaauccaagccuc

SEQ ID NO: 2782529 - RNA, 18 nt, Human
uccagggaagcuggccga

SEQ ID NO: 2782530 - RNA, 21 nt, Human
uccagggacgaagaagagcca

SEQ ID NO: 2782531 - RNA, 15 nt, Human
uccagggagccuaga

SEQ ID NO: 2782532 - RNA, 21 nt, Human
uccagggagccuagaagcugg

SEQ ID NO: 2782533 - RNA, 16 nt, Human
accuucucuauaucau

SEQ ID NO: 2782534 - RNA, 18 nt, Human
uccagggaauccaagccu

SEQ ID NO: 2782535 - RNA, 14 nt, Human
uccagggaauccaa

SEQ ID NO: 2782536 - RNA, 23 nt, Human
uccagggaagcuggccgaggguc

SEQ ID NO: 2782537 - RNA, 17 nt, Human
uccacgauccugccacc

SEQ ID NO: 2782538 - RNA, 18 nt, Human
uccacgauccugccaccc

SEQ ID NO: 2782539 - RNA, 17 nt, Human
uccacgcgcuucgacuu

SEQ ID NO: 2782540 - RNA, 21 nt, Human
uccacgcgcuucgacuuuucu

SEQ ID NO: 2782541 - RNA, 22 nt, Human
uccaucccuacccccuaagagc

SEQ ID NO: 2782542 - RNA, 23 nt, Human
uccaucccucuaaugagacugac

SEQ ID NO: 2782543 - RNA, 15 nt, Human
uccaucccucuaaug

SEQ ID NO: 2782544 - RNA, 12 nt, Human
uccaucccucua

SEQ ID NO: 2782545 - RNA, 18 nt, Human
uccaucccuacccccuaa

SEQ ID NO: 2782546 - RNA, 15 nt, Human
acggcucacugcagc

SEQ ID NO: 2782547 - RNA, 19 nt, Human
acggcguuguaccuguagg

SEQ ID NO: 2782548 - RNA, 15 nt, Human
acggcuaagaggcug

SEQ ID NO: 2782549 - RNA, 16 nt, Human
acggcuaagaggcugc

SEQ ID NO: 2782550 - RNA, 17 nt, Human
acggcuaagaggcugcu

SEQ ID NO: 2782551 - RNA, 18 nt, Human
acggcuaagaggcugcug

SEQ ID NO: 2782552 - RNA, 20 nt, Human
uccagugacaaaccauccag

SEQ ID NO: 2782553 - RNA, 14 nt, Human
acggcucacugcag

SEQ ID NO: 2782554 - RNA, 22 nt, Human
acggccugaugcucccuccccu

SEQ ID NO: 2782555 - RNA, 20 nt, Human
acggccugaugcucccuccc

SEQ ID NO: 2782556 - RNA, 21 nt, Human
acggccccgaagggcccccac

SEQ ID NO: 2782557 - RNA, 22 nt, Human
acggccccgaagggcccccaca

SEQ ID NO: 2782558 - RNA, 22 nt, Human
acggcccucaucuaugaggaaa

SEQ ID NO: 2782559 - RNA, 11 nt, Human
acggcccugca

SEQ ID NO: 2782560 - RNA, 12 nt, Human
acggcccugcaa

SEQ ID NO: 2782561 - RNA, 13 nt, Human
acggcccugcaau

SEQ ID NO: 2782562 - RNA, 18 nt, Human
acggcccugcagccagcu

SEQ ID NO: 2782563 - RNA, 19 nt, Human
acggccugaugcucccucc

SEQ ID NO: 2782564 - RNA, 18 nt, Human
acggccugaugcucccuc

SEQ ID NO: 2782565 - RNA, 15 nt, Human
acggccugaugcucc

SEQ ID NO: 2782566 - RNA, 15 nt, Human
uccaugacaggccug

SEQ ID NO: 2782567 - RNA, 20 nt, Human
uccaugacaggccugaagau

SEQ ID NO: 2782568 - RNA, 18 nt, Human
uccaucugcccgccugcc

SEQ ID NO: 2782569 - RNA, 20 nt, Human
uccaucugcccgccugccca

SEQ ID NO: 2782570 - RNA, 21 nt, Human
uccaucugcccgccugcccac

SEQ ID NO: 2782571 - RNA, 22 nt, Human
uccaucugcccgccugcccacc

SEQ ID NO: 2782572 - RNA, 14 nt, Human
uccaucuguacuug

SEQ ID NO: 2782573 - RNA, 17 nt, Human
uccaucuguacuugguc

SEQ ID NO: 2782574 - RNA, 19 nt, Human
uccaucuguacuuggucca

SEQ ID NO: 2782575 - RNA, 13 nt, Human
uccaucuuuacaa

SEQ ID NO: 2782576 - RNA, 18 nt, Human
uccaucuuuccugauggc

SEQ ID NO: 2782577 - RNA, 22 nt, Human
uccauugguccaagauuccgga

SEQ ID NO: 2782578 - RNA, 18 nt, Human
uccaugaguuugcccugg

SEQ ID NO: 2782579 - RNA, 18 nt, Human
uccauugccuagcucuuu

SEQ ID NO: 2782580 - RNA, 15 nt, Human
uccauugguccaaga

SEQ ID NO: 2782581 - RNA, 16 nt, Human
uccauugguccaagau

SEQ ID NO: 2782582 - RNA, 18 nt, Human
uccauugguccaagauuc

SEQ ID NO: 2782583 - RNA, 19 nt, Human
uccauugguccaagauucc

SEQ ID NO: 2782584 - RNA, 13 nt, Human
uccauuuguaaaa

SEQ ID NO: 2782585 - RNA, 13 nt, Human
uccauuuguaauu

SEQ ID NO: 2782586 - RNA, 21 nt, Human
uccauuuguaauuaaauuaug

SEQ ID NO: 2782587 - RNA, 18 nt, Human
uccauuuuccuacaggca

SEQ ID NO: 2782588 - RNA, 19 nt, Human
uccauuuuccuacaggcag

SEQ ID NO: 2782589 - RNA, 23 nt, Human
uccauuuuccuacaggcagucuc

SEQ ID NO: 2782590 - RNA, 22 nt, Human
uccauuuucuuauugcgcugcu

SEQ ID NO: 2782591 - RNA, 22 nt, Human
uccauuuuggcgcuauuacaaa

SEQ ID NO: 2782592 - RNA, 16 nt, Human
ucccaaagugcuggga

SEQ ID NO: 2782593 - RNA, 20 nt, Human
ucccaaagugcugggauuac

SEQ ID NO: 2782594 - RNA, 15 nt, Human
ucccaaagugcuggg

SEQ ID NO: 2782595 - RNA, 13 nt, Human
uccauuuugugaa

SEQ ID NO: 2782596 - RNA, 14 nt, Human
uccauuuugugaag

SEQ ID NO: 2782597 - RNA, 15 nt, Human
uccauuuugugaagc

SEQ ID NO: 2782598 - RNA, 16 nt, Human
uccauuuugugaagcc

SEQ ID NO: 2782599 - RNA, 17 nt, Human
uccauuuugugaagccc

SEQ ID NO: 2782600 - RNA, 19 nt, Human
uccauuuugugaagcccug

SEQ ID NO: 2782601 - RNA, 20 nt, Human
uccauuuugugaagcccugu

SEQ ID NO: 2782602 - RNA, 16 nt, Human
ucccaauugagaaaaa

SEQ ID NO: 2782603 - RNA, 14 nt, Human
ucccaaucagcacu

SEQ ID NO: 2782604 - RNA, 15 nt, Human
ucccaaucagcacug

SEQ ID NO: 2782605 - RNA, 16 nt, Human
ucccaaucagcacuga

SEQ ID NO: 2782606 - RNA, 17 nt, Human
ucccaaucagcacugaa

SEQ ID NO: 2782607 - RNA, 18 nt, Human
ucccaaucagcacugaaa

SEQ ID NO: 2782608 - RNA, 19 nt, Human
ucccaaucagcacugaaaa

SEQ ID NO: 2782609 - RNA, 14 nt, Human
ucccaaugcacauc

SEQ ID NO: 2782610 - RNA, 20 nt, Human
ucccaaugcacauccauucc

SEQ ID NO: 2782611 - RNA, 22 nt, Human
ucccaaugcacauccauuccca

SEQ ID NO: 2782612 - RNA, 13 nt, Human
ucccaaugguguu

SEQ ID NO: 2782613 - RNA, 14 nt, Human
ucccaaugguguuu

SEQ ID NO: 2782614 - RNA, 16 nt, Human
ucccaaugguguuuuu

SEQ ID NO: 2782615 - RNA, 21 nt, Human
ucccaaugguguuuuucuugu

SEQ ID NO: 2782616 - RNA, 22 nt, Human
ucccaaugguguuuuucuugua

SEQ ID NO: 2782617 - RNA, 19 nt, Human
ucccacauccaacuccagc

SEQ ID NO: 2782618 - RNA, 21 nt, Human
ucccacaggcccuuccucucc

SEQ ID NO: 2782619 - RNA, 22 nt, Human
ucccacaggcccuuccucucca

SEQ ID NO: 2782620 - RNA, 15 nt, Human
ucccacaggcccuuc

SEQ ID NO: 2782621 - RNA, 17 nt, Human
ucccacaggcccuuccu

SEQ ID NO: 2782622 - RNA, 16 nt, Human
ucccacccacauguga

SEQ ID NO: 2782623 - RNA, 15 nt, Human
ucccacccacaugug

SEQ ID NO: 2782624 - RNA, 18 nt, Human
ucccacccacaugugaca

SEQ ID NO: 2782625 - RNA, 22 nt, Human
ucccacccacaugugacacaua

SEQ ID NO: 2782626 - RNA, 22 nt, Human
ucccacauccaacuccagcaac

SEQ ID NO: 2782627 - RNA, 20 nt, Human
ucccacauccaacuccagca

SEQ ID NO: 2782628 - RNA, 23 nt, Human
ucccacauccaacuccagcaacu

SEQ ID NO: 2782629 - RNA, 19 nt, Human
ucccaccaacccucagagc

SEQ ID NO: 2782630 - RNA, 20 nt, Human
ucccacccccaucucucccu

SEQ ID NO: 2782631 - RNA, 19 nt, Human
ucccacccccuucucugcu

SEQ ID NO: 2782632 - RNA, 17 nt, Human
ucccacccccuucucug

SEQ ID NO: 2782633 - RNA, 20 nt, Human
ucccacccccacccccagcu

SEQ ID NO: 2782634 - RNA, 22 nt, Human
ucccacccccacccccagcuca

SEQ ID NO: 2782635 - RNA, 23 nt, Human
ucccacccccacccccagcucaa

SEQ ID NO: 2782636 - RNA, 22 nt, Human
ucccacccccuucucugcucca

SEQ ID NO: 2782637 - RNA, 13 nt, Human
ucccaccccuccc

SEQ ID NO: 2782638 - RNA, 19 nt, Human
ucccaccccucccucuguc

SEQ ID NO: 2782639 - RNA, 21 nt, Human
ucccacccccuucucugcucc

SEQ ID NO: 2782640 - RNA, 20 nt, Human
ucccacccccuucucugcuc

SEQ ID NO: 2782641 - RNA, 11 nt, Human
ucccacccugu

SEQ ID NO: 2782642 - RNA, 12 nt, Human
ucccacccugua

SEQ ID NO: 2782643 - RNA, 20 nt, Human
ucccacccuguaccucaucc

SEQ ID NO: 2782644 - RNA, 13 nt, Human
ucccacccuguuc

SEQ ID NO: 2782645 - RNA, 15 nt, Human
acggguuggggccgg

SEQ ID NO: 2782646 - RNA, 14 nt, Human
acgggguccuucaa

SEQ ID NO: 2782647 - RNA, 18 nt, Human
acggggagcggcggaaag

SEQ ID NO: 2782648 - RNA, 14 nt, Human
acggggacugggga

SEQ ID NO: 2782649 - RNA, 21 nt, Human
ucaaucaaauaaguauuuaua

SEQ ID NO: 2782650 - RNA, 13 nt, Human
ucaaucaacacua

SEQ ID NO: 2782651 - RNA, 15 nt, Human
ucaaucaacacuacc

SEQ ID NO: 2782652 - RNA, 17 nt, Human
ucaaucaagccauguau

SEQ ID NO: 2782653 - RNA, 16 nt, Human
ucaauauuuuuagaua

SEQ ID NO: 2782654 - RNA, 20 nt, Human
ucaagugauucucaugccuc

SEQ ID NO: 2782655 - RNA, 13 nt, Human
ucaaucccaaaag

SEQ ID NO: 2782656 - RNA, 16 nt, Human
ucaaucccaaaaguca

SEQ ID NO: 2782657 - RNA, 19 nt, Human
ucaaucccaaaagucacca

SEQ ID NO: 2782658 - RNA, 13 nt, Human
ucaaucccagccu

SEQ ID NO: 2782659 - RNA, 12 nt, Human
ucaaucauuucu

SEQ ID NO: 2782660 - RNA, 13 nt, Human
ucaaucauuucuc

SEQ ID NO: 2782661 - RNA, 14 nt, Human
ucaaucauuucuca

SEQ ID NO: 2782662 - RNA, 15 nt, Human
ucaaucauuucucac

SEQ ID NO: 2782663 - RNA, 19 nt, Human
ucaaucauuucucacugug

SEQ ID NO: 2782664 - RNA, 18 nt, Human
ucaauccagaugguggga

SEQ ID NO: 2782665 - RNA, 19 nt, Human
ucaaucaucugugugaaaa

SEQ ID NO: 2782666 - RNA, 16 nt, Human
ucaaucaucuguguga

SEQ ID NO: 2782667 - RNA, 20 nt, Human
ucaaucaucugugugaaaau

SEQ ID NO: 2782668 - RNA, 15 nt, Human
ucaaucaucugugug

SEQ ID NO: 2782669 - RNA, 12 nt, Human
ucaaucacuguc

SEQ ID NO: 2782670 - RNA, 22 nt, Human
ucaaucacuguccuccacacaa

SEQ ID NO: 2782671 - RNA, 17 nt, Human
ucaagugauucuccugc

SEQ ID NO: 2782672 - RNA, 16 nt, Human
ucaagugauucuccug

SEQ ID NO: 2782673 - RNA, 22 nt, Human
ucaagugauucucaugccucag

SEQ ID NO: 2782674 - RNA, 21 nt, Human
ucaagugauucucaugccuca

SEQ ID NO: 2782675 - RNA, 19 nt, Human
ucaaguaauccaccugccu

SEQ ID NO: 2782676 - RNA, 23 nt, Human
ucaagguuuuagguucuaaaguu

SEQ ID NO: 2782677 - RNA, 21 nt, Human
ucaagguuuuagguucuaaag

SEQ ID NO: 2782678 - RNA, 22 nt, Human
ucaagguuuuagguucuaaagu

SEQ ID NO: 2782679 - RNA, 17 nt, Human
ucaagagggucugagga

SEQ ID NO: 2782680 - RNA, 20 nt, Human
ucaagagggcacugguggcc

SEQ ID NO: 2782681 - RNA, 21 nt, Human
ucaagagggcacugguggccc

SEQ ID NO: 2782682 - RNA, 15 nt, Human
acauuauugcuuauu

SEQ ID NO: 2782683 - RNA, 19 nt, Human
ucaagaggugggagggccc

SEQ ID NO: 2782684 - RNA, 17 nt, Human
acauuaugcuccagaaa

SEQ ID NO: 2782685 - RNA, 19 nt, Human
acauuaugugguuuuagau

SEQ ID NO: 2782686 - RNA, 21 nt, Human
acauuaugugguuuuagauuu

SEQ ID NO: 2782687 - RNA, 22 nt, Human
acauuaugugguuuuagauuuu

SEQ ID NO: 2782688 - RNA, 13 nt, Human
acauuaugugugc

SEQ ID NO: 2782689 - RNA, 14 nt, Human
acauuaugugugca

SEQ ID NO: 2782690 - RNA, 15 nt, Human
acauuaugugugcau

SEQ ID NO: 2782691 - RNA, 17 nt, Human
acauuaugugugcaugu

SEQ ID NO: 2782692 - RNA, 19 nt, Human
acauuaugugugcaugugu

SEQ ID NO: 2782693 - RNA, 20 nt, Human
acauuaugugugcaugugug

SEQ ID NO: 2782694 - RNA, 21 nt, Human
acauuaugugugcaugugugu

SEQ ID NO: 2782695 - RNA, 22 nt, Human
acauuaugugugcaugugugua

SEQ ID NO: 2782696 - RNA, 23 nt, Human
acauuaugugugcauguguguau

SEQ ID NO: 2782697 - RNA, 19 nt, Human
acauuaucucacuugugcc

SEQ ID NO: 2782698 - RNA, 17 nt, Human
ucaagagcugcccuccu

SEQ ID NO: 2782699 - RNA, 12 nt, Human
ucaagaggcuga

SEQ ID NO: 2782700 - RNA, 18 nt, Human
ucaagaggcugagacagg

SEQ ID NO: 2782701 - RNA, 18 nt, Human
acauuauuuauaugggga

SEQ ID NO: 2782702 - RNA, 16 nt, Human
acauuauuuauucagc

SEQ ID NO: 2782703 - RNA, 12 nt, Human
acauuauuucua

SEQ ID NO: 2782704 - RNA, 13 nt, Human
acauuauuucuag

SEQ ID NO: 2782705 - RNA, 16 nt, Human
acauuauuucuagucc

SEQ ID NO: 2782706 - RNA, 14 nt, Human
acauuauuuauaug

SEQ ID NO: 2782707 - RNA, 13 nt, Human
ucaaggcacucua

SEQ ID NO: 2782708 - RNA, 14 nt, Human
ucaaggcacucuag

SEQ ID NO: 2782709 - RNA, 15 nt, Human
ucaaggcacucuaga

SEQ ID NO: 2782710 - RNA, 16 nt, Human
ucaaggcacucuagau

SEQ ID NO: 2782711 - RNA, 12 nt, Human
ucaagcagccaa

SEQ ID NO: 2782712 - RNA, 18 nt, Human
ucaagcagcgaccgcccc

SEQ ID NO: 2782713 - RNA, 21 nt, Human
ucaagcagcgaccgcccccuc

SEQ ID NO: 2782714 - RNA, 12 nt, Human
ucaagcacugau

SEQ ID NO: 2782715 - RNA, 13 nt, Human
ucaagcacugaua

SEQ ID NO: 2782716 - RNA, 20 nt, Human
ucaagcaauccucucaccuc

SEQ ID NO: 2782717 - RNA, 20 nt, Human
ucaagguggccaaauuauuu

SEQ ID NO: 2782718 - RNA, 11 nt, Human
ucaagguucua

SEQ ID NO: 2782719 - RNA, 14 nt, Human
ucaagguucuaacc

SEQ ID NO: 2782720 - RNA, 13 nt, Human
ucaagguuuuagg

SEQ ID NO: 2782721 - RNA, 18 nt, Human
ucaagguuuuagguucua

SEQ ID NO: 2782722 - RNA, 20 nt, Human
ucaagguuuuagguucuaaa

SEQ ID NO: 2782723 - RNA, 17 nt, Human
ucaaggcaucaugcaga

SEQ ID NO: 2782724 - RNA, 13 nt, Human
ucaaggcacugcc

SEQ ID NO: 2782725 - RNA, 14 nt, Human
ucaaggcacugccu

SEQ ID NO: 2782726 - RNA, 15 nt, Human
ucaaggcacugccug

SEQ ID NO: 2782727 - RNA, 16 nt, Human
ucaaggcacugccuga

SEQ ID NO: 2782728 - RNA, 17 nt, Human
ucaaggcacucuagauu

SEQ ID NO: 2782729 - RNA, 18 nt, Human
ucaaggcacucuagauuc

SEQ ID NO: 2782730 - RNA, 20 nt, Human
ucaaggcacucuagauucca

SEQ ID NO: 2782731 - RNA, 21 nt, Human
ucaaggcacucuagauuccau

SEQ ID NO: 2782732 - RNA, 16 nt, Human
acauugggucuauucc

SEQ ID NO: 2782733 - RNA, 18 nt, Human
acauugggucuauuccag

SEQ ID NO: 2782734 - RNA, 20 nt, Human
acauugggucuauuccagcu

SEQ ID NO: 2782735 - RNA, 21 nt, Human
acauugggucuauuccagcuc

SEQ ID NO: 2782736 - RNA, 22 nt, Human
acauugggucuauuccagcuca

SEQ ID NO: 2782737 - RNA, 23 nt, Human
acauugggucuauuccagcucau

SEQ ID NO: 2782738 - RNA, 21 nt, Human
acauuguaaauaguauuugag

SEQ ID NO: 2782739 - RNA, 19 nt, Human
acauuguaaauaguauuug

SEQ ID NO: 2782740 - RNA, 17 nt, Human
acauuguaaauaguauu

SEQ ID NO: 2782741 - RNA, 17 nt, Human
acauuguuugcugcuau

SEQ ID NO: 2782742 - RNA, 18 nt, Human
acauuguuugcugcuauu

SEQ ID NO: 2782743 - RNA, 13 nt, Human
acauuguuuuaaa

SEQ ID NO: 2782744 - RNA, 15 nt, Human
acauuguuuuaaaaa

SEQ ID NO: 2782745 - RNA, 16 nt, Human
acauuguuuuaaaaag

SEQ ID NO: 2782746 - RNA, 17 nt, Human
acauuguuuuaaaaaga

SEQ ID NO: 2782747 - RNA, 18 nt, Human
acauuguuuuaaaaagaa

SEQ ID NO: 2782748 - RNA, 15 nt, Human
acauugggaagggga

SEQ ID NO: 2782749 - RNA, 19 nt, Human
acauugggaaggggacccc

SEQ ID NO: 2782750 - RNA, 23 nt, Human
acauugggaaggggacccccgcc

SEQ ID NO: 2782751 - RNA, 16 nt, Human
acauuggauuauccug

SEQ ID NO: 2782752 - RNA, 22 nt, Human
acauuggagaugccauccucuu

SEQ ID NO: 2782753 - RNA, 18 nt, Human
acauuggauuauccugag

SEQ ID NO: 2782754 - RNA, 22 nt, Human
acauugcggacagccacggcca

SEQ ID NO: 2782755 - RNA, 21 nt, Human
acauugcggacagccacggcc

SEQ ID NO: 2782756 - RNA, 23 nt, Human
acauugcguuugaccuuuuaugu

SEQ ID NO: 2782757 - RNA, 15 nt, Human
acauugcguuugacc

SEQ ID NO: 2782758 - RNA, 20 nt, Human
acauugcuugugccacaccc

SEQ ID NO: 2782759 - RNA, 19 nt, Human
acauuuuuccguuugcuuu

SEQ ID NO: 2782760 - RNA, 21 nt, Human
acauuuuuccguuugcuuuug

SEQ ID NO: 2782761 - RNA, 12 nt, Human
acauuuuuauuu

SEQ ID NO: 2782762 - RNA, 13 nt, Human
acauuuuuauuua

SEQ ID NO: 2782763 - RNA, 15 nt, Human
acauuuuuauuuaug

SEQ ID NO: 2782764 - RNA, 16 nt, Human
acauuuuuauuuauga

SEQ ID NO: 2782765 - RNA, 17 nt, Human
acauuuuuauuuaugaa

SEQ ID NO: 2782766 - RNA, 18 nt, Human
acauuuuuauuuaugaag

SEQ ID NO: 2782767 - RNA, 23 nt, Human
acauuuuuauuuaugaaguuuaa

SEQ ID NO: 2782768 - RNA, 14 nt, Human
acauuuuuucauca

SEQ ID NO: 2782769 - RNA, 18 nt, Human
acauuuuuuuuuuaaauc

SEQ ID NO: 2782770 - RNA, 14 nt, Human
acauuuuacauuaa

SEQ ID NO: 2782771 - RNA, 12 nt, Human
acauuuuaacaa

SEQ ID NO: 2782772 - RNA, 13 nt, Human
acauuuuaacaag

SEQ ID NO: 2782773 - RNA, 14 nt, Human
acauuuuaacaaga

SEQ ID NO: 2782774 - RNA, 15 nt, Human
acauuuuaacaagaa

SEQ ID NO: 2782775 - RNA, 17 nt, Human
acauuuuaacaagaaga

SEQ ID NO: 2782776 - RNA, 18 nt, Human
acauuuuaacaagaagau

SEQ ID NO: 2782777 - RNA, 21 nt, Human
acauuuuaacaagaagaugaa

SEQ ID NO: 2782778 - RNA, 16 nt, Human
acauuuaauaucuuca

SEQ ID NO: 2782779 - RNA, 12 nt, Human
acauuuaauuua

SEQ ID NO: 2782780 - RNA, 15 nt, Human
acauuuaauuuagug

SEQ ID NO: 2782781 - RNA, 19 nt, Human
acauuuaauuuagugaucu

SEQ ID NO: 2782782 - RNA, 20 nt, Human
acauuuaagagacagucacc

SEQ ID NO: 2782783 - RNA, 21 nt, Human
acauuuaaggaugggguuaug

SEQ ID NO: 2782784 - RNA, 13 nt, Human
acauuuaaagcau

SEQ ID NO: 2782785 - RNA, 14 nt, Human
acauuuaaagcauu

SEQ ID NO: 2782786 - RNA, 19 nt, Human
acauuuaaagcauugcugu

SEQ ID NO: 2782787 - RNA, 20 nt, Human
acauuuaaagcauugcuguu

SEQ ID NO: 2782788 - RNA, 10 nt, Human
acauuuaaaa

SEQ ID NO: 2782789 - RNA, 23 nt, Human
acauuuaaauuuuacccuuuaga

SEQ ID NO: 2782790 - RNA, 14 nt, Human
acauuuaaaacuua

SEQ ID NO: 2782791 - RNA, 12 nt, Human
acauuuaaaauu

SEQ ID NO: 2782792 - RNA, 17 nt, Human
acauuuaaaauugcuau

SEQ ID NO: 2782793 - RNA, 18 nt, Human
acauuuuacuuuuuccug

SEQ ID NO: 2782794 - RNA, 18 nt, Human
acauuuuacauuaaauuu

SEQ ID NO: 2782795 - RNA, 15 nt, Human
acauuuuacauuaaa

SEQ ID NO: 2782796 - RNA, 18 nt, Human
acauuuuagcucuauuga

SEQ ID NO: 2782797 - RNA, 12 nt, Human
acauuuuguucu

SEQ ID NO: 2782798 - RNA, 14 nt, Human
acauuuuguucuua

SEQ ID NO: 2782799 - RNA, 18 nt, Human
acauuuuguucuuacaca

SEQ ID NO: 2782800 - RNA, 19 nt, Human
acauuuuguucuuacacau

SEQ ID NO: 2782801 - RNA, 20 nt, Human
acauuuuguucuuacacaua

SEQ ID NO: 2782802 - RNA, 13 nt, Human
acauuuuguugua

SEQ ID NO: 2782803 - RNA, 14 nt, Human
acauuuuguuguaa

SEQ ID NO: 2782804 - RNA, 15 nt, Human
acauuuuguuguaaa

SEQ ID NO: 2782805 - RNA, 16 nt, Human
acauuuuguuguaaaa

SEQ ID NO: 2782806 - RNA, 17 nt, Human
acauuuuguuguaaaaa

SEQ ID NO: 2782807 - RNA, 19 nt, Human
acauuuuguuguaaaaaga

SEQ ID NO: 2782808 - RNA, 20 nt, Human
acauuuuguuguaaaaagaa

SEQ ID NO: 2782809 - RNA, 21 nt, Human
acauuuuguuguaaaaagaaa

SEQ ID NO: 2782810 - RNA, 23 nt, Human
acauuuuguuguaaaaagaaaaa

SEQ ID NO: 2782811 - RNA, 14 nt, Human
acauuuuuaaauug

SEQ ID NO: 2782812 - RNA, 20 nt, Human
acauuuuuaaauuguuagcu

SEQ ID NO: 2782813 - RNA, 13 nt, Human
accacacccagcc

SEQ ID NO: 2782814 - RNA, 12 nt, Human
accacacccagc

SEQ ID NO: 2782815 - RNA, 21 nt, Human
ucacagaacccuuggagccaa

SEQ ID NO: 2782816 - RNA, 22 nt, Human
ucacagaugaguuaucuaagaa

SEQ ID NO: 2782817 - RNA, 15 nt, Human
ucacagcagcuucua

SEQ ID NO: 2782818 - RNA, 16 nt, Human
ucacagcuccucccac

SEQ ID NO: 2782819 - RNA, 11 nt, Human
ucacagcuccu

SEQ ID NO: 2782820 - RNA, 14 nt, Human
ucacagcuccuccc

SEQ ID NO: 2782821 - RNA, 13 nt, Human
ucacaucacagga

SEQ ID NO: 2782822 - RNA, 13 nt, Human
ucacaucagauaa

SEQ ID NO: 2782823 - RNA, 16 nt, Human
ucacaucagauaagac

SEQ ID NO: 2782824 - RNA, 17 nt, Human
ucacaucagauaagaca

SEQ ID NO: 2782825 - RNA, 18 nt, Human
ucacaucagauaagacau

SEQ ID NO: 2782826 - RNA, 23 nt, Human
ucacauauuuuauuaagaacuca

SEQ ID NO: 2782827 - RNA, 16 nt, Human
ucaccagccccagugc

SEQ ID NO: 2782828 - RNA, 17 nt, Human
ucaccagccccagugcc

SEQ ID NO: 2782829 - RNA, 17 nt, Human
ucacauuccccugggga

SEQ ID NO: 2782830 - RNA, 18 nt, Human
ucacauuccccuggggac

SEQ ID NO: 2782831 - RNA, 21 nt, Human
ucacauuccccuggggaccca

SEQ ID NO: 2782832 - RNA, 13 nt, Human
ucacauuagaauu

SEQ ID NO: 2782833 - RNA, 15 nt, Human
ucacauuagaauuag

SEQ ID NO: 2782834 - RNA, 21 nt, Human
ucacauggugcuacgccugca

SEQ ID NO: 2782835 - RNA, 16 nt, Human
ucacauggugccccua

SEQ ID NO: 2782836 - RNA, 18 nt, Human
ucacauggugccccuagc

SEQ ID NO: 2782837 - RNA, 16 nt, Human
ucacauggccuaugca

SEQ ID NO: 2782838 - RNA, 21 nt, Human
ucacauggccuaugcacauau

SEQ ID NO: 2782839 - RNA, 20 nt, Human
ucacauuaauauuugcugac

SEQ ID NO: 2782840 - RNA, 16 nt, Human
ucacauuaauggucua

SEQ ID NO: 2782841 - RNA, 19 nt, Human
ucacauuaauggucuaaaa

SEQ ID NO: 2782842 - RNA, 22 nt, Human
ucacauuaauggucuaaaaaua

SEQ ID NO: 2782843 - RNA, 21 nt, Human
ucacauuaaaaaaugaaauau

SEQ ID NO: 2782844 - RNA, 22 nt, Human
ucacauuaaaaaaugaaauauu

SEQ ID NO: 2782845 - RNA, 19 nt, Human
ucacauuaauauuugcuga

SEQ ID NO: 2782846 - RNA, 20 nt, Human
accacaaagcacaguuugaa

SEQ ID NO: 2782847 - RNA, 10 nt, Human
accacaaagg

SEQ ID NO: 2782848 - RNA, 14 nt, Human
accacaaaggccaa

SEQ ID NO: 2782849 - RNA, 18 nt, Human
accacaaaggccaaacug

SEQ ID NO: 2782850 - RNA, 20 nt, Human
accacaaaggccaaacugcu

SEQ ID NO: 2782851 - RNA, 21 nt, Human
accacaaaggccaaacugcug

SEQ ID NO: 2782852 - RNA, 21 nt, Human
accaaugccaaaaaaagacag

SEQ ID NO: 2782853 - RNA, 16 nt, Human
accaaugccaagauaa

SEQ ID NO: 2782854 - RNA, 22 nt, Human
accaaugccaagauaauucacu

SEQ ID NO: 2782855 - RNA, 18 nt, Human
accaaugcuuuuaucaaa

SEQ ID NO: 2782856 - RNA, 19 nt, Human
accaaugcuuuuaucaaac

SEQ ID NO: 2782857 - RNA, 22 nt, Human
accaacacccaaagcauggacu

SEQ ID NO: 2782858 - RNA, 15 nt, Human
accaacccucagagc

SEQ ID NO: 2782859 - RNA, 23 nt, Human
accacacccagcccacuucugcc

SEQ ID NO: 2782860 - RNA, 21 nt, Human
accacacccagcccacuucug

SEQ ID NO: 2782861 - RNA, 20 nt, Human
accacacccagcccacuucu

SEQ ID NO: 2782862 - RNA, 16 nt, Human
accacacccagcccac

SEQ ID NO: 2782863 - RNA, 15 nt, Human
accacacccagccca

SEQ ID NO: 2782864 - RNA, 13 nt, Human
accacacauccca

SEQ ID NO: 2782865 - RNA, 14 nt, Human
accacacaucccag

SEQ ID NO: 2782866 - RNA, 15 nt, Human
accacacaucccagc

SEQ ID NO: 2782867 - RNA, 17 nt, Human
accacacaucccagccc

SEQ ID NO: 2782868 - RNA, 18 nt, Human
accacacaucccagccca

SEQ ID NO: 2782869 - RNA, 19 nt, Human
accacacaucccagcccaa

SEQ ID NO: 2782870 - RNA, 15 nt, Human
accacacaucuauga

SEQ ID NO: 2782871 - RNA, 12 nt, Human
accacaagggcu

SEQ ID NO: 2782872 - RNA, 13 nt, Human
accacacacaaca

SEQ ID NO: 2782873 - RNA, 14 nt, Human
accacacacaacag

SEQ ID NO: 2782874 - RNA, 15 nt, Human
accacacacaacagc

SEQ ID NO: 2782875 - RNA, 18 nt, Human
accacacacaacagccaa

SEQ ID NO: 2782876 - RNA, 18 nt, Human
accacacaccucaccaga

SEQ ID NO: 2782877 - RNA, 11 nt, Human
accacacaaag

SEQ ID NO: 2782878 - RNA, 14 nt, Human
accacacaaagaca

SEQ ID NO: 2782879 - RNA, 13 nt, Human
accacaacugaca

SEQ ID NO: 2782880 - RNA, 15 nt, Human
accacaacugacaca

SEQ ID NO: 2782881 - RNA, 16 nt, Human
accacaacugacacag

SEQ ID NO: 2782882 - RNA, 19 nt, Human
accacaacugacacaggaa

SEQ ID NO: 2782883 - RNA, 20 nt, Human
accaaaucucucaaaucugu

SEQ ID NO: 2782884 - RNA, 17 nt, Human
accaaauuuuucuauca

SEQ ID NO: 2782885 - RNA, 22 nt, Human
accaacaggcuguucugcacug

SEQ ID NO: 2782886 - RNA, 23 nt, Human
accaacaggcuguucugcacuga

SEQ ID NO: 2782887 - RNA, 16 nt, Human
accaacaguuccuuca

SEQ ID NO: 2782888 - RNA, 15 nt, Human
acauuggaaagcaca

SEQ ID NO: 2782889 - RNA, 19 nt, Human
accaaaaacugaaagugaa

SEQ ID NO: 2782890 - RNA, 12 nt, Human
accaaaguucua

SEQ ID NO: 2782891 - RNA, 18 nt, Human
accaaauaaaaauauugu

SEQ ID NO: 2782892 - RNA, 16 nt, Human
accaaauaaaaauauu

SEQ ID NO: 2782893 - RNA, 14 nt, Human
accaaaguucuaau

SEQ ID NO: 2782894 - RNA, 15 nt, Human
accaaaguucuaaua

SEQ ID NO: 2782895 - RNA, 20 nt, Human
accaaaguucuaauaauuuc

SEQ ID NO: 2782896 - RNA, 21 nt, Human
accaaaguucuaauaauuucu

SEQ ID NO: 2782897 - RNA, 23 nt, Human
accaaaguucuaauaauuucuaa

SEQ ID NO: 2782898 - RNA, 12 nt, Human
accaaaguuuua

SEQ ID NO: 2782899 - RNA, 17 nt, Human
uauuuguuauuuucagu

SEQ ID NO: 2782900 - RNA, 13 nt, Human
uauuuguuuucau

SEQ ID NO: 2782901 - RNA, 14 nt, Human
uauuuguuuucaug

SEQ ID NO: 2782902 - RNA, 17 nt, Human
uauuuguuuuucauuca

SEQ ID NO: 2782903 - RNA, 19 nt, Human
uauuuuaaaaaaugaaaau

SEQ ID NO: 2782904 - RNA, 18 nt, Human
uauuuguuauuuucagua

SEQ ID NO: 2782905 - RNA, 14 nt, Human
uauuuguucauguu

SEQ ID NO: 2782906 - RNA, 15 nt, Human
uauuuguucauguuu

SEQ ID NO: 2782907 - RNA, 16 nt, Human
uauuuguucauguuug

SEQ ID NO: 2782908 - RNA, 22 nt, Human
uauuuguucauguuuggugcau

SEQ ID NO: 2782909 - RNA, 16 nt, Human
uauuuguucuucaaga

SEQ ID NO: 2782910 - RNA, 15 nt, Human
uauuuguaggagaaa

SEQ ID NO: 2782911 - RNA, 12 nt, Human
uauuuuaaaagc

SEQ ID NO: 2782912 - RNA, 14 nt, Human
uauuuuaaaagcca

SEQ ID NO: 2782913 - RNA, 23 nt, Human
uauuuuaaaagccacauagagug

SEQ ID NO: 2782914 - RNA, 12 nt, Human
uauuuuaaacaa

SEQ ID NO: 2782915 - RNA, 14 nt, Human
uauuuuaaacaaaa

SEQ ID NO: 2782916 - RNA, 19 nt, Human
uauuuuaaacaaaauagaa

SEQ ID NO: 2782917 - RNA, 23 nt, Human
uauuuguaaggcuuguuccaaug

SEQ ID NO: 2782918 - RNA, 12 nt, Human
uauuuguacaua

SEQ ID NO: 2782919 - RNA, 23 nt, Human
uauuuguacuguuuaauguucug

SEQ ID NO: 2782920 - RNA, 24 nt, Human
uauuuguacuguuuaauguucugu

SEQ ID NO: 2782921 - RNA, 16 nt, Human
uauuuguuauggcaga

SEQ ID NO: 2782922 - RNA, 14 nt, Human
uauuuguuauuuuc

SEQ ID NO: 2782923 - RNA, 12 nt, Human
uauuuguguuuu

SEQ ID NO: 2782924 - RNA, 19 nt, Human
uauuuguguuuuaauuuaa

SEQ ID NO: 2782925 - RNA, 21 nt, Human
uauuuguguuuuaauuuaaac

SEQ ID NO: 2782926 - RNA, 22 nt, Human
uauuuguaucucugaagcaugu

SEQ ID NO: 2782927 - RNA, 23 nt, Human
uauuuguaucucugaagcauguu

SEQ ID NO: 2782928 - RNA, 12 nt, Human
uauuuguaucuc

SEQ ID NO: 2782929 - RNA, 15 nt, Human
uauuuguaucucuga

SEQ ID NO: 2782930 - RNA, 15 nt, Human
uauuugucuuucagg

SEQ ID NO: 2782931 - RNA, 17 nt, Human
acaucuugcucugcuga

SEQ ID NO: 2782932 - RNA, 22 nt, Human
acaucuugcucugcugacagac

SEQ ID NO: 2782933 - RNA, 14 nt, Human
acaucuugcucugc

SEQ ID NO: 2782934 - RNA, 13 nt, Human
acaucuuggcaca

SEQ ID NO: 2782935 - RNA, 24 nt, Human
acaucuuggcacauuuaagagaca

SEQ ID NO: 2782936 - RNA, 17 nt, Human
acaucuuuaucuguucu

SEQ ID NO: 2782937 - RNA, 14 nt, Human
acaucuuuccuguc

SEQ ID NO: 2782938 - RNA, 18 nt, Human
acaucuuucucuuuucua

SEQ ID NO: 2782939 - RNA, 16 nt, Human
acaucuuuuaagacaa

SEQ ID NO: 2782940 - RNA, 18 nt, Human
acaucuuuuaagacaaau

SEQ ID NO: 2782941 - RNA, 15 nt, Human
acaucuuuuuucaca

SEQ ID NO: 2782942 - RNA, 19 nt, Human
acaucuuuuuucacaaauu

SEQ ID NO: 2782943 - RNA, 16 nt, Human
acaucuuuuuaaagcu

SEQ ID NO: 2782944 - RNA, 18 nt, Human
acaucuuuuuaaagcuua

SEQ ID NO: 2782945 - RNA, 19 nt, Human
acaucuuuuuaaagcuuau

SEQ ID NO: 2782946 - RNA, 22 nt, Human
acaucuuuuuaaagcuuaucca

SEQ ID NO: 2782947 - RNA, 16 nt, Human
acaucuugcucugcug

SEQ ID NO: 2782948 - RNA, 15 nt, Human
acaucuugcucugcu

SEQ ID NO: 2782949 - RNA, 17 nt, Human
uauguguaaaaugugaa

SEQ ID NO: 2782950 - RNA, 14 nt, Human
uauguguaaaaugu

SEQ ID NO: 2782951 - RNA, 19 nt, Human
uaugugguuuuagauuuuc

SEQ ID NO: 2782952 - RNA, 16 nt, Human
uaugugguuuuagauu

SEQ ID NO: 2782953 - RNA, 18 nt, Human
uaugugguuuuagauuuu

SEQ ID NO: 2782954 - RNA, 19 nt, Human
uauguggguugccugguga

SEQ ID NO: 2782955 - RNA, 19 nt, Human
uauuuuaagcacucuuaaa

SEQ ID NO: 2782956 - RNA, 22 nt, Human
uauuuuaaaggggucugaaauu

SEQ ID NO: 2782957 - RNA, 19 nt, Human
uauuuuaauuuaugaguuu

SEQ ID NO: 2782958 - RNA, 13 nt, Human
uauuuuaauguga

SEQ ID NO: 2782959 - RNA, 14 nt, Human
uauuuuaaugugau

SEQ ID NO: 2782960 - RNA, 21 nt, Human
uauuuuaaugugaugauguaa

SEQ ID NO: 2782961 - RNA, 19 nt, Human
uauuuuacacagaaacacu

SEQ ID NO: 2782962 - RNA, 18 nt, Human
uauuuuacacagaaacac

SEQ ID NO: 2782963 - RNA, 17 nt, Human
uauuuuacacagaaaca

SEQ ID NO: 2782964 - RNA, 15 nt, Human
uauuuuacacagaaa

SEQ ID NO: 2782965 - RNA, 14 nt, Human
uauuuuacacagaa

SEQ ID NO: 2782966 - RNA, 23 nt, Human
uauuuuggauuguauauuguguu

SEQ ID NO: 2782967 - RNA, 20 nt, Human
uauuuuggauuguauauugu

SEQ ID NO: 2782968 - RNA, 16 nt, Human
uauuuuggagaaauua

SEQ ID NO: 2782969 - RNA, 18 nt, Human
uauuuuggaaagaagaaa

SEQ ID NO: 2782970 - RNA, 14 nt, Human
uauuuuggaaaguu

SEQ ID NO: 2782971 - RNA, 15 nt, Human
uauuuuggaaaguuu

SEQ ID NO: 2782972 - RNA, 24 nt, Human
uauuuuacacagaaacacugccuu

SEQ ID NO: 2782973 - RNA, 23 nt, Human
uauuuuacacagaaacacugccu

SEQ ID NO: 2782974 - RNA, 13 nt, Human
uauuuuaccauac

SEQ ID NO: 2782975 - RNA, 12 nt, Human
uauuuuacuauu

SEQ ID NO: 2782976 - RNA, 17 nt, Human
uauuuuacuauuggaau

SEQ ID NO: 2782977 - RNA, 14 nt, Human
uauuuugauaauaa

SEQ ID NO: 2782978 - RNA, 15 nt, Human
uauuuugauaauaaa

SEQ ID NO: 2782979 - RNA, 18 nt, Human
uauuuugauaauaaauug

SEQ ID NO: 2782980 - RNA, 20 nt, Human
uauuuugauaauaaauugaa

SEQ ID NO: 2782981 - RNA, 15 nt, Human
uauuuugauaauaau

SEQ ID NO: 2782982 - RNA, 18 nt, Human
uauuuugauaauaauauu

SEQ ID NO: 2782983 - RNA, 19 nt, Human
uauuuugauaauaauauug

SEQ ID NO: 2782984 - RNA, 13 nt, Human
uauuuugaugcag

SEQ ID NO: 2782985 - RNA, 15 nt, Human
uauuuugaugcagca

SEQ ID NO: 2782986 - RNA, 17 nt, Human
uauuuugaugcagcauu

SEQ ID NO: 2782987 - RNA, 19 nt, Human
uauuuugaugcagcauuug

SEQ ID NO: 2782988 - RNA, 23 nt, Human
uauuuugaugcagcauuugauaa

SEQ ID NO: 2782989 - RNA, 13 nt, Human
uauuuugccauuu

SEQ ID NO: 2782990 - RNA, 16 nt, Human
uauuuugccauuuagc

SEQ ID NO: 2782991 - RNA, 14 nt, Human
uauuuugcacaguu

SEQ ID NO: 2782992 - RNA, 13 nt, Human
uauuuugugugac

SEQ ID NO: 2782993 - RNA, 15 nt, Human
uauuuugugugacca

SEQ ID NO: 2782994 - RNA, 17 nt, Human
uauuuugugugaccaac

SEQ ID NO: 2782995 - RNA, 21 nt, Human
uauuuugugugaccaacugug

SEQ ID NO: 2782996 - RNA, 22 nt, Human
uauuuugugugaccaacugugu

SEQ ID NO: 2782997 - RNA, 23 nt, Human
uauuuugugugaccaacuguguu

SEQ ID NO: 2782998 - RNA, 17 nt, Human
uauuuugugcucauuua

SEQ ID NO: 2782999 - RNA, 17 nt, Human
uauuuuguggaggcagu

SEQ ID NO: 2783000 - RNA, 21 nt, Human
uauuuuguggaggcaguguca

SEQ ID NO: 2783001 - RNA, 23 nt, Human
uauuuuguggaggcagugucauu

SEQ ID NO: 2783002 - RNA, 19 nt, Human
uauuuuguauuauugcugu

SEQ ID NO: 2783003 - RNA, 20 nt, Human
uauuuuguauuauugcuguu

SEQ ID NO: 2783004 - RNA, 16 nt, Human
uauuuuguauuguggu

SEQ ID NO: 2783005 - RNA, 17 nt, Human
uauuuuguauuguggua

SEQ ID NO: 2783006 - RNA, 21 nt, Human
uauuuuguaaacucaaaauau

SEQ ID NO: 2783007 - RNA, 15 nt, Human
uauuuuguauauauc

SEQ ID NO: 2783008 - RNA, 20 nt, Human
uauuuuguaaacucaaaaua

SEQ ID NO: 2783009 - RNA, 13 nt, Human
uauuuuguaaacu

SEQ ID NO: 2783010 - RNA, 11 nt, Human
uauuuuucaua

SEQ ID NO: 2783011 - RNA, 13 nt, Human
uauuuuucauauu

SEQ ID NO: 2783012 - RNA, 14 nt, Human
uauuuuucauauug

SEQ ID NO: 2783013 - RNA, 13 nt, Human
uauuuuucagaga

SEQ ID NO: 2783014 - RNA, 21 nt, Human
uauuuuucagagauuuauaua

SEQ ID NO: 2783015 - RNA, 14 nt, Human
uauuuuucaguucc

SEQ ID NO: 2783016 - RNA, 17 nt, Human
uauuuuucaguuccaag

SEQ ID NO: 2783017 - RNA, 14 nt, Human
uauuuuucaaggaa

SEQ ID NO: 2783018 - RNA, 15 nt, Human
uauuuuucaaggaag

SEQ ID NO: 2783019 - RNA, 23 nt, Human
uauuuuuaaaaaaugaaauccuu

SEQ ID NO: 2783020 - RNA, 15 nt, Human
uauuuuuaaaaagaa

SEQ ID NO: 2783021 - RNA, 19 nt, Human
uauuuuuaaaaagaaaucu

SEQ ID NO: 2783022 - RNA, 13 nt, Human
uauuuuuaaaaga

SEQ ID NO: 2783023 - RNA, 17 nt, Human
uauuuuuaaaagaucuu

SEQ ID NO: 2783024 - RNA, 13 nt, Human
uauuuuuaaagau

SEQ ID NO: 2783025 - RNA, 15 nt, Human
uauuuuuaaagauag

SEQ ID NO: 2783026 - RNA, 17 nt, Human
uauuuuuguagagccag

SEQ ID NO: 2783027 - RNA, 17 nt, Human
uauuuuguuucuuuuaa

SEQ ID NO: 2783028 - RNA, 12 nt, Human
uauuuuuguaaa

SEQ ID NO: 2783029 - RNA, 13 nt, Human
uauuuuuguaaac

SEQ ID NO: 2783030 - RNA, 13 nt, Human
uauuuuucuaaac

SEQ ID NO: 2783031 - RNA, 13 nt, Human
uauuuuugcccug

SEQ ID NO: 2783032 - RNA, 15 nt, Human
uauuuuucauauugu

SEQ ID NO: 2783033 - RNA, 19 nt, Human
uauuuuucauauugugcca

SEQ ID NO: 2783034 - RNA, 13 nt, Human
ucaaaaguuccaa

SEQ ID NO: 2783035 - RNA, 14 nt, Human
ucaaaaguuccaag

SEQ ID NO: 2783036 - RNA, 21 nt, Human
ucaaaaguuccaagagucuaa

SEQ ID NO: 2783037 - RNA, 15 nt, Human
ucaaaaguuccaaga

SEQ ID NO: 2783038 - RNA, 17 nt, Human
ucaaaaguuccaagagu

SEQ ID NO: 2783039 - RNA, 11 nt, Human
ucaaaaggaac

SEQ ID NO: 2783040 - RNA, 21 nt, Human
ucaaaaggaaccaggagguuu

SEQ ID NO: 2783041 - RNA, 17 nt, Human
ucaaaaguaaugccucu

SEQ ID NO: 2783042 - RNA, 16 nt, Human
ucaaacagaauuuuaa

SEQ ID NO: 2783043 - RNA, 12 nt, Human
ucaaagaugcug

SEQ ID NO: 2783044 - RNA, 23 nt, Human
ucaaagcaaaugucuuccuggau

SEQ ID NO: 2783045 - RNA, 15 nt, Human
ucaaagcaaaugucu

SEQ ID NO: 2783046 - RNA, 19 nt, Human
ucaaagaugcugugagucu

SEQ ID NO: 2783047 - RNA, 17 nt, Human
ucaaaguucugcuuucu

SEQ ID NO: 2783048 - RNA, 19 nt, Human
ucaaaguaaaacuugcugc

SEQ ID NO: 2783049 - RNA, 13 nt, Human
ucaaaguauuugu

SEQ ID NO: 2783050 - RNA, 13 nt, Human
ucaaagucaaaaa

SEQ ID NO: 2783051 - RNA, 14 nt, Human
ucaaaguaaaacuu

SEQ ID NO: 2783052 - RNA, 21 nt, Human
ucaaagguucuagguuucaaa

SEQ ID NO: 2783053 - RNA, 23 nt, Human
ucaaagguucuagguuucaaaga

SEQ ID NO: 2783054 - RNA, 12 nt, Human
ucaaagguucua

SEQ ID NO: 2783055 - RNA, 16 nt, Human
ucaaagguucuagguu

SEQ ID NO: 2783056 - RNA, 20 nt, Human
ucaaagguucuagguuucaa

SEQ ID NO: 2783057 - RNA, 15 nt, Human
acaugaaacagaaac

SEQ ID NO: 2783058 - RNA, 18 nt, Human
acaugaaaccuacacacu

SEQ ID NO: 2783059 - RNA, 20 nt, Human
acaugaaaccuacacacugu

SEQ ID NO: 2783060 - RNA, 23 nt, Human
acaugaaaccuacacacugucau

SEQ ID NO: 2783061 - RNA, 13 nt, Human
acaugaaacagaa

SEQ ID NO: 2783062 - RNA, 14 nt, Human
acaugaaaauuuua

SEQ ID NO: 2783063 - RNA, 15 nt, Human
acaugaaaauuuuaa

SEQ ID NO: 2783064 - RNA, 16 nt, Human
acaugaaaauuuuaaa

SEQ ID NO: 2783065 - RNA, 18 nt, Human
acaugaaaauuuuaaaaa

SEQ ID NO: 2783066 - RNA, 23 nt, Human
acaugaaaauuuuaaaaauacau

SEQ ID NO: 2783067 - RNA, 21 nt, Human
acaugaaaguagcagugugaa

SEQ ID NO: 2783068 - RNA, 12 nt, Human
acaugaaaugau

SEQ ID NO: 2783069 - RNA, 13 nt, Human
acaugaaaugaua

SEQ ID NO: 2783070 - RNA, 17 nt, Human
acaugaaauuuuuguaa

SEQ ID NO: 2783071 - RNA, 18 nt, Human
acaugaaauuuuuguaaa

SEQ ID NO: 2783072 - RNA, 19 nt, Human
acaugaaauuuuuguaaau

SEQ ID NO: 2783073 - RNA, 19 nt, Human
acaugaacacccuuagaaa

SEQ ID NO: 2783074 - RNA, 15 nt, Human
acaugagaacaaaca

SEQ ID NO: 2783075 - RNA, 13 nt, Human
acaugacacugac

SEQ ID NO: 2783076 - RNA, 14 nt, Human
acaugacacugacc

SEQ ID NO: 2783077 - RNA, 15 nt, Human
acaugacacugaccu

SEQ ID NO: 2783078 - RNA, 16 nt, Human
acaugacacugaccuu

SEQ ID NO: 2783079 - RNA, 18 nt, Human
acaugacauuuaccagca

SEQ ID NO: 2783080 - RNA, 15 nt, Human
acaugacacccguga

SEQ ID NO: 2783081 - RNA, 11 nt, Human
acaugacacug

SEQ ID NO: 2783082 - RNA, 12 nt, Human
acaugacacuga

SEQ ID NO: 2783083 - RNA, 13 nt, Human
acaugaagaaaua

SEQ ID NO: 2783084 - RNA, 22 nt, Human
acaugucuuguacauguguagc

SEQ ID NO: 2783085 - RNA, 16 nt, Human
acaugucuuguacaug

SEQ ID NO: 2783086 - RNA, 19 nt, Human
acaugucuuguacaugugu

SEQ ID NO: 2783087 - RNA, 13 nt, Human
acaugucuuguac

SEQ ID NO: 2783088 - RNA, 14 nt, Human
acaugucuuguaca

SEQ ID NO: 2783089 - RNA, 13 nt, Human
acaugucuuccau

SEQ ID NO: 2783090 - RNA, 20 nt, Human
acaugucuuccauguaucuu

SEQ ID NO: 2783091 - RNA, 19 nt, Human
acauuacucugccucugua

SEQ ID NO: 2783092 - RNA, 16 nt, Human
acauuaccuuacugug

SEQ ID NO: 2783093 - RNA, 19 nt, Human
acauuaccuuacuguggag

SEQ ID NO: 2783094 - RNA, 20 nt, Human
acauuagaauaaaagguagu

SEQ ID NO: 2783095 - RNA, 15 nt, Human
acauuauagauuuuc

SEQ ID NO: 2783096 - RNA, 15 nt, Human
acauuaccuuacugu

SEQ ID NO: 2783097 - RNA, 18 nt, Human
acauuagaacacugcauu

SEQ ID NO: 2783098 - RNA, 11 nt, Human
acauuagaacu

SEQ ID NO: 2783099 - RNA, 12 nt, Human
acauuagaacuu

SEQ ID NO: 2783100 - RNA, 13 nt, Human
acauuagaacuuc

SEQ ID NO: 2783101 - RNA, 14 nt, Human
acauuagaacuucu

SEQ ID NO: 2783102 - RNA, 22 nt, Human
acauuagaacuucuccguccuc

SEQ ID NO: 2783103 - RNA, 21 nt, Human
acauuaaucaaucaucugugu

SEQ ID NO: 2783104 - RNA, 17 nt, Human
acauuaauggucuaaaa

SEQ ID NO: 2783105 - RNA, 20 nt, Human
acauuaauggucuaaaaaua

SEQ ID NO: 2783106 - RNA, 19 nt, Human
acauggugcuacgccugca

SEQ ID NO: 2783107 - RNA, 23 nt, Human
acauggugcuacgccugcaugua

SEQ ID NO: 2783108 - RNA, 21 nt, Human
acaugguggcaugcaccugca

SEQ ID NO: 2783109 - RNA, 23 nt, Human
acauggugucuggauucccagga

SEQ ID NO: 2783110 - RNA, 17 nt, Human
acaugguuugacucccg

SEQ ID NO: 2783111 - RNA, 15 nt, Human
acauguauuauuuca

SEQ ID NO: 2783112 - RNA, 13 nt, Human
acauguauuuaug

SEQ ID NO: 2783113 - RNA, 14 nt, Human
acauguauuuaugu

SEQ ID NO: 2783114 - RNA, 15 nt, Human
acauguauuuaugua

SEQ ID NO: 2783115 - RNA, 18 nt, Human
acauguauuuauguaaug

SEQ ID NO: 2783116 - RNA, 15 nt, Human
acauggacucagaga

SEQ ID NO: 2783117 - RNA, 14 nt, Human
acaugaggaacugu

SEQ ID NO: 2783118 - RNA, 20 nt, Human
acaugagauguguggacugu

SEQ ID NO: 2783119 - RNA, 18 nt, Human
acaugagauguguggacu

SEQ ID NO: 2783120 - RNA, 23 nt, Human
acaugagauguguggacuguggc

SEQ ID NO: 2783121 - RNA, 14 nt, Human
acaugagauuuaua

SEQ ID NO: 2783122 - RNA, 21 nt, Human
acaugaggaacuguagaugau

SEQ ID NO: 2783123 - RNA, 18 nt, Human
acaugaggaacuguagau

SEQ ID NO: 2783124 - RNA, 17 nt, Human
acaugaggaacuguaga

SEQ ID NO: 2783125 - RNA, 22 nt, Human
acaugaggaacuguagaugaug

SEQ ID NO: 2783126 - RNA, 21 nt, Human
acaugaggacaugauggagcg

SEQ ID NO: 2783127 - RNA, 14 nt, Human
acauggagguucua

SEQ ID NO: 2783128 - RNA, 15 nt, Human
acauggagguucuaa

SEQ ID NO: 2783129 - RNA, 16 nt, Human
acauggagguucuaag

SEQ ID NO: 2783130 - RNA, 17 nt, Human
acauggagguucuaagg

SEQ ID NO: 2783131 - RNA, 18 nt, Human
acauggagguucuaaggc

SEQ ID NO: 2783132 - RNA, 19 nt, Human
acauggagguucuaaggcc

SEQ ID NO: 2783133 - RNA, 15 nt, Human
acauggacagaauuu

SEQ ID NO: 2783134 - RNA, 20 nt, Human
acauggccuaugcacauaug

SEQ ID NO: 2783135 - RNA, 17 nt, Human
acauggccuaugcacau

SEQ ID NO: 2783136 - RNA, 18 nt, Human
acauggccuaugcacaua

SEQ ID NO: 2783137 - RNA, 19 nt, Human
acauggcucuggacucuaa

SEQ ID NO: 2783138 - RNA, 20 nt, Human
acauggcucuggacucuaaa

SEQ ID NO: 2783139 - RNA, 22 nt, Human
acauggcucuggacucuaaaga

SEQ ID NO: 2783140 - RNA, 23 nt, Human
acauggcucuggacucuaaagac

SEQ ID NO: 2783141 - RNA, 15 nt, Human
acauggccaguguga

SEQ ID NO: 2783142 - RNA, 14 nt, Human
acauggccagugug

SEQ ID NO: 2783143 - RNA, 21 nt, Human
ucagaugcccagagggcccag

SEQ ID NO: 2783144 - RNA, 22 nt, Human
ucagaugcccagagggcccagg

SEQ ID NO: 2783145 - RNA, 12 nt, Human
ucagaugcucaa

SEQ ID NO: 2783146 - RNA, 13 nt, Human
ucagaugcucaaa

SEQ ID NO: 2783147 - RNA, 21 nt, Human
ucagaugcugugcaaauguua

SEQ ID NO: 2783148 - RNA, 14 nt, Human
ucagaugcuccaag

SEQ ID NO: 2783149 - RNA, 15 nt, Human
ucagaugcuccaaga

SEQ ID NO: 2783150 - RNA, 16 nt, Human
ucagaugcuccaagau

SEQ ID NO: 2783151 - RNA, 18 nt, Human
ucagaugcuccaagauuc

SEQ ID NO: 2783152 - RNA, 19 nt, Human
ucagaugcuccaagauucu

SEQ ID NO: 2783153 - RNA, 20 nt, Human
ucagaugcuccaagauucua

SEQ ID NO: 2783154 - RNA, 22 nt, Human
ucagaugcuccaagauucuaga

SEQ ID NO: 2783155 - RNA, 18 nt, Human
ucagagccccuacagcau

SEQ ID NO: 2783156 - RNA, 20 nt, Human
ucagagccccuacagcauug

SEQ ID NO: 2783157 - RNA, 21 nt, Human
ucagagaucguguauugagau

SEQ ID NO: 2783158 - RNA, 17 nt, Human
ucagagaugugcaccca

SEQ ID NO: 2783159 - RNA, 17 nt, Human
ucagagauuuauauaaa

SEQ ID NO: 2783160 - RNA, 18 nt, Human
ucagagauuuauauaaau

SEQ ID NO: 2783161 - RNA, 19 nt, Human
ucagagauuuauauaaaug

SEQ ID NO: 2783162 - RNA, 21 nt, Human
ucagagccaccccuaaagaga

SEQ ID NO: 2783163 - RNA, 13 nt, Human
ucagagcaggacc

SEQ ID NO: 2783164 - RNA, 14 nt, Human
ucagagcaggaccu

SEQ ID NO: 2783165 - RNA, 18 nt, Human
ucagagcaggaccucccu

SEQ ID NO: 2783166 - RNA, 21 nt, Human
ucagagcaggaccucccuucc

SEQ ID NO: 2783167 - RNA, 12 nt, Human
ucagagagcagc

SEQ ID NO: 2783168 - RNA, 22 nt, Human
ucagagagcgagcgcuacccac

SEQ ID NO: 2783169 - RNA, 15 nt, Human
ucagagacagcugau

SEQ ID NO: 2783170 - RNA, 22 nt, Human
ucagagacaaaauauuucccau

SEQ ID NO: 2783171 - RNA, 21 nt, Human
ucagagacaaaauauuuccca

SEQ ID NO: 2783172 - RNA, 17 nt, Human
ucagagaccugaagugu

SEQ ID NO: 2783173 - RNA, 16 nt, Human
ucagagaccaggcccu

SEQ ID NO: 2783174 - RNA, 18 nt, Human
ucagagaccaggcccugg

SEQ ID NO: 2783175 - RNA, 21 nt, Human
ucagagaccaggcccuggcua

SEQ ID NO: 2783176 - RNA, 14 nt, Human
ucagagacaaaaua

SEQ ID NO: 2783177 - RNA, 23 nt, Human
ucagagaauuucuaccauuucag

SEQ ID NO: 2783178 - RNA, 13 nt, Human
ucagagaauuucu

SEQ ID NO: 2783179 - RNA, 15 nt, Human
acccagcccacuucu

SEQ ID NO: 2783180 - RNA, 14 nt, Human
acccagcaguucug

SEQ ID NO: 2783181 - RNA, 15 nt, Human
acccagcaguucugu

SEQ ID NO: 2783182 - RNA, 17 nt, Human
acccagcaguucuguua

SEQ ID NO: 2783183 - RNA, 22 nt, Human
acccacugguuccuucuuccug

SEQ ID NO: 2783184 - RNA, 13 nt, Human
ucagaauuaugau

SEQ ID NO: 2783185 - RNA, 14 nt, Human
ucagaauuaugaug

SEQ ID NO: 2783186 - RNA, 16 nt, Human
ucagaauuauuuuuaa

SEQ ID NO: 2783187 - RNA, 20 nt, Human
ucagaauuauuuuuaaaaag

SEQ ID NO: 2783188 - RNA, 23 nt, Human
ucagaauagccacauuuggaaua

SEQ ID NO: 2783189 - RNA, 22 nt, Human
ucagaauagccacauuuggaau

SEQ ID NO: 2783190 - RNA, 17 nt, Human
ucagaaucacuucugag

SEQ ID NO: 2783191 - RNA, 19 nt, Human
ucagaaucacuucugagaa

SEQ ID NO: 2783192 - RNA, 21 nt, Human
ucagaauagccacauuuggaa

SEQ ID NO: 2783193 - RNA, 17 nt, Human
ucagaaguuuggcaaua

SEQ ID NO: 2783194 - RNA, 15 nt, Human
ucagaauaaggcagg

SEQ ID NO: 2783195 - RNA, 20 nt, Human
ucagaauaaggcaggcauug

SEQ ID NO: 2783196 - RNA, 21 nt, Human
ucagaauaaggcaggcauuga

SEQ ID NO: 2783197 - RNA, 19 nt, Human
ucagauggaaauauuuuga

SEQ ID NO: 2783198 - RNA, 19 nt, Human
ucagauucccagagcaaaa

SEQ ID NO: 2783199 - RNA, 22 nt, Human
ucagauucccagagcaaaauaa

SEQ ID NO: 2783200 - RNA, 21 nt, Human
ucagauucccagagcaaaaua

SEQ ID NO: 2783201 - RNA, 14 nt, Human
ucagccccugaucc

SEQ ID NO: 2783202 - RNA, 22 nt, Human
ucagccccugauccugugaagu

SEQ ID NO: 2783203 - RNA, 22 nt, Human
acccagccucaguccuccccuc

SEQ ID NO: 2783204 - RNA, 23 nt, Human
acccagccucaguccuccccuca

SEQ ID NO: 2783205 - RNA, 13 nt, Human
acccagcgagccc

SEQ ID NO: 2783206 - RNA, 17 nt, Human
acccagcgagcccuggu

SEQ ID NO: 2783207 - RNA, 16 nt, Human
acccagcgagcccugg

SEQ ID NO: 2783208 - RNA, 15 nt, Human
acccaggagccccga

SEQ ID NO: 2783209 - RNA, 15 nt, Human
acccagggccugcag

SEQ ID NO: 2783210 - RNA, 13 nt, Human
acccaggagcccc

SEQ ID NO: 2783211 - RNA, 15 nt, Human
acccaggacuccucc

SEQ ID NO: 2783212 - RNA, 14 nt, Human
acccaggaccaagc

SEQ ID NO: 2783213 - RNA, 13 nt, Human
accccagguuucu

SEQ ID NO: 2783214 - RNA, 24 nt, Human
accccagggccugagccuggccag

SEQ ID NO: 2783215 - RNA, 17 nt, Human
accccagggccugagcc

SEQ ID NO: 2783216 - RNA, 16 nt, Human
accccaguggccacuc

SEQ ID NO: 2783217 - RNA, 15 nt, Human
accccagggccugag

SEQ ID NO: 2783218 - RNA, 14 nt, Human
accccagggccuga

SEQ ID NO: 2783219 - RNA, 13 nt, Human
accccagggccug

SEQ ID NO: 2783220 - RNA, 11 nt, Human
accccagggcc

SEQ ID NO: 2783221 - RNA, 18 nt, Human
acccccacccccagcuca

SEQ ID NO: 2783222 - RNA, 19 nt, Human
acccccacccccagcucaa

SEQ ID NO: 2783223 - RNA, 16 nt, Human
acccccaccccacacu

SEQ ID NO: 2783224 - RNA, 15 nt, Human
acccccaccccacac

SEQ ID NO: 2783225 - RNA, 17 nt, Human
accccaguggccacuca

SEQ ID NO: 2783226 - RNA, 19 nt, Human
accccaguggccacucagc

SEQ ID NO: 2783227 - RNA, 23 nt, Human
accccaguggccacucagcuucc

SEQ ID NO: 2783228 - RNA, 17 nt, Human
acccccaccccacacuu

SEQ ID NO: 2783229 - RNA, 14 nt, Human
acccccacccccag

SEQ ID NO: 2783230 - RNA, 15 nt, Human
acccccacccccagc

SEQ ID NO: 2783231 - RNA, 14 nt, Human
acccagguccccuc

SEQ ID NO: 2783232 - RNA, 21 nt, Human
acccaggugauguuaguguuu

SEQ ID NO: 2783233 - RNA, 15 nt, Human
acccaggguggagug

SEQ ID NO: 2783234 - RNA, 19 nt, Human
acccaggguggagugcagu

SEQ ID NO: 2783235 - RNA, 20 nt, Human
acccaggguggagugcagug

SEQ ID NO: 2783236 - RNA, 21 nt, Human
acccaggguggagugcagugg

SEQ ID NO: 2783237 - RNA, 17 nt, Human
acccagggccugcagga

SEQ ID NO: 2783238 - RNA, 15 nt, Human
acccagggcucugcc

SEQ ID NO: 2783239 - RNA, 16 nt, Human
acccagggcucugccc

SEQ ID NO: 2783240 - RNA, 17 nt, Human
acccagggcucugcccc

SEQ ID NO: 2783241 - RNA, 18 nt, Human
acccagggcucugcccca

SEQ ID NO: 2783242 - RNA, 19 nt, Human
acccagggcucugccccag

SEQ ID NO: 2783243 - RNA, 20 nt, Human
acccagggcucugccccagu

SEQ ID NO: 2783244 - RNA, 21 nt, Human
acccagggcucugccccaguc

SEQ ID NO: 2783245 - RNA, 23 nt, Human
accccagcucccuaggagaccaa

SEQ ID NO: 2783246 - RNA, 17 nt, Human
accccagcucccuagga

SEQ ID NO: 2783247 - RNA, 14 nt, Human
accccagcucccua

SEQ ID NO: 2783248 - RNA, 14 nt, Human
acccaaagcaugga

SEQ ID NO: 2783249 - RNA, 16 nt, Human
acccaaagcauggacu

SEQ ID NO: 2783250 - RNA, 17 nt, Human
acccaaagcauggacua

SEQ ID NO: 2783251 - RNA, 18 nt, Human
acccaaagagguauuuau

SEQ ID NO: 2783252 - RNA, 20 nt, Human
acccacugcuuuuggucugu

SEQ ID NO: 2783253 - RNA, 17 nt, Human
acccacuggacucaccu

SEQ ID NO: 2783254 - RNA, 14 nt, Human
acccacuggacuca

SEQ ID NO: 2783255 - RNA, 21 nt, Human
acccacuggacucaccucccc

SEQ ID NO: 2783256 - RNA, 17 nt, Human
acccacuucucaucaca

SEQ ID NO: 2783257 - RNA, 18 nt, Human
acccacuucucaucacac

SEQ ID NO: 2783258 - RNA, 19 nt, Human
acccacuucucaucacaca

SEQ ID NO: 2783259 - RNA, 20 nt, Human
acccacuucucaucacacac

SEQ ID NO: 2783260 - RNA, 21 nt, Human
acccacuucucaucacacaca

SEQ ID NO: 2783261 - RNA, 22 nt, Human
acccacuucucaucacacacau

SEQ ID NO: 2783262 - RNA, 23 nt, Human
acccacuucucaucacacacaug

SEQ ID NO: 2783263 - RNA, 22 nt, Human
acccagaugggggaaagcacag

SEQ ID NO: 2783264 - RNA, 18 nt, Human
accauguuggccaggcug

SEQ ID NO: 2783265 - RNA, 23 nt, Human
accauguugguugcacuuuguag

SEQ ID NO: 2783266 - RNA, 21 nt, Human
accauuuugggguacccacug

SEQ ID NO: 2783267 - RNA, 16 nt, Human
accauguauuuuguaa

SEQ ID NO: 2783268 - RNA, 22 nt, Human
accaugucuaugauucguguaa

SEQ ID NO: 2783269 - RNA, 15 nt, Human
accaugugucacuug

SEQ ID NO: 2783270 - RNA, 16 nt, Human
accaugugucacuugu

SEQ ID NO: 2783271 - RNA, 19 nt, Human
accaugugucacuugugcu

SEQ ID NO: 2783272 - RNA, 21 nt, Human
accaugugucacuugugcuuu

SEQ ID NO: 2783273 - RNA, 15 nt, Human
accauggccagccaa

SEQ ID NO: 2783274 - RNA, 16 nt, Human
accauggagacaagaa

SEQ ID NO: 2783275 - RNA, 16 nt, Human
accauggacuuuauaa

SEQ ID NO: 2783276 - RNA, 15 nt, Human
accauggacuuuaua

SEQ ID NO: 2783277 - RNA, 14 nt, Human
accauggacuuuau

SEQ ID NO: 2783278 - RNA, 18 nt, Human
ucacuuaaaaugugcagu

SEQ ID NO: 2783279 - RNA, 22 nt, Human
ucacuugaacccgggaggcaga

SEQ ID NO: 2783280 - RNA, 17 nt, Human
ucacuucugagaacuca

SEQ ID NO: 2783281 - RNA, 20 nt, Human
accaugcccggcuaauuuuu

SEQ ID NO: 2783282 - RNA, 16 nt, Human
accaugcaaaugcuau

SEQ ID NO: 2783283 - RNA, 13 nt, Human
accaggugccuuu

SEQ ID NO: 2783284 - RNA, 17 nt, Human
accaggugccuuucaaa

SEQ ID NO: 2783285 - RNA, 22 nt, Human
accaggugccuuucaaauuuag

SEQ ID NO: 2783286 - RNA, 23 nt, Human
accaggugccuuucaaauuuaga

SEQ ID NO: 2783287 - RNA, 11 nt, Human
ucacucuuuau

SEQ ID NO: 2783288 - RNA, 14 nt, Human
ucacucuuuauagu

SEQ ID NO: 2783289 - RNA, 19 nt, Human
ucacucuuuauagugcaca

SEQ ID NO: 2783290 - RNA, 21 nt, Human
ucacucuuuauagugcacaaa

SEQ ID NO: 2783291 - RNA, 21 nt, Human
ucacugaaaccuuuaagaaaa

SEQ ID NO: 2783292 - RNA, 21 nt, Human
ucacaugaucuguuuuucacc

SEQ ID NO: 2783293 - RNA, 12 nt, Human
ucacugaagacg

SEQ ID NO: 2783294 - RNA, 14 nt, Human
ucacugaagacgcc

SEQ ID NO: 2783295 - RNA, 11 nt, Human
ucacugaagcc

SEQ ID NO: 2783296 - RNA, 14 nt, Human
ucacugaagccugc

SEQ ID NO: 2783297 - RNA, 15 nt, Human
ucacucauugcugag

SEQ ID NO: 2783298 - RNA, 17 nt, Human
ucacucauugcugagcc

SEQ ID NO: 2783299 - RNA, 18 nt, Human
ucacucauugcugagccu

SEQ ID NO: 2783300 - RNA, 19 nt, Human
ucacucauugcugagccuc

SEQ ID NO: 2783301 - RNA, 20 nt, Human
ucacucauugcugagccucu

SEQ ID NO: 2783302 - RNA, 22 nt, Human
ucacucauugcugagccucugc

SEQ ID NO: 2783303 - RNA, 21 nt, Human
ucacuauguugcccaggcagg

SEQ ID NO: 2783304 - RNA, 20 nt, Human
ucacuauguugcccaggcag

SEQ ID NO: 2783305 - RNA, 22 nt, Human
ucaccagccccagugcccacag

SEQ ID NO: 2783306 - RNA, 16 nt, Human
ucacucacugucaaug

SEQ ID NO: 2783307 - RNA, 14 nt, Human
ucacucaagcacug

SEQ ID NO: 2783308 - RNA, 15 nt, Human
ucacucaagcacuga

SEQ ID NO: 2783309 - RNA, 17 nt, Human
ucacucaagcacugaua

SEQ ID NO: 2783310 - RNA, 13 nt, Human
ucacucauugcug

SEQ ID NO: 2783311 - RNA, 17 nt, Human
ucacucauacaucuggc

SEQ ID NO: 2783312 - RNA, 13 nt, Human
ucacucaggcugg

SEQ ID NO: 2783313 - RNA, 14 nt, Human
ucacucaggcugga

SEQ ID NO: 2783314 - RNA, 21 nt, Human
ucacucaggcuggaguacagu

SEQ ID NO: 2783315 - RNA, 15 nt, Human
ucacuguugcccagg

SEQ ID NO: 2783316 - RNA, 14 nt, Human
ucacuguuuuuaga

SEQ ID NO: 2783317 - RNA, 17 nt, Human
ucacuguuuuuagacac

SEQ ID NO: 2783318 - RNA, 21 nt, Human
ucacuguuuuuagacaccuuc

SEQ ID NO: 2783319 - RNA, 22 nt, Human
ucacuguuuuuagacaccuuca

SEQ ID NO: 2783320 - RNA, 19 nt, Human
ucacuguugaaaauuauuu

SEQ ID NO: 2783321 - RNA, 20 nt, Human
ucacuguugaaaauuauuuu

SEQ ID NO: 2783322 - RNA, 20 nt, Human
ucacuuaacauuccuaaaau

SEQ ID NO: 2783323 - RNA, 22 nt, Human
ucacuuaacauuccuaaaaugc

SEQ ID NO: 2783324 - RNA, 13 nt, Human
ucacuuacuauug

SEQ ID NO: 2783325 - RNA, 18 nt, Human
ucacuuacuauuguugcu

SEQ ID NO: 2783326 - RNA, 13 nt, Human
ucacuuauaccug

SEQ ID NO: 2783327 - RNA, 13 nt, Human
ucacuuagccaug

SEQ ID NO: 2783328 - RNA, 22 nt, Human
ucacuucucuuaaacuugugaa

SEQ ID NO: 2783329 - RNA, 20 nt, Human
ucacuucuaggguaugggaa

SEQ ID NO: 2783330 - RNA, 23 nt, Human
ucacuucgcgugcccucgcugcu

SEQ ID NO: 2783331 - RNA, 18 nt, Human
ucacuucggccagagcug

SEQ ID NO: 2783332 - RNA, 19 nt, Human
ucacuucggccagagcuga

SEQ ID NO: 2783333 - RNA, 23 nt, Human
ucacuucgggcuguguaaacaca

SEQ ID NO: 2783334 - RNA, 17 nt, Human
ucacuuccuacaagagc

SEQ ID NO: 2783335 - RNA, 22 nt, Human
ucacuucgcgugcccucgcugc

SEQ ID NO: 2783336 - RNA, 14 nt, Human
ucacuguugcccag

SEQ ID NO: 2783337 - RNA, 22 nt, Human
ucacuguucuauucaucucaag

SEQ ID NO: 2783338 - RNA, 15 nt, Human
ucacuguugaaaauu

SEQ ID NO: 2783339 - RNA, 18 nt, Human
ucacuguugaaaauuauu

SEQ ID NO: 2783340 - RNA, 17 nt, Human
ucacugcaacuucugcc

SEQ ID NO: 2783341 - RNA, 18 nt, Human
ucacugcaacuucugccu

SEQ ID NO: 2783342 - RNA, 23 nt, Human
ucacugaacaaacuaaaggugca

SEQ ID NO: 2783343 - RNA, 16 nt, Human
ucacugcaaccuucac

SEQ ID NO: 2783344 - RNA, 18 nt, Human
ucacugcaaccuccgccu

SEQ ID NO: 2783345 - RNA, 21 nt, Human
ucacugcaaccuucgccaccu

SEQ ID NO: 2783346 - RNA, 19 nt, Human
ucacugcaaccucugccuc

SEQ ID NO: 2783347 - RNA, 14 nt, Human
ucacugauguacaa

SEQ ID NO: 2783348 - RNA, 17 nt, Human
ucacugauguacaauua

SEQ ID NO: 2783349 - RNA, 21 nt, Human
ucacugauguacaauuaaaaa

SEQ ID NO: 2783350 - RNA, 16 nt, Human
ucacugaggccugaga

SEQ ID NO: 2783351 - RNA, 22 nt, Human
ucacugaggccugagacccagg

SEQ ID NO: 2783352 - RNA, 23 nt, Human
ucacugaggccugagacccagga

SEQ ID NO: 2783353 - RNA, 20 nt, Human
ucacugauauuuuuuauaca

SEQ ID NO: 2783354 - RNA, 13 nt, Human
ucaguaggcuaau

SEQ ID NO: 2783355 - RNA, 18 nt, Human
ucaguaggcuaaugucaa

SEQ ID NO: 2783356 - RNA, 17 nt, Human
ucaguauguuuuacacu

SEQ ID NO: 2783357 - RNA, 18 nt, Human
ucaguauguuuuacacug

SEQ ID NO: 2783358 - RNA, 19 nt, Human
ucaguauguuuuacacugu

SEQ ID NO: 2783359 - RNA, 20 nt, Human
ucaguauguuuuacacugua

SEQ ID NO: 2783360 - RNA, 17 nt, Human
ucaguauuauguaguug

SEQ ID NO: 2783361 - RNA, 16 nt, Human
ucaguauuaauacuaa

SEQ ID NO: 2783362 - RNA, 21 nt, Human
ucaguauuaauacuaaaauau

SEQ ID NO: 2783363 - RNA, 23 nt, Human
ucaguauuaauacuaaaauaugu

SEQ ID NO: 2783364 - RNA, 13 nt, Human
ucaguggcagcug

SEQ ID NO: 2783365 - RNA, 15 nt, Human
ucagugcuguggccu

SEQ ID NO: 2783366 - RNA, 14 nt, Human
ucagugcuguggcc

SEQ ID NO: 2783367 - RNA, 12 nt, Human
ucagugcugugg

SEQ ID NO: 2783368 - RNA, 16 nt, Human
ucaguggcagcugcuu

SEQ ID NO: 2783369 - RNA, 19 nt, Human
ucagugcuguggccugggc

SEQ ID NO: 2783370 - RNA, 17 nt, Human
ucagugcuguggccugg

SEQ ID NO: 2783371 - RNA, 15 nt, Human
ucaguggcagcugcu

SEQ ID NO: 2783372 - RNA, 14 nt, Human
ucaguggcagcugc

SEQ ID NO: 2783373 - RNA, 22 nt, Human
ucagugcuguggccugggcaag

SEQ ID NO: 2783374 - RNA, 19 nt, Human
ucaguuguuuguuuuugcu

SEQ ID NO: 2783375 - RNA, 16 nt, Human
ucaguuuauguuguac

SEQ ID NO: 2783376 - RNA, 21 nt, Human
ucaguuuauguuguacaaugu

SEQ ID NO: 2783377 - RNA, 14 nt, Human
ucaguuuguauaga

SEQ ID NO: 2783378 - RNA, 15 nt, Human
ucaguuugugugucu

SEQ ID NO: 2783379 - RNA, 16 nt, Human
ucaguuugugugucuu

SEQ ID NO: 2783380 - RNA, 17 nt, Human
ucaguuugugugucuua

SEQ ID NO: 2783381 - RNA, 21 nt, Human
ucauaaaauaaaguauauaua

SEQ ID NO: 2783382 - RNA, 23 nt, Human
ucauaaaaucaaaacaagugaaa

SEQ ID NO: 2783383 - RNA, 16 nt, Human
ucauaaaauaaaguau

SEQ ID NO: 2783384 - RNA, 12 nt, Human
ucaguuucuaca

SEQ ID NO: 2783385 - RNA, 22 nt, Human
ucaguuucuucugcgccucagg

SEQ ID NO: 2783386 - RNA, 12 nt, Human
ucaguuugauca

SEQ ID NO: 2783387 - RNA, 16 nt, Human
ucaguuugaucacacu

SEQ ID NO: 2783388 - RNA, 19 nt, Human
ucaguuucaauucagugcu

SEQ ID NO: 2783389 - RNA, 20 nt, Human
ucaguuuccaauuauuugac

SEQ ID NO: 2783390 - RNA, 24 nt, Human
ucauaaagaggcguugcuuucacu

SEQ ID NO: 2783391 - RNA, 18 nt, Human
ucaguuuguccuguagag

SEQ ID NO: 2783392 - RNA, 19 nt, Human
ucauaaacagaugaauaaa

SEQ ID NO: 2783393 - RNA, 19 nt, Human
ucauaaaguuagaaucuau

SEQ ID NO: 2783394 - RNA, 20 nt, Human
ucauaaaguuagaaucuauu

SEQ ID NO: 2783395 - RNA, 23 nt, Human
ucauaaaguuagaaucuauuuuc

SEQ ID NO: 2783396 - RNA, 15 nt, Human
ucauaaaguacuuga

SEQ ID NO: 2783397 - RNA, 12 nt, Human
ucauaaaugaag

SEQ ID NO: 2783398 - RNA, 11 nt, Human
ucauaacuuau

SEQ ID NO: 2783399 - RNA, 15 nt, Human
ucauaacuuauugcu

SEQ ID NO: 2783400 - RNA, 18 nt, Human
ucauaacuuauugcugau

SEQ ID NO: 2783401 - RNA, 20 nt, Human
ucauaacuuauugcugauuu

SEQ ID NO: 2783402 - RNA, 21 nt, Human
ucauaacuuauugcugauuuu

SEQ ID NO: 2783403 - RNA, 17 nt, Human
ucauaacuuccuguacu

SEQ ID NO: 2783404 - RNA, 14 nt, Human
ucauaaggcuucaa

SEQ ID NO: 2783405 - RNA, 15 nt, Human
ucauaaggcuucaaa

SEQ ID NO: 2783406 - RNA, 18 nt, Human
ucaggugucccugcacuu

SEQ ID NO: 2783407 - RNA, 17 nt, Human
ucaggugucccugcacu

SEQ ID NO: 2783408 - RNA, 15 nt, Human
ucaggugucccugca

SEQ ID NO: 2783409 - RNA, 17 nt, Human
acccuuggccugucuca

SEQ ID NO: 2783410 - RNA, 13 nt, Human
acccuuggccugu

SEQ ID NO: 2783411 - RNA, 17 nt, Human
acccuuggcucaauccu

SEQ ID NO: 2783412 - RNA, 17 nt, Human
acccuuggcuugcccac

SEQ ID NO: 2783413 - RNA, 12 nt, Human
acccuuggccug

SEQ ID NO: 2783414 - RNA, 11 nt, Human
acccuuggccu

SEQ ID NO: 2783415 - RNA, 20 nt, Human
acccuggaccaguggucuca

SEQ ID NO: 2783416 - RNA, 17 nt, Human
acccuggaccagugguc

SEQ ID NO: 2783417 - RNA, 19 nt, Human
acccugcuuuagagcuagg

SEQ ID NO: 2783418 - RNA, 14 nt, Human
acccugcugccuuc

SEQ ID NO: 2783419 - RNA, 14 nt, Human
acccuggaaaugga

SEQ ID NO: 2783420 - RNA, 23 nt, Human
acccuggaaauggacugguuuga

SEQ ID NO: 2783421 - RNA, 19 nt, Human
ucaguaauaaacuguguuu

SEQ ID NO: 2783422 - RNA, 14 nt, Human
ucaguaauauuuau

SEQ ID NO: 2783423 - RNA, 13 nt, Human
ucaguaauguuau

SEQ ID NO: 2783424 - RNA, 21 nt, Human
ucaguaagacgacaaggaaag

SEQ ID NO: 2783425 - RNA, 22 nt, Human
ucaguaagacgacaaggaaagg

SEQ ID NO: 2783426 - RNA, 17 nt, Human
ucaguaagaaaaagaag

SEQ ID NO: 2783427 - RNA, 19 nt, Human
ucaguaagaaaaagaagaa

SEQ ID NO: 2783428 - RNA, 13 nt, Human
ucaguaagacgac

SEQ ID NO: 2783429 - RNA, 16 nt, Human
ucaguacuucagcaag

SEQ ID NO: 2783430 - RNA, 17 nt, Human
ucaguacuucagcaaga

SEQ ID NO: 2783431 - RNA, 19 nt, Human
ucaguacuucagcaagaga

SEQ ID NO: 2783432 - RNA, 21 nt, Human
ucaguacuucagcaagagaga

SEQ ID NO: 2783433 - RNA, 20 nt, Human
ucaguacuugugaaacacag

SEQ ID NO: 2783434 - RNA, 22 nt, Human
ucaguacuugugaaacacagcu

SEQ ID NO: 2783435 - RNA, 23 nt, Human
ucaguacuugugaaacacagcug

SEQ ID NO: 2783436 - RNA, 24 nt, Human
ucaguacuugugaaacacagcugu

SEQ ID NO: 2783437 - RNA, 16 nt, Human
ucaguacccucucagc

SEQ ID NO: 2783438 - RNA, 17 nt, Human
ucaguacccucucagcu

SEQ ID NO: 2783439 - RNA, 19 nt, Human
ucaguacccucucagcucc

SEQ ID NO: 2783440 - RNA, 18 nt, Human
ucaguaauuugaggacaa

SEQ ID NO: 2783441 - RNA, 17 nt, Human
ucaguaauuugaggaca

SEQ ID NO: 2783442 - RNA, 15 nt, Human
ucaguaauuugagga

SEQ ID NO: 2783443 - RNA, 14 nt, Human
ucaguaauuugagg

SEQ ID NO: 2783444 - RNA, 22 nt, Human
ucaggugucccugcacuugcag

SEQ ID NO: 2783445 - RNA, 22 nt, Human
ucagguguuuuuuaugaagugc

SEQ ID NO: 2783446 - RNA, 18 nt, Human
ucagguuaucgaaauaac

SEQ ID NO: 2783447 - RNA, 18 nt, Human
ucagguucaguauuaugu

SEQ ID NO: 2783448 - RNA, 23 nt, Human
ucagguuaucgaaauaacaaugu

SEQ ID NO: 2783449 - RNA, 19 nt, Human
ucagguuaucgaaauaaca

SEQ ID NO: 2783450 - RNA, 20 nt, Human
ucagguuaucgaaauaacaa

SEQ ID NO: 2783451 - RNA, 21 nt, Human
ucagguuaucgaaauaacaau

SEQ ID NO: 2783452 - RNA, 22 nt, Human
ucaguaaauaacaggcauuugu

SEQ ID NO: 2783453 - RNA, 13 nt, Human
ucagguuuuguaa

SEQ ID NO: 2783454 - RNA, 14 nt, Human
ucagguuuuguaaa

SEQ ID NO: 2783455 - RNA, 19 nt, Human
ucagguuugucaucagaug

SEQ ID NO: 2783456 - RNA, 14 nt, Human
ucagguuguuggug

SEQ ID NO: 2783457 - RNA, 15 nt, Human
ucagguuuaacauuu

SEQ ID NO: 2783458 - RNA, 17 nt, Human
ucagguuuaacauuugc

SEQ ID NO: 2783459 - RNA, 19 nt, Human
ucagguuuaacauuugccu

SEQ ID NO: 2783460 - RNA, 23 nt, Human
ucagguuuaacauuugccuugca

SEQ ID NO: 2783461 - RNA, 22 nt, Human
ucagguugucugaagucacugc

SEQ ID NO: 2783462 - RNA, 14 nt, Human
acccugaugaaaac

SEQ ID NO: 2783463 - RNA, 14 nt, Human
acccugaggucagg

SEQ ID NO: 2783464 - RNA, 20 nt, Human
acccugaggucagggagugc

SEQ ID NO: 2783465 - RNA, 22 nt, Human
acccugaggucagggagugcug

SEQ ID NO: 2783466 - RNA, 23 nt, Human
acccugaggucagggagugcugg

SEQ ID NO: 2783467 - RNA, 16 nt, Human
acccugaguucaucca

SEQ ID NO: 2783468 - RNA, 15 nt, Human
acccugcaaggccca

SEQ ID NO: 2783469 - RNA, 16 nt, Human
acccugcaaggcccac

SEQ ID NO: 2783470 - RNA, 17 nt, Human
acccugcaaggcccaca

SEQ ID NO: 2783471 - RNA, 18 nt, Human
acccugcaaggcccacag

SEQ ID NO: 2783472 - RNA, 23 nt, Human
acccugcaaggcccacaggaggc

SEQ ID NO: 2783473 - RNA, 17 nt, Human
acccugauuucuugcuu

SEQ ID NO: 2783474 - RNA, 19 nt, Human
acccugcaaacagaacagg

SEQ ID NO: 2783475 - RNA, 23 nt, Human
acccugcaaacagaacaggguca

SEQ ID NO: 2783476 - RNA, 17 nt, Human
acccugaguuuuguuuu

SEQ ID NO: 2783477 - RNA, 22 nt, Human
acccugcgcccaguccuuccac

SEQ ID NO: 2783478 - RNA, 22 nt, Human
acccugcgaaggggcccugguc

SEQ ID NO: 2783479 - RNA, 20 nt, Human
acccugcgaaggggcccugg

SEQ ID NO: 2783480 - RNA, 19 nt, Human
acccugcgaaggggcccug

SEQ ID NO: 2783481 - RNA, 18 nt, Human
acccugcgaaggggcccu

SEQ ID NO: 2783482 - RNA, 20 nt, Human
acccucgaagcgcgccacuc

SEQ ID NO: 2783483 - RNA, 16 nt, Human
acccucgaagcgcgcc

SEQ ID NO: 2783484 - RNA, 21 nt, Human
acccucgaagcgcgccacucg

SEQ ID NO: 2783485 - RNA, 21 nt, Human
acccugaauuuggccugcacu

SEQ ID NO: 2783486 - RNA, 21 nt, Human
acccuccuuucaccacaugug

SEQ ID NO: 2783487 - RNA, 23 nt, Human
acccucccccaggaggucgaccc

SEQ ID NO: 2783488 - RNA, 23 nt, Human
acccuccccgcaccccccaagcu

SEQ ID NO: 2783489 - RNA, 13 nt, Human
ucaggccacuuga

SEQ ID NO: 2783490 - RNA, 12 nt, Human
acccccagccug

SEQ ID NO: 2783491 - RNA, 13 nt, Human
acccccagccugc

SEQ ID NO: 2783492 - RNA, 21 nt, Human
ucaggcaggaagggcaggaag

SEQ ID NO: 2783493 - RNA, 23 nt, Human
ucaggcaggcaccuagcaauucc

SEQ ID NO: 2783494 - RNA, 13 nt, Human
ucaggcaggaagg

SEQ ID NO: 2783495 - RNA, 13 nt, Human
ucaggcagcucaa

SEQ ID NO: 2783496 - RNA, 12 nt, Human
ucaggcagccag

SEQ ID NO: 2783497 - RNA, 13 nt, Human
ucaggcagccagu

SEQ ID NO: 2783498 - RNA, 20 nt, Human
ucaggcagccagugagauga

SEQ ID NO: 2783499 - RNA, 14 nt, Human
ucaggggugacaca

SEQ ID NO: 2783500 - RNA, 15 nt, Human
ucaggggugacacag

SEQ ID NO: 2783501 - RNA, 16 nt, Human
ucaggggugacacaga

SEQ ID NO: 2783502 - RNA, 17 nt, Human
ucaggggugacacagac

SEQ ID NO: 2783503 - RNA, 18 nt, Human
ucaggggugacacagacu

SEQ ID NO: 2783504 - RNA, 19 nt, Human
ucaggggugacacagacuc

SEQ ID NO: 2783505 - RNA, 20 nt, Human
ucaggggugacacagacuca

SEQ ID NO: 2783506 - RNA, 17 nt, Human
ucaggguuggccccugc

SEQ ID NO: 2783507 - RNA, 19 nt, Human
ucaggguuggccccugccc

SEQ ID NO: 2783508 - RNA, 18 nt, Human
ucaggguuggccccugcc

SEQ ID NO: 2783509 - RNA, 18 nt, Human
ucagguaaucgaccugcc

SEQ ID NO: 2783510 - RNA, 20 nt, Human
ucagguaaucgaccugccuc

SEQ ID NO: 2783511 - RNA, 19 nt, Human
ucagguaaucgaccugccu

SEQ ID NO: 2783512 - RNA, 16 nt, Human
ucagguaguacuaaga

SEQ ID NO: 2783513 - RNA, 16 nt, Human
ucagguauguugccuu

SEQ ID NO: 2783514 - RNA, 15 nt, Human
ucagguauguugccu

SEQ ID NO: 2783515 - RNA, 21 nt, Human
ucagguaaucgaccugccucg

SEQ ID NO: 2783516 - RNA, 21 nt, Human
ucuacaugaggaacuguagau

SEQ ID NO: 2783517 - RNA, 14 nt, Human
ucuacauuauugcu

SEQ ID NO: 2783518 - RNA, 15 nt, Human
ucuacauuauugcuu

SEQ ID NO: 2783519 - RNA, 16 nt, Human
ucuacauauucuuuaa

SEQ ID NO: 2783520 - RNA, 15 nt, Human
ucuacaucuucugcc

SEQ ID NO: 2783521 - RNA, 15 nt, Human
ucuacauauucuuua

SEQ ID NO: 2783522 - RNA, 23 nt, Human
ucuacauacuuucauccugacuc

SEQ ID NO: 2783523 - RNA, 16 nt, Human
ucuacaucuucugccu

SEQ ID NO: 2783524 - RNA, 17 nt, Human
ucuacaucuucugccuu

SEQ ID NO: 2783525 - RNA, 19 nt, Human
ucuacaucuuuuuucacaa

SEQ ID NO: 2783526 - RNA, 22 nt, Human
ucuacaucuuuuuucacaaauu

SEQ ID NO: 2783527 - RNA, 11 nt, Human
ucuacaugaau

SEQ ID NO: 2783528 - RNA, 13 nt, Human
ucuacaugaaugc

SEQ ID NO: 2783529 - RNA, 15 nt, Human
ucuacccguuccaaa

SEQ ID NO: 2783530 - RNA, 16 nt, Human
ucuacccguuccaaaa

SEQ ID NO: 2783531 - RNA, 20 nt, Human
ucuacaugaggaacuguaga

SEQ ID NO: 2783532 - RNA, 14 nt, Human
ucuacauuucuuag

SEQ ID NO: 2783533 - RNA, 16 nt, Human
ucuacccucccacccc

SEQ ID NO: 2783534 - RNA, 15 nt, Human
ucuacccucccaccc

SEQ ID NO: 2783535 - RNA, 18 nt, Human
ucuacccucccacccccu

SEQ ID NO: 2783536 - RNA, 15 nt, Human
ucuaccucaggcagc

SEQ ID NO: 2783537 - RNA, 19 nt, Human
ucuaagucaauccaagagu

SEQ ID NO: 2783538 - RNA, 16 nt, Human
ucuaaguauuugaaac

SEQ ID NO: 2783539 - RNA, 22 nt, Human
ucuaaguuauaagacucucaca

SEQ ID NO: 2783540 - RNA, 12 nt, Human
ucuaaguuucua

SEQ ID NO: 2783541 - RNA, 14 nt, Human
ucuaaguuauaaga

SEQ ID NO: 2783542 - RNA, 16 nt, Human
ucuaaguuauaagacu

SEQ ID NO: 2783543 - RNA, 17 nt, Human
ucuaaguuauaagacuc

SEQ ID NO: 2783544 - RNA, 20 nt, Human
ucuaaguuauaagacucuca

SEQ ID NO: 2783545 - RNA, 13 nt, Human
ucuaagauucuga

SEQ ID NO: 2783546 - RNA, 13 nt, Human
ucuaagauucuag

SEQ ID NO: 2783547 - RNA, 14 nt, Human
ucuaagauucuaga

SEQ ID NO: 2783548 - RNA, 15 nt, Human
ucuaagauucuagau

SEQ ID NO: 2783549 - RNA, 16 nt, Human
ucuaagauucuagauc

SEQ ID NO: 2783550 - RNA, 19 nt, Human
ucuaagauucuagaucaga

SEQ ID NO: 2783551 - RNA, 12 nt, Human
ucuaagauucug

SEQ ID NO: 2783552 - RNA, 19 nt, Human
ucuaagauucugauuuuag

SEQ ID NO: 2783553 - RNA, 16 nt, Human
ucuaagcaauuucuug

SEQ ID NO: 2783554 - RNA, 12 nt, Human
ucuaagauucua

SEQ ID NO: 2783555 - RNA, 13 nt, Human
ucuaagauucuaa

SEQ ID NO: 2783556 - RNA, 14 nt, Human
ucuaagauucuaaa

SEQ ID NO: 2783557 - RNA, 15 nt, Human
ucuaagauucuaaag

SEQ ID NO: 2783558 - RNA, 16 nt, Human
ucuaagauucuaaagg

SEQ ID NO: 2783559 - RNA, 17 nt, Human
ucuaagauucuaaaggu

SEQ ID NO: 2783560 - RNA, 18 nt, Human
ucuaagauucuaaagguc

SEQ ID NO: 2783561 - RNA, 19 nt, Human
ucuaagauucuaaaggucc

SEQ ID NO: 2783562 - RNA, 14 nt, Human
ucuaagauucuaau

SEQ ID NO: 2783563 - RNA, 15 nt, Human
ucuaagauucuaaug

SEQ ID NO: 2783564 - RNA, 16 nt, Human
ucuaagauucuaauga

SEQ ID NO: 2783565 - RNA, 17 nt, Human
ucuaagauucuaaugau

SEQ ID NO: 2783566 - RNA, 19 nt, Human
ucuaagauucuaaugauga

SEQ ID NO: 2783567 - RNA, 20 nt, Human
ucuaagauucuaaugaugau

SEQ ID NO: 2783568 - RNA, 21 nt, Human
ucuaaagaguuuauuuuaaga

SEQ ID NO: 2783569 - RNA, 18 nt, Human
ucuaaagauaauauuacu

SEQ ID NO: 2783570 - RNA, 24 nt, Human
ucuaaagauagagucauugcugua

SEQ ID NO: 2783571 - RNA, 20 nt, Human
ucuaaagaguuuauuuuaag

SEQ ID NO: 2783572 - RNA, 13 nt, Human
ucuaaagaccaaa

SEQ ID NO: 2783573 - RNA, 18 nt, Human
ucuaaagaccaaacuuca

SEQ ID NO: 2783574 - RNA, 20 nt, Human
ucuaaagaccaaacuucacu

SEQ ID NO: 2783575 - RNA, 22 nt, Human
ucuaaagaccaaacuucacucu

SEQ ID NO: 2783576 - RNA, 12 nt, Human
ucuaaagagcac

SEQ ID NO: 2783577 - RNA, 15 nt, Human
ucuaaagagcacuua

SEQ ID NO: 2783578 - RNA, 17 nt, Human
ucuaaacuuccccaucu

SEQ ID NO: 2783579 - RNA, 17 nt, Human
ucuaaacauuaaucaau

SEQ ID NO: 2783580 - RNA, 23 nt, Human
ucuaaacugcccccucugcccug

SEQ ID NO: 2783581 - RNA, 22 nt, Human
ucuaaacugcccccucugcccu

SEQ ID NO: 2783582 - RNA, 16 nt, Human
ucuaaacugcccccuc

SEQ ID NO: 2783583 - RNA, 13 nt, Human
ucuaaacugcccc

SEQ ID NO: 2783584 - RNA, 21 nt, Human
ucuaagauaguaacaaugaag

SEQ ID NO: 2783585 - RNA, 12 nt, Human
ucuaagaucuua

SEQ ID NO: 2783586 - RNA, 15 nt, Human
ucuaagaucuuagau

SEQ ID NO: 2783587 - RNA, 17 nt, Human
ucuaagaucuuagauuc

SEQ ID NO: 2783588 - RNA, 19 nt, Human
ucuaagaucuuagauucuc

SEQ ID NO: 2783589 - RNA, 23 nt, Human
ucuaagacuuacucuaagaucuu

SEQ ID NO: 2783590 - RNA, 21 nt, Human
ucuaagacucaaauguucuaa

SEQ ID NO: 2783591 - RNA, 22 nt, Human
ucuaagacucaaauguucuaag

SEQ ID NO: 2783592 - RNA, 19 nt, Human
ucuaagacuuacucuaaga

SEQ ID NO: 2783593 - RNA, 20 nt, Human
ucuaagacuuacucuaagau

SEQ ID NO: 2783594 - RNA, 24 nt, Human
ucuaagaugugauauucuaagacu

SEQ ID NO: 2783595 - RNA, 21 nt, Human
ucuaagaucuuagauucucug

SEQ ID NO: 2783596 - RNA, 12 nt, Human
ucuaagauguga

SEQ ID NO: 2783597 - RNA, 13 nt, Human
ucuaagaugugau

SEQ ID NO: 2783598 - RNA, 18 nt, Human
ucuaagaugugauauucu

SEQ ID NO: 2783599 - RNA, 19 nt, Human
ucuaagaugugauauucua

SEQ ID NO: 2783600 - RNA, 20 nt, Human
ucuaagaugugauauucuaa

SEQ ID NO: 2783601 - RNA, 21 nt, Human
ucuaagaugugauauucuaag

SEQ ID NO: 2783602 - RNA, 22 nt, Human
ucuaagaugugauauucuaaga

SEQ ID NO: 2783603 - RNA, 16 nt, Human
ucuaagacucaaaugu

SEQ ID NO: 2783604 - RNA, 18 nt, Human
ucuaagacucaaauguuc

SEQ ID NO: 2783605 - RNA, 19 nt, Human
ucuaagacucaaauguucu

SEQ ID NO: 2783606 - RNA, 16 nt, Human
ucuaagaauacagcuu

SEQ ID NO: 2783607 - RNA, 17 nt, Human
ucuaagaauacagcuuu

SEQ ID NO: 2783608 - RNA, 13 nt, Human
ucuaacuuuagaa

SEQ ID NO: 2783609 - RNA, 12 nt, Human
ucuaagaaaccc

SEQ ID NO: 2783610 - RNA, 23 nt, Human
acuguggccguuaucuggaagua

SEQ ID NO: 2783611 - RNA, 22 nt, Human
acugugugugugaaugaacacu

SEQ ID NO: 2783612 - RNA, 18 nt, Human
acugugugugugaaugaa

SEQ ID NO: 2783613 - RNA, 16 nt, Human
acugugugugugaaug

SEQ ID NO: 2783614 - RNA, 15 nt, Human
acugugugugugaau

SEQ ID NO: 2783615 - RNA, 22 nt, Human
acuguggcacuugccuggguca

SEQ ID NO: 2783616 - RNA, 20 nt, Human
acuguggccguuaucuggaa

SEQ ID NO: 2783617 - RNA, 19 nt, Human
acuguggcacuugccuggg

SEQ ID NO: 2783618 - RNA, 23 nt, Human
acuguggaggaaggauuguaaaa

SEQ ID NO: 2783619 - RNA, 21 nt, Human
acuguggauacccuuacccuu

SEQ ID NO: 2783620 - RNA, 20 nt, Human
acuguggcacuugccugggu

SEQ ID NO: 2783621 - RNA, 17 nt, Human
acuguggccguuaucug

SEQ ID NO: 2783622 - RNA, 22 nt, Human
acuguggaggaaggauuguaaa

SEQ ID NO: 2783623 - RNA, 18 nt, Human
acuguggaggaaggauug

SEQ ID NO: 2783624 - RNA, 17 nt, Human
acuguuaauaguucagg

SEQ ID NO: 2783625 - RNA, 19 nt, Human
acuguguuuuauaaaauag

SEQ ID NO: 2783626 - RNA, 18 nt, Human
acuguguuuuauaaaaua

SEQ ID NO: 2783627 - RNA, 17 nt, Human
acuguguuuuauaaaau

SEQ ID NO: 2783628 - RNA, 19 nt, Human
acuguuaagaaaucuguuu

SEQ ID NO: 2783629 - RNA, 14 nt, Human
acuguuaagaagca

SEQ ID NO: 2783630 - RNA, 18 nt, Human
acuguuaaccauuuaagu

SEQ ID NO: 2783631 - RNA, 14 nt, Human
acuguguuguauua

SEQ ID NO: 2783632 - RNA, 15 nt, Human
acuguguuguauuaa

SEQ ID NO: 2783633 - RNA, 17 nt, Human
acuguguuguauuaaca

SEQ ID NO: 2783634 - RNA, 20 nt, Human
acuguguuguauuaacaaaa

SEQ ID NO: 2783635 - RNA, 21 nt, Human
acuguguuguauuaacaaaag

SEQ ID NO: 2783636 - RNA, 14 nt, Human
acuguguucauuag

SEQ ID NO: 2783637 - RNA, 21 nt, Human
acuguuaauaguucagguaac

SEQ ID NO: 2783638 - RNA, 14 nt, Human
acuguggcugucug

SEQ ID NO: 2783639 - RNA, 19 nt, Human
ucgggacaccugcccugcc

SEQ ID NO: 2783640 - RNA, 20 nt, Human
ucgggacaccugcccugccc

SEQ ID NO: 2783641 - RNA, 11 nt, Human
ucgggaccagg

SEQ ID NO: 2783642 - RNA, 10 nt, Human
ucgggaccag

SEQ ID NO: 2783643 - RNA, 16 nt, Human
ucgggacaccugcccu

SEQ ID NO: 2783644 - RNA, 18 nt, Human
ucgucacuaauacacagu

SEQ ID NO: 2783645 - RNA, 12 nt, Human
ucguuccuuucu

SEQ ID NO: 2783646 - RNA, 22 nt, Human
ucguugguuauacaaguucuug

SEQ ID NO: 2783647 - RNA, 14 nt, Human
ucguucuuuuuaag

SEQ ID NO: 2783648 - RNA, 18 nt, Human
ucguucuuuuuaaguuaa

SEQ ID NO: 2783649 - RNA, 13 nt, Human
ucguucucugccu

SEQ ID NO: 2783650 - RNA, 20 nt, Human
ucuaaacaaugcugauuugg

SEQ ID NO: 2783651 - RNA, 22 nt, Human
ucuaaaaugugauguucuaagg

SEQ ID NO: 2783652 - RNA, 19 nt, Human
ucuaaacccaauccaaaug

SEQ ID NO: 2783653 - RNA, 19 nt, Human
ucuaaacguaagcacuguu

SEQ ID NO: 2783654 - RNA, 20 nt, Human
ucuaaacguaagcacuguuu

SEQ ID NO: 2783655 - RNA, 21 nt, Human
ucuaaacguaagcacuguuuu

SEQ ID NO: 2783656 - RNA, 16 nt, Human
ucuaaacccaauccaa

SEQ ID NO: 2783657 - RNA, 13 nt, Human
ucuaaacauuaau

SEQ ID NO: 2783658 - RNA, 14 nt, Human
ucuaaacauuaauc

SEQ ID NO: 2783659 - RNA, 15 nt, Human
ucguuuacuaugccu

SEQ ID NO: 2783660 - RNA, 18 nt, Human
ucuaaaaugugauguucu

SEQ ID NO: 2783661 - RNA, 19 nt, Human
ucuaaaaugugauguucua

SEQ ID NO: 2783662 - RNA, 20 nt, Human
ucuaaaaugugauguucuaa

SEQ ID NO: 2783663 - RNA, 21 nt, Human
ucuaaaaugugauguucuaag

SEQ ID NO: 2783664 - RNA, 12 nt, Human
ucguagcuuucc

SEQ ID NO: 2783665 - RNA, 22 nt, Human
ucguagcuuucccaaauaaacu

SEQ ID NO: 2783666 - RNA, 20 nt, Human
ucguaucccgagucugggac

SEQ ID NO: 2783667 - RNA, 12 nt, Human
ucguaugaaaau

SEQ ID NO: 2783668 - RNA, 13 nt, Human
ucguaugaaaaug

SEQ ID NO: 2783669 - RNA, 15 nt, Human
ucguaugaaaaugag

SEQ ID NO: 2783670 - RNA, 13 nt, Human
ucggggagccuua

SEQ ID NO: 2783671 - RNA, 16 nt, Human
ucggggcaugcugggg

SEQ ID NO: 2783672 - RNA, 18 nt, Human
ucggggcaugcuggggca

SEQ ID NO: 2783673 - RNA, 17 nt, Human
ucggggcaugcuggggc

SEQ ID NO: 2783674 - RNA, 20 nt, Human
ucguaaccagccagauccuc

SEQ ID NO: 2783675 - RNA, 13 nt, Human
ucguaaugacuua

SEQ ID NO: 2783676 - RNA, 19 nt, Human
ucggggagaggcugaggac

SEQ ID NO: 2783677 - RNA, 19 nt, Human
ucgggaggcugaggcacaa

SEQ ID NO: 2783678 - RNA, 14 nt, Human
acugucacucauug

SEQ ID NO: 2783679 - RNA, 15 nt, Human
acugucacccuccac

SEQ ID NO: 2783680 - RNA, 17 nt, Human
acugucacccuccaccu

SEQ ID NO: 2783681 - RNA, 14 nt, Human
acugucacccucca

SEQ ID NO: 2783682 - RNA, 13 nt, Human
acugucauagaaa

SEQ ID NO: 2783683 - RNA, 15 nt, Human
acugucaugcuucau

SEQ ID NO: 2783684 - RNA, 24 nt, Human
acugucaugcuucaucauucccuc

SEQ ID NO: 2783685 - RNA, 13 nt, Human
acuguccagagag

SEQ ID NO: 2783686 - RNA, 14 nt, Human
acuguccagagagc

SEQ ID NO: 2783687 - RNA, 15 nt, Human
acuguccagagagca

SEQ ID NO: 2783688 - RNA, 18 nt, Human
acuguccuccaagccagc

SEQ ID NO: 2783689 - RNA, 17 nt, Human
acuguccucuccccucc

SEQ ID NO: 2783690 - RNA, 18 nt, Human
acuguccucuccccucca

SEQ ID NO: 2783691 - RNA, 19 nt, Human
acuguccucuccccuccag

SEQ ID NO: 2783692 - RNA, 20 nt, Human
acuguccucuccccuccagc

SEQ ID NO: 2783693 - RNA, 16 nt, Human
acuguccuccaagcca

SEQ ID NO: 2783694 - RNA, 18 nt, Human
acuguauauuuuaagaag

SEQ ID NO: 2783695 - RNA, 14 nt, Human
acuguaucugugua

SEQ ID NO: 2783696 - RNA, 13 nt, Human
acuguaucugugu

SEQ ID NO: 2783697 - RNA, 15 nt, Human
acuguaucuguguag

SEQ ID NO: 2783698 - RNA, 13 nt, Human
acuguaugcugga

SEQ ID NO: 2783699 - RNA, 14 nt, Human
acuguaugugauga

SEQ ID NO: 2783700 - RNA, 16 nt, Human
acuguaugugaugaau

SEQ ID NO: 2783701 - RNA, 15 nt, Human
acuguaugauuuaua

SEQ ID NO: 2783702 - RNA, 12 nt, Human
acuguaugcuca

SEQ ID NO: 2783703 - RNA, 13 nt, Human
acuguauuuguau

SEQ ID NO: 2783704 - RNA, 14 nt, Human
acuguauuuguauc

SEQ ID NO: 2783705 - RNA, 20 nt, Human
acuguacuccucccaggcgc

SEQ ID NO: 2783706 - RNA, 15 nt, Human
acuguacuccuccca

SEQ ID NO: 2783707 - RNA, 17 nt, Human
acuguacugacuugagg

SEQ ID NO: 2783708 - RNA, 18 nt, Human
acuggguacuuguggaca

SEQ ID NO: 2783709 - RNA, 17 nt, Human
acuggguacuuguggac

SEQ ID NO: 2783710 - RNA, 21 nt, Human
acuggguaaaugcaaaguucu

SEQ ID NO: 2783711 - RNA, 11 nt, Human
acuguacaaua

SEQ ID NO: 2783712 - RNA, 17 nt, Human
acuguacaauaaaaaca

SEQ ID NO: 2783713 - RNA, 18 nt, Human
acuguacaauaaaaacau

SEQ ID NO: 2783714 - RNA, 14 nt, Human
acugaaaucuguca

SEQ ID NO: 2783715 - RNA, 17 nt, Human
acugaaaucugucaaga

SEQ ID NO: 2783716 - RNA, 12 nt, Human
acugaagagaca

SEQ ID NO: 2783717 - RNA, 16 nt, Human
acugaagauguugaga

SEQ ID NO: 2783718 - RNA, 13 nt, Human
acugaaagguuac

SEQ ID NO: 2783719 - RNA, 13 nt, Human
acugaaagugguu

SEQ ID NO: 2783720 - RNA, 14 nt, Human
acugaaagugguuu

SEQ ID NO: 2783721 - RNA, 17 nt, Human
acugaaagugguuugaa

SEQ ID NO: 2783722 - RNA, 22 nt, Human
ucgcccgagcuguuuauguuuu

SEQ ID NO: 2783723 - RNA, 14 nt, Human
ucgcuccugugucu

SEQ ID NO: 2783724 - RNA, 17 nt, Human
ucgccguugaagaggaa

SEQ ID NO: 2783725 - RNA, 13 nt, Human
ucgccuggagccc

SEQ ID NO: 2783726 - RNA, 14 nt, Human
ucgccuggagcccu

SEQ ID NO: 2783727 - RNA, 15 nt, Human
ucgccgucugugaau

SEQ ID NO: 2783728 - RNA, 14 nt, Human
ucgcccucccaggc

SEQ ID NO: 2783729 - RNA, 19 nt, Human
ucgcccuuacuucuugccc

SEQ ID NO: 2783730 - RNA, 20 nt, Human
ucgcccuuacuucuugcccu

SEQ ID NO: 2783731 - RNA, 22 nt, Human
ucgcccuuacuucuugcccugg

SEQ ID NO: 2783732 - RNA, 23 nt, Human
ucgcccuuacuucuugcccuggg

SEQ ID NO: 2783733 - RNA, 17 nt, Human
ucgcccucccaggcucu

SEQ ID NO: 2783734 - RNA, 14 nt, Human
ucgcccuccuuucu

SEQ ID NO: 2783735 - RNA, 16 nt, Human
ucgcccuccuuucugu

SEQ ID NO: 2783736 - RNA, 18 nt, Human
ucgcccuccuuucugugc

SEQ ID NO: 2783737 - RNA, 13 nt, Human
ucgcccucccagg

SEQ ID NO: 2783738 - RNA, 13 nt, Human
acuggggggcuug

SEQ ID NO: 2783739 - RNA, 17 nt, Human
acuggggccuccagaac

SEQ ID NO: 2783740 - RNA, 17 nt, Human
acuggggugggaggucu

SEQ ID NO: 2783741 - RNA, 21 nt, Human
acuggggugggaggucuugcu

SEQ ID NO: 2783742 - RNA, 22 nt, Human
acuggggugggaggucuugcua

SEQ ID NO: 2783743 - RNA, 15 nt, Human
acuggguacuugugg

SEQ ID NO: 2783744 - RNA, 21 nt, Human
acuggggccuacagcuuugau

SEQ ID NO: 2783745 - RNA, 12 nt, Human
acuggggccucc

SEQ ID NO: 2783746 - RNA, 13 nt, Human
acuggggccucca

SEQ ID NO: 2783747 - RNA, 16 nt, Human
acuggggccuccagaa

SEQ ID NO: 2783748 - RNA, 16 nt, Human
ucgcugucacaggcgg

SEQ ID NO: 2783749 - RNA, 22 nt, Human
ucgcuggccccuuugggcccug

SEQ ID NO: 2783750 - RNA, 23 nt, Human
ucgcuggccccuuugggcccugc

SEQ ID NO: 2783751 - RNA, 17 nt, Human
acugggccuguagcuca

SEQ ID NO: 2783752 - RNA, 21 nt, Human
acugggccuguugcccuuucu

SEQ ID NO: 2783753 - RNA, 20 nt, Human
acugggccuuagugggccag

SEQ ID NO: 2783754 - RNA, 21 nt, Human
acugggccuuagugggccagg

SEQ ID NO: 2783755 - RNA, 16 nt, Human
ucgcugacuucaugga

SEQ ID NO: 2783756 - RNA, 17 nt, Human
ucgcugacuucauggaa

SEQ ID NO: 2783757 - RNA, 18 nt, Human
ucgcugacuucauggaau

SEQ ID NO: 2783758 - RNA, 21 nt, Human
ucgcucuguugcccaggcugg

SEQ ID NO: 2783759 - RNA, 19 nt, Human
ucgcucuguuacccagggu

SEQ ID NO: 2783760 - RNA, 22 nt, Human
acuugaacccgggaggcagagg

SEQ ID NO: 2783761 - RNA, 14 nt, Human
acuugaaauguuag

SEQ ID NO: 2783762 - RNA, 23 nt, Human
acuugaaauguuagucauuguua

SEQ ID NO: 2783763 - RNA, 16 nt, Human
acuugaaauuauaucu

SEQ ID NO: 2783764 - RNA, 17 nt, Human
acuugaaauuauaucug

SEQ ID NO: 2783765 - RNA, 23 nt, Human
acuugaaauuauaucuguggucu

SEQ ID NO: 2783766 - RNA, 21 nt, Human
acuucucuuguuagguaauuu

SEQ ID NO: 2783767 - RNA, 21 nt, Human
acuugagaacuuuccauuuug

SEQ ID NO: 2783768 - RNA, 15 nt, Human
acuugagguggccuc

SEQ ID NO: 2783769 - RNA, 21 nt, Human
acuugagguggccuccuugcu

SEQ ID NO: 2783770 - RNA, 22 nt, Human
acuugagguggccuccuugcuu

SEQ ID NO: 2783771 - RNA, 16 nt, Human
acuugaguguaauguu

SEQ ID NO: 2783772 - RNA, 22 nt, Human
acuugaguguaauguuuguuac

SEQ ID NO: 2783773 - RNA, 15 nt, Human
acuugagggcccaga

SEQ ID NO: 2783774 - RNA, 16 nt, Human
acuugagggcccagag

SEQ ID NO: 2783775 - RNA, 17 nt, Human
acuugagggcccagagc

SEQ ID NO: 2783776 - RNA, 18 nt, Human
acuugagggcccagagca

SEQ ID NO: 2783777 - RNA, 19 nt, Human
acuugagggcccagagcag

SEQ ID NO: 2783778 - RNA, 20 nt, Human
acuugagggcccagagcagg

SEQ ID NO: 2783779 - RNA, 21 nt, Human
acuugagggcccagagcagga

SEQ ID NO: 2783780 - RNA, 18 nt, Human
acuugacuccauuucauc

SEQ ID NO: 2783781 - RNA, 21 nt, Human
acuugacuccauuucaucauu

SEQ ID NO: 2783782 - RNA, 19 nt, Human
acuugacccccuugagggu

SEQ ID NO: 2783783 - RNA, 20 nt, Human
acuugaaccuaugaagcaau

SEQ ID NO: 2783784 - RNA, 16 nt, Human
acuugaacuuuccugg

SEQ ID NO: 2783785 - RNA, 18 nt, Human
acuugaacuucaccugca

SEQ ID NO: 2783786 - RNA, 15 nt, Human
acuugaaugugucag

SEQ ID NO: 2783787 - RNA, 14 nt, Human
acuuguaugaaaga

SEQ ID NO: 2783788 - RNA, 15 nt, Human
acuugucucauuuua

SEQ ID NO: 2783789 - RNA, 16 nt, Human
acuugucucauuuuaa

SEQ ID NO: 2783790 - RNA, 17 nt, Human
acuugucucauuuuaau

SEQ ID NO: 2783791 - RNA, 19 nt, Human
acuugucucauuuuaaugu

SEQ ID NO: 2783792 - RNA, 20 nt, Human
acuugucucauuuuaaugua

SEQ ID NO: 2783793 - RNA, 23 nt, Human
acuuguccuuuuguaccauggug

SEQ ID NO: 2783794 - RNA, 14 nt, Human
acuuggaagcuccg

SEQ ID NO: 2783795 - RNA, 23 nt, Human
acuugccgcgucgcccucccagg

SEQ ID NO: 2783796 - RNA, 18 nt, Human
acuugccuccgugucacc

SEQ ID NO: 2783797 - RNA, 22 nt, Human
acuugccgcgucgcccucccag

SEQ ID NO: 2783798 - RNA, 19 nt, Human
acuugcauccaacuccagg

SEQ ID NO: 2783799 - RNA, 19 nt, Human
acuugauagcaaacacugg

SEQ ID NO: 2783800 - RNA, 20 nt, Human
acuugauagcaaacacuggg

SEQ ID NO: 2783801 - RNA, 11 nt, Human
acuugcauuuc

SEQ ID NO: 2783802 - RNA, 12 nt, Human
acuugcaugaag

SEQ ID NO: 2783803 - RNA, 14 nt, Human
acuugcaugaagag

SEQ ID NO: 2783804 - RNA, 21 nt, Human
acuugcaugaagagaagcaau

SEQ ID NO: 2783805 - RNA, 15 nt, Human
acuugcauggagcag

SEQ ID NO: 2783806 - RNA, 12 nt, Human
acuugcaugucc

SEQ ID NO: 2783807 - RNA, 19 nt, Human
acuugcaugucccaucacg

SEQ ID NO: 2783808 - RNA, 12 nt, Human
acuugcccugcu

SEQ ID NO: 2783809 - RNA, 13 nt, Human
acuugcccugcuc

SEQ ID NO: 2783810 - RNA, 15 nt, Human
acuugcccugcuccc

SEQ ID NO: 2783811 - RNA, 16 nt, Human
acuugcccugcucccu

SEQ ID NO: 2783812 - RNA, 18 nt, Human
acuugcccugcucccucu

SEQ ID NO: 2783813 - RNA, 14 nt, Human
acuugccagaaguu

SEQ ID NO: 2783814 - RNA, 20 nt, Human
acuugccagaaguuguggau

SEQ ID NO: 2783815 - RNA, 21 nt, Human
acuugccaugugacucuggcu

SEQ ID NO: 2783816 - RNA, 22 nt, Human
acuugccaugugacucuggcuu

SEQ ID NO: 2783817 - RNA, 13 nt, Human
ucuauuuuugucu

SEQ ID NO: 2783818 - RNA, 14 nt, Human
ucucaaaaauacaa

SEQ ID NO: 2783819 - RNA, 15 nt, Human
ucucaaaaauacaaa

SEQ ID NO: 2783820 - RNA, 16 nt, Human
ucucaaaaauacaaaa

SEQ ID NO: 2783821 - RNA, 23 nt, Human
ucucaaaaauacaaaauaaaaac

SEQ ID NO: 2783822 - RNA, 13 nt, Human
ucucacuccccau

SEQ ID NO: 2783823 - RNA, 15 nt, Human
ucucacuccccaugc

SEQ ID NO: 2783824 - RNA, 12 nt, Human
ucucacucccca

SEQ ID NO: 2783825 - RNA, 13 nt, Human
ucucacuccuacc

SEQ ID NO: 2783826 - RNA, 23 nt, Human
ucucacauggugcuacgccugca

SEQ ID NO: 2783827 - RNA, 22 nt, Human
ucucacauggugcuacgccugc

SEQ ID NO: 2783828 - RNA, 15 nt, Human
ucucaccagcugcug

SEQ ID NO: 2783829 - RNA, 17 nt, Human
ucucaccagcugcugcu

SEQ ID NO: 2783830 - RNA, 14 nt, Human
ucuauauaugugua

SEQ ID NO: 2783831 - RNA, 15 nt, Human
ucuauauauguguau

SEQ ID NO: 2783832 - RNA, 14 nt, Human
ucuauaguucuaga

SEQ ID NO: 2783833 - RNA, 12 nt, Human
ucuauaguucua

SEQ ID NO: 2783834 - RNA, 15 nt, Human
ucuauaguucuagac

SEQ ID NO: 2783835 - RNA, 21 nt, Human
ucuauaguugauauguuuuau

SEQ ID NO: 2783836 - RNA, 16 nt, Human
ucuauaguugucagua

SEQ ID NO: 2783837 - RNA, 16 nt, Human
ucuauauauguguaug

SEQ ID NO: 2783838 - RNA, 19 nt, Human
ucuauauauguguauguac

SEQ ID NO: 2783839 - RNA, 12 nt, Human
ucuauaugaauu

SEQ ID NO: 2783840 - RNA, 14 nt, Human
ucuauaugaauuua

SEQ ID NO: 2783841 - RNA, 15 nt, Human
acuucggccagagcu

SEQ ID NO: 2783842 - RNA, 18 nt, Human
acuucuccacccugcucu

SEQ ID NO: 2783843 - RNA, 19 nt, Human
acuucucuuaaacuuguga

SEQ ID NO: 2783844 - RNA, 20 nt, Human
acuucucuuaaacuugugaa

SEQ ID NO: 2783845 - RNA, 21 nt, Human
acuucucuuaaacuugugaau

SEQ ID NO: 2783846 - RNA, 14 nt, Human
acuucucuugcuuu

SEQ ID NO: 2783847 - RNA, 16 nt, Human
acuucucuugcuuucu

SEQ ID NO: 2783848 - RNA, 17 nt, Human
acuucucuugcuuucua

SEQ ID NO: 2783849 - RNA, 21 nt, Human
acuucucugccuuugacauuu

SEQ ID NO: 2783850 - RNA, 23 nt, Human
acuucucugccuuugacauuuaa

SEQ ID NO: 2783851 - RNA, 16 nt, Human
acuucucucuaaggag

SEQ ID NO: 2783852 - RNA, 22 nt, Human
acuucucucuaaggagaauggc

SEQ ID NO: 2783853 - RNA, 16 nt, Human
acuucuccaggucuca

SEQ ID NO: 2783854 - RNA, 14 nt, Human
acuucccuuucugc

SEQ ID NO: 2783855 - RNA, 16 nt, Human
ucucacuccuaccugg

SEQ ID NO: 2783856 - RNA, 17 nt, Human
ucucacuccuaccuggu

SEQ ID NO: 2783857 - RNA, 22 nt, Human
acuucccuuucugcuuguguua

SEQ ID NO: 2783858 - RNA, 18 nt, Human
acuuccuccuccccacuu

SEQ ID NO: 2783859 - RNA, 17 nt, Human
acuuccucgccucuccc

SEQ ID NO: 2783860 - RNA, 18 nt, Human
acuuccucgccucuccca

SEQ ID NO: 2783861 - RNA, 15 nt, Human
acuuccuccucccca

SEQ ID NO: 2783862 - RNA, 17 nt, Human
acuuccuccuccccacu

SEQ ID NO: 2783863 - RNA, 18 nt, Human
ucuauugugggacuuauu

SEQ ID NO: 2783864 - RNA, 12 nt, Human
acuuccuguacu

SEQ ID NO: 2783865 - RNA, 15 nt, Human
ucuaguuugcauucc

SEQ ID NO: 2783866 - RNA, 18 nt, Human
ucuaguuugcauuccuga

SEQ ID NO: 2783867 - RNA, 21 nt, Human
ucuauaaucccagcacuuugg

SEQ ID NO: 2783868 - RNA, 22 nt, Human
ucuauaaggccauaaaacaggu

SEQ ID NO: 2783869 - RNA, 19 nt, Human
ucuauaaucccagcacuuu

SEQ ID NO: 2783870 - RNA, 20 nt, Human
ucuauaaucccagcacuuug

SEQ ID NO: 2783871 - RNA, 15 nt, Human
ucuauacaucucucc

SEQ ID NO: 2783872 - RNA, 16 nt, Human
ucuauacaucucuccc

SEQ ID NO: 2783873 - RNA, 11 nt, Human
ucuauacaaau

SEQ ID NO: 2783874 - RNA, 16 nt, Human
ucuauacaaauauaaa

SEQ ID NO: 2783875 - RNA, 21 nt, Human
ucuauacaaauauaaaucuua

SEQ ID NO: 2783876 - RNA, 22 nt, Human
ucuauacaaauauaaaucuuaa

SEQ ID NO: 2783877 - RNA, 18 nt, Human
ucuauaguagacacacua

SEQ ID NO: 2783878 - RNA, 13 nt, Human
ucuaguuugcauu

SEQ ID NO: 2783879 - RNA, 21 nt, Human
ucuaguggucuuuguaagagu

SEQ ID NO: 2783880 - RNA, 22 nt, Human
ucuaguggucuuuguaagagug

SEQ ID NO: 2783881 - RNA, 23 nt, Human
ucuaguggucuuuguaagagugu

SEQ ID NO: 2783882 - RNA, 19 nt, Human
ucuagcaugccaacaagaa

SEQ ID NO: 2783883 - RNA, 20 nt, Human
ucuagcaugccaacaagaau

SEQ ID NO: 2783884 - RNA, 22 nt, Human
ucuagcaugccaacaagaaugc

SEQ ID NO: 2783885 - RNA, 20 nt, Human
ucuagccuauuuaccugcag

SEQ ID NO: 2783886 - RNA, 11 nt, Human
ucuagccugca

SEQ ID NO: 2783887 - RNA, 14 nt, Human
ucuagccugcacuu

SEQ ID NO: 2783888 - RNA, 16 nt, Human
ucuagccugcacuuug

SEQ ID NO: 2783889 - RNA, 20 nt, Human
ucuagccugcacuuugaugu

SEQ ID NO: 2783890 - RNA, 22 nt, Human
ucuagccugcacuuugauguca

SEQ ID NO: 2783891 - RNA, 22 nt, Human
ucuagcacaauuugcacuaaau

SEQ ID NO: 2783892 - RNA, 17 nt, Human
ucuagcacucauuuucu

SEQ ID NO: 2783893 - RNA, 18 nt, Human
ucuagcacucauuuucua

SEQ ID NO: 2783894 - RNA, 21 nt, Human
ucuagauucucuggcuguaag

SEQ ID NO: 2783895 - RNA, 22 nt, Human
ucuagcaaccgccucaaaaugu

SEQ ID NO: 2783896 - RNA, 13 nt, Human
ucuagauucaaag

SEQ ID NO: 2783897 - RNA, 17 nt, Human
ucuagauucaaagguuc

SEQ ID NO: 2783898 - RNA, 18 nt, Human
ucuagauucaaagguucu

SEQ ID NO: 2783899 - RNA, 19 nt, Human
ucuagauucaaagguucua

SEQ ID NO: 2783900 - RNA, 20 nt, Human
ucuagauucaaagguucuag

SEQ ID NO: 2783901 - RNA, 22 nt, Human
ucuagauucaaagguucuaggu

SEQ ID NO: 2783902 - RNA, 23 nt, Human
ucuagauucaaagguucuagguu

SEQ ID NO: 2783903 - RNA, 15 nt, Human
ucuagauugagagaa

SEQ ID NO: 2783904 - RNA, 11 nt, Human
ucuagauucuc

SEQ ID NO: 2783905 - RNA, 14 nt, Human
ucuagauucucugg

SEQ ID NO: 2783906 - RNA, 19 nt, Human
ucuagauuccauuggucca

SEQ ID NO: 2783907 - RNA, 21 nt, Human
ucuagauuccauugguccaag

SEQ ID NO: 2783908 - RNA, 22 nt, Human
ucuagauuccauugguccaaga

SEQ ID NO: 2783909 - RNA, 23 nt, Human
ucuagauuccauugguccaagau

SEQ ID NO: 2783910 - RNA, 17 nt, Human
acuucccagugaauucu

SEQ ID NO: 2783911 - RNA, 24 nt, Human
acuucccaguucaggagucccaag

SEQ ID NO: 2783912 - RNA, 23 nt, Human
acuucccaguucaggagucccaa

SEQ ID NO: 2783913 - RNA, 22 nt, Human
acuucccaguucaggaguccca

SEQ ID NO: 2783914 - RNA, 16 nt, Human
ucuagaucagaugcuc

SEQ ID NO: 2783915 - RNA, 18 nt, Human
ucuagaucagaugcucca

SEQ ID NO: 2783916 - RNA, 20 nt, Human
ucuagaucagaugcuccaag

SEQ ID NO: 2783917 - RNA, 21 nt, Human
ucuagaucagaugcuccaaga

SEQ ID NO: 2783918 - RNA, 22 nt, Human
ucuagaucagaugcuccaagau

SEQ ID NO: 2783919 - RNA, 21 nt, Human
ucuagaugaaguuuuacauug

SEQ ID NO: 2783920 - RNA, 20 nt, Human
ucuagaugaaguuuuacauu

SEQ ID NO: 2783921 - RNA, 19 nt, Human
ucuagaugaaguuuuacau

SEQ ID NO: 2783922 - RNA, 14 nt, Human
ucuagaucauaagg

SEQ ID NO: 2783923 - RNA, 22 nt, Human
ucuagauguuuauucuucuaga

SEQ ID NO: 2783924 - RNA, 23 nt, Human
ucuagauguuuauucuucuagag

SEQ ID NO: 2783925 - RNA, 21 nt, Human
ucuagauguuuauucuucuag

SEQ ID NO: 2783926 - RNA, 22 nt, Human
ucuagaugauuaaauaagauuc

SEQ ID NO: 2783927 - RNA, 23 nt, Human
ucuagaugaaguuuuacauuguu

SEQ ID NO: 2783928 - RNA, 16 nt, Human
ucuagaugagcugggc

SEQ ID NO: 2783929 - RNA, 22 nt, Human
ucuagaugaaguuuuacauugu

SEQ ID NO: 2783930 - RNA, 21 nt, Human
acuuccagguguuacuguaau

SEQ ID NO: 2783931 - RNA, 20 nt, Human
acuuccagguguuacuguaa

SEQ ID NO: 2783932 - RNA, 21 nt, Human
acuuccaggggaaccugccau

SEQ ID NO: 2783933 - RNA, 20 nt, Human
acuuccaggggaaccugcca

SEQ ID NO: 2783934 - RNA, 18 nt, Human
acuuccaggggaaccugc

SEQ ID NO: 2783935 - RNA, 16 nt, Human
acuuccaggggaaccu

SEQ ID NO: 2783936 - RNA, 17 nt, Human
acuuccauaaucuggac

SEQ ID NO: 2783937 - RNA, 21 nt, Human
acuuccaccucgggcacauuu

SEQ ID NO: 2783938 - RNA, 15 nt, Human
acuuccaaagaaugu

SEQ ID NO: 2783939 - RNA, 23 nt, Human
acuuccaaagaauguuagagcac

SEQ ID NO: 2783940 - RNA, 17 nt, Human
acuucauucugcagggu

SEQ ID NO: 2783941 - RNA, 19 nt, Human
acuucaugacaagcauuuu

SEQ ID NO: 2783942 - RNA, 15 nt, Human
acuucauggaaugga

SEQ ID NO: 2783943 - RNA, 20 nt, Human
acuucauggaauggacaucc

SEQ ID NO: 2783944 - RNA, 21 nt, Human
acuucauugagaguuuugucu

SEQ ID NO: 2783945 - RNA, 15 nt, Human
acuucauugucccuc

SEQ ID NO: 2783946 - RNA, 20 nt, Human
acuucauuuaaaaaaaucac

SEQ ID NO: 2783947 - RNA, 14 nt, Human
acuuccaaaauucu

SEQ ID NO: 2783948 - RNA, 15 nt, Human
acuuccaaaauucuu

SEQ ID NO: 2783949 - RNA, 16 nt, Human
acuuccaaaauucuua

SEQ ID NO: 2783950 - RNA, 19 nt, Human
acuuccaaaauucuuauuu

SEQ ID NO: 2783951 - RNA, 20 nt, Human
acuucaggcucuucuccuuu

SEQ ID NO: 2783952 - RNA, 17 nt, Human
acuucaggcucuucucc

SEQ ID NO: 2783953 - RNA, 18 nt, Human
acuucaggcucuucuccu

SEQ ID NO: 2783954 - RNA, 16 nt, Human
acuucaucuggcugcc

SEQ ID NO: 2783955 - RNA, 21 nt, Human
acuucaucuggcugccuuugc

SEQ ID NO: 2783956 - RNA, 13 nt, Human
acuuacucuaaga

SEQ ID NO: 2783957 - RNA, 14 nt, Human
acuuacucuaagau

SEQ ID NO: 2783958 - RNA, 19 nt, Human
ucuaccucaggcagcucaa

SEQ ID NO: 2783959 - RNA, 18 nt, Human
acuuauccuaaaacaaau

SEQ ID NO: 2783960 - RNA, 19 nt, Human
acuuauccuaaaacaaaua

SEQ ID NO: 2783961 - RNA, 20 nt, Human
acuuaucauccacauuguuu

SEQ ID NO: 2783962 - RNA, 22 nt, Human
acuuaucauccacauuguuuua

SEQ ID NO: 2783963 - RNA, 16 nt, Human
acuuaucccugcccau

SEQ ID NO: 2783964 - RNA, 17 nt, Human
acuuaucccugcccauu

SEQ ID NO: 2783965 - RNA, 16 nt, Human
acuucaggcucuucuc

SEQ ID NO: 2783966 - RNA, 16 nt, Human
acuuaucucucugugc

SEQ ID NO: 2783967 - RNA, 17 nt, Human
acuuaucucucugugcu

SEQ ID NO: 2783968 - RNA, 22 nt, Human
acuuaucucucugugcugugga

SEQ ID NO: 2783969 - RNA, 19 nt, Human
acuuaucauccacauuguu

SEQ ID NO: 2783970 - RNA, 20 nt, Human
acuuaucagcuacuuaagag

SEQ ID NO: 2783971 - RNA, 15 nt, Human
acuuauauuucccua

SEQ ID NO: 2783972 - RNA, 15 nt, Human
acuuauauuuucgua

SEQ ID NO: 2783973 - RNA, 19 nt, Human
acuuauauuuucguaugaa

SEQ ID NO: 2783974 - RNA, 21 nt, Human
acuuauauuuucguaugaaaa

SEQ ID NO: 2783975 - RNA, 22 nt, Human
acuuauauuuucguaugaaaau

SEQ ID NO: 2783976 - RNA, 23 nt, Human
acuuauauuuucguaugaaaaug

SEQ ID NO: 2783977 - RNA, 16 nt, Human
acuuacucuaagaucu

SEQ ID NO: 2783978 - RNA, 16 nt, Human
acuuacuguaagacau

SEQ ID NO: 2783979 - RNA, 17 nt, Human
acuuacuguaagacauu

SEQ ID NO: 2783980 - RNA, 15 nt, Human
acuuagaguuucugu

SEQ ID NO: 2783981 - RNA, 17 nt, Human
acuuagaguuucuguuu

SEQ ID NO: 2783982 - RNA, 18 nt, Human
acuuagaguuucuguuug

SEQ ID NO: 2783983 - RNA, 20 nt, Human
acuuagaguuucuguuugau

SEQ ID NO: 2783984 - RNA, 21 nt, Human
acuuagaguuucuguuugauu

SEQ ID NO: 2783985 - RNA, 22 nt, Human
acuuagaguuucuguuugauuc

SEQ ID NO: 2783986 - RNA, 14 nt, Human
acuuagcauccuaa

SEQ ID NO: 2783987 - RNA, 18 nt, Human
acuuagcauccuaagaaa

SEQ ID NO: 2783988 - RNA, 19 nt, Human
acuuagcauccuaagaaau

SEQ ID NO: 2783989 - RNA, 21 nt, Human
acuuagcauccuaagaaauau

SEQ ID NO: 2783990 - RNA, 13 nt, Human
acuuagcaaaaag

SEQ ID NO: 2783991 - RNA, 17 nt, Human
acuuagcaaaaaguggg

SEQ ID NO: 2783992 - RNA, 18 nt, Human
acuuauauugaagacaau

SEQ ID NO: 2783993 - RNA, 20 nt, Human
acuuauauugaagacaauuu

SEQ ID NO: 2783994 - RNA, 12 nt, Human
agaaagcagggg

SEQ ID NO: 2783995 - RNA, 14 nt, Human
agaaagcaggggcu

SEQ ID NO: 2783996 - RNA, 21 nt, Human
agaaagcagauaccucacccu

SEQ ID NO: 2783997 - RNA, 19 nt, Human
agaaauacaauucuacauu

SEQ ID NO: 2783998 - RNA, 20 nt, Human
agaaagcaggggcuacaaga

SEQ ID NO: 2783999 - RNA, 12 nt, Human
agaaagauguau

SEQ ID NO: 2784000 - RNA, 14 nt, Human
agaaagauguauau

SEQ ID NO: 2784001 - RNA, 20 nt, Human
agaaagauguauauaggugu

SEQ ID NO: 2784002 - RNA, 18 nt, Human
agaaagacaucuuucucu

SEQ ID NO: 2784003 - RNA, 22 nt, Human
agaaaucuggucuuguuagaaa

SEQ ID NO: 2784004 - RNA, 13 nt, Human
agaaaucuguuuu

SEQ ID NO: 2784005 - RNA, 16 nt, Human
agaaauggggaauucu

SEQ ID NO: 2784006 - RNA, 21 nt, Human
agaaauggggaauucucuaau

SEQ ID NO: 2784007 - RNA, 12 nt, Human
agaaaugcuuug

SEQ ID NO: 2784008 - RNA, 22 nt, Human
ucugaaggacauugcggacagc

SEQ ID NO: 2784009 - RNA, 21 nt, Human
agaaauacuauaacauaugua

SEQ ID NO: 2784010 - RNA, 20 nt, Human
agaaauagccugcgcuguuu

SEQ ID NO: 2784011 - RNA, 20 nt, Human
agaaaucucccaugugcaua

SEQ ID NO: 2784012 - RNA, 13 nt, Human
agaaaucugaaaa

SEQ ID NO: 2784013 - RNA, 23 nt, Human
agaaaucuaguauuucaugcugg

SEQ ID NO: 2784014 - RNA, 14 nt, Human
agaaagcaacuuau

SEQ ID NO: 2784015 - RNA, 23 nt, Human
agaaauaguuugagaaaugcaua

SEQ ID NO: 2784016 - RNA, 14 nt, Human
agaaacaauaaaga

SEQ ID NO: 2784017 - RNA, 15 nt, Human
agaaacaauaaagag

SEQ ID NO: 2784018 - RNA, 16 nt, Human
agaaacaauaaagaga

SEQ ID NO: 2784019 - RNA, 17 nt, Human
agaaacaauaaagagau

SEQ ID NO: 2784020 - RNA, 12 nt, Human
agaaaaggaaaa

SEQ ID NO: 2784021 - RNA, 13 nt, Human
agaaaaggaaaag

SEQ ID NO: 2784022 - RNA, 15 nt, Human
agaaaaggaaaagaa

SEQ ID NO: 2784023 - RNA, 17 nt, Human
agaaaaggaaaagaaaa

SEQ ID NO: 2784024 - RNA, 18 nt, Human
agaaaaggaaaagaaaaa

SEQ ID NO: 2784025 - RNA, 16 nt, Human
agaaaagagaagaaga

SEQ ID NO: 2784026 - RNA, 17 nt, Human
agaaaagagaagaagaa

SEQ ID NO: 2784027 - RNA, 20 nt, Human
agaaaagagaagaagaaaaa

SEQ ID NO: 2784028 - RNA, 22 nt, Human
agaaaacaagcaaguucugaga

SEQ ID NO: 2784029 - RNA, 21 nt, Human
agaaaacaagcaaguucugag

SEQ ID NO: 2784030 - RNA, 12 nt, Human
agaaaagcacac

SEQ ID NO: 2784031 - RNA, 22 nt, Human
agaaacuguucccaccugcugg

SEQ ID NO: 2784032 - RNA, 21 nt, Human
agaaacuguucccaccugcug

SEQ ID NO: 2784033 - RNA, 15 nt, Human
agaaacuguucccac

SEQ ID NO: 2784034 - RNA, 12 nt, Human
agaaacaugaca

SEQ ID NO: 2784035 - RNA, 13 nt, Human
agaaacaugacac

SEQ ID NO: 2784036 - RNA, 14 nt, Human
agaaacaugacacu

SEQ ID NO: 2784037 - RNA, 15 nt, Human
agaaacaugacacug

SEQ ID NO: 2784038 - RNA, 17 nt, Human
agaaacaugacacugac

SEQ ID NO: 2784039 - RNA, 18 nt, Human
agaaacaugacacugacc

SEQ ID NO: 2784040 - RNA, 14 nt, Human
agaaacauugaaga

SEQ ID NO: 2784041 - RNA, 15 nt, Human
agaaacauugaagau

SEQ ID NO: 2784042 - RNA, 14 nt, Human
ucucucccuccccu

SEQ ID NO: 2784043 - RNA, 22 nt, Human
ucucuuguauaagauccuagau

SEQ ID NO: 2784044 - RNA, 16 nt, Human
agaaaacaagcaaguu

SEQ ID NO: 2784045 - RNA, 13 nt, Human
agaaaacaaaauu

SEQ ID NO: 2784046 - RNA, 22 nt, Human
agaaaacaagaugagauuggca

SEQ ID NO: 2784047 - RNA, 13 nt, Human
agaaaaaugcuuu

SEQ ID NO: 2784048 - RNA, 20 nt, Human
agaaaaauucagcaaaccau

SEQ ID NO: 2784049 - RNA, 13 nt, Human
ucucuugguguua

SEQ ID NO: 2784050 - RNA, 20 nt, Human
ucucuugguguuaaaacacu

SEQ ID NO: 2784051 - RNA, 22 nt, Human
ucucuugguguuaaaacacuuc

SEQ ID NO: 2784052 - RNA, 21 nt, Human
ucucggcaacuaagcaguccc

SEQ ID NO: 2784053 - RNA, 17 nt, Human
acuuuguggaccaauua

SEQ ID NO: 2784054 - RNA, 18 nt, Human
acuuuguggaccaauuau

SEQ ID NO: 2784055 - RNA, 20 nt, Human
acuuuguggaccaauuauug

SEQ ID NO: 2784056 - RNA, 21 nt, Human
acuuuguggaccaauuauuga

SEQ ID NO: 2784057 - RNA, 22 nt, Human
acuuuguggaccaauuauugau

SEQ ID NO: 2784058 - RNA, 16 nt, Human
acuuuguguucaccuu

SEQ ID NO: 2784059 - RNA, 22 nt, Human
acuuuguaugucauuuccuuca

SEQ ID NO: 2784060 - RNA, 20 nt, Human
acuuugucgcccaggcugga

SEQ ID NO: 2784061 - RNA, 14 nt, Human
acuuugucugaaaa

SEQ ID NO: 2784062 - RNA, 15 nt, Human
acuuugucugaaaaa

SEQ ID NO: 2784063 - RNA, 17 nt, Human
acuuugucugaaaaauu

SEQ ID NO: 2784064 - RNA, 18 nt, Human
acuuuguguucaccuugu

SEQ ID NO: 2784065 - RNA, 14 nt, Human
agaaaaaaaucuuc

SEQ ID NO: 2784066 - RNA, 16 nt, Human
agaaaaaaaucuucuc

SEQ ID NO: 2784067 - RNA, 17 nt, Human
agaaaaaaaucuucucc

SEQ ID NO: 2784068 - RNA, 21 nt, Human
agaaaaaaaucuucuccagau

SEQ ID NO: 2784069 - RNA, 17 nt, Human
agaaaaaaagauuuauu

SEQ ID NO: 2784070 - RNA, 12 nt, Human
agaaaaaaacga

SEQ ID NO: 2784071 - RNA, 18 nt, Human
agaaaaaaacgaaaacag

SEQ ID NO: 2784072 - RNA, 18 nt, Human
agaaaaaaaccacacaaa

SEQ ID NO: 2784073 - RNA, 13 nt, Human
agaaaaaaaaaug

SEQ ID NO: 2784074 - RNA, 15 nt, Human
agaaaaaaaaaugcc

SEQ ID NO: 2784075 - RNA, 16 nt, Human
agaaaaaaaaaugcca

SEQ ID NO: 2784076 - RNA, 21 nt, Human
agaaaaaaaaaugccauaaua

SEQ ID NO: 2784077 - RNA, 22 nt, Human
agaaaaaaaaaugccauaauac

SEQ ID NO: 2784078 - RNA, 23 nt, Human
agaaaaaaaaaugccauaauaca

SEQ ID NO: 2784079 - RNA, 18 nt, Human
agaaaaaaaauagacuuu

SEQ ID NO: 2784080 - RNA, 12 nt, Human
agaaaaaaacaa

SEQ ID NO: 2784081 - RNA, 19 nt, Human
agaaaaaaauuacuaauuu

SEQ ID NO: 2784082 - RNA, 13 nt, Human
ucuccuucuuagc

SEQ ID NO: 2784083 - RNA, 11 nt, Human
ucuccuuccuu

SEQ ID NO: 2784084 - RNA, 14 nt, Human
ucuccuuccuuacc

SEQ ID NO: 2784085 - RNA, 18 nt, Human
ucuccuuccuuacccaaa

SEQ ID NO: 2784086 - RNA, 18 nt, Human
ucuccuucguaucccgag

SEQ ID NO: 2784087 - RNA, 19 nt, Human
ucuccuucguaucccgagu

SEQ ID NO: 2784088 - RNA, 23 nt, Human
ucuccuucguaucccgagucugg

SEQ ID NO: 2784089 - RNA, 14 nt, Human
ucuccuguuuuucu

SEQ ID NO: 2784090 - RNA, 17 nt, Human
ucuccuguuuuucuggg

SEQ ID NO: 2784091 - RNA, 19 nt, Human
ucuccuguuuuucugggug

SEQ ID NO: 2784092 - RNA, 19 nt, Human
ucuccuguuuauucccauc

SEQ ID NO: 2784093 - RNA, 20 nt, Human
ucuccuguuuauucccaucu

SEQ ID NO: 2784094 - RNA, 17 nt, Human
ucuccuguuucccuucc

SEQ ID NO: 2784095 - RNA, 18 nt, Human
ucuccuguuucccuuccc

SEQ ID NO: 2784096 - RNA, 17 nt, Human
ucucucagccuuacauu

SEQ ID NO: 2784097 - RNA, 14 nt, Human
ucucggcucagugc

SEQ ID NO: 2784098 - RNA, 16 nt, Human
ucucggcucagugcaa

SEQ ID NO: 2784099 - RNA, 15 nt, Human
ucucggcucacugca

SEQ ID NO: 2784100 - RNA, 23 nt, Human
ucuccuugcuccuggccuugcug

SEQ ID NO: 2784101 - RNA, 19 nt, Human
ucuccuugcccuagaugag

SEQ ID NO: 2784102 - RNA, 13 nt, Human
ucuccuugcaguu

SEQ ID NO: 2784103 - RNA, 14 nt, Human
ucuccuugcaguuc

SEQ ID NO: 2784104 - RNA, 17 nt, Human
ucuccuugcaguucuug

SEQ ID NO: 2784105 - RNA, 13 nt, Human
ucuccuugcccua

SEQ ID NO: 2784106 - RNA, 14 nt, Human
ucuccuucuuagcu

SEQ ID NO: 2784107 - RNA, 17 nt, Human
ucucgaacuccugaccu

SEQ ID NO: 2784108 - RNA, 19 nt, Human
ucuccuuuuccucucuccc

SEQ ID NO: 2784109 - RNA, 12 nt, Human
ucuccuuuucuu

SEQ ID NO: 2784110 - RNA, 14 nt, Human
ucuccuuuucuuuu

SEQ ID NO: 2784111 - RNA, 17 nt, Human
ucuccuuuucuuuuguu

SEQ ID NO: 2784112 - RNA, 18 nt, Human
ucuccuuuucuuuuguua

SEQ ID NO: 2784113 - RNA, 19 nt, Human
ucuccuuuucuuuuguuac

SEQ ID NO: 2784114 - RNA, 20 nt, Human
ucuccuuuucuuuuguuacu

SEQ ID NO: 2784115 - RNA, 21 nt, Human
ucuccuuuucuuuuguuacug

SEQ ID NO: 2784116 - RNA, 22 nt, Human
ucuccuuuucuuuuguuacugu

SEQ ID NO: 2784117 - RNA, 23 nt, Human
ucuccuuuucuuuuguuacuguu

SEQ ID NO: 2784118 - RNA, 20 nt, Human
ucucgaacuccuaaccucaa

SEQ ID NO: 2784119 - RNA, 14 nt, Human
ucuccuuguggccu

SEQ ID NO: 2784120 - RNA, 12 nt, Human
ucucgagcuugg

SEQ ID NO: 2784121 - RNA, 13 nt, Human
ucucgagcuuggg

SEQ ID NO: 2784122 - RNA, 16 nt, Human
ucucgcaucuucccaa

SEQ ID NO: 2784123 - RNA, 20 nt, Human
ucucgcuauugucaccaggg

SEQ ID NO: 2784124 - RNA, 17 nt, Human
ucucgcucuguugccca

SEQ ID NO: 2784125 - RNA, 16 nt, Human
ucucgcucccucccag

SEQ ID NO: 2784126 - RNA, 15 nt, Human
ucucgcucccuccca

SEQ ID NO: 2784127 - RNA, 17 nt, Human
ucucggaaggcuggcug

SEQ ID NO: 2784128 - RNA, 19 nt, Human
ucucggacuaagccuaccu

SEQ ID NO: 2784129 - RNA, 20 nt, Human
ucucggagcaucccggagga

SEQ ID NO: 2784130 - RNA, 18 nt, Human
ucucgcucccucccagga

SEQ ID NO: 2784131 - RNA, 14 nt, Human
acuuuaaaaaauau

SEQ ID NO: 2784132 - RNA, 21 nt, Human
acuuuaaaaaauauuuauuaa

SEQ ID NO: 2784133 - RNA, 17 nt, Human
acuuuagaaagcugaca

SEQ ID NO: 2784134 - RNA, 18 nt, Human
acuuuagaaagcugacau

SEQ ID NO: 2784135 - RNA, 21 nt, Human
acuuuagaagcacaguaaaua

SEQ ID NO: 2784136 - RNA, 19 nt, Human
acuuuagaagugcauuucu

SEQ ID NO: 2784137 - RNA, 20 nt, Human
acuuuagaagugcauuucug

SEQ ID NO: 2784138 - RNA, 21 nt, Human
acuuuagaagugcauuucuga

SEQ ID NO: 2784139 - RNA, 14 nt, Human
acuuuaggcuuuca

SEQ ID NO: 2784140 - RNA, 17 nt, Human
acuuuaggcuuucagcu

SEQ ID NO: 2784141 - RNA, 18 nt, Human
acuuuaggcuuucagcuu

SEQ ID NO: 2784142 - RNA, 19 nt, Human
acuuuaggcuuucagcuua

SEQ ID NO: 2784143 - RNA, 21 nt, Human
acuuuaggcuuucagcuuaca

SEQ ID NO: 2784144 - RNA, 17 nt, Human
acuuucuuucuguaggu

SEQ ID NO: 2784145 - RNA, 18 nt, Human
acuuucuuuaaauuaugu

SEQ ID NO: 2784146 - RNA, 23 nt, Human
acuuucuuuaaauuauguuuuua

SEQ ID NO: 2784147 - RNA, 14 nt, Human
acuuucuucugaau

SEQ ID NO: 2784148 - RNA, 18 nt, Human
acuuucuucugaauauuu

SEQ ID NO: 2784149 - RNA, 20 nt, Human
acuuucuucugaauauuuua

SEQ ID NO: 2784150 - RNA, 21 nt, Human
acuugugcuuucaguuagccu

SEQ ID NO: 2784151 - RNA, 15 nt, Human
acuugugcuuugcuc

SEQ ID NO: 2784152 - RNA, 16 nt, Human
acuuguuuucugggaa

SEQ ID NO: 2784153 - RNA, 16 nt, Human
acuuuaaaaggagcca

SEQ ID NO: 2784154 - RNA, 14 nt, Human
acuuguggacacag

SEQ ID NO: 2784155 - RNA, 17 nt, Human
acuugugauuauuuauu

SEQ ID NO: 2784156 - RNA, 20 nt, Human
acuugugauuauuuauuauu

SEQ ID NO: 2784157 - RNA, 13 nt, Human
acuugugccaaca

SEQ ID NO: 2784158 - RNA, 18 nt, Human
acuugugccaacacucaa

SEQ ID NO: 2784159 - RNA, 16 nt, Human
acuugugauuauuuau

SEQ ID NO: 2784160 - RNA, 12 nt, Human
acuugugaaugc

SEQ ID NO: 2784161 - RNA, 13 nt, Human
acuugugaaugcu

SEQ ID NO: 2784162 - RNA, 17 nt, Human
acuugugaaugcuucuc

SEQ ID NO: 2784163 - RNA, 18 nt, Human
acuugugaaugcuucuca

SEQ ID NO: 2784164 - RNA, 15 nt, Human
acuuugcuuucauga

SEQ ID NO: 2784165 - RNA, 14 nt, Human
acuuuguauacuuu

SEQ ID NO: 2784166 - RNA, 16 nt, Human
acuuuguauacuuuaa

SEQ ID NO: 2784167 - RNA, 17 nt, Human
acuuuguauacuuuaaa

SEQ ID NO: 2784168 - RNA, 18 nt, Human
acuuuguauacuuuaaau

SEQ ID NO: 2784169 - RNA, 21 nt, Human
acuuuguauacuuuaaauaau

SEQ ID NO: 2784170 - RNA, 19 nt, Human
acuuuguaugucauuuccu

SEQ ID NO: 2784171 - RNA, 14 nt, Human
acuuugaugucaug

SEQ ID NO: 2784172 - RNA, 15 nt, Human
acuuugaugucaugu

SEQ ID NO: 2784173 - RNA, 19 nt, Human
acuuugaugucauguguuc

SEQ ID NO: 2784174 - RNA, 21 nt, Human
acuuugaugucauguguuccc

SEQ ID NO: 2784175 - RNA, 22 nt, Human
acuuugaugucauguguucccu

SEQ ID NO: 2784176 - RNA, 14 nt, Human
acuuugcacauuuu

SEQ ID NO: 2784177 - RNA, 15 nt, Human
acuuugcacauuuug

SEQ ID NO: 2784178 - RNA, 20 nt, Human
acuuugcacauuuugauuuu

SEQ ID NO: 2784179 - RNA, 19 nt, Human
acuuugcacgacgcccucu

SEQ ID NO: 2784180 - RNA, 20 nt, Human
acuuugcacgacgcccucuc

SEQ ID NO: 2784181 - RNA, 21 nt, Human
acuuugaagacccgcuacaaa

SEQ ID NO: 2784182 - RNA, 16 nt, Human
acuuugaggugucuca

SEQ ID NO: 2784183 - RNA, 14 nt, Human
acuuugaaauaccu

SEQ ID NO: 2784184 - RNA, 15 nt, Human
acuuugaaauaccuc

SEQ ID NO: 2784185 - RNA, 16 nt, Human
acuuugaaauaccuca

SEQ ID NO: 2784186 - RNA, 17 nt, Human
acuuugaaauaccucau

SEQ ID NO: 2784187 - RNA, 20 nt, Human
acuuugaaauaccucauguu

SEQ ID NO: 2784188 - RNA, 21 nt, Human
acuuugaaauaccucauguuu

SEQ ID NO: 2784189 - RNA, 22 nt, Human
acuuugaaauaccucauguuua

SEQ ID NO: 2784190 - RNA, 23 nt, Human
acuuugaaauaccucauguuuau

SEQ ID NO: 2784191 - RNA, 17 nt, Human
acuuugcucuuucuuga

SEQ ID NO: 2784192 - RNA, 15 nt, Human
acuuugcugauuucc

SEQ ID NO: 2784193 - RNA, 20 nt, Human
acuuugcugauuuccccucu

SEQ ID NO: 2784194 - RNA, 15 nt, Human
acuuugcucuuucuu

SEQ ID NO: 2784195 - RNA, 15 nt, Human
acuuugccuccugug

SEQ ID NO: 2784196 - RNA, 16 nt, Human
acuuugccuccugugu

SEQ ID NO: 2784197 - RNA, 23 nt, Human
acuuugccuccuguguacugugu

SEQ ID NO: 2784198 - RNA, 10 nt, Human
agaacuuuuu

SEQ ID NO: 2784199 - RNA, 20 nt, Human
agaacuuuuucuuuucccuc

SEQ ID NO: 2784200 - RNA, 13 nt, Human
agaacuuuuuuaa

SEQ ID NO: 2784201 - RNA, 14 nt, Human
agaacuuuuuuaaa

SEQ ID NO: 2784202 - RNA, 15 nt, Human
agaacuuuuuuaaau

SEQ ID NO: 2784203 - RNA, 16 nt, Human
agaacuuuuuuaaaua

SEQ ID NO: 2784204 - RNA, 17 nt, Human
agaacuuuuuuaaauaa

SEQ ID NO: 2784205 - RNA, 18 nt, Human
agaacuuuuuuaaauaaa

SEQ ID NO: 2784206 - RNA, 19 nt, Human
agaacuuuuuuaaauaaac

SEQ ID NO: 2784207 - RNA, 20 nt, Human
agaacuuuuuuaaauaaacu

SEQ ID NO: 2784208 - RNA, 21 nt, Human
agaacuuuuuuaaauaaacuu

SEQ ID NO: 2784209 - RNA, 22 nt, Human
agaacuuuuuuaaauaaacuuu

SEQ ID NO: 2784210 - RNA, 18 nt, Human
agaacuugaaugugucag

SEQ ID NO: 2784211 - RNA, 20 nt, Human
agaacuucuccguccucgau

SEQ ID NO: 2784212 - RNA, 13 nt, Human
agaagcagagaga

SEQ ID NO: 2784213 - RNA, 18 nt, Human
agaagcaggcuacacuga

SEQ ID NO: 2784214 - RNA, 13 nt, Human
agaagcauuccuu

SEQ ID NO: 2784215 - RNA, 12 nt, Human
ucugcccugugg

SEQ ID NO: 2784216 - RNA, 20 nt, Human
ucugcccugugggaccccag

SEQ ID NO: 2784217 - RNA, 21 nt, Human
ucugcccugugggaccccagg

SEQ ID NO: 2784218 - RNA, 22 nt, Human
ucugcccugugggaccccaggc

SEQ ID NO: 2784219 - RNA, 16 nt, Human
ucugcccccugcuggc

SEQ ID NO: 2784220 - RNA, 22 nt, Human
ucugcccugcgggucacaggag

SEQ ID NO: 2784221 - RNA, 14 nt, Human
ucugcccccugcug

SEQ ID NO: 2784222 - RNA, 20 nt, Human
ucugccccccccccccaucu

SEQ ID NO: 2784223 - RNA, 17 nt, Human
ucugccccagcucuggc

SEQ ID NO: 2784224 - RNA, 16 nt, Human
ucugccccagcucugg

SEQ ID NO: 2784225 - RNA, 20 nt, Human
ucugccccagcucuggcuuc

SEQ ID NO: 2784226 - RNA, 13 nt, Human
ucugcccccagcc

SEQ ID NO: 2784227 - RNA, 14 nt, Human
ucugcccccagccc

SEQ ID NO: 2784228 - RNA, 15 nt, Human
ucugcccccagccca

SEQ ID NO: 2784229 - RNA, 16 nt, Human
ucugcccccagcccaa

SEQ ID NO: 2784230 - RNA, 18 nt, Human
ucugcccccagcccaaag

SEQ ID NO: 2784231 - RNA, 19 nt, Human
ucugcccccagcccaaagg

SEQ ID NO: 2784232 - RNA, 11 nt, Human
ucugccccagu

SEQ ID NO: 2784233 - RNA, 14 nt, Human
ucugccccagcucu

SEQ ID NO: 2784234 - RNA, 21 nt, Human
agaaccuggaaaaauuccaga

SEQ ID NO: 2784235 - RNA, 23 nt, Human
agaaccuggaaaaauuccagaag

SEQ ID NO: 2784236 - RNA, 18 nt, Human
agaaauuacacccaaaga

SEQ ID NO: 2784237 - RNA, 13 nt, Human
ucugaaugcugcc

SEQ ID NO: 2784238 - RNA, 20 nt, Human
ucugaaugcugccacaacca

SEQ ID NO: 2784239 - RNA, 14 nt, Human
agaaauuagccggg

SEQ ID NO: 2784240 - RNA, 12 nt, Human
agaaauuagaaa

SEQ ID NO: 2784241 - RNA, 21 nt, Human
agaaauuagaaaaaaauuacu

SEQ ID NO: 2784242 - RNA, 17 nt, Human
agaaauuagaaaccuua

SEQ ID NO: 2784243 - RNA, 15 nt, Human
agaaauuagccgggc

SEQ ID NO: 2784244 - RNA, 22 nt, Human
ucugaaucgagugagacaaaau

SEQ ID NO: 2784245 - RNA, 16 nt, Human
ucugaauagaaauggg

SEQ ID NO: 2784246 - RNA, 19 nt, Human
ucugaaggggcaaauucuu

SEQ ID NO: 2784247 - RNA, 14 nt, Human
agaacucacugggg

SEQ ID NO: 2784248 - RNA, 15 nt, Human
agaacugcacaugaa

SEQ ID NO: 2784249 - RNA, 17 nt, Human
agaacugcacaugaaga

SEQ ID NO: 2784250 - RNA, 19 nt, Human
agaacugcacaugaagaaa

SEQ ID NO: 2784251 - RNA, 20 nt, Human
agaacugcacaugaagaaau

SEQ ID NO: 2784252 - RNA, 21 nt, Human
agaacugcacaugaagaaaua

SEQ ID NO: 2784253 - RNA, 18 nt, Human
agaacgaggauuuuaauu

SEQ ID NO: 2784254 - RNA, 23 nt, Human
agaacgcagcccuagagccugcc

SEQ ID NO: 2784255 - RNA, 13 nt, Human
agaacgcagcccu

SEQ ID NO: 2784256 - RNA, 22 nt, Human
agaacgcagcccuagagccugc

SEQ ID NO: 2784257 - RNA, 17 nt, Human
agaacuauuuuauucua

SEQ ID NO: 2784258 - RNA, 20 nt, Human
agaacucaaacuucuggcuc

SEQ ID NO: 2784259 - RNA, 16 nt, Human
agaacuauaugugaau

SEQ ID NO: 2784260 - RNA, 19 nt, Human
agaacuauaugugaauccu

SEQ ID NO: 2784261 - RNA, 21 nt, Human
agaacuauaugugaauccucu

SEQ ID NO: 2784262 - RNA, 15 nt, Human
agaacuagcauauag

SEQ ID NO: 2784263 - RNA, 14 nt, Human
agaagugcauuucu

SEQ ID NO: 2784264 - RNA, 15 nt, Human
agaagugcauuucug

SEQ ID NO: 2784265 - RNA, 16 nt, Human
agaagugcauuucuga

SEQ ID NO: 2784266 - RNA, 19 nt, Human
agaagugcauuucugaaua

SEQ ID NO: 2784267 - RNA, 24 nt, Human
agaagugcauuucugaauagaaau

SEQ ID NO: 2784268 - RNA, 21 nt, Human
agaagugagaauaggcagccc

SEQ ID NO: 2784269 - RNA, 18 nt, Human
agaagugagaauaggcag

SEQ ID NO: 2784270 - RNA, 15 nt, Human
agaagugcuccccuc

SEQ ID NO: 2784271 - RNA, 17 nt, Human
agaagugaguguuucua

SEQ ID NO: 2784272 - RNA, 19 nt, Human
agaaguuguggauuucagu

SEQ ID NO: 2784273 - RNA, 20 nt, Human
agaaguuguggauuucaguu

SEQ ID NO: 2784274 - RNA, 21 nt, Human
agaaguuguggauuucaguuu

SEQ ID NO: 2784275 - RNA, 14 nt, Human
agaaguuguuuguc

SEQ ID NO: 2784276 - RNA, 20 nt, Human
agaaguugaggauuguugaa

SEQ ID NO: 2784277 - RNA, 18 nt, Human
agaaguugauauagaaca

SEQ ID NO: 2784278 - RNA, 19 nt, Human
agaaguugauauagaacag

SEQ ID NO: 2784279 - RNA, 14 nt, Human
agaaggagagaaag

SEQ ID NO: 2784280 - RNA, 18 nt, Human
agaaggagagaaaguggg

SEQ ID NO: 2784281 - RNA, 19 nt, Human
agaaggagagaaagugggu

SEQ ID NO: 2784282 - RNA, 21 nt, Human
agaaggaugaaugagguccca

SEQ ID NO: 2784283 - RNA, 14 nt, Human
agaaggaugaauga

SEQ ID NO: 2784284 - RNA, 20 nt, Human
agaaggagucagaaacuguu

SEQ ID NO: 2784285 - RNA, 11 nt, Human
agaaggcaaaa

SEQ ID NO: 2784286 - RNA, 13 nt, Human
agaaggagagaaa

SEQ ID NO: 2784287 - RNA, 23 nt, Human
agaagcucccugaaguaagcaaa

SEQ ID NO: 2784288 - RNA, 13 nt, Human
agaauaaucuuug

SEQ ID NO: 2784289 - RNA, 13 nt, Human
agaaguuugucca

SEQ ID NO: 2784290 - RNA, 15 nt, Human
agaaguuuguccauu

SEQ ID NO: 2784291 - RNA, 19 nt, Human
agaaguuuguccauuugua

SEQ ID NO: 2784292 - RNA, 21 nt, Human
agaaguuuguccauuuguaaa

SEQ ID NO: 2784293 - RNA, 22 nt, Human
agaaguuuguccauuuguaaaa

SEQ ID NO: 2784294 - RNA, 14 nt, Human
agaauacagcuuuc

SEQ ID NO: 2784295 - RNA, 15 nt, Human
agaauacagcuuucu

SEQ ID NO: 2784296 - RNA, 16 nt, Human
agaauacagcuuucug

SEQ ID NO: 2784297 - RNA, 17 nt, Human
agaauacagcuuucuga

SEQ ID NO: 2784298 - RNA, 16 nt, Human
agaauaaucuuugggu

SEQ ID NO: 2784299 - RNA, 14 nt, Human
agaauaauguucua

SEQ ID NO: 2784300 - RNA, 16 nt, Human
agaauaauguucuauu

SEQ ID NO: 2784301 - RNA, 19 nt, Human
agaauaauguucuauugug

SEQ ID NO: 2784302 - RNA, 21 nt, Human
agaauaauucaauuuuaaaga

SEQ ID NO: 2784303 - RNA, 19 nt, Human
agaauagccacauuuggaa

SEQ ID NO: 2784304 - RNA, 20 nt, Human
agaauagccacauuuggaau

SEQ ID NO: 2784305 - RNA, 21 nt, Human
agaauagccacauuuggaaua

SEQ ID NO: 2784306 - RNA, 20 nt, Human
agaauagccuagauaugaau

SEQ ID NO: 2784307 - RNA, 11 nt, Human
agaauauauau

SEQ ID NO: 2784308 - RNA, 12 nt, Human
agaauauauaua

SEQ ID NO: 2784309 - RNA, 15 nt, Human
agaauauauauauau

SEQ ID NO: 2784310 - RNA, 12 nt, Human
agaauauauuua

SEQ ID NO: 2784311 - RNA, 13 nt, Human
agaauauauuuau

SEQ ID NO: 2784312 - RNA, 14 nt, Human
agaauauauuuauu

SEQ ID NO: 2784313 - RNA, 14 nt, Human
agaaucaaucagua

SEQ ID NO: 2784314 - RNA, 13 nt, Human
agaauauaacaug

SEQ ID NO: 2784315 - RNA, 14 nt, Human
agaauauaacauga

SEQ ID NO: 2784316 - RNA, 15 nt, Human
agaauauaacaugaa

SEQ ID NO: 2784317 - RNA, 16 nt, Human
agaauauaacaugaaa

SEQ ID NO: 2784318 - RNA, 21 nt, Human
agaauauaacaugaaaugaua

SEQ ID NO: 2784319 - RNA, 22 nt, Human
agaauauaacaugaaaugauag

SEQ ID NO: 2784320 - RNA, 18 nt, Human
agaauaggcauuaacaca

SEQ ID NO: 2784321 - RNA, 19 nt, Human
agaauaggcauuaacacaa

SEQ ID NO: 2784322 - RNA, 14 nt, Human
agaauauaggucuc

SEQ ID NO: 2784323 - RNA, 19 nt, Human
agaauauaggucucuucuc

SEQ ID NO: 2784324 - RNA, 14 nt, Human
agaagccugaggcu

SEQ ID NO: 2784325 - RNA, 12 nt, Human
agaagccugagg

SEQ ID NO: 2784326 - RNA, 17 nt, Human
agaagccugaggcuggg

SEQ ID NO: 2784327 - RNA, 14 nt, Human
agaagccucuggcu

SEQ ID NO: 2784328 - RNA, 13 nt, Human
agaagccucuggc

SEQ ID NO: 2784329 - RNA, 12 nt, Human
agaagccucugg

SEQ ID NO: 2784330 - RNA, 20 nt, Human
agaagccucguuuugaugcc

SEQ ID NO: 2784331 - RNA, 23 nt, Human
agaagccucuggcuagaggccag

SEQ ID NO: 2784332 - RNA, 16 nt, Human
agaagccucuggcuag

SEQ ID NO: 2784333 - RNA, 23 nt, Human
agaagccucugggucaguggucc

SEQ ID NO: 2784334 - RNA, 22 nt, Human
agaagccucugggucagugguc

SEQ ID NO: 2784335 - RNA, 12 nt, Human
ucuggccuggcc

SEQ ID NO: 2784336 - RNA, 13 nt, Human
agaagcccugaug

SEQ ID NO: 2784337 - RNA, 13 nt, Human
ucuggccuggccu

SEQ ID NO: 2784338 - RNA, 14 nt, Human
ucuggccuggccug

SEQ ID NO: 2784339 - RNA, 16 nt, Human
ucuggccuggccuggc

SEQ ID NO: 2784340 - RNA, 17 nt, Human
ucuggccuggccuggcc

SEQ ID NO: 2784341 - RNA, 18 nt, Human
ucuggccuggccuggccc

SEQ ID NO: 2784342 - RNA, 19 nt, Human
ucuggccuggccuggcccu

SEQ ID NO: 2784343 - RNA, 20 nt, Human
ucuggccuggccuggcccug

SEQ ID NO: 2784344 - RNA, 21 nt, Human
ucuggccuggccuggcccugc

SEQ ID NO: 2784345 - RNA, 22 nt, Human
ucuggccuggccuggcccugcc

SEQ ID NO: 2784346 - RNA, 23 nt, Human
ucuggccuggccuggcccugccc

SEQ ID NO: 2784347 - RNA, 22 nt, Human
agaagccgggaacagacaacag

SEQ ID NO: 2784348 - RNA, 18 nt, Human
agaagccgggaacagaca

SEQ ID NO: 2784349 - RNA, 16 nt, Human
agaagccgggaacaga

SEQ ID NO: 2784350 - RNA, 14 nt, Human
agaagccgggaaca

SEQ ID NO: 2784351 - RNA, 14 nt, Human
ucuggccucccaca

SEQ ID NO: 2784352 - RNA, 13 nt, Human
ucuggccucccac

SEQ ID NO: 2784353 - RNA, 17 nt, Human
ucuggccuaaaaucuug

SEQ ID NO: 2784354 - RNA, 22 nt, Human
ucuggccuaaaaucuuggaagu

SEQ ID NO: 2784355 - RNA, 13 nt, Human
ucugcuuuuauua

SEQ ID NO: 2784356 - RNA, 16 nt, Human
ucugcccuucacccca

SEQ ID NO: 2784357 - RNA, 12 nt, Human
ucugccugucuc

SEQ ID NO: 2784358 - RNA, 14 nt, Human
ucugccugucuccc

SEQ ID NO: 2784359 - RNA, 13 nt, Human
ucugccuuagagg

SEQ ID NO: 2784360 - RNA, 16 nt, Human
ucugccuuagaggagc

SEQ ID NO: 2784361 - RNA, 15 nt, Human
ucugccuuagucuca

SEQ ID NO: 2784362 - RNA, 19 nt, Human
ucugccuuagucucaguuu

SEQ ID NO: 2784363 - RNA, 16 nt, Human
ucugccuguugcguga

SEQ ID NO: 2784364 - RNA, 13 nt, Human
ucuggauucccag

SEQ ID NO: 2784365 - RNA, 14 nt, Human
ucuggauucccagg

SEQ ID NO: 2784366 - RNA, 17 nt, Human
ucuggauucccaggaug

SEQ ID NO: 2784367 - RNA, 21 nt, Human
ucuggauucccaggaugagca

SEQ ID NO: 2784368 - RNA, 22 nt, Human
ucuggauucccaggaugagcau

SEQ ID NO: 2784369 - RNA, 13 nt, Human
ucuggaagaaaaa

SEQ ID NO: 2784370 - RNA, 14 nt, Human
ucuggaagaaaaaa

SEQ ID NO: 2784371 - RNA, 18 nt, Human
ucuggaagcccuggagac

SEQ ID NO: 2784372 - RNA, 13 nt, Human
ucuggaagggcca

SEQ ID NO: 2784373 - RNA, 13 nt, Human
ucuggaaguccaa

SEQ ID NO: 2784374 - RNA, 18 nt, Human
ugaauacuuacauucucu

SEQ ID NO: 2784375 - RNA, 17 nt, Human
ugaauaccauuaaaacu

SEQ ID NO: 2784376 - RNA, 21 nt, Human
ugaauaccauuaaaacugcuu

SEQ ID NO: 2784377 - RNA, 22 nt, Human
ugaauaccauuaaaacugcuuu

SEQ ID NO: 2784378 - RNA, 23 nt, Human
ugaauaccauuaaaacugcuuuu

SEQ ID NO: 2784379 - RNA, 14 nt, Human
ugaagucacacagu

SEQ ID NO: 2784380 - RNA, 14 nt, Human
ugaagucacugcac

SEQ ID NO: 2784381 - RNA, 12 nt, Human
ugaauaaagugu

SEQ ID NO: 2784382 - RNA, 14 nt, Human
ugaagucaccuugu

SEQ ID NO: 2784383 - RNA, 20 nt, Human
ugaauaaagccugcuuuuua

SEQ ID NO: 2784384 - RNA, 18 nt, Human
ugaagucacaucacagga

SEQ ID NO: 2784385 - RNA, 18 nt, Human
ugaauaaagccugcuuuu

SEQ ID NO: 2784386 - RNA, 15 nt, Human
ugaagucacugcaca

SEQ ID NO: 2784387 - RNA, 16 nt, Human
ugaagucacugcacag

SEQ ID NO: 2784388 - RNA, 16 nt, Human
ugaauaaagacaccua

SEQ ID NO: 2784389 - RNA, 17 nt, Human
ugaauauugaaguuuca

SEQ ID NO: 2784390 - RNA, 14 nt, Human
ugaauaugccugua

SEQ ID NO: 2784391 - RNA, 16 nt, Human
ugaauaugccuguaau

SEQ ID NO: 2784392 - RNA, 21 nt, Human
ugaauaugccuguaauucagu

SEQ ID NO: 2784393 - RNA, 23 nt, Human
ugaauaugccuguaauucagugu

SEQ ID NO: 2784394 - RNA, 12 nt, Human
ugaauauggaca

SEQ ID NO: 2784395 - RNA, 19 nt, Human
ugaauauggacaagaggua

SEQ ID NO: 2784396 - RNA, 22 nt, Human
ugaauauggacaagagguacag

SEQ ID NO: 2784397 - RNA, 21 nt, Human
ugaauauggacucaguuuucu

SEQ ID NO: 2784398 - RNA, 15 nt, Human
ugaauauuacuccua

SEQ ID NO: 2784399 - RNA, 19 nt, Human
ugaauauuacuccuauuuu

SEQ ID NO: 2784400 - RNA, 22 nt, Human
ugaauauuacuccuauuuuugu

SEQ ID NO: 2784401 - RNA, 18 nt, Human
ugaauaucuauuaauaua

SEQ ID NO: 2784402 - RNA, 21 nt, Human
ugaauaucuauuaauauaugu

SEQ ID NO: 2784403 - RNA, 14 nt, Human
ugaauaucuuucga

SEQ ID NO: 2784404 - RNA, 21 nt, Human
ugaauagcaauagcauggaua

SEQ ID NO: 2784405 - RNA, 16 nt, Human
ugaauacuuuuuacaa

SEQ ID NO: 2784406 - RNA, 12 nt, Human
ugaauagaaaug

SEQ ID NO: 2784407 - RNA, 15 nt, Human
ugaauagaaauggga

SEQ ID NO: 2784408 - RNA, 13 nt, Human
ugaaugggaucau

SEQ ID NO: 2784409 - RNA, 18 nt, Human
ugaaugggaucaugaaag

SEQ ID NO: 2784410 - RNA, 20 nt, Human
ugaaugggaucaugaaagua

SEQ ID NO: 2784411 - RNA, 19 nt, Human
ugaauguagcagccccggg

SEQ ID NO: 2784412 - RNA, 11 nt, Human
ugaauguauuu

SEQ ID NO: 2784413 - RNA, 16 nt, Human
ugaauguauugaacuu

SEQ ID NO: 2784414 - RNA, 20 nt, Human
ugaauguauguaaugugugg

SEQ ID NO: 2784415 - RNA, 22 nt, Human
ugaauguauguaauguguggug

SEQ ID NO: 2784416 - RNA, 14 nt, Human
agaguaugaacacc

SEQ ID NO: 2784417 - RNA, 13 nt, Human
agaguauggagcu

SEQ ID NO: 2784418 - RNA, 14 nt, Human
agaguauggagcuc

SEQ ID NO: 2784419 - RNA, 21 nt, Human
agaguauggagcucagagagg

SEQ ID NO: 2784420 - RNA, 22 nt, Human
agaguaugugccaggaaacucu

SEQ ID NO: 2784421 - RNA, 16 nt, Human
agaguauugagauacu

SEQ ID NO: 2784422 - RNA, 20 nt, Human
agagguuaucugucccaggu

SEQ ID NO: 2784423 - RNA, 14 nt, Human
agaguaguuauaua

SEQ ID NO: 2784424 - RNA, 23 nt, Human
agaguaguuauauaauuguugaa

SEQ ID NO: 2784425 - RNA, 13 nt, Human
agaguauaugcac

SEQ ID NO: 2784426 - RNA, 17 nt, Human
agagguuaucuguccca

SEQ ID NO: 2784427 - RNA, 15 nt, Human
ugaagccaaagccaa

SEQ ID NO: 2784428 - RNA, 23 nt, Human
agaguauuggucuccucucagcc

SEQ ID NO: 2784429 - RNA, 16 nt, Human
ugaagccacugaagcu

SEQ ID NO: 2784430 - RNA, 13 nt, Human
ugaagccuuuuga

SEQ ID NO: 2784431 - RNA, 15 nt, Human
ugaagccuuuugaaa

SEQ ID NO: 2784432 - RNA, 16 nt, Human
ugaagccuuuugaaag

SEQ ID NO: 2784433 - RNA, 21 nt, Human
ugaagcgaaacacagagaagc

SEQ ID NO: 2784434 - RNA, 17 nt, Human
ugaagcgugauuuuaaa

SEQ ID NO: 2784435 - RNA, 12 nt, Human
ugaagccuuugu

SEQ ID NO: 2784436 - RNA, 22 nt, Human
ugaaggggccaaggagggugag

SEQ ID NO: 2784437 - RNA, 23 nt, Human
ugaaggggcaaauucuuuugaau

SEQ ID NO: 2784438 - RNA, 13 nt, Human
ugaagggcccagg

SEQ ID NO: 2784439 - RNA, 14 nt, Human
ugaagggcccagga

SEQ ID NO: 2784440 - RNA, 14 nt, Human
ugaagcuacugugu

SEQ ID NO: 2784441 - RNA, 22 nt, Human
ugaagcuacugugugugugaau

SEQ ID NO: 2784442 - RNA, 14 nt, Human
ugaaaguacauuug

SEQ ID NO: 2784443 - RNA, 15 nt, Human
ugaaagguuuacauu

SEQ ID NO: 2784444 - RNA, 23 nt, Human
ugaaaguacauuuggagacacaa

SEQ ID NO: 2784445 - RNA, 21 nt, Human
agagcugaagaguugccccgu

SEQ ID NO: 2784446 - RNA, 20 nt, Human
ugaaaguagcagugugaagu

SEQ ID NO: 2784447 - RNA, 16 nt, Human
ugaaaguccagaaacu

SEQ ID NO: 2784448 - RNA, 18 nt, Human
ugaaagucagaugcccag

SEQ ID NO: 2784449 - RNA, 15 nt, Human
ugaaagucagaugcc

SEQ ID NO: 2784450 - RNA, 18 nt, Human
ugaaaguccagaaacugu

SEQ ID NO: 2784451 - RNA, 24 nt, Human
agagggaggagaaugagccucggc

SEQ ID NO: 2784452 - RNA, 19 nt, Human
agagggagaagggauggag

SEQ ID NO: 2784453 - RNA, 14 nt, Human
ugaauuuuguugcu

SEQ ID NO: 2784454 - RNA, 23 nt, Human
ugaauuuuaaaucuaaaucuauu

SEQ ID NO: 2784455 - RNA, 14 nt, Human
ugaauuuuaagggu

SEQ ID NO: 2784456 - RNA, 17 nt, Human
ugaauuuuaaggguuuc

SEQ ID NO: 2784457 - RNA, 13 nt, Human
ugaauuuguacuu

SEQ ID NO: 2784458 - RNA, 21 nt, Human
ugaauuuggccugcacuaauu

SEQ ID NO: 2784459 - RNA, 12 nt, Human
ugacaaacugug

SEQ ID NO: 2784460 - RNA, 22 nt, Human
ugacaaacuguguacauagcgg

SEQ ID NO: 2784461 - RNA, 10 nt, Human
ugacaaaauu

SEQ ID NO: 2784462 - RNA, 17 nt, Human
ugaauuuuaaaucuaaa

SEQ ID NO: 2784463 - RNA, 16 nt, Human
ugaauuuuguugcugu

SEQ ID NO: 2784464 - RNA, 15 nt, Human
ugaauuugcccuggg

SEQ ID NO: 2784465 - RNA, 17 nt, Human
ugaauuugcccugggaa

SEQ ID NO: 2784466 - RNA, 18 nt, Human
ugaauuugcccugggaaa

SEQ ID NO: 2784467 - RNA, 17 nt, Human
agaucaaaauaaaaagu

SEQ ID NO: 2784468 - RNA, 14 nt, Human
agaucaaaauaaaa

SEQ ID NO: 2784469 - RNA, 16 nt, Human
agaucaaaauaaaaag

SEQ ID NO: 2784470 - RNA, 23 nt, Human
agaucaaauuucacgucgucuuc

SEQ ID NO: 2784471 - RNA, 14 nt, Human
agaucaaauuucac

SEQ ID NO: 2784472 - RNA, 20 nt, Human
ugaauuuggccugcacuaau

SEQ ID NO: 2784473 - RNA, 20 nt, Human
ugaauuuggagacucugugg

SEQ ID NO: 2784474 - RNA, 17 nt, Human
ugaauuuggagacucug

SEQ ID NO: 2784475 - RNA, 15 nt, Human
ugaauuuggagacuc

SEQ ID NO: 2784476 - RNA, 14 nt, Human
ugaauuuggagacu

SEQ ID NO: 2784477 - RNA, 14 nt, Human
ugacaccaaagcca

SEQ ID NO: 2784478 - RNA, 16 nt, Human
ugacaccaaagccacc

SEQ ID NO: 2784479 - RNA, 20 nt, Human
ugacaccaaagccaccucug

SEQ ID NO: 2784480 - RNA, 21 nt, Human
ugacacauaugcaccuugugu

SEQ ID NO: 2784481 - RNA, 22 nt, Human
ugacacauaugcaccuuguguc

SEQ ID NO: 2784482 - RNA, 19 nt, Human
ugacacauccgccuuuugu

SEQ ID NO: 2784483 - RNA, 22 nt, Human
ugacacauccgccuuuuguaua

SEQ ID NO: 2784484 - RNA, 21 nt, Human
ugacacccgugagcgccugug

SEQ ID NO: 2784485 - RNA, 22 nt, Human
ugacacccgugagcgccugugc

SEQ ID NO: 2784486 - RNA, 15 nt, Human
ugacacucuccuugc

SEQ ID NO: 2784487 - RNA, 17 nt, Human
ugacacucuccuugcag

SEQ ID NO: 2784488 - RNA, 18 nt, Human
ugacacucuccuugcagu

SEQ ID NO: 2784489 - RNA, 19 nt, Human
ugacacucuccuugcaguu

SEQ ID NO: 2784490 - RNA, 20 nt, Human
ugacacucuccuugcaguuc

SEQ ID NO: 2784491 - RNA, 16 nt, Human
ugacacucccacccag

SEQ ID NO: 2784492 - RNA, 18 nt, Human
ugacacucccacccaguc

SEQ ID NO: 2784493 - RNA, 20 nt, Human
ugacacucccacccagucuc

SEQ ID NO: 2784494 - RNA, 15 nt, Human
ugacacuagaaaacu

SEQ ID NO: 2784495 - RNA, 18 nt, Human
ugacacuauaguuuaaaa

SEQ ID NO: 2784496 - RNA, 20 nt, Human
ugacacuauaguuuaaaaca

SEQ ID NO: 2784497 - RNA, 18 nt, Human
ugacacacagcucugucc

SEQ ID NO: 2784498 - RNA, 16 nt, Human
ugacacacagcucugu

SEQ ID NO: 2784499 - RNA, 14 nt, Human
ugacaaagauggcu

SEQ ID NO: 2784500 - RNA, 16 nt, Human
ugacaaagauggcuca

SEQ ID NO: 2784501 - RNA, 18 nt, Human
ugacaaagauggcucaga

SEQ ID NO: 2784502 - RNA, 19 nt, Human
ugacaaagauggcucagag

SEQ ID NO: 2784503 - RNA, 23 nt, Human
ugacaaagauggcucagaggggg

SEQ ID NO: 2784504 - RNA, 19 nt, Human
ugacacacagcucuguccu

SEQ ID NO: 2784505 - RNA, 23 nt, Human
ugacacagaaaauguugagaauc

SEQ ID NO: 2784506 - RNA, 11 nt, Human
ugacacagacu

SEQ ID NO: 2784507 - RNA, 12 nt, Human
ugacacagacuc

SEQ ID NO: 2784508 - RNA, 13 nt, Human
ugacacagacuca

SEQ ID NO: 2784509 - RNA, 17 nt, Human
ugacacagacucauccu

SEQ ID NO: 2784510 - RNA, 19 nt, Human
ugacacagacucauccuga

SEQ ID NO: 2784511 - RNA, 22 nt, Human
ugacacagacucauccugaaca

SEQ ID NO: 2784512 - RNA, 22 nt, Human
ugacacagucuuggcucacugc

SEQ ID NO: 2784513 - RNA, 23 nt, Human
ugacacagucuuggcucacugca

SEQ ID NO: 2784514 - RNA, 16 nt, Human
ugacacagcagcuuca

SEQ ID NO: 2784515 - RNA, 16 nt, Human
ugacacaggaugaagg

SEQ ID NO: 2784516 - RNA, 22 nt, Human
ugacacagcagcuucaccagag

SEQ ID NO: 2784517 - RNA, 16 nt, Human
ugacacaggaaaccaa

SEQ ID NO: 2784518 - RNA, 15 nt, Human
agauaauauuacugu

SEQ ID NO: 2784519 - RNA, 16 nt, Human
agauaauauuacuguu

SEQ ID NO: 2784520 - RNA, 20 nt, Human
agauacaggaaaagcugcug

SEQ ID NO: 2784521 - RNA, 13 nt, Human
agauacuggugga

SEQ ID NO: 2784522 - RNA, 14 nt, Human
agauacugguggaa

SEQ ID NO: 2784523 - RNA, 11 nt, Human
agauauuuggc

SEQ ID NO: 2784524 - RNA, 12 nt, Human
agauauuuggcu

SEQ ID NO: 2784525 - RNA, 16 nt, Human
agauauuuggcuuaaa

SEQ ID NO: 2784526 - RNA, 19 nt, Human
agauauuuggcuuaaauau

SEQ ID NO: 2784527 - RNA, 20 nt, Human
agauauuuggcuuaaauaua

SEQ ID NO: 2784528 - RNA, 21 nt, Human
agauauuuggcuuaaauauag

SEQ ID NO: 2784529 - RNA, 21 nt, Human
agauauuuucacaaugucagu

SEQ ID NO: 2784530 - RNA, 12 nt, Human
agaucaaaauaa

SEQ ID NO: 2784531 - RNA, 14 nt, Human
agagucacaagccu

SEQ ID NO: 2784532 - RNA, 20 nt, Human
agagucacacgggggcagcu

SEQ ID NO: 2784533 - RNA, 21 nt, Human
agagucacacgggggcagcug

SEQ ID NO: 2784534 - RNA, 12 nt, Human
agauaagacaua

SEQ ID NO: 2784535 - RNA, 19 nt, Human
agauaacuuugacuuucuu

SEQ ID NO: 2784536 - RNA, 22 nt, Human
agaguuuguguguugucuugaa

SEQ ID NO: 2784537 - RNA, 18 nt, Human
agaguuuguguguugucu

SEQ ID NO: 2784538 - RNA, 19 nt, Human
agaguuuguguguugucuu

SEQ ID NO: 2784539 - RNA, 13 nt, Human
agaguuugugugu

SEQ ID NO: 2784540 - RNA, 16 nt, Human
agaguuuguguguugu

SEQ ID NO: 2784541 - RNA, 21 nt, Human
agaguuugccuuccuuucucc

SEQ ID NO: 2784542 - RNA, 16 nt, Human
agaguuugguuugguc

SEQ ID NO: 2784543 - RNA, 14 nt, Human
agaguuucuguuug

SEQ ID NO: 2784544 - RNA, 15 nt, Human
agaguuucuguuuga

SEQ ID NO: 2784545 - RNA, 18 nt, Human
agaguuucuguuugauuc

SEQ ID NO: 2784546 - RNA, 22 nt, Human
agaguuucuguuugauucuuuu

SEQ ID NO: 2784547 - RNA, 21 nt, Human
agauaaccagcuguaacacag

SEQ ID NO: 2784548 - RNA, 22 nt, Human
agauaacgcuuaaaggaaguca

SEQ ID NO: 2784549 - RNA, 22 nt, Human
agauaacacacuuuuuauuaga

SEQ ID NO: 2784550 - RNA, 15 nt, Human
agauaacauuugugu

SEQ ID NO: 2784551 - RNA, 22 nt, Human
agcaaaaaaguccaauuuuaau

SEQ ID NO: 2784552 - RNA, 19 nt, Human
agcaaaaaaaacccaugug

SEQ ID NO: 2784553 - RNA, 23 nt, Human
agcaaaaaaaacccaugugguga

SEQ ID NO: 2784554 - RNA, 20 nt, Human
agcaacguagcuucuaccau

SEQ ID NO: 2784555 - RNA, 14 nt, Human
agcaacucuugauu

SEQ ID NO: 2784556 - RNA, 13 nt, Human
agcaaaaaaugaa

SEQ ID NO: 2784557 - RNA, 20 nt, Human
agcaaaaaaugaaugucuaa

SEQ ID NO: 2784558 - RNA, 13 nt, Human
agauuuuuuauug

SEQ ID NO: 2784559 - RNA, 16 nt, Human
agauuuuuuauugcua

SEQ ID NO: 2784560 - RNA, 18 nt, Human
agauuuuuuauugcuagu

SEQ ID NO: 2784561 - RNA, 22 nt, Human
agauuuuuuauugcuaguauuu

SEQ ID NO: 2784562 - RNA, 23 nt, Human
agauuuuuuauugcuaguauuug

SEQ ID NO: 2784563 - RNA, 16 nt, Human
agauuuuuucagacuu

SEQ ID NO: 2784564 - RNA, 21 nt, Human
agauuuuuucagacuugucaa

SEQ ID NO: 2784565 - RNA, 22 nt, Human
agauuuuuucagacuugucaag

SEQ ID NO: 2784566 - RNA, 13 nt, Human
agauuuuugcaau

SEQ ID NO: 2784567 - RNA, 22 nt, Human
agauuuuucucaaaguuuugaa

SEQ ID NO: 2784568 - RNA, 13 nt, Human
agauuuuucucaa

SEQ ID NO: 2784569 - RNA, 14 nt, Human
agauuuuugcaaua

SEQ ID NO: 2784570 - RNA, 22 nt, Human
agauuucuuaaauaaugcuuca

SEQ ID NO: 2784571 - RNA, 13 nt, Human
agauuuuuuuuaa

SEQ ID NO: 2784572 - RNA, 15 nt, Human
agcaacuuuugugua

SEQ ID NO: 2784573 - RNA, 20 nt, Human
agcaacuuuuguguaaugaa

SEQ ID NO: 2784574 - RNA, 16 nt, Human
agcaagaaaaaaaaau

SEQ ID NO: 2784575 - RNA, 18 nt, Human
agcaagaaaaaaaaaugc

SEQ ID NO: 2784576 - RNA, 19 nt, Human
agcaagaaaaaaaaaugcc

SEQ ID NO: 2784577 - RNA, 20 nt, Human
agcaagaaaaaaaaaugcca

SEQ ID NO: 2784578 - RNA, 21 nt, Human
agcaagaagauccuaaaacaa

SEQ ID NO: 2784579 - RNA, 21 nt, Human
agcaagaauaaaaaagaaauc

SEQ ID NO: 2784580 - RNA, 18 nt, Human
agcaacuucuucuccauc

SEQ ID NO: 2784581 - RNA, 16 nt, Human
agcaacuucuucucca

SEQ ID NO: 2784582 - RNA, 15 nt, Human
agcaacuucuucucc

SEQ ID NO: 2784583 - RNA, 21 nt, Human
agcaacuguuaugaaauaaag

SEQ ID NO: 2784584 - RNA, 21 nt, Human
agcaacuucuucuccaucccu

SEQ ID NO: 2784585 - RNA, 12 nt, Human
agcaacuugaac

SEQ ID NO: 2784586 - RNA, 22 nt, Human
agcaacuugaacuucaccugca

SEQ ID NO: 2784587 - RNA, 13 nt, Human
agcaacuguuaug

SEQ ID NO: 2784588 - RNA, 17 nt, Human
agcaacuguuaugaaau

SEQ ID NO: 2784589 - RNA, 18 nt, Human
agcaacuguuaugaaaua

SEQ ID NO: 2784590 - RNA, 20 nt, Human
agcaacuguuaugaaauaaa

SEQ ID NO: 2784591 - RNA, 20 nt, Human
agcaacucuugauuauccau

SEQ ID NO: 2784592 - RNA, 16 nt, Human
agcaacucuugauuau

SEQ ID NO: 2784593 - RNA, 12 nt, Human
agcaacugggac

SEQ ID NO: 2784594 - RNA, 21 nt, Human
agcaagauccugucuuuaagg

SEQ ID NO: 2784595 - RNA, 14 nt, Human
agcaagagagaacc

SEQ ID NO: 2784596 - RNA, 23 nt, Human
agcaagagagaaccuaacuguau

SEQ ID NO: 2784597 - RNA, 15 nt, Human
ugagaagaggagccc

SEQ ID NO: 2784598 - RNA, 12 nt, Human
ugagaagaauag

SEQ ID NO: 2784599 - RNA, 16 nt, Human
agcaagagauauuuug

SEQ ID NO: 2784600 - RNA, 18 nt, Human
ugagaacuuaaguggcua

SEQ ID NO: 2784601 - RNA, 13 nt, Human
ugagaacuccuga

SEQ ID NO: 2784602 - RNA, 15 nt, Human
ugagaacuccugacu

SEQ ID NO: 2784603 - RNA, 20 nt, Human
ugagaaggcagccaccagcg

SEQ ID NO: 2784604 - RNA, 16 nt, Human
ugagaaguagccacag

SEQ ID NO: 2784605 - RNA, 17 nt, Human
ugagaaguagccacagu

SEQ ID NO: 2784606 - RNA, 12 nt, Human
ugagaaguauac

SEQ ID NO: 2784607 - RNA, 16 nt, Human
ugagaaggcagccacc

SEQ ID NO: 2784608 - RNA, 17 nt, Human
ugagaaggcagccacca

SEQ ID NO: 2784609 - RNA, 16 nt, Human
agauuccggauccuaa

SEQ ID NO: 2784610 - RNA, 18 nt, Human
agauuccggauccuaagc

SEQ ID NO: 2784611 - RNA, 20 nt, Human
agauuccggauccuaagcau

SEQ ID NO: 2784612 - RNA, 23 nt, Human
agauuccggauccuaagcaucua

SEQ ID NO: 2784613 - RNA, 24 nt, Human
agauuccggauccuaagcaucuaa

SEQ ID NO: 2784614 - RNA, 15 nt, Human
agauuccucuguauu

SEQ ID NO: 2784615 - RNA, 13 nt, Human
agauucuaaagau

SEQ ID NO: 2784616 - RNA, 16 nt, Human
agauucgcuuuccaug

SEQ ID NO: 2784617 - RNA, 11 nt, Human
agauucuaaag

SEQ ID NO: 2784618 - RNA, 12 nt, Human
agauucuaaaga

SEQ ID NO: 2784619 - RNA, 16 nt, Human
agauugcuuaaaauag

SEQ ID NO: 2784620 - RNA, 12 nt, Human
agauugcuucuc

SEQ ID NO: 2784621 - RNA, 15 nt, Human
agauugcuuaaaaua

SEQ ID NO: 2784622 - RNA, 14 nt, Human
agauuggaaggaga

SEQ ID NO: 2784623 - RNA, 15 nt, Human
agauuggaaggagac

SEQ ID NO: 2784624 - RNA, 16 nt, Human
agauuggaaggagaca

SEQ ID NO: 2784625 - RNA, 20 nt, Human
agauuggaaggagacacaga

SEQ ID NO: 2784626 - RNA, 21 nt, Human
agauuggaaggagacacagau

SEQ ID NO: 2784627 - RNA, 22 nt, Human
agauuggaaggagacacagaug

SEQ ID NO: 2784628 - RNA, 23 nt, Human
agauuggaaggagacacagaugu

SEQ ID NO: 2784629 - RNA, 20 nt, Human
agauuggaguggggaagugu

SEQ ID NO: 2784630 - RNA, 18 nt, Human
agauucaugauuuauaaa

SEQ ID NO: 2784631 - RNA, 18 nt, Human
agauuccagagaguggcu

SEQ ID NO: 2784632 - RNA, 17 nt, Human
agauucauuuuuaauca

SEQ ID NO: 2784633 - RNA, 20 nt, Human
agauucauuuuuaaucauga

SEQ ID NO: 2784634 - RNA, 15 nt, Human
agauuucuaaauaaa

SEQ ID NO: 2784635 - RNA, 16 nt, Human
agauuucuaaauaaaa

SEQ ID NO: 2784636 - RNA, 20 nt, Human
agauuucucauuugccaaua

SEQ ID NO: 2784637 - RNA, 13 nt, Human
agauuuccuccug

SEQ ID NO: 2784638 - RNA, 15 nt, Human
agauuggcauggcuu

SEQ ID NO: 2784639 - RNA, 23 nt, Human
agauuggcauggcuuuauuuguu

SEQ ID NO: 2784640 - RNA, 19 nt, Human
agauuuucugguucuaaca

SEQ ID NO: 2784641 - RNA, 17 nt, Human
agauuuucugguucuaa

SEQ ID NO: 2784642 - RNA, 18 nt, Human
agauuuucugguucuaac

SEQ ID NO: 2784643 - RNA, 22 nt, Human
agauuuucugggccuaaaggau

SEQ ID NO: 2784644 - RNA, 12 nt, Human
agauuuucuggu

SEQ ID NO: 2784645 - RNA, 16 nt, Human
agauuuucugguucua

SEQ ID NO: 2784646 - RNA, 21 nt, Human
agauuuuucggaggccccacu

SEQ ID NO: 2784647 - RNA, 21 nt, Human
agauuuuuauauuaguugcuu

SEQ ID NO: 2784648 - RNA, 22 nt, Human
agauuuuuauauuaguugcuuu

SEQ ID NO: 2784649 - RNA, 19 nt, Human
agauuuugagguaaagaua

SEQ ID NO: 2784650 - RNA, 14 nt, Human
agauuuugauaacu

SEQ ID NO: 2784651 - RNA, 16 nt, Human
agauuuugauaacugu

SEQ ID NO: 2784652 - RNA, 17 nt, Human
agauuuugauaacuguu

SEQ ID NO: 2784653 - RNA, 18 nt, Human
agauuuugauaacuguuu

SEQ ID NO: 2784654 - RNA, 22 nt, Human
agauuuugggguuguguuguca

SEQ ID NO: 2784655 - RNA, 15 nt, Human
ugacacuucaaggug

SEQ ID NO: 2784656 - RNA, 18 nt, Human
ugacacuucaaggugaca

SEQ ID NO: 2784657 - RNA, 18 nt, Human
agaugcagagagccauuu

SEQ ID NO: 2784658 - RNA, 16 nt, Human
agaugccaucuguguc

SEQ ID NO: 2784659 - RNA, 15 nt, Human
agaugccauucauag

SEQ ID NO: 2784660 - RNA, 16 nt, Human
agaugccauucauaga

SEQ ID NO: 2784661 - RNA, 18 nt, Human
agaugccauucauagaga

SEQ ID NO: 2784662 - RNA, 19 nt, Human
agaugcagagagccauuuu

SEQ ID NO: 2784663 - RNA, 20 nt, Human
agaugcagagagccauuuug

SEQ ID NO: 2784664 - RNA, 12 nt, Human
agaugccccaga

SEQ ID NO: 2784665 - RNA, 22 nt, Human
agaugcccagagggcccaggca

SEQ ID NO: 2784666 - RNA, 21 nt, Human
agaugcccagagggcccaggc

SEQ ID NO: 2784667 - RNA, 19 nt, Human
agaugcuccagcaacacag

SEQ ID NO: 2784668 - RNA, 19 nt, Human
ugacacgccuaaggucaca

SEQ ID NO: 2784669 - RNA, 17 nt, Human
agaugccccagagcugu

SEQ ID NO: 2784670 - RNA, 15 nt, Human
agaugcucuucugug

SEQ ID NO: 2784671 - RNA, 23 nt, Human
agaugcugacuguacuccuccca

SEQ ID NO: 2784672 - RNA, 13 nt, Human
agaugcucuuuua

SEQ ID NO: 2784673 - RNA, 20 nt, Human
agaugcugacuguacuccuc

SEQ ID NO: 2784674 - RNA, 15 nt, Human
agauggaaugcugug

SEQ ID NO: 2784675 - RNA, 13 nt, Human
agauggaaugcug

SEQ ID NO: 2784676 - RNA, 18 nt, Human
agauggaaugcuguguua

SEQ ID NO: 2784677 - RNA, 23 nt, Human
agauggacaguucacacccugca

SEQ ID NO: 2784678 - RNA, 14 nt, Human
agauguugccaugu

SEQ ID NO: 2784679 - RNA, 23 nt, Human
agauguugauuuuuacuguguuu

SEQ ID NO: 2784680 - RNA, 22 nt, Human
agauguugauuuuuacuguguu

SEQ ID NO: 2784681 - RNA, 16 nt, Human
agauguugauuuuuac

SEQ ID NO: 2784682 - RNA, 21 nt, Human
agauguugaagaauacaguua

SEQ ID NO: 2784683 - RNA, 15 nt, Human
agauguugaauucuu

SEQ ID NO: 2784684 - RNA, 23 nt, Human
agauguugaauucuuuugccaag

SEQ ID NO: 2784685 - RNA, 22 nt, Human
agauguugagaaaccugggcuc

SEQ ID NO: 2784686 - RNA, 21 nt, Human
agauguuuccagacuuccuug

SEQ ID NO: 2784687 - RNA, 23 nt, Human
agauguuuccagacuuccuugag

SEQ ID NO: 2784688 - RNA, 14 nt, Human
agauguuuccagac

SEQ ID NO: 2784689 - RNA, 14 nt, Human
agauguuucacgaa

SEQ ID NO: 2784690 - RNA, 18 nt, Human
agauguugccauguguuu

SEQ ID NO: 2784691 - RNA, 17 nt, Human
agauguugccauguguu

SEQ ID NO: 2784692 - RNA, 14 nt, Human
agauguuucacacc

SEQ ID NO: 2784693 - RNA, 23 nt, Human
agauguuucacaccggaagguuu

SEQ ID NO: 2784694 - RNA, 22 nt, Human
agauguuuauucuucuagaguu

SEQ ID NO: 2784695 - RNA, 18 nt, Human
agauguuuauucuucuag

SEQ ID NO: 2784696 - RNA, 19 nt, Human
agauguuuauucuucuaga

SEQ ID NO: 2784697 - RNA, 20 nt, Human
agauguuuauucuucuagag

SEQ ID NO: 2784698 - RNA, 21 nt, Human
agauguuuauucuucuagagu

SEQ ID NO: 2784699 - RNA, 12 nt, Human
agauuaaauaua

SEQ ID NO: 2784700 - RNA, 13 nt, Human
agauuaaauauag

SEQ ID NO: 2784701 - RNA, 16 nt, Human
agauuaaauauagauu

SEQ ID NO: 2784702 - RNA, 17 nt, Human
agauuaaauauagauua

SEQ ID NO: 2784703 - RNA, 22 nt, Human
agauguuuuuaaaaguuucaau

SEQ ID NO: 2784704 - RNA, 18 nt, Human
agauguuuuuaaaaguuu

SEQ ID NO: 2784705 - RNA, 20 nt, Human
agauguuuuuaaaaguuuca

SEQ ID NO: 2784706 - RNA, 14 nt, Human
agauuaaacagaug

SEQ ID NO: 2784707 - RNA, 17 nt, Human
agauuaaacagaugaug

SEQ ID NO: 2784708 - RNA, 22 nt, Human
agauguuuuaccguaauaauua

SEQ ID NO: 2784709 - RNA, 19 nt, Human
agauguuuugguagauuaa

SEQ ID NO: 2784710 - RNA, 21 nt, Human
agauguuuugguagauuaaau

SEQ ID NO: 2784711 - RNA, 22 nt, Human
agauguuuugguagauuaaaua

SEQ ID NO: 2784712 - RNA, 23 nt, Human
agauguuuuggucaaguaguuug

SEQ ID NO: 2784713 - RNA, 13 nt, Human
agauguuuuuaaa

SEQ ID NO: 2784714 - RNA, 16 nt, Human
agauguuuuuaaaagu

SEQ ID NO: 2784715 - RNA, 21 nt, Human
ugaccccaaacaccuuccagc

SEQ ID NO: 2784716 - RNA, 18 nt, Human
ugacucgagucacacuca

SEQ ID NO: 2784717 - RNA, 22 nt, Human
ugacucccuuaaaauagaaaua

SEQ ID NO: 2784718 - RNA, 17 nt, Human
ugacuccuaccugcccu

SEQ ID NO: 2784719 - RNA, 18 nt, Human
ugacuccuaccugcccug

SEQ ID NO: 2784720 - RNA, 19 nt, Human
ugacuccuaccugcccugg

SEQ ID NO: 2784721 - RNA, 20 nt, Human
ugacuccuaccugcccugga

SEQ ID NO: 2784722 - RNA, 22 nt, Human
ugacuccuaccugcccuggaac

SEQ ID NO: 2784723 - RNA, 11 nt, Human
ugaccuuccuc

SEQ ID NO: 2784724 - RNA, 16 nt, Human
ugacucaaaucuccag

SEQ ID NO: 2784725 - RNA, 23 nt, Human
ugacuagggauucaggcugcuug

SEQ ID NO: 2784726 - RNA, 13 nt, Human
ugacuaguacaaa

SEQ ID NO: 2784727 - RNA, 15 nt, Human
ugacuaguacaaauu

SEQ ID NO: 2784728 - RNA, 16 nt, Human
ugacuaguacaaauua

SEQ ID NO: 2784729 - RNA, 17 nt, Human
ugacuaguacaaauuau

SEQ ID NO: 2784730 - RNA, 20 nt, Human
ugacuaguacaaauuauaaa

SEQ ID NO: 2784731 - RNA, 23 nt, Human
ugacuaguacaaauuauaaaaag

SEQ ID NO: 2784732 - RNA, 21 nt, Human
ugacuagggauucaggcugcu

SEQ ID NO: 2784733 - RNA, 20 nt, Human
ugacuagggauucaggcugc

SEQ ID NO: 2784734 - RNA, 14 nt, Human
ugaccuucucuaua

SEQ ID NO: 2784735 - RNA, 19 nt, Human
ugacuagacguucauuugu

SEQ ID NO: 2784736 - RNA, 21 nt, Human
ugacuagaagggccaguccug

SEQ ID NO: 2784737 - RNA, 14 nt, Human
ugacuacauuuuuu

SEQ ID NO: 2784738 - RNA, 19 nt, Human
ugacuacuuagcauccuaa

SEQ ID NO: 2784739 - RNA, 22 nt, Human
ugacuacuuagcauccuaagaa

SEQ ID NO: 2784740 - RNA, 15 nt, Human
ugacuacuuugccuu

SEQ ID NO: 2784741 - RNA, 19 nt, Human
ugacuagggauucaggcug

SEQ ID NO: 2784742 - RNA, 18 nt, Human
ugacuagggauucaggcu

SEQ ID NO: 2784743 - RNA, 17 nt, Human
ugacuagggauucaggc

SEQ ID NO: 2784744 - RNA, 23 nt, Human
ugacuagaugauggaugccaaua

SEQ ID NO: 2784745 - RNA, 16 nt, Human
ugacccuacucccuug

SEQ ID NO: 2784746 - RNA, 17 nt, Human
ugacccuacucccuugc

SEQ ID NO: 2784747 - RNA, 21 nt, Human
ugaccccuccucacuggccau

SEQ ID NO: 2784748 - RNA, 15 nt, Human
ugaccccuucccugu

SEQ ID NO: 2784749 - RNA, 22 nt, Human
ugaccccuccucacuggccauc

SEQ ID NO: 2784750 - RNA, 12 nt, Human
ugaccccuccug

SEQ ID NO: 2784751 - RNA, 13 nt, Human
ugaccccuccugg

SEQ ID NO: 2784752 - RNA, 14 nt, Human
ugaccccuccuggg

SEQ ID NO: 2784753 - RNA, 15 nt, Human
ugaccccuccugggg

SEQ ID NO: 2784754 - RNA, 16 nt, Human
ugaccccuccuggggc

SEQ ID NO: 2784755 - RNA, 17 nt, Human
ugaccccuccuggggcc

SEQ ID NO: 2784756 - RNA, 19 nt, Human
ugaccccuccuggggccag

SEQ ID NO: 2784757 - RNA, 20 nt, Human
ugaccccuccuggggccagg

SEQ ID NO: 2784758 - RNA, 22 nt, Human
ugaccccuccuggggccaggcc

SEQ ID NO: 2784759 - RNA, 23 nt, Human
ugaccccuccuggggccaggccg

SEQ ID NO: 2784760 - RNA, 23 nt, Human
ugaccccucauagcccucacccu

SEQ ID NO: 2784761 - RNA, 13 nt, Human
ugaccccuccuca

SEQ ID NO: 2784762 - RNA, 11 nt, Human
ugaccccuccu

SEQ ID NO: 2784763 - RNA, 15 nt, Human
ugaccccuccucacu

SEQ ID NO: 2784764 - RNA, 20 nt, Human
ugaccccuccucacuggcca

SEQ ID NO: 2784765 - RNA, 22 nt, Human
ugaccccaaacaccuuccagcu

SEQ ID NO: 2784766 - RNA, 22 nt, Human
ugaccccagcauucucaggcac

SEQ ID NO: 2784767 - RNA, 18 nt, Human
ugacccuagcucuuuccu

SEQ ID NO: 2784768 - RNA, 12 nt, Human
ugaccugagggc

SEQ ID NO: 2784769 - RNA, 20 nt, Human
ugaccugcaggccaagagca

SEQ ID NO: 2784770 - RNA, 11 nt, Human
ugaccugcagg

SEQ ID NO: 2784771 - RNA, 15 nt, Human
ugaccuguuucucug

SEQ ID NO: 2784772 - RNA, 16 nt, Human
ugaccuguuucucugc

SEQ ID NO: 2784773 - RNA, 19 nt, Human
ugaccuuauccuuccucuc

SEQ ID NO: 2784774 - RNA, 22 nt, Human
ugaccuuaugagaaacugcaug

SEQ ID NO: 2784775 - RNA, 12 nt, Human
ugaccuucagcu

SEQ ID NO: 2784776 - RNA, 19 nt, Human
ugaccuucagcucacgcuu

SEQ ID NO: 2784777 - RNA, 13 nt, Human
ugaccuucauuuc

SEQ ID NO: 2784778 - RNA, 20 nt, Human
ugaccuucauuucauguaua

SEQ ID NO: 2784779 - RNA, 14 nt, Human
ugaccuuccucugg

SEQ ID NO: 2784780 - RNA, 15 nt, Human
ugaccuuccucuggg

SEQ ID NO: 2784781 - RNA, 16 nt, Human
ugaccuuccucugggg

SEQ ID NO: 2784782 - RNA, 17 nt, Human
ugaccuuccucuggggc

SEQ ID NO: 2784783 - RNA, 18 nt, Human
ugaccuuccucuggggcu

SEQ ID NO: 2784784 - RNA, 19 nt, Human
ugaccuuccucuggggcuc

SEQ ID NO: 2784785 - RNA, 21 nt, Human
ugaccuuccucuggggcucua

SEQ ID NO: 2784786 - RNA, 23 nt, Human
ugaccuuccucuggggcucuagg

SEQ ID NO: 2784787 - RNA, 24 nt, Human
ugaccuuccucuggggcucuaggg

SEQ ID NO: 2784788 - RNA, 14 nt, Human
ugaccuuccuuccu

SEQ ID NO: 2784789 - RNA, 16 nt, Human
ugaccuuccuuccugu

SEQ ID NO: 2784790 - RNA, 15 nt, Human
agacuauggagccug

SEQ ID NO: 2784791 - RNA, 16 nt, Human
agacuauggagccugg

SEQ ID NO: 2784792 - RNA, 20 nt, Human
agacuauggagccuggcaca

SEQ ID NO: 2784793 - RNA, 21 nt, Human
agacuauggagccuggcacag

SEQ ID NO: 2784794 - RNA, 23 nt, Human
agaccuuggaucagaugaacucu

SEQ ID NO: 2784795 - RNA, 11 nt, Human
agaccuuaccc

SEQ ID NO: 2784796 - RNA, 13 nt, Human
agaccuuccauaa

SEQ ID NO: 2784797 - RNA, 22 nt, Human
agaccuuccauaaugcuacugu

SEQ ID NO: 2784798 - RNA, 23 nt, Human
agaccuuccauaaugcuacuguc

SEQ ID NO: 2784799 - RNA, 18 nt, Human
agaccuucuaggacgcca

SEQ ID NO: 2784800 - RNA, 22 nt, Human
agaccuggcaaggacacagaug

SEQ ID NO: 2784801 - RNA, 23 nt, Human
agacucaggccaagaaacgucuu

SEQ ID NO: 2784802 - RNA, 13 nt, Human
agacucagccugc

SEQ ID NO: 2784803 - RNA, 14 nt, Human
agacucagccugca

SEQ ID NO: 2784804 - RNA, 17 nt, Human
agacucagccugcaguu

SEQ ID NO: 2784805 - RNA, 23 nt, Human
agacucagccugcaguuaauuag

SEQ ID NO: 2784806 - RNA, 20 nt, Human
agacucaggccaagaaacgu

SEQ ID NO: 2784807 - RNA, 19 nt, Human
agacucaggccaagaaacg

SEQ ID NO: 2784808 - RNA, 13 nt, Human
ucuugauuugagu

SEQ ID NO: 2784809 - RNA, 23 nt, Human
ucuugauuauccauauugaguca

SEQ ID NO: 2784810 - RNA, 14 nt, Human
ucuugauuauccau

SEQ ID NO: 2784811 - RNA, 22 nt, Human
ucuugaggugguaguaaaacac

SEQ ID NO: 2784812 - RNA, 23 nt, Human
ucuugaggugguaguaaaacaca

SEQ ID NO: 2784813 - RNA, 19 nt, Human
ucuugaguauaagaaaugc

SEQ ID NO: 2784814 - RNA, 20 nt, Human
ucuugaguauaagaaaugca

SEQ ID NO: 2784815 - RNA, 21 nt, Human
ucuugaguauaagaaaugcau

SEQ ID NO: 2784816 - RNA, 14 nt, Human
ucuugagcuggccu

SEQ ID NO: 2784817 - RNA, 13 nt, Human
ucuugagcuggcc

SEQ ID NO: 2784818 - RNA, 12 nt, Human
ucuugagcuggc

SEQ ID NO: 2784819 - RNA, 21 nt, Human
ucuugagcuggccucucuagc

SEQ ID NO: 2784820 - RNA, 17 nt, Human
ucuugagcuggccucuc

SEQ ID NO: 2784821 - RNA, 15 nt, Human
ucuugaggccaggag

SEQ ID NO: 2784822 - RNA, 23 nt, Human
ucuugagcuggccucucuagcac

SEQ ID NO: 2784823 - RNA, 16 nt, Human
ucuugaggccaggagu

SEQ ID NO: 2784824 - RNA, 14 nt, Human
ucuugguaagaagc

SEQ ID NO: 2784825 - RNA, 16 nt, Human
ucuugggucuaugccu

SEQ ID NO: 2784826 - RNA, 20 nt, Human
ucuugguaaaguccuuuucu

SEQ ID NO: 2784827 - RNA, 14 nt, Human
ucuugggaacugaa

SEQ ID NO: 2784828 - RNA, 13 nt, Human
ucuugggaacuga

SEQ ID NO: 2784829 - RNA, 22 nt, Human
ucuugcaauggcagccuuggca

SEQ ID NO: 2784830 - RNA, 19 nt, Human
ucuuggcagcaccugucuc

SEQ ID NO: 2784831 - RNA, 18 nt, Human
ucuuggcagcaccugucu

SEQ ID NO: 2784832 - RNA, 18 nt, Human
ucuugcaauggcagccuu

SEQ ID NO: 2784833 - RNA, 19 nt, Human
ucuugcaauggcagccuug

SEQ ID NO: 2784834 - RNA, 17 nt, Human
ucuuggcuuggugagga

SEQ ID NO: 2784835 - RNA, 19 nt, Human
ucuuggcuuacugcagccu

SEQ ID NO: 2784836 - RNA, 14 nt, Human
ucuugguauucuua

SEQ ID NO: 2784837 - RNA, 11 nt, Human
ucuuuaaaugu

SEQ ID NO: 2784838 - RNA, 12 nt, Human
ucuuuaaauguu

SEQ ID NO: 2784839 - RNA, 16 nt, Human
ucuuuaaauguuuuau

SEQ ID NO: 2784840 - RNA, 19 nt, Human
ucuuuaaauguuuuauaag

SEQ ID NO: 2784841 - RNA, 15 nt, Human
ucuuuaacucauaaa

SEQ ID NO: 2784842 - RNA, 12 nt, Human
ucuuuaaauaga

SEQ ID NO: 2784843 - RNA, 14 nt, Human
ucuuuaaauagaua

SEQ ID NO: 2784844 - RNA, 16 nt, Human
ucuuuaaaucauuuua

SEQ ID NO: 2784845 - RNA, 23 nt, Human
ucuuuaaaucauuuuaggaaagg

SEQ ID NO: 2784846 - RNA, 14 nt, Human
ucuuuaaucacuua

SEQ ID NO: 2784847 - RNA, 18 nt, Human
ucuuuaaucacuuaacau

SEQ ID NO: 2784848 - RNA, 23 nt, Human
ucuuuaaucacuuaacauuccua

SEQ ID NO: 2784849 - RNA, 18 nt, Human
ucuuuaagggcaugccuu

SEQ ID NO: 2784850 - RNA, 19 nt, Human
ucuuuaagggcaugccuug

SEQ ID NO: 2784851 - RNA, 20 nt, Human
ucuuuaagggcaugccuugu

SEQ ID NO: 2784852 - RNA, 22 nt, Human
ucuuuaagggcaugccuugugc

SEQ ID NO: 2784853 - RNA, 19 nt, Human
ucuuuaaguauugauucug

SEQ ID NO: 2784854 - RNA, 22 nt, Human
ucuuuauauacaauaauggaaa

SEQ ID NO: 2784855 - RNA, 23 nt, Human
ucuuuauauacaauaauggaaaa

SEQ ID NO: 2784856 - RNA, 23 nt, Human
ucuuuaaucauuuugccucuuuu

SEQ ID NO: 2784857 - RNA, 11 nt, Human
ucuuuccuguc

SEQ ID NO: 2784858 - RNA, 21 nt, Human
ucuuucuaacuccagugaagu

SEQ ID NO: 2784859 - RNA, 14 nt, Human
ucuuucgucacccu

SEQ ID NO: 2784860 - RNA, 15 nt, Human
ucuuucgucacccuu

SEQ ID NO: 2784861 - RNA, 18 nt, Human
ucuuucuaaugugugaau

SEQ ID NO: 2784862 - RNA, 18 nt, Human
ucuuucucucuucccuca

SEQ ID NO: 2784863 - RNA, 13 nt, Human
ucuuuauuccuag

SEQ ID NO: 2784864 - RNA, 14 nt, Human
ucuuuauuccuagu

SEQ ID NO: 2784865 - RNA, 15 nt, Human
ucuuuauuccuaguu

SEQ ID NO: 2784866 - RNA, 14 nt, Human
agaaucacuugaac

SEQ ID NO: 2784867 - RNA, 22 nt, Human
agaaucacuucugagaacucau

SEQ ID NO: 2784868 - RNA, 17 nt, Human
agaaucacuugaacccg

SEQ ID NO: 2784869 - RNA, 20 nt, Human
ucuucaacaugucacacugg

SEQ ID NO: 2784870 - RNA, 16 nt, Human
agaaucagaguagaaa

SEQ ID NO: 2784871 - RNA, 17 nt, Human
agaaucagaguagaaau

SEQ ID NO: 2784872 - RNA, 18 nt, Human
agaaucagaguagaaaua

SEQ ID NO: 2784873 - RNA, 15 nt, Human
ucuucaacucccugc

SEQ ID NO: 2784874 - RNA, 16 nt, Human
ucuucaacugaccagc

SEQ ID NO: 2784875 - RNA, 19 nt, Human
ucuucaacugaccagccuc

SEQ ID NO: 2784876 - RNA, 15 nt, Human
ucuuccaucccagga

SEQ ID NO: 2784877 - RNA, 11 nt, Human
ucuucaagaga

SEQ ID NO: 2784878 - RNA, 22 nt, Human
ucuucaagagacccuucaaacu

SEQ ID NO: 2784879 - RNA, 15 nt, Human
ucuucaaggcuucag

SEQ ID NO: 2784880 - RNA, 16 nt, Human
ucuucaaggcuucagu

SEQ ID NO: 2784881 - RNA, 17 nt, Human
ucuucaaggcuucaguc

SEQ ID NO: 2784882 - RNA, 16 nt, Human
ucuuccauguaucuuu

SEQ ID NO: 2784883 - RNA, 19 nt, Human
ucuuccauguaucuuuuga

SEQ ID NO: 2784884 - RNA, 16 nt, Human
ucuuccaucccaggac

SEQ ID NO: 2784885 - RNA, 14 nt, Human
ucuuccaugauuuu

SEQ ID NO: 2784886 - RNA, 12 nt, Human
ucuucucugucu

SEQ ID NO: 2784887 - RNA, 11 nt, Human
ucuuccugacg

SEQ ID NO: 2784888 - RNA, 23 nt, Human
ucuuccugacgaaacuggccccg

SEQ ID NO: 2784889 - RNA, 11 nt, Human
ucuuccugccc

SEQ ID NO: 2784890 - RNA, 13 nt, Human
ucuuccugccccu

SEQ ID NO: 2784891 - RNA, 14 nt, Human
ucuuccugccccuc

SEQ ID NO: 2784892 - RNA, 15 nt, Human
ucuuccugccccucu

SEQ ID NO: 2784893 - RNA, 16 nt, Human
ucuuccugccccucuu

SEQ ID NO: 2784894 - RNA, 17 nt, Human
ucuuccugccccucuuu

SEQ ID NO: 2784895 - RNA, 18 nt, Human
ucuuccugccccucuuuc

SEQ ID NO: 2784896 - RNA, 19 nt, Human
ucuuccugccccucuuucu

SEQ ID NO: 2784897 - RNA, 21 nt, Human
ucuuccugccccucuuucucu

SEQ ID NO: 2784898 - RNA, 11 nt, Human
ucuuccucugc

SEQ ID NO: 2784899 - RNA, 12 nt, Human
ucuuccucugcu

SEQ ID NO: 2784900 - RNA, 14 nt, Human
ucuuccucugcuga

SEQ ID NO: 2784901 - RNA, 13 nt, Human
ucuuccuccagcu

SEQ ID NO: 2784902 - RNA, 14 nt, Human
ucuuccuccagcug

SEQ ID NO: 2784903 - RNA, 15 nt, Human
ucuuccuccagcugc

SEQ ID NO: 2784904 - RNA, 17 nt, Human
ucuuccuccagcugcac

SEQ ID NO: 2784905 - RNA, 19 nt, Human
ucuuccuccagcugcacca

SEQ ID NO: 2784906 - RNA, 19 nt, Human
ucuuccccacuccccaccu

SEQ ID NO: 2784907 - RNA, 14 nt, Human
ucuuccccacuccc

SEQ ID NO: 2784908 - RNA, 20 nt, Human
ucuuccccagaaaggagacu

SEQ ID NO: 2784909 - RNA, 20 nt, Human
agacaucaugaauuuuacau

SEQ ID NO: 2784910 - RNA, 17 nt, Human
agacauccauguuugua

SEQ ID NO: 2784911 - RNA, 18 nt, Human
agacauaggccaugaaaa

SEQ ID NO: 2784912 - RNA, 17 nt, Human
agacauaacguuuuucc

SEQ ID NO: 2784913 - RNA, 16 nt, Human
agacauagcauccaag

SEQ ID NO: 2784914 - RNA, 22 nt, Human
agacauagcauccaaguggcau

SEQ ID NO: 2784915 - RNA, 19 nt, Human
agacauaggccaugaaaaa

SEQ ID NO: 2784916 - RNA, 13 nt, Human
agacauaucucua

SEQ ID NO: 2784917 - RNA, 14 nt, Human
agacauauuuaacu

SEQ ID NO: 2784918 - RNA, 15 nt, Human
agacauauuuaacug

SEQ ID NO: 2784919 - RNA, 16 nt, Human
agacauauuuaacugg

SEQ ID NO: 2784920 - RNA, 14 nt, Human
agacauaacguuuu

SEQ ID NO: 2784921 - RNA, 20 nt, Human
agacauaacguuuuuccuuu

SEQ ID NO: 2784922 - RNA, 16 nt, Human
agacauacgaaacaca

SEQ ID NO: 2784923 - RNA, 18 nt, Human
agacauacgaaacacaaa

SEQ ID NO: 2784924 - RNA, 19 nt, Human
agacauucuuccaaaaaga

SEQ ID NO: 2784925 - RNA, 18 nt, Human
agacauugggucuauucc

SEQ ID NO: 2784926 - RNA, 19 nt, Human
agacauugggucuauucca

SEQ ID NO: 2784927 - RNA, 22 nt, Human
agacauugggucuauuccagcu

SEQ ID NO: 2784928 - RNA, 23 nt, Human
agacauugggucuauuccagcuc

SEQ ID NO: 2784929 - RNA, 18 nt, Human
agacauguuuuccgugaa

SEQ ID NO: 2784930 - RNA, 16 nt, Human
agacaucucugcaccc

SEQ ID NO: 2784931 - RNA, 18 nt, Human
agacauccauguuuguaa

SEQ ID NO: 2784932 - RNA, 21 nt, Human
agacauccauguuuguaaaac

SEQ ID NO: 2784933 - RNA, 22 nt, Human
agacauccauguuuguaaaacu

SEQ ID NO: 2784934 - RNA, 14 nt, Human
agacaucucugcac

SEQ ID NO: 2784935 - RNA, 21 nt, Human
agaccccggcuuccuuuccca

SEQ ID NO: 2784936 - RNA, 21 nt, Human
ucuucuguguuuauaaaauau

SEQ ID NO: 2784937 - RNA, 13 nt, Human
ucuucuguggacc

SEQ ID NO: 2784938 - RNA, 13 nt, Human
ucuucuuaacuua

SEQ ID NO: 2784939 - RNA, 15 nt, Human
agacaguuucuuagc

SEQ ID NO: 2784940 - RNA, 18 nt, Human
ucuucuuaagacuuuugg

SEQ ID NO: 2784941 - RNA, 21 nt, Human
agacaguuucuuagcuuuuua

SEQ ID NO: 2784942 - RNA, 18 nt, Human
agacaguuucuuagcuuu

SEQ ID NO: 2784943 - RNA, 20 nt, Human
agacaguuucuuagcuuuuu

SEQ ID NO: 2784944 - RNA, 22 nt, Human
agacaguuucuuagcuuuuuaa

SEQ ID NO: 2784945 - RNA, 11 nt, Human
agacaguuugu

SEQ ID NO: 2784946 - RNA, 13 nt, Human
agacaguuuguaa

SEQ ID NO: 2784947 - RNA, 14 nt, Human
agacaguuuguaaa

SEQ ID NO: 2784948 - RNA, 15 nt, Human
agacaguuuguaaau

SEQ ID NO: 2784949 - RNA, 16 nt, Human
agacaguuuguaaaug

SEQ ID NO: 2784950 - RNA, 17 nt, Human
agacaguuuguaaaugu

SEQ ID NO: 2784951 - RNA, 18 nt, Human
agacaguuuguaaauguu

SEQ ID NO: 2784952 - RNA, 19 nt, Human
agacaguuuguaaauguua

SEQ ID NO: 2784953 - RNA, 21 nt, Human
agacaguuuguaaauguuauu

SEQ ID NO: 2784954 - RNA, 16 nt, Human
agacaguuuugagaac

SEQ ID NO: 2784955 - RNA, 20 nt, Human
agacaguuuugagaacguaa

SEQ ID NO: 2784956 - RNA, 21 nt, Human
agacaguuuugagaacguaaa

SEQ ID NO: 2784957 - RNA, 11 nt, Human
agacauaaagc

SEQ ID NO: 2784958 - RNA, 12 nt, Human
agacauaaagcc

SEQ ID NO: 2784959 - RNA, 13 nt, Human
agacauaaagcca

SEQ ID NO: 2784960 - RNA, 15 nt, Human
ucuucuguacgucug

SEQ ID NO: 2784961 - RNA, 22 nt, Human
ucuucuggggcaggcugggcca

SEQ ID NO: 2784962 - RNA, 23 nt, Human
ucuucugugauucgguggagacu

SEQ ID NO: 2784963 - RNA, 19 nt, Human
ucuucuguauacuguggag

SEQ ID NO: 2784964 - RNA, 17 nt, Human
ucuucuguauauaaaug

SEQ ID NO: 2784965 - RNA, 20 nt, Human
ucuucuguauauaaauggga

SEQ ID NO: 2784966 - RNA, 22 nt, Human
ucuucuguauauaaaugggaac

SEQ ID NO: 2784967 - RNA, 24 nt, Human
ucuucuguauauaaaugggaacau

SEQ ID NO: 2784968 - RNA, 18 nt, Human
ucuucuggguuccuuccu

SEQ ID NO: 2784969 - RNA, 13 nt, Human
ucuucugaaauga

SEQ ID NO: 2784970 - RNA, 22 nt, Human
ucuucugaaaugaaacaaauaa

SEQ ID NO: 2784971 - RNA, 20 nt, Human
ucuucugcuccacccuuggc

SEQ ID NO: 2784972 - RNA, 19 nt, Human
ucuucugcuccacccuugg

SEQ ID NO: 2784973 - RNA, 17 nt, Human
ucuucugcuccacccuu

SEQ ID NO: 2784974 - RNA, 16 nt, Human
ucuucugcuccacccu

SEQ ID NO: 2784975 - RNA, 15 nt, Human
ucuucugcuccaccc

SEQ ID NO: 2784976 - RNA, 14 nt, Human
ucuucugcuccacc

SEQ ID NO: 2784977 - RNA, 13 nt, Human
ucuucugcuccac

SEQ ID NO: 2784978 - RNA, 19 nt, Human
ucuucugcuucagccuccc

SEQ ID NO: 2784979 - RNA, 12 nt, Human
ucuucugcuuca

SEQ ID NO: 2784980 - RNA, 21 nt, Human
ucuucuggggcaggcugggcc

SEQ ID NO: 2784981 - RNA, 20 nt, Human
ucuucuggggcaggcugggc

SEQ ID NO: 2784982 - RNA, 18 nt, Human
ucuucuggggcaggcugg

SEQ ID NO: 2784983 - RNA, 23 nt, Human
ucuucugcuccacccuuggccug

SEQ ID NO: 2784984 - RNA, 22 nt, Human
ucuucugcuccacccuuggccu

SEQ ID NO: 2784985 - RNA, 15 nt, Human
ugaaaagcuucuuaa

SEQ ID NO: 2784986 - RNA, 16 nt, Human
ugaaaagcuucuuaau

SEQ ID NO: 2784987 - RNA, 17 nt, Human
ugaaaagcuucuuaauu

SEQ ID NO: 2784988 - RNA, 19 nt, Human
ugaaaagcuucuuaauuaa

SEQ ID NO: 2784989 - RNA, 23 nt, Human
ugaaaagcuucuuaauuaauuug

SEQ ID NO: 2784990 - RNA, 13 nt, Human
ugaaaaaugaaag

SEQ ID NO: 2784991 - RNA, 14 nt, Human
ugaaaaaugaaaga

SEQ ID NO: 2784992 - RNA, 16 nt, Human
ugaaaaaugaaagaug

SEQ ID NO: 2784993 - RNA, 17 nt, Human
ugaaaaaugaaagauga

SEQ ID NO: 2784994 - RNA, 18 nt, Human
ugaaaaaugaaagaugau

SEQ ID NO: 2784995 - RNA, 18 nt, Human
ugaaaaaucggcuuacca

SEQ ID NO: 2784996 - RNA, 15 nt, Human
ugaaaaagaugccaa

SEQ ID NO: 2784997 - RNA, 16 nt, Human
ugaaaaaguaaagugu

SEQ ID NO: 2784998 - RNA, 19 nt, Human
ugaaaaauuccuuuguguu

SEQ ID NO: 2784999 - RNA, 21 nt, Human
ugaaaaaucacuugauucaua

SEQ ID NO: 2785000 - RNA, 22 nt, Human
ugaaaaaguauccugcuucuga

SEQ ID NO: 2785001 - RNA, 19 nt, Human
ugaaaaaguuaaugcuuaa

SEQ ID NO: 2785002 - RNA, 16 nt, Human
ugaaaaucgugacaac

SEQ ID NO: 2785003 - RNA, 20 nt, Human
ugaaaauaugauguuucaca

SEQ ID NO: 2785004 - RNA, 18 nt, Human
ugaaaauaucugcucaaa

SEQ ID NO: 2785005 - RNA, 23 nt, Human
ugaaaauaucugcucaaaacuuu

SEQ ID NO: 2785006 - RNA, 12 nt, Human
ugaaaagucguu

SEQ ID NO: 2785007 - RNA, 17 nt, Human
ugaaaagucguuuucca

SEQ ID NO: 2785008 - RNA, 22 nt, Human
ugaaaagucguuuuccaaacug

SEQ ID NO: 2785009 - RNA, 19 nt, Human
ugaaaagggggugggaugg

SEQ ID NO: 2785010 - RNA, 21 nt, Human
ugaaaagguucuucaucccuu

SEQ ID NO: 2785011 - RNA, 18 nt, Human
ugaaacuggcacugaauu

SEQ ID NO: 2785012 - RNA, 17 nt, Human
ugaaaauauaugauggc

SEQ ID NO: 2785013 - RNA, 16 nt, Human
ugaaacucacaaauga

SEQ ID NO: 2785014 - RNA, 17 nt, Human
ugaaacucacaaaugau

SEQ ID NO: 2785015 - RNA, 13 nt, Human
ugaaacuccaccu

SEQ ID NO: 2785016 - RNA, 21 nt, Human
ugaaacuccaccuugcgggga

SEQ ID NO: 2785017 - RNA, 14 nt, Human
ugaaaaugucaaag

SEQ ID NO: 2785018 - RNA, 19 nt, Human
ugaaaaucgugacaacacu

SEQ ID NO: 2785019 - RNA, 14 nt, Human
ugaaaaucuaauau

SEQ ID NO: 2785020 - RNA, 15 nt, Human
ugaaaaucuaauauu

SEQ ID NO: 2785021 - RNA, 17 nt, Human
ugaaaaucuaauauuaa

SEQ ID NO: 2785022 - RNA, 21 nt, Human
ugaaaaucuaauauuaaaaau

SEQ ID NO: 2785023 - RNA, 12 nt, Human
ugaaaauguacu

SEQ ID NO: 2785024 - RNA, 13 nt, Human
ugaaaauguacug

SEQ ID NO: 2785025 - RNA, 16 nt, Human
ugaaaauguacugaga

SEQ ID NO: 2785026 - RNA, 10 nt, Human
ucuuucugua

SEQ ID NO: 2785027 - RNA, 20 nt, Human
ucuuucuuacaaggaaggug

SEQ ID NO: 2785028 - RNA, 13 nt, Human
ucuuucugucccu

SEQ ID NO: 2785029 - RNA, 14 nt, Human
ucuuucugucccuu

SEQ ID NO: 2785030 - RNA, 18 nt, Human
ucuuucugagcacacuuu

SEQ ID NO: 2785031 - RNA, 19 nt, Human
ucuuucugagcacacuuua

SEQ ID NO: 2785032 - RNA, 21 nt, Human
ucuuucugagcacacuuuagu

SEQ ID NO: 2785033 - RNA, 12 nt, Human
ucuuucucuuuc

SEQ ID NO: 2785034 - RNA, 11 nt, Human
ucuuuaacuuu

SEQ ID NO: 2785035 - RNA, 14 nt, Human
ucuuucuaaugcug

SEQ ID NO: 2785036 - RNA, 17 nt, Human
ucuuucucuuucuuccu

SEQ ID NO: 2785037 - RNA, 12 nt, Human
ucuuucucuuuu

SEQ ID NO: 2785038 - RNA, 15 nt, Human
agagacauggcuuuc

SEQ ID NO: 2785039 - RNA, 12 nt, Human
agagacagucac

SEQ ID NO: 2785040 - RNA, 22 nt, Human
agagacaguuauuuauagucau

SEQ ID NO: 2785041 - RNA, 17 nt, Human
ucuuugguguacagacu

SEQ ID NO: 2785042 - RNA, 12 nt, Human
ucuuugguucua

SEQ ID NO: 2785043 - RNA, 14 nt, Human
ucuuugguucuaag

SEQ ID NO: 2785044 - RNA, 15 nt, Human
ucuuugguucuaagg

SEQ ID NO: 2785045 - RNA, 16 nt, Human
ucuuugguucuaagga

SEQ ID NO: 2785046 - RNA, 21 nt, Human
ucuuugguucuaaggaccuga

SEQ ID NO: 2785047 - RNA, 18 nt, Human
ucuuuguguagcuuugcu

SEQ ID NO: 2785048 - RNA, 13 nt, Human
ucuuuguggggcu

SEQ ID NO: 2785049 - RNA, 18 nt, Human
ucuuuguggggcuuggcg

SEQ ID NO: 2785050 - RNA, 22 nt, Human
ucuuuguggggcuuggcgugga

SEQ ID NO: 2785051 - RNA, 15 nt, Human
ucuuuguguagcuuu

SEQ ID NO: 2785052 - RNA, 13 nt, Human
ucuuuguguagcu

SEQ ID NO: 2785053 - RNA, 13 nt, Human
ucuuuguaagagu

SEQ ID NO: 2785054 - RNA, 14 nt, Human
ucuuuguaagagug

SEQ ID NO: 2785055 - RNA, 12 nt, Human
ucuuuguaagaa

SEQ ID NO: 2785056 - RNA, 20 nt, Human
ucuuuguaagaacuaaagaa

SEQ ID NO: 2785057 - RNA, 21 nt, Human
ucuuuguaagaacuaaagaag

SEQ ID NO: 2785058 - RNA, 22 nt, Human
ucuuuguaagaacuaaagaaga

SEQ ID NO: 2785059 - RNA, 18 nt, Human
ucuuuguaagaguguaga

SEQ ID NO: 2785060 - RNA, 22 nt, Human
ugaaaaagaccuuuggagcaaa

SEQ ID NO: 2785061 - RNA, 23 nt, Human
ugaaaaacuggcaacauuccaag

SEQ ID NO: 2785062 - RNA, 17 nt, Human
ugaaaaacaacaacaca

SEQ ID NO: 2785063 - RNA, 13 nt, Human
ugaaaaacaacca

SEQ ID NO: 2785064 - RNA, 11 nt, Human
ugaaaaaagcu

SEQ ID NO: 2785065 - RNA, 12 nt, Human
ugaaaaaagcuc

SEQ ID NO: 2785066 - RNA, 13 nt, Human
ugaaaaaagcuca

SEQ ID NO: 2785067 - RNA, 14 nt, Human
ugaaaaaagcucau

SEQ ID NO: 2785068 - RNA, 20 nt, Human
ugaaaaaagcucauuucaug

SEQ ID NO: 2785069 - RNA, 16 nt, Human
ugaaaaaaaguuuaca

SEQ ID NO: 2785070 - RNA, 17 nt, Human
ugaaaaaaaguuuacaa

SEQ ID NO: 2785071 - RNA, 18 nt, Human
ugaaaaaaauaauuuuaa

SEQ ID NO: 2785072 - RNA, 15 nt, Human
ugaaaaaaacuucau

SEQ ID NO: 2785073 - RNA, 16 nt, Human
ugaaaaaaacuucauu

SEQ ID NO: 2785074 - RNA, 21 nt, Human
ucuuuguuaucaaacuucagc

SEQ ID NO: 2785075 - RNA, 15 nt, Human
ucuuuguuauaccau

SEQ ID NO: 2785076 - RNA, 18 nt, Human
ucuuuuaaaaauucaaau

SEQ ID NO: 2785077 - RNA, 19 nt, Human
ucuuuuaaaaauucaaaug

SEQ ID NO: 2785078 - RNA, 19 nt, Human
ucuuucugaaggcuuugug

SEQ ID NO: 2785079 - RNA, 12 nt, Human
ucuuuuaaugcu

SEQ ID NO: 2785080 - RNA, 19 nt, Human
ucuuuuaaugcuucauuca

SEQ ID NO: 2785081 - RNA, 18 nt, Human
ucuuuuaaaguguuacuu

SEQ ID NO: 2785082 - RNA, 21 nt, Human
ucuuuuaaaguguuacuuuuu

SEQ ID NO: 2785083 - RNA, 23 nt, Human
ucuuuuaaaguguuacuuuuugu

SEQ ID NO: 2785084 - RNA, 14 nt, Human
ucuuuuacauucug

SEQ ID NO: 2785085 - RNA, 12 nt, Human
ucuuuuacaacu

SEQ ID NO: 2785086 - RNA, 22 nt, Human
agagcaguuucuguccugcugg

SEQ ID NO: 2785087 - RNA, 23 nt, Human
agagcaguuucuguccugcuggu

SEQ ID NO: 2785088 - RNA, 13 nt, Human
agagccagcuugg

SEQ ID NO: 2785089 - RNA, 11 nt, Human
agagccagcuu

SEQ ID NO: 2785090 - RNA, 12 nt, Human
agagccagcuug

SEQ ID NO: 2785091 - RNA, 12 nt, Human
agagcaugaaau

SEQ ID NO: 2785092 - RNA, 14 nt, Human
agagcaugaaauuu

SEQ ID NO: 2785093 - RNA, 14 nt, Human
agagcaacucugag

SEQ ID NO: 2785094 - RNA, 20 nt, Human
agagcaccuuugcacaggau

SEQ ID NO: 2785095 - RNA, 21 nt, Human
agagcacuagguucaauuccc

SEQ ID NO: 2785096 - RNA, 17 nt, Human
agagcagccuguggcau

SEQ ID NO: 2785097 - RNA, 16 nt, Human
agagcagccuguggca

SEQ ID NO: 2785098 - RNA, 12 nt, Human
agagcagccugu

SEQ ID NO: 2785099 - RNA, 19 nt, Human
agagcagccuguggcaucu

SEQ ID NO: 2785100 - RNA, 18 nt, Human
agagcagcuuuaaacuca

SEQ ID NO: 2785101 - RNA, 23 nt, Human
agagcaggaagcauucagagagc

SEQ ID NO: 2785102 - RNA, 13 nt, Human
agagcaggaccuc

SEQ ID NO: 2785103 - RNA, 20 nt, Human
agagcagcuuuaaacucagg

SEQ ID NO: 2785104 - RNA, 21 nt, Human
agagcagcuuuaaacucaggg

SEQ ID NO: 2785105 - RNA, 18 nt, Human
agagcaggaagcauucag

SEQ ID NO: 2785106 - RNA, 20 nt, Human
agagcaggaagcauucagag

SEQ ID NO: 2785107 - RNA, 23 nt, Human
agagcugacacaaaccugccugg

SEQ ID NO: 2785108 - RNA, 23 nt, Human
agagcugacacaggaugaaggca

SEQ ID NO: 2785109 - RNA, 18 nt, Human
agagcugacacaaaccug

SEQ ID NO: 2785110 - RNA, 20 nt, Human
agagcugacacaaaccugcc

SEQ ID NO: 2785111 - RNA, 22 nt, Human
agagcugacacaaaccugccug

SEQ ID NO: 2785112 - RNA, 17 nt, Human
agagcaaccucucacuc

SEQ ID NO: 2785113 - RNA, 21 nt, Human
agagcucuggugauaaggaca

SEQ ID NO: 2785114 - RNA, 22 nt, Human
agagcucuggugauaaggacau

SEQ ID NO: 2785115 - RNA, 23 nt, Human
agagcuccucuguccugcuucug

SEQ ID NO: 2785116 - RNA, 20 nt, Human
agagcuccccuacggaccag

SEQ ID NO: 2785117 - RNA, 21 nt, Human
agagcuccccuacggaccagg

SEQ ID NO: 2785118 - RNA, 17 nt, Human
agagcucaagggacaag

SEQ ID NO: 2785119 - RNA, 21 nt, Human
agagcucaagggacaaggaca

SEQ ID NO: 2785120 - RNA, 17 nt, Human
agagcuaagggugggug

SEQ ID NO: 2785121 - RNA, 18 nt, Human
agagcuaagggugggugc

SEQ ID NO: 2785122 - RNA, 22 nt, Human
agagcuaagggugggugcucag

SEQ ID NO: 2785123 - RNA, 23 nt, Human
agagcuaagggugggugcucaga

SEQ ID NO: 2785124 - RNA, 16 nt, Human
agagacuccagcuggg

SEQ ID NO: 2785125 - RNA, 15 nt, Human
agagaccuccugccu

SEQ ID NO: 2785126 - RNA, 15 nt, Human
agagaccugaagugu

SEQ ID NO: 2785127 - RNA, 16 nt, Human
agagaccugaagugug

SEQ ID NO: 2785128 - RNA, 22 nt, Human
agagaccuguuuuaaaaaggaa

SEQ ID NO: 2785129 - RNA, 16 nt, Human
agagacggugucuugu

SEQ ID NO: 2785130 - RNA, 21 nt, Human
agagacggugucuuguucugu

SEQ ID NO: 2785131 - RNA, 18 nt, Human
agagacuauggagccugg

SEQ ID NO: 2785132 - RNA, 22 nt, Human
agagacuauggagccuggcaca

SEQ ID NO: 2785133 - RNA, 13 nt, Human
agagacucagccu

SEQ ID NO: 2785134 - RNA, 14 nt, Human
agagacucagccug

SEQ ID NO: 2785135 - RNA, 15 nt, Human
agagacucagccugc

SEQ ID NO: 2785136 - RNA, 16 nt, Human
agagacucagccugca

SEQ ID NO: 2785137 - RNA, 18 nt, Human
agagacucagccugcagu

SEQ ID NO: 2785138 - RNA, 14 nt, Human
ugaaagaauauauu

SEQ ID NO: 2785139 - RNA, 18 nt, Human
ugaaagaauauauuuauu

SEQ ID NO: 2785140 - RNA, 22 nt, Human
ugaaagaauauauuuauuuaaa

SEQ ID NO: 2785141 - RNA, 13 nt, Human
ugaaagacaccau

SEQ ID NO: 2785142 - RNA, 22 nt, Human
ugaaagaagaauguguuucaaa

SEQ ID NO: 2785143 - RNA, 14 nt, Human
agagagaaaauaaa

SEQ ID NO: 2785144 - RNA, 16 nt, Human
agagacucccaugaag

SEQ ID NO: 2785145 - RNA, 17 nt, Human
agagacucccaugaagc

SEQ ID NO: 2785146 - RNA, 18 nt, Human
agagacucccaugaagcc

SEQ ID NO: 2785147 - RNA, 19 nt, Human
agagacucccaugaagccu

SEQ ID NO: 2785148 - RNA, 20 nt, Human
agagacucccaugaagccuu

SEQ ID NO: 2785149 - RNA, 21 nt, Human
agagacucccaugaagccuuu

SEQ ID NO: 2785150 - RNA, 22 nt, Human
agagacucccaugaagccuuuu

SEQ ID NO: 2785151 - RNA, 14 nt, Human
agagagaaagagag

SEQ ID NO: 2785152 - RNA, 14 nt, Human
agagagaaagccag

SEQ ID NO: 2785153 - RNA, 22 nt, Human
agagaucaaccccuucgcuccu

SEQ ID NO: 2785154 - RNA, 18 nt, Human
agagagaaccuaacugua

SEQ ID NO: 2785155 - RNA, 19 nt, Human
agagagaaccuaacuguau

SEQ ID NO: 2785156 - RNA, 21 nt, Human
agagagaaccuaacuguaucu

SEQ ID NO: 2785157 - RNA, 22 nt, Human
agagagaaccuaacuguaucuu

SEQ ID NO: 2785158 - RNA, 22 nt, Human
agagagaaagccaggcagguag

SEQ ID NO: 2785159 - RNA, 15 nt, Human
agagagaaagccagg

SEQ ID NO: 2785160 - RNA, 16 nt, Human
agagagaaagccaggc

SEQ ID NO: 2785161 - RNA, 12 nt, Human
agagagaaaucu

SEQ ID NO: 2785162 - RNA, 13 nt, Human
agagagaaauucu

SEQ ID NO: 2785163 - RNA, 14 nt, Human
agagagaaauucug

SEQ ID NO: 2785164 - RNA, 19 nt, Human
agagagaaauucuguuaaa

SEQ ID NO: 2785165 - RNA, 21 nt, Human
agagagaaauucuguuaaaau

SEQ ID NO: 2785166 - RNA, 20 nt, Human
agagauauguagaaggcaca

SEQ ID NO: 2785167 - RNA, 15 nt, Human
agagauauuuugggc

SEQ ID NO: 2785168 - RNA, 18 nt, Human
agagauauuuugggcaug

SEQ ID NO: 2785169 - RNA, 20 nt, Human
agagauauuuugggcaugug

SEQ ID NO: 2785170 - RNA, 23 nt, Human
agagauauuuugggcaugugggc

SEQ ID NO: 2785171 - RNA, 20 nt, Human
agagcaaaauugauguguuu

SEQ ID NO: 2785172 - RNA, 14 nt, Human
agagcaaagugacc

SEQ ID NO: 2785173 - RNA, 21 nt, Human
agagaugugcaauugauuucu

SEQ ID NO: 2785174 - RNA, 14 nt, Human
agagaugugcaccc

SEQ ID NO: 2785175 - RNA, 15 nt, Human
agagaugugcaccca

SEQ ID NO: 2785176 - RNA, 17 nt, Human
agagaugugcacccaug

SEQ ID NO: 2785177 - RNA, 15 nt, Human
agagaugggagcucc

SEQ ID NO: 2785178 - RNA, 17 nt, Human
agagaugggagcuccuc

SEQ ID NO: 2785179 - RNA, 19 nt, Human
agagaugggagcuccucuc

SEQ ID NO: 2785180 - RNA, 20 nt, Human
agagaugggagcuccucucc

SEQ ID NO: 2785181 - RNA, 21 nt, Human
agagaugggagcuccucuccu

SEQ ID NO: 2785182 - RNA, 24 nt, Human
agagaugggagcuccucuccugga

SEQ ID NO: 2785183 - RNA, 17 nt, Human
agagaugucaucagagc

SEQ ID NO: 2785184 - RNA, 18 nt, Human
agagauggagucuugcua

SEQ ID NO: 2785185 - RNA, 13 nt, Human
agagaucauggaa

SEQ ID NO: 2785186 - RNA, 17 nt, Human
ugauauggcagaagaca

SEQ ID NO: 2785187 - RNA, 18 nt, Human
ugauauggcagaagacac

SEQ ID NO: 2785188 - RNA, 16 nt, Human
ugauauggcagaagac

SEQ ID NO: 2785189 - RNA, 18 nt, Human
ugauagacaauugaggua

SEQ ID NO: 2785190 - RNA, 17 nt, Human
ugauagacaauugaggu

SEQ ID NO: 2785191 - RNA, 19 nt, Human
ugauauggcagaagacacc

SEQ ID NO: 2785192 - RNA, 20 nt, Human
ugauauggcagaagacacca

SEQ ID NO: 2785193 - RNA, 14 nt, Human
ugauaugggacuga

SEQ ID NO: 2785194 - RNA, 21 nt, Human
ugauacuaucauacuacugaa

SEQ ID NO: 2785195 - RNA, 13 nt, Human
ugauacugauggu

SEQ ID NO: 2785196 - RNA, 18 nt, Human
ugauacuauccaguuacu

SEQ ID NO: 2785197 - RNA, 20 nt, Human
ugauacucuuucuaaugcug

SEQ ID NO: 2785198 - RNA, 14 nt, Human
ugauacuuauauuu

SEQ ID NO: 2785199 - RNA, 15 nt, Human
ugauacuuauauuuu

SEQ ID NO: 2785200 - RNA, 16 nt, Human
ugauacuuauauuuuc

SEQ ID NO: 2785201 - RNA, 22 nt, Human
ugauacuuauauuuucguauga

SEQ ID NO: 2785202 - RNA, 14 nt, Human
ugauacuucacuac

SEQ ID NO: 2785203 - RNA, 13 nt, Human
ugauacuucauuu

SEQ ID NO: 2785204 - RNA, 16 nt, Human
ugauacuucauuuaaa

SEQ ID NO: 2785205 - RNA, 15 nt, Human
ugauacuuuuaagag

SEQ ID NO: 2785206 - RNA, 12 nt, Human
ugauauucuaag

SEQ ID NO: 2785207 - RNA, 15 nt, Human
ugauauucuaagacu

SEQ ID NO: 2785208 - RNA, 17 nt, Human
ugauauucuaagacuua

SEQ ID NO: 2785209 - RNA, 13 nt, Human
ugauauugugaac

SEQ ID NO: 2785210 - RNA, 17 nt, Human
ugauauugugaacauuu

SEQ ID NO: 2785211 - RNA, 21 nt, Human
ugauauugugaacauuuguga

SEQ ID NO: 2785212 - RNA, 12 nt, Human
ugauauucagaa

SEQ ID NO: 2785213 - RNA, 14 nt, Human
ugauauucagaauu

SEQ ID NO: 2785214 - RNA, 22 nt, Human
ugauauucagaauuaugaugga

SEQ ID NO: 2785215 - RNA, 16 nt, Human
ugauauguuuuauuuc

SEQ ID NO: 2785216 - RNA, 17 nt, Human
ugauauguuuuauuuca

SEQ ID NO: 2785217 - RNA, 23 nt, Human
ugauauguuuuauuucauugguu

SEQ ID NO: 2785218 - RNA, 23 nt, Human
ugauauuucccuccccuggggac

SEQ ID NO: 2785219 - RNA, 12 nt, Human
ugauauuucucu

SEQ ID NO: 2785220 - RNA, 14 nt, Human
ugauauuucucuag

SEQ ID NO: 2785221 - RNA, 15 nt, Human
ugauauuucucuagu

SEQ ID NO: 2785222 - RNA, 16 nt, Human
ugauauuucucuagua

SEQ ID NO: 2785223 - RNA, 18 nt, Human
ugauauuucucuaguagu

SEQ ID NO: 2785224 - RNA, 19 nt, Human
ugauauuucucuaguaguu

SEQ ID NO: 2785225 - RNA, 19 nt, Human
ugauauuuucaacgcagcc

SEQ ID NO: 2785226 - RNA, 21 nt, Human
ugauauuuucaacgcagcccu

SEQ ID NO: 2785227 - RNA, 22 nt, Human
ugauauuuucaacgcagcccug

SEQ ID NO: 2785228 - RNA, 23 nt, Human
ugauauuuucaacgcagcccugc

SEQ ID NO: 2785229 - RNA, 19 nt, Human
ugaucacggcucacugcag

SEQ ID NO: 2785230 - RNA, 18 nt, Human
ugaucacggcucacugca

SEQ ID NO: 2785231 - RNA, 15 nt, Human
ugaucaacucuucga

SEQ ID NO: 2785232 - RNA, 18 nt, Human
ugaucaaagccacacucu

SEQ ID NO: 2785233 - RNA, 16 nt, Human
ugaucaaaaauaaugc

SEQ ID NO: 2785234 - RNA, 17 nt, Human
ugaucaaaaauaaugca

SEQ ID NO: 2785235 - RNA, 18 nt, Human
ugaucaaaaauaaugcau

SEQ ID NO: 2785236 - RNA, 16 nt, Human
ugauauuuuguacuuu

SEQ ID NO: 2785237 - RNA, 18 nt, Human
ugauauuuuguuuuuccc

SEQ ID NO: 2785238 - RNA, 19 nt, Human
ugauauuuuaccucuuauu

SEQ ID NO: 2785239 - RNA, 21 nt, Human
ugaucacggcucacugcagcc

SEQ ID NO: 2785240 - RNA, 20 nt, Human
ugaucacggcucacugcagc

SEQ ID NO: 2785241 - RNA, 22 nt, Human
ugauauggguuuauaauuuucu

SEQ ID NO: 2785242 - RNA, 21 nt, Human
agcauauucuuuucugcaaaa

SEQ ID NO: 2785243 - RNA, 23 nt, Human
agcauggcacucccuccagcaca

SEQ ID NO: 2785244 - RNA, 18 nt, Human
agcauggcucaaagugca

SEQ ID NO: 2785245 - RNA, 17 nt, Human
agcauguauaguugcuu

SEQ ID NO: 2785246 - RNA, 18 nt, Human
agcauguauaguugcuuu

SEQ ID NO: 2785247 - RNA, 21 nt, Human
agcauugcuuuuauuuugaaa

SEQ ID NO: 2785248 - RNA, 23 nt, Human
agcauugcuuuuauuuugaaaag

SEQ ID NO: 2785249 - RNA, 17 nt, Human
agcauuggauacagcag

SEQ ID NO: 2785250 - RNA, 23 nt, Human
agcauuggauacagcaguagaca

SEQ ID NO: 2785251 - RNA, 13 nt, Human
agcauugugagua

SEQ ID NO: 2785252 - RNA, 23 nt, Human
agcauuuccaacaccacagacac

SEQ ID NO: 2785253 - RNA, 14 nt, Human
agcauuuccaacac

SEQ ID NO: 2785254 - RNA, 17 nt, Human
agcauuuccaacaccac

SEQ ID NO: 2785255 - RNA, 18 nt, Human
agcauuuccaacaccaca

SEQ ID NO: 2785256 - RNA, 19 nt, Human
agcauuuccaacaccacag

SEQ ID NO: 2785257 - RNA, 21 nt, Human
agcauuuccaacaccacagac

SEQ ID NO: 2785258 - RNA, 22 nt, Human
agcauuuccaacaccacagaca

SEQ ID NO: 2785259 - RNA, 14 nt, Human
agcauguuuuguau

SEQ ID NO: 2785260 - RNA, 15 nt, Human
agcauguuuuguaua

SEQ ID NO: 2785261 - RNA, 16 nt, Human
agcauguuuuguauac

SEQ ID NO: 2785262 - RNA, 17 nt, Human
agcauguuuuguauaca

SEQ ID NO: 2785263 - RNA, 19 nt, Human
agcauguuuuguauacaaa

SEQ ID NO: 2785264 - RNA, 18 nt, Human
agcauguuucauguuuug

SEQ ID NO: 2785265 - RNA, 21 nt, Human
agcauguuucauguuuuguga

SEQ ID NO: 2785266 - RNA, 12 nt, Human
agcauugccugg

SEQ ID NO: 2785267 - RNA, 13 nt, Human
agcauugccuggc

SEQ ID NO: 2785268 - RNA, 17 nt, Human
agcauugccuggccuuc

SEQ ID NO: 2785269 - RNA, 21 nt, Human
agcauugccuggccuuccugu

SEQ ID NO: 2785270 - RNA, 15 nt, Human
agcauugcuguuaug

SEQ ID NO: 2785271 - RNA, 16 nt, Human
agcauugcuguuaugu

SEQ ID NO: 2785272 - RNA, 17 nt, Human
agcauugcuguuauguc

SEQ ID NO: 2785273 - RNA, 20 nt, Human
agcauugcuguuaugucugu

SEQ ID NO: 2785274 - RNA, 23 nt, Human
agcauugcuguuaugucuguuua

SEQ ID NO: 2785275 - RNA, 14 nt, Human
agcauguuucaugu

SEQ ID NO: 2785276 - RNA, 17 nt, Human
agcauguuucauguuuu

SEQ ID NO: 2785277 - RNA, 16 nt, Human
agcaugugucaugcau

SEQ ID NO: 2785278 - RNA, 15 nt, Human
agcaugugcccuccu

SEQ ID NO: 2785279 - RNA, 16 nt, Human
agcaugugcccuccug

SEQ ID NO: 2785280 - RNA, 17 nt, Human
agcaugugcccuccuga

SEQ ID NO: 2785281 - RNA, 16 nt, Human
agcaugugccuuaaug

SEQ ID NO: 2785282 - RNA, 18 nt, Human
agcaugugccuuaaugcu

SEQ ID NO: 2785283 - RNA, 15 nt, Human
ugaguaacuauuauu

SEQ ID NO: 2785284 - RNA, 21 nt, Human
agcauaauugaaaguucugaa

SEQ ID NO: 2785285 - RNA, 12 nt, Human
ugaguaaauauu

SEQ ID NO: 2785286 - RNA, 15 nt, Human
ugaguaaauauugag

SEQ ID NO: 2785287 - RNA, 20 nt, Human
ugaguaaauauugaggcuuu

SEQ ID NO: 2785288 - RNA, 23 nt, Human
ugaguaaauauugaggcuuugug

SEQ ID NO: 2785289 - RNA, 17 nt, Human
ugaguaaaucagauguu

SEQ ID NO: 2785290 - RNA, 20 nt, Human
agcauauggguuagauguug

SEQ ID NO: 2785291 - RNA, 19 nt, Human
ugaguagacacauuuaagg

SEQ ID NO: 2785292 - RNA, 14 nt, Human
ugaguagauauuac

SEQ ID NO: 2785293 - RNA, 15 nt, Human
ugaguagauauuacu

SEQ ID NO: 2785294 - RNA, 18 nt, Human
ugaguagauauuacuuua

SEQ ID NO: 2785295 - RNA, 19 nt, Human
ugaguagauauuacuuuau

SEQ ID NO: 2785296 - RNA, 20 nt, Human
ugaguagauauuacuuuauc

SEQ ID NO: 2785297 - RNA, 13 nt, Human
ugaguagcuggau

SEQ ID NO: 2785298 - RNA, 13 nt, Human
ugaguagcuggga

SEQ ID NO: 2785299 - RNA, 19 nt, Human
ugaguauaaaaacuugaaa

SEQ ID NO: 2785300 - RNA, 15 nt, Human
ugaguauacaauaua

SEQ ID NO: 2785301 - RNA, 18 nt, Human
ugaguauacaauauauaa

SEQ ID NO: 2785302 - RNA, 19 nt, Human
ugagaauugggcggcucug

SEQ ID NO: 2785303 - RNA, 13 nt, Human
ugagaauuucuaa

SEQ ID NO: 2785304 - RNA, 14 nt, Human
ugagaauuucuaaa

SEQ ID NO: 2785305 - RNA, 15 nt, Human
ugagaauuucuaaaa

SEQ ID NO: 2785306 - RNA, 22 nt, Human
ugagaauuucuaaaaagauuag

SEQ ID NO: 2785307 - RNA, 23 nt, Human
ugagacaaauuuuaacuucuugu

SEQ ID NO: 2785308 - RNA, 16 nt, Human
ugagacaaaauuuuag

SEQ ID NO: 2785309 - RNA, 14 nt, Human
ugagacaaacaugc

SEQ ID NO: 2785310 - RNA, 17 nt, Human
agcauaaguauacaguu

SEQ ID NO: 2785311 - RNA, 18 nt, Human
agcauaaguauacaguuc

SEQ ID NO: 2785312 - RNA, 12 nt, Human
ugauaaguaaau

SEQ ID NO: 2785313 - RNA, 19 nt, Human
ugauaaggacaugaugcuu

SEQ ID NO: 2785314 - RNA, 19 nt, Human
ugauaauauuguggugcca

SEQ ID NO: 2785315 - RNA, 16 nt, Human
ugauaauucuuauuuu

SEQ ID NO: 2785316 - RNA, 21 nt, Human
ugauaauguuaaauuuguaag

SEQ ID NO: 2785317 - RNA, 22 nt, Human
ugauaauguuaaauuuguaagu

SEQ ID NO: 2785318 - RNA, 15 nt, Human
ugauaauguuaaauu

SEQ ID NO: 2785319 - RNA, 16 nt, Human
ugauaauguuaaauuu

SEQ ID NO: 2785320 - RNA, 17 nt, Human
ugauaauguuaaauuug

SEQ ID NO: 2785321 - RNA, 18 nt, Human
ugauaauguuaaauuugu

SEQ ID NO: 2785322 - RNA, 13 nt, Human
ugauaauguuaaa

SEQ ID NO: 2785323 - RNA, 14 nt, Human
ugauaauguuaaau

SEQ ID NO: 2785324 - RNA, 21 nt, Human
ugauaaugauaaaacaccuca

SEQ ID NO: 2785325 - RNA, 17 nt, Human
ugaguucauacccuguu

SEQ ID NO: 2785326 - RNA, 19 nt, Human
ugauaagagggcacacacu

SEQ ID NO: 2785327 - RNA, 21 nt, Human
ugauaagagggcacacacugu

SEQ ID NO: 2785328 - RNA, 14 nt, Human
ugauaauugcauuc

SEQ ID NO: 2785329 - RNA, 16 nt, Human
ugauaauugcauucau

SEQ ID NO: 2785330 - RNA, 19 nt, Human
ugauaauugcauucaucuu

SEQ ID NO: 2785331 - RNA, 13 nt, Human
ugauaauuuaaga

SEQ ID NO: 2785332 - RNA, 18 nt, Human
ugauaauuuaagagcuaa

SEQ ID NO: 2785333 - RNA, 19 nt, Human
ugauacgcaacauaauuaa

SEQ ID NO: 2785334 - RNA, 17 nt, Human
ugauacuaaaaguucuu

SEQ ID NO: 2785335 - RNA, 17 nt, Human
ugagucaccaagcccag

SEQ ID NO: 2785336 - RNA, 16 nt, Human
ugagucaccaagccca

SEQ ID NO: 2785337 - RNA, 14 nt, Human
ugagucaccaagcc

SEQ ID NO: 2785338 - RNA, 21 nt, Human
ugaguagaugcgcagccccau

SEQ ID NO: 2785339 - RNA, 13 nt, Human
ugaguaucagaau

SEQ ID NO: 2785340 - RNA, 14 nt, Human
ugaguaucagaauu

SEQ ID NO: 2785341 - RNA, 15 nt, Human
ugaguaucagaauug

SEQ ID NO: 2785342 - RNA, 22 nt, Human
ugaguaucagaauugaaacacu

SEQ ID NO: 2785343 - RNA, 17 nt, Human
ugaguauguggaaggca

SEQ ID NO: 2785344 - RNA, 20 nt, Human
ugaguauggagcagccugga

SEQ ID NO: 2785345 - RNA, 23 nt, Human
ugaguauggagcagccuggagac

SEQ ID NO: 2785346 - RNA, 15 nt, Human
ugagugccuuuugca

SEQ ID NO: 2785347 - RNA, 17 nt, Human
ugagugccuuuugcaga

SEQ ID NO: 2785348 - RNA, 19 nt, Human
ugagugccuuuugcagaag

SEQ ID NO: 2785349 - RNA, 22 nt, Human
ugagugccuuuugcagaagagg

SEQ ID NO: 2785350 - RNA, 13 nt, Human
ugaguguaauguu

SEQ ID NO: 2785351 - RNA, 21 nt, Human
ugagugggguuaucucugugu

SEQ ID NO: 2785352 - RNA, 22 nt, Human
ugagugggguuaucucuguguu

SEQ ID NO: 2785353 - RNA, 15 nt, Human
ugaguuaucuaagaa

SEQ ID NO: 2785354 - RNA, 16 nt, Human
ugaguuaucuaagaau

SEQ ID NO: 2785355 - RNA, 15 nt, Human
ugaguuaugauguaa

SEQ ID NO: 2785356 - RNA, 16 nt, Human
ugaguuauguuaaaau

SEQ ID NO: 2785357 - RNA, 22 nt, Human
ugaguuauuccuugaucauuuu

SEQ ID NO: 2785358 - RNA, 23 nt, Human
ugaguuauuccuugaucauuuug

SEQ ID NO: 2785359 - RNA, 21 nt, Human
ugaguuauugagauuguccuc

SEQ ID NO: 2785360 - RNA, 17 nt, Human
ugaguuaggaaugagaa

SEQ ID NO: 2785361 - RNA, 18 nt, Human
ugaguuaggaaugagaag

SEQ ID NO: 2785362 - RNA, 14 nt, Human
ugaugaagaggagu

SEQ ID NO: 2785363 - RNA, 15 nt, Human
ugaugaagcaaggaa

SEQ ID NO: 2785364 - RNA, 16 nt, Human
ugaugaagcaaggaag

SEQ ID NO: 2785365 - RNA, 23 nt, Human
ugaugaagcaaggaagauauaca

SEQ ID NO: 2785366 - RNA, 24 nt, Human
ugaugaagcaaggaagauauacau

SEQ ID NO: 2785367 - RNA, 21 nt, Human
ugaugaagccgaccuuagauu

SEQ ID NO: 2785368 - RNA, 13 nt, Human
ugaugaagaggag

SEQ ID NO: 2785369 - RNA, 13 nt, Human
ugaugaaucacug

SEQ ID NO: 2785370 - RNA, 14 nt, Human
ugaugaaucacugu

SEQ ID NO: 2785371 - RNA, 21 nt, Human
agccaccuaaacgguucaguu

SEQ ID NO: 2785372 - RNA, 16 nt, Human
ugaugagcuccucuuc

SEQ ID NO: 2785373 - RNA, 15 nt, Human
ugaugagcuccucuu

SEQ ID NO: 2785374 - RNA, 15 nt, Human
agccacggccaggcc

SEQ ID NO: 2785375 - RNA, 21 nt, Human
ugauccaugaguuugcccugg

SEQ ID NO: 2785376 - RNA, 13 nt, Human
ugauccugugaag

SEQ ID NO: 2785377 - RNA, 13 nt, Human
ugauccauccagc

SEQ ID NO: 2785378 - RNA, 16 nt, Human
ugauccauccagcuug

SEQ ID NO: 2785379 - RNA, 19 nt, Human
ugauccauccagcuugcca

SEQ ID NO: 2785380 - RNA, 18 nt, Human
ugauccuuuuggagucag

SEQ ID NO: 2785381 - RNA, 14 nt, Human
ugauccugugaagu

SEQ ID NO: 2785382 - RNA, 21 nt, Human
ugaucgaugauucaggugcag

SEQ ID NO: 2785383 - RNA, 17 nt, Human
ugaucgcacaaccugca

SEQ ID NO: 2785384 - RNA, 20 nt, Human
agccacauuuggaauacuuu

SEQ ID NO: 2785385 - RNA, 15 nt, Human
agccacauuuggaau

SEQ ID NO: 2785386 - RNA, 21 nt, Human
agccacauagagugacuccaa

SEQ ID NO: 2785387 - RNA, 20 nt, Human
agcauuucuuuucuggccaa

SEQ ID NO: 2785388 - RNA, 14 nt, Human
agccacggccaggc

SEQ ID NO: 2785389 - RNA, 18 nt, Human
agccaccucucuuuuuca

SEQ ID NO: 2785390 - RNA, 16 nt, Human
agccaccucugucauu

SEQ ID NO: 2785391 - RNA, 23 nt, Human
agccaccucugucauuuguugug

SEQ ID NO: 2785392 - RNA, 18 nt, Human
agccaccgugccuggcca

SEQ ID NO: 2785393 - RNA, 14 nt, Human
agccaccucucuuu

SEQ ID NO: 2785394 - RNA, 14 nt, Human
agccacauuauuuc

SEQ ID NO: 2785395 - RNA, 23 nt, Human
agccacauuuggaauacuuuuug

SEQ ID NO: 2785396 - RNA, 22 nt, Human
agccacauuuggaauacuuuuu

SEQ ID NO: 2785397 - RNA, 21 nt, Human
agccacauuuggaauacuuuu

SEQ ID NO: 2785398 - RNA, 16 nt, Human
agccacugaagcuggg

SEQ ID NO: 2785399 - RNA, 13 nt, Human
agccacugaagcu

SEQ ID NO: 2785400 - RNA, 12 nt, Human
agccacugaagc

SEQ ID NO: 2785401 - RNA, 22 nt, Human
agccacucuaccagugcaggcu

SEQ ID NO: 2785402 - RNA, 16 nt, Human
agccacucucuucccu

SEQ ID NO: 2785403 - RNA, 19 nt, Human
agccacucucuucccuuuc

SEQ ID NO: 2785404 - RNA, 20 nt, Human
agccacucucuucccuuucc

SEQ ID NO: 2785405 - RNA, 17 nt, Human
agccacucugucccuuc

SEQ ID NO: 2785406 - RNA, 15 nt, Human
ugauguuuuuaugau

SEQ ID NO: 2785407 - RNA, 17 nt, Human
agccacuucggccaggu

SEQ ID NO: 2785408 - RNA, 22 nt, Human
agccacuucggccaggucacac

SEQ ID NO: 2785409 - RNA, 22 nt, Human
agccacugcaccgggccacaga

SEQ ID NO: 2785410 - RNA, 21 nt, Human
agccacugcaccgggccacag

SEQ ID NO: 2785411 - RNA, 13 nt, Human
agccacugcaccg

SEQ ID NO: 2785412 - RNA, 20 nt, Human
agccacugcaccgggccaca

SEQ ID NO: 2785413 - RNA, 15 nt, Human
ugauuaaaaugguga

SEQ ID NO: 2785414 - RNA, 11 nt, Human
ugauguuugug

SEQ ID NO: 2785415 - RNA, 16 nt, Human
ugauguuuguggccuc

SEQ ID NO: 2785416 - RNA, 20 nt, Human
ugauguuuguggccucagaa

SEQ ID NO: 2785417 - RNA, 19 nt, Human
ugauguuuguggccucaga

SEQ ID NO: 2785418 - RNA, 18 nt, Human
ugauguuuguggccucag

SEQ ID NO: 2785419 - RNA, 17 nt, Human
ugauguuuguggccuca

SEQ ID NO: 2785420 - RNA, 17 nt, Human
ugaugauacaaugaaca

SEQ ID NO: 2785421 - RNA, 15 nt, Human
ugaugauacaagauu

SEQ ID NO: 2785422 - RNA, 13 nt, Human
ugauguuugcucu

SEQ ID NO: 2785423 - RNA, 23 nt, Human
agccagacgccauuuaaaagucu

SEQ ID NO: 2785424 - RNA, 18 nt, Human
agccagaaucagcacaga

SEQ ID NO: 2785425 - RNA, 19 nt, Human
agccagaaucagcacagau

SEQ ID NO: 2785426 - RNA, 21 nt, Human
agccagaaucagcacagauaa

SEQ ID NO: 2785427 - RNA, 12 nt, Human
agccagacagac

SEQ ID NO: 2785428 - RNA, 13 nt, Human
agccagacagacc

SEQ ID NO: 2785429 - RNA, 15 nt, Human
agccagacagacccu

SEQ ID NO: 2785430 - RNA, 20 nt, Human
agccagcugcagcugggcug

SEQ ID NO: 2785431 - RNA, 18 nt, Human
agccagcugcaggaauca

SEQ ID NO: 2785432 - RNA, 11 nt, Human
agccagcugcc

SEQ ID NO: 2785433 - RNA, 19 nt, Human
agccagcugcagcugggcu

SEQ ID NO: 2785434 - RNA, 12 nt, Human
agccagcuuggg

SEQ ID NO: 2785435 - RNA, 14 nt, Human
agccaggagcuguc

SEQ ID NO: 2785436 - RNA, 15 nt, Human
agccaggagcuguca

SEQ ID NO: 2785437 - RNA, 17 nt, Human
agccaggagcugucacc

SEQ ID NO: 2785438 - RNA, 14 nt, Human
agccaggaucaugg

SEQ ID NO: 2785439 - RNA, 15 nt, Human
agccaggaucauggu

SEQ ID NO: 2785440 - RNA, 18 nt, Human
agccaggaucauggugua

SEQ ID NO: 2785441 - RNA, 20 nt, Human
agccaggaucaugguguaau

SEQ ID NO: 2785442 - RNA, 23 nt, Human
agccaggaucaugguguaauaag

SEQ ID NO: 2785443 - RNA, 22 nt, Human
agccaggcaacuucaguccugg

SEQ ID NO: 2785444 - RNA, 22 nt, Human
agccaggaucaugguguaauaa

SEQ ID NO: 2785445 - RNA, 20 nt, Human
agccaggaaguacuuccacc

SEQ ID NO: 2785446 - RNA, 15 nt, Human
agccaggacagucag

SEQ ID NO: 2785447 - RNA, 21 nt, Human
agccaggcagguagccagggg

SEQ ID NO: 2785448 - RNA, 12 nt, Human
agccagggucuc

SEQ ID NO: 2785449 - RNA, 23 nt, Human
agccagggggacuagccccugug

SEQ ID NO: 2785450 - RNA, 21 nt, Human
agccagggggacuagccccug

SEQ ID NO: 2785451 - RNA, 22 nt, Human
agccagggggacuagccccugu

SEQ ID NO: 2785452 - RNA, 20 nt, Human
agccagggggaugccacucc

SEQ ID NO: 2785453 - RNA, 16 nt, Human
agccagggucucuccc

SEQ ID NO: 2785454 - RNA, 18 nt, Human
agccagggucucucccuc

SEQ ID NO: 2785455 - RNA, 20 nt, Human
agccagggucucucccucag

SEQ ID NO: 2785456 - RNA, 21 nt, Human
agccagggucucucccucagg

SEQ ID NO: 2785457 - RNA, 22 nt, Human
agccagggucucucccucaggu

SEQ ID NO: 2785458 - RNA, 18 nt, Human
agccagggggacuagccc

SEQ ID NO: 2785459 - RNA, 20 nt, Human
agccaggcuagcuggagccu

SEQ ID NO: 2785460 - RNA, 21 nt, Human
agccaggcuagcuggagccug

SEQ ID NO: 2785461 - RNA, 17 nt, Human
agccagguauggcucug

SEQ ID NO: 2785462 - RNA, 19 nt, Human
agccagguauggcucugca

SEQ ID NO: 2785463 - RNA, 15 nt, Human
agccaggucccccug

SEQ ID NO: 2785464 - RNA, 16 nt, Human
agccaggucccccugc

SEQ ID NO: 2785465 - RNA, 17 nt, Human
agccaggucccccugca

SEQ ID NO: 2785466 - RNA, 18 nt, Human
agccaggucccccugcag

SEQ ID NO: 2785467 - RNA, 19 nt, Human
agccaggucccccugcagc

SEQ ID NO: 2785468 - RNA, 20 nt, Human
agccaggucccccugcagcu

SEQ ID NO: 2785469 - RNA, 20 nt, Human
agccagggcuuaccuguaca

SEQ ID NO: 2785470 - RNA, 22 nt, Human
agccauacuuaucucucugugc

SEQ ID NO: 2785471 - RNA, 16 nt, Human
agccauacuuaucucu

SEQ ID NO: 2785472 - RNA, 19 nt, Human
agccauacuuaucucucug

SEQ ID NO: 2785473 - RNA, 21 nt, Human
agccauauaaguuugaaggaa

SEQ ID NO: 2785474 - RNA, 16 nt, Human
agccaguguugccuaa

SEQ ID NO: 2785475 - RNA, 13 nt, Human
agccagugagaug

SEQ ID NO: 2785476 - RNA, 23 nt, Human
agccaugggcacaaagggcccag

SEQ ID NO: 2785477 - RNA, 22 nt, Human
agccauguagaagcugcaucuu

SEQ ID NO: 2785478 - RNA, 15 nt, Human
agccauguauaaaug

SEQ ID NO: 2785479 - RNA, 16 nt, Human
agccauguauaaaugu

SEQ ID NO: 2785480 - RNA, 17 nt, Human
agccauguauaaaugug

SEQ ID NO: 2785481 - RNA, 18 nt, Human
agccauguauaaauguga

SEQ ID NO: 2785482 - RNA, 22 nt, Human
agccaugggcacaaagggccca

SEQ ID NO: 2785483 - RNA, 13 nt, Human
agccauguacaga

SEQ ID NO: 2785484 - RNA, 14 nt, Human
agccauguacagac

SEQ ID NO: 2785485 - RNA, 20 nt, Human
agccauguacagacagagaa

SEQ ID NO: 2785486 - RNA, 23 nt, Human
agccauguacagacagagaauau

SEQ ID NO: 2785487 - RNA, 15 nt, Human
agccaucaaaaugcu

SEQ ID NO: 2785488 - RNA, 14 nt, Human
agccaucaaaaugc

SEQ ID NO: 2785489 - RNA, 13 nt, Human
agccaucaaaaug

SEQ ID NO: 2785490 - RNA, 12 nt, Human
agcccagaagaa

SEQ ID NO: 2785491 - RNA, 17 nt, Human
agccauguuaacaugac

SEQ ID NO: 2785492 - RNA, 22 nt, Human
agcccacuucugccauauucug

SEQ ID NO: 2785493 - RNA, 20 nt, Human
agcccagagacuuuguagau

SEQ ID NO: 2785494 - RNA, 12 nt, Human
agcccagagacu

SEQ ID NO: 2785495 - RNA, 12 nt, Human
agcccagacaaa

SEQ ID NO: 2785496 - RNA, 11 nt, Human
agcccagagaa

SEQ ID NO: 2785497 - RNA, 14 nt, Human
agcccagagaacag

SEQ ID NO: 2785498 - RNA, 15 nt, Human
agcccagagaacagc

SEQ ID NO: 2785499 - RNA, 13 nt, Human
agcccagcccucc

SEQ ID NO: 2785500 - RNA, 17 nt, Human
agcccagcccuguucug

SEQ ID NO: 2785501 - RNA, 14 nt, Human
agcccagcgcucug

SEQ ID NO: 2785502 - RNA, 17 nt, Human
agcccagcgcucugccu

SEQ ID NO: 2785503 - RNA, 16 nt, Human
agcccagcccuguucu

SEQ ID NO: 2785504 - RNA, 15 nt, Human
agcccagcccuguuc

SEQ ID NO: 2785505 - RNA, 23 nt, Human
agcccagccauuaccauggagac

SEQ ID NO: 2785506 - RNA, 21 nt, Human
agcccagccauuaccauggag

SEQ ID NO: 2785507 - RNA, 21 nt, Human
ugauucccaagcucugcuccu

SEQ ID NO: 2785508 - RNA, 19 nt, Human
ugauucccaagcucugcuc

SEQ ID NO: 2785509 - RNA, 17 nt, Human
ugauuccuuuuuucaaa

SEQ ID NO: 2785510 - RNA, 18 nt, Human
ugauucccaagcucugcu

SEQ ID NO: 2785511 - RNA, 16 nt, Human
ugauucccaagcucug

SEQ ID NO: 2785512 - RNA, 15 nt, Human
ugauucccaagcucu

SEQ ID NO: 2785513 - RNA, 13 nt, Human
agcccaggagaga

SEQ ID NO: 2785514 - RNA, 14 nt, Human
agcccaggagagag

SEQ ID NO: 2785515 - RNA, 15 nt, Human
agcccaggagagaga

SEQ ID NO: 2785516 - RNA, 14 nt, Human
ugauucaggugcag

SEQ ID NO: 2785517 - RNA, 18 nt, Human
ugauucaggugcagagga

SEQ ID NO: 2785518 - RNA, 21 nt, Human
ugauucaggugcagaggaagu

SEQ ID NO: 2785519 - RNA, 16 nt, Human
agcccaggagagagaa

SEQ ID NO: 2785520 - RNA, 13 nt, Human
ugauucauaaaga

SEQ ID NO: 2785521 - RNA, 21 nt, Human
agccucuuucugucccuucug

SEQ ID NO: 2785522 - RNA, 21 nt, Human
agccugaauuuuguugcuguu

SEQ ID NO: 2785523 - RNA, 20 nt, Human
agccugaauuuuguugcugu

SEQ ID NO: 2785524 - RNA, 23 nt, Human
ugcagccucaaccuccugggcua

SEQ ID NO: 2785525 - RNA, 16 nt, Human
ugcagcccugagaaag

SEQ ID NO: 2785526 - RNA, 19 nt, Human
ugcagcccugagaaagccc

SEQ ID NO: 2785527 - RNA, 21 nt, Human
ugcagcccugagaaagcccug

SEQ ID NO: 2785528 - RNA, 22 nt, Human
ugcagcccugagaaagcccugu

SEQ ID NO: 2785529 - RNA, 21 nt, Human
ugcagccccgcgccuccuucc

SEQ ID NO: 2785530 - RNA, 13 nt, Human
ugcagcccaugcc

SEQ ID NO: 2785531 - RNA, 21 nt, Human
ugcagcccaugcccaccugcc

SEQ ID NO: 2785532 - RNA, 19 nt, Human
ugcagcccaugcccaccug

SEQ ID NO: 2785533 - RNA, 18 nt, Human
ugcagcccaugcccaccu

SEQ ID NO: 2785534 - RNA, 14 nt, Human
ugcagcccaugccc

SEQ ID NO: 2785535 - RNA, 23 nt, Human
ugcagcccaugcccaccugccca

SEQ ID NO: 2785536 - RNA, 14 nt, Human
ugcagcccauuucu

SEQ ID NO: 2785537 - RNA, 15 nt, Human
ugcagcccauuucuc

SEQ ID NO: 2785538 - RNA, 18 nt, Human
ugcagcccauuucuccag

SEQ ID NO: 2785539 - RNA, 19 nt, Human
ugcagcccauuucuccaga

SEQ ID NO: 2785540 - RNA, 20 nt, Human
ugcagcccauuucuccagaa

SEQ ID NO: 2785541 - RNA, 21 nt, Human
ugcagcccauuucuccagaac

SEQ ID NO: 2785542 - RNA, 22 nt, Human
ugcagcccauuucuccagaacc

SEQ ID NO: 2785543 - RNA, 21 nt, Human
ugcagccuugaacucugggcu

SEQ ID NO: 2785544 - RNA, 12 nt, Human
ugcagcgcagcu

SEQ ID NO: 2785545 - RNA, 19 nt, Human
ugcagcgcagcuggacucu

SEQ ID NO: 2785546 - RNA, 22 nt, Human
ugcagcgcagcuggacucugca

SEQ ID NO: 2785547 - RNA, 19 nt, Human
ugcagcuaguccuagugaa

SEQ ID NO: 2785548 - RNA, 21 nt, Human
ugcagcuaguccuagugaacc

SEQ ID NO: 2785549 - RNA, 22 nt, Human
ugcagcuaguccuagugaaccu

SEQ ID NO: 2785550 - RNA, 23 nt, Human
ugcagccuuugccuccccggcuc

SEQ ID NO: 2785551 - RNA, 13 nt, Human
ugcagucuccucu

SEQ ID NO: 2785552 - RNA, 15 nt, Human
ugcagucuccucuuu

SEQ ID NO: 2785553 - RNA, 17 nt, Human
ugcagucuccucuuuaa

SEQ ID NO: 2785554 - RNA, 21 nt, Human
ugcagucuccucuuuaaaaca

SEQ ID NO: 2785555 - RNA, 23 nt, Human
ugcagucuccucuuuaaaacaaa

SEQ ID NO: 2785556 - RNA, 18 nt, Human
ugcaguacuuuaccuccu

SEQ ID NO: 2785557 - RNA, 21 nt, Human
ugcaguaaaucuuuuacaacu

SEQ ID NO: 2785558 - RNA, 18 nt, Human
ugcaguaaaucuuuuaca

SEQ ID NO: 2785559 - RNA, 17 nt, Human
ugcagcucaacuuucug

SEQ ID NO: 2785560 - RNA, 15 nt, Human
ugcaguaaaucuuuu

SEQ ID NO: 2785561 - RNA, 14 nt, Human
ugcaguaaaucuuu

SEQ ID NO: 2785562 - RNA, 13 nt, Human
ugcaguaaaucuu

SEQ ID NO: 2785563 - RNA, 12 nt, Human
agccucaucucu

SEQ ID NO: 2785564 - RNA, 23 nt, Human
agccucagcauccuggcacccgg

SEQ ID NO: 2785565 - RNA, 22 nt, Human
agccucagcauccuggcacccg

SEQ ID NO: 2785566 - RNA, 18 nt, Human
agccuccaugcugccucc

SEQ ID NO: 2785567 - RNA, 20 nt, Human
agccuccaugcugccuccag

SEQ ID NO: 2785568 - RNA, 13 nt, Human
agccucccaaagu

SEQ ID NO: 2785569 - RNA, 14 nt, Human
agccucccaaagug

SEQ ID NO: 2785570 - RNA, 16 nt, Human
agccucccaaagugcu

SEQ ID NO: 2785571 - RNA, 15 nt, Human
agccuaggaccacuc

SEQ ID NO: 2785572 - RNA, 18 nt, Human
agccuaggaccacucagc

SEQ ID NO: 2785573 - RNA, 19 nt, Human
agccuaggaccacucagcc

SEQ ID NO: 2785574 - RNA, 20 nt, Human
agccuaggaccacucagccc

SEQ ID NO: 2785575 - RNA, 21 nt, Human
agccuaggaccacucagcccc

SEQ ID NO: 2785576 - RNA, 22 nt, Human
agccuaggaccacucagccccu

SEQ ID NO: 2785577 - RNA, 16 nt, Human
agccucagcauccugg

SEQ ID NO: 2785578 - RNA, 17 nt, Human
agccuagaagagcuucu

SEQ ID NO: 2785579 - RNA, 19 nt, Human
agccuagaagagcuucuga

SEQ ID NO: 2785580 - RNA, 14 nt, Human
agccuagaagcugg

SEQ ID NO: 2785581 - RNA, 18 nt, Human
agccuagaagcugguggc

SEQ ID NO: 2785582 - RNA, 17 nt, Human
agccuaccugcucucca

SEQ ID NO: 2785583 - RNA, 18 nt, Human
agccuagacccuccuccu

SEQ ID NO: 2785584 - RNA, 15 nt, Human
agccuagacccuccu

SEQ ID NO: 2785585 - RNA, 18 nt, Human
agccuagauaugaauaua

SEQ ID NO: 2785586 - RNA, 19 nt, Human
agccuagauaugaauauau

SEQ ID NO: 2785587 - RNA, 21 nt, Human
agccucagcauccuggcaccc

SEQ ID NO: 2785588 - RNA, 20 nt, Human
agccucagcauccuggcacc

SEQ ID NO: 2785589 - RNA, 19 nt, Human
agccucagcauccuggcac

SEQ ID NO: 2785590 - RNA, 17 nt, Human
agccucagcauccuggc

SEQ ID NO: 2785591 - RNA, 22 nt, Human
agccgacaacuauuucggccuu

SEQ ID NO: 2785592 - RNA, 23 nt, Human
agccgacugcacagcggccccug

SEQ ID NO: 2785593 - RNA, 16 nt, Human
agccuaccugcucucc

SEQ ID NO: 2785594 - RNA, 22 nt, Human
agccguggcuucccgcucagcc

SEQ ID NO: 2785595 - RNA, 23 nt, Human
agccguggcuucccgcucagccc

SEQ ID NO: 2785596 - RNA, 14 nt, Human
agccguggcuuccc

SEQ ID NO: 2785597 - RNA, 21 nt, Human
agccguggcuucccgcucagc

SEQ ID NO: 2785598 - RNA, 13 nt, Human
agccguggcuucc

SEQ ID NO: 2785599 - RNA, 14 nt, Human
ugcacucaaccuua

SEQ ID NO: 2785600 - RNA, 23 nt, Human
ugcacuauagccuaggugacaga

SEQ ID NO: 2785601 - RNA, 22 nt, Human
ugcacuauagccuaggugacag

SEQ ID NO: 2785602 - RNA, 15 nt, Human
ugcacuaugaggaau

SEQ ID NO: 2785603 - RNA, 15 nt, Human
agcccaucucggagc

SEQ ID NO: 2785604 - RNA, 18 nt, Human
agcccauccuucccuuug

SEQ ID NO: 2785605 - RNA, 11 nt, Human
agcccaugccc

SEQ ID NO: 2785606 - RNA, 17 nt, Human
agcccaugaguccuuga

SEQ ID NO: 2785607 - RNA, 20 nt, Human
agcccaugcccaccugccca

SEQ ID NO: 2785608 - RNA, 16 nt, Human
agcccaugcccaccug

SEQ ID NO: 2785609 - RNA, 22 nt, Human
agcccaugcccaccugcccauc

SEQ ID NO: 2785610 - RNA, 20 nt, Human
agcccaucccugccugguca

SEQ ID NO: 2785611 - RNA, 13 nt, Human
agcccaucccugc

SEQ ID NO: 2785612 - RNA, 15 nt, Human
agcccaucccugccu

SEQ ID NO: 2785613 - RNA, 17 nt, Human
agcccaucccugccugg

SEQ ID NO: 2785614 - RNA, 18 nt, Human
agcccaucccugccuggu

SEQ ID NO: 2785615 - RNA, 15 nt, Human
agcccauacucagcc

SEQ ID NO: 2785616 - RNA, 16 nt, Human
agcccauacucagccu

SEQ ID NO: 2785617 - RNA, 17 nt, Human
agcccauacucagccug

SEQ ID NO: 2785618 - RNA, 18 nt, Human
agcccauacucagccugc

SEQ ID NO: 2785619 - RNA, 19 nt, Human
agcccauacucagccugcu

SEQ ID NO: 2785620 - RNA, 20 nt, Human
agcccauacucagccugcug

SEQ ID NO: 2785621 - RNA, 16 nt, Human
agcccauccauaguaa

SEQ ID NO: 2785622 - RNA, 19 nt, Human
agcccauccauaguaacug

SEQ ID NO: 2785623 - RNA, 22 nt, Human
agcccauccauaguaacugaca

SEQ ID NO: 2785624 - RNA, 15 nt, Human
ugauucuccugccuc

SEQ ID NO: 2785625 - RNA, 19 nt, Human
ugauucuccugccucagcc

SEQ ID NO: 2785626 - RNA, 15 nt, Human
ugauucuaaugucuu

SEQ ID NO: 2785627 - RNA, 22 nt, Human
ugauucuauuuauauguacaug

SEQ ID NO: 2785628 - RNA, 11 nt, Human
ugauucucagg

SEQ ID NO: 2785629 - RNA, 12 nt, Human
ugauucucaggg

SEQ ID NO: 2785630 - RNA, 21 nt, Human
ugauucuauuuauauguacau

SEQ ID NO: 2785631 - RNA, 17 nt, Human
ugauucuaaugucuuca

SEQ ID NO: 2785632 - RNA, 19 nt, Human
ugauucuaaugucuucauu

SEQ ID NO: 2785633 - RNA, 20 nt, Human
ugauucuccugccucagccu

SEQ ID NO: 2785634 - RNA, 15 nt, Human
ugauucucagggucu

SEQ ID NO: 2785635 - RNA, 19 nt, Human
ugauucucagggucucugc

SEQ ID NO: 2785636 - RNA, 17 nt, Human
agcccaggugccagccu

SEQ ID NO: 2785637 - RNA, 22 nt, Human
agcccaggugccagccugaggc

SEQ ID NO: 2785638 - RNA, 14 nt, Human
agccccgcagaccu

SEQ ID NO: 2785639 - RNA, 16 nt, Human
agccccgcagaccucc

SEQ ID NO: 2785640 - RNA, 12 nt, Human
agccccuagaaa

SEQ ID NO: 2785641 - RNA, 16 nt, Human
agccccuagaaaccca

SEQ ID NO: 2785642 - RNA, 18 nt, Human
agccccuagaaacccaag

SEQ ID NO: 2785643 - RNA, 23 nt, Human
agccccuagaaacccaagcuccu

SEQ ID NO: 2785644 - RNA, 21 nt, Human
agccccuagcccaggagagag

SEQ ID NO: 2785645 - RNA, 22 nt, Human
agccccuagcccaggagagaga

SEQ ID NO: 2785646 - RNA, 23 nt, Human
agccccuagcccaggagagagaa

SEQ ID NO: 2785647 - RNA, 11 nt, Human
agccccuagga

SEQ ID NO: 2785648 - RNA, 13 nt, Human
agccccuccaucu

SEQ ID NO: 2785649 - RNA, 16 nt, Human
agccccuccaucugua

SEQ ID NO: 2785650 - RNA, 10 nt, Human
agccccuccc

SEQ ID NO: 2785651 - RNA, 13 nt, Human
agccccucccaag

SEQ ID NO: 2785652 - RNA, 16 nt, Human
agccccucccaagcug

SEQ ID NO: 2785653 - RNA, 19 nt, Human
agccccucccaagcuggcu

SEQ ID NO: 2785654 - RNA, 20 nt, Human
agccccucccaagcuggcug

SEQ ID NO: 2785655 - RNA, 21 nt, Human
agccccucccaagcuggcugg

SEQ ID NO: 2785656 - RNA, 22 nt, Human
agccccucccaagcuggcuggg

SEQ ID NO: 2785657 - RNA, 18 nt, Human
agccccgcagaccucccc

SEQ ID NO: 2785658 - RNA, 12 nt, Human
agccccuagccc

SEQ ID NO: 2785659 - RNA, 14 nt, Human
agccccuagcccag

SEQ ID NO: 2785660 - RNA, 15 nt, Human
agccccuagcccagg

SEQ ID NO: 2785661 - RNA, 16 nt, Human
agccccuagcccagga

SEQ ID NO: 2785662 - RNA, 18 nt, Human
agccccuagcccaggaga

SEQ ID NO: 2785663 - RNA, 19 nt, Human
agccccuagcccaggagag

SEQ ID NO: 2785664 - RNA, 23 nt, Human
agccccauucugccugcccaggc

SEQ ID NO: 2785665 - RNA, 15 nt, Human
agcccccagccccuc

SEQ ID NO: 2785666 - RNA, 17 nt, Human
agcccccagccccuccc

SEQ ID NO: 2785667 - RNA, 18 nt, Human
agcccccagccccucccc

SEQ ID NO: 2785668 - RNA, 16 nt, Human
agccccgaggccuucu

SEQ ID NO: 2785669 - RNA, 22 nt, Human
agccccgaggccuucucugaag

SEQ ID NO: 2785670 - RNA, 17 nt, Human
agccccgaggccuucuc

SEQ ID NO: 2785671 - RNA, 14 nt, Human
ugcacacccacuca

SEQ ID NO: 2785672 - RNA, 17 nt, Human
ugcacacccacucagcu

SEQ ID NO: 2785673 - RNA, 16 nt, Human
ugcacacccacucagc

SEQ ID NO: 2785674 - RNA, 18 nt, Human
ugcacacccacucagcuc

SEQ ID NO: 2785675 - RNA, 15 nt, Human
ugcacccagaagaag

SEQ ID NO: 2785676 - RNA, 14 nt, Human
ugcacccagcccag

SEQ ID NO: 2785677 - RNA, 16 nt, Human
ugcacccagcccagau

SEQ ID NO: 2785678 - RNA, 15 nt, Human
ugcacccacugaaag

SEQ ID NO: 2785679 - RNA, 15 nt, Human
ugcacgugugugcac

SEQ ID NO: 2785680 - RNA, 14 nt, Human
ugcacgugugugca

SEQ ID NO: 2785681 - RNA, 14 nt, Human
ugcacccuccgccu

SEQ ID NO: 2785682 - RNA, 16 nt, Human
ugcacccuccgccuuc

SEQ ID NO: 2785683 - RNA, 18 nt, Human
ugcacccaugggcucuga

SEQ ID NO: 2785684 - RNA, 20 nt, Human
ugcacccaugggcucugaca

SEQ ID NO: 2785685 - RNA, 21 nt, Human
ugcacccaugggcucugacag

SEQ ID NO: 2785686 - RNA, 22 nt, Human
ugcacccaggaggggaacacug

SEQ ID NO: 2785687 - RNA, 15 nt, Human
ugcacccaugggcuc

SEQ ID NO: 2785688 - RNA, 21 nt, Human
agcccugguggcagugggagc

SEQ ID NO: 2785689 - RNA, 22 nt, Human
agcccugcuuugggcugcccug

SEQ ID NO: 2785690 - RNA, 23 nt, Human
agcccugcuuugggcugcccugg

SEQ ID NO: 2785691 - RNA, 20 nt, Human
agcccugcuuugggcugccc

SEQ ID NO: 2785692 - RNA, 12 nt, Human
agcccuggagac

SEQ ID NO: 2785693 - RNA, 20 nt, Human
agccccuugcucuccccugc

SEQ ID NO: 2785694 - RNA, 21 nt, Human
agcccugcuuugggcugcccu

SEQ ID NO: 2785695 - RNA, 22 nt, Human
ugcacacaccagagcccaccuu

SEQ ID NO: 2785696 - RNA, 12 nt, Human
ugcacaaggauu

SEQ ID NO: 2785697 - RNA, 15 nt, Human
ugcacaaggauugaa

SEQ ID NO: 2785698 - RNA, 17 nt, Human
ugcacaaggauugaaaa

SEQ ID NO: 2785699 - RNA, 16 nt, Human
ugcacacagaaauaua

SEQ ID NO: 2785700 - RNA, 17 nt, Human
ugcacacagaaauauau

SEQ ID NO: 2785701 - RNA, 18 nt, Human
ugcacacagaaauauaua

SEQ ID NO: 2785702 - RNA, 19 nt, Human
ugcacacagaaauauauau

SEQ ID NO: 2785703 - RNA, 20 nt, Human
ugcacacagaaauauauaua

SEQ ID NO: 2785704 - RNA, 22 nt, Human
ugcacacagaaauauauauaca

SEQ ID NO: 2785705 - RNA, 23 nt, Human
ugcacacagaaauauauauacau

SEQ ID NO: 2785706 - RNA, 24 nt, Human
ugcacacagcacgggggccaagga

SEQ ID NO: 2785707 - RNA, 12 nt, Human
ugcacacagcac

SEQ ID NO: 2785708 - RNA, 23 nt, Human
agcccugguggcagugggagcug

SEQ ID NO: 2785709 - RNA, 22 nt, Human
agcccugguggcagugggagcu

SEQ ID NO: 2785710 - RNA, 14 nt, Human
agcuacuugguuug

SEQ ID NO: 2785711 - RNA, 16 nt, Human
agcuacuugguuugug

SEQ ID NO: 2785712 - RNA, 17 nt, Human
agcuacuugguuugugu

SEQ ID NO: 2785713 - RNA, 21 nt, Human
agcuacuugguuuguguucuu

SEQ ID NO: 2785714 - RNA, 17 nt, Human
agcuagaaaacauuuuu

SEQ ID NO: 2785715 - RNA, 15 nt, Human
agcuagcuuuuagga

SEQ ID NO: 2785716 - RNA, 16 nt, Human
agcuagcuuuuaggaa

SEQ ID NO: 2785717 - RNA, 20 nt, Human
agcuagcuuuuaggaaaauc

SEQ ID NO: 2785718 - RNA, 13 nt, Human
agcuagaugcuuu

SEQ ID NO: 2785719 - RNA, 17 nt, Human
agcuagaugcuuuccua

SEQ ID NO: 2785720 - RNA, 18 nt, Human
ugccagaagauccccuca

SEQ ID NO: 2785721 - RNA, 21 nt, Human
ugccagaagauccccucagga

SEQ ID NO: 2785722 - RNA, 22 nt, Human
ugccagaaguuguggauuucag

SEQ ID NO: 2785723 - RNA, 17 nt, Human
ugccagaauuuuaggaa

SEQ ID NO: 2785724 - RNA, 12 nt, Human
ugccacuuuuua

SEQ ID NO: 2785725 - RNA, 22 nt, Human
ugccacacuucaggcucuucuc

SEQ ID NO: 2785726 - RNA, 23 nt, Human
ugccacacuucaggcucuucucc

SEQ ID NO: 2785727 - RNA, 23 nt, Human
ugccacuuugguacauggccagu

SEQ ID NO: 2785728 - RNA, 13 nt, Human
ugccacuuugcac

SEQ ID NO: 2785729 - RNA, 15 nt, Human
ugccacuuugcacau

SEQ ID NO: 2785730 - RNA, 19 nt, Human
ugccacuuugcacauuuug

SEQ ID NO: 2785731 - RNA, 20 nt, Human
ugccacuuugcacauuuuga

SEQ ID NO: 2785732 - RNA, 21 nt, Human
ugccacuuugcacauuuugau

SEQ ID NO: 2785733 - RNA, 12 nt, Human
ugccacuuugca

SEQ ID NO: 2785734 - RNA, 16 nt, Human
agcgggguaugaagag

SEQ ID NO: 2785735 - RNA, 20 nt, Human
ugccagaagauccccucagg

SEQ ID NO: 2785736 - RNA, 15 nt, Human
ugccagagauaaacu

SEQ ID NO: 2785737 - RNA, 17 nt, Human
ugccagagauaaacuaa

SEQ ID NO: 2785738 - RNA, 13 nt, Human
agcggucucaggc

SEQ ID NO: 2785739 - RNA, 22 nt, Human
agcggucucaggcuggugggag

SEQ ID NO: 2785740 - RNA, 14 nt, Human
agcgguugccagga

SEQ ID NO: 2785741 - RNA, 15 nt, Human
agcgguggcccuguc

SEQ ID NO: 2785742 - RNA, 23 nt, Human
agcggucucaggcuggugggagg

SEQ ID NO: 2785743 - RNA, 12 nt, Human
agcgguggcccu

SEQ ID NO: 2785744 - RNA, 21 nt, Human
agcgguggcccugucccuccc

SEQ ID NO: 2785745 - RNA, 20 nt, Human
agcggugggggaggaggguu

SEQ ID NO: 2785746 - RNA, 22 nt, Human
agcgugagccacugcaccgggc

SEQ ID NO: 2785747 - RNA, 19 nt, Human
agcgugagccacugcaccg

SEQ ID NO: 2785748 - RNA, 13 nt, Human
agcguaaaauggu

SEQ ID NO: 2785749 - RNA, 16 nt, Human
agcguaaaauggugaa

SEQ ID NO: 2785750 - RNA, 22 nt, Human
agcuacguggcacuauauucug

SEQ ID NO: 2785751 - RNA, 14 nt, Human
agcuaccucaacca

SEQ ID NO: 2785752 - RNA, 23 nt, Human
agcuaccucaaccaaugccaaaa

SEQ ID NO: 2785753 - RNA, 20 nt, Human
agcuacccuuuuucuccagc

SEQ ID NO: 2785754 - RNA, 21 nt, Human
agcuacccuuuuucuccagcu

SEQ ID NO: 2785755 - RNA, 21 nt, Human
agcucaggugucccugcacuu

SEQ ID NO: 2785756 - RNA, 20 nt, Human
agcucaggugucccugcacu

SEQ ID NO: 2785757 - RNA, 22 nt, Human
agcucaggugucccugcacuug

SEQ ID NO: 2785758 - RNA, 21 nt, Human
agcucagucccaucagagagc

SEQ ID NO: 2785759 - RNA, 13 nt, Human
agcucagucccau

SEQ ID NO: 2785760 - RNA, 18 nt, Human
agcucaggugucccugca

SEQ ID NO: 2785761 - RNA, 22 nt, Human
agcucagcuuuuugucuuuucu

SEQ ID NO: 2785762 - RNA, 20 nt, Human
agcucagcuuuuugucuuuu

SEQ ID NO: 2785763 - RNA, 15 nt, Human
agcuaggccuggcca

SEQ ID NO: 2785764 - RNA, 14 nt, Human
agcuaggccuggcc

SEQ ID NO: 2785765 - RNA, 16 nt, Human
agcuaggccuggccag

SEQ ID NO: 2785766 - RNA, 21 nt, Human
agcucagcuacugauuuuugu

SEQ ID NO: 2785767 - RNA, 12 nt, Human
agcucagcgcca

SEQ ID NO: 2785768 - RNA, 17 nt, Human
agcucagcgccagccug

SEQ ID NO: 2785769 - RNA, 20 nt, Human
agcuaggauuugaacacuug

SEQ ID NO: 2785770 - RNA, 23 nt, Human
agcuaggauuugaacacuuggug

SEQ ID NO: 2785771 - RNA, 12 nt, Human
agcuaggccugg

SEQ ID NO: 2785772 - RNA, 13 nt, Human
agcuaggaaugaa

SEQ ID NO: 2785773 - RNA, 12 nt, Human
agcuaggaauga

SEQ ID NO: 2785774 - RNA, 20 nt, Human
ugcccagcccggaccuuggc

SEQ ID NO: 2785775 - RNA, 16 nt, Human
ugcccacaggaucagu

SEQ ID NO: 2785776 - RNA, 19 nt, Human
ugcccacaggaucagucug

SEQ ID NO: 2785777 - RNA, 20 nt, Human
ugcccacaggaucagucuga

SEQ ID NO: 2785778 - RNA, 14 nt, Human
agcucauucauuuu

SEQ ID NO: 2785779 - RNA, 16 nt, Human
agcucauucauuuuau

SEQ ID NO: 2785780 - RNA, 17 nt, Human
agcucauucauuuuaua

SEQ ID NO: 2785781 - RNA, 22 nt, Human
agcucauucauuuuauauugaa

SEQ ID NO: 2785782 - RNA, 18 nt, Human
agcucauauuuuguauau

SEQ ID NO: 2785783 - RNA, 20 nt, Human
agcucauagaguccccccuc

SEQ ID NO: 2785784 - RNA, 14 nt, Human
agcucaucucuguc

SEQ ID NO: 2785785 - RNA, 14 nt, Human
agcucauauuuugu

SEQ ID NO: 2785786 - RNA, 15 nt, Human
agcucauauuuugua

SEQ ID NO: 2785787 - RNA, 22 nt, Human
ugcccaagaauagaugcugacu

SEQ ID NO: 2785788 - RNA, 23 nt, Human
ugcccaagaauagaugcugacug

SEQ ID NO: 2785789 - RNA, 21 nt, Human
ugcccaagaauagaugcugac

SEQ ID NO: 2785790 - RNA, 17 nt, Human
agcucauuucaugcucu

SEQ ID NO: 2785791 - RNA, 10 nt, Human
agccuugugu

SEQ ID NO: 2785792 - RNA, 13 nt, Human
agccuuguguaua

SEQ ID NO: 2785793 - RNA, 14 nt, Human
agccuuguguauau

SEQ ID NO: 2785794 - RNA, 19 nt, Human
agccuuguguauauuugua

SEQ ID NO: 2785795 - RNA, 20 nt, Human
agccuuguguauauuuguau

SEQ ID NO: 2785796 - RNA, 22 nt, Human
agccuuguguauauuuguauau

SEQ ID NO: 2785797 - RNA, 24 nt, Human
agccuuguguauauuuguauauua

SEQ ID NO: 2785798 - RNA, 11 nt, Human
agcgccuggcc

SEQ ID NO: 2785799 - RNA, 13 nt, Human
agcgccuggccua

SEQ ID NO: 2785800 - RNA, 15 nt, Human
agcgccugugcacac

SEQ ID NO: 2785801 - RNA, 16 nt, Human
agcgccugugcacaca

SEQ ID NO: 2785802 - RNA, 17 nt, Human
agcgccugugcacacac

SEQ ID NO: 2785803 - RNA, 18 nt, Human
agcggagacggaguccca

SEQ ID NO: 2785804 - RNA, 15 nt, Human
agcggaggcugugug

SEQ ID NO: 2785805 - RNA, 16 nt, Human
agcggaggcugugugc

SEQ ID NO: 2785806 - RNA, 19 nt, Human
agcggacaucagcugguca

SEQ ID NO: 2785807 - RNA, 20 nt, Human
agcggacuccuccuuucucc

SEQ ID NO: 2785808 - RNA, 18 nt, Human
ugccaauacuagucaccc

SEQ ID NO: 2785809 - RNA, 21 nt, Human
ugccaauacuagucaccccaa

SEQ ID NO: 2785810 - RNA, 15 nt, Human
ugccaauuagcaauu

SEQ ID NO: 2785811 - RNA, 21 nt, Human
ugccaauuauuguuacacauu

SEQ ID NO: 2785812 - RNA, 22 nt, Human
ugccaauaauaauaccucccuu

SEQ ID NO: 2785813 - RNA, 21 nt, Human
ugccaauaauaauaccucccu

SEQ ID NO: 2785814 - RNA, 13 nt, Human
ugccacacuucag

SEQ ID NO: 2785815 - RNA, 14 nt, Human
ugccacacuucagg

SEQ ID NO: 2785816 - RNA, 15 nt, Human
ugccacacuucaggc

SEQ ID NO: 2785817 - RNA, 16 nt, Human
ugccacacuucaggcu

SEQ ID NO: 2785818 - RNA, 19 nt, Human
ugccaauuuuugccuucau

SEQ ID NO: 2785819 - RNA, 17 nt, Human
ugccaauuuuugccuuc

SEQ ID NO: 2785820 - RNA, 18 nt, Human
ugccaauuuuugccuuca

SEQ ID NO: 2785821 - RNA, 21 nt, Human
ugccaauuuuugccuucauua

SEQ ID NO: 2785822 - RNA, 17 nt, Human
ugccacaaccagccagg

SEQ ID NO: 2785823 - RNA, 18 nt, Human
ugccacaacgccuggcua

SEQ ID NO: 2785824 - RNA, 19 nt, Human
ugccacaacgccuggcuaa

SEQ ID NO: 2785825 - RNA, 23 nt, Human
agcggagguugcagggagccgag

SEQ ID NO: 2785826 - RNA, 22 nt, Human
ugcauugaacacaaacuguaaa

SEQ ID NO: 2785827 - RNA, 23 nt, Human
ugcauugaacacaaacuguaaau

SEQ ID NO: 2785828 - RNA, 14 nt, Human
ugcauugacauuau

SEQ ID NO: 2785829 - RNA, 15 nt, Human
ugcauugcuagauaa

SEQ ID NO: 2785830 - RNA, 16 nt, Human
ugcauugcuagauaaa

SEQ ID NO: 2785831 - RNA, 17 nt, Human
ugcauugcuagauaaaa

SEQ ID NO: 2785832 - RNA, 18 nt, Human
ugcauugcuagauaaaag

SEQ ID NO: 2785833 - RNA, 13 nt, Human
ugcauugauauug

SEQ ID NO: 2785834 - RNA, 17 nt, Human
ugcauugauauugugaa

SEQ ID NO: 2785835 - RNA, 18 nt, Human
ugcauugauauugugaac

SEQ ID NO: 2785836 - RNA, 22 nt, Human
ugcauugauauugugaacauuu

SEQ ID NO: 2785837 - RNA, 17 nt, Human
ugcauugauucaguauu

SEQ ID NO: 2785838 - RNA, 20 nt, Human
ugcauugcccagucuuucau

SEQ ID NO: 2785839 - RNA, 20 nt, Human
ugcauugaccgcgacuaauu

SEQ ID NO: 2785840 - RNA, 22 nt, Human
ugcauugaccgcgacuaauuuc

SEQ ID NO: 2785841 - RNA, 14 nt, Human
ugcauugacuuuca

SEQ ID NO: 2785842 - RNA, 21 nt, Human
ugcauugacuuucaguaaaca

SEQ ID NO: 2785843 - RNA, 15 nt, Human
agccuguggaugauc

SEQ ID NO: 2785844 - RNA, 16 nt, Human
agccuguggaugauca

SEQ ID NO: 2785845 - RNA, 20 nt, Human
agccuguggaugaucaaucc

SEQ ID NO: 2785846 - RNA, 23 nt, Human
agccuguggaugaucaauccuuu

SEQ ID NO: 2785847 - RNA, 22 nt, Human
agccuguggcaucuuugccuug

SEQ ID NO: 2785848 - RNA, 13 nt, Human
agccuguggcccu

SEQ ID NO: 2785849 - RNA, 14 nt, Human
agccuguggcccug

SEQ ID NO: 2785850 - RNA, 15 nt, Human
agccuguggcccugu

SEQ ID NO: 2785851 - RNA, 19 nt, Human
agccuguggcccuguccug

SEQ ID NO: 2785852 - RNA, 13 nt, Human
agccuguggccuu

SEQ ID NO: 2785853 - RNA, 17 nt, Human
agccuguggccuuugca

SEQ ID NO: 2785854 - RNA, 14 nt, Human
agccuguggcaucu

SEQ ID NO: 2785855 - RNA, 11 nt, Human
agccuguggca

SEQ ID NO: 2785856 - RNA, 11 nt, Human
agccuguggcu

SEQ ID NO: 2785857 - RNA, 14 nt, Human
agccuguggcugug

SEQ ID NO: 2785858 - RNA, 15 nt, Human
agccuguggcugugg

SEQ ID NO: 2785859 - RNA, 16 nt, Human
agccuguggcugugga

SEQ ID NO: 2785860 - RNA, 18 nt, Human
agccuguggcuguggaga

SEQ ID NO: 2785861 - RNA, 22 nt, Human
agccuguggcuguggagacaau

SEQ ID NO: 2785862 - RNA, 23 nt, Human
agccuguggcuguggagacaaug

SEQ ID NO: 2785863 - RNA, 21 nt, Human
agccuguggcaucuuugccuu

SEQ ID NO: 2785864 - RNA, 20 nt, Human
agccugguaggaaagggcaa

SEQ ID NO: 2785865 - RNA, 21 nt, Human
agccugguaggaaagggcaag

SEQ ID NO: 2785866 - RNA, 11 nt, Human
agccuggugcc

SEQ ID NO: 2785867 - RNA, 22 nt, Human
agccuuagaagucacacaguau

SEQ ID NO: 2785868 - RNA, 14 nt, Human
agccuucagcucca

SEQ ID NO: 2785869 - RNA, 23 nt, Human
agccuucagucuugaauuucuaa

SEQ ID NO: 2785870 - RNA, 22 nt, Human
agccuuagggaagcuggccuga

SEQ ID NO: 2785871 - RNA, 20 nt, Human
agccuuagggaagcuggccu

SEQ ID NO: 2785872 - RNA, 15 nt, Human
agccuuagggaagcu

SEQ ID NO: 2785873 - RNA, 14 nt, Human
agccuuagggaagc

SEQ ID NO: 2785874 - RNA, 22 nt, Human
agccuguugggaucgcauugca

SEQ ID NO: 2785875 - RNA, 18 nt, Human
ugcauaccaaccugggca

SEQ ID NO: 2785876 - RNA, 14 nt, Human
ugcauaccaaccug

SEQ ID NO: 2785877 - RNA, 12 nt, Human
ugcauaccaacc

SEQ ID NO: 2785878 - RNA, 14 nt, Human
ugcauaagugaaaa

SEQ ID NO: 2785879 - RNA, 18 nt, Human
ugcauaagugaaaaucuu

SEQ ID NO: 2785880 - RNA, 22 nt, Human
ugcauaagugaaaaucuuacaa

SEQ ID NO: 2785881 - RNA, 15 nt, Human
ugcauacagaaauau

SEQ ID NO: 2785882 - RNA, 14 nt, Human
agccugggugacaa

SEQ ID NO: 2785883 - RNA, 19 nt, Human
agccugggugacaaagcga

SEQ ID NO: 2785884 - RNA, 14 nt, Human
uggagaacuagaga

SEQ ID NO: 2785885 - RNA, 15 nt, Human
uggacuuuggaagca

SEQ ID NO: 2785886 - RNA, 19 nt, Human
uggagaaauuauuuaauaa

SEQ ID NO: 2785887 - RNA, 21 nt, Human
uggagaaauuauuuaauaaaa

SEQ ID NO: 2785888 - RNA, 12 nt, Human
uggacuuucaaa

SEQ ID NO: 2785889 - RNA, 16 nt, Human
uggacuuucaaaauua

SEQ ID NO: 2785890 - RNA, 23 nt, Human
uggacuuucaaaauuaaaucugu

SEQ ID NO: 2785891 - RNA, 17 nt, Human
uggacuugagcuuggca

SEQ ID NO: 2785892 - RNA, 22 nt, Human
uggagcccaggcgggagcggug

SEQ ID NO: 2785893 - RNA, 16 nt, Human
uggagcccaggcggga

SEQ ID NO: 2785894 - RNA, 18 nt, Human
uggagcccaggcgggagc

SEQ ID NO: 2785895 - RNA, 22 nt, Human
aggcacccaccaucaugucugg

SEQ ID NO: 2785896 - RNA, 21 nt, Human
aggcacccaccaucaugucug

SEQ ID NO: 2785897 - RNA, 20 nt, Human
aggcacccaccaucaugucu

SEQ ID NO: 2785898 - RNA, 14 nt, Human
aggcaaugcuggcu

SEQ ID NO: 2785899 - RNA, 15 nt, Human
aggcacccaccauca

SEQ ID NO: 2785900 - RNA, 17 nt, Human
aggcaccgcugaugggg

SEQ ID NO: 2785901 - RNA, 17 nt, Human
aggcaccuagcaauucc

SEQ ID NO: 2785902 - RNA, 20 nt, Human
aggcaccuaccaccacgccc

SEQ ID NO: 2785903 - RNA, 18 nt, Human
aggcaaguuaagagaaac

SEQ ID NO: 2785904 - RNA, 19 nt, Human
aggcaaguuaagagaaacu

SEQ ID NO: 2785905 - RNA, 20 nt, Human
aggcaaguuaagagaaacuu

SEQ ID NO: 2785906 - RNA, 23 nt, Human
uggagcggaauuuaccugauuuc

SEQ ID NO: 2785907 - RNA, 18 nt, Human
uggagcgggguaugaaga

SEQ ID NO: 2785908 - RNA, 22 nt, Human
uggagcgcaccugcccccuggu

SEQ ID NO: 2785909 - RNA, 21 nt, Human
uggagcgcaccugcccccugg

SEQ ID NO: 2785910 - RNA, 18 nt, Human
uggagcucagagagggca

SEQ ID NO: 2785911 - RNA, 12 nt, Human
uggagcucagcc

SEQ ID NO: 2785912 - RNA, 13 nt, Human
uggagcucagccc

SEQ ID NO: 2785913 - RNA, 22 nt, Human
uggagcucagccccgagcuguc

SEQ ID NO: 2785914 - RNA, 16 nt, Human
uggagcgcaccugccc

SEQ ID NO: 2785915 - RNA, 14 nt, Human
uggagcgcaccugc

SEQ ID NO: 2785916 - RNA, 20 nt, Human
uggagccuuuuaacugugca

SEQ ID NO: 2785917 - RNA, 23 nt, Human
uggagcgagcaucccccaaaguu

SEQ ID NO: 2785918 - RNA, 15 nt, Human
uggagcccuccgccu

SEQ ID NO: 2785919 - RNA, 17 nt, Human
uggagcccuccgccuuc

SEQ ID NO: 2785920 - RNA, 19 nt, Human
uggagcccuccgccuucac

SEQ ID NO: 2785921 - RNA, 20 nt, Human
uggaccuugaacuggguacu

SEQ ID NO: 2785922 - RNA, 16 nt, Human
uggaccugccuccugc

SEQ ID NO: 2785923 - RNA, 17 nt, Human
uggaccugccuccugcc

SEQ ID NO: 2785924 - RNA, 18 nt, Human
uggaccugccuccugccu

SEQ ID NO: 2785925 - RNA, 19 nt, Human
uggaccugccuccugccug

SEQ ID NO: 2785926 - RNA, 22 nt, Human
uggaccuuacgaucaggcacag

SEQ ID NO: 2785927 - RNA, 20 nt, Human
uggaccugccuccugccugc

SEQ ID NO: 2785928 - RNA, 15 nt, Human
uggaccuuaggccuu

SEQ ID NO: 2785929 - RNA, 16 nt, Human
uggaccuuaggccuuc

SEQ ID NO: 2785930 - RNA, 17 nt, Human
uggaccuuaggccuucc

SEQ ID NO: 2785931 - RNA, 19 nt, Human
uggaccuuaggccuuccuc

SEQ ID NO: 2785932 - RNA, 21 nt, Human
uggaccuuaggccuuccucuc

SEQ ID NO: 2785933 - RNA, 15 nt, Human
uggacacagggugac

SEQ ID NO: 2785934 - RNA, 23 nt, Human
uggacacagcucuucuccaggcu

SEQ ID NO: 2785935 - RNA, 14 nt, Human
uggacacagcucuu

SEQ ID NO: 2785936 - RNA, 13 nt, Human
uggacacagcucu

SEQ ID NO: 2785937 - RNA, 22 nt, Human
uggacacagcucuucuccaggc

SEQ ID NO: 2785938 - RNA, 21 nt, Human
uggacacagcucuucuccagg

SEQ ID NO: 2785939 - RNA, 17 nt, Human
uggacacacaaggugca

SEQ ID NO: 2785940 - RNA, 13 nt, Human
uggaauucuuccu

SEQ ID NO: 2785941 - RNA, 12 nt, Human
uggaauugauuu

SEQ ID NO: 2785942 - RNA, 14 nt, Human
uggaagauucagcu

SEQ ID NO: 2785943 - RNA, 19 nt, Human
uggaauuccauuugaggau

SEQ ID NO: 2785944 - RNA, 18 nt, Human
uggaauugauuugcauug

SEQ ID NO: 2785945 - RNA, 17 nt, Human
uggaauugauuugcauu

SEQ ID NO: 2785946 - RNA, 16 nt, Human
uggaauugauuugcau

SEQ ID NO: 2785947 - RNA, 15 nt, Human
uggaauugauuugca

SEQ ID NO: 2785948 - RNA, 16 nt, Human
uggacaaucaugaaau

SEQ ID NO: 2785949 - RNA, 22 nt, Human
uggaauugauuugcauugaaca

SEQ ID NO: 2785950 - RNA, 22 nt, Human
uggacaagcagagguggccaga

SEQ ID NO: 2785951 - RNA, 20 nt, Human
uggaauugauuugcauugaa

SEQ ID NO: 2785952 - RNA, 19 nt, Human
uggaauugauuugcauuga

SEQ ID NO: 2785953 - RNA, 20 nt, Human
aggcaaaauugcaaaucuug

SEQ ID NO: 2785954 - RNA, 19 nt, Human
aggcaaaauugcaaaucuu

SEQ ID NO: 2785955 - RNA, 14 nt, Human
aggcaaagcuggcu

SEQ ID NO: 2785956 - RNA, 17 nt, Human
aggcaaaauugcaaauc

SEQ ID NO: 2785957 - RNA, 13 nt, Human
aggcaaaugugua

SEQ ID NO: 2785958 - RNA, 14 nt, Human
aggcaaaugcccaa

SEQ ID NO: 2785959 - RNA, 15 nt, Human
aggcaaaugcccaag

SEQ ID NO: 2785960 - RNA, 13 nt, Human
uggaaaggcucag

SEQ ID NO: 2785961 - RNA, 23 nt, Human
uggaaaggcucagucucaggagc

SEQ ID NO: 2785962 - RNA, 21 nt, Human
uggaaaggcucagucucagga

SEQ ID NO: 2785963 - RNA, 20 nt, Human
uggaaaggcucagucucagg

SEQ ID NO: 2785964 - RNA, 17 nt, Human
uggaaaggcucagucuc

SEQ ID NO: 2785965 - RNA, 19 nt, Human
uggaaaguaacucauuugu

SEQ ID NO: 2785966 - RNA, 17 nt, Human
ugcuuuuggucugugug

SEQ ID NO: 2785967 - RNA, 14 nt, Human
ugcuuuuggucugu

SEQ ID NO: 2785968 - RNA, 13 nt, Human
ugcuuuuggccug

SEQ ID NO: 2785969 - RNA, 12 nt, Human
ugcuuguaccuc

SEQ ID NO: 2785970 - RNA, 14 nt, Human
ugcuuguaccucug

SEQ ID NO: 2785971 - RNA, 18 nt, Human
ugcuuguaccucuggcug

SEQ ID NO: 2785972 - RNA, 22 nt, Human
ugcuuguaccucuggcugacua

SEQ ID NO: 2785973 - RNA, 21 nt, Human
ugcuuugucuggaagaaagau

SEQ ID NO: 2785974 - RNA, 19 nt, Human
ugcuugcuuucuuuuuuaa

SEQ ID NO: 2785975 - RNA, 21 nt, Human
ugcuugauaggaauucaucuu

SEQ ID NO: 2785976 - RNA, 16 nt, Human
ugcuugauauuuucua

SEQ ID NO: 2785977 - RNA, 14 nt, Human
ugcuugaugaagca

SEQ ID NO: 2785978 - RNA, 17 nt, Human
ugcuugaugaagcaagg

SEQ ID NO: 2785979 - RNA, 18 nt, Human
ugcuugaugaagcaagga

SEQ ID NO: 2785980 - RNA, 19 nt, Human
ugcuugaugaagcaaggaa

SEQ ID NO: 2785981 - RNA, 20 nt, Human
ugcuugaugaagcaaggaag

SEQ ID NO: 2785982 - RNA, 22 nt, Human
aggacagugcuucagccugagg

SEQ ID NO: 2785983 - RNA, 21 nt, Human
aggacagugcuucagccugag

SEQ ID NO: 2785984 - RNA, 20 nt, Human
aggacagugcuucagccuga

SEQ ID NO: 2785985 - RNA, 19 nt, Human
aggacagugcuucagccug

SEQ ID NO: 2785986 - RNA, 18 nt, Human
aggacagugcuucagccu

SEQ ID NO: 2785987 - RNA, 17 nt, Human
aggacagugcuucagcc

SEQ ID NO: 2785988 - RNA, 16 nt, Human
aggacagugcuucagc

SEQ ID NO: 2785989 - RNA, 15 nt, Human
aggacagugcuucag

SEQ ID NO: 2785990 - RNA, 20 nt, Human
ugcuuuugaaggaauacaau

SEQ ID NO: 2785991 - RNA, 14 nt, Human
uggaaauauuuuga

SEQ ID NO: 2785992 - RNA, 17 nt, Human
uggaaauauuuugauaa

SEQ ID NO: 2785993 - RNA, 21 nt, Human
uggaaauauuuugauaauaaa

SEQ ID NO: 2785994 - RNA, 18 nt, Human
uggaaaucaucgaaaauu

SEQ ID NO: 2785995 - RNA, 19 nt, Human
uggaaauccuaguuuccuc

SEQ ID NO: 2785996 - RNA, 22 nt, Human
uggaaauccuaguuuccucucc

SEQ ID NO: 2785997 - RNA, 17 nt, Human
uggaaauggaugcaaag

SEQ ID NO: 2785998 - RNA, 19 nt, Human
uggaaauggaugcaaagua

SEQ ID NO: 2785999 - RNA, 16 nt, Human
uggaagcacagcuuca

SEQ ID NO: 2786000 - RNA, 18 nt, Human
uggaagcaacaggaauca

SEQ ID NO: 2786001 - RNA, 17 nt, Human
uggaagauuuucagucu

SEQ ID NO: 2786002 - RNA, 14 nt, Human
uggaagcaaaguau

SEQ ID NO: 2786003 - RNA, 19 nt, Human
uggaagauaguuuucuccu

SEQ ID NO: 2786004 - RNA, 16 nt, Human
uggaagagugugugug

SEQ ID NO: 2786005 - RNA, 14 nt, Human
uggaagauccugug

SEQ ID NO: 2786006 - RNA, 15 nt, Human
uggaagauccuguga

SEQ ID NO: 2786007 - RNA, 17 nt, Human
uggaagauccugugagg

SEQ ID NO: 2786008 - RNA, 18 nt, Human
uggaagauccugugagga

SEQ ID NO: 2786009 - RNA, 15 nt, Human
uggaaggguuugugg

SEQ ID NO: 2786010 - RNA, 18 nt, Human
uggaaggguucuggcugc

SEQ ID NO: 2786011 - RNA, 19 nt, Human
uggaaggguucuggcugcc

SEQ ID NO: 2786012 - RNA, 23 nt, Human
uggaaggggacacgugacagccg

SEQ ID NO: 2786013 - RNA, 20 nt, Human
uggaaguaaccauuugcacu

SEQ ID NO: 2786014 - RNA, 13 nt, Human
uggaaggugggga

SEQ ID NO: 2786015 - RNA, 17 nt, Human
uggaaggguuuguggcu

SEQ ID NO: 2786016 - RNA, 16 nt, Human
aggagcuaaggcucua

SEQ ID NO: 2786017 - RNA, 17 nt, Human
aggagcuaaggcucuau

SEQ ID NO: 2786018 - RNA, 19 nt, Human
aggagcuaaggcucuauga

SEQ ID NO: 2786019 - RNA, 20 nt, Human
aggagcuaaggcucuaugag

SEQ ID NO: 2786020 - RNA, 18 nt, Human
uggaagcuuguuuuccag

SEQ ID NO: 2786021 - RNA, 20 nt, Human
uggaagcuuguuuuccaguc

SEQ ID NO: 2786022 - RNA, 17 nt, Human
uggaagcuuuguccccu

SEQ ID NO: 2786023 - RNA, 18 nt, Human
uggaagcuuuguccccug

SEQ ID NO: 2786024 - RNA, 19 nt, Human
uggaagcuuuguccccugc

SEQ ID NO: 2786025 - RNA, 15 nt, Human
uggaaggagacacag

SEQ ID NO: 2786026 - RNA, 16 nt, Human
uggaaggagacacaga

SEQ ID NO: 2786027 - RNA, 17 nt, Human
uggaaggagacacagau

SEQ ID NO: 2786028 - RNA, 19 nt, Human
uggaaggagacacagaugu

SEQ ID NO: 2786029 - RNA, 20 nt, Human
uggaaggagacacagauguu

SEQ ID NO: 2786030 - RNA, 21 nt, Human
uggaaggagacacagauguuc

SEQ ID NO: 2786031 - RNA, 14 nt, Human
uggaaggcagacag

SEQ ID NO: 2786032 - RNA, 23 nt, Human
uggaaggcagacagcaggcagcg

SEQ ID NO: 2786033 - RNA, 16 nt, Human
uggaagggccaagguc

SEQ ID NO: 2786034 - RNA, 15 nt, Human
aggaucccucucugg

SEQ ID NO: 2786035 - RNA, 19 nt, Human
aggaucccucucuggauug

SEQ ID NO: 2786036 - RNA, 16 nt, Human
aggaucccucucugga

SEQ ID NO: 2786037 - RNA, 17 nt, Human
aggaucccucucuggau

SEQ ID NO: 2786038 - RNA, 14 nt, Human
aggagcuucugggg

SEQ ID NO: 2786039 - RNA, 20 nt, Human
aggagcuucuggggucccca

SEQ ID NO: 2786040 - RNA, 22 nt, Human
aggagcuucugggguccccagg

SEQ ID NO: 2786041 - RNA, 20 nt, Human
aggagcugucaccaaggaaa

SEQ ID NO: 2786042 - RNA, 21 nt, Human
aggagcugucaccaaggaaac

SEQ ID NO: 2786043 - RNA, 21 nt, Human
aggagcugcuggcuugcagug

SEQ ID NO: 2786044 - RNA, 17 nt, Human
aggagcugcuggcuugc

SEQ ID NO: 2786045 - RNA, 15 nt, Human
aggagcugagguuuc

SEQ ID NO: 2786046 - RNA, 21 nt, Human
aggagcugagguuucacccuu

SEQ ID NO: 2786047 - RNA, 21 nt, Human
aggagcucuucaggccucccu

SEQ ID NO: 2786048 - RNA, 19 nt, Human
aggagcucuucaggccucc

SEQ ID NO: 2786049 - RNA, 17 nt, Human
aggagcucuucaggccu

SEQ ID NO: 2786050 - RNA, 21 nt, Human
aggagcuaaggcucuaugagu

SEQ ID NO: 2786051 - RNA, 22 nt, Human
aggagcuacccuuuuccuuugu

SEQ ID NO: 2786052 - RNA, 13 nt, Human
uggcagccuuggc

SEQ ID NO: 2786053 - RNA, 13 nt, Human
uggcaauuccaau

SEQ ID NO: 2786054 - RNA, 17 nt, Human
uggcaauuccaauauuu

SEQ ID NO: 2786055 - RNA, 19 nt, Human
uggcaauuccaauauuucu

SEQ ID NO: 2786056 - RNA, 13 nt, Human
uggcaauugucua

SEQ ID NO: 2786057 - RNA, 14 nt, Human
uggcaauugucuau

SEQ ID NO: 2786058 - RNA, 16 nt, Human
uggcaauugucuauuu

SEQ ID NO: 2786059 - RNA, 18 nt, Human
uggcaauugucuauuuau

SEQ ID NO: 2786060 - RNA, 13 nt, Human
uggcaauuuugua

SEQ ID NO: 2786061 - RNA, 15 nt, Human
uggcaauuuuguaac

SEQ ID NO: 2786062 - RNA, 14 nt, Human
uggcaauuuuguaa

SEQ ID NO: 2786063 - RNA, 18 nt, Human
uggcacagggcaguggga

SEQ ID NO: 2786064 - RNA, 16 nt, Human
uggcacagggcagugg

SEQ ID NO: 2786065 - RNA, 14 nt, Human
aggccagagggagu

SEQ ID NO: 2786066 - RNA, 17 nt, Human
uggcagccuuggcaaac

SEQ ID NO: 2786067 - RNA, 20 nt, Human
aggccagagggagugacaga

SEQ ID NO: 2786068 - RNA, 17 nt, Human
aggccagaguggccugg

SEQ ID NO: 2786069 - RNA, 16 nt, Human
aggccagaguggccug

SEQ ID NO: 2786070 - RNA, 22 nt, Human
aggccagaguggccuggccagg

SEQ ID NO: 2786071 - RNA, 21 nt, Human
aggccagaguggccuggccag

SEQ ID NO: 2786072 - RNA, 20 nt, Human
aggccagaguggccuggcca

SEQ ID NO: 2786073 - RNA, 19 nt, Human
aggccagaguggccuggcc

SEQ ID NO: 2786074 - RNA, 21 nt, Human
aggccagccccacccaggagg

SEQ ID NO: 2786075 - RNA, 18 nt, Human
aggccagccccacccagg

SEQ ID NO: 2786076 - RNA, 17 nt, Human
aggccagccccacccag

SEQ ID NO: 2786077 - RNA, 16 nt, Human
aggccagccccaccca

SEQ ID NO: 2786078 - RNA, 15 nt, Human
aggccagccccaccc

SEQ ID NO: 2786079 - RNA, 14 nt, Human
aggccagccccacc

SEQ ID NO: 2786080 - RNA, 13 nt, Human
aggccagccccac

SEQ ID NO: 2786081 - RNA, 13 nt, Human
aggccccacugau

SEQ ID NO: 2786082 - RNA, 14 nt, Human
aggccccacugaug

SEQ ID NO: 2786083 - RNA, 15 nt, Human
aggccccacugaugc

SEQ ID NO: 2786084 - RNA, 19 nt, Human
aggccccacugaugcuguu

SEQ ID NO: 2786085 - RNA, 21 nt, Human
aggccccacugaugcuguucu

SEQ ID NO: 2786086 - RNA, 17 nt, Human
aggcccagugagaugca

SEQ ID NO: 2786087 - RNA, 13 nt, Human
aggcccagugaga

SEQ ID NO: 2786088 - RNA, 13 nt, Human
aggcccagccccu

SEQ ID NO: 2786089 - RNA, 14 nt, Human
aggcccagccccua

SEQ ID NO: 2786090 - RNA, 15 nt, Human
aggcccagccccuag

SEQ ID NO: 2786091 - RNA, 16 nt, Human
aggcccagccccuaga

SEQ ID NO: 2786092 - RNA, 17 nt, Human
aggcccagccccuagaa

SEQ ID NO: 2786093 - RNA, 19 nt, Human
aggcccagccccuagaaac

SEQ ID NO: 2786094 - RNA, 17 nt, Human
aggcagccccauucugc

SEQ ID NO: 2786095 - RNA, 16 nt, Human
aggcagccccauucug

SEQ ID NO: 2786096 - RNA, 14 nt, Human
aggcagccagggcu

SEQ ID NO: 2786097 - RNA, 15 nt, Human
aggcagccagugaga

SEQ ID NO: 2786098 - RNA, 13 nt, Human
aggccaaggggag

SEQ ID NO: 2786099 - RNA, 22 nt, Human
aggccaaggggagucaccuucc

SEQ ID NO: 2786100 - RNA, 18 nt, Human
aggccaaggucugagcca

SEQ ID NO: 2786101 - RNA, 17 nt, Human
aggccaaggccuucucc

SEQ ID NO: 2786102 - RNA, 20 nt, Human
aggccaagagcagaggcagc

SEQ ID NO: 2786103 - RNA, 18 nt, Human
aggccaagagcagaggca

SEQ ID NO: 2786104 - RNA, 17 nt, Human
aggccaagagcagaggc

SEQ ID NO: 2786105 - RNA, 14 nt, Human
aggccaagagcaga

SEQ ID NO: 2786106 - RNA, 14 nt, Human
uggagggguguggc

SEQ ID NO: 2786107 - RNA, 13 nt, Human
uggaggggugugg

SEQ ID NO: 2786108 - RNA, 14 nt, Human
uggagguacacucu

SEQ ID NO: 2786109 - RNA, 20 nt, Human
uggagggugggagagcccag

SEQ ID NO: 2786110 - RNA, 23 nt, Human
uggagggguguggcuccuuccca

SEQ ID NO: 2786111 - RNA, 15 nt, Human
uggcaauauuccuua

SEQ ID NO: 2786112 - RNA, 19 nt, Human
uggcaaucucagaugcagu

SEQ ID NO: 2786113 - RNA, 23 nt, Human
uggauuggauuauuuaauaacau

SEQ ID NO: 2786114 - RNA, 17 nt, Human
uggauugggggggccaa

SEQ ID NO: 2786115 - RNA, 21 nt, Human
uggauugggggggccaaaagg

SEQ ID NO: 2786116 - RNA, 15 nt, Human
uggauuauuuaauaa

SEQ ID NO: 2786117 - RNA, 20 nt, Human
uggauuggagauagggaaag

SEQ ID NO: 2786118 - RNA, 21 nt, Human
uggauuggagauagggaaaga

SEQ ID NO: 2786119 - RNA, 15 nt, Human
uggauuggauuauuu

SEQ ID NO: 2786120 - RNA, 16 nt, Human
uggauuggauuauuua

SEQ ID NO: 2786121 - RNA, 17 nt, Human
uggauuggauuauuuaa

SEQ ID NO: 2786122 - RNA, 20 nt, Human
uggauuggauuauuuaauaa

SEQ ID NO: 2786123 - RNA, 21 nt, Human
uggauuggauuauuuaauaac

SEQ ID NO: 2786124 - RNA, 13 nt, Human
uggauuaaauuua

SEQ ID NO: 2786125 - RNA, 15 nt, Human
uggauuaaauuuaau

SEQ ID NO: 2786126 - RNA, 13 nt, Human
uggauuaggucuc

SEQ ID NO: 2786127 - RNA, 15 nt, Human
uggauuaggucucug

SEQ ID NO: 2786128 - RNA, 14 nt, Human
uggauuauccugag

SEQ ID NO: 2786129 - RNA, 13 nt, Human
uggauuauuuaau

SEQ ID NO: 2786130 - RNA, 14 nt, Human
uggauuauuuaaua

SEQ ID NO: 2786131 - RNA, 23 nt, Human
uggauuggagaaguaauccuagg

SEQ ID NO: 2786132 - RNA, 16 nt, Human
uggaguauaauauuca

SEQ ID NO: 2786133 - RNA, 13 nt, Human
uggauggaagggg

SEQ ID NO: 2786134 - RNA, 13 nt, Human
uggagguucuaag

SEQ ID NO: 2786135 - RNA, 15 nt, Human
uggagguucuaaggc

SEQ ID NO: 2786136 - RNA, 16 nt, Human
uggagguucuaaggcc

SEQ ID NO: 2786137 - RNA, 15 nt, Human
uggauggagcccagg

SEQ ID NO: 2786138 - RNA, 15 nt, Human
uggauggaaggggcu

SEQ ID NO: 2786139 - RNA, 14 nt, Human
uggauuaaacuuau

SEQ ID NO: 2786140 - RNA, 15 nt, Human
uggauuaaacuuaug

SEQ ID NO: 2786141 - RNA, 17 nt, Human
uggauuaaacuuaugaa

SEQ ID NO: 2786142 - RNA, 18 nt, Human
uggauuaaacuuaugaau

SEQ ID NO: 2786143 - RNA, 20 nt, Human
uggauuaaacuuaugaaugu

SEQ ID NO: 2786144 - RNA, 22 nt, Human
uggcauacgccuguaguccuag

SEQ ID NO: 2786145 - RNA, 14 nt, Human
uggcauagacaugg

SEQ ID NO: 2786146 - RNA, 14 nt, Human
uggcauaguuucau

SEQ ID NO: 2786147 - RNA, 16 nt, Human
uggcauaguuucauaa

SEQ ID NO: 2786148 - RNA, 23 nt, Human
uggcaucaagaggugggagggcc

SEQ ID NO: 2786149 - RNA, 22 nt, Human
uggcaucaagaggugggagggc

SEQ ID NO: 2786150 - RNA, 22 nt, Human
uggcaucuucgucuucacucuu

SEQ ID NO: 2786151 - RNA, 23 nt, Human
uggcaucuucgucuucacucuua

SEQ ID NO: 2786152 - RNA, 23 nt, Human
uggcaucuuugccuugggcugcu

SEQ ID NO: 2786153 - RNA, 21 nt, Human
uggcaucuuugccuugggcug

SEQ ID NO: 2786154 - RNA, 16 nt, Human
uggcauaccuuucaca

SEQ ID NO: 2786155 - RNA, 20 nt, Human
uggcaucuuugccuugggcu

SEQ ID NO: 2786156 - RNA, 16 nt, Human
uggcaucuuugccuug

SEQ ID NO: 2786157 - RNA, 19 nt, Human
aggccugacuucugcuggc

SEQ ID NO: 2786158 - RNA, 21 nt, Human
aggccugacuucugcuggcau

SEQ ID NO: 2786159 - RNA, 14 nt, Human
aggccugagaccca

SEQ ID NO: 2786160 - RNA, 15 nt, Human
aggccugagacccag

SEQ ID NO: 2786161 - RNA, 16 nt, Human
aggccugagacccagg

SEQ ID NO: 2786162 - RNA, 17 nt, Human
aggccugagacccagga

SEQ ID NO: 2786163 - RNA, 18 nt, Human
aggccugagacccaggac

SEQ ID NO: 2786164 - RNA, 17 nt, Human
aggccugacuucugcug

SEQ ID NO: 2786165 - RNA, 16 nt, Human
aggccugacuucugcu

SEQ ID NO: 2786166 - RNA, 23 nt, Human
uggccagugugacaaggauugcu

SEQ ID NO: 2786167 - RNA, 16 nt, Human
uggccagugugauccc

SEQ ID NO: 2786168 - RNA, 19 nt, Human
uggccagguggccacucca

SEQ ID NO: 2786169 - RNA, 16 nt, Human
uggccagguggccacu

SEQ ID NO: 2786170 - RNA, 17 nt, Human
uggccagguggccacuc

SEQ ID NO: 2786171 - RNA, 14 nt, Human
uggccaucucugga

SEQ ID NO: 2786172 - RNA, 17 nt, Human
uggccaucucuggaugc

SEQ ID NO: 2786173 - RNA, 16 nt, Human
uggccaucucuggaug

SEQ ID NO: 2786174 - RNA, 16 nt, Human
uggccaguuggaacca

SEQ ID NO: 2786175 - RNA, 14 nt, Human
uggccaucccugug

SEQ ID NO: 2786176 - RNA, 15 nt, Human
uggccaucccuguga

SEQ ID NO: 2786177 - RNA, 16 nt, Human
uggccaucccugugag

SEQ ID NO: 2786178 - RNA, 17 nt, Human
uggccaucccugugagg

SEQ ID NO: 2786179 - RNA, 23 nt, Human
uggccaaagccaaagcuaggccu

SEQ ID NO: 2786180 - RNA, 21 nt, Human
uggccaaagccaaagcuaggc

SEQ ID NO: 2786181 - RNA, 22 nt, Human
uggccacagcccauccauagua

SEQ ID NO: 2786182 - RNA, 23 nt, Human
uggccacagcccauccauaguaa

SEQ ID NO: 2786183 - RNA, 17 nt, Human
uggcauuugcagauuuu

SEQ ID NO: 2786184 - RNA, 19 nt, Human
uggcauuugcagauuuuua

SEQ ID NO: 2786185 - RNA, 14 nt, Human
uggccacaaauucu

SEQ ID NO: 2786186 - RNA, 19 nt, Human
uggccacaaauucuuugac

SEQ ID NO: 2786187 - RNA, 12 nt, Human
uggccacacugu

SEQ ID NO: 2786188 - RNA, 14 nt, Human
uggccacacuguga

SEQ ID NO: 2786189 - RNA, 16 nt, Human
uggccacacugugaca

SEQ ID NO: 2786190 - RNA, 18 nt, Human
uggccacacugugacaca

SEQ ID NO: 2786191 - RNA, 19 nt, Human
uggccacacugugacacac

SEQ ID NO: 2786192 - RNA, 18 nt, Human
uggccaaaagcaguaaau

SEQ ID NO: 2786193 - RNA, 22 nt, Human
uggccacauuuaauaucuucag

SEQ ID NO: 2786194 - RNA, 21 nt, Human
uggccacauuuucagccaaag

SEQ ID NO: 2786195 - RNA, 17 nt, Human
uggccacaguagucuug

SEQ ID NO: 2786196 - RNA, 15 nt, Human
uggccaccucucucc

SEQ ID NO: 2786197 - RNA, 22 nt, Human
uggccaccaggugccuuucaaa

SEQ ID NO: 2786198 - RNA, 11 nt, Human
uggccaggugg

SEQ ID NO: 2786199 - RNA, 15 nt, Human
uggccagguggccac

SEQ ID NO: 2786200 - RNA, 16 nt, Human
uggccuaaaaaugcaa

SEQ ID NO: 2786201 - RNA, 18 nt, Human
uggccuaaaacuggccug

SEQ ID NO: 2786202 - RNA, 21 nt, Human
uggccuaaaacuggccugacu

SEQ ID NO: 2786203 - RNA, 15 nt, Human
uggccuaaaaucuug

SEQ ID NO: 2786204 - RNA, 17 nt, Human
uggccuaaaaucuugga

SEQ ID NO: 2786205 - RNA, 14 nt, Human
uggccgugggccug

SEQ ID NO: 2786206 - RNA, 19 nt, Human
uggccgugggccuggggua

SEQ ID NO: 2786207 - RNA, 14 nt, Human
uggccguuaucugg

SEQ ID NO: 2786208 - RNA, 19 nt, Human
uggccguugauguuggcug

SEQ ID NO: 2786209 - RNA, 21 nt, Human
uggccguugauguuggcuggg

SEQ ID NO: 2786210 - RNA, 19 nt, Human
uggcccuggggucccacga

SEQ ID NO: 2786211 - RNA, 12 nt, Human
uggcccuggggu

SEQ ID NO: 2786212 - RNA, 13 nt, Human
uggcccugggguc

SEQ ID NO: 2786213 - RNA, 13 nt, Human
uggcccugucccu

SEQ ID NO: 2786214 - RNA, 15 nt, Human
uggcccugcccugag

SEQ ID NO: 2786215 - RNA, 14 nt, Human
uggcccuggcucug

SEQ ID NO: 2786216 - RNA, 17 nt, Human
uggcccuggcucugcug

SEQ ID NO: 2786217 - RNA, 19 nt, Human
uggcccuggcucugcuguc

SEQ ID NO: 2786218 - RNA, 13 nt, Human
uggcccugcccug

SEQ ID NO: 2786219 - RNA, 14 nt, Human
uggcccugcccugg

SEQ ID NO: 2786220 - RNA, 19 nt, Human
uggcccaaguggcagagcu

SEQ ID NO: 2786221 - RNA, 21 nt, Human
uggcccaaguggcagagcuug

SEQ ID NO: 2786222 - RNA, 20 nt, Human
uggccauucuuuuuuucuug

SEQ ID NO: 2786223 - RNA, 22 nt, Human
uggccauucuuuuuuucuuggc

SEQ ID NO: 2786224 - RNA, 23 nt, Human
uggccauucuuuuuuucuuggcc

SEQ ID NO: 2786225 - RNA, 15 nt, Human
uggccauuugcuuuu

SEQ ID NO: 2786226 - RNA, 14 nt, Human
uggccauuugcuuu

SEQ ID NO: 2786227 - RNA, 13 nt, Human
uggccuggccugg

SEQ ID NO: 2786228 - RNA, 14 nt, Human
uggccuggccuggc

SEQ ID NO: 2786229 - RNA, 15 nt, Human
uggccuggccuggcc

SEQ ID NO: 2786230 - RNA, 16 nt, Human
uggccuggccuggccc

SEQ ID NO: 2786231 - RNA, 17 nt, Human
uggccuggccuggcccu

SEQ ID NO: 2786232 - RNA, 18 nt, Human
uggccuggccuggcccug

SEQ ID NO: 2786233 - RNA, 19 nt, Human
uggccuggccuggcccugc

SEQ ID NO: 2786234 - RNA, 15 nt, Human
uggccugagagggga

SEQ ID NO: 2786235 - RNA, 17 nt, Human
uggccugacuuggggga

SEQ ID NO: 2786236 - RNA, 13 nt, Human
uggccuggcccug

SEQ ID NO: 2786237 - RNA, 14 nt, Human
uggccuggcccugc

SEQ ID NO: 2786238 - RNA, 15 nt, Human
uggccuggcccugcc

SEQ ID NO: 2786239 - RNA, 16 nt, Human
uggccuggcccugccc

SEQ ID NO: 2786240 - RNA, 18 nt, Human
uggccuggcccugcccug

SEQ ID NO: 2786241 - RNA, 20 nt, Human
uggccuggcccugcccugag

SEQ ID NO: 2786242 - RNA, 21 nt, Human
uggccugaagaguccucugaa

SEQ ID NO: 2786243 - RNA, 22 nt, Human
uggccguugauguuggcuggga

SEQ ID NO: 2786244 - RNA, 12 nt, Human
aggccugugugu

SEQ ID NO: 2786245 - RNA, 23 nt, Human
aggccugugugugaaaggaagcu

SEQ ID NO: 2786246 - RNA, 15 nt, Human
uggccuuaccccugc

SEQ ID NO: 2786247 - RNA, 16 nt, Human
uggccuuaccccugcc

SEQ ID NO: 2786248 - RNA, 18 nt, Human
uggccuguuucaacacag

SEQ ID NO: 2786249 - RNA, 18 nt, Human
uggccuuccauuuauaug

SEQ ID NO: 2786250 - RNA, 23 nt, Human
uggccuguuuuagaagguucucu

SEQ ID NO: 2786251 - RNA, 15 nt, Human
agcuguguuguugcu

SEQ ID NO: 2786252 - RNA, 23 nt, Human
agcuguguuguugcuucuuguga

SEQ ID NO: 2786253 - RNA, 12 nt, Human
agcuguuaaacu

SEQ ID NO: 2786254 - RNA, 14 nt, Human
agcuguuaaacugu

SEQ ID NO: 2786255 - RNA, 15 nt, Human
agcuguuaaacuguu

SEQ ID NO: 2786256 - RNA, 16 nt, Human
agcuguuaaacuguua

SEQ ID NO: 2786257 - RNA, 19 nt, Human
agcuguuaaacuguuagca

SEQ ID NO: 2786258 - RNA, 22 nt, Human
agcuguuaaacuguuagcacug

SEQ ID NO: 2786259 - RNA, 23 nt, Human
agcuguuaaacuguuagcacugu

SEQ ID NO: 2786260 - RNA, 15 nt, Human
agcuguuaccauuca

SEQ ID NO: 2786261 - RNA, 16 nt, Human
agcuguuaccauucac

SEQ ID NO: 2786262 - RNA, 17 nt, Human
agcuguuaccauucaca

SEQ ID NO: 2786263 - RNA, 19 nt, Human
agcuguuaccauucacaau

SEQ ID NO: 2786264 - RNA, 20 nt, Human
ugccuguucagcuccagcuc

SEQ ID NO: 2786265 - RNA, 18 nt, Human
ugccuguucagcuccagc

SEQ ID NO: 2786266 - RNA, 17 nt, Human
ugccuguucagcuccag

SEQ ID NO: 2786267 - RNA, 14 nt, Human
ugccuuaaaaugga

SEQ ID NO: 2786268 - RNA, 15 nt, Human
ugccuuaaaauggaa

SEQ ID NO: 2786269 - RNA, 20 nt, Human
ugccuuaaaauggaauugaa

SEQ ID NO: 2786270 - RNA, 13 nt, Human
ugccuuaaagaaa

SEQ ID NO: 2786271 - RNA, 15 nt, Human
ugccuuagucucagu

SEQ ID NO: 2786272 - RNA, 16 nt, Human
ugccuuaggccuaccu

SEQ ID NO: 2786273 - RNA, 17 nt, Human
ugccuuaggccuaccug

SEQ ID NO: 2786274 - RNA, 21 nt, Human
ugccuuaggccuaccugaugg

SEQ ID NO: 2786275 - RNA, 14 nt, Human
ugccuuagaggagc

SEQ ID NO: 2786276 - RNA, 16 nt, Human
ugccuuagaggagccc

SEQ ID NO: 2786277 - RNA, 18 nt, Human
ugccuuagaggagcccac

SEQ ID NO: 2786278 - RNA, 19 nt, Human
ugccuuagaggagcccacg

SEQ ID NO: 2786279 - RNA, 21 nt, Human
ugccuguucagcuccagcuca

SEQ ID NO: 2786280 - RNA, 21 nt, Human
agcugugcucuggacaggcau

SEQ ID NO: 2786281 - RNA, 20 nt, Human
agcugugcucuggacaggca

SEQ ID NO: 2786282 - RNA, 19 nt, Human
agcugugcucuggacaggc

SEQ ID NO: 2786283 - RNA, 11 nt, Human
agcugucugcu

SEQ ID NO: 2786284 - RNA, 15 nt, Human
agcugucucuaacuu

SEQ ID NO: 2786285 - RNA, 17 nt, Human
agcugucugcucagaca

SEQ ID NO: 2786286 - RNA, 16 nt, Human
agcugucuguggcuuc

SEQ ID NO: 2786287 - RNA, 15 nt, Human
agcugucacaacuug

SEQ ID NO: 2786288 - RNA, 14 nt, Human
agcuguccagagaa

SEQ ID NO: 2786289 - RNA, 18 nt, Human
agcugucacaacuugugu

SEQ ID NO: 2786290 - RNA, 17 nt, Human
agcugucaccaaggaaa

SEQ ID NO: 2786291 - RNA, 18 nt, Human
agcugucaccaaggaaac

SEQ ID NO: 2786292 - RNA, 21 nt, Human
agcugucacuucgcgugcccu

SEQ ID NO: 2786293 - RNA, 20 nt, Human
agcugucacuuuugcuccga

SEQ ID NO: 2786294 - RNA, 15 nt, Human
agcuguccucccucc

SEQ ID NO: 2786295 - RNA, 17 nt, Human
agcuguccucccuccac

SEQ ID NO: 2786296 - RNA, 15 nt, Human
agcugucccugcccu

SEQ ID NO: 2786297 - RNA, 16 nt, Human
agcugucccugcccuu

SEQ ID NO: 2786298 - RNA, 13 nt, Human
agcuggcuggggu

SEQ ID NO: 2786299 - RNA, 14 nt, Human
agcuggcuggggug

SEQ ID NO: 2786300 - RNA, 15 nt, Human
agcuggcuggggugg

SEQ ID NO: 2786301 - RNA, 19 nt, Human
agcuggcugggguggccug

SEQ ID NO: 2786302 - RNA, 20 nt, Human
agcuggcugggguggccugu

SEQ ID NO: 2786303 - RNA, 21 nt, Human
agcuggcugggguggccugug

SEQ ID NO: 2786304 - RNA, 23 nt, Human
agcuggcugggguggccugugug

SEQ ID NO: 2786305 - RNA, 14 nt, Human
agcuggccccgccg

SEQ ID NO: 2786306 - RNA, 15 nt, Human
agcuggccccgccgc

SEQ ID NO: 2786307 - RNA, 18 nt, Human
agcuggccccgccgccug

SEQ ID NO: 2786308 - RNA, 19 nt, Human
agcuggccccgccgccugg

SEQ ID NO: 2786309 - RNA, 20 nt, Human
agcuggccgaggguccuggc

SEQ ID NO: 2786310 - RNA, 21 nt, Human
agcuggccgaggguccuggcu

SEQ ID NO: 2786311 - RNA, 18 nt, Human
agcugccgggccugauuu

SEQ ID NO: 2786312 - RNA, 15 nt, Human
agcugccuagcaagc

SEQ ID NO: 2786313 - RNA, 19 nt, Human
agcugccuagcaagcuggc

SEQ ID NO: 2786314 - RNA, 20 nt, Human
agcugccuagcaagcuggcc

SEQ ID NO: 2786315 - RNA, 21 nt, Human
agcugccuagcaagcuggccu

SEQ ID NO: 2786316 - RNA, 22 nt, Human
agcugccuagcaagcuggccuc

SEQ ID NO: 2786317 - RNA, 13 nt, Human
agcugccucacuu

SEQ ID NO: 2786318 - RNA, 20 nt, Human
agcugccuguucagcuccag

SEQ ID NO: 2786319 - RNA, 23 nt, Human
ugccuggauccccucugucuaca

SEQ ID NO: 2786320 - RNA, 21 nt, Human
ugccuggagugcccacccugg

SEQ ID NO: 2786321 - RNA, 22 nt, Human
agcugccuguucagcuccagcu

SEQ ID NO: 2786322 - RNA, 21 nt, Human
agcugccuguucagcuccagc

SEQ ID NO: 2786323 - RNA, 19 nt, Human
agcugccuguucagcucca

SEQ ID NO: 2786324 - RNA, 21 nt, Human
agcugcuuuugucuaugggac

SEQ ID NO: 2786325 - RNA, 13 nt, Human
agcuggccccgcc

SEQ ID NO: 2786326 - RNA, 21 nt, Human
agcuggcauuacagcuggaga

SEQ ID NO: 2786327 - RNA, 15 nt, Human
agcuggcauuacagc

SEQ ID NO: 2786328 - RNA, 22 nt, Human
agcuggaucuccauucucucag

SEQ ID NO: 2786329 - RNA, 20 nt, Human
agcuggaugauggucuucag

SEQ ID NO: 2786330 - RNA, 15 nt, Human
ugccucugccucuga

SEQ ID NO: 2786331 - RNA, 13 nt, Human
ugccugcccaggc

SEQ ID NO: 2786332 - RNA, 14 nt, Human
ugccucugccucug

SEQ ID NO: 2786333 - RNA, 13 nt, Human
ugccucugccucu

SEQ ID NO: 2786334 - RNA, 14 nt, Human
ugcccaggcagguc

SEQ ID NO: 2786335 - RNA, 13 nt, Human
ugcccaggcaggu

SEQ ID NO: 2786336 - RNA, 12 nt, Human
ugcccaggcagg

SEQ ID NO: 2786337 - RNA, 16 nt, Human
ugccugcccaggcccc

SEQ ID NO: 2786338 - RNA, 24 nt, Human
ugccugcccaggccccugccaccc

SEQ ID NO: 2786339 - RNA, 12 nt, Human
ugccucugccuc

SEQ ID NO: 2786340 - RNA, 15 nt, Human
ugccugcccaggccc

SEQ ID NO: 2786341 - RNA, 14 nt, Human
ugccugcccaggcc

SEQ ID NO: 2786342 - RNA, 18 nt, Human
ugccuggagacguggaac

SEQ ID NO: 2786343 - RNA, 22 nt, Human
ugccuggagacguggaaccucu

SEQ ID NO: 2786344 - RNA, 18 nt, Human
ugccugcccgcacagcag

SEQ ID NO: 2786345 - RNA, 19 nt, Human
ugccugcccgcacagcagc

SEQ ID NO: 2786346 - RNA, 20 nt, Human
ugccugcccgcacagcagcc

SEQ ID NO: 2786347 - RNA, 22 nt, Human
ugccugcccgcacagcagccug

SEQ ID NO: 2786348 - RNA, 18 nt, Human
ugccugccccccucaucu

SEQ ID NO: 2786349 - RNA, 18 nt, Human
ugccugccccaaacaaau

SEQ ID NO: 2786350 - RNA, 20 nt, Human
ugccugccccaaacaaauau

SEQ ID NO: 2786351 - RNA, 18 nt, Human
ugcuaagguucuaaggcc

SEQ ID NO: 2786352 - RNA, 16 nt, Human
ugcuaagguucuaagg

SEQ ID NO: 2786353 - RNA, 17 nt, Human
ugcuaagguucuaaggc

SEQ ID NO: 2786354 - RNA, 12 nt, Human
ugcuaagguucu

SEQ ID NO: 2786355 - RNA, 13 nt, Human
ugcuaagguucua

SEQ ID NO: 2786356 - RNA, 14 nt, Human
ugcuaagguucuaa

SEQ ID NO: 2786357 - RNA, 15 nt, Human
ugcuaagguucuaag

SEQ ID NO: 2786358 - RNA, 15 nt, Human
agcuguuguacauuu

SEQ ID NO: 2786359 - RNA, 19 nt, Human
agcuuacaagccagcugga

SEQ ID NO: 2786360 - RNA, 21 nt, Human
agcuuacaaucgcaaaucaaa

SEQ ID NO: 2786361 - RNA, 16 nt, Human
agcuuacacaaaucua

SEQ ID NO: 2786362 - RNA, 20 nt, Human
agcuuacacaaaucuauuua

SEQ ID NO: 2786363 - RNA, 16 nt, Human
agcuuacauaguuuua

SEQ ID NO: 2786364 - RNA, 17 nt, Human
agcuuacauaguuuuaa

SEQ ID NO: 2786365 - RNA, 22 nt, Human
agcuuacauaguuuuaaacuca

SEQ ID NO: 2786366 - RNA, 22 nt, Human
agcuucuuccaggugcccagcu

SEQ ID NO: 2786367 - RNA, 20 nt, Human
agcuucuuccaggugcccag

SEQ ID NO: 2786368 - RNA, 17 nt, Human
agcuugaaaguuuucag

SEQ ID NO: 2786369 - RNA, 16 nt, Human
agcuugaaaguuuuca

SEQ ID NO: 2786370 - RNA, 22 nt, Human
agcuugaaaguuuucagaaccu

SEQ ID NO: 2786371 - RNA, 12 nt, Human
agcuucuuccag

SEQ ID NO: 2786372 - RNA, 18 nt, Human
agcuucuuaauuaauuug

SEQ ID NO: 2786373 - RNA, 19 nt, Human
agcuucuuaauuaauuuga

SEQ ID NO: 2786374 - RNA, 21 nt, Human
agcuucuuaauuaauuugauu

SEQ ID NO: 2786375 - RNA, 10 nt, Human
agcuuagaac

SEQ ID NO: 2786376 - RNA, 21 nt, Human
agcuuacucuguccauuuauc

SEQ ID NO: 2786377 - RNA, 13 nt, Human
agcuuaccugaca

SEQ ID NO: 2786378 - RNA, 15 nt, Human
agcuuaccugacaca

SEQ ID NO: 2786379 - RNA, 17 nt, Human
agcuuaccugacacaag

SEQ ID NO: 2786380 - RNA, 20 nt, Human
agcuuaccagaagcuuccau

SEQ ID NO: 2786381 - RNA, 22 nt, Human
agcuuaccagaagcuuccauag

SEQ ID NO: 2786382 - RNA, 14 nt, Human
agcuugaggguugg

SEQ ID NO: 2786383 - RNA, 13 nt, Human
agcuugacuccca

SEQ ID NO: 2786384 - RNA, 15 nt, Human
agcuugacucccaag

SEQ ID NO: 2786385 - RNA, 18 nt, Human
agcuugaggguugggcug

SEQ ID NO: 2786386 - RNA, 18 nt, Human
agcuugggaggcuucccc

SEQ ID NO: 2786387 - RNA, 22 nt, Human
agcuugggagagccccuggggc

SEQ ID NO: 2786388 - RNA, 24 nt, Human
agcuugggagagccccuggggccu

SEQ ID NO: 2786389 - RNA, 22 nt, Human
agcuuggggccaccaaagcugc

SEQ ID NO: 2786390 - RNA, 21 nt, Human
agcuuggggccaccaaagcug

SEQ ID NO: 2786391 - RNA, 20 nt, Human
agcuuggggccaccaaagcu

SEQ ID NO: 2786392 - RNA, 17 nt, Human
agcuuggggcaacauug

SEQ ID NO: 2786393 - RNA, 23 nt, Human
agcuuggggccaccaaagcugcc

SEQ ID NO: 2786394 - RNA, 14 nt, Human
agcuuggggccagg

SEQ ID NO: 2786395 - RNA, 15 nt, Human
agcuuggggccaggg

SEQ ID NO: 2786396 - RNA, 16 nt, Human
agcuuggggccaggga

SEQ ID NO: 2786397 - RNA, 18 nt, Human
ugcgguccacccaggagc

SEQ ID NO: 2786398 - RNA, 17 nt, Human
ugcgguccacccaggag

SEQ ID NO: 2786399 - RNA, 17 nt, Human
ugcgggucacaggaggg

SEQ ID NO: 2786400 - RNA, 16 nt, Human
ugcgggucacaggagg

SEQ ID NO: 2786401 - RNA, 14 nt, Human
ugcgggucacagga

SEQ ID NO: 2786402 - RNA, 17 nt, Human
ugcgggaugguccuggg

SEQ ID NO: 2786403 - RNA, 19 nt, Human
ugcgggaugguccuggggc

SEQ ID NO: 2786404 - RNA, 18 nt, Human
ugcgggaugguccugggg

SEQ ID NO: 2786405 - RNA, 22 nt, Human
ugcggacagccacggccaggcc

SEQ ID NO: 2786406 - RNA, 13 nt, Human
ugccuuuuauagc

SEQ ID NO: 2786407 - RNA, 17 nt, Human
ugccuuuuauagcuauu

SEQ ID NO: 2786408 - RNA, 22 nt, Human
ugccuuuuauagcuauuacugu

SEQ ID NO: 2786409 - RNA, 23 nt, Human
ugcggacagccacggccaggcca

SEQ ID NO: 2786410 - RNA, 13 nt, Human
ugcggagaacaaa

SEQ ID NO: 2786411 - RNA, 14 nt, Human
ugcggaccccagcu

SEQ ID NO: 2786412 - RNA, 22 nt, Human
ugcggaccccagcugugagccu

SEQ ID NO: 2786413 - RNA, 13 nt, Human
ugcggaccccagc

SEQ ID NO: 2786414 - RNA, 15 nt, Human
ugcggaucucagcuu

SEQ ID NO: 2786415 - RNA, 23 nt, Human
ugcggaccccagcugugagccuu

SEQ ID NO: 2786416 - RNA, 15 nt, Human
ugcggagaacaaaug

SEQ ID NO: 2786417 - RNA, 17 nt, Human
ugcggaucucagcuuug

SEQ ID NO: 2786418 - RNA, 17 nt, Human
ugcggcauuaaagccau

SEQ ID NO: 2786419 - RNA, 15 nt, Human
ugccuuuguuuugau

SEQ ID NO: 2786420 - RNA, 16 nt, Human
ugccuuugccuccaga

SEQ ID NO: 2786421 - RNA, 12 nt, Human
ugccuuugggag

SEQ ID NO: 2786422 - RNA, 15 nt, Human
ugccuuugggagcag

SEQ ID NO: 2786423 - RNA, 16 nt, Human
ugccuuugcaaaucag

SEQ ID NO: 2786424 - RNA, 23 nt, Human
ugccuuugagacaguuucuuagc

SEQ ID NO: 2786425 - RNA, 12 nt, Human
ugccuuugagac

SEQ ID NO: 2786426 - RNA, 13 nt, Human
ugccuuugagaca

SEQ ID NO: 2786427 - RNA, 15 nt, Human
ugccuuugagacagu

SEQ ID NO: 2786428 - RNA, 17 nt, Human
ugccuuugagacaguuu

SEQ ID NO: 2786429 - RNA, 18 nt, Human
ugccuuugagacaguuuc

SEQ ID NO: 2786430 - RNA, 19 nt, Human
ugccuuugagacaguuucu

SEQ ID NO: 2786431 - RNA, 20 nt, Human
ugccuuugagacaguuucuu

SEQ ID NO: 2786432 - RNA, 21 nt, Human
ugccuuugagacaguuucuua

SEQ ID NO: 2786433 - RNA, 16 nt, Human
ugccuuagucucaguu

SEQ ID NO: 2786434 - RNA, 20 nt, Human
ugccuuagucucaguuugug

SEQ ID NO: 2786435 - RNA, 15 nt, Human
ugccuuucugcaguu

SEQ ID NO: 2786436 - RNA, 20 nt, Human
ugccuuucugcaguuuuuca

SEQ ID NO: 2786437 - RNA, 22 nt, Human
ugccuuucugcaguuuuucagg

SEQ ID NO: 2786438 - RNA, 12 nt, Human
ugccuuugaaug

SEQ ID NO: 2786439 - RNA, 17 nt, Human
ugcugggauuacaggug

SEQ ID NO: 2786440 - RNA, 21 nt, Human
ugcugggauuacaagcgugag

SEQ ID NO: 2786441 - RNA, 21 nt, Human
ugcugggaaccucaggguauu

SEQ ID NO: 2786442 - RNA, 20 nt, Human
ugcugggauggugggcuuca

SEQ ID NO: 2786443 - RNA, 23 nt, Human
ugcugggauggugggcuucaggg

SEQ ID NO: 2786444 - RNA, 16 nt, Human
ugcuguagaugacaac

SEQ ID NO: 2786445 - RNA, 21 nt, Human
ugcuggcuguuggcugggggc

SEQ ID NO: 2786446 - RNA, 19 nt, Human
ugcuggcuguuggcugggg

SEQ ID NO: 2786447 - RNA, 19 nt, Human
ugcugggauuacaagcgug

SEQ ID NO: 2786448 - RNA, 19 nt, Human
ugcuggcucacaguacagc

SEQ ID NO: 2786449 - RNA, 13 nt, Human
ugcuggcucuucu

SEQ ID NO: 2786450 - RNA, 13 nt, Human
ugcuggcugccuu

SEQ ID NO: 2786451 - RNA, 14 nt, Human
ugcuggccuuugcu

SEQ ID NO: 2786452 - RNA, 23 nt, Human
ugcuggcgagugaaugccagugu

SEQ ID NO: 2786453 - RNA, 20 nt, Human
aggaauggacagacagagga

SEQ ID NO: 2786454 - RNA, 12 nt, Human
aggaauggacag

SEQ ID NO: 2786455 - RNA, 23 nt, Human
ugcuggaggugggagcaggagau

SEQ ID NO: 2786456 - RNA, 18 nt, Human
ugcuggaggugggagcag

SEQ ID NO: 2786457 - RNA, 22 nt, Human
ugcuggaggugggagcaggaga

SEQ ID NO: 2786458 - RNA, 17 nt, Human
ugcuggaggugggagca

SEQ ID NO: 2786459 - RNA, 16 nt, Human
ugcuggaggugggagc

SEQ ID NO: 2786460 - RNA, 20 nt, Human
ugcuggaguuucauguacaa

SEQ ID NO: 2786461 - RNA, 17 nt, Human
ugcuggauggagcccag

SEQ ID NO: 2786462 - RNA, 18 nt, Human
ugcuggauggagcccagg

SEQ ID NO: 2786463 - RNA, 19 nt, Human
ugcuggauggagcccaggc

SEQ ID NO: 2786464 - RNA, 20 nt, Human
ugcuggauggagcccaggcg

SEQ ID NO: 2786465 - RNA, 18 nt, Human
ugcuggaugucugccaau

SEQ ID NO: 2786466 - RNA, 22 nt, Human
ugcuggaugucugccaauuuuu

SEQ ID NO: 2786467 - RNA, 15 nt, Human
ugcuggccagccugg

SEQ ID NO: 2786468 - RNA, 16 nt, Human
ugcuggccagccuggg

SEQ ID NO: 2786469 - RNA, 17 nt, Human
ugcuggccagccugggg

SEQ ID NO: 2786470 - RNA, 18 nt, Human
ugcuggcaucaagaggug

SEQ ID NO: 2786471 - RNA, 22 nt, Human
aggacacgcgccccccucccag

SEQ ID NO: 2786472 - RNA, 23 nt, Human
aggacacgcgccccccucccaga

SEQ ID NO: 2786473 - RNA, 13 nt, Human
aggacagaaagga

SEQ ID NO: 2786474 - RNA, 23 nt, Human
aggacagaaaggagaguggccau

SEQ ID NO: 2786475 - RNA, 17 nt, Human
aggacagccccuccucc

SEQ ID NO: 2786476 - RNA, 15 nt, Human
aggacaccacaccca

SEQ ID NO: 2786477 - RNA, 18 nt, Human
aggacacuaaccacgcug

SEQ ID NO: 2786478 - RNA, 17 nt, Human
aggacaccacacccagc

SEQ ID NO: 2786479 - RNA, 18 nt, Human
aggacaccacacccagcc

SEQ ID NO: 2786480 - RNA, 19 nt, Human
aggacaccacacccagccu

SEQ ID NO: 2786481 - RNA, 20 nt, Human
aggacaccacacccagccuc

SEQ ID NO: 2786482 - RNA, 21 nt, Human
aggacaccacacccagccuca

SEQ ID NO: 2786483 - RNA, 22 nt, Human
aggacaccacacccagccucag

SEQ ID NO: 2786484 - RNA, 23 nt, Human
aggacaccacacccagccucagu

SEQ ID NO: 2786485 - RNA, 15 nt, Human
ugcuuccaauuuucu

SEQ ID NO: 2786486 - RNA, 15 nt, Human
ugcuucauucaauau

SEQ ID NO: 2786487 - RNA, 19 nt, Human
ugcuucauucaauauugac

SEQ ID NO: 2786488 - RNA, 18 nt, Human
ugcuucaucuucccaggu

SEQ ID NO: 2786489 - RNA, 19 nt, Human
ugcuucaucuucccaggua

SEQ ID NO: 2786490 - RNA, 13 nt, Human
ugcuucaauaguu

SEQ ID NO: 2786491 - RNA, 21 nt, Human
ugcuucaauaguucaaggaac

SEQ ID NO: 2786492 - RNA, 22 nt, Human
ugcuucaauaguucaaggaacu

SEQ ID NO: 2786493 - RNA, 15 nt, Human
ugcuucaaucccagc

SEQ ID NO: 2786494 - RNA, 16 nt, Human
ugcuucaaggcuucca

SEQ ID NO: 2786495 - RNA, 16 nt, Human
ugcuucaauaaaucuu

SEQ ID NO: 2786496 - RNA, 22 nt, Human
ugcuucaauaaaucuuuggaaa

SEQ ID NO: 2786497 - RNA, 15 nt, Human
ugcuucaauuaauaa

SEQ ID NO: 2786498 - RNA, 16 nt, Human
ugcuucaauuaauaaa

SEQ ID NO: 2786499 - RNA, 13 nt, Human
ugcugugcaaaug

SEQ ID NO: 2786500 - RNA, 13 nt, Human
ugcuguggaagca

SEQ ID NO: 2786501 - RNA, 20 nt, Human
ugcuguaugcugaucaucgc

SEQ ID NO: 2786502 - RNA, 22 nt, Human
ugcuguaugcugaucaucgcca

SEQ ID NO: 2786503 - RNA, 14 nt, Human
ugcuuagaaaagaa

SEQ ID NO: 2786504 - RNA, 18 nt, Human
ugcuguaggaucuaaggc

SEQ ID NO: 2786505 - RNA, 17 nt, Human
ugcuuagacauaacaaa

SEQ ID NO: 2786506 - RNA, 16 nt, Human
ugcuuagagacuauca

SEQ ID NO: 2786507 - RNA, 17 nt, Human
ugcuuagagacuaucaa

SEQ ID NO: 2786508 - RNA, 22 nt, Human
ugcuuagagggauuucuuugcu

SEQ ID NO: 2786509 - RNA, 23 nt, Human
ugcuuagagggauuucuuugcug

SEQ ID NO: 2786510 - RNA, 15 nt, Human
ugcuguggccugggc

SEQ ID NO: 2786511 - RNA, 14 nt, Human
ugcuguggccuggg

SEQ ID NO: 2786512 - RNA, 12 nt, Human
ugcuguggccug

SEQ ID NO: 2786513 - RNA, 16 nt, Human
ugcuguggccugggca

SEQ ID NO: 2786514 - RNA, 14 nt, Human
ugcuuacuuaugcc

SEQ ID NO: 2786515 - RNA, 13 nt, Human
ugcuucaaaaaca

SEQ ID NO: 2786516 - RNA, 21 nt, Human
ugcuucaaaaacauucuuaca

SEQ ID NO: 2786517 - RNA, 17 nt, Human
ugcuuauugcuuaguaa

SEQ ID NO: 2786518 - RNA, 21 nt, Human
ugcuuauugcuuaguaaaauu

SEQ ID NO: 2786519 - RNA, 21 nt, Human
ugcuuaguaucucaucaacaa

SEQ ID NO: 2786520 - RNA, 13 nt, Human
ugcuuaguaaaau

SEQ ID NO: 2786521 - RNA, 14 nt, Human
ugcuuaguaaaauu

SEQ ID NO: 2786522 - RNA, 16 nt, Human
ugcuuaguaaaauuua

SEQ ID NO: 2786523 - RNA, 14 nt, Human
aggaaauccagggu

SEQ ID NO: 2786524 - RNA, 22 nt, Human
aggaaauaaaaccuuucaaauu

SEQ ID NO: 2786525 - RNA, 21 nt, Human
aggaaauaaaaccuuucaaau

SEQ ID NO: 2786526 - RNA, 20 nt, Human
aggaaauaaaaccuuucaaa

SEQ ID NO: 2786527 - RNA, 19 nt, Human
aggaaauaaaaccuuucaa

SEQ ID NO: 2786528 - RNA, 17 nt, Human
aggaaauaaaaccuuuc

SEQ ID NO: 2786529 - RNA, 21 nt, Human
ugcugacuguacuccucccag

SEQ ID NO: 2786530 - RNA, 22 nt, Human
ugcugacuguacuccucccagg

SEQ ID NO: 2786531 - RNA, 19 nt, Human
aggaagccugcaguccugg

SEQ ID NO: 2786532 - RNA, 12 nt, Human
aggaaggaaaga

SEQ ID NO: 2786533 - RNA, 20 nt, Human
aggaagccugcaguccugga

SEQ ID NO: 2786534 - RNA, 16 nt, Human
aggaaauauugcuggg

SEQ ID NO: 2786535 - RNA, 19 nt, Human
ugcucaugggcugugugau

SEQ ID NO: 2786536 - RNA, 15 nt, Human
ugcucauuaauuuug

SEQ ID NO: 2786537 - RNA, 12 nt, Human
ugcucauuuaag

SEQ ID NO: 2786538 - RNA, 18 nt, Human
ugcucauuuaaguuucaa

SEQ ID NO: 2786539 - RNA, 19 nt, Human
ugcuccaagauucuagaug

SEQ ID NO: 2786540 - RNA, 14 nt, Human
ugcuccaagauucu

SEQ ID NO: 2786541 - RNA, 15 nt, Human
ugcuccaagauucua

SEQ ID NO: 2786542 - RNA, 16 nt, Human
ugcuccaagauucuag

SEQ ID NO: 2786543 - RNA, 17 nt, Human
ugcuccaagauucuaga

SEQ ID NO: 2786544 - RNA, 18 nt, Human
ugcuccaagauucuagau

SEQ ID NO: 2786545 - RNA, 17 nt, Human
ugcucccuccccugccc

SEQ ID NO: 2786546 - RNA, 15 nt, Human
ugcucccuccccugc

SEQ ID NO: 2786547 - RNA, 14 nt, Human
ugcucccuccccug

SEQ ID NO: 2786548 - RNA, 13 nt, Human
ugcucccuccccu

SEQ ID NO: 2786549 - RNA, 18 nt, Human
ugcucccuaagccagccu

SEQ ID NO: 2786550 - RNA, 19 nt, Human
ugcucccuaagccagccug

SEQ ID NO: 2786551 - RNA, 20 nt, Human
ugcucccuaagccagccugg

SEQ ID NO: 2786552 - RNA, 21 nt, Human
ugcucccuaagccagccuggu

SEQ ID NO: 2786553 - RNA, 15 nt, Human
ugcuccccucugaaa

SEQ ID NO: 2786554 - RNA, 16 nt, Human
ugcucuggacaggcau

SEQ ID NO: 2786555 - RNA, 15 nt, Human
ugcucuggacaggca

SEQ ID NO: 2786556 - RNA, 14 nt, Human
ugcugacuguacuc

SEQ ID NO: 2786557 - RNA, 16 nt, Human
ugcugacuguacuccu

SEQ ID NO: 2786558 - RNA, 19 nt, Human
ugcugacuguacuccuccc

SEQ ID NO: 2786559 - RNA, 14 nt, Human
ugcucuggacaggc

SEQ ID NO: 2786560 - RNA, 18 nt, Human
ugcuccuaguuugaccuc

SEQ ID NO: 2786561 - RNA, 20 nt, Human
ugcuccuaguuugaccucac

SEQ ID NO: 2786562 - RNA, 19 nt, Human
ugcuccucacugcccgcac

SEQ ID NO: 2786563 - RNA, 20 nt, Human
ugcuauuggaggaucaguuu

SEQ ID NO: 2786564 - RNA, 12 nt, Human
ugcuauuaaagu

SEQ ID NO: 2786565 - RNA, 13 nt, Human
ugcuauuaaagug

SEQ ID NO: 2786566 - RNA, 16 nt, Human
ugcuauguuacuauuu

SEQ ID NO: 2786567 - RNA, 18 nt, Human
ugcuauguuacuauuuuc

SEQ ID NO: 2786568 - RNA, 19 nt, Human
ugcuauguuacuauuuucu

SEQ ID NO: 2786569 - RNA, 15 nt, Human
agcuuucaaagcauu

SEQ ID NO: 2786570 - RNA, 16 nt, Human
agcuuucaaagcauuu

SEQ ID NO: 2786571 - RNA, 16 nt, Human
agcuuucaagugccuu

SEQ ID NO: 2786572 - RNA, 17 nt, Human
agcuuucaagugccuuu

SEQ ID NO: 2786573 - RNA, 16 nt, Human
ugcuaucucugugugc

SEQ ID NO: 2786574 - RNA, 20 nt, Human
ugcuaucucugugugcacaa

SEQ ID NO: 2786575 - RNA, 21 nt, Human
ugcuaucucugugugcacaaa

SEQ ID NO: 2786576 - RNA, 20 nt, Human
ugcuaucuggaggccuucca

SEQ ID NO: 2786577 - RNA, 23 nt, Human
ugcuaucuggaggccuuccagcu

SEQ ID NO: 2786578 - RNA, 17 nt, Human
agcuuuauauauggaca

SEQ ID NO: 2786579 - RNA, 18 nt, Human
agcuuuauauauggacau

SEQ ID NO: 2786580 - RNA, 18 nt, Human
agcuuuauguucauuugu

SEQ ID NO: 2786581 - RNA, 23 nt, Human
agcuuuauguucauuuguuuguu

SEQ ID NO: 2786582 - RNA, 10 nt, Human
agcuuuauga

SEQ ID NO: 2786583 - RNA, 12 nt, Human
agcuuuaugauu

SEQ ID NO: 2786584 - RNA, 14 nt, Human
agcuuuaugauuuu

SEQ ID NO: 2786585 - RNA, 15 nt, Human
agcuuuaugauuuuc

SEQ ID NO: 2786586 - RNA, 17 nt, Human
agcuuuaugauuuucau

SEQ ID NO: 2786587 - RNA, 18 nt, Human
agcuuuaugauuuucaua

SEQ ID NO: 2786588 - RNA, 23 nt, Human
agcuuuaugauuuucauaacuua

SEQ ID NO: 2786589 - RNA, 21 nt, Human
agcuuuaugguccuaaaagca

SEQ ID NO: 2786590 - RNA, 14 nt, Human
agcuuuauucuuca

SEQ ID NO: 2786591 - RNA, 22 nt, Human
agcuuuauuuuuuaaguauuua

SEQ ID NO: 2786592 - RNA, 19 nt, Human
agcuuuauuuuuuaaguau

SEQ ID NO: 2786593 - RNA, 21 nt, Human
agcuuuacaugcaauuuauua

SEQ ID NO: 2786594 - RNA, 15 nt, Human
agcuuuacaugcaau

SEQ ID NO: 2786595 - RNA, 19 nt, Human
agcuuuacaugcaauuuau

SEQ ID NO: 2786596 - RNA, 15 nt, Human
agcuuuaaaagaaaa

SEQ ID NO: 2786597 - RNA, 13 nt, Human
agcuuuaaaagaa

SEQ ID NO: 2786598 - RNA, 15 nt, Human
agcuuuaaacaaauu

SEQ ID NO: 2786599 - RNA, 19 nt, Human
agcuuuaaacucagggaca

SEQ ID NO: 2786600 - RNA, 20 nt, Human
agcuuuaaacucagggacag

SEQ ID NO: 2786601 - RNA, 21 nt, Human
agcuuuaaacucagggacaga

SEQ ID NO: 2786602 - RNA, 13 nt, Human
agcuuuacacaca

SEQ ID NO: 2786603 - RNA, 20 nt, Human
agcuuuacacacacagaugu

SEQ ID NO: 2786604 - RNA, 14 nt, Human
aguagauauuacuu

SEQ ID NO: 2786605 - RNA, 15 nt, Human
aguagauauuacuuu

SEQ ID NO: 2786606 - RNA, 16 nt, Human
aguagauauuacuuua

SEQ ID NO: 2786607 - RNA, 17 nt, Human
aguagauauuacuuuau

SEQ ID NO: 2786608 - RNA, 18 nt, Human
aguagauauuacuuuauc

SEQ ID NO: 2786609 - RNA, 21 nt, Human
aguagauauuacuuuaucacu

SEQ ID NO: 2786610 - RNA, 15 nt, Human
aguagauggugaaau

SEQ ID NO: 2786611 - RNA, 16 nt, Human
aguagauggugaaauu

SEQ ID NO: 2786612 - RNA, 17 nt, Human
aguagauggugaaauuu

SEQ ID NO: 2786613 - RNA, 20 nt, Human
aguagaugcgcagccccauc

SEQ ID NO: 2786614 - RNA, 21 nt, Human
aguagaugcgcagccccaucu

SEQ ID NO: 2786615 - RNA, 21 nt, Human
aguagauggugaaauuuauua

SEQ ID NO: 2786616 - RNA, 13 nt, Human
uguaggagacuug

SEQ ID NO: 2786617 - RNA, 13 nt, Human
uguaggagaaacu

SEQ ID NO: 2786618 - RNA, 18 nt, Human
uguaggagaaacucccau

SEQ ID NO: 2786619 - RNA, 22 nt, Human
uguaggagacuugccagagccg

SEQ ID NO: 2786620 - RNA, 18 nt, Human
uguaggagacuugccaga

SEQ ID NO: 2786621 - RNA, 20 nt, Human
uguaggagcuacccuuuucc

SEQ ID NO: 2786622 - RNA, 17 nt, Human
uguaggagcugagguuu

SEQ ID NO: 2786623 - RNA, 12 nt, Human
uguaggagcugc

SEQ ID NO: 2786624 - RNA, 15 nt, Human
uguaggagcugccuu

SEQ ID NO: 2786625 - RNA, 22 nt, Human
uguaggagcugccuuggcucag

SEQ ID NO: 2786626 - RNA, 20 nt, Human
uguaggugcaagauggaaag

SEQ ID NO: 2786627 - RNA, 16 nt, Human
uguaggugguauguga

SEQ ID NO: 2786628 - RNA, 23 nt, Human
uguagguggucuggagcuguccg

SEQ ID NO: 2786629 - RNA, 19 nt, Human
aguagaacagauaaucagu

SEQ ID NO: 2786630 - RNA, 13 nt, Human
aguagaacagaua

SEQ ID NO: 2786631 - RNA, 19 nt, Human
aguagaaauaauaugcauu

SEQ ID NO: 2786632 - RNA, 18 nt, Human
aguagaaauaauaugcau

SEQ ID NO: 2786633 - RNA, 15 nt, Human
aguagaaauaaaagu

SEQ ID NO: 2786634 - RNA, 19 nt, Human
aguagaaauaaaagugaau

SEQ ID NO: 2786635 - RNA, 12 nt, Human
aguagagacagg

SEQ ID NO: 2786636 - RNA, 18 nt, Human
aguagagguacuagaaug

SEQ ID NO: 2786637 - RNA, 15 nt, Human
aguagagccagcuug

SEQ ID NO: 2786638 - RNA, 14 nt, Human
aguagauaagcaga

SEQ ID NO: 2786639 - RNA, 12 nt, Human
aguagagccagc

SEQ ID NO: 2786640 - RNA, 13 nt, Human
aguagagccagcu

SEQ ID NO: 2786641 - RNA, 14 nt, Human
aguaaucaauaaag

SEQ ID NO: 2786642 - RNA, 15 nt, Human
aguaaucaauaaaga

SEQ ID NO: 2786643 - RNA, 18 nt, Human
aguaaucaauaaagaaaa

SEQ ID NO: 2786644 - RNA, 14 nt, Human
aguaauccaccugc

SEQ ID NO: 2786645 - RNA, 15 nt, Human
aguaauuugaggaca

SEQ ID NO: 2786646 - RNA, 13 nt, Human
aguacaaaugccu

SEQ ID NO: 2786647 - RNA, 16 nt, Human
aguacaaaugccuuaa

SEQ ID NO: 2786648 - RNA, 21 nt, Human
aguacaaaugccuuaaaaugg

SEQ ID NO: 2786649 - RNA, 22 nt, Human
aguacaaaugccuuaaaaugga

SEQ ID NO: 2786650 - RNA, 23 nt, Human
aguacaaaugccuuaaaauggaa

SEQ ID NO: 2786651 - RNA, 14 nt, Human
aguacaaauuauaa

SEQ ID NO: 2786652 - RNA, 17 nt, Human
aguacaaauuauaaaaa

SEQ ID NO: 2786653 - RNA, 14 nt, Human
aguacaauaaaagu

SEQ ID NO: 2786654 - RNA, 22 nt, Human
aguacacaauaagcaaaaacaa

SEQ ID NO: 2786655 - RNA, 21 nt, Human
aguacacaauaagcaaaaaca

SEQ ID NO: 2786656 - RNA, 18 nt, Human
aguacacaauaagcaaaa

SEQ ID NO: 2786657 - RNA, 13 nt, Human
aguacaauguguu

SEQ ID NO: 2786658 - RNA, 17 nt, Human
aguacaauguguuuuuc

SEQ ID NO: 2786659 - RNA, 18 nt, Human
aguacaauguguuuuucu

SEQ ID NO: 2786660 - RNA, 20 nt, Human
aguacaauguguuuuucucc

SEQ ID NO: 2786661 - RNA, 17 nt, Human
aguacacaauaagcaaa

SEQ ID NO: 2786662 - RNA, 16 nt, Human
aguacacaauaagcaa

SEQ ID NO: 2786663 - RNA, 23 nt, Human
agguuuuuaaacacuaaaauaua

SEQ ID NO: 2786664 - RNA, 12 nt, Human
aguaaaaauaaa

SEQ ID NO: 2786665 - RNA, 13 nt, Human
aguaaaaauacaa

SEQ ID NO: 2786666 - RNA, 12 nt, Human
aguaaaaauaca

SEQ ID NO: 2786667 - RNA, 15 nt, Human
aguaaaaauaaaauu

SEQ ID NO: 2786668 - RNA, 22 nt, Human
agguuuuccucuucuauuuugu

SEQ ID NO: 2786669 - RNA, 22 nt, Human
agguuuuccccucuuuuguuaa

SEQ ID NO: 2786670 - RNA, 15 nt, Human
agguuuuguaaagau

SEQ ID NO: 2786671 - RNA, 23 nt, Human
agguuuuggaucuugaauguggu

SEQ ID NO: 2786672 - RNA, 13 nt, Human
agguuuuguaaag

SEQ ID NO: 2786673 - RNA, 12 nt, Human
agguuuuguugu

SEQ ID NO: 2786674 - RNA, 17 nt, Human
agguuuuguuguuuuau

SEQ ID NO: 2786675 - RNA, 17 nt, Human
aguaaguaccacucagg

SEQ ID NO: 2786676 - RNA, 18 nt, Human
aguaauauuuauauauuu

SEQ ID NO: 2786677 - RNA, 14 nt, Human
aguaaguaauuaug

SEQ ID NO: 2786678 - RNA, 20 nt, Human
aguaaguaauuaugcacuaa

SEQ ID NO: 2786679 - RNA, 19 nt, Human
aguaaaaauacaaaaauua

SEQ ID NO: 2786680 - RNA, 13 nt, Human
aguaaaacacaga

SEQ ID NO: 2786681 - RNA, 14 nt, Human
aguaaaacacagag

SEQ ID NO: 2786682 - RNA, 15 nt, Human
aguaaaacacagagg

SEQ ID NO: 2786683 - RNA, 23 nt, Human
uguacuuuuauuuuacacagaaa

SEQ ID NO: 2786684 - RNA, 17 nt, Human
uguaccauauagcaaaa

SEQ ID NO: 2786685 - RNA, 18 nt, Human
uguaccauaugaucuguu

SEQ ID NO: 2786686 - RNA, 18 nt, Human
uguacuuuuuaguuguuc

SEQ ID NO: 2786687 - RNA, 16 nt, Human
uguacuuuuaaggcag

SEQ ID NO: 2786688 - RNA, 21 nt, Human
uguaccaugaaacaaagcugc

SEQ ID NO: 2786689 - RNA, 19 nt, Human
uguacauuuuguuguaaaa

SEQ ID NO: 2786690 - RNA, 21 nt, Human
uguacauuuuguuguaaaaag

SEQ ID NO: 2786691 - RNA, 22 nt, Human
uguacauuuuguuguaaaaaga

SEQ ID NO: 2786692 - RNA, 23 nt, Human
uguacauuuuguuguaaaaagaa

SEQ ID NO: 2786693 - RNA, 21 nt, Human
uguaccaggaaaggauuuuau

SEQ ID NO: 2786694 - RNA, 20 nt, Human
uguaauuuaggguacuaaau

SEQ ID NO: 2786695 - RNA, 21 nt, Human
uguaauuuaggguacuaaauu

SEQ ID NO: 2786696 - RNA, 23 nt, Human
uguaauuuaggguacuaaauuua

SEQ ID NO: 2786697 - RNA, 15 nt, Human
uguaauuuauaaaau

SEQ ID NO: 2786698 - RNA, 16 nt, Human
uguaauuuauaaaauu

SEQ ID NO: 2786699 - RNA, 16 nt, Human
uguaauuuaugugaaa

SEQ ID NO: 2786700 - RNA, 13 nt, Human
uguaaguuucagg

SEQ ID NO: 2786701 - RNA, 22 nt, Human
uguaauuacuuaucccugccca

SEQ ID NO: 2786702 - RNA, 15 nt, Human
uguaauuaugauuug

SEQ ID NO: 2786703 - RNA, 16 nt, Human
uguaauuaugauuugg

SEQ ID NO: 2786704 - RNA, 13 nt, Human
uguaagccaaaga

SEQ ID NO: 2786705 - RNA, 15 nt, Human
uguaagccaaagaaa

SEQ ID NO: 2786706 - RNA, 18 nt, Human
uguaagccaaagaaauga

SEQ ID NO: 2786707 - RNA, 20 nt, Human
uguaagccaaagaaaugaac

SEQ ID NO: 2786708 - RNA, 21 nt, Human
uguaagccaaagaaaugaaca

SEQ ID NO: 2786709 - RNA, 22 nt, Human
uguaagccaaagaaaugaacau

SEQ ID NO: 2786710 - RNA, 14 nt, Human
uguaagccugcaag

SEQ ID NO: 2786711 - RNA, 15 nt, Human
uguaagccugcaagc

SEQ ID NO: 2786712 - RNA, 23 nt, Human
uguaagauuauagauucuaaaga

SEQ ID NO: 2786713 - RNA, 17 nt, Human
uguaagugagugugcug

SEQ ID NO: 2786714 - RNA, 21 nt, Human
uguaagugagugugcugcugu

SEQ ID NO: 2786715 - RNA, 16 nt, Human
uguaagugcuacauaa

SEQ ID NO: 2786716 - RNA, 22 nt, Human
uguaagugcuacauaaauuggc

SEQ ID NO: 2786717 - RNA, 16 nt, Human
uguaagucaguguuga

SEQ ID NO: 2786718 - RNA, 17 nt, Human
uguaagucaguguugag

SEQ ID NO: 2786719 - RNA, 19 nt, Human
uguaagucaguguugagau

SEQ ID NO: 2786720 - RNA, 21 nt, Human
uguaaguaacuucacauuaaa

SEQ ID NO: 2786721 - RNA, 14 nt, Human
uguaaguucacaac

SEQ ID NO: 2786722 - RNA, 19 nt, Human
uguaagcaggagagaaauu

SEQ ID NO: 2786723 - RNA, 19 nt, Human
uguaagauuauagauucua

SEQ ID NO: 2786724 - RNA, 20 nt, Human
uguaagauuauagauucuaa

SEQ ID NO: 2786725 - RNA, 21 nt, Human
uguaagauuauagauucuaaa

SEQ ID NO: 2786726 - RNA, 22 nt, Human
uguaagauuauagauucuaaag

SEQ ID NO: 2786727 - RNA, 18 nt, Human
uguaagauuauagauucu

SEQ ID NO: 2786728 - RNA, 13 nt, Human
uguaagaugucug

SEQ ID NO: 2786729 - RNA, 14 nt, Human
uguaagaugucugu

SEQ ID NO: 2786730 - RNA, 19 nt, Human
uguaagaucguucucugcc

SEQ ID NO: 2786731 - RNA, 20 nt, Human
uguaagaucguucucugccu

SEQ ID NO: 2786732 - RNA, 15 nt, Human
uguaagaguguagaa

SEQ ID NO: 2786733 - RNA, 18 nt, Human
uguaagaguguagaagca

SEQ ID NO: 2786734 - RNA, 19 nt, Human
uguaagaguguagaagcau

SEQ ID NO: 2786735 - RNA, 20 nt, Human
uguaagaguguagaagcauu

SEQ ID NO: 2786736 - RNA, 21 nt, Human
uguaagaguguagaagcauuc

SEQ ID NO: 2786737 - RNA, 22 nt, Human
agguugguuuaaugcaauagaa

SEQ ID NO: 2786738 - RNA, 13 nt, Human
uguaacuuaugua

SEQ ID NO: 2786739 - RNA, 15 nt, Human
uguaacuuauguaga

SEQ ID NO: 2786740 - RNA, 16 nt, Human
uguaacuuauguagau

SEQ ID NO: 2786741 - RNA, 17 nt, Human
uguaacuuauguagaua

SEQ ID NO: 2786742 - RNA, 20 nt, Human
uguaacuuauguagauauuu

SEQ ID NO: 2786743 - RNA, 22 nt, Human
uguaacuuauguagauauuugg

SEQ ID NO: 2786744 - RNA, 23 nt, Human
uguaacuuauguagauauuuggc

SEQ ID NO: 2786745 - RNA, 24 nt, Human
uguaacuugaaccuaugaagcaau

SEQ ID NO: 2786746 - RNA, 22 nt, Human
uguaagaauaggcauuaacaca

SEQ ID NO: 2786747 - RNA, 20 nt, Human
uguaagacaaagguuuuccu

SEQ ID NO: 2786748 - RNA, 11 nt, Human
uguaagacauu

SEQ ID NO: 2786749 - RNA, 16 nt, Human
uguaagaauucagaag

SEQ ID NO: 2786750 - RNA, 18 nt, Human
uguaagaauucagaagac

SEQ ID NO: 2786751 - RNA, 21 nt, Human
uguaagacaaagguuuuccuc

SEQ ID NO: 2786752 - RNA, 20 nt, Human
uguaacuuuuguaagacaaa

SEQ ID NO: 2786753 - RNA, 16 nt, Human
uguaacuuuuguaaga

SEQ ID NO: 2786754 - RNA, 15 nt, Human
uguaacuuuuguaag

SEQ ID NO: 2786755 - RNA, 21 nt, Human
agguggccacuuuaagagaga

SEQ ID NO: 2786756 - RNA, 16 nt, Human
agguggugugaucuua

SEQ ID NO: 2786757 - RNA, 20 nt, Human
agguugaggggcuccuggaa

SEQ ID NO: 2786758 - RNA, 17 nt, Human
agguugaggggcuccug

SEQ ID NO: 2786759 - RNA, 15 nt, Human
aggugguuuuaaagg

SEQ ID NO: 2786760 - RNA, 12 nt, Human
agguugcaggga

SEQ ID NO: 2786761 - RNA, 18 nt, Human
agguugcagggagccgag

SEQ ID NO: 2786762 - RNA, 11 nt, Human
aggucuugcua

SEQ ID NO: 2786763 - RNA, 14 nt, Human
aggucccccugcag

SEQ ID NO: 2786764 - RNA, 15 nt, Human
aggucccccugcagc

SEQ ID NO: 2786765 - RNA, 16 nt, Human
aggucccccugcagcu

SEQ ID NO: 2786766 - RNA, 18 nt, Human
aggucuuugguucagcua

SEQ ID NO: 2786767 - RNA, 20 nt, Human
aggucuuuguaagaacuaaa

SEQ ID NO: 2786768 - RNA, 21 nt, Human
aggucuuuguaagaacuaaag

SEQ ID NO: 2786769 - RNA, 23 nt, Human
aggucuuuguaagaacuaaagaa

SEQ ID NO: 2786770 - RNA, 23 nt, Human
aggucuugaacuccuggccucaa

SEQ ID NO: 2786771 - RNA, 14 nt, Human
aggucccaggcaga

SEQ ID NO: 2786772 - RNA, 16 nt, Human
uguaaauccugccauu

SEQ ID NO: 2786773 - RNA, 15 nt, Human
aggugcaauuucaag

SEQ ID NO: 2786774 - RNA, 23 nt, Human
agguggccucuccuuguggccug

SEQ ID NO: 2786775 - RNA, 21 nt, Human
agguggccuccuugcuuguua

SEQ ID NO: 2786776 - RNA, 17 nt, Human
agguggugucacugucc

SEQ ID NO: 2786777 - RNA, 18 nt, Human
agguggugucacuguccc

SEQ ID NO: 2786778 - RNA, 21 nt, Human
agguggugucacugucccucc

SEQ ID NO: 2786779 - RNA, 23 nt, Human
agguggugucacugucccuccug

SEQ ID NO: 2786780 - RNA, 21 nt, Human
agguggugagaaauuucugug

SEQ ID NO: 2786781 - RNA, 15 nt, Human
agguggugcuuacau

SEQ ID NO: 2786782 - RNA, 21 nt, Human
aggugcaauuucaagguucua

SEQ ID NO: 2786783 - RNA, 22 nt, Human
aggugcaauuucaagguucuaa

SEQ ID NO: 2786784 - RNA, 16 nt, Human
aggugcaauuucaagg

SEQ ID NO: 2786785 - RNA, 18 nt, Human
aggugcaauuucaagguu

SEQ ID NO: 2786786 - RNA, 19 nt, Human
aggugcaauuucaagguuc

SEQ ID NO: 2786787 - RNA, 20 nt, Human
aggugcaauuucaagguucu

SEQ ID NO: 2786788 - RNA, 13 nt, Human
aggugcagaggaa

SEQ ID NO: 2786789 - RNA, 16 nt, Human
aggugcaguggcucac

SEQ ID NO: 2786790 - RNA, 11 nt, Human
aggugcagugg

SEQ ID NO: 2786791 - RNA, 17 nt, Human
agguggccacuccagac

SEQ ID NO: 2786792 - RNA, 14 nt, Human
agguggccacucca

SEQ ID NO: 2786793 - RNA, 17 nt, Human
ugucaagaguaguuaua

SEQ ID NO: 2786794 - RNA, 20 nt, Human
ugucaagaguaguuauauaa

SEQ ID NO: 2786795 - RNA, 22 nt, Human
ugucaagaguaguuauauaauu

SEQ ID NO: 2786796 - RNA, 19 nt, Human
ugucaagagggucugagga

SEQ ID NO: 2786797 - RNA, 18 nt, Human
uguauuuuucaauaauaa

SEQ ID NO: 2786798 - RNA, 14 nt, Human
uguauuuuucuaca

SEQ ID NO: 2786799 - RNA, 19 nt, Human
uguauuuuucuacauuauu

SEQ ID NO: 2786800 - RNA, 22 nt, Human
uguauuuuucuacauuauugcu

SEQ ID NO: 2786801 - RNA, 14 nt, Human
ugucaagaaagagc

SEQ ID NO: 2786802 - RNA, 18 nt, Human
uguauuuuuucuugcauu

SEQ ID NO: 2786803 - RNA, 19 nt, Human
uguauuuuuucuugcauug

SEQ ID NO: 2786804 - RNA, 20 nt, Human
uguauuuuuucuugcauuga

SEQ ID NO: 2786805 - RNA, 21 nt, Human
uguauuuuuucuugcauugac

SEQ ID NO: 2786806 - RNA, 19 nt, Human
ugucaagaagaugaucaga

SEQ ID NO: 2786807 - RNA, 16 nt, Human
uguauuuuuauauaau

SEQ ID NO: 2786808 - RNA, 23 nt, Human
uguauuuuuauauaauaucuaaa

SEQ ID NO: 2786809 - RNA, 14 nt, Human
uguauuuuguguga

SEQ ID NO: 2786810 - RNA, 15 nt, Human
uguauuuugugugac

SEQ ID NO: 2786811 - RNA, 16 nt, Human
uguauuuugugugacc

SEQ ID NO: 2786812 - RNA, 19 nt, Human
uguauuuugugugaccaac

SEQ ID NO: 2786813 - RNA, 17 nt, Human
uguauuuuuaaagcaug

SEQ ID NO: 2786814 - RNA, 21 nt, Human
uguauuauuucauuauguaaa

SEQ ID NO: 2786815 - RNA, 13 nt, Human
uguauuauuucau

SEQ ID NO: 2786816 - RNA, 20 nt, Human
uguauuauuucauuauguaa

SEQ ID NO: 2786817 - RNA, 14 nt, Human
uguauuauuuauaa

SEQ ID NO: 2786818 - RNA, 15 nt, Human
uguauuauuuauaau

SEQ ID NO: 2786819 - RNA, 12 nt, Human
uguauuauugcu

SEQ ID NO: 2786820 - RNA, 14 nt, Human
uguauuauugcugu

SEQ ID NO: 2786821 - RNA, 15 nt, Human
uguauuauugcuguu

SEQ ID NO: 2786822 - RNA, 18 nt, Human
uguauuauugcuguugcu

SEQ ID NO: 2786823 - RNA, 16 nt, Human
uguaguaauugacaug

SEQ ID NO: 2786824 - RNA, 15 nt, Human
uguaguaauugacau

SEQ ID NO: 2786825 - RNA, 14 nt, Human
uguaguaauugaca

SEQ ID NO: 2786826 - RNA, 19 nt, Human
uguaguaaagccguuguuu

SEQ ID NO: 2786827 - RNA, 20 nt, Human
uguaguaaagccguuguuua

SEQ ID NO: 2786828 - RNA, 22 nt, Human
uguaguaaagccguuguuuacu

SEQ ID NO: 2786829 - RNA, 17 nt, Human
ugucaaugauuauuuuc

SEQ ID NO: 2786830 - RNA, 18 nt, Human
aguagcugggauuuuaaa

SEQ ID NO: 2786831 - RNA, 21 nt, Human
aguagcugggauuuuaaacua

SEQ ID NO: 2786832 - RNA, 22 nt, Human
aguagcugggauuuuaaacuag

SEQ ID NO: 2786833 - RNA, 23 nt, Human
aguagcugggauuuuaaacuaga

SEQ ID NO: 2786834 - RNA, 13 nt, Human
aguagcuugcucc

SEQ ID NO: 2786835 - RNA, 14 nt, Human
aguagcuugcuccc

SEQ ID NO: 2786836 - RNA, 16 nt, Human
aguagcuugcucccug

SEQ ID NO: 2786837 - RNA, 17 nt, Human
aguagcuugcucccugu

SEQ ID NO: 2786838 - RNA, 18 nt, Human
aguagcuugcucccugug

SEQ ID NO: 2786839 - RNA, 19 nt, Human
aguagcuugcucccugugu

SEQ ID NO: 2786840 - RNA, 23 nt, Human
aguagcuugcucccuguguccac

SEQ ID NO: 2786841 - RNA, 18 nt, Human
aguagucagcuagaucau

SEQ ID NO: 2786842 - RNA, 18 nt, Human
aguaguucuguuuggugu

SEQ ID NO: 2786843 - RNA, 19 nt, Human
aguaguucucuugguguua

SEQ ID NO: 2786844 - RNA, 13 nt, Human
aguagucugcuca

SEQ ID NO: 2786845 - RNA, 14 nt, Human
aguagucugcucac

SEQ ID NO: 2786846 - RNA, 13 nt, Human
aguaguuauauaa

SEQ ID NO: 2786847 - RNA, 18 nt, Human
aguaguuauauaauuguu

SEQ ID NO: 2786848 - RNA, 12 nt, Human
aguaguuaaaaa

SEQ ID NO: 2786849 - RNA, 14 nt, Human
aguaguuaaaaaaa

SEQ ID NO: 2786850 - RNA, 23 nt, Human
aguaguuaaaaaaaaaaaaagga

SEQ ID NO: 2786851 - RNA, 16 nt, Human
aguaguccuuggcaua

SEQ ID NO: 2786852 - RNA, 17 nt, Human
ugucaauccagauggug

SEQ ID NO: 2786853 - RNA, 21 nt, Human
aguagggaggaccacaggugu

SEQ ID NO: 2786854 - RNA, 18 nt, Human
aguagggcuuaguguuuu

SEQ ID NO: 2786855 - RNA, 23 nt, Human
aguaggggaggagcacaguuugu

SEQ ID NO: 2786856 - RNA, 13 nt, Human
aguauuucagugu

SEQ ID NO: 2786857 - RNA, 14 nt, Human
aguauuucagugua

SEQ ID NO: 2786858 - RNA, 17 nt, Human
aguauuucaguguaguu

SEQ ID NO: 2786859 - RNA, 20 nt, Human
aguauuucaguguaguuaau

SEQ ID NO: 2786860 - RNA, 23 nt, Human
aguauuucaguguaguuaauuua

SEQ ID NO: 2786861 - RNA, 16 nt, Human
aguauuugagaguucu

SEQ ID NO: 2786862 - RNA, 23 nt, Human
aguauuugaaacugaauguuuau

SEQ ID NO: 2786863 - RNA, 12 nt, Human
aguauuugaauu

SEQ ID NO: 2786864 - RNA, 13 nt, Human
aguauuugaauua

SEQ ID NO: 2786865 - RNA, 15 nt, Human
aguauuugaauuaaa

SEQ ID NO: 2786866 - RNA, 16 nt, Human
aguauuugaauuaaaa

SEQ ID NO: 2786867 - RNA, 17 nt, Human
aguauuugaauuaaaac

SEQ ID NO: 2786868 - RNA, 20 nt, Human
aguauuugaauuaaaacuuc

SEQ ID NO: 2786869 - RNA, 21 nt, Human
aguauuugaauuaaaacuucu

SEQ ID NO: 2786870 - RNA, 22 nt, Human
aguauuugaauuaaaacuucuu

SEQ ID NO: 2786871 - RNA, 17 nt, Human
aguauuugggaagugaa

SEQ ID NO: 2786872 - RNA, 13 nt, Human
aguauuugauuca

SEQ ID NO: 2786873 - RNA, 17 nt, Human
aguauuugauucaaaau

SEQ ID NO: 2786874 - RNA, 19 nt, Human
aguauuugauucaaaauau

SEQ ID NO: 2786875 - RNA, 20 nt, Human
aguauuugauucaaaauauu

SEQ ID NO: 2786876 - RNA, 23 nt, Human
aguauuugauucaaaauauuuaa

SEQ ID NO: 2786877 - RNA, 14 nt, Human
agucaccaagccca

SEQ ID NO: 2786878 - RNA, 13 nt, Human
agucaccaagccc

SEQ ID NO: 2786879 - RNA, 14 nt, Human
aguaugucugaugg

SEQ ID NO: 2786880 - RNA, 14 nt, Human
aguaugugccagga

SEQ ID NO: 2786881 - RNA, 21 nt, Human
aguaugugccaggaaacucuu

SEQ ID NO: 2786882 - RNA, 21 nt, Human
aguauguaaaguauguaaaca

SEQ ID NO: 2786883 - RNA, 16 nt, Human
aguauuucaugcuggg

SEQ ID NO: 2786884 - RNA, 13 nt, Human
aguauuucauugc

SEQ ID NO: 2786885 - RNA, 15 nt, Human
aguauuucauugccu

SEQ ID NO: 2786886 - RNA, 19 nt, Human
aguauuucauugccugugu

SEQ ID NO: 2786887 - RNA, 21 nt, Human
aguauuucauugccuguguau

SEQ ID NO: 2786888 - RNA, 18 nt, Human
aguauuuccacuuguucu

SEQ ID NO: 2786889 - RNA, 22 nt, Human
aguauuuccacuuguucucagg

SEQ ID NO: 2786890 - RNA, 15 nt, Human
aguauaaaaacuuga

SEQ ID NO: 2786891 - RNA, 17 nt, Human
aguauaaaauacaacaa

SEQ ID NO: 2786892 - RNA, 21 nt, Human
aguauaaaauacaacaaagga

SEQ ID NO: 2786893 - RNA, 12 nt, Human
aguaguuuguau

SEQ ID NO: 2786894 - RNA, 17 nt, Human
aguaguuuguauaacuu

SEQ ID NO: 2786895 - RNA, 21 nt, Human
aguaguuuuuacagcuguguu

SEQ ID NO: 2786896 - RNA, 15 nt, Human
aguauguaaaguaug

SEQ ID NO: 2786897 - RNA, 16 nt, Human
aguauguaaaguaugu

SEQ ID NO: 2786898 - RNA, 17 nt, Human
aguauaaccauaugaua

SEQ ID NO: 2786899 - RNA, 19 nt, Human
aguauaaccauaugauacu

SEQ ID NO: 2786900 - RNA, 15 nt, Human
ugucaguauccaggc

SEQ ID NO: 2786901 - RNA, 16 nt, Human
ugucaguauuauucua

SEQ ID NO: 2786902 - RNA, 14 nt, Human
ugucaguauccagg

SEQ ID NO: 2786903 - RNA, 16 nt, Human
ugucagguggggcagc

SEQ ID NO: 2786904 - RNA, 22 nt, Human
ugucaggggcggggagggugac

SEQ ID NO: 2786905 - RNA, 14 nt, Human
ugucaggccugugu

SEQ ID NO: 2786906 - RNA, 17 nt, Human
ugucagcucucaucuga

SEQ ID NO: 2786907 - RNA, 20 nt, Human
ugucagcucucaucugaggc

SEQ ID NO: 2786908 - RNA, 17 nt, Human
ugucaggaacagaagga

SEQ ID NO: 2786909 - RNA, 16 nt, Human
ugucaggaacagaagg

SEQ ID NO: 2786910 - RNA, 20 nt, Human
ugucaggaacagaaggauga

SEQ ID NO: 2786911 - RNA, 18 nt, Human
ugucaggaacagaaggau

SEQ ID NO: 2786912 - RNA, 16 nt, Human
agucacugauguacaa

SEQ ID NO: 2786913 - RNA, 23 nt, Human
agucacugauguacaauuaaaaa

SEQ ID NO: 2786914 - RNA, 13 nt, Human
agucacugcacag

SEQ ID NO: 2786915 - RNA, 17 nt, Human
agucacugccacuuugc

SEQ ID NO: 2786916 - RNA, 18 nt, Human
agucacugccacuuugca

SEQ ID NO: 2786917 - RNA, 19 nt, Human
agucacugccacuuugcac

SEQ ID NO: 2786918 - RNA, 20 nt, Human
agucacugccacuuugcaca

SEQ ID NO: 2786919 - RNA, 21 nt, Human
agucacugccacuuugcacau

SEQ ID NO: 2786920 - RNA, 22 nt, Human
agucagagccccuacagcauug

SEQ ID NO: 2786921 - RNA, 23 nt, Human
agucagagccccuacagcauugu

SEQ ID NO: 2786922 - RNA, 20 nt, Human
ugucuaaacaaugcugauuu

SEQ ID NO: 2786923 - RNA, 21 nt, Human
ugucuaaacaaugcugauuug

SEQ ID NO: 2786924 - RNA, 15 nt, Human
agucagacugcuggg

SEQ ID NO: 2786925 - RNA, 16 nt, Human
agucagacagaugugg

SEQ ID NO: 2786926 - RNA, 21 nt, Human
ugucguuaaaaaguuguuugu

SEQ ID NO: 2786927 - RNA, 23 nt, Human
ugucguuaaaaaguuguuuguuu

SEQ ID NO: 2786928 - RNA, 13 nt, Human
ugucuaaaaacac

SEQ ID NO: 2786929 - RNA, 15 nt, Human
ugucuaaaaaccaga

SEQ ID NO: 2786930 - RNA, 16 nt, Human
ugucuaaacaaugcug

SEQ ID NO: 2786931 - RNA, 17 nt, Human
ugucuaaacaaugcuga

SEQ ID NO: 2786932 - RNA, 15 nt, Human
ugucgcccagucugg

SEQ ID NO: 2786933 - RNA, 14 nt, Human
ugucgcccagucug

SEQ ID NO: 2786934 - RNA, 23 nt, Human
ugucgugagugucucuugucuaa

SEQ ID NO: 2786935 - RNA, 23 nt, Human
ugucguagccaaggugggcugag

SEQ ID NO: 2786936 - RNA, 21 nt, Human
ugucguggguguguguagcca

SEQ ID NO: 2786937 - RNA, 15 nt, Human
ugucgggcaccagcc

SEQ ID NO: 2786938 - RNA, 19 nt, Human
ugucgggcaccagccagcg

SEQ ID NO: 2786939 - RNA, 12 nt, Human
ugucauuugcuu

SEQ ID NO: 2786940 - RNA, 13 nt, Human
ugucauuuguuaa

SEQ ID NO: 2786941 - RNA, 16 nt, Human
ugucauuuguuaaaau

SEQ ID NO: 2786942 - RNA, 17 nt, Human
ugucauuuguugugaug

SEQ ID NO: 2786943 - RNA, 18 nt, Human
ugucauuuguugugaugu

SEQ ID NO: 2786944 - RNA, 15 nt, Human
uguccgcuggguggu

SEQ ID NO: 2786945 - RNA, 20 nt, Human
uguccgcugggugguacccu

SEQ ID NO: 2786946 - RNA, 17 nt, Human
uguccggaaugccaccc

SEQ ID NO: 2786947 - RNA, 19 nt, Human
uguccuaaggaaccuuccu

SEQ ID NO: 2786948 - RNA, 16 nt, Human
uguccuaaggaaccuu

SEQ ID NO: 2786949 - RNA, 22 nt, Human
uguccgcugggugguacccucu

SEQ ID NO: 2786950 - RNA, 23 nt, Human
uguccgcugggugguacccucug

SEQ ID NO: 2786951 - RNA, 16 nt, Human
uguccuacccacccuc

SEQ ID NO: 2786952 - RNA, 13 nt, Human
uguccuuucccuu

SEQ ID NO: 2786953 - RNA, 14 nt, Human
uguccuuucccuuc

SEQ ID NO: 2786954 - RNA, 14 nt, Human
uguccuaauucuuc

SEQ ID NO: 2786955 - RNA, 16 nt, Human
uguccuaauucuucug

SEQ ID NO: 2786956 - RNA, 18 nt, Human
uguccuaauucuucuguc

SEQ ID NO: 2786957 - RNA, 19 nt, Human
uguccuaauucuucugucc

SEQ ID NO: 2786958 - RNA, 20 nt, Human
uguccuaauucuucuguccu

SEQ ID NO: 2786959 - RNA, 16 nt, Human
uguccuuuugucuucu

SEQ ID NO: 2786960 - RNA, 23 nt, Human
uguccuuucccuucaguacccuc

SEQ ID NO: 2786961 - RNA, 18 nt, Human
ugucaguauuucagugua

SEQ ID NO: 2786962 - RNA, 20 nt, Human
ugucgaaaagagucuuccaa

SEQ ID NO: 2786963 - RNA, 22 nt, Human
ugucgaaaagagucuuccaauu

SEQ ID NO: 2786964 - RNA, 16 nt, Human
ugucgcccaggcugga

SEQ ID NO: 2786965 - RNA, 15 nt, Human
ugucgcccaggcugg

SEQ ID NO: 2786966 - RNA, 21 nt, Human
agucccugacucucugugacc

SEQ ID NO: 2786967 - RNA, 15 nt, Human
agucccuauguauuu

SEQ ID NO: 2786968 - RNA, 19 nt, Human
agucccugacucucuguga

SEQ ID NO: 2786969 - RNA, 20 nt, Human
agucccuauguauuugcagu

SEQ ID NO: 2786970 - RNA, 20 nt, Human
aguccagaaacuguucccac

SEQ ID NO: 2786971 - RNA, 14 nt, Human
agucagggcccaga

SEQ ID NO: 2786972 - RNA, 15 nt, Human
agucagggcccagag

SEQ ID NO: 2786973 - RNA, 16 nt, Human
agucagggcccagagg

SEQ ID NO: 2786974 - RNA, 20 nt, Human
agucagggcccagaggcuga

SEQ ID NO: 2786975 - RNA, 22 nt, Human
agucaggaguccaagaccagac

SEQ ID NO: 2786976 - RNA, 13 nt, Human
aguccagccugga

SEQ ID NO: 2786977 - RNA, 13 nt, Human
aguccaggcacag

SEQ ID NO: 2786978 - RNA, 14 nt, Human
aguccaggcacagg

SEQ ID NO: 2786979 - RNA, 16 nt, Human
aguccaggcacaggau

SEQ ID NO: 2786980 - RNA, 19 nt, Human
aguccaggcacaggaugcu

SEQ ID NO: 2786981 - RNA, 15 nt, Human
aguccagccuggaga

SEQ ID NO: 2786982 - RNA, 13 nt, Human
aguccaggaacaa

SEQ ID NO: 2786983 - RNA, 23 nt, Human
aguccgaaagggacuuggaagcu

SEQ ID NO: 2786984 - RNA, 23 nt, Human
agucccuuccccucccuggcucc

SEQ ID NO: 2786985 - RNA, 15 nt, Human
aguccgcagaagccc

SEQ ID NO: 2786986 - RNA, 22 nt, Human
agucccuuccccucccuggcuc

SEQ ID NO: 2786987 - RNA, 21 nt, Human
agucccuuccccucccuggcu

SEQ ID NO: 2786988 - RNA, 20 nt, Human
agucccuuccccucccuggc

SEQ ID NO: 2786989 - RNA, 19 nt, Human
agucccuuccccucccugg

SEQ ID NO: 2786990 - RNA, 17 nt, Human
agucccuuccccucccu

SEQ ID NO: 2786991 - RNA, 15 nt, Human
agucccuuccccucc

SEQ ID NO: 2786992 - RNA, 14 nt, Human
agucccuuccccuc

SEQ ID NO: 2786993 - RNA, 13 nt, Human
agucccuuccccu

SEQ ID NO: 2786994 - RNA, 18 nt, Human
aguccguguggauccaau

SEQ ID NO: 2786995 - RNA, 19 nt, Human
aguccguguggauccaaug

SEQ ID NO: 2786996 - RNA, 18 nt, Human
aguccgcagaagcccuga

SEQ ID NO: 2786997 - RNA, 17 nt, Human
aguccggacccaccuca

SEQ ID NO: 2786998 - RNA, 22 nt, Human
aguccggacccaccucaccccg

SEQ ID NO: 2786999 - RNA, 17 nt, Human
aguccgcagaagcccug

SEQ ID NO: 2787000 - RNA, 17 nt, Human
agucucacuguugccca

SEQ ID NO: 2787001 - RNA, 16 nt, Human
agucucacuguugccc

SEQ ID NO: 2787002 - RNA, 19 nt, Human
agucucaaaaauacaaaau

SEQ ID NO: 2787003 - RNA, 20 nt, Human
agucucaaaaauacaaaaua

SEQ ID NO: 2787004 - RNA, 21 nt, Human
agucucaaaaauacaaaauaa

SEQ ID NO: 2787005 - RNA, 16 nt, Human
agucuagauucucugg

SEQ ID NO: 2787006 - RNA, 13 nt, Human
agucuagauucuc

SEQ ID NO: 2787007 - RNA, 14 nt, Human
agucuagauucucu

SEQ ID NO: 2787008 - RNA, 20 nt, Human
agucuagauucucuggcugu

SEQ ID NO: 2787009 - RNA, 16 nt, Human
agucuagcacucauuu

SEQ ID NO: 2787010 - RNA, 20 nt, Human
agucuagcacucauuuucua

SEQ ID NO: 2787011 - RNA, 13 nt, Human
agucguuuuccaa

SEQ ID NO: 2787012 - RNA, 14 nt, Human
agucguuuuccaaa

SEQ ID NO: 2787013 - RNA, 20 nt, Human
agucuaaagauggaguuucu

SEQ ID NO: 2787014 - RNA, 21 nt, Human
agucuaaagauggaguuucua

SEQ ID NO: 2787015 - RNA, 20 nt, Human
agucuacgcucuccuuucuu

SEQ ID NO: 2787016 - RNA, 22 nt, Human
agucuaaagauggaguuucuaa

SEQ ID NO: 2787017 - RNA, 23 nt, Human
agucuagauguuuauucuucuag

SEQ ID NO: 2787018 - RNA, 14 nt, Human
agucuagauucaaa

SEQ ID NO: 2787019 - RNA, 15 nt, Human
agucuagauucaaag

SEQ ID NO: 2787020 - RNA, 18 nt, Human
agucuagauucaaagguu

SEQ ID NO: 2787021 - RNA, 20 nt, Human
agucuagauucaaagguucu

SEQ ID NO: 2787022 - RNA, 21 nt, Human
agucuagauucaaagguucua

SEQ ID NO: 2787023 - RNA, 22 nt, Human
agucuagauucaaagguucuag

SEQ ID NO: 2787024 - RNA, 14 nt, Human
agucuagaaguugu

SEQ ID NO: 2787025 - RNA, 22 nt, Human
agggcagggaccacacccugua

SEQ ID NO: 2787026 - RNA, 12 nt, Human
agggcagcccca

SEQ ID NO: 2787027 - RNA, 13 nt, Human
agggcagccccac

SEQ ID NO: 2787028 - RNA, 11 nt, Human
agggcaggugg

SEQ ID NO: 2787029 - RNA, 12 nt, Human
agggcagguggg

SEQ ID NO: 2787030 - RNA, 15 nt, Human
agggcagguggggug

SEQ ID NO: 2787031 - RNA, 19 nt, Human
agggcagguggggugagaa

SEQ ID NO: 2787032 - RNA, 12 nt, Human
agggccaggacu

SEQ ID NO: 2787033 - RNA, 17 nt, Human
agggccaggacugagcc

SEQ ID NO: 2787034 - RNA, 19 nt, Human
agggccaggacugagcccc

SEQ ID NO: 2787035 - RNA, 21 nt, Human
agggccaggacugagccccgc

SEQ ID NO: 2787036 - RNA, 10 nt, Human
agggccaggc

SEQ ID NO: 2787037 - RNA, 12 nt, Human
agggccaggcag

SEQ ID NO: 2787038 - RNA, 13 nt, Human
agggccaggcagg

SEQ ID NO: 2787039 - RNA, 14 nt, Human
agggccaggcaggu

SEQ ID NO: 2787040 - RNA, 21 nt, Human
agggccaggcaggugccugga

SEQ ID NO: 2787041 - RNA, 22 nt, Human
agggccaggcaggugccuggac

SEQ ID NO: 2787042 - RNA, 18 nt, Human
agggcccagagagggugg

SEQ ID NO: 2787043 - RNA, 18 nt, Human
agggccaguccugccugg

SEQ ID NO: 2787044 - RNA, 17 nt, Human
agggccaguccugccug

SEQ ID NO: 2787045 - RNA, 23 nt, Human
agggcccagagaggguggugacc

SEQ ID NO: 2787046 - RNA, 16 nt, Human
agggccaguccugccu

SEQ ID NO: 2787047 - RNA, 13 nt, Human
agggccaguccug

SEQ ID NO: 2787048 - RNA, 22 nt, Human
agggccagggcccugcagaggg

SEQ ID NO: 2787049 - RNA, 19 nt, Human
agggccagggcccugcaga

SEQ ID NO: 2787050 - RNA, 15 nt, Human
agggccagggcccug

SEQ ID NO: 2787051 - RNA, 14 nt, Human
agggccagggcccu

SEQ ID NO: 2787052 - RNA, 12 nt, Human
agggccagggcc

SEQ ID NO: 2787053 - RNA, 20 nt, Human
agggccgaggaggugccugg

SEQ ID NO: 2787054 - RNA, 21 nt, Human
agggccgaggaggugccugga

SEQ ID NO: 2787055 - RNA, 18 nt, Human
agggcccagagcaggaag

SEQ ID NO: 2787056 - RNA, 15 nt, Human
agggcccagagcagg

SEQ ID NO: 2787057 - RNA, 17 nt, Human
agggcccagagcaggaa

SEQ ID NO: 2787058 - RNA, 12 nt, Human
agggcccagagc

SEQ ID NO: 2787059 - RNA, 13 nt, Human
agggcccagagca

SEQ ID NO: 2787060 - RNA, 14 nt, Human
agggcccagagcag

SEQ ID NO: 2787061 - RNA, 23 nt, Human
ugggcccaagacagaugccccag

SEQ ID NO: 2787062 - RNA, 22 nt, Human
ugggcccaagacagaugcccca

SEQ ID NO: 2787063 - RNA, 14 nt, Human
ugggcccagaucug

SEQ ID NO: 2787064 - RNA, 13 nt, Human
ugggcccagaucu

SEQ ID NO: 2787065 - RNA, 19 nt, Human
agggagugacagaggcagc

SEQ ID NO: 2787066 - RNA, 18 nt, Human
agggagugacagaggcag

SEQ ID NO: 2787067 - RNA, 17 nt, Human
agggagugacagaggca

SEQ ID NO: 2787068 - RNA, 17 nt, Human
agggaggugaccccagg

SEQ ID NO: 2787069 - RNA, 16 nt, Human
agggaggucaggcccu

SEQ ID NO: 2787070 - RNA, 17 nt, Human
agggaggucaggcccug

SEQ ID NO: 2787071 - RNA, 18 nt, Human
agggaggucaggcccugg

SEQ ID NO: 2787072 - RNA, 22 nt, Human
agggaggucaggcccuggaacu

SEQ ID NO: 2787073 - RNA, 16 nt, Human
ugggcaacccccagcc

SEQ ID NO: 2787074 - RNA, 17 nt, Human
ugggauuucuaugcagu

SEQ ID NO: 2787075 - RNA, 14 nt, Human
ugggauuuaauuuc

SEQ ID NO: 2787076 - RNA, 16 nt, Human
ugggauuuaauuucca

SEQ ID NO: 2787077 - RNA, 17 nt, Human
ugggauuuaauuuccag

SEQ ID NO: 2787078 - RNA, 10 nt, Human
ugggauugcu

SEQ ID NO: 2787079 - RNA, 23 nt, Human
ugggauugacagaagcuucugcc

SEQ ID NO: 2787080 - RNA, 16 nt, Human
ugggaggucaggaaac

SEQ ID NO: 2787081 - RNA, 17 nt, Human
ugggaggucaggaaacu

SEQ ID NO: 2787082 - RNA, 14 nt, Human
ugggaggucuugcu

SEQ ID NO: 2787083 - RNA, 17 nt, Human
ugggauucaggaaugug

SEQ ID NO: 2787084 - RNA, 19 nt, Human
ugggagguggagguugcau

SEQ ID NO: 2787085 - RNA, 16 nt, Human
aggccuuccucucucc

SEQ ID NO: 2787086 - RNA, 18 nt, Human
aggccuuccucucuccag

SEQ ID NO: 2787087 - RNA, 19 nt, Human
aggccuuccucucuccaga

SEQ ID NO: 2787088 - RNA, 13 nt, Human
aggccuucuccuc

SEQ ID NO: 2787089 - RNA, 22 nt, Human
aggccuucuccuccccacccgc

SEQ ID NO: 2787090 - RNA, 15 nt, Human
aggccuuccagcugc

SEQ ID NO: 2787091 - RNA, 16 nt, Human
aggccuuccagcugcu

SEQ ID NO: 2787092 - RNA, 17 nt, Human
aggccuuccagcugcug

SEQ ID NO: 2787093 - RNA, 18 nt, Human
aggccuuccagcugcugu

SEQ ID NO: 2787094 - RNA, 20 nt, Human
aggccuuccagcugcugucu

SEQ ID NO: 2787095 - RNA, 15 nt, Human
aggccuuccucucuc

SEQ ID NO: 2787096 - RNA, 19 nt, Human
aggccuuaucuccaagacc

SEQ ID NO: 2787097 - RNA, 18 nt, Human
aggccuuaugaggguccu

SEQ ID NO: 2787098 - RNA, 17 nt, Human
aggccuuaucuccaaga

SEQ ID NO: 2787099 - RNA, 20 nt, Human
ugggcaacccccagccugcu

SEQ ID NO: 2787100 - RNA, 17 nt, Human
ugggcaacccccagccu

SEQ ID NO: 2787101 - RNA, 22 nt, Human
ugggcacacgccucccacuggg

SEQ ID NO: 2787102 - RNA, 20 nt, Human
ugggcacccacccugggacc

SEQ ID NO: 2787103 - RNA, 16 nt, Human
ugggcaccccacugca

SEQ ID NO: 2787104 - RNA, 14 nt, Human
ugggcacccacccu

SEQ ID NO: 2787105 - RNA, 16 nt, Human
ugggcacccacccugg

SEQ ID NO: 2787106 - RNA, 17 nt, Human
ugggccagaauuucaaa

SEQ ID NO: 2787107 - RNA, 16 nt, Human
ugggcacacucugcca

SEQ ID NO: 2787108 - RNA, 15 nt, Human
ugggccacuguggug

SEQ ID NO: 2787109 - RNA, 17 nt, Human
ugggccaccccuccuag

SEQ ID NO: 2787110 - RNA, 22 nt, Human
ugggccagccccuccaucugua

SEQ ID NO: 2787111 - RNA, 14 nt, Human
ugggccagccccuc

SEQ ID NO: 2787112 - RNA, 13 nt, Human
ugggccagccccu

SEQ ID NO: 2787113 - RNA, 18 nt, Human
ugggccagaauuucaaac

SEQ ID NO: 2787114 - RNA, 24 nt, Human
ugggccauguccaaagaggcugcc

SEQ ID NO: 2787115 - RNA, 18 nt, Human
ugggcuggaacagauuca

SEQ ID NO: 2787116 - RNA, 16 nt, Human
ugggcugcuccucaug

SEQ ID NO: 2787117 - RNA, 15 nt, Human
ugggcugcuccucau

SEQ ID NO: 2787118 - RNA, 11 nt, Human
uggggacccac

SEQ ID NO: 2787119 - RNA, 13 nt, Human
uggggacccaggc

SEQ ID NO: 2787120 - RNA, 14 nt, Human
uggggacccaggcu

SEQ ID NO: 2787121 - RNA, 21 nt, Human
uggggacccaggcuccgcccu

SEQ ID NO: 2787122 - RNA, 22 nt, Human
uggggacccaggcuccgcccuu

SEQ ID NO: 2787123 - RNA, 17 nt, Human
uggggacagagcagaac

SEQ ID NO: 2787124 - RNA, 19 nt, Human
uggggacagauucagucuu

SEQ ID NO: 2787125 - RNA, 21 nt, Human
uggggacagauucagucuugc

SEQ ID NO: 2787126 - RNA, 21 nt, Human
ugggcugaccccgguggcggc

SEQ ID NO: 2787127 - RNA, 13 nt, Human
ugggcucuuccaa

SEQ ID NO: 2787128 - RNA, 12 nt, Human
ugggcugagccc

SEQ ID NO: 2787129 - RNA, 16 nt, Human
ugggcugagcccuggc

SEQ ID NO: 2787130 - RNA, 15 nt, Human
ugggcugagcccugg

SEQ ID NO: 2787131 - RNA, 18 nt, Human
ugggcugagcccuggcag

SEQ ID NO: 2787132 - RNA, 17 nt, Human
ugggcugagcccuggca

SEQ ID NO: 2787133 - RNA, 17 nt, Human
ugggcugcccuggugcu

SEQ ID NO: 2787134 - RNA, 19 nt, Human
ugggcugcccuggugcugc

SEQ ID NO: 2787135 - RNA, 20 nt, Human
ugggcugcccuggugcugcc

SEQ ID NO: 2787136 - RNA, 17 nt, Human
ugggcugcuacccagaa

SEQ ID NO: 2787137 - RNA, 16 nt, Human
ugggcugcccuggugc

SEQ ID NO: 2787138 - RNA, 21 nt, Human
ugggcugcccuggugcugcca

SEQ ID NO: 2787139 - RNA, 15 nt, Human
agggccugagccugg

SEQ ID NO: 2787140 - RNA, 15 nt, Human
agggcuuacuauuuc

SEQ ID NO: 2787141 - RNA, 20 nt, Human
agggccucaaaggcccgcuc

SEQ ID NO: 2787142 - RNA, 16 nt, Human
uggggaggugucacau

SEQ ID NO: 2787143 - RNA, 16 nt, Human
uggggagguguucacu

SEQ ID NO: 2787144 - RNA, 23 nt, Human
uggggagguguucacugaagacg

SEQ ID NO: 2787145 - RNA, 19 nt, Human
uggggaguaggacauacca

SEQ ID NO: 2787146 - RNA, 12 nt, Human
uggggagaaagu

SEQ ID NO: 2787147 - RNA, 15 nt, Human
uggggaggggcugug

SEQ ID NO: 2787148 - RNA, 21 nt, Human
uggggacgcuccgcugccgug

SEQ ID NO: 2787149 - RNA, 18 nt, Human
uggggaccugguacccuc

SEQ ID NO: 2787150 - RNA, 18 nt, Human
uggggcggugagagggga

SEQ ID NO: 2787151 - RNA, 14 nt, Human
uggggcgaggcagg

SEQ ID NO: 2787152 - RNA, 15 nt, Human
uggggcucugugcag

SEQ ID NO: 2787153 - RNA, 22 nt, Human
uggggcucucugaguccuggcc

SEQ ID NO: 2787154 - RNA, 23 nt, Human
uggggcucuaggguugcuggagc

SEQ ID NO: 2787155 - RNA, 23 nt, Human
uggggcuaggaaauccagggugg

SEQ ID NO: 2787156 - RNA, 14 nt, Human
agggcuugugaaca

SEQ ID NO: 2787157 - RNA, 18 nt, Human
uggggccuacagcuuuga

SEQ ID NO: 2787158 - RNA, 16 nt, Human
uggggccuagacucug

SEQ ID NO: 2787159 - RNA, 12 nt, Human
uggggccuuggu

SEQ ID NO: 2787160 - RNA, 13 nt, Human
uggggccugugga

SEQ ID NO: 2787161 - RNA, 14 nt, Human
uggggccuguggaa

SEQ ID NO: 2787162 - RNA, 16 nt, Human
uggggccuguggaaug

SEQ ID NO: 2787163 - RNA, 21 nt, Human
uggggccuguggaaugagugu

SEQ ID NO: 2787164 - RNA, 22 nt, Human
uggggccuguggaaugagugug

SEQ ID NO: 2787165 - RNA, 20 nt, Human
ugggguacccacugcucugg

SEQ ID NO: 2787166 - RNA, 21 nt, Human
ugggguaccaagagacuccuu

SEQ ID NO: 2787167 - RNA, 16 nt, Human
ugggguacccacugcu

SEQ ID NO: 2787168 - RNA, 15 nt, Human
ugggguacccacugc

SEQ ID NO: 2787169 - RNA, 16 nt, Human
ugggguagggcugacu

SEQ ID NO: 2787170 - RNA, 13 nt, Human
ugggguagggcug

SEQ ID NO: 2787171 - RNA, 14 nt, Human
ugggguacccacug

SEQ ID NO: 2787172 - RNA, 17 nt, Human
ugggggaagaccuggca

SEQ ID NO: 2787173 - RNA, 12 nt, Human
uggggcuuggcg

SEQ ID NO: 2787174 - RNA, 16 nt, Human
uggggcuuggcgugga

SEQ ID NO: 2787175 - RNA, 18 nt, Human
uggggcuuggcguggagc

SEQ ID NO: 2787176 - RNA, 22 nt, Human
uggggcuuucguccacagcuuc

SEQ ID NO: 2787177 - RNA, 23 nt, Human
uggggcuuucguccacagcuucc

SEQ ID NO: 2787178 - RNA, 15 nt, Human
ugggggaaagcacag

SEQ ID NO: 2787179 - RNA, 17 nt, Human
uggggcucugugcaggg

SEQ ID NO: 2787180 - RNA, 13 nt, Human
uggggcugggccc

SEQ ID NO: 2787181 - RNA, 17 nt, Human
ugguaauguguuuuaga

SEQ ID NO: 2787182 - RNA, 12 nt, Human
uggguggggcug

SEQ ID NO: 2787183 - RNA, 15 nt, Human
ugguaagagacagaa

SEQ ID NO: 2787184 - RNA, 20 nt, Human
ugguaagagacagaauguau

SEQ ID NO: 2787185 - RNA, 22 nt, Human
ugguaagagacagaauguaucu

SEQ ID NO: 2787186 - RNA, 15 nt, Human
uggguggcacugcca

SEQ ID NO: 2787187 - RNA, 15 nt, Human
uggguggccucggga

SEQ ID NO: 2787188 - RNA, 17 nt, Human
ugguacucauuaaaaaa

SEQ ID NO: 2787189 - RNA, 18 nt, Human
ugguacggagauguuuca

SEQ ID NO: 2787190 - RNA, 15 nt, Human
ugguacgugacccuc

SEQ ID NO: 2787191 - RNA, 20 nt, Human
ugguacgugacccucugcug

SEQ ID NO: 2787192 - RNA, 17 nt, Human
ugguacucccucucagg

SEQ ID NO: 2787193 - RNA, 20 nt, Human
ugguagcuuuucccuucuuu

SEQ ID NO: 2787194 - RNA, 22 nt, Human
ugguacucccucucaggaucca

SEQ ID NO: 2787195 - RNA, 16 nt, Human
ugguacucugaaacac

SEQ ID NO: 2787196 - RNA, 24 nt, Human
ugguacuuagaguuucuguuugau

SEQ ID NO: 2787197 - RNA, 20 nt, Human
uggucacaggacucugccuc

SEQ ID NO: 2787198 - RNA, 22 nt, Human
uggucacaggacucugccuccu

SEQ ID NO: 2787199 - RNA, 23 nt, Human
uggucacaggacucugccuccuc

SEQ ID NO: 2787200 - RNA, 21 nt, Human
ugguagcuuuucccuucuuuu

SEQ ID NO: 2787201 - RNA, 17 nt, Human
ugguagcuuuucccuuc

SEQ ID NO: 2787202 - RNA, 18 nt, Human
ugggugcugauccuugca

SEQ ID NO: 2787203 - RNA, 13 nt, Human
ugggugcucagaa

SEQ ID NO: 2787204 - RNA, 14 nt, Human
ugggugcucagaau

SEQ ID NO: 2787205 - RNA, 15 nt, Human
ugggugcucagaaua

SEQ ID NO: 2787206 - RNA, 22 nt, Human
ugggugcucagaauaaggcagg

SEQ ID NO: 2787207 - RNA, 14 nt, Human
ugggucugugcauu

SEQ ID NO: 2787208 - RNA, 22 nt, Human
ugggucucgcuuuguugcccag

SEQ ID NO: 2787209 - RNA, 20 nt, Human
ugggucucgcuuuguugccc

SEQ ID NO: 2787210 - RNA, 14 nt, Human
ugggucuauuccag

SEQ ID NO: 2787211 - RNA, 15 nt, Human
ugggucuauuccagc

SEQ ID NO: 2787212 - RNA, 16 nt, Human
ugggucuauuccagcu

SEQ ID NO: 2787213 - RNA, 17 nt, Human
ugggucuauuccagcuc

SEQ ID NO: 2787214 - RNA, 18 nt, Human
ugggucuauuccagcuca

SEQ ID NO: 2787215 - RNA, 19 nt, Human
ugggucuauuccagcucau

SEQ ID NO: 2787216 - RNA, 20 nt, Human
ugggucuauuccagcucauu

SEQ ID NO: 2787217 - RNA, 21 nt, Human
agggucucacucugucgccca

SEQ ID NO: 2787218 - RNA, 22 nt, Human
agggucucacucugucgcccag

SEQ ID NO: 2787219 - RNA, 13 nt, Human
agggucucugcug

SEQ ID NO: 2787220 - RNA, 12 nt, Human
agggucucuccc

SEQ ID NO: 2787221 - RNA, 16 nt, Human
agggucucucccucag

SEQ ID NO: 2787222 - RNA, 17 nt, Human
agggucucucccucagg

SEQ ID NO: 2787223 - RNA, 14 nt, Human
agggucucugcugc

SEQ ID NO: 2787224 - RNA, 15 nt, Human
agggucucugcugcc

SEQ ID NO: 2787225 - RNA, 18 nt, Human
aggguggcccuugcaguu

SEQ ID NO: 2787226 - RNA, 14 nt, Human
aggguggcccuugc

SEQ ID NO: 2787227 - RNA, 11 nt, Human
aggguggcccu

SEQ ID NO: 2787228 - RNA, 19 nt, Human
agggugggagagcccagcc

SEQ ID NO: 2787229 - RNA, 18 nt, Human
agggugggagagcccagc

SEQ ID NO: 2787230 - RNA, 17 nt, Human
agggugggagagcccag

SEQ ID NO: 2787231 - RNA, 16 nt, Human
agggugggagagccca

SEQ ID NO: 2787232 - RNA, 16 nt, Human
agggucucugcugccg

SEQ ID NO: 2787233 - RNA, 15 nt, Human
aggggccuggcagcc

SEQ ID NO: 2787234 - RNA, 23 nt, Human
aggggcgccgcaaaccacacugg

SEQ ID NO: 2787235 - RNA, 14 nt, Human
aggggcgcccaccu

SEQ ID NO: 2787236 - RNA, 18 nt, Human
aggggccuggcagccgug

SEQ ID NO: 2787237 - RNA, 23 nt, Human
aggggccuggcagccgugccuuc

SEQ ID NO: 2787238 - RNA, 17 nt, Human
aggggacucagcccuga

SEQ ID NO: 2787239 - RNA, 14 nt, Human
aggggacucagccc

SEQ ID NO: 2787240 - RNA, 22 nt, Human
aggggacucagcccugagguga

SEQ ID NO: 2787241 - RNA, 23 nt, Human
aggggacucugggcuauggacac

SEQ ID NO: 2787242 - RNA, 15 nt, Human
agggggaggggaagu

SEQ ID NO: 2787243 - RNA, 16 nt, Human
agggggaggggaaguc

SEQ ID NO: 2787244 - RNA, 15 nt, Human
agggggaaggcaggg

SEQ ID NO: 2787245 - RNA, 22 nt, Human
agggggaaggugggguccugga

SEQ ID NO: 2787246 - RNA, 20 nt, Human
agggggacugcugcugccug

SEQ ID NO: 2787247 - RNA, 21 nt, Human
agggggacugcugcugccugg

SEQ ID NO: 2787248 - RNA, 22 nt, Human
agggggacugcugcugccuggc

SEQ ID NO: 2787249 - RNA, 12 nt, Human
agggggagaaaa

SEQ ID NO: 2787250 - RNA, 20 nt, Human
agggggagaaaaggaaaaga

SEQ ID NO: 2787251 - RNA, 21 nt, Human
agggggagaaaaggaaaagaa

SEQ ID NO: 2787252 - RNA, 18 nt, Human
aggggcuacaagagggaa

SEQ ID NO: 2787253 - RNA, 20 nt, Human
aggggcgugggaguggccug

SEQ ID NO: 2787254 - RNA, 18 nt, Human
aggggcggugcccacacc

SEQ ID NO: 2787255 - RNA, 15 nt, Human
aggggcuacaagagg

SEQ ID NO: 2787256 - RNA, 17 nt, Human
aggggcuacaagaggga

SEQ ID NO: 2787257 - RNA, 17 nt, Human
aggggcgggaauauugu

SEQ ID NO: 2787258 - RNA, 21 nt, Human
aggggcgggaauauuguuucu

SEQ ID NO: 2787259 - RNA, 16 nt, Human
aggggcgcccaccucc

SEQ ID NO: 2787260 - RNA, 23 nt, Human
agggggugauuagagggaggaga

SEQ ID NO: 2787261 - RNA, 21 nt, Human
agggguggguuccucuucccc

SEQ ID NO: 2787262 - RNA, 20 nt, Human
agggguggguuccucuuccc

SEQ ID NO: 2787263 - RNA, 16 nt, Human
agggggaugccacucc

SEQ ID NO: 2787264 - RNA, 23 nt, Human
agggggaugccacuccucccucc

SEQ ID NO: 2787265 - RNA, 23 nt, Human
agggucucacuauguugcccagg

SEQ ID NO: 2787266 - RNA, 22 nt, Human
agggucucacuauguugcccag

SEQ ID NO: 2787267 - RNA, 21 nt, Human
agggucucacuauguugccca

SEQ ID NO: 2787268 - RNA, 15 nt, Human
agggguguggcuccu

SEQ ID NO: 2787269 - RNA, 20 nt, Human
agguacuuuuugugaagacg

SEQ ID NO: 2787270 - RNA, 13 nt, Human
agguagaaaaagg

SEQ ID NO: 2787271 - RNA, 14 nt, Human
agguagaaaaaggg

SEQ ID NO: 2787272 - RNA, 16 nt, Human
agguagaaaaaggguc

SEQ ID NO: 2787273 - RNA, 17 nt, Human
agguagaaaaaggguca

SEQ ID NO: 2787274 - RNA, 18 nt, Human
agguagaaaaagggucaa

SEQ ID NO: 2787275 - RNA, 17 nt, Human
aggguuggccccugccc

SEQ ID NO: 2787276 - RNA, 15 nt, Human
aggguugggcccaga

SEQ ID NO: 2787277 - RNA, 22 nt, Human
agguacugucaugggcuaggca

SEQ ID NO: 2787278 - RNA, 23 nt, Human
aggguuggccccugcccggcugc

SEQ ID NO: 2787279 - RNA, 18 nt, Human
aggguuggccccugcccg

SEQ ID NO: 2787280 - RNA, 20 nt, Human
agguauaaguggugugugua

SEQ ID NO: 2787281 - RNA, 19 nt, Human
agguauaaguggugugugu

SEQ ID NO: 2787282 - RNA, 12 nt, Human
agguagaaacuu

SEQ ID NO: 2787283 - RNA, 18 nt, Human
aggguuggccugaguuag

SEQ ID NO: 2787284 - RNA, 15 nt, Human
agguagaaccucacc

SEQ ID NO: 2787285 - RNA, 14 nt, Human
aggucauuucuuca

SEQ ID NO: 2787286 - RNA, 14 nt, Human
aggucccaccucca

SEQ ID NO: 2787287 - RNA, 15 nt, Human
aggucccaccuccag

SEQ ID NO: 2787288 - RNA, 16 nt, Human
aggucccaccuccagc

SEQ ID NO: 2787289 - RNA, 17 nt, Human
aggucccaccuccagcc

SEQ ID NO: 2787290 - RNA, 18 nt, Human
aggucccaccuccagccc

SEQ ID NO: 2787291 - RNA, 19 nt, Human
aggucccaccuccagcccg

SEQ ID NO: 2787292 - RNA, 11 nt, Human
aggucccaggc

SEQ ID NO: 2787293 - RNA, 13 nt, Human
aggucccaggcag

SEQ ID NO: 2787294 - RNA, 12 nt, Human
aggucccaggca

SEQ ID NO: 2787295 - RNA, 12 nt, Human
aggucagagccu

SEQ ID NO: 2787296 - RNA, 19 nt, Human
aggucagacuaagaaauau

SEQ ID NO: 2787297 - RNA, 15 nt, Human
aggucauggccacac

SEQ ID NO: 2787298 - RNA, 16 nt, Human
aggucauggccacacu

SEQ ID NO: 2787299 - RNA, 18 nt, Human
aggucauggccacacugu

SEQ ID NO: 2787300 - RNA, 19 nt, Human
aggucauggccacacugug

SEQ ID NO: 2787301 - RNA, 21 nt, Human
aggucauggccacacugugac

SEQ ID NO: 2787302 - RNA, 19 nt, Human
aggucaccuuuauucuggc

SEQ ID NO: 2787303 - RNA, 12 nt, Human
aggucaccagca

SEQ ID NO: 2787304 - RNA, 18 nt, Human
aggucaccuuuauucugg

SEQ ID NO: 2787305 - RNA, 22 nt, Human
aggucacacgaccggggccagc

SEQ ID NO: 2787306 - RNA, 23 nt, Human
aggucacacgaccggggccagca

SEQ ID NO: 2787307 - RNA, 15 nt, Human
aggucacauaaaacu

SEQ ID NO: 2787308 - RNA, 20 nt, Human
agguauguugccuuuauggu

SEQ ID NO: 2787309 - RNA, 14 nt, Human
agguauguugccuu

SEQ ID NO: 2787310 - RNA, 22 nt, Human
agguauggaaggguuuguggcu

SEQ ID NO: 2787311 - RNA, 13 nt, Human
agguauggcucug

SEQ ID NO: 2787312 - RNA, 23 nt, Human
agguauggcucugcaccccucug

SEQ ID NO: 2787313 - RNA, 20 nt, Human
agguauggaaggguuugugg

SEQ ID NO: 2787314 - RNA, 15 nt, Human
agguauuauuaucuu

SEQ ID NO: 2787315 - RNA, 16 nt, Human
agguauuauuaucuuu

SEQ ID NO: 2787316 - RNA, 18 nt, Human
agguauuauuaucuuuaa

SEQ ID NO: 2787317 - RNA, 20 nt, Human
aggguguguuugaaaucauc

SEQ ID NO: 2787318 - RNA, 21 nt, Human
aggguguugggauacugcagg

SEQ ID NO: 2787319 - RNA, 20 nt, Human
aggguuacagagaccuaugu

SEQ ID NO: 2787320 - RNA, 21 nt, Human
aggguggugaccucugccuga

SEQ ID NO: 2787321 - RNA, 14 nt, Human
uggucuuuguaaga

SEQ ID NO: 2787322 - RNA, 15 nt, Human
uggucuuuguaagag

SEQ ID NO: 2787323 - RNA, 21 nt, Human
uggucuuuguaagaguguaga

SEQ ID NO: 2787324 - RNA, 22 nt, Human
uggucuuuguaagaguguagaa

SEQ ID NO: 2787325 - RNA, 15 nt, Human
agggugguggagcca

SEQ ID NO: 2787326 - RNA, 17 nt, Human
agggugguggagccagu

SEQ ID NO: 2787327 - RNA, 17 nt, Human
uggucugacccacugcu

SEQ ID NO: 2787328 - RNA, 16 nt, Human
uggucugacccacugc

SEQ ID NO: 2787329 - RNA, 12 nt, Human
uggucucaggau

SEQ ID NO: 2787330 - RNA, 13 nt, Human
uggucucaggaua

SEQ ID NO: 2787331 - RNA, 23 nt, Human
uggucucaggauauccuuaucag

SEQ ID NO: 2787332 - RNA, 14 nt, Human
uggucuauguuccg

SEQ ID NO: 2787333 - RNA, 20 nt, Human
uggucuuucuuacaaggaag

SEQ ID NO: 2787334 - RNA, 13 nt, Human
uggucuuuguaag

SEQ ID NO: 2787335 - RNA, 14 nt, Human
uggucuuuccucug

SEQ ID NO: 2787336 - RNA, 20 nt, Human
uggucuuggcagcaccuguc

SEQ ID NO: 2787337 - RNA, 16 nt, Human
uggucuuguggaauug

SEQ ID NO: 2787338 - RNA, 14 nt, Human
uggucuucagccuc

SEQ ID NO: 2787339 - RNA, 15 nt, Human
uggucuucagccucu

SEQ ID NO: 2787340 - RNA, 20 nt, Human
uggucuuggaauuccauuug

SEQ ID NO: 2787341 - RNA, 17 nt, Human
uggucuuggcagcaccu

SEQ ID NO: 2787342 - RNA, 15 nt, Human
uggucuugaaguccu

SEQ ID NO: 2787343 - RNA, 19 nt, Human
uggucuugaaguccuggcu

SEQ ID NO: 2787344 - RNA, 20 nt, Human
uggucuugaaguccuggcuu

SEQ ID NO: 2787345 - RNA, 16 nt, Human
uggucucaaacucuug

SEQ ID NO: 2787346 - RNA, 19 nt, Human
uggucuaucuuugagcgcc

SEQ ID NO: 2787347 - RNA, 23 nt, Human
uggucucaaacucuugaccucag

SEQ ID NO: 2787348 - RNA, 17 nt, Human
uggucucaaacucuuga

SEQ ID NO: 2787349 - RNA, 18 nt, Human
uggucucaaacuccugac

SEQ ID NO: 2787350 - RNA, 12 nt, Human
uggucucagaaa

SEQ ID NO: 2787351 - RNA, 15 nt, Human
uggucaggcccuggu

SEQ ID NO: 2787352 - RNA, 13 nt, Human
uggucaggcuggu

SEQ ID NO: 2787353 - RNA, 13 nt, Human
uggucacagggca

SEQ ID NO: 2787354 - RNA, 17 nt, Human
uggucacagggcaugcc

SEQ ID NO: 2787355 - RNA, 17 nt, Human
agugccgcaaauuguac

SEQ ID NO: 2787356 - RNA, 22 nt, Human
agugccuggauccccucugucu

SEQ ID NO: 2787357 - RNA, 23 nt, Human
agugccuggauccccucugucua

SEQ ID NO: 2787358 - RNA, 19 nt, Human
agugcugggauuacaggug

SEQ ID NO: 2787359 - RNA, 17 nt, Human
agugcugggauuacagg

SEQ ID NO: 2787360 - RNA, 20 nt, Human
agugcugggauuacaggcgu

SEQ ID NO: 2787361 - RNA, 14 nt, Human
agugcuucagccug

SEQ ID NO: 2787362 - RNA, 19 nt, Human
agugcugggauuacaggcu

SEQ ID NO: 2787363 - RNA, 20 nt, Human
agugcugggauuacaagcgu

SEQ ID NO: 2787364 - RNA, 13 nt, Human
agugcuggcucac

SEQ ID NO: 2787365 - RNA, 14 nt, Human
agugcuggcucaca

SEQ ID NO: 2787366 - RNA, 15 nt, Human
agugcuggcucacag

SEQ ID NO: 2787367 - RNA, 16 nt, Human
agugcuggcucacagu

SEQ ID NO: 2787368 - RNA, 17 nt, Human
agugcuggcucacagua

SEQ ID NO: 2787369 - RNA, 18 nt, Human
agugcuggcucacaguac

SEQ ID NO: 2787370 - RNA, 19 nt, Human
agugcuggcucacaguaca

SEQ ID NO: 2787371 - RNA, 20 nt, Human
agugcuggcucacaguacag

SEQ ID NO: 2787372 - RNA, 21 nt, Human
agugcuggcucacaguacagc

SEQ ID NO: 2787373 - RNA, 21 nt, Human
agugcugggauggaggggagu

SEQ ID NO: 2787374 - RNA, 22 nt, Human
agugcugggauggaggggagug

SEQ ID NO: 2787375 - RNA, 15 nt, Human
uguggugaugaugug

SEQ ID NO: 2787376 - RNA, 19 nt, Human
uguggugaugauguguaua

SEQ ID NO: 2787377 - RNA, 14 nt, Human
ugugguggccucag

SEQ ID NO: 2787378 - RNA, 15 nt, Human
ugugguggccucagc

SEQ ID NO: 2787379 - RNA, 19 nt, Human
ugugguugacuuaugggcc

SEQ ID NO: 2787380 - RNA, 11 nt, Human
uguggucucag

SEQ ID NO: 2787381 - RNA, 13 nt, Human
uguggucucagga

SEQ ID NO: 2787382 - RNA, 14 nt, Human
uguggucucaggau

SEQ ID NO: 2787383 - RNA, 15 nt, Human
uguggucucaggaua

SEQ ID NO: 2787384 - RNA, 18 nt, Human
agugcuucagccugaggc

SEQ ID NO: 2787385 - RNA, 17 nt, Human
agugcuucagccugagg

SEQ ID NO: 2787386 - RNA, 16 nt, Human
agugcuucagccugag

SEQ ID NO: 2787387 - RNA, 15 nt, Human
agugcuucagccuga

SEQ ID NO: 2787388 - RNA, 20 nt, Human
agugcuucagccugaggcug

SEQ ID NO: 2787389 - RNA, 19 nt, Human
agugcuucagccugaggcu

SEQ ID NO: 2787390 - RNA, 15 nt, Human
agugcuugccacaga

SEQ ID NO: 2787391 - RNA, 16 nt, Human
agugcuugccacagag

SEQ ID NO: 2787392 - RNA, 17 nt, Human
agugcuugccacagagc

SEQ ID NO: 2787393 - RNA, 19 nt, Human
agugcuugccacagagcgg

SEQ ID NO: 2787394 - RNA, 14 nt, Human
uguguuaugaagca

SEQ ID NO: 2787395 - RNA, 14 nt, Human
uguguugcauuauu

SEQ ID NO: 2787396 - RNA, 24 nt, Human
uguguugcauuauucauuuaguga

SEQ ID NO: 2787397 - RNA, 16 nt, Human
uguguuccaaguuucc

SEQ ID NO: 2787398 - RNA, 17 nt, Human
uguguuccaaguuucca

SEQ ID NO: 2787399 - RNA, 18 nt, Human
uguguuccaaguuuccaa

SEQ ID NO: 2787400 - RNA, 19 nt, Human
uguguuccaaguuuccaaa

SEQ ID NO: 2787401 - RNA, 19 nt, Human
uguguguuccaaguuucca

SEQ ID NO: 2787402 - RNA, 14 nt, Human
ugugugugugugug

SEQ ID NO: 2787403 - RNA, 13 nt, Human
ugugugugugugu

SEQ ID NO: 2787404 - RNA, 14 nt, Human
ugugugugugugua

SEQ ID NO: 2787405 - RNA, 12 nt, Human
ugugugugugug

SEQ ID NO: 2787406 - RNA, 16 nt, Human
uguguguguguaugug

SEQ ID NO: 2787407 - RNA, 13 nt, Human
uguguguguguau

SEQ ID NO: 2787408 - RNA, 15 nt, Human
ugugucuaagauucu

SEQ ID NO: 2787409 - RNA, 16 nt, Human
ugugucuaagauucua

SEQ ID NO: 2787410 - RNA, 17 nt, Human
ugugucuaagauucuag

SEQ ID NO: 2787411 - RNA, 18 nt, Human
ugugucuaagauucuaga

SEQ ID NO: 2787412 - RNA, 19 nt, Human
ugugucuaagauucuagau

SEQ ID NO: 2787413 - RNA, 19 nt, Human
ugugucagguggggcagcu

SEQ ID NO: 2787414 - RNA, 17 nt, Human
ugugucagguggggcag

SEQ ID NO: 2787415 - RNA, 20 nt, Human
ugugucuaagauucuagauc

SEQ ID NO: 2787416 - RNA, 13 nt, Human
ugugugugugcau

SEQ ID NO: 2787417 - RNA, 14 nt, Human
ugugugugugcaug

SEQ ID NO: 2787418 - RNA, 11 nt, Human
ugugugugugc

SEQ ID NO: 2787419 - RNA, 11 nt, Human
ugugugugugu

SEQ ID NO: 2787420 - RNA, 12 nt, Human
ugugugugugua

SEQ ID NO: 2787421 - RNA, 19 nt, Human
uguuaaugauagcuacugu

SEQ ID NO: 2787422 - RNA, 19 nt, Human
uguuaaucucuguuaugua

SEQ ID NO: 2787423 - RNA, 21 nt, Human
uguuaaucucuguuauguacu

SEQ ID NO: 2787424 - RNA, 23 nt, Human
uguuaaucucuguuauguacugu

SEQ ID NO: 2787425 - RNA, 13 nt, Human
agugcuuguguaa

SEQ ID NO: 2787426 - RNA, 14 nt, Human
agugcuuguguaau

SEQ ID NO: 2787427 - RNA, 19 nt, Human
agugcuuguguaauuuaug

SEQ ID NO: 2787428 - RNA, 22 nt, Human
agugcuuguguaauuuauguga

SEQ ID NO: 2787429 - RNA, 13 nt, Human
agugcuuuaaugg

SEQ ID NO: 2787430 - RNA, 12 nt, Human
uguuaauguauu

SEQ ID NO: 2787431 - RNA, 18 nt, Human
uguuaauguauuuguuca

SEQ ID NO: 2787432 - RNA, 19 nt, Human
uguuaauguauuuguucau

SEQ ID NO: 2787433 - RNA, 22 nt, Human
uguuaauguauuuguucauguu

SEQ ID NO: 2787434 - RNA, 13 nt, Human
agugcuuucuugu

SEQ ID NO: 2787435 - RNA, 15 nt, Human
uguuaacauuccaag

SEQ ID NO: 2787436 - RNA, 16 nt, Human
uguuaaccaaggaaau

SEQ ID NO: 2787437 - RNA, 15 nt, Human
uguuaaccauuuaag

SEQ ID NO: 2787438 - RNA, 21 nt, Human
uguuaacauuccaagacucua

SEQ ID NO: 2787439 - RNA, 16 nt, Human
uguuaacauuccaaga

SEQ ID NO: 2787440 - RNA, 20 nt, Human
uguuaacauuccaagacucu

SEQ ID NO: 2787441 - RNA, 17 nt, Human
uguuaacucuugucuau

SEQ ID NO: 2787442 - RNA, 13 nt, Human
uguguugugaaug

SEQ ID NO: 2787443 - RNA, 18 nt, Human
uguguugucuugaaagau

SEQ ID NO: 2787444 - RNA, 16 nt, Human
uguuaaauuuuucuga

SEQ ID NO: 2787445 - RNA, 14 nt, Human
uguguugucuugaa

SEQ ID NO: 2787446 - RNA, 21 nt, Human
uguguuggacaaaugugaaga

SEQ ID NO: 2787447 - RNA, 15 nt, Human
uguguuggacagaga

SEQ ID NO: 2787448 - RNA, 19 nt, Human
uguguuggacagagaaggg

SEQ ID NO: 2787449 - RNA, 12 nt, Human
uguguuguauua

SEQ ID NO: 2787450 - RNA, 19 nt, Human
uguguuguauuaacaaaag

SEQ ID NO: 2787451 - RNA, 18 nt, Human
uguguugccaugugugcu

SEQ ID NO: 2787452 - RNA, 15 nt, Human
uguguugcuauccug

SEQ ID NO: 2787453 - RNA, 17 nt, Human
agugauugggacagagg

SEQ ID NO: 2787454 - RNA, 14 nt, Human
agugaguguuucua

SEQ ID NO: 2787455 - RNA, 16 nt, Human
agugaguguuucuaug

SEQ ID NO: 2787456 - RNA, 13 nt, Human
agugauugcagcu

SEQ ID NO: 2787457 - RNA, 14 nt, Human
agugauugcagcuu

SEQ ID NO: 2787458 - RNA, 20 nt, Human
agugauugcagcuuuauguu

SEQ ID NO: 2787459 - RNA, 16 nt, Human
agugcaaugacacagu

SEQ ID NO: 2787460 - RNA, 18 nt, Human
agugcaaugacacagucu

SEQ ID NO: 2787461 - RNA, 22 nt, Human
agugcaaugguauaaauuucaa

SEQ ID NO: 2787462 - RNA, 13 nt, Human
agugcacaaaaug

SEQ ID NO: 2787463 - RNA, 14 nt, Human
agugcacaaaauga

SEQ ID NO: 2787464 - RNA, 15 nt, Human
agugcacaaaaugaa

SEQ ID NO: 2787465 - RNA, 17 nt, Human
agugcacaaaaugaaug

SEQ ID NO: 2787466 - RNA, 16 nt, Human
agugcacacagaaaua

SEQ ID NO: 2787467 - RNA, 17 nt, Human
agugcacacagaaauau

SEQ ID NO: 2787468 - RNA, 19 nt, Human
agugcacacagaaauauau

SEQ ID NO: 2787469 - RNA, 20 nt, Human
agugcacacagaaauauaua

SEQ ID NO: 2787470 - RNA, 11 nt, Human
agugcacaccu

SEQ ID NO: 2787471 - RNA, 12 nt, Human
agugcacagcug

SEQ ID NO: 2787472 - RNA, 13 nt, Human
agugcacagcugu

SEQ ID NO: 2787473 - RNA, 14 nt, Human
agugcacagcuguc

SEQ ID NO: 2787474 - RNA, 15 nt, Human
agugcacagcugucc

SEQ ID NO: 2787475 - RNA, 12 nt, Human
agugcacaugaa

SEQ ID NO: 2787476 - RNA, 13 nt, Human
agugcacaugaac

SEQ ID NO: 2787477 - RNA, 24 nt, Human
agugauucuccugccucagccucc

SEQ ID NO: 2787478 - RNA, 22 nt, Human
agugauucuccugccucagccu

SEQ ID NO: 2787479 - RNA, 14 nt, Human
agugagugagccug

SEQ ID NO: 2787480 - RNA, 16 nt, Human
agugagugagccuggc

SEQ ID NO: 2787481 - RNA, 15 nt, Human
agugagugugcugcu

SEQ ID NO: 2787482 - RNA, 17 nt, Human
agugagugugcugcugu

SEQ ID NO: 2787483 - RNA, 19 nt, Human
agugagugugcugcuguaa

SEQ ID NO: 2787484 - RNA, 14 nt, Human
agugagucugucag

SEQ ID NO: 2787485 - RNA, 15 nt, Human
agugagucugucagc

SEQ ID NO: 2787486 - RNA, 13 nt, Human
agugagugagccu

SEQ ID NO: 2787487 - RNA, 16 nt, Human
agugagucgaggacag

SEQ ID NO: 2787488 - RNA, 14 nt, Human
uguggcccuguccu

SEQ ID NO: 2787489 - RNA, 16 nt, Human
uguggcccuguccugc

SEQ ID NO: 2787490 - RNA, 15 nt, Human
uguggccgaggacuu

SEQ ID NO: 2787491 - RNA, 16 nt, Human
uguggccgaggacuuu

SEQ ID NO: 2787492 - RNA, 18 nt, Human
uguggcccuggcucugcu

SEQ ID NO: 2787493 - RNA, 17 nt, Human
uguggccccugaacaag

SEQ ID NO: 2787494 - RNA, 22 nt, Human
uguggccccugaacaagaauug

SEQ ID NO: 2787495 - RNA, 12 nt, Human
uguggcccuggc

SEQ ID NO: 2787496 - RNA, 20 nt, Human
uguggcccucucccuuaccc

SEQ ID NO: 2787497 - RNA, 19 nt, Human
agugccacucauuccugua

SEQ ID NO: 2787498 - RNA, 12 nt, Human
agugccaaggac

SEQ ID NO: 2787499 - RNA, 13 nt, Human
agugccaaggacc

SEQ ID NO: 2787500 - RNA, 22 nt, Human
agugccaaggaccuccucuucc

SEQ ID NO: 2787501 - RNA, 16 nt, Human
agugccaacuccucac

SEQ ID NO: 2787502 - RNA, 13 nt, Human
agugccaacugug

SEQ ID NO: 2787503 - RNA, 16 nt, Human
agugccaacuguggcu

SEQ ID NO: 2787504 - RNA, 18 nt, Human
agugcacggggcacagcg

SEQ ID NO: 2787505 - RNA, 14 nt, Human
agugccaaaugcuc

SEQ ID NO: 2787506 - RNA, 14 nt, Human
agugcccacaggau

SEQ ID NO: 2787507 - RNA, 16 nt, Human
agugcccacccuggga

SEQ ID NO: 2787508 - RNA, 18 nt, Human
agugcccacccugggaga

SEQ ID NO: 2787509 - RNA, 20 nt, Human
agugcccacccugggagaca

SEQ ID NO: 2787510 - RNA, 22 nt, Human
agugcccacccugggagacaga

SEQ ID NO: 2787511 - RNA, 23 nt, Human
agugcccacccugggagacagac

SEQ ID NO: 2787512 - RNA, 14 nt, Human
agugcaggcuggcc

SEQ ID NO: 2787513 - RNA, 15 nt, Human
agugcaggcuggcca

SEQ ID NO: 2787514 - RNA, 16 nt, Human
agugcaggcuggccag

SEQ ID NO: 2787515 - RNA, 17 nt, Human
agugcaggcuggccagc

SEQ ID NO: 2787516 - RNA, 18 nt, Human
agugcaggcuggccagcc

SEQ ID NO: 2787517 - RNA, 19 nt, Human
agugcaggcuggccagccg

SEQ ID NO: 2787518 - RNA, 21 nt, Human
agugcaggcuggccagccgcu

SEQ ID NO: 2787519 - RNA, 16 nt, Human
agugcagggcaaaaua

SEQ ID NO: 2787520 - RNA, 12 nt, Human
agugcaggcugg

SEQ ID NO: 2787521 - RNA, 15 nt, Human
agugcaucucagccc

SEQ ID NO: 2787522 - RNA, 14 nt, Human
agugcaucucagcc

SEQ ID NO: 2787523 - RNA, 18 nt, Human
agugcaucuuugccucuc

SEQ ID NO: 2787524 - RNA, 16 nt, Human
agugcaucucagccca

SEQ ID NO: 2787525 - RNA, 17 nt, Human
agugcaucucagcccac

SEQ ID NO: 2787526 - RNA, 17 nt, Human
uguggcaaggaaaaaca

SEQ ID NO: 2787527 - RNA, 19 nt, Human
uguggcacuugccuggguc

SEQ ID NO: 2787528 - RNA, 14 nt, Human
uguggcagagagag

SEQ ID NO: 2787529 - RNA, 15 nt, Human
uguggcagagagaga

SEQ ID NO: 2787530 - RNA, 22 nt, Human
uguggcagagagagagaaagag

SEQ ID NO: 2787531 - RNA, 23 nt, Human
uguggcagagagagagaaagaga

SEQ ID NO: 2787532 - RNA, 18 nt, Human
uguggcacuugccugggu

SEQ ID NO: 2787533 - RNA, 16 nt, Human
uguggcacuugccugg

SEQ ID NO: 2787534 - RNA, 15 nt, Human
uguggcacuugccug

SEQ ID NO: 2787535 - RNA, 20 nt, Human
ugucgggcuuugugugaagg

SEQ ID NO: 2787536 - RNA, 11 nt, Human
uguggagccag

SEQ ID NO: 2787537 - RNA, 12 nt, Human
uguggagccagg

SEQ ID NO: 2787538 - RNA, 13 nt, Human
uguggagccaggc

SEQ ID NO: 2787539 - RNA, 14 nt, Human
uguggagccaggcg

SEQ ID NO: 2787540 - RNA, 15 nt, Human
uguggagccaggcgu

SEQ ID NO: 2787541 - RNA, 13 nt, Human
uguggagacuggg

SEQ ID NO: 2787542 - RNA, 15 nt, Human
uguggagcucagccc

SEQ ID NO: 2787543 - RNA, 16 nt, Human
uguggagcucagcccc

SEQ ID NO: 2787544 - RNA, 12 nt, Human
uguggaggaagg

SEQ ID NO: 2787545 - RNA, 14 nt, Human
uguggaggaaggau

SEQ ID NO: 2787546 - RNA, 15 nt, Human
uguggaggaaggauu

SEQ ID NO: 2787547 - RNA, 16 nt, Human
uguggaggaaggauug

SEQ ID NO: 2787548 - RNA, 17 nt, Human
uguggaggaaggauugu

SEQ ID NO: 2787549 - RNA, 14 nt, Human
uguggauuucaguu

SEQ ID NO: 2787550 - RNA, 15 nt, Human
uguggauuucaguuu

SEQ ID NO: 2787551 - RNA, 18 nt, Human
ugugcucuggacaggcau

SEQ ID NO: 2787552 - RNA, 16 nt, Human
ugugcucuggacaggc

SEQ ID NO: 2787553 - RNA, 19 nt, Human
ugugcucuggacaggcaug

SEQ ID NO: 2787554 - RNA, 12 nt, Human
ugugcugcccug

SEQ ID NO: 2787555 - RNA, 16 nt, Human
ugugcugcccugaaga

SEQ ID NO: 2787556 - RNA, 18 nt, Human
ugugcugcccugaagaau

SEQ ID NO: 2787557 - RNA, 17 nt, Human
ugugcugcccugaagaa

SEQ ID NO: 2787558 - RNA, 18 nt, Human
uguggagacaaugucugc

SEQ ID NO: 2787559 - RNA, 24 nt, Human
uguggagacaaugucugcagcccu

SEQ ID NO: 2787560 - RNA, 19 nt, Human
agucucacuguugcccagg

SEQ ID NO: 2787561 - RNA, 18 nt, Human
agucucacuguugcccag

SEQ ID NO: 2787562 - RNA, 20 nt, Human
agucucacuguugcccaggc

SEQ ID NO: 2787563 - RNA, 15 nt, Human
ugugcucuggacagg

SEQ ID NO: 2787564 - RNA, 23 nt, Human
ugugcucugaucauccacugugc

SEQ ID NO: 2787565 - RNA, 12 nt, Human
ugugcucugauc

SEQ ID NO: 2787566 - RNA, 22 nt, Human
ugugcucugaucauccacugug

SEQ ID NO: 2787567 - RNA, 16 nt, Human
ugugccuccucacccc

SEQ ID NO: 2787568 - RNA, 15 nt, Human
ugugccuccucaccc

SEQ ID NO: 2787569 - RNA, 14 nt, Human
ugugccuccucacc

SEQ ID NO: 2787570 - RNA, 12 nt, Human
ugugccucugcc

SEQ ID NO: 2787571 - RNA, 21 nt, Human
ugugccucggcuuuucucagc

SEQ ID NO: 2787572 - RNA, 12 nt, Human
ugugccucggcu

SEQ ID NO: 2787573 - RNA, 17 nt, Human
aguguuacuuuuuguaa

SEQ ID NO: 2787574 - RNA, 21 nt, Human
aguuacucuucaguuaagccu

SEQ ID NO: 2787575 - RNA, 12 nt, Human
aguguugaaggg

SEQ ID NO: 2787576 - RNA, 19 nt, Human
aguguugaagggagguggc

SEQ ID NO: 2787577 - RNA, 17 nt, Human
aguguugagccuuuucc

SEQ ID NO: 2787578 - RNA, 13 nt, Human
aguguugccuaag

SEQ ID NO: 2787579 - RNA, 14 nt, Human
aguguugccuaagu

SEQ ID NO: 2787580 - RNA, 16 nt, Human
aguguugccuaaguau

SEQ ID NO: 2787581 - RNA, 17 nt, Human
aguguugccuaaguauu

SEQ ID NO: 2787582 - RNA, 23 nt, Human
aguguugccuaaguauuaaaaca

SEQ ID NO: 2787583 - RNA, 13 nt, Human
aguuacugugcau

SEQ ID NO: 2787584 - RNA, 14 nt, Human
aguuacugugcauu

SEQ ID NO: 2787585 - RNA, 21 nt, Human
aguuacugccgguuugaaaau

SEQ ID NO: 2787586 - RNA, 18 nt, Human
aguuacugauucacugca

SEQ ID NO: 2787587 - RNA, 15 nt, Human
aguuagaaucuauuu

SEQ ID NO: 2787588 - RNA, 17 nt, Human
aguuagaaucuauuuuc

SEQ ID NO: 2787589 - RNA, 18 nt, Human
aguuagaaucuauuuucu

SEQ ID NO: 2787590 - RNA, 13 nt, Human
aguuauaguuuca

SEQ ID NO: 2787591 - RNA, 16 nt, Human
aguuacuuucuuaaug

SEQ ID NO: 2787592 - RNA, 14 nt, Human
aguuacuuuauguu

SEQ ID NO: 2787593 - RNA, 20 nt, Human
aguuacuuuauguuugucuu

SEQ ID NO: 2787594 - RNA, 11 nt, Human
uguucuuuaua

SEQ ID NO: 2787595 - RNA, 13 nt, Human
uguucuuuauaua

SEQ ID NO: 2787596 - RNA, 14 nt, Human
uguucuuuauauac

SEQ ID NO: 2787597 - RNA, 15 nt, Human
uguucuuuauauaca

SEQ ID NO: 2787598 - RNA, 20 nt, Human
uguucuuuauauacaauaau

SEQ ID NO: 2787599 - RNA, 12 nt, Human
uguucuugcugc

SEQ ID NO: 2787600 - RNA, 13 nt, Human
uguucuugcugcu

SEQ ID NO: 2787601 - RNA, 14 nt, Human
uguucuugcugcua

SEQ ID NO: 2787602 - RNA, 15 nt, Human
uguucuugcugcuag

SEQ ID NO: 2787603 - RNA, 16 nt, Human
uguucuugcugcuaga

SEQ ID NO: 2787604 - RNA, 17 nt, Human
uguucuugcugcuagaa

SEQ ID NO: 2787605 - RNA, 13 nt, Human
uguugcccaggcu

SEQ ID NO: 2787606 - RNA, 15 nt, Human
uguugcccaggcugg

SEQ ID NO: 2787607 - RNA, 14 nt, Human
uguugcccaggcug

SEQ ID NO: 2787608 - RNA, 21 nt, Human
uguugcccaggcuggagugca

SEQ ID NO: 2787609 - RNA, 20 nt, Human
aguguuauuuuucaaggaag

SEQ ID NO: 2787610 - RNA, 21 nt, Human
aguguuauuuuucaaggaagg

SEQ ID NO: 2787611 - RNA, 15 nt, Human
aguguucacaaccug

SEQ ID NO: 2787612 - RNA, 23 nt, Human
aguguucacaaccuggaagugcu

SEQ ID NO: 2787613 - RNA, 17 nt, Human
aguguugaaaauguuca

SEQ ID NO: 2787614 - RNA, 13 nt, Human
aguguuauguauu

SEQ ID NO: 2787615 - RNA, 14 nt, Human
aguguuauguauuu

SEQ ID NO: 2787616 - RNA, 15 nt, Human
aguguuauguauuuc

SEQ ID NO: 2787617 - RNA, 20 nt, Human
aguguguuuccuucagugca

SEQ ID NO: 2787618 - RNA, 19 nt, Human
aguguguuuccuucagugc

SEQ ID NO: 2787619 - RNA, 12 nt, Human
uguuauugugaa

SEQ ID NO: 2787620 - RNA, 13 nt, Human
uguuauugugaau

SEQ ID NO: 2787621 - RNA, 15 nt, Human
uguuauugugaauga

SEQ ID NO: 2787622 - RNA, 16 nt, Human
uguuauugugaaugau

SEQ ID NO: 2787623 - RNA, 19 nt, Human
uguuauugugaaugauuca

SEQ ID NO: 2787624 - RNA, 16 nt, Human
uguuauuguuuuguua

SEQ ID NO: 2787625 - RNA, 22 nt, Human
uguuauuguuuuguuaauuaca

SEQ ID NO: 2787626 - RNA, 19 nt, Human
uguuauuuaacccauuugu

SEQ ID NO: 2787627 - RNA, 17 nt, Human
uguuauuuagacucauc

SEQ ID NO: 2787628 - RNA, 13 nt, Human
uguuauuucugca

SEQ ID NO: 2787629 - RNA, 14 nt, Human
uguuauuucugcaa

SEQ ID NO: 2787630 - RNA, 15 nt, Human
uguuauuucugcaaa

SEQ ID NO: 2787631 - RNA, 17 nt, Human
uguucuacccguuccaa

SEQ ID NO: 2787632 - RNA, 18 nt, Human
uguucuacccguuccaaa

SEQ ID NO: 2787633 - RNA, 19 nt, Human
uguucuacccguuccaaaa

SEQ ID NO: 2787634 - RNA, 23 nt, Human
uguucuaaguuucuaagauucua

SEQ ID NO: 2787635 - RNA, 17 nt, Human
uguucuaaguuucuaag

SEQ ID NO: 2787636 - RNA, 18 nt, Human
uguucuaaguuucuaaga

SEQ ID NO: 2787637 - RNA, 19 nt, Human
uguucuaaguuucuaagau

SEQ ID NO: 2787638 - RNA, 22 nt, Human
uguucuaaguuucuaagauucu

SEQ ID NO: 2787639 - RNA, 18 nt, Human
uguucccucucccuguug

SEQ ID NO: 2787640 - RNA, 14 nt, Human
uguucuaaggcucu

SEQ ID NO: 2787641 - RNA, 15 nt, Human
uguucuaaggcucug

SEQ ID NO: 2787642 - RNA, 16 nt, Human
uguucuaaggcucuga

SEQ ID NO: 2787643 - RNA, 18 nt, Human
uguucuaaggcucugaga

SEQ ID NO: 2787644 - RNA, 23 nt, Human
uguucuaaggcucugagagucua

SEQ ID NO: 2787645 - RNA, 11 nt, Human
uguucuaaggg

SEQ ID NO: 2787646 - RNA, 19 nt, Human
uguucuaaggcucugagag

SEQ ID NO: 2787647 - RNA, 12 nt, Human
uguucuaaguuu

SEQ ID NO: 2787648 - RNA, 14 nt, Human
uguucuaaguuucu

SEQ ID NO: 2787649 - RNA, 16 nt, Human
uguucuaaguuucuaa

SEQ ID NO: 2787650 - RNA, 18 nt, Human
uguuaucccaaucauugu

SEQ ID NO: 2787651 - RNA, 20 nt, Human
uguucuuaugcaaaauggaa

SEQ ID NO: 2787652 - RNA, 13 nt, Human
uguucuucagaga

SEQ ID NO: 2787653 - RNA, 13 nt, Human
uguucuuccucca

SEQ ID NO: 2787654 - RNA, 22 nt, Human
uguuauuauuacuuauuuuuga

SEQ ID NO: 2787655 - RNA, 16 nt, Human
uguuaucuucucaagu

SEQ ID NO: 2787656 - RNA, 20 nt, Human
uguuaucuucucaaguucua

SEQ ID NO: 2787657 - RNA, 19 nt, Human
uguuaucuuauacuguaca

SEQ ID NO: 2787658 - RNA, 21 nt, Human
uguuaucuuauacuguacaau

SEQ ID NO: 2787659 - RNA, 22 nt, Human
uguuaucuuauacuguacaaua

SEQ ID NO: 2787660 - RNA, 15 nt, Human
uguuaucuucucaag

SEQ ID NO: 2787661 - RNA, 16 nt, Human
uguuauauuaagcaga

SEQ ID NO: 2787662 - RNA, 18 nt, Human
uguuauauuuaaugcauu

SEQ ID NO: 2787663 - RNA, 19 nt, Human
uguuauauuuaaugcauua

SEQ ID NO: 2787664 - RNA, 20 nt, Human
uguuauauuuaaugcauuaa

SEQ ID NO: 2787665 - RNA, 23 nt, Human
uguuauauuuaaugcauuaaacc

SEQ ID NO: 2787666 - RNA, 21 nt, Human
uguuaucagucaauauuuuua

SEQ ID NO: 2787667 - RNA, 14 nt, Human
uguuaucagcuuuc

SEQ ID NO: 2787668 - RNA, 13 nt, Human
uguuaucaaacuu

SEQ ID NO: 2787669 - RNA, 15 nt, Human
agugugggggguccu

SEQ ID NO: 2787670 - RNA, 14 nt, Human
aguggaaauucagg

SEQ ID NO: 2787671 - RNA, 22 nt, Human
aguggaaauucaggugaaaaug

SEQ ID NO: 2787672 - RNA, 16 nt, Human
agugcuuuucuguuua

SEQ ID NO: 2787673 - RNA, 16 nt, Human
aguggaaacauuuaua

SEQ ID NO: 2787674 - RNA, 22 nt, Human
aguggaaccguugccaaccgag

SEQ ID NO: 2787675 - RNA, 22 nt, Human
aguggaaagacagcuucucauc

SEQ ID NO: 2787676 - RNA, 12 nt, Human
aguggaaaaaca

SEQ ID NO: 2787677 - RNA, 13 nt, Human
aguggaaaaacac

SEQ ID NO: 2787678 - RNA, 14 nt, Human
aguggaaaaacaca

SEQ ID NO: 2787679 - RNA, 11 nt, Human
aguggaaaaag

SEQ ID NO: 2787680 - RNA, 16 nt, Human
aguggagaauuauaua

SEQ ID NO: 2787681 - RNA, 14 nt, Human
aguggagguuuguc

SEQ ID NO: 2787682 - RNA, 18 nt, Human
aguuccucuagugcccuc

SEQ ID NO: 2787683 - RNA, 15 nt, Human
aguucuacauaagua

SEQ ID NO: 2787684 - RNA, 20 nt, Human
aguucuaccucaggcagcuc

SEQ ID NO: 2787685 - RNA, 21 nt, Human
aguucuaauaauuucuaaugu

SEQ ID NO: 2787686 - RNA, 16 nt, Human
aguucgccuggagccc

SEQ ID NO: 2787687 - RNA, 17 nt, Human
aguucgccuggagcccu

SEQ ID NO: 2787688 - RNA, 18 nt, Human
aguucgccuggagcccuc

SEQ ID NO: 2787689 - RNA, 19 nt, Human
aguucgccuggagcccucc

SEQ ID NO: 2787690 - RNA, 17 nt, Human
aguucggcucugggugg

SEQ ID NO: 2787691 - RNA, 20 nt, Human
aguucuaauaauuucuaaug

SEQ ID NO: 2787692 - RNA, 22 nt, Human
aguucuaccucaggcagcucaa

SEQ ID NO: 2787693 - RNA, 23 nt, Human
aguucuaccucaggcagcucaag

SEQ ID NO: 2787694 - RNA, 22 nt, Human
aguucuacuauggcugaguucu

SEQ ID NO: 2787695 - RNA, 22 nt, Human
aguucuagacauggagguucua

SEQ ID NO: 2787696 - RNA, 23 nt, Human
aguucuagacauggagguucuaa

SEQ ID NO: 2787697 - RNA, 10 nt, Human
aguucuagac

SEQ ID NO: 2787698 - RNA, 21 nt, Human
aguucuagacauggagguucu

SEQ ID NO: 2787699 - RNA, 14 nt, Human
aguucuaggcacug

SEQ ID NO: 2787700 - RNA, 22 nt, Human
aguucuaggcacuguaguucua

SEQ ID NO: 2787701 - RNA, 10 nt, Human
aguucuaggc

SEQ ID NO: 2787702 - RNA, 15 nt, Human
aguucucaaugugaa

SEQ ID NO: 2787703 - RNA, 17 nt, Human
aguucuaguuugcauuc

SEQ ID NO: 2787704 - RNA, 18 nt, Human
aguucuauacuguaaagc

SEQ ID NO: 2787705 - RNA, 20 nt, Human
aguucuauacuguaaagcgc

SEQ ID NO: 2787706 - RNA, 15 nt, Human
aguucuaguuugcau

SEQ ID NO: 2787707 - RNA, 16 nt, Human
aguucuaguuugcauu

SEQ ID NO: 2787708 - RNA, 14 nt, Human
aguucacacccugc

SEQ ID NO: 2787709 - RNA, 15 nt, Human
aguucacacccugca

SEQ ID NO: 2787710 - RNA, 16 nt, Human
aguucacacccugcaa

SEQ ID NO: 2787711 - RNA, 17 nt, Human
aguucacacccugcaag

SEQ ID NO: 2787712 - RNA, 18 nt, Human
aguucacacccugcaagg

SEQ ID NO: 2787713 - RNA, 22 nt, Human
aguucacacccugcaaggccca

SEQ ID NO: 2787714 - RNA, 23 nt, Human
aguucacacccugcaaggcccac

SEQ ID NO: 2787715 - RNA, 18 nt, Human
aguucacauuagaauuag

SEQ ID NO: 2787716 - RNA, 17 nt, Human
aguucccaaaagauugc

SEQ ID NO: 2787717 - RNA, 14 nt, Human
aguuccccaugcag

SEQ ID NO: 2787718 - RNA, 16 nt, Human
aguuccccaugcagac

SEQ ID NO: 2787719 - RNA, 17 nt, Human
aguuccccaugcagaca

SEQ ID NO: 2787720 - RNA, 16 nt, Human
aguucaauucucauuu

SEQ ID NO: 2787721 - RNA, 18 nt, Human
aguucaauaaaugucugu

SEQ ID NO: 2787722 - RNA, 23 nt, Human
aguucaauaaacuuaacuuuaac

SEQ ID NO: 2787723 - RNA, 22 nt, Human
aguucaaggaacuugaaaaaua

SEQ ID NO: 2787724 - RNA, 23 nt, Human
aguucaaggaacuugaaaaauac

SEQ ID NO: 2787725 - RNA, 19 nt, Human
aguucaauaaaugucuguu

SEQ ID NO: 2787726 - RNA, 21 nt, Human
aguucaauaaaugucuguuga

SEQ ID NO: 2787727 - RNA, 15 nt, Human
aguucaaucucccgc

SEQ ID NO: 2787728 - RNA, 22 nt, Human
aguucaaucucccgcugcugcu

SEQ ID NO: 2787729 - RNA, 21 nt, Human
aguuauccagaggguugugau

SEQ ID NO: 2787730 - RNA, 15 nt, Human
aguuauaguuucaga

SEQ ID NO: 2787731 - RNA, 16 nt, Human
aguuauaguuucagau

SEQ ID NO: 2787732 - RNA, 20 nt, Human
aguuauauaauucacucaag

SEQ ID NO: 2787733 - RNA, 18 nt, Human
aguuauaguuucagauau

SEQ ID NO: 2787734 - RNA, 19 nt, Human
aguuauauuucagauguaa

SEQ ID NO: 2787735 - RNA, 22 nt, Human
aguuauauuucagauguaaugu

SEQ ID NO: 2787736 - RNA, 23 nt, Human
aguuauauuucagauguaauguu

SEQ ID NO: 2787737 - RNA, 12 nt, Human
uguuuaugaaaa

SEQ ID NO: 2787738 - RNA, 13 nt, Human
uguuuaugaaaau

SEQ ID NO: 2787739 - RNA, 14 nt, Human
uguuuaugaaaaua

SEQ ID NO: 2787740 - RNA, 18 nt, Human
uguuuaugaaaauaaaua

SEQ ID NO: 2787741 - RNA, 21 nt, Human
uguuuaugaaaauaaauagcu

SEQ ID NO: 2787742 - RNA, 16 nt, Human
uguuuagauagggcug

SEQ ID NO: 2787743 - RNA, 18 nt, Human
uguuuaggggaucuggaa

SEQ ID NO: 2787744 - RNA, 14 nt, Human
uguuuauuagauga

SEQ ID NO: 2787745 - RNA, 24 nt, Human
uguuuauggccucagcugccucac

SEQ ID NO: 2787746 - RNA, 17 nt, Human
uguuuauggccacauuu

SEQ ID NO: 2787747 - RNA, 21 nt, Human
uguuuaugcaaggaaggaaag

SEQ ID NO: 2787748 - RNA, 23 nt, Human
uguuuauggccucagcugccuca

SEQ ID NO: 2787749 - RNA, 15 nt, Human
uguuuauggccucag

SEQ ID NO: 2787750 - RNA, 14 nt, Human
uguuuauggccuca

SEQ ID NO: 2787751 - RNA, 13 nt, Human
uguuuauggccuc

SEQ ID NO: 2787752 - RNA, 14 nt, Human
uguuuauuucuguu

SEQ ID NO: 2787753 - RNA, 17 nt, Human
uguuuauuucuguuucu

SEQ ID NO: 2787754 - RNA, 13 nt, Human
uguuuauuccuug

SEQ ID NO: 2787755 - RNA, 16 nt, Human
uguuuauucuucuaga

SEQ ID NO: 2787756 - RNA, 17 nt, Human
uguuuauucuucuagag

SEQ ID NO: 2787757 - RNA, 14 nt, Human
uguuuauugaguuu

SEQ ID NO: 2787758 - RNA, 14 nt, Human
uguuguuaugcuau

SEQ ID NO: 2787759 - RNA, 16 nt, Human
uguuguguacagacuu

SEQ ID NO: 2787760 - RNA, 13 nt, Human
uguugugaugucu

SEQ ID NO: 2787761 - RNA, 14 nt, Human
uguugugaugucuu

SEQ ID NO: 2787762 - RNA, 12 nt, Human
uguugugccaca

SEQ ID NO: 2787763 - RNA, 21 nt, Human
uguuguggguucuauguuuac

SEQ ID NO: 2787764 - RNA, 22 nt, Human
uguuguggguucuauguuuacu

SEQ ID NO: 2787765 - RNA, 12 nt, Human
uguugugugugc

SEQ ID NO: 2787766 - RNA, 13 nt, Human
uguugugugugca

SEQ ID NO: 2787767 - RNA, 15 nt, Human
uguugugugugcagg

SEQ ID NO: 2787768 - RNA, 12 nt, Human
uguuguuagaga

SEQ ID NO: 2787769 - RNA, 14 nt, Human
uguuguguuucugu

SEQ ID NO: 2787770 - RNA, 14 nt, Human
uguuguuaaaauua

SEQ ID NO: 2787771 - RNA, 20 nt, Human
uguugugauguauucuagcu

SEQ ID NO: 2787772 - RNA, 14 nt, Human
uguugugauguauu

SEQ ID NO: 2787773 - RNA, 13 nt, Human
uguugugaauguu

SEQ ID NO: 2787774 - RNA, 12 nt, Human
uguugugaaugu

SEQ ID NO: 2787775 - RNA, 16 nt, Human
uguugucuugaaagau

SEQ ID NO: 2787776 - RNA, 12 nt, Human
uguugucuugaa

SEQ ID NO: 2787777 - RNA, 21 nt, Human
uguugguuuugggggugugag

SEQ ID NO: 2787778 - RNA, 13 nt, Human
uguuguaaaaaga

SEQ ID NO: 2787779 - RNA, 15 nt, Human
uguugguugcacuuu

SEQ ID NO: 2787780 - RNA, 19 nt, Human
uguugguugcacuuuguag

SEQ ID NO: 2787781 - RNA, 16 nt, Human
uguugguuguuuuuuc

SEQ ID NO: 2787782 - RNA, 19 nt, Human
uguugguuguuuuuuccuu

SEQ ID NO: 2787783 - RNA, 20 nt, Human
uguugguuguuuuuuccuuu

SEQ ID NO: 2787784 - RNA, 14 nt, Human
uguugguuuaauau

SEQ ID NO: 2787785 - RNA, 13 nt, Human
uguugguuuacuu

SEQ ID NO: 2787786 - RNA, 14 nt, Human
uguugguuuacuuu

SEQ ID NO: 2787787 - RNA, 17 nt, Human
uguugguuuacuuucaa

SEQ ID NO: 2787788 - RNA, 19 nt, Human
uguugguuuacuuucaaau

SEQ ID NO: 2787789 - RNA, 20 nt, Human
uguugguuuacuuucaaauc

SEQ ID NO: 2787790 - RNA, 20 nt, Human
uguuggucaggcuggucuca

SEQ ID NO: 2787791 - RNA, 15 nt, Human
aguuuucuuccauga

SEQ ID NO: 2787792 - RNA, 14 nt, Human
aguuuucuucugug

SEQ ID NO: 2787793 - RNA, 12 nt, Human
aguuuucuuguu

SEQ ID NO: 2787794 - RNA, 13 nt, Human
aguuuucuuguug

SEQ ID NO: 2787795 - RNA, 15 nt, Human
aguuuucuuguugcu

SEQ ID NO: 2787796 - RNA, 18 nt, Human
aguuuucuuguugcuuug

SEQ ID NO: 2787797 - RNA, 19 nt, Human
aguuuucuuguugcuuugu

SEQ ID NO: 2787798 - RNA, 21 nt, Human
aguuuucuuguugcuuuguug

SEQ ID NO: 2787799 - RNA, 13 nt, Human
aguuuugaauguu

SEQ ID NO: 2787800 - RNA, 18 nt, Human
aguuuugaauguuaagaa

SEQ ID NO: 2787801 - RNA, 21 nt, Human
aguuuugaauguuaagaauug

SEQ ID NO: 2787802 - RNA, 12 nt, Human
aguuuugaaaag

SEQ ID NO: 2787803 - RNA, 14 nt, Human
aguuuugaaaagcu

SEQ ID NO: 2787804 - RNA, 15 nt, Human
aguuuugaaaagcua

SEQ ID NO: 2787805 - RNA, 16 nt, Human
aguuuugaaaagcuau

SEQ ID NO: 2787806 - RNA, 17 nt, Human
aguuuugaaaagcuauu

SEQ ID NO: 2787807 - RNA, 16 nt, Human
aguuuccuaaucagaa

SEQ ID NO: 2787808 - RNA, 16 nt, Human
aguuucccuuccucca

SEQ ID NO: 2787809 - RNA, 20 nt, Human
aguuucccuuccuccauccu

SEQ ID NO: 2787810 - RNA, 17 nt, Human
aguuucauucuccugcc

SEQ ID NO: 2787811 - RNA, 20 nt, Human
aguuucauucuccugccugu

SEQ ID NO: 2787812 - RNA, 18 nt, Human
aguuuccaauuauuugac

SEQ ID NO: 2787813 - RNA, 17 nt, Human
aguuuccagucucaaaa

SEQ ID NO: 2787814 - RNA, 17 nt, Human
aguuuccauagcaacag

SEQ ID NO: 2787815 - RNA, 20 nt, Human
aguuuccauagcaacaggaa

SEQ ID NO: 2787816 - RNA, 18 nt, Human
aguuuuuaguaaucugua

SEQ ID NO: 2787817 - RNA, 21 nt, Human
aguuuuuaguaaucuguacau

SEQ ID NO: 2787818 - RNA, 23 nt, Human
aguuuuuaacucuacuguguaau

SEQ ID NO: 2787819 - RNA, 18 nt, Human
aguuuuuacagcuguguu

SEQ ID NO: 2787820 - RNA, 14 nt, Human
aguuuugucuugaa

SEQ ID NO: 2787821 - RNA, 12 nt, Human
aguuuugucuug

SEQ ID NO: 2787822 - RNA, 13 nt, Human
aguuuugucuuga

SEQ ID NO: 2787823 - RNA, 17 nt, Human
aguuuuggccaccacau

SEQ ID NO: 2787824 - RNA, 19 nt, Human
aguuuugaugacuggcauu

SEQ ID NO: 2787825 - RNA, 20 nt, Human
aguuuugaugacuggcauuu

SEQ ID NO: 2787826 - RNA, 21 nt, Human
aguuuugaugacuggcauuuu

SEQ ID NO: 2787827 - RNA, 23 nt, Human
aguuuugaugacuggcauuuuau

SEQ ID NO: 2787828 - RNA, 18 nt, Human
aguuuugacaucagccag

SEQ ID NO: 2787829 - RNA, 22 nt, Human
aguuuugacaucagccagcugc

SEQ ID NO: 2787830 - RNA, 23 nt, Human
aguuuugacaucagccagcugcc

SEQ ID NO: 2787831 - RNA, 12 nt, Human
aguuuugagaac

SEQ ID NO: 2787832 - RNA, 18 nt, Human
aguuuugagaacguaaag

SEQ ID NO: 2787833 - RNA, 18 nt, Human
aguuuugaguagauauua

SEQ ID NO: 2787834 - RNA, 20 nt, Human
aguuuugaguagauauuacu

SEQ ID NO: 2787835 - RNA, 21 nt, Human
aguuuugaguagauauuacuu

SEQ ID NO: 2787836 - RNA, 22 nt, Human
aguuuugaguagauauuacuuu

SEQ ID NO: 2787837 - RNA, 18 nt, Human
aguuuugauaugaguaua

SEQ ID NO: 2787838 - RNA, 18 nt, Human
auaaaauaauucuaaagg

SEQ ID NO: 2787839 - RNA, 16 nt, Human
auaaaauaauucuaaa

SEQ ID NO: 2787840 - RNA, 17 nt, Human
auaaaauaauucuaaag

SEQ ID NO: 2787841 - RNA, 15 nt, Human
auaaaauauaaacaa

SEQ ID NO: 2787842 - RNA, 18 nt, Human
auaaaauaguuguccaua

SEQ ID NO: 2787843 - RNA, 19 nt, Human
auaaaauaguuguccauau

SEQ ID NO: 2787844 - RNA, 16 nt, Human
auaaaaucaaaacaag

SEQ ID NO: 2787845 - RNA, 21 nt, Human
auaaaaucaaaacaagugaaa

SEQ ID NO: 2787846 - RNA, 16 nt, Human
auaaaaucaaguuuua

SEQ ID NO: 2787847 - RNA, 16 nt, Human
auaaaaucaauuuuua

SEQ ID NO: 2787848 - RNA, 20 nt, Human
auaaaaucaauuuuuaggaa

SEQ ID NO: 2787849 - RNA, 14 nt, Human
uuaagaaaaguauu

SEQ ID NO: 2787850 - RNA, 15 nt, Human
uuaagaaaaguauuu

SEQ ID NO: 2787851 - RNA, 16 nt, Human
uuaagaaaaguauuuu

SEQ ID NO: 2787852 - RNA, 17 nt, Human
uuaagaaaaguauuuug

SEQ ID NO: 2787853 - RNA, 18 nt, Human
uuaagaaaaguauuuuga

SEQ ID NO: 2787854 - RNA, 21 nt, Human
uuaagaaaaguauuuugaagu

SEQ ID NO: 2787855 - RNA, 23 nt, Human
uuaagaaaaguauuuugaaguuu

SEQ ID NO: 2787856 - RNA, 15 nt, Human
auaaaauaauucuaa

SEQ ID NO: 2787857 - RNA, 13 nt, Human
auaaaauaaugca

SEQ ID NO: 2787858 - RNA, 18 nt, Human
aguuuuuauuccuuguga

SEQ ID NO: 2787859 - RNA, 15 nt, Human
auaaaagauucaccu

SEQ ID NO: 2787860 - RNA, 22 nt, Human
uuaauucuucagcguaaaaugg

SEQ ID NO: 2787861 - RNA, 12 nt, Human
uuaauugcugca

SEQ ID NO: 2787862 - RNA, 13 nt, Human
uuaauugcugcaa

SEQ ID NO: 2787863 - RNA, 21 nt, Human
uuaaucaucuauaaagaagaa

SEQ ID NO: 2787864 - RNA, 13 nt, Human
uuaaucaugaaau

SEQ ID NO: 2787865 - RNA, 16 nt, Human
uuaauauuuaacauua

SEQ ID NO: 2787866 - RNA, 17 nt, Human
uuaauauuuaacauuau

SEQ ID NO: 2787867 - RNA, 12 nt, Human
uuaauauuugcu

SEQ ID NO: 2787868 - RNA, 20 nt, Human
uuaauauuugcugacagcug

SEQ ID NO: 2787869 - RNA, 19 nt, Human
uuaauauuugcugacagcu

SEQ ID NO: 2787870 - RNA, 12 nt, Human
uuaauauuuaac

SEQ ID NO: 2787871 - RNA, 22 nt, Human
uuaauauuuaaacagcaguguu

SEQ ID NO: 2787872 - RNA, 18 nt, Human
uuaauauuuaaacagcag

SEQ ID NO: 2787873 - RNA, 21 nt, Human
uuaauauuuaaacagcagugu

SEQ ID NO: 2787874 - RNA, 22 nt, Human
uuaauauuuauaggucacuuug

SEQ ID NO: 2787875 - RNA, 20 nt, Human
uuaaucuagacaauauacaa

SEQ ID NO: 2787876 - RNA, 21 nt, Human
uuaaucugggccagaauuuca

SEQ ID NO: 2787877 - RNA, 14 nt, Human
uuaaucucuguuau

SEQ ID NO: 2787878 - RNA, 15 nt, Human
uuaaucucuguuaug

SEQ ID NO: 2787879 - RNA, 19 nt, Human
uuaaucucuguuauguacu

SEQ ID NO: 2787880 - RNA, 20 nt, Human
uuaaucucuguuauguacug

SEQ ID NO: 2787881 - RNA, 21 nt, Human
uuaaucucuguuauguacugu

SEQ ID NO: 2787882 - RNA, 22 nt, Human
uuaaucucuguuauguacugua

SEQ ID NO: 2787883 - RNA, 23 nt, Human
uuaaucucuguuauguacuguac

SEQ ID NO: 2787884 - RNA, 15 nt, Human
uuaaucugaaauucu

SEQ ID NO: 2787885 - RNA, 16 nt, Human
uuaaucugaaauucua

SEQ ID NO: 2787886 - RNA, 17 nt, Human
uuaaucugaaauucuaa

SEQ ID NO: 2787887 - RNA, 18 nt, Human
uuaaucugaaauucuaaa

SEQ ID NO: 2787888 - RNA, 19 nt, Human
uuaaucugaaauucuaaag

SEQ ID NO: 2787889 - RNA, 23 nt, Human
uuaaucugaaauucuaaagagca

SEQ ID NO: 2787890 - RNA, 12 nt, Human
uuaauauuuaaa

SEQ ID NO: 2787891 - RNA, 15 nt, Human
uuaauauuuaaacag

SEQ ID NO: 2787892 - RNA, 16 nt, Human
uuaauauuuaaacagc

SEQ ID NO: 2787893 - RNA, 17 nt, Human
uuaauauuuaaacagca

SEQ ID NO: 2787894 - RNA, 19 nt, Human
uuaaguauuuauauauuua

SEQ ID NO: 2787895 - RNA, 17 nt, Human
uuaaguauuuauauauu

SEQ ID NO: 2787896 - RNA, 14 nt, Human
uuaaguauguguaa

SEQ ID NO: 2787897 - RNA, 23 nt, Human
uuaaguauugauucugcuugaga

SEQ ID NO: 2787898 - RNA, 14 nt, Human
uuaaguaucuuuuu

SEQ ID NO: 2787899 - RNA, 19 nt, Human
uuaaguaucuuuuuucaaa

SEQ ID NO: 2787900 - RNA, 16 nt, Human
uuaaguauuuauauau

SEQ ID NO: 2787901 - RNA, 11 nt, Human
uuaaguauuua

SEQ ID NO: 2787902 - RNA, 22 nt, Human
uuaagaaaucuguuuuuguuua

SEQ ID NO: 2787903 - RNA, 14 nt, Human
uuaagaaauguagu

SEQ ID NO: 2787904 - RNA, 15 nt, Human
uuaagaaauguaguu

SEQ ID NO: 2787905 - RNA, 21 nt, Human
uuaagaaauguaguugaugua

SEQ ID NO: 2787906 - RNA, 16 nt, Human
uuaagggcaugccuug

SEQ ID NO: 2787907 - RNA, 19 nt, Human
uuaagggcaugccuugugc

SEQ ID NO: 2787908 - RNA, 22 nt, Human
uuaagggccaccuacaauacau

SEQ ID NO: 2787909 - RNA, 20 nt, Human
uuaaggugaggccugucugu

SEQ ID NO: 2787910 - RNA, 21 nt, Human
uuaaggugaggccugucugug

SEQ ID NO: 2787911 - RNA, 12 nt, Human
uguuuauuuuuc

SEQ ID NO: 2787912 - RNA, 14 nt, Human
uguuuauuuuucau

SEQ ID NO: 2787913 - RNA, 15 nt, Human
uguuuauuuuucaua

SEQ ID NO: 2787914 - RNA, 19 nt, Human
uguuuauuuuucauauugu

SEQ ID NO: 2787915 - RNA, 16 nt, Human
uguuuauuuuucauau

SEQ ID NO: 2787916 - RNA, 18 nt, Human
uguuuauuuuucauauug

SEQ ID NO: 2787917 - RNA, 17 nt, Human
uguuucaaacacaaaug

SEQ ID NO: 2787918 - RNA, 18 nt, Human
uguuucaaacacaaaugc

SEQ ID NO: 2787919 - RNA, 19 nt, Human
uguuucaaacacaaaugca

SEQ ID NO: 2787920 - RNA, 17 nt, Human
aguugccccgucucugu

SEQ ID NO: 2787921 - RNA, 18 nt, Human
aguugccccgucucuguu

SEQ ID NO: 2787922 - RNA, 19 nt, Human
aguugccccgucucuguuc

SEQ ID NO: 2787923 - RNA, 20 nt, Human
aguugccccgucucuguucc

SEQ ID NO: 2787924 - RNA, 19 nt, Human
aguugggcuuccucauagu

SEQ ID NO: 2787925 - RNA, 13 nt, Human
aguugggcuuccu

SEQ ID NO: 2787926 - RNA, 14 nt, Human
aguuggaaauauuc

SEQ ID NO: 2787927 - RNA, 15 nt, Human
aguuggaauuuacca

SEQ ID NO: 2787928 - RNA, 13 nt, Human
aguuggacuaaau

SEQ ID NO: 2787929 - RNA, 14 nt, Human
aguuggacuaaaug

SEQ ID NO: 2787930 - RNA, 20 nt, Human
aguuggacuaaaugccuagu

SEQ ID NO: 2787931 - RNA, 15 nt, Human
aguuuaaaacacauu

SEQ ID NO: 2787932 - RNA, 13 nt, Human
aguuuaaaacagu

SEQ ID NO: 2787933 - RNA, 16 nt, Human
aguuuaaaacaguauu

SEQ ID NO: 2787934 - RNA, 17 nt, Human
aguuuaaaacaguauuu

SEQ ID NO: 2787935 - RNA, 18 nt, Human
aguuuaaaacaguauuua

SEQ ID NO: 2787936 - RNA, 20 nt, Human
aguuuaaaacaguauuuauu

SEQ ID NO: 2787937 - RNA, 12 nt, Human
aguuuaaagcaa

SEQ ID NO: 2787938 - RNA, 17 nt, Human
aguugguacacaacuag

SEQ ID NO: 2787939 - RNA, 12 nt, Human
uuaaaaaaagaa

SEQ ID NO: 2787940 - RNA, 13 nt, Human
uuaaaaaaagaaa

SEQ ID NO: 2787941 - RNA, 14 nt, Human
uuaaaaaaagaaaa

SEQ ID NO: 2787942 - RNA, 19 nt, Human
uuaaaaaaaggcauuguuu

SEQ ID NO: 2787943 - RNA, 21 nt, Human
uuaaaaaaaggcauuguuuga

SEQ ID NO: 2787944 - RNA, 23 nt, Human
uuaaaaauauggaacuucuaaua

SEQ ID NO: 2787945 - RNA, 12 nt, Human
uuaaaaaaauca

SEQ ID NO: 2787946 - RNA, 16 nt, Human
uuaaaaaaauggcagu

SEQ ID NO: 2787947 - RNA, 17 nt, Human
uuaaaaaaaucacaaaa

SEQ ID NO: 2787948 - RNA, 23 nt, Human
uuaaaaaaaucacaaaaauuuga

SEQ ID NO: 2787949 - RNA, 13 nt, Human
aguuuacagaaaa

SEQ ID NO: 2787950 - RNA, 18 nt, Human
aguuuacagaaaaaucuu

SEQ ID NO: 2787951 - RNA, 19 nt, Human
aguuuacagaaaaaucuug

SEQ ID NO: 2787952 - RNA, 23 nt, Human
aguuuacagcucugacuuuacac

SEQ ID NO: 2787953 - RNA, 19 nt, Human
aguuuacaaguguauauca

SEQ ID NO: 2787954 - RNA, 21 nt, Human
aguuuacaaguguauaucaga

SEQ ID NO: 2787955 - RNA, 23 nt, Human
aguuuacaaguguauaucagaaa

SEQ ID NO: 2787956 - RNA, 22 nt, Human
aguuuacaucauuuuuguaucu

SEQ ID NO: 2787957 - RNA, 15 nt, Human
aguuuacaaguguau

SEQ ID NO: 2787958 - RNA, 16 nt, Human
aguuuacaaguguaua

SEQ ID NO: 2787959 - RNA, 17 nt, Human
aguuuacaaguguauau

SEQ ID NO: 2787960 - RNA, 20 nt, Human
uuaaacaaaauagaagcugu

SEQ ID NO: 2787961 - RNA, 20 nt, Human
uuaaacaaacauuguguuga

SEQ ID NO: 2787962 - RNA, 12 nt, Human
uuaaacaaacca

SEQ ID NO: 2787963 - RNA, 16 nt, Human
uuaaacaaaccagaau

SEQ ID NO: 2787964 - RNA, 14 nt, Human
uuaaacacauuguc

SEQ ID NO: 2787965 - RNA, 14 nt, Human
uuaaacaccccuca

SEQ ID NO: 2787966 - RNA, 13 nt, Human
uuaaacaccuccu

SEQ ID NO: 2787967 - RNA, 16 nt, Human
uuaaacaccuccucau

SEQ ID NO: 2787968 - RNA, 14 nt, Human
uuaaacaaagguug

SEQ ID NO: 2787969 - RNA, 14 nt, Human
uuaaacacaaagug

SEQ ID NO: 2787970 - RNA, 12 nt, Human
uuaaacacacag

SEQ ID NO: 2787971 - RNA, 22 nt, Human
uuaaacacacagauacacacac

SEQ ID NO: 2787972 - RNA, 23 nt, Human
uuaaacacacagauacacacaca

SEQ ID NO: 2787973 - RNA, 12 nt, Human
uuaaacagcagu

SEQ ID NO: 2787974 - RNA, 11 nt, Human
uuaaacagaug

SEQ ID NO: 2787975 - RNA, 12 nt, Human
uuaaacagauga

SEQ ID NO: 2787976 - RNA, 22 nt, Human
uuaaacagaugaugagaauuuc

SEQ ID NO: 2787977 - RNA, 14 nt, Human
uuaaacagcagugu

SEQ ID NO: 2787978 - RNA, 19 nt, Human
uuaaacagccuauuccuga

SEQ ID NO: 2787979 - RNA, 23 nt, Human
uuaaacagugagccugaauuuug

SEQ ID NO: 2787980 - RNA, 18 nt, Human
uuaaacagugagccugaa

SEQ ID NO: 2787981 - RNA, 16 nt, Human
uuaaacaguauuucau

SEQ ID NO: 2787982 - RNA, 19 nt, Human
uuaaacaguauuucauugc

SEQ ID NO: 2787983 - RNA, 14 nt, Human
uuaaaguguuucag

SEQ ID NO: 2787984 - RNA, 17 nt, Human
uuaaaguguuucagcua

SEQ ID NO: 2787985 - RNA, 22 nt, Human
uuaaaguguuucagcuaaggga

SEQ ID NO: 2787986 - RNA, 19 nt, Human
uuaaagugcuaagguucua

SEQ ID NO: 2787987 - RNA, 21 nt, Human
uuaaagugcuaagguucuaag

SEQ ID NO: 2787988 - RNA, 22 nt, Human
uuaaagugcuaagguucuaagg

SEQ ID NO: 2787989 - RNA, 17 nt, Human
uuaaaguggcaaucuca

SEQ ID NO: 2787990 - RNA, 17 nt, Human
uuaaaguguaauaauau

SEQ ID NO: 2787991 - RNA, 12 nt, Human
uuaaagucugaa

SEQ ID NO: 2787992 - RNA, 13 nt, Human
uuaaagugaauug

SEQ ID NO: 2787993 - RNA, 10 nt, Human
uuaaacauua

SEQ ID NO: 2787994 - RNA, 13 nt, Human
uuaaacauuaaaa

SEQ ID NO: 2787995 - RNA, 18 nt, Human
uuaaacauuaaaaaugga

SEQ ID NO: 2787996 - RNA, 21 nt, Human
uuaaacauuaaaaauggaacu

SEQ ID NO: 2787997 - RNA, 16 nt, Human
uuaacacaaguccugu

SEQ ID NO: 2787998 - RNA, 13 nt, Human
uuaacacugagcu

SEQ ID NO: 2787999 - RNA, 16 nt, Human
aguuucauaauugugu

SEQ ID NO: 2788000 - RNA, 21 nt, Human
aguuucauguacaagaugaag

SEQ ID NO: 2788001 - RNA, 18 nt, Human
aguuucauguacaagaug

SEQ ID NO: 2788002 - RNA, 15 nt, Human
aguuucauguacaag

SEQ ID NO: 2788003 - RNA, 13 nt, Human
uuaaauaauuuaa

SEQ ID NO: 2788004 - RNA, 14 nt, Human
uuaaauaauuuaac

SEQ ID NO: 2788005 - RNA, 15 nt, Human
uuaaauaauuuaacu

SEQ ID NO: 2788006 - RNA, 16 nt, Human
uuaaauaauuuaacua

SEQ ID NO: 2788007 - RNA, 21 nt, Human
uuaaauaauuuaacuacccuu

SEQ ID NO: 2788008 - RNA, 18 nt, Human
uuaaauagaguuugcuau

SEQ ID NO: 2788009 - RNA, 13 nt, Human
uuaaauagauaca

SEQ ID NO: 2788010 - RNA, 17 nt, Human
uuaaauagauacaaaug

SEQ ID NO: 2788011 - RNA, 19 nt, Human
uuaaauagaguauaugcac

SEQ ID NO: 2788012 - RNA, 19 nt, Human
uuaaauacgcacuacaugu

SEQ ID NO: 2788013 - RNA, 21 nt, Human
auaauagcaacuuuuguguaa

SEQ ID NO: 2788014 - RNA, 13 nt, Human
auaauagauucuc

SEQ ID NO: 2788015 - RNA, 15 nt, Human
auaaucccagcacuu

SEQ ID NO: 2788016 - RNA, 16 nt, Human
auaaucccagcacuuu

SEQ ID NO: 2788017 - RNA, 17 nt, Human
auaaucccagcacuuug

SEQ ID NO: 2788018 - RNA, 12 nt, Human
auaaucuagaac

SEQ ID NO: 2788019 - RNA, 15 nt, Human
auaaucuagaacaca

SEQ ID NO: 2788020 - RNA, 14 nt, Human
auaaucuaguuuac

SEQ ID NO: 2788021 - RNA, 23 nt, Human
auaaucuaguuuacagaaaaauc

SEQ ID NO: 2788022 - RNA, 18 nt, Human
auaaucuggacuccucug

SEQ ID NO: 2788023 - RNA, 19 nt, Human
auaaucuggacuccucugu

SEQ ID NO: 2788024 - RNA, 20 nt, Human
auaaucuggacuccucuguc

SEQ ID NO: 2788025 - RNA, 13 nt, Human
auaauucuuauuu

SEQ ID NO: 2788026 - RNA, 14 nt, Human
auaauucuuauuuu

SEQ ID NO: 2788027 - RNA, 16 nt, Human
auaauucuuauuuugu

SEQ ID NO: 2788028 - RNA, 19 nt, Human
auaauucuuauuuugugga

SEQ ID NO: 2788029 - RNA, 12 nt, Human
auaauucuguaa

SEQ ID NO: 2788030 - RNA, 13 nt, Human
auaauucuguaaa

SEQ ID NO: 2788031 - RNA, 14 nt, Human
auaauucuguaaau

SEQ ID NO: 2788032 - RNA, 15 nt, Human
auaaugagcuauuaa

SEQ ID NO: 2788033 - RNA, 19 nt, Human
auaaugagcuauuaaaacu

SEQ ID NO: 2788034 - RNA, 21 nt, Human
auaaugagcuauuaaaacuca

SEQ ID NO: 2788035 - RNA, 15 nt, Human
auaaugauaaaacac

SEQ ID NO: 2788036 - RNA, 16 nt, Human
auaaugauaaaacacc

SEQ ID NO: 2788037 - RNA, 17 nt, Human
auaaugauaaaacaccu

SEQ ID NO: 2788038 - RNA, 14 nt, Human
auaaugcaaagaau

SEQ ID NO: 2788039 - RNA, 19 nt, Human
auaaugcaaagaaucccua

SEQ ID NO: 2788040 - RNA, 18 nt, Human
auaaugcauccagcagua

SEQ ID NO: 2788041 - RNA, 13 nt, Human
auaauaaauuaaa

SEQ ID NO: 2788042 - RNA, 14 nt, Human
auaauaauuuuuau

SEQ ID NO: 2788043 - RNA, 22 nt, Human
auaauaauuuuuauauuuaauu

SEQ ID NO: 2788044 - RNA, 12 nt, Human
auaauacaaaag

SEQ ID NO: 2788045 - RNA, 13 nt, Human
auaauacaaaagg

SEQ ID NO: 2788046 - RNA, 12 nt, Human
auaauagauucu

SEQ ID NO: 2788047 - RNA, 17 nt, Human
auaauacucuguuguac

SEQ ID NO: 2788048 - RNA, 16 nt, Human
auaauaccucaauguu

SEQ ID NO: 2788049 - RNA, 18 nt, Human
auaauaccucaauguuug

SEQ ID NO: 2788050 - RNA, 19 nt, Human
auaauaccucaauguuuga

SEQ ID NO: 2788051 - RNA, 14 nt, Human
auaauaaaguguuu

SEQ ID NO: 2788052 - RNA, 18 nt, Human
auaauaaaggacuguaau

SEQ ID NO: 2788053 - RNA, 13 nt, Human
auaauaaaggacu

SEQ ID NO: 2788054 - RNA, 11 nt, Human
auaauaaagga

SEQ ID NO: 2788055 - RNA, 20 nt, Human
auaagagaccuguuuuaaaa

SEQ ID NO: 2788056 - RNA, 14 nt, Human
auaagagaaagaaa

SEQ ID NO: 2788057 - RNA, 18 nt, Human
auaagagaaagaaaauga

SEQ ID NO: 2788058 - RNA, 13 nt, Human
auaauaaacauaa

SEQ ID NO: 2788059 - RNA, 21 nt, Human
auaauaaacauaaugaaaaua

SEQ ID NO: 2788060 - RNA, 12 nt, Human
auaauaaaauag

SEQ ID NO: 2788061 - RNA, 13 nt, Human
auaauaaaauagu

SEQ ID NO: 2788062 - RNA, 14 nt, Human
auaagacauaacgu

SEQ ID NO: 2788063 - RNA, 17 nt, Human
auaagacuuagauugug

SEQ ID NO: 2788064 - RNA, 23 nt, Human
auaagacauaacguuuuuccuuu

SEQ ID NO: 2788065 - RNA, 22 nt, Human
auaagacauaucucuaauucca

SEQ ID NO: 2788066 - RNA, 17 nt, Human
auaagacauaacguuuu

SEQ ID NO: 2788067 - RNA, 22 nt, Human
auaagaccaccaccucagagua

SEQ ID NO: 2788068 - RNA, 18 nt, Human
auaagaaugguugccuua

SEQ ID NO: 2788069 - RNA, 18 nt, Human
auaagaauggagcaguac

SEQ ID NO: 2788070 - RNA, 23 nt, Human
auaauuuaacuacccuuaauuac

SEQ ID NO: 2788071 - RNA, 12 nt, Human
auaauuuaagag

SEQ ID NO: 2788072 - RNA, 15 nt, Human
auaauuuaaugcaug

SEQ ID NO: 2788073 - RNA, 12 nt, Human
auaauuguugaa

SEQ ID NO: 2788074 - RNA, 15 nt, Human
auaauuguugaaauu

SEQ ID NO: 2788075 - RNA, 18 nt, Human
auaauuguugaaauuuug

SEQ ID NO: 2788076 - RNA, 19 nt, Human
auaauuguugaaauuuugc

SEQ ID NO: 2788077 - RNA, 20 nt, Human
auaauuguugaaauuuugca

SEQ ID NO: 2788078 - RNA, 21 nt, Human
auaauuguugaaauuuugcaa

SEQ ID NO: 2788079 - RNA, 22 nt, Human
auaauuguugaaauuuugcaaa

SEQ ID NO: 2788080 - RNA, 14 nt, Human
uuagcaaacuuugu

SEQ ID NO: 2788081 - RNA, 13 nt, Human
uuagcacagauuu

SEQ ID NO: 2788082 - RNA, 19 nt, Human
uuagcacagauuuuaauug

SEQ ID NO: 2788083 - RNA, 20 nt, Human
uuagcacagauuuuaauugu

SEQ ID NO: 2788084 - RNA, 21 nt, Human
uuagcacagauuuuaauuguc

SEQ ID NO: 2788085 - RNA, 22 nt, Human
uuagcacagauuuuaauuguca

SEQ ID NO: 2788086 - RNA, 23 nt, Human
uuagcacagauuuuaauugucau

SEQ ID NO: 2788087 - RNA, 16 nt, Human
uuagcaguuugcuuug

SEQ ID NO: 2788088 - RNA, 14 nt, Human
uuagcggagacgga

SEQ ID NO: 2788089 - RNA, 12 nt, Human
uuagccuggagc

SEQ ID NO: 2788090 - RNA, 23 nt, Human
uuagccuggagcaccuuuccuuc

SEQ ID NO: 2788091 - RNA, 12 nt, Human
uuagcaaggauu

SEQ ID NO: 2788092 - RNA, 18 nt, Human
uuagcaaggucauuucuu

SEQ ID NO: 2788093 - RNA, 21 nt, Human
uuagcaaggucauuucuucag

SEQ ID NO: 2788094 - RNA, 18 nt, Human
uuagcauagcuuauuauu

SEQ ID NO: 2788095 - RNA, 15 nt, Human
uuagcauccuaagaa

SEQ ID NO: 2788096 - RNA, 17 nt, Human
uuagcauccuaagaaau

SEQ ID NO: 2788097 - RNA, 18 nt, Human
uuagcauccuaagaaaua

SEQ ID NO: 2788098 - RNA, 19 nt, Human
uuagcauccuaagaaauau

SEQ ID NO: 2788099 - RNA, 15 nt, Human
uuagccaggaucaug

SEQ ID NO: 2788100 - RNA, 17 nt, Human
uuagccaggaucauggu

SEQ ID NO: 2788101 - RNA, 23 nt, Human
uuagccaggaucaugguguaaua

SEQ ID NO: 2788102 - RNA, 14 nt, Human
uuaguuucuuuggg

SEQ ID NO: 2788103 - RNA, 18 nt, Human
uuaguuuggauucuuaug

SEQ ID NO: 2788104 - RNA, 14 nt, Human
uuaguuuggauucu

SEQ ID NO: 2788105 - RNA, 13 nt, Human
uuaguaaaugucu

SEQ ID NO: 2788106 - RNA, 16 nt, Human
uuaguaaaugucuuug

SEQ ID NO: 2788107 - RNA, 17 nt, Human
uuaguaaaugucuuugu

SEQ ID NO: 2788108 - RNA, 18 nt, Human
uuaguaaaugucuuugua

SEQ ID NO: 2788109 - RNA, 19 nt, Human
uuaguaaaugucuuuguaa

SEQ ID NO: 2788110 - RNA, 20 nt, Human
uuaguaaaugucuuuguaag

SEQ ID NO: 2788111 - RNA, 21 nt, Human
uuaguaaaugucuuuguaagu

SEQ ID NO: 2788112 - RNA, 13 nt, Human
uuaguaaauguua

SEQ ID NO: 2788113 - RNA, 22 nt, Human
uuaguaacauaauaaauuaaaa

SEQ ID NO: 2788114 - RNA, 16 nt, Human
uuaguaacaucauuuu

SEQ ID NO: 2788115 - RNA, 16 nt, Human
uuagguuuuuccuuau

SEQ ID NO: 2788116 - RNA, 19 nt, Human
uuagguuuuuuuguauagu

SEQ ID NO: 2788117 - RNA, 18 nt, Human
uuagguggcaagcuguga

SEQ ID NO: 2788118 - RNA, 18 nt, Human
uuaggugcaauuucaagg

SEQ ID NO: 2788119 - RNA, 22 nt, Human
uuaggugcaauuucaagguucu

SEQ ID NO: 2788120 - RNA, 16 nt, Human
auaacgcuuaaaggaa

SEQ ID NO: 2788121 - RNA, 18 nt, Human
auaacgcuuaaaggaagu

SEQ ID NO: 2788122 - RNA, 13 nt, Human
auaacugugaagu

SEQ ID NO: 2788123 - RNA, 16 nt, Human
auaacuguuuauaugu

SEQ ID NO: 2788124 - RNA, 20 nt, Human
auaacuguuuauauguguug

SEQ ID NO: 2788125 - RNA, 21 nt, Human
auaacuguuuauauguguuga

SEQ ID NO: 2788126 - RNA, 17 nt, Human
auaacguuuuuccuuua

SEQ ID NO: 2788127 - RNA, 18 nt, Human
auaacguuuuuccuuuaa

SEQ ID NO: 2788128 - RNA, 15 nt, Human
auaacguuuuuccuu

SEQ ID NO: 2788129 - RNA, 13 nt, Human
auaacguuuuucc

SEQ ID NO: 2788130 - RNA, 16 nt, Human
auaacgugauacauuu

SEQ ID NO: 2788131 - RNA, 21 nt, Human
auaaauuauuaguuuacauca

SEQ ID NO: 2788132 - RNA, 15 nt, Human
auaaauccaguucua

SEQ ID NO: 2788133 - RNA, 18 nt, Human
auaaauccaguucuacua

SEQ ID NO: 2788134 - RNA, 21 nt, Human
auaaaucagugggauuuggua

SEQ ID NO: 2788135 - RNA, 14 nt, Human
auaaaucauauuga

SEQ ID NO: 2788136 - RNA, 15 nt, Human
auaaaucauauugau

SEQ ID NO: 2788137 - RNA, 18 nt, Human
auaaaucauauugaugaa

SEQ ID NO: 2788138 - RNA, 20 nt, Human
auaaaucauauugaugaaaa

SEQ ID NO: 2788139 - RNA, 21 nt, Human
auaaaucauauugaugaaaag

SEQ ID NO: 2788140 - RNA, 20 nt, Human
auaaccccagcucccuagga

SEQ ID NO: 2788141 - RNA, 15 nt, Human
auaacccacuuguca

SEQ ID NO: 2788142 - RNA, 13 nt, Human
auaaccuauauga

SEQ ID NO: 2788143 - RNA, 18 nt, Human
auaaccuauaugauuuau

SEQ ID NO: 2788144 - RNA, 15 nt, Human
auaacccuaacacac

SEQ ID NO: 2788145 - RNA, 13 nt, Human
auaacccuguuac

SEQ ID NO: 2788146 - RNA, 13 nt, Human
auaacccuucaac

SEQ ID NO: 2788147 - RNA, 15 nt, Human
auaaauuccacugga

SEQ ID NO: 2788148 - RNA, 23 nt, Human
auaaauucccaacuucucuugcu

SEQ ID NO: 2788149 - RNA, 13 nt, Human
auaaaguacuuga

SEQ ID NO: 2788150 - RNA, 12 nt, Human
uuaauugucaug

SEQ ID NO: 2788151 - RNA, 14 nt, Human
uuaauugucauggu

SEQ ID NO: 2788152 - RNA, 16 nt, Human
auaaaggcuaacuaug

SEQ ID NO: 2788153 - RNA, 14 nt, Human
auaaagggaacaaa

SEQ ID NO: 2788154 - RNA, 17 nt, Human
auaaagggggagggaaa

SEQ ID NO: 2788155 - RNA, 15 nt, Human
auaaagguaaaacaa

SEQ ID NO: 2788156 - RNA, 15 nt, Human
auaaauauaagccuu

SEQ ID NO: 2788157 - RNA, 16 nt, Human
auaaauauaagccuuu

SEQ ID NO: 2788158 - RNA, 16 nt, Human
auaaauaggagaggau

SEQ ID NO: 2788159 - RNA, 14 nt, Human
auaaauauauauaa

SEQ ID NO: 2788160 - RNA, 18 nt, Human
auaaauauuuuugccaua

SEQ ID NO: 2788161 - RNA, 20 nt, Human
auaaauauuugacuugcaug

SEQ ID NO: 2788162 - RNA, 16 nt, Human
auaaauauauauaaag

SEQ ID NO: 2788163 - RNA, 17 nt, Human
auaaauauauauaaaga

SEQ ID NO: 2788164 - RNA, 19 nt, Human
auaaauauauauaaagaau

SEQ ID NO: 2788165 - RNA, 15 nt, Human
uuaccuccaacagaa

SEQ ID NO: 2788166 - RNA, 18 nt, Human
uuaccuccaacagaacua

SEQ ID NO: 2788167 - RNA, 19 nt, Human
uuaccuccaacagaacuaa

SEQ ID NO: 2788168 - RNA, 22 nt, Human
uuaccuccaacagaacuaaaug

SEQ ID NO: 2788169 - RNA, 23 nt, Human
uuaccuccaacagaacuaaaugu

SEQ ID NO: 2788170 - RNA, 19 nt, Human
uuaccuaccacaugccaag

SEQ ID NO: 2788171 - RNA, 16 nt, Human
uuaccccuuagccucc

SEQ ID NO: 2788172 - RNA, 17 nt, Human
uuacccgguuucuuuuu

SEQ ID NO: 2788173 - RNA, 12 nt, Human
uuacccuaaugu

SEQ ID NO: 2788174 - RNA, 18 nt, Human
uuacccuaaugucuucau

SEQ ID NO: 2788175 - RNA, 14 nt, Human
uuaccccuuagccu

SEQ ID NO: 2788176 - RNA, 17 nt, Human
uuaccccuggcuguuug

SEQ ID NO: 2788177 - RNA, 13 nt, Human
uuacccaugaaaa

SEQ ID NO: 2788178 - RNA, 22 nt, Human
uuaccccacaacgugcaacuga

SEQ ID NO: 2788179 - RNA, 21 nt, Human
uuaccccauggcugcacaguu

SEQ ID NO: 2788180 - RNA, 17 nt, Human
uuacccccauucgcgcu

SEQ ID NO: 2788181 - RNA, 20 nt, Human
uuacccaggguggagugcag

SEQ ID NO: 2788182 - RNA, 20 nt, Human
uuacaggcaugagccacugc

SEQ ID NO: 2788183 - RNA, 11 nt, Human
uuacaggcccu

SEQ ID NO: 2788184 - RNA, 17 nt, Human
uuacaggcccugcuccu

SEQ ID NO: 2788185 - RNA, 22 nt, Human
uuacaggcccugcuccugcagc

SEQ ID NO: 2788186 - RNA, 24 nt, Human
uuacaggcgugagccaccgugccu

SEQ ID NO: 2788187 - RNA, 18 nt, Human
uuacaggcuccugccacc

SEQ ID NO: 2788188 - RNA, 16 nt, Human
uuacaggcuccugcca

SEQ ID NO: 2788189 - RNA, 21 nt, Human
auaacuuaaaaauguaaauau

SEQ ID NO: 2788190 - RNA, 19 nt, Human
auaacuuaaaaauguaaau

SEQ ID NO: 2788191 - RNA, 20 nt, Human
auaacuuaaaaauguaaaua

SEQ ID NO: 2788192 - RNA, 20 nt, Human
uuagacagagucucacuguu

SEQ ID NO: 2788193 - RNA, 13 nt, Human
uuagacagagucu

SEQ ID NO: 2788194 - RNA, 16 nt, Human
uuagaacaauuuucuu

SEQ ID NO: 2788195 - RNA, 18 nt, Human
uuagaacaauuuucuugu

SEQ ID NO: 2788196 - RNA, 14 nt, Human
uuagaaauuagaaa

SEQ ID NO: 2788197 - RNA, 16 nt, Human
uuagaaaugcagaauc

SEQ ID NO: 2788198 - RNA, 17 nt, Human
uuagaaauguaaacugc

SEQ ID NO: 2788199 - RNA, 20 nt, Human
uuagaaauguaaacugccau

SEQ ID NO: 2788200 - RNA, 21 nt, Human
uuagaaauguaaacugccaua

SEQ ID NO: 2788201 - RNA, 17 nt, Human
uuagaaauugcauuucc

SEQ ID NO: 2788202 - RNA, 22 nt, Human
uuagaaagcugacauugccaaa

SEQ ID NO: 2788203 - RNA, 21 nt, Human
uuagaaaguagccacguaugg

SEQ ID NO: 2788204 - RNA, 17 nt, Human
uuagaaagcaacuuauc

SEQ ID NO: 2788205 - RNA, 21 nt, Human
uuacucuaugccccaaauaua

SEQ ID NO: 2788206 - RNA, 18 nt, Human
uuaccuugacuguugaug

SEQ ID NO: 2788207 - RNA, 19 nt, Human
uuaccuugacuguugaugu

SEQ ID NO: 2788208 - RNA, 23 nt, Human
uuacucuucaguuaagccuuugg

SEQ ID NO: 2788209 - RNA, 15 nt, Human
uuaccuuguuauuua

SEQ ID NO: 2788210 - RNA, 18 nt, Human
uuagaaaccuuaauaugu

SEQ ID NO: 2788211 - RNA, 14 nt, Human
uuagaaaccuuaau

SEQ ID NO: 2788212 - RNA, 18 nt, Human
uuugcaauaaaaaugaua

SEQ ID NO: 2788213 - RNA, 19 nt, Human
uuugcaauggcuauauggc

SEQ ID NO: 2788214 - RNA, 22 nt, Human
uuugccauguuggccaggcugg

SEQ ID NO: 2788215 - RNA, 16 nt, Human
uuugcacagcucuccg

SEQ ID NO: 2788216 - RNA, 12 nt, Human
uuugcacagcuc

SEQ ID NO: 2788217 - RNA, 11 nt, Human
uuugccauuug

SEQ ID NO: 2788218 - RNA, 12 nt, Human
uuugccauuuga

SEQ ID NO: 2788219 - RNA, 14 nt, Human
uuugccauuugaua

SEQ ID NO: 2788220 - RNA, 16 nt, Human
uuugccauuugauacc

SEQ ID NO: 2788221 - RNA, 13 nt, Human
uuugcacauuuug

SEQ ID NO: 2788222 - RNA, 18 nt, Human
uuugcacauuuugauuuu

SEQ ID NO: 2788223 - RNA, 19 nt, Human
uuugcuagacucuagacaa

SEQ ID NO: 2788224 - RNA, 21 nt, Human
uuugcuagacucuagacaaga

SEQ ID NO: 2788225 - RNA, 15 nt, Human
uuugcuagcaguaaa

SEQ ID NO: 2788226 - RNA, 20 nt, Human
uuugcuagcaguaaaagaug

SEQ ID NO: 2788227 - RNA, 24 nt, Human
uuugcuagcaguaaaagaugaagu

SEQ ID NO: 2788228 - RNA, 14 nt, Human
uuugcuacuaaguu

SEQ ID NO: 2788229 - RNA, 24 nt, Human
uuugcuacuguacauaaacaauga

SEQ ID NO: 2788230 - RNA, 13 nt, Human
uuugcuaauuaaa

SEQ ID NO: 2788231 - RNA, 14 nt, Human
uuugcuaauuaaaa

SEQ ID NO: 2788232 - RNA, 19 nt, Human
uuugcuaauuaaaaaguua

SEQ ID NO: 2788233 - RNA, 19 nt, Human
uuugcccugguuucacugg

SEQ ID NO: 2788234 - RNA, 12 nt, Human
uuugcuuagaaa

SEQ ID NO: 2788235 - RNA, 16 nt, Human
uuugcuuagaaaagaa

SEQ ID NO: 2788236 - RNA, 14 nt, Human
uuugcugugaacaa

SEQ ID NO: 2788237 - RNA, 15 nt, Human
uuugcugugaacaau

SEQ ID NO: 2788238 - RNA, 13 nt, Human
uuugcuucauaaa

SEQ ID NO: 2788239 - RNA, 15 nt, Human
uuugcuucaaaaaca

SEQ ID NO: 2788240 - RNA, 19 nt, Human
uuuggcccaaucucugcca

SEQ ID NO: 2788241 - RNA, 13 nt, Human
uuuggccaucucu

SEQ ID NO: 2788242 - RNA, 23 nt, Human
uuuggccaucucuggaugccuga

SEQ ID NO: 2788243 - RNA, 19 nt, Human
uuuggggagguguucacug

SEQ ID NO: 2788244 - RNA, 23 nt, Human
uuuggggaaggguuugaauuguu

SEQ ID NO: 2788245 - RNA, 22 nt, Human
uuuggggacagauucagucuug

SEQ ID NO: 2788246 - RNA, 23 nt, Human
uuuggggacagauucagucuugc

SEQ ID NO: 2788247 - RNA, 16 nt, Human
uuugggaaacuuguca

SEQ ID NO: 2788248 - RNA, 17 nt, Human
uuugggaaccaagcuau

SEQ ID NO: 2788249 - RNA, 22 nt, Human
uuugggaagugaagacuggaag

SEQ ID NO: 2788250 - RNA, 20 nt, Human
uuugggaagugaagacugga

SEQ ID NO: 2788251 - RNA, 17 nt, Human
uuuggccugcacuaauu

SEQ ID NO: 2788252 - RNA, 17 nt, Human
uuuggcgcuauuacaaa

SEQ ID NO: 2788253 - RNA, 19 nt, Human
uuuggcgcuauuacaaaua

SEQ ID NO: 2788254 - RNA, 15 nt, Human
uuugggacccugcuu

SEQ ID NO: 2788255 - RNA, 20 nt, Human
uuugggacccugcuuuagag

SEQ ID NO: 2788256 - RNA, 23 nt, Human
uuugggacccugcuuuagagcua

SEQ ID NO: 2788257 - RNA, 14 nt, Human
auguccccucccag

SEQ ID NO: 2788258 - RNA, 22 nt, Human
augucccaucacguguacuggc

SEQ ID NO: 2788259 - RNA, 24 nt, Human
augucccuaccgagucucuucucc

SEQ ID NO: 2788260 - RNA, 19 nt, Human
augucccuagaaaacaaug

SEQ ID NO: 2788261 - RNA, 14 nt, Human
augucccugggcca

SEQ ID NO: 2788262 - RNA, 15 nt, Human
augucccugggccag

SEQ ID NO: 2788263 - RNA, 16 nt, Human
augucccugggccagg

SEQ ID NO: 2788264 - RNA, 17 nt, Human
augucccugggccaggg

SEQ ID NO: 2788265 - RNA, 18 nt, Human
augucccugggccagggu

SEQ ID NO: 2788266 - RNA, 20 nt, Human
augucccugggccagggucu

SEQ ID NO: 2788267 - RNA, 21 nt, Human
augucccugggccagggucug

SEQ ID NO: 2788268 - RNA, 19 nt, Human
auguccauuuauaucauuu

SEQ ID NO: 2788269 - RNA, 20 nt, Human
augucccaacuuguaaaaau

SEQ ID NO: 2788270 - RNA, 19 nt, Human
augucuaaaugcugaaaaa

SEQ ID NO: 2788271 - RNA, 18 nt, Human
augucccuugaugcacag

SEQ ID NO: 2788272 - RNA, 19 nt, Human
augucccuugaugcacaga

SEQ ID NO: 2788273 - RNA, 21 nt, Human
augucccuugaugcacagaga

SEQ ID NO: 2788274 - RNA, 23 nt, Human
augucccuugaugcacagagaag

SEQ ID NO: 2788275 - RNA, 23 nt, Human
augucucuuuaaugucacaggca

SEQ ID NO: 2788276 - RNA, 12 nt, Human
augucuauuuaa

SEQ ID NO: 2788277 - RNA, 13 nt, Human
augucuauuuaag

SEQ ID NO: 2788278 - RNA, 14 nt, Human
augucuauuuaagc

SEQ ID NO: 2788279 - RNA, 22 nt, Human
augucuauaaucccagcacuuu

SEQ ID NO: 2788280 - RNA, 20 nt, Human
augucuaucaacuuuaauca

SEQ ID NO: 2788281 - RNA, 21 nt, Human
augucuaugauucguguaauu

SEQ ID NO: 2788282 - RNA, 19 nt, Human
augucaggucagccaacug

SEQ ID NO: 2788283 - RNA, 22 nt, Human
auguagugugggaggcuccugu

SEQ ID NO: 2788284 - RNA, 15 nt, Human
auguaguugauguau

SEQ ID NO: 2788285 - RNA, 17 nt, Human
auguaguugauguaucc

SEQ ID NO: 2788286 - RNA, 18 nt, Human
auguaguugauguaucca

SEQ ID NO: 2788287 - RNA, 22 nt, Human
auguaguugauguauccaacaa

SEQ ID NO: 2788288 - RNA, 21 nt, Human
auguauaaagcaacuguuaug

SEQ ID NO: 2788289 - RNA, 22 nt, Human
auguauaaagcaacuguuauga

SEQ ID NO: 2788290 - RNA, 14 nt, Human
auguauaaauguga

SEQ ID NO: 2788291 - RNA, 16 nt, Human
auguauaaaugugaua

SEQ ID NO: 2788292 - RNA, 16 nt, Human
auguaucauagaaaug

SEQ ID NO: 2788293 - RNA, 21 nt, Human
auguaucccuucucacagcac

SEQ ID NO: 2788294 - RNA, 19 nt, Human
auguaucgggaagauuucu

SEQ ID NO: 2788295 - RNA, 12 nt, Human
auguaucaucug

SEQ ID NO: 2788296 - RNA, 17 nt, Human
auguaucauagaaaugu

SEQ ID NO: 2788297 - RNA, 16 nt, Human
auguaucuauuuauua

SEQ ID NO: 2788298 - RNA, 22 nt, Human
auguauggaaucccacuguaug

SEQ ID NO: 2788299 - RNA, 14 nt, Human
uuugggggaaacuu

SEQ ID NO: 2788300 - RNA, 23 nt, Human
augucaggggcggggagggugac

SEQ ID NO: 2788301 - RNA, 12 nt, Human
augucaggccug

SEQ ID NO: 2788302 - RNA, 16 nt, Human
augucaggccugugug

SEQ ID NO: 2788303 - RNA, 20 nt, Human
augucaggaacagaaggaug

SEQ ID NO: 2788304 - RNA, 19 nt, Human
augucaggaacagaaggau

SEQ ID NO: 2788305 - RNA, 17 nt, Human
augucaggaacagaagg

SEQ ID NO: 2788306 - RNA, 15 nt, Human
augucaggaacagaa

SEQ ID NO: 2788307 - RNA, 13 nt, Human
uuuuaaaagaaau

SEQ ID NO: 2788308 - RNA, 14 nt, Human
uuuuaacauuuugu

SEQ ID NO: 2788309 - RNA, 19 nt, Human
uuuuaacauuuuguucuua

SEQ ID NO: 2788310 - RNA, 20 nt, Human
uuuuaaaacacauguuuuua

SEQ ID NO: 2788311 - RNA, 22 nt, Human
uuuuaaaacacuuccauaaucu

SEQ ID NO: 2788312 - RNA, 11 nt, Human
uuuuaaaacac

SEQ ID NO: 2788313 - RNA, 13 nt, Human
uuuuaaaacacau

SEQ ID NO: 2788314 - RNA, 16 nt, Human
uuuuaaaacacuucca

SEQ ID NO: 2788315 - RNA, 12 nt, Human
uuuuaaaaaugg

SEQ ID NO: 2788316 - RNA, 13 nt, Human
uuuuaaaaauggu

SEQ ID NO: 2788317 - RNA, 23 nt, Human
uuuuaaaaauguccugccuuuua

SEQ ID NO: 2788318 - RNA, 17 nt, Human
uuuuaaaaauagacacu

SEQ ID NO: 2788319 - RNA, 21 nt, Human
uuuguuuggauguaauuuagg

SEQ ID NO: 2788320 - RNA, 12 nt, Human
uuuguuugucuc

SEQ ID NO: 2788321 - RNA, 12 nt, Human
uuuguuugucug

SEQ ID NO: 2788322 - RNA, 10 nt, Human
uuuguuucuu

SEQ ID NO: 2788323 - RNA, 13 nt, Human
uuuguuugaugca

SEQ ID NO: 2788324 - RNA, 13 nt, Human
uuuuaaaaaauga

SEQ ID NO: 2788325 - RNA, 14 nt, Human
uuuuaaaaaaugaa

SEQ ID NO: 2788326 - RNA, 22 nt, Human
uuuuaaaaaaugaaaauaagug

SEQ ID NO: 2788327 - RNA, 19 nt, Human
uuuuaaaaacauagaaaaa

SEQ ID NO: 2788328 - RNA, 22 nt, Human
uuuuaaaaagaaacaagaugcu

SEQ ID NO: 2788329 - RNA, 23 nt, Human
uuuuaaaaaagcaacagaaaccu

SEQ ID NO: 2788330 - RNA, 16 nt, Human
uuuuaaaaacaacuua

SEQ ID NO: 2788331 - RNA, 21 nt, Human
uuuuaaaaaggaacugcagca

SEQ ID NO: 2788332 - RNA, 14 nt, Human
uuuuaaaaauacau

SEQ ID NO: 2788333 - RNA, 16 nt, Human
uuuuaaaaauacauau

SEQ ID NO: 2788334 - RNA, 21 nt, Human
uuuuaaaaauacauaucgcug

SEQ ID NO: 2788335 - RNA, 11 nt, Human
uuuuaagaaau

SEQ ID NO: 2788336 - RNA, 13 nt, Human
uuuuaagaaaugu

SEQ ID NO: 2788337 - RNA, 14 nt, Human
uuuuaagaaaugua

SEQ ID NO: 2788338 - RNA, 16 nt, Human
uuuuaagaaauguagu

SEQ ID NO: 2788339 - RNA, 15 nt, Human
uuuuaagaggcaggg

SEQ ID NO: 2788340 - RNA, 16 nt, Human
uuuuaagaggcagggu

SEQ ID NO: 2788341 - RNA, 19 nt, Human
uuuuaagacguguuugugu

SEQ ID NO: 2788342 - RNA, 18 nt, Human
uuuuaaccucuuuaagua

SEQ ID NO: 2788343 - RNA, 18 nt, Human
uuuuaaccauggcagggu

SEQ ID NO: 2788344 - RNA, 13 nt, Human
uuuuaacuucuuu

SEQ ID NO: 2788345 - RNA, 15 nt, Human
uuuuaacuucuuucu

SEQ ID NO: 2788346 - RNA, 19 nt, Human
uuuuaacuccccuguuuca

SEQ ID NO: 2788347 - RNA, 14 nt, Human
uuuuaacugugcaa

SEQ ID NO: 2788348 - RNA, 18 nt, Human
uuuuaaguauuuauauau

SEQ ID NO: 2788349 - RNA, 17 nt, Human
uuuuaaguauuuauaua

SEQ ID NO: 2788350 - RNA, 15 nt, Human
uuuuaaguauuuagg

SEQ ID NO: 2788351 - RNA, 14 nt, Human
uuuuaaguaaugug

SEQ ID NO: 2788352 - RNA, 15 nt, Human
uuuuaaguaaugugg

SEQ ID NO: 2788353 - RNA, 17 nt, Human
uuuuaaguaauguggaa

SEQ ID NO: 2788354 - RNA, 23 nt, Human
uuuuaaggguuuguggaaaauga

SEQ ID NO: 2788355 - RNA, 12 nt, Human
uuuuaagauuuu

SEQ ID NO: 2788356 - RNA, 17 nt, Human
uuuuaagauuuuucuca

SEQ ID NO: 2788357 - RNA, 18 nt, Human
uuuuaagauuuuucucaa

SEQ ID NO: 2788358 - RNA, 19 nt, Human
uuuuaagauuuuucucaaa

SEQ ID NO: 2788359 - RNA, 15 nt, Human
uuuuaagcaaaauau

SEQ ID NO: 2788360 - RNA, 21 nt, Human
uuuuaagcacucuuaaagcaa

SEQ ID NO: 2788361 - RNA, 18 nt, Human
uuuuaagcauugugagua

SEQ ID NO: 2788362 - RNA, 21 nt, Human
uuuuaagauuuuucucaaagu

SEQ ID NO: 2788363 - RNA, 20 nt, Human
uuuuaaggguuuguggaaaa

SEQ ID NO: 2788364 - RNA, 12 nt, Human
uuuuaaggaaac

SEQ ID NO: 2788365 - RNA, 13 nt, Human
uuugucucuccuu

SEQ ID NO: 2788366 - RNA, 16 nt, Human
uuugucucuccuuuuc

SEQ ID NO: 2788367 - RNA, 17 nt, Human
uuugucucuccuuuucu

SEQ ID NO: 2788368 - RNA, 22 nt, Human
uuugucucuccuuuucuuuugu

SEQ ID NO: 2788369 - RNA, 18 nt, Human
uuugucuauuuuaaaaua

SEQ ID NO: 2788370 - RNA, 22 nt, Human
uuugucucagaagugaaaaucu

SEQ ID NO: 2788371 - RNA, 18 nt, Human
uuugucucaguuggaaau

SEQ ID NO: 2788372 - RNA, 13 nt, Human
uuugucugucgug

SEQ ID NO: 2788373 - RNA, 14 nt, Human
uuugucugaaaaau

SEQ ID NO: 2788374 - RNA, 20 nt, Human
uuugugacuauauagagaug

SEQ ID NO: 2788375 - RNA, 22 nt, Human
uuugugacuauauagagauguu

SEQ ID NO: 2788376 - RNA, 16 nt, Human
uuugugagcaggcugu

SEQ ID NO: 2788377 - RNA, 21 nt, Human
uuuguaggaaggucucauucu

SEQ ID NO: 2788378 - RNA, 22 nt, Human
uuuguaggaaggucucauucuu

SEQ ID NO: 2788379 - RNA, 23 nt, Human
uuuguaggaaggucucauucuuc

SEQ ID NO: 2788380 - RNA, 21 nt, Human
uuuguaggagaaacucccaug

SEQ ID NO: 2788381 - RNA, 21 nt, Human
uuugucgggcaccagccagcg

SEQ ID NO: 2788382 - RNA, 19 nt, Human
uuuguaggggucaaagaaa

SEQ ID NO: 2788383 - RNA, 20 nt, Human
uuuguaggggucaaagaaau

SEQ ID NO: 2788384 - RNA, 21 nt, Human
uuuguaggggucaaagaaaug

SEQ ID NO: 2788385 - RNA, 23 nt, Human
uuuguaggggucaaagaaaugcu

SEQ ID NO: 2788386 - RNA, 19 nt, Human
uuuguccugaugcuuuugu

SEQ ID NO: 2788387 - RNA, 23 nt, Human
uuugugacuauauagagauguuu

SEQ ID NO: 2788388 - RNA, 13 nt, Human
uuugugauaauuu

SEQ ID NO: 2788389 - RNA, 14 nt, Human
uuugugauaauuua

SEQ ID NO: 2788390 - RNA, 13 nt, Human
uuuguagagccag

SEQ ID NO: 2788391 - RNA, 13 nt, Human
uuuguacuguuua

SEQ ID NO: 2788392 - RNA, 14 nt, Human
uuuguacuguuuaa

SEQ ID NO: 2788393 - RNA, 18 nt, Human
uuuguacuguuuaauguu

SEQ ID NO: 2788394 - RNA, 15 nt, Human
uuuguacugaaaaau

SEQ ID NO: 2788395 - RNA, 14 nt, Human
uuuguacugaaaaa

SEQ ID NO: 2788396 - RNA, 17 nt, Human
uuuguaccaugguguga

SEQ ID NO: 2788397 - RNA, 19 nt, Human
uuuguacauaguuauuuau

SEQ ID NO: 2788398 - RNA, 11 nt, Human
uuuguaaauuc

SEQ ID NO: 2788399 - RNA, 13 nt, Human
uuuguaaauuguc

SEQ ID NO: 2788400 - RNA, 14 nt, Human
uuuguaccauggug

SEQ ID NO: 2788401 - RNA, 19 nt, Human
uuuguacauauguaaaaua

SEQ ID NO: 2788402 - RNA, 12 nt, Human
uuuguacaucug

SEQ ID NO: 2788403 - RNA, 19 nt, Human
uuuguacaucuggcuuauu

SEQ ID NO: 2788404 - RNA, 19 nt, Human
augucugcuccuuuccccu

SEQ ID NO: 2788405 - RNA, 23 nt, Human
augucugccaauuuuugccuuca

SEQ ID NO: 2788406 - RNA, 11 nt, Human
augucugcagc

SEQ ID NO: 2788407 - RNA, 13 nt, Human
augucugcagccc

SEQ ID NO: 2788408 - RNA, 14 nt, Human
augucugcagcccu

SEQ ID NO: 2788409 - RNA, 15 nt, Human
augucugcagcccug

SEQ ID NO: 2788410 - RNA, 19 nt, Human
augucugcagcccugagaa

SEQ ID NO: 2788411 - RNA, 15 nt, Human
augucuauuuaagcc

SEQ ID NO: 2788412 - RNA, 23 nt, Human
augucuauuuaagccucauauuu

SEQ ID NO: 2788413 - RNA, 13 nt, Human
augucugaacuuu

SEQ ID NO: 2788414 - RNA, 14 nt, Human
augucugaacuuug

SEQ ID NO: 2788415 - RNA, 17 nt, Human
augucugaacuuuggga

SEQ ID NO: 2788416 - RNA, 18 nt, Human
augucugaacuuugggaa

SEQ ID NO: 2788417 - RNA, 13 nt, Human
augucugccaauu

SEQ ID NO: 2788418 - RNA, 14 nt, Human
augucugccaauuu

SEQ ID NO: 2788419 - RNA, 16 nt, Human
augucugccaauuuuu

SEQ ID NO: 2788420 - RNA, 21 nt, Human
augucugccaauuuuugccuu

SEQ ID NO: 2788421 - RNA, 12 nt, Human
augucuguaaau

SEQ ID NO: 2788422 - RNA, 13 nt, Human
augucugucauug

SEQ ID NO: 2788423 - RNA, 16 nt, Human
augucuguugaugacu

SEQ ID NO: 2788424 - RNA, 14 nt, Human
augucuguuuaaga

SEQ ID NO: 2788425 - RNA, 16 nt, Human
augucuguuuaagaaa

SEQ ID NO: 2788426 - RNA, 17 nt, Human
augucuguuuaagaaaa

SEQ ID NO: 2788427 - RNA, 19 nt, Human
augucuguuuaagaaaagu

SEQ ID NO: 2788428 - RNA, 13 nt, Human
augucuguuugcu

SEQ ID NO: 2788429 - RNA, 14 nt, Human
augucuguuugcug

SEQ ID NO: 2788430 - RNA, 15 nt, Human
augucuguuugcuga

SEQ ID NO: 2788431 - RNA, 24 nt, Human
augucuguuugcugauggucuggu

SEQ ID NO: 2788432 - RNA, 17 nt, Human
auguuuauuuacuaauu

SEQ ID NO: 2788433 - RNA, 19 nt, Human
auguuuauucuucuagagu

SEQ ID NO: 2788434 - RNA, 21 nt, Human
auguuuauucuucuagaguuc

SEQ ID NO: 2788435 - RNA, 22 nt, Human
auguuuacagguggacacacaa

SEQ ID NO: 2788436 - RNA, 21 nt, Human
auguuuagauagggcugggca

SEQ ID NO: 2788437 - RNA, 16 nt, Human
auguuuauucuucuag

SEQ ID NO: 2788438 - RNA, 14 nt, Human
auguuuauuccuug

SEQ ID NO: 2788439 - RNA, 17 nt, Human
auguuuauucuucuaga

SEQ ID NO: 2788440 - RNA, 18 nt, Human
auguuuauucuucuagag

SEQ ID NO: 2788441 - RNA, 15 nt, Human
auguugugauguauu

SEQ ID NO: 2788442 - RNA, 22 nt, Human
auguuguccaauuguugacagu

SEQ ID NO: 2788443 - RNA, 22 nt, Human
auguuguaaauuaggaggcuca

SEQ ID NO: 2788444 - RNA, 14 nt, Human
auguuguaaugcug

SEQ ID NO: 2788445 - RNA, 15 nt, Human
auguuguaaugcugc

SEQ ID NO: 2788446 - RNA, 16 nt, Human
auguuguaaugcugca

SEQ ID NO: 2788447 - RNA, 18 nt, Human
auguuguaaugcugcacu

SEQ ID NO: 2788448 - RNA, 11 nt, Human
auguuguacaa

SEQ ID NO: 2788449 - RNA, 15 nt, Human
auguuguacaaugua

SEQ ID NO: 2788450 - RNA, 19 nt, Human
uuuucuauuccuucuggcc

SEQ ID NO: 2788451 - RNA, 20 nt, Human
uuuucuauuccuucuggccu

SEQ ID NO: 2788452 - RNA, 17 nt, Human
uuuucuauuuaugccuu

SEQ ID NO: 2788453 - RNA, 12 nt, Human
uuuucuauguac

SEQ ID NO: 2788454 - RNA, 14 nt, Human
uuuucuauguacua

SEQ ID NO: 2788455 - RNA, 18 nt, Human
uuuucuauguacuaguac

SEQ ID NO: 2788456 - RNA, 21 nt, Human
uuuucuauguacuaguacugu

SEQ ID NO: 2788457 - RNA, 17 nt, Human
uuuucucacuccuuuug

SEQ ID NO: 2788458 - RNA, 18 nt, Human
auguugguuuacuuucaa

SEQ ID NO: 2788459 - RNA, 19 nt, Human
auguugguuuacuuucaaa

SEQ ID NO: 2788460 - RNA, 12 nt, Human
uuuucucagcug

SEQ ID NO: 2788461 - RNA, 19 nt, Human
uuuucucaaaguuuugaaa

SEQ ID NO: 2788462 - RNA, 20 nt, Human
uuuucucaaaguuuugaaaa

SEQ ID NO: 2788463 - RNA, 15 nt, Human
uuuucucaaaguuuu

SEQ ID NO: 2788464 - RNA, 15 nt, Human
uuuucucaaaagcau

SEQ ID NO: 2788465 - RNA, 22 nt, Human
uuuucucaaaagcauuuaucau

SEQ ID NO: 2788466 - RNA, 23 nt, Human
uuuucucaaaguuuugaaaagcu

SEQ ID NO: 2788467 - RNA, 21 nt, Human
auuaaaaauauggaacuucua

SEQ ID NO: 2788468 - RNA, 16 nt, Human
auuaaaaggauaguau

SEQ ID NO: 2788469 - RNA, 12 nt, Human
auuaaaagucac

SEQ ID NO: 2788470 - RNA, 13 nt, Human
auuaaaagucaca

SEQ ID NO: 2788471 - RNA, 22 nt, Human
auuaaaagucacaauguucuuu

SEQ ID NO: 2788472 - RNA, 23 nt, Human
auuaaaagucacaauguucuuua

SEQ ID NO: 2788473 - RNA, 14 nt, Human
auuaaaaauaugga

SEQ ID NO: 2788474 - RNA, 13 nt, Human
auuaaaaaguuaa

SEQ ID NO: 2788475 - RNA, 15 nt, Human
auuaaaaaguuaauc

SEQ ID NO: 2788476 - RNA, 17 nt, Human
auuaaaaaguuaaucuu

SEQ ID NO: 2788477 - RNA, 16 nt, Human
auuaaaaacuaguagu

SEQ ID NO: 2788478 - RNA, 17 nt, Human
auuaaaaacuaguaguu

SEQ ID NO: 2788479 - RNA, 19 nt, Human
auuaaaaacuaguaguucu

SEQ ID NO: 2788480 - RNA, 22 nt, Human
auuaaaaacuaguaguucucuu

SEQ ID NO: 2788481 - RNA, 21 nt, Human
auuaaaaagaugguugccaag

SEQ ID NO: 2788482 - RNA, 16 nt, Human
auuaaaaagauucuuu

SEQ ID NO: 2788483 - RNA, 17 nt, Human
auuaaaaagauucuuuu

SEQ ID NO: 2788484 - RNA, 19 nt, Human
auuaaaaagauucuuuuuc

SEQ ID NO: 2788485 - RNA, 22 nt, Human
auuaaaaagauucuuuuucuga

SEQ ID NO: 2788486 - RNA, 18 nt, Human
auguuuuccagcuccuca

SEQ ID NO: 2788487 - RNA, 19 nt, Human
auguuuuccagcuccucau

SEQ ID NO: 2788488 - RNA, 16 nt, Human
auguuuucuuugcaaa

SEQ ID NO: 2788489 - RNA, 17 nt, Human
auguuuucuuugcaaag

SEQ ID NO: 2788490 - RNA, 18 nt, Human
auguuuucuuugcaaagu

SEQ ID NO: 2788491 - RNA, 21 nt, Human
auguuuucuuugcaaaguauu

SEQ ID NO: 2788492 - RNA, 19 nt, Human
auuaaaggcauaaaugacu

SEQ ID NO: 2788493 - RNA, 16 nt, Human
auuaaagccuuuagua

SEQ ID NO: 2788494 - RNA, 14 nt, Human
auuaaagucugaau

SEQ ID NO: 2788495 - RNA, 16 nt, Human
auuaaagucugaauca

SEQ ID NO: 2788496 - RNA, 15 nt, Human
auuaaccgaugcuuu

SEQ ID NO: 2788497 - RNA, 16 nt, Human
auuaaccgaugcuuua

SEQ ID NO: 2788498 - RNA, 17 nt, Human
auuaaccgaugcuuuac

SEQ ID NO: 2788499 - RNA, 21 nt, Human
auuaaccgaugcuuuaccaaa

SEQ ID NO: 2788500 - RNA, 22 nt, Human
auuaacugaguagcucuccuga

SEQ ID NO: 2788501 - RNA, 14 nt, Human
auuaacuacauuua

SEQ ID NO: 2788502 - RNA, 17 nt, Human
auuaacuacauuuauga

SEQ ID NO: 2788503 - RNA, 21 nt, Human
auuaacuacauuuaugaguaa

SEQ ID NO: 2788504 - RNA, 12 nt, Human
auuaacuuauuu

SEQ ID NO: 2788505 - RNA, 14 nt, Human
auuaacuuauuuag

SEQ ID NO: 2788506 - RNA, 15 nt, Human
auuaacuuauuuaga

SEQ ID NO: 2788507 - RNA, 17 nt, Human
auuaacuuauuuagaga

SEQ ID NO: 2788508 - RNA, 18 nt, Human
auuaacuuauuuagagau

SEQ ID NO: 2788509 - RNA, 22 nt, Human
auuaagaaggcaaaaauguaaa

SEQ ID NO: 2788510 - RNA, 20 nt, Human
auuaagaauauguuuccuug

SEQ ID NO: 2788511 - RNA, 21 nt, Human
auuaagaauauguuuccuugu

SEQ ID NO: 2788512 - RNA, 19 nt, Human
auuaagaaggcaaaaaugu

SEQ ID NO: 2788513 - RNA, 15 nt, Human
auuaagaaggcaaaa

SEQ ID NO: 2788514 - RNA, 19 nt, Human
auguugaauacuuuuuaca

SEQ ID NO: 2788515 - RNA, 15 nt, Human
auguugaauacuuuu

SEQ ID NO: 2788516 - RNA, 14 nt, Human
auguugaauacuuu

SEQ ID NO: 2788517 - RNA, 11 nt, Human
auguucauuua

SEQ ID NO: 2788518 - RNA, 18 nt, Human
auguucauuuguuuguuu

SEQ ID NO: 2788519 - RNA, 15 nt, Human
auguugaagccuuug

SEQ ID NO: 2788520 - RNA, 16 nt, Human
auguugaagccuuugu

SEQ ID NO: 2788521 - RNA, 13 nt, Human
auguuauauauuu

SEQ ID NO: 2788522 - RNA, 17 nt, Human
auguuauauauuuuuug

SEQ ID NO: 2788523 - RNA, 16 nt, Human
auguuauaucauaugu

SEQ ID NO: 2788524 - RNA, 18 nt, Human
auguuauaucauauguau

SEQ ID NO: 2788525 - RNA, 19 nt, Human
auguuauaucauauguaua

SEQ ID NO: 2788526 - RNA, 13 nt, Human
auguuauauuuaa

SEQ ID NO: 2788527 - RNA, 22 nt, Human
auguuauauuuaaugcauuaaa

SEQ ID NO: 2788528 - RNA, 15 nt, Human
auguuaucuucucaa

SEQ ID NO: 2788529 - RNA, 16 nt, Human
auguuaucuucucaag

SEQ ID NO: 2788530 - RNA, 21 nt, Human
auguuaucuuauacuguacaa

SEQ ID NO: 2788531 - RNA, 16 nt, Human
auguucaucaauuccc

SEQ ID NO: 2788532 - RNA, 15 nt, Human
auguuaguuucuugg

SEQ ID NO: 2788533 - RNA, 15 nt, Human
auguuagucauuguu

SEQ ID NO: 2788534 - RNA, 16 nt, Human
auguuagucauuguua

SEQ ID NO: 2788535 - RNA, 22 nt, Human
auguuagucauuguuauuuaua

SEQ ID NO: 2788536 - RNA, 18 nt, Human
auguuaguguuuuaagaa

SEQ ID NO: 2788537 - RNA, 22 nt, Human
auguuaguguuuuaagaaaugu

SEQ ID NO: 2788538 - RNA, 19 nt, Human
uuuuaaguauuuauauauu

SEQ ID NO: 2788539 - RNA, 21 nt, Human
uuuuaagugaaagugaggaaa

SEQ ID NO: 2788540 - RNA, 15 nt, Human
uuuuaagugguuuga

SEQ ID NO: 2788541 - RNA, 15 nt, Human
uuuuaaguuaauaga

SEQ ID NO: 2788542 - RNA, 18 nt, Human
uuuuaaguuaauagauuu

SEQ ID NO: 2788543 - RNA, 23 nt, Human
uuuuaaguuaauagauuuuuuca

SEQ ID NO: 2788544 - RNA, 21 nt, Human
auguugauuuuuacuguguuu

SEQ ID NO: 2788545 - RNA, 17 nt, Human
uuuuagaugguuucuug

SEQ ID NO: 2788546 - RNA, 20 nt, Human
uuuuagaugagauuguuuua

SEQ ID NO: 2788547 - RNA, 22 nt, Human
uuuuagauuuucugguucuaac

SEQ ID NO: 2788548 - RNA, 19 nt, Human
uuuuagaugagauuguuuu

SEQ ID NO: 2788549 - RNA, 21 nt, Human
uuuuagcaauuuauacaauau

SEQ ID NO: 2788550 - RNA, 14 nt, Human
auguuggccaggcu

SEQ ID NO: 2788551 - RNA, 13 nt, Human
auguuggccaggc

SEQ ID NO: 2788552 - RNA, 16 nt, Human
auguuggccaggcugg

SEQ ID NO: 2788553 - RNA, 16 nt, Human
auguuggccaggcugc

SEQ ID NO: 2788554 - RNA, 22 nt, Human
auguugcacacccacucagcuc

SEQ ID NO: 2788555 - RNA, 21 nt, Human
auguugcacacccacucagcu

SEQ ID NO: 2788556 - RNA, 23 nt, Human
auguugauuuuuacuguguuuua

SEQ ID NO: 2788557 - RNA, 20 nt, Human
auguugauuuuuacuguguu

SEQ ID NO: 2788558 - RNA, 17 nt, Human
auguugauuuuuacugu

SEQ ID NO: 2788559 - RNA, 16 nt, Human
auguugauuuuuacug

SEQ ID NO: 2788560 - RNA, 20 nt, Human
auguugauccauccagcuug

SEQ ID NO: 2788561 - RNA, 23 nt, Human
auguugauccauccagcuugcca

SEQ ID NO: 2788562 - RNA, 24 nt, Human
auguugauccauccagcuugccag

SEQ ID NO: 2788563 - RNA, 16 nt, Human
auguugaccaugucua

SEQ ID NO: 2788564 - RNA, 19 nt, Human
auguugaccaugucuauga

SEQ ID NO: 2788565 - RNA, 22 nt, Human
auguugagaaucccaaauuuga

SEQ ID NO: 2788566 - RNA, 16 nt, Human
auguugagaaucccaa

SEQ ID NO: 2788567 - RNA, 14 nt, Human
auguugaauucuuu

SEQ ID NO: 2788568 - RNA, 19 nt, Human
auguugacauaccuuuuau

SEQ ID NO: 2788569 - RNA, 19 nt, Human
uuuuauguaguaauugaca

SEQ ID NO: 2788570 - RNA, 13 nt, Human
uuuuaugcucuuu

SEQ ID NO: 2788571 - RNA, 19 nt, Human
uuuuaugcucuuuuuuacu

SEQ ID NO: 2788572 - RNA, 22 nt, Human
uuuuaugcucuuuuuuacucau

SEQ ID NO: 2788573 - RNA, 24 nt, Human
uuuuaugcucuuuuuuacucauug

SEQ ID NO: 2788574 - RNA, 19 nt, Human
uuuuauggagaccucuccu

SEQ ID NO: 2788575 - RNA, 14 nt, Human
uuuuauaagcaaau

SEQ ID NO: 2788576 - RNA, 20 nt, Human
uuuuauaaauauaagccuuu

SEQ ID NO: 2788577 - RNA, 20 nt, Human
uuuuauaacuaguccuuuac

SEQ ID NO: 2788578 - RNA, 12 nt, Human
uuuuauaaagug

SEQ ID NO: 2788579 - RNA, 13 nt, Human
uuuuauaaagugc

SEQ ID NO: 2788580 - RNA, 19 nt, Human
uuuuauaaagugcuugugu

SEQ ID NO: 2788581 - RNA, 18 nt, Human
uuuuauaaauaaacuguu

SEQ ID NO: 2788582 - RNA, 17 nt, Human
uuuuauaaaauuuugcu

SEQ ID NO: 2788583 - RNA, 16 nt, Human
uuuuauaaaaauaaau

SEQ ID NO: 2788584 - RNA, 12 nt, Human
uuuuauuauugu

SEQ ID NO: 2788585 - RNA, 13 nt, Human
uuuuauuauugug

SEQ ID NO: 2788586 - RNA, 14 nt, Human
uuuuauuauugugg

SEQ ID NO: 2788587 - RNA, 15 nt, Human
uuuuauuauuguggu

SEQ ID NO: 2788588 - RNA, 22 nt, Human
uuuuauuauugugguaggccuu

SEQ ID NO: 2788589 - RNA, 15 nt, Human
uuuuauuauuucuau

SEQ ID NO: 2788590 - RNA, 17 nt, Human
uuuuauuauuucuauua

SEQ ID NO: 2788591 - RNA, 14 nt, Human
uuuuauucaaguua

SEQ ID NO: 2788592 - RNA, 18 nt, Human
uuuucauggugaaaaugu

SEQ ID NO: 2788593 - RNA, 19 nt, Human
uuuuauaaguucacaaaau

SEQ ID NO: 2788594 - RNA, 15 nt, Human
uuuuccagucucuug

SEQ ID NO: 2788595 - RNA, 18 nt, Human
uuuuccagucucuuguac

SEQ ID NO: 2788596 - RNA, 20 nt, Human
uuuuccagggcaaucaaugu

SEQ ID NO: 2788597 - RNA, 16 nt, Human
uuuucauuacaaugga

SEQ ID NO: 2788598 - RNA, 19 nt, Human
uuuucauuacaauggaaac

SEQ ID NO: 2788599 - RNA, 21 nt, Human
uuuucauggugaaaauguacu

SEQ ID NO: 2788600 - RNA, 14 nt, Human
uuuucauucucauu

SEQ ID NO: 2788601 - RNA, 15 nt, Human
auuaucaauaucuaa

SEQ ID NO: 2788602 - RNA, 17 nt, Human
auuaucaauaucuaaua

SEQ ID NO: 2788603 - RNA, 19 nt, Human
auuaucaauaucuaauaua

SEQ ID NO: 2788604 - RNA, 12 nt, Human
auuaucccugaa

SEQ ID NO: 2788605 - RNA, 16 nt, Human
auuauccuagauuaua

SEQ ID NO: 2788606 - RNA, 21 nt, Human
auuauccuagauuauaucaaa

SEQ ID NO: 2788607 - RNA, 17 nt, Human
auuauccuauuucagua

SEQ ID NO: 2788608 - RNA, 21 nt, Human
auuauccugaacucuucugca

SEQ ID NO: 2788609 - RNA, 17 nt, Human
auuauccauauugaguc

SEQ ID NO: 2788610 - RNA, 14 nt, Human
auuauccauauuga

SEQ ID NO: 2788611 - RNA, 20 nt, Human
auuauguuuuuuaaaauauu

SEQ ID NO: 2788612 - RNA, 16 nt, Human
auuauguuuuuauuaa

SEQ ID NO: 2788613 - RNA, 18 nt, Human
auuauguuuuuauuaaga

SEQ ID NO: 2788614 - RNA, 23 nt, Human
auuauguuuuuauuaagauuauu

SEQ ID NO: 2788615 - RNA, 16 nt, Human
auuauguuuuuuaaaa

SEQ ID NO: 2788616 - RNA, 14 nt, Human
auuauuaacuacau

SEQ ID NO: 2788617 - RNA, 15 nt, Human
auuauuaacuacauu

SEQ ID NO: 2788618 - RNA, 18 nt, Human
auuauuaacuacauuuau

SEQ ID NO: 2788619 - RNA, 19 nt, Human
auuauuaacuacauuuaug

SEQ ID NO: 2788620 - RNA, 20 nt, Human
auuauuaacuacauuuauga

SEQ ID NO: 2788621 - RNA, 22 nt, Human
auuaucuauagcuaaguacaca

SEQ ID NO: 2788622 - RNA, 19 nt, Human
auuaucuauagcuaaguac

SEQ ID NO: 2788623 - RNA, 20 nt, Human
auuauguuguuagagaaaaa

SEQ ID NO: 2788624 - RNA, 22 nt, Human
auuaucuugggauaguucccaa

SEQ ID NO: 2788625 - RNA, 17 nt, Human
auuaucucacuugugcc

SEQ ID NO: 2788626 - RNA, 19 nt, Human
auuaucuauuugugugugu

SEQ ID NO: 2788627 - RNA, 13 nt, Human
auuauuuuaaaca

SEQ ID NO: 2788628 - RNA, 14 nt, Human
auuauuuuaaacaa

SEQ ID NO: 2788629 - RNA, 22 nt, Human
auuauuuauauggggaauauau

SEQ ID NO: 2788630 - RNA, 17 nt, Human
auuauuuguguaauaga

SEQ ID NO: 2788631 - RNA, 18 nt, Human
auuauuuguguaauagaa

SEQ ID NO: 2788632 - RNA, 12 nt, Human
auuauuuguguu

SEQ ID NO: 2788633 - RNA, 20 nt, Human
auuauuuguguaauagaaaa

SEQ ID NO: 2788634 - RNA, 23 nt, Human
auuauuuguguaauagaaaacug

SEQ ID NO: 2788635 - RNA, 15 nt, Human
auuauuuguguuuua

SEQ ID NO: 2788636 - RNA, 22 nt, Human
auuauuuguguuuuaauuuaaa

SEQ ID NO: 2788637 - RNA, 13 nt, Human
auuauucauuuag

SEQ ID NO: 2788638 - RNA, 15 nt, Human
auuauucauuuagug

SEQ ID NO: 2788639 - RNA, 12 nt, Human
auuauucauuua

SEQ ID NO: 2788640 - RNA, 12 nt, Human
auuauugaaauu

SEQ ID NO: 2788641 - RNA, 21 nt, Human
auuauugaaggaagccaaauu

SEQ ID NO: 2788642 - RNA, 12 nt, Human
auuauucucuuu

SEQ ID NO: 2788643 - RNA, 14 nt, Human
auuauucucuuuua

SEQ ID NO: 2788644 - RNA, 18 nt, Human
auuauucucuuuuaucug

SEQ ID NO: 2788645 - RNA, 21 nt, Human
auuauucucuuuuaucuguuu

SEQ ID NO: 2788646 - RNA, 12 nt, Human
auuauucuugua

SEQ ID NO: 2788647 - RNA, 13 nt, Human
auuauucuuguag

SEQ ID NO: 2788648 - RNA, 13 nt, Human
auuauuuauaugg

SEQ ID NO: 2788649 - RNA, 12 nt, Human
auuauuuauaau

SEQ ID NO: 2788650 - RNA, 21 nt, Human
auuauuuaauaacauuaccuu

SEQ ID NO: 2788651 - RNA, 22 nt, Human
auuauuuaauaacauuaccuua

SEQ ID NO: 2788652 - RNA, 21 nt, Human
auuauuuaauaaaaaaacaau

SEQ ID NO: 2788653 - RNA, 15 nt, Human
auuauugauaguacu

SEQ ID NO: 2788654 - RNA, 17 nt, Human
auuauugauaguacucu

SEQ ID NO: 2788655 - RNA, 13 nt, Human
auuauugauauau

SEQ ID NO: 2788656 - RNA, 15 nt, Human
auuauugauauauau

SEQ ID NO: 2788657 - RNA, 13 nt, Human
auuauuuaauaac

SEQ ID NO: 2788658 - RNA, 14 nt, Human
auuauuuaauaaca

SEQ ID NO: 2788659 - RNA, 15 nt, Human
auuauuuaauaacau

SEQ ID NO: 2788660 - RNA, 18 nt, Human
auuauuuaauaacauuac

SEQ ID NO: 2788661 - RNA, 19 nt, Human
auuauagguaaucaaugaa

SEQ ID NO: 2788662 - RNA, 21 nt, Human
auuauagguaaucaaugaaua

SEQ ID NO: 2788663 - RNA, 17 nt, Human
auuauaggaucauuugu

SEQ ID NO: 2788664 - RNA, 17 nt, Human
auuauaggagccuuaau

SEQ ID NO: 2788665 - RNA, 19 nt, Human
auuauaggagccuuaauuu

SEQ ID NO: 2788666 - RNA, 19 nt, Human
auuauagauucuaaagauu

SEQ ID NO: 2788667 - RNA, 13 nt, Human
auuauaaugaauu

SEQ ID NO: 2788668 - RNA, 21 nt, Human
auuagaauuagugccagaauu

SEQ ID NO: 2788669 - RNA, 13 nt, Human
auuauagauucua

SEQ ID NO: 2788670 - RNA, 14 nt, Human
auuauagauucuaa

SEQ ID NO: 2788671 - RNA, 15 nt, Human
auuauagauucuaaa

SEQ ID NO: 2788672 - RNA, 16 nt, Human
auuauagauucuaaag

SEQ ID NO: 2788673 - RNA, 17 nt, Human
auuauagauucuaaaga

SEQ ID NO: 2788674 - RNA, 18 nt, Human
auuauagauucuaaagau

SEQ ID NO: 2788675 - RNA, 13 nt, Human
auuagaauuauuu

SEQ ID NO: 2788676 - RNA, 13 nt, Human
auuagagcaggcg

SEQ ID NO: 2788677 - RNA, 14 nt, Human
auuagagcauugaa

SEQ ID NO: 2788678 - RNA, 15 nt, Human
auuauaagucacaaa

SEQ ID NO: 2788679 - RNA, 12 nt, Human
auuauaagcauu

SEQ ID NO: 2788680 - RNA, 17 nt, Human
auuauaagcauugaaau

SEQ ID NO: 2788681 - RNA, 18 nt, Human
auuauaagcauugaaauu

SEQ ID NO: 2788682 - RNA, 17 nt, Human
auuacuggcguggauua

SEQ ID NO: 2788683 - RNA, 18 nt, Human
auuacuggcguggauuaa

SEQ ID NO: 2788684 - RNA, 21 nt, Human
auuacuggcguggauuaaacu

SEQ ID NO: 2788685 - RNA, 22 nt, Human
auuacuggcguggauuaaacuu

SEQ ID NO: 2788686 - RNA, 23 nt, Human
auuacuggcguggauuaaacuua

SEQ ID NO: 2788687 - RNA, 12 nt, Human
auuacugggccu

SEQ ID NO: 2788688 - RNA, 13 nt, Human
auuacugggccuu

SEQ ID NO: 2788689 - RNA, 14 nt, Human
auuacugggccuua

SEQ ID NO: 2788690 - RNA, 15 nt, Human
auuacugggccuuag

SEQ ID NO: 2788691 - RNA, 11 nt, Human
auuacuuuauc

SEQ ID NO: 2788692 - RNA, 14 nt, Human
auuacuuuaucacu

SEQ ID NO: 2788693 - RNA, 15 nt, Human
auuacuuuaucacuu

SEQ ID NO: 2788694 - RNA, 16 nt, Human
auuacuuuaucacuuu

SEQ ID NO: 2788695 - RNA, 23 nt, Human
auuacuuuaucacuuuuugaacu

SEQ ID NO: 2788696 - RNA, 14 nt, Human
auuacuuuuuucca

SEQ ID NO: 2788697 - RNA, 15 nt, Human
auuacuuuuuuccaa

SEQ ID NO: 2788698 - RNA, 16 nt, Human
auuagaaaaaaauuac

SEQ ID NO: 2788699 - RNA, 22 nt, Human
auuagaaaaaaauuacuaauuu

SEQ ID NO: 2788700 - RNA, 21 nt, Human
auuagaaaaauagcaacuugu

SEQ ID NO: 2788701 - RNA, 17 nt, Human
auuagaaaaauuccuaa

SEQ ID NO: 2788702 - RNA, 10 nt, Human
auuagaacuu

SEQ ID NO: 2788703 - RNA, 11 nt, Human
auuagaacuuc

SEQ ID NO: 2788704 - RNA, 15 nt, Human
auuagaaauuagaaa

SEQ ID NO: 2788705 - RNA, 17 nt, Human
auuagaaauuggcugga

SEQ ID NO: 2788706 - RNA, 20 nt, Human
auuaauauauguauuauuua

SEQ ID NO: 2788707 - RNA, 23 nt, Human
auuaauagcuuuuauuguauaaa

SEQ ID NO: 2788708 - RNA, 16 nt, Human
auuaauauauguauua

SEQ ID NO: 2788709 - RNA, 18 nt, Human
auuaauagcuuuuauugu

SEQ ID NO: 2788710 - RNA, 19 nt, Human
auuaauagcuuuuauugua

SEQ ID NO: 2788711 - RNA, 13 nt, Human
auuaauagcuuuu

SEQ ID NO: 2788712 - RNA, 15 nt, Human
auuaaucuuggauag

SEQ ID NO: 2788713 - RNA, 21 nt, Human
auuaaucuuggauagcuaaua

SEQ ID NO: 2788714 - RNA, 21 nt, Human
auuaauauauguauuauuuau

SEQ ID NO: 2788715 - RNA, 18 nt, Human
auuaauauuaauuuucua

SEQ ID NO: 2788716 - RNA, 22 nt, Human
auuaauauauguauuauuuaua

SEQ ID NO: 2788717 - RNA, 15 nt, Human
auuaaguaaucaaua

SEQ ID NO: 2788718 - RNA, 18 nt, Human
auuaaguaaucaauaaag

SEQ ID NO: 2788719 - RNA, 18 nt, Human
uuuuuuaaaaaaagaaaa

SEQ ID NO: 2788720 - RNA, 17 nt, Human
uuuuuguuuuacaaugu

SEQ ID NO: 2788721 - RNA, 15 nt, Human
uuuuuguuuguuucu

SEQ ID NO: 2788722 - RNA, 20 nt, Human
uuuuuguuucugagaaaaga

SEQ ID NO: 2788723 - RNA, 13 nt, Human
uuuuuguuugaug

SEQ ID NO: 2788724 - RNA, 21 nt, Human
auuaacaugcuuaugacaaug

SEQ ID NO: 2788725 - RNA, 13 nt, Human
auuaagaauguug

SEQ ID NO: 2788726 - RNA, 21 nt, Human
auuaagaauguugguuuacuu

SEQ ID NO: 2788727 - RNA, 23 nt, Human
auuaagaauguugguuuacuuuc

SEQ ID NO: 2788728 - RNA, 17 nt, Human
auuaagaggcagaaaau

SEQ ID NO: 2788729 - RNA, 14 nt, Human
auuaagauacaaau

SEQ ID NO: 2788730 - RNA, 15 nt, Human
auuaagauacaaauu

SEQ ID NO: 2788731 - RNA, 16 nt, Human
auuaagauacaaauua

SEQ ID NO: 2788732 - RNA, 17 nt, Human
auuaagauacaaauuaa

SEQ ID NO: 2788733 - RNA, 14 nt, Human
auuaccuaaugaaa

SEQ ID NO: 2788734 - RNA, 15 nt, Human
auuaccuaaugaaag

SEQ ID NO: 2788735 - RNA, 18 nt, Human
auuaccagcaagaauaaa

SEQ ID NO: 2788736 - RNA, 15 nt, Human
auuacucuuaaggaa

SEQ ID NO: 2788737 - RNA, 12 nt, Human
auuaccuucucc

SEQ ID NO: 2788738 - RNA, 21 nt, Human
auuaccuuuuaccagcuuuua

SEQ ID NO: 2788739 - RNA, 13 nt, Human
auuaccuuacugu

SEQ ID NO: 2788740 - RNA, 14 nt, Human
auucagccuguuug

SEQ ID NO: 2788741 - RNA, 14 nt, Human
auuauuuuauuaug

SEQ ID NO: 2788742 - RNA, 15 nt, Human
auuauuuuaaacaaa

SEQ ID NO: 2788743 - RNA, 21 nt, Human
auuauuuuaaacaaaauagaa

SEQ ID NO: 2788744 - RNA, 14 nt, Human
auuauuuucauuac

SEQ ID NO: 2788745 - RNA, 17 nt, Human
auuauuuucauuacaau

SEQ ID NO: 2788746 - RNA, 19 nt, Human
auuauuuucauuacaaugg

SEQ ID NO: 2788747 - RNA, 21 nt, Human
auuauuuucauuacaauggaa

SEQ ID NO: 2788748 - RNA, 21 nt, Human
auucaaaaguuccaagagucu

SEQ ID NO: 2788749 - RNA, 14 nt, Human
auuauuuucuguca

SEQ ID NO: 2788750 - RNA, 15 nt, Human
auuauuuucugucag

SEQ ID NO: 2788751 - RNA, 16 nt, Human
auuauuuucugucaga

SEQ ID NO: 2788752 - RNA, 22 nt, Human
auuauuuucugucagaugagaa

SEQ ID NO: 2788753 - RNA, 14 nt, Human
auuauuuucuucau

SEQ ID NO: 2788754 - RNA, 17 nt, Human
auucaaaaguuccaaga

SEQ ID NO: 2788755 - RNA, 16 nt, Human
auucaaaaugauguau

SEQ ID NO: 2788756 - RNA, 12 nt, Human
auucaaaauauu

SEQ ID NO: 2788757 - RNA, 14 nt, Human
auucaaaauauuua

SEQ ID NO: 2788758 - RNA, 15 nt, Human
auucaaaauauuuaa

SEQ ID NO: 2788759 - RNA, 16 nt, Human
auucaaaauauuuaaa

SEQ ID NO: 2788760 - RNA, 22 nt, Human
auucaaaauauuuaaaaauguc

SEQ ID NO: 2788761 - RNA, 21 nt, Human
auucaggaauguguggccugc

SEQ ID NO: 2788762 - RNA, 17 nt, Human
auucagcugagguucau

SEQ ID NO: 2788763 - RNA, 21 nt, Human
auucagcugagguucauuaca

SEQ ID NO: 2788764 - RNA, 15 nt, Human
auucauaaaaacugc

SEQ ID NO: 2788765 - RNA, 16 nt, Human
auucauaaaaacugcu

SEQ ID NO: 2788766 - RNA, 14 nt, Human
auucaguuuucauu

SEQ ID NO: 2788767 - RNA, 13 nt, Human
auuccacagcugc

SEQ ID NO: 2788768 - RNA, 15 nt, Human
auucaguuuucauuu

SEQ ID NO: 2788769 - RNA, 13 nt, Human
auucaguuuucau

SEQ ID NO: 2788770 - RNA, 12 nt, Human
auuccacuggac

SEQ ID NO: 2788771 - RNA, 19 nt, Human
auuccagaagaagagaagc

SEQ ID NO: 2788772 - RNA, 21 nt, Human
auuccagaagaagagaagcug

SEQ ID NO: 2788773 - RNA, 22 nt, Human
auuccagaagaagagaagcugc

SEQ ID NO: 2788774 - RNA, 23 nt, Human
auuccagaagaagagaagcugcu

SEQ ID NO: 2788775 - RNA, 16 nt, Human
auuccauucuggauuu

SEQ ID NO: 2788776 - RNA, 19 nt, Human
auuccauugccuagcucuu

SEQ ID NO: 2788777 - RNA, 20 nt, Human
auuccauugccuagcucuuu

SEQ ID NO: 2788778 - RNA, 16 nt, Human
auuccauugguccaag

SEQ ID NO: 2788779 - RNA, 17 nt, Human
auuccauugguccaaga

SEQ ID NO: 2788780 - RNA, 23 nt, Human
auuccauugguccaagauuccgg

SEQ ID NO: 2788781 - RNA, 23 nt, Human
auuccauguuuggaagacccuug

SEQ ID NO: 2788782 - RNA, 12 nt, Human
auuccaugcuaa

SEQ ID NO: 2788783 - RNA, 17 nt, Human
auuccaugcuaagcaag

SEQ ID NO: 2788784 - RNA, 22 nt, Human
auuccaugcuaagcaagcuaac

SEQ ID NO: 2788785 - RNA, 18 nt, Human
auuccguugucuguggau

SEQ ID NO: 2788786 - RNA, 19 nt, Human
auuccguugucuguggaug

SEQ ID NO: 2788787 - RNA, 13 nt, Human
auuccggauccua

SEQ ID NO: 2788788 - RNA, 15 nt, Human
auuccggauccuaag

SEQ ID NO: 2788789 - RNA, 16 nt, Human
auuccggauccuaagc

SEQ ID NO: 2788790 - RNA, 19 nt, Human
auuccggauccuaagcauc

SEQ ID NO: 2788791 - RNA, 21 nt, Human
auuccauuugaggauuuagaa

SEQ ID NO: 2788792 - RNA, 17 nt, Human
auucccaacuagacauu

SEQ ID NO: 2788793 - RNA, 21 nt, Human
auucccaacuagacauuacca

SEQ ID NO: 2788794 - RNA, 22 nt, Human
auucccaacugaguguuauuug

SEQ ID NO: 2788795 - RNA, 20 nt, Human
auuccccagauugcaacagg

SEQ ID NO: 2788796 - RNA, 18 nt, Human
auuuaccagggauguaga

SEQ ID NO: 2788797 - RNA, 19 nt, Human
auuuaccagggauguagau

SEQ ID NO: 2788798 - RNA, 23 nt, Human
auuuaauuuuuuugagacagagu

SEQ ID NO: 2788799 - RNA, 19 nt, Human
auuuaauuuuuuugagaca

SEQ ID NO: 2788800 - RNA, 13 nt, Human
auuuaacuggcuu

SEQ ID NO: 2788801 - RNA, 18 nt, Human
auuuaacuggugcacuuu

SEQ ID NO: 2788802 - RNA, 21 nt, Human
auuuaacuggugcacuuugua

SEQ ID NO: 2788803 - RNA, 22 nt, Human
auuuaacuggugcacuuuguaa

SEQ ID NO: 2788804 - RNA, 23 nt, Human
auuuaacuggugcacuuuguaaa

SEQ ID NO: 2788805 - RNA, 13 nt, Human
auuuaacugaaga

SEQ ID NO: 2788806 - RNA, 18 nt, Human
auuuaacuacccuuaauu

SEQ ID NO: 2788807 - RNA, 19 nt, Human
auuuaacuacccuuaauua

SEQ ID NO: 2788808 - RNA, 21 nt, Human
auuuaacuacccuuaauuacu

SEQ ID NO: 2788809 - RNA, 22 nt, Human
auuuaacuacccuuaauuacuu

SEQ ID NO: 2788810 - RNA, 23 nt, Human
auuuaacuacccuuaauuacuua

SEQ ID NO: 2788811 - RNA, 15 nt, Human
auuuaacauuauuua

SEQ ID NO: 2788812 - RNA, 16 nt, Human
auuuaacauuauuuau

SEQ ID NO: 2788813 - RNA, 13 nt, Human
auuuaacaugcaa

SEQ ID NO: 2788814 - RNA, 22 nt, Human
auuuaacaugcaacccgaaggu

SEQ ID NO: 2788815 - RNA, 17 nt, Human
auuuaacauuauuuaua

SEQ ID NO: 2788816 - RNA, 20 nt, Human
auuuaacauuauuuauaugg

SEQ ID NO: 2788817 - RNA, 19 nt, Human
auuuaacccauuugucucu

SEQ ID NO: 2788818 - RNA, 17 nt, Human
auuuaacagggagggga

SEQ ID NO: 2788819 - RNA, 15 nt, Human
auuuaaagccuccuc

SEQ ID NO: 2788820 - RNA, 12 nt, Human
auuuaaagcauu

SEQ ID NO: 2788821 - RNA, 18 nt, Human
auuuaaagcauugcuguu

SEQ ID NO: 2788822 - RNA, 21 nt, Human
auuuaaagcauugcuguuaug

SEQ ID NO: 2788823 - RNA, 16 nt, Human
auuuaaagcauugcuu

SEQ ID NO: 2788824 - RNA, 14 nt, Human
auuuaaacagcagu

SEQ ID NO: 2788825 - RNA, 15 nt, Human
auuuaaacagcagug

SEQ ID NO: 2788826 - RNA, 16 nt, Human
auuuaaacagcagugu

SEQ ID NO: 2788827 - RNA, 20 nt, Human
auuuaaacagcaguguuccc

SEQ ID NO: 2788828 - RNA, 13 nt, Human
auuuaaaacaugu

SEQ ID NO: 2788829 - RNA, 14 nt, Human
auuuaaaacaugua

SEQ ID NO: 2788830 - RNA, 15 nt, Human
auuuaaaacauguaa

SEQ ID NO: 2788831 - RNA, 19 nt, Human
auuuaaacaauaaaugugc

SEQ ID NO: 2788832 - RNA, 13 nt, Human
auuuaaacacaca

SEQ ID NO: 2788833 - RNA, 14 nt, Human
auuuaaacacacag

SEQ ID NO: 2788834 - RNA, 15 nt, Human
auuuaaacacacaga

SEQ ID NO: 2788835 - RNA, 18 nt, Human
auugucuuuugucaugug

SEQ ID NO: 2788836 - RNA, 20 nt, Human
auugucuuuugucauguggc

SEQ ID NO: 2788837 - RNA, 18 nt, Human
auugucucguuugugauu

SEQ ID NO: 2788838 - RNA, 19 nt, Human
auugucucguuugugauuc

SEQ ID NO: 2788839 - RNA, 19 nt, Human
auugugccaauauguauug

SEQ ID NO: 2788840 - RNA, 16 nt, Human
auugugaacauuugug

SEQ ID NO: 2788841 - RNA, 18 nt, Human
auugugaacauuugugau

SEQ ID NO: 2788842 - RNA, 20 nt, Human
auugugcuucacaguagagc

SEQ ID NO: 2788843 - RNA, 15 nt, Human
auugugcuucacagu

SEQ ID NO: 2788844 - RNA, 11 nt, Human
auugugcugcc

SEQ ID NO: 2788845 - RNA, 12 nt, Human
auugugcugcca

SEQ ID NO: 2788846 - RNA, 13 nt, Human
auugugcugccau

SEQ ID NO: 2788847 - RNA, 15 nt, Human
auugugcugccauuu

SEQ ID NO: 2788848 - RNA, 24 nt, Human
auugugcuucacaguagagccagc

SEQ ID NO: 2788849 - RNA, 12 nt, Human
auugugcuucuc

SEQ ID NO: 2788850 - RNA, 14 nt, Human
auugugcuucuccc

SEQ ID NO: 2788851 - RNA, 17 nt, Human
auugugcuucuccccag

SEQ ID NO: 2788852 - RNA, 18 nt, Human
auugugcuucuccccaga

SEQ ID NO: 2788853 - RNA, 19 nt, Human
auugugcuucuccccagaa

SEQ ID NO: 2788854 - RNA, 20 nt, Human
auugugcuucuccccagaau

SEQ ID NO: 2788855 - RNA, 18 nt, Human
auuguggauaacaaagau

SEQ ID NO: 2788856 - RNA, 21 nt, Human
auuguggauaacaaagauauc

SEQ ID NO: 2788857 - RNA, 14 nt, Human
auugucuucaugua

SEQ ID NO: 2788858 - RNA, 17 nt, Human
auuguuuccucuuccaa

SEQ ID NO: 2788859 - RNA, 20 nt, Human
auuguuuccucuuccaaagu

SEQ ID NO: 2788860 - RNA, 15 nt, Human
auuguuucuauacaa

SEQ ID NO: 2788861 - RNA, 16 nt, Human
auuguuucuauacaaa

SEQ ID NO: 2788862 - RNA, 19 nt, Human
auuguuucuauacaaauau

SEQ ID NO: 2788863 - RNA, 17 nt, Human
auuguuucucaaaucuu

SEQ ID NO: 2788864 - RNA, 15 nt, Human
auuguuucugugggc

SEQ ID NO: 2788865 - RNA, 21 nt, Human
auuguuucuuuaucaccuggc

SEQ ID NO: 2788866 - RNA, 12 nt, Human
auuguuugcugc

SEQ ID NO: 2788867 - RNA, 15 nt, Human
auuguuugcugcuau

SEQ ID NO: 2788868 - RNA, 18 nt, Human
auuguuuggcuuccuccu

SEQ ID NO: 2788869 - RNA, 20 nt, Human
auuguuuggcuuccuccuga

SEQ ID NO: 2788870 - RNA, 21 nt, Human
auugcuaaucaccaaaggcuc

SEQ ID NO: 2788871 - RNA, 14 nt, Human
auugcuaauugcug

SEQ ID NO: 2788872 - RNA, 15 nt, Human
auugcuaauugcugu

SEQ ID NO: 2788873 - RNA, 16 nt, Human
auugcuaauugcuguu

SEQ ID NO: 2788874 - RNA, 19 nt, Human
auugcuaauugcuguugaa

SEQ ID NO: 2788875 - RNA, 20 nt, Human
auugcuaauugcuguugaaa

SEQ ID NO: 2788876 - RNA, 23 nt, Human
auugcuaauugcuguugaaagca

SEQ ID NO: 2788877 - RNA, 21 nt, Human
auugcuacuacuuaccuacca

SEQ ID NO: 2788878 - RNA, 13 nt, Human
auugcgcugcuac

SEQ ID NO: 2788879 - RNA, 20 nt, Human
auugcguuugaccuuuuaug

SEQ ID NO: 2788880 - RNA, 13 nt, Human
auugcguuggucu

SEQ ID NO: 2788881 - RNA, 17 nt, Human
auugcguuggucucugc

SEQ ID NO: 2788882 - RNA, 20 nt, Human
auugcguuggucucugcauu

SEQ ID NO: 2788883 - RNA, 21 nt, Human
auugcguuugaccuuuuaugu

SEQ ID NO: 2788884 - RNA, 16 nt, Human
auuggcuuuucaugcg

SEQ ID NO: 2788885 - RNA, 13 nt, Human
auuguauaaacua

SEQ ID NO: 2788886 - RNA, 17 nt, Human
auuguauaaacuaucag

SEQ ID NO: 2788887 - RNA, 21 nt, Human
auuguauaaacuaucaguuug

SEQ ID NO: 2788888 - RNA, 22 nt, Human
auuguauaaacuaucaguuugu

SEQ ID NO: 2788889 - RNA, 14 nt, Human
auuggcuuguagaa

SEQ ID NO: 2788890 - RNA, 15 nt, Human
auuggcuuguagaau

SEQ ID NO: 2788891 - RNA, 16 nt, Human
auuggcuuguagaauu

SEQ ID NO: 2788892 - RNA, 17 nt, Human
auuggcuuguagaauug

SEQ ID NO: 2788893 - RNA, 18 nt, Human
auuggcuuguagaauugu

SEQ ID NO: 2788894 - RNA, 19 nt, Human
auuggcuuguagaauuguu

SEQ ID NO: 2788895 - RNA, 22 nt, Human
auuggcuuguagaauuguuaua

SEQ ID NO: 2788896 - RNA, 22 nt, Human
auuggcugaacucaugagaagu

SEQ ID NO: 2788897 - RNA, 17 nt, Human
auuguauauuguguuug

SEQ ID NO: 2788898 - RNA, 13 nt, Human
auuguaugaugug

SEQ ID NO: 2788899 - RNA, 12 nt, Human
auuguaugaugu

SEQ ID NO: 2788900 - RNA, 21 nt, Human
auuguaugauguguugugaua

SEQ ID NO: 2788901 - RNA, 14 nt, Human
auuguaugaugugu

SEQ ID NO: 2788902 - RNA, 15 nt, Human
auuguaugauguguu

SEQ ID NO: 2788903 - RNA, 13 nt, Human
auugacagaagcu

SEQ ID NO: 2788904 - RNA, 18 nt, Human
auucuaaugucuucauuu

SEQ ID NO: 2788905 - RNA, 22 nt, Human
auucuagaucagaugcuccaag

SEQ ID NO: 2788906 - RNA, 23 nt, Human
auucuagaucagaugcuccaaga

SEQ ID NO: 2788907 - RNA, 23 nt, Human
auugaccgcgacuaauuucaaaa

SEQ ID NO: 2788908 - RNA, 20 nt, Human
auugaccgcgacuaauuuca

SEQ ID NO: 2788909 - RNA, 17 nt, Human
auugaccgcgacuaauu

SEQ ID NO: 2788910 - RNA, 15 nt, Human
auugcaacaggcugg

SEQ ID NO: 2788911 - RNA, 19 nt, Human
auugcaaaucuugaaauua

SEQ ID NO: 2788912 - RNA, 17 nt, Human
auugcaaaucuugaaau

SEQ ID NO: 2788913 - RNA, 16 nt, Human
auugcaaaucuugaaa

SEQ ID NO: 2788914 - RNA, 12 nt, Human
auugcaaaucuu

SEQ ID NO: 2788915 - RNA, 23 nt, Human
auugcaaagguuccaacuguaua

SEQ ID NO: 2788916 - RNA, 19 nt, Human
auugcaaaauagcauuugu

SEQ ID NO: 2788917 - RNA, 21 nt, Human
auugcaacaggcugggcuuca

SEQ ID NO: 2788918 - RNA, 13 nt, Human
auugcacaauauu

SEQ ID NO: 2788919 - RNA, 11 nt, Human
auugcacaaua

SEQ ID NO: 2788920 - RNA, 17 nt, Human
auugcaauaucugaagc

SEQ ID NO: 2788921 - RNA, 14 nt, Human
auugcaauaucuga

SEQ ID NO: 2788922 - RNA, 16 nt, Human
auugcaauaucugaag

SEQ ID NO: 2788923 - RNA, 16 nt, Human
auugcagguggaacuc

SEQ ID NO: 2788924 - RNA, 17 nt, Human
auugcagguggaacuca

SEQ ID NO: 2788925 - RNA, 19 nt, Human
auugcagucauagaagaga

SEQ ID NO: 2788926 - RNA, 14 nt, Human
auugcagcuuuaug

SEQ ID NO: 2788927 - RNA, 16 nt, Human
auugcagcuuuauguu

SEQ ID NO: 2788928 - RNA, 17 nt, Human
auugcagcuuuauguuc

SEQ ID NO: 2788929 - RNA, 20 nt, Human
auugcagcuuuauguucauu

SEQ ID NO: 2788930 - RNA, 20 nt, Human
auugcagauaacuuugacuu

SEQ ID NO: 2788931 - RNA, 22 nt, Human
auugcacaauauugaacuuuuu

SEQ ID NO: 2788932 - RNA, 16 nt, Human
auugcacagaaguccu

SEQ ID NO: 2788933 - RNA, 19 nt, Human
auugcggacagccacggcc

SEQ ID NO: 2788934 - RNA, 18 nt, Human
auugcggacagccacggc

SEQ ID NO: 2788935 - RNA, 16 nt, Human
auugcggacagccacg

SEQ ID NO: 2788936 - RNA, 21 nt, Human
auugcccacgcuggagugcag

SEQ ID NO: 2788937 - RNA, 17 nt, Human
auugcccacgcuggagu

SEQ ID NO: 2788938 - RNA, 14 nt, Human
auugcccaggcugg

SEQ ID NO: 2788939 - RNA, 15 nt, Human
auugcccaggcuggu

SEQ ID NO: 2788940 - RNA, 16 nt, Human
auugcccaggcugguc

SEQ ID NO: 2788941 - RNA, 20 nt, Human
auugcccaggcuggucuuga

SEQ ID NO: 2788942 - RNA, 15 nt, Human
auugcccagucuuuc

SEQ ID NO: 2788943 - RNA, 16 nt, Human
auugcccagucuuuca

SEQ ID NO: 2788944 - RNA, 21 nt, Human
auugccaccaggagaaccacu

SEQ ID NO: 2788945 - RNA, 22 nt, Human
auugccaagcucaggaccaggc

SEQ ID NO: 2788946 - RNA, 15 nt, Human
auugccaccaggaga

SEQ ID NO: 2788947 - RNA, 14 nt, Human
auugccaccaggag

SEQ ID NO: 2788948 - RNA, 16 nt, Human
auugcauuuccugaca

SEQ ID NO: 2788949 - RNA, 17 nt, Human
auugcauuuccugacag

SEQ ID NO: 2788950 - RNA, 15 nt, Human
auugccaaaaaggau

SEQ ID NO: 2788951 - RNA, 16 nt, Human
auugccaaaaaggaua

SEQ ID NO: 2788952 - RNA, 22 nt, Human
auuuguaucucugaagcauguu

SEQ ID NO: 2788953 - RNA, 23 nt, Human
auuuguaucucugaagcauguuu

SEQ ID NO: 2788954 - RNA, 12 nt, Human
auuuuaauuuau

SEQ ID NO: 2788955 - RNA, 22 nt, Human
auuuguaggaaggucucauucu

SEQ ID NO: 2788956 - RNA, 23 nt, Human
auuuguaggaaggucucauucuu

SEQ ID NO: 2788957 - RNA, 14 nt, Human
auuuguaggagaaa

SEQ ID NO: 2788958 - RNA, 19 nt, Human
auuuguaguggaaacauuu

SEQ ID NO: 2788959 - RNA, 22 nt, Human
auuuguaguggaaacauuuaua

SEQ ID NO: 2788960 - RNA, 22 nt, Human
auuuguauauuacacauuugua

SEQ ID NO: 2788961 - RNA, 19 nt, Human
auuuguaucucugaagcau

SEQ ID NO: 2788962 - RNA, 20 nt, Human
auuuguaucucugaagcaug

SEQ ID NO: 2788963 - RNA, 21 nt, Human
auuuguaucucugaagcaugu

SEQ ID NO: 2788964 - RNA, 22 nt, Human
auuuuacaaaagaggagcacuu

SEQ ID NO: 2788965 - RNA, 18 nt, Human
auuuuaauuuaugaguuu

SEQ ID NO: 2788966 - RNA, 22 nt, Human
auuuuacacagaaacacugccu

SEQ ID NO: 2788967 - RNA, 20 nt, Human
auuuuacacagaaacacugc

SEQ ID NO: 2788968 - RNA, 19 nt, Human
auuuuacacagaaacacug

SEQ ID NO: 2788969 - RNA, 18 nt, Human
auuuuacacagaaacacu

SEQ ID NO: 2788970 - RNA, 23 nt, Human
auuuuacacagaaacacugccuu

SEQ ID NO: 2788971 - RNA, 13 nt, Human
auuuuacacauua

SEQ ID NO: 2788972 - RNA, 19 nt, Human
auuuuacacauuagauuuu

SEQ ID NO: 2788973 - RNA, 17 nt, Human
auuuuacacagaaacac

SEQ ID NO: 2788974 - RNA, 15 nt, Human
auuuuacacagaaac

SEQ ID NO: 2788975 - RNA, 14 nt, Human
auuuuacacagaaa

SEQ ID NO: 2788976 - RNA, 22 nt, Human
auuuuacuccauaaacagacug

SEQ ID NO: 2788977 - RNA, 21 nt, Human
auuuuacuuuaaaaggagcca

SEQ ID NO: 2788978 - RNA, 15 nt, Human
auuuuauguuuagau

SEQ ID NO: 2788979 - RNA, 12 nt, Human
auuuuauuaugc

SEQ ID NO: 2788980 - RNA, 13 nt, Human
auuuuauuuccau

SEQ ID NO: 2788981 - RNA, 16 nt, Human
auuuuauuuccaucau

SEQ ID NO: 2788982 - RNA, 17 nt, Human
auuuuauuuguuuuuca

SEQ ID NO: 2788983 - RNA, 12 nt, Human
auuuuauuacug

SEQ ID NO: 2788984 - RNA, 14 nt, Human
auuuuauuacuggc

SEQ ID NO: 2788985 - RNA, 21 nt, Human
auuuuauuacuggcguggauu

SEQ ID NO: 2788986 - RNA, 16 nt, Human
auuuauuaguuaauau

SEQ ID NO: 2788987 - RNA, 23 nt, Human
auuuauuaugcuuuauuggaaaa

SEQ ID NO: 2788988 - RNA, 13 nt, Human
auuuauguuugca

SEQ ID NO: 2788989 - RNA, 14 nt, Human
auuuaguaaauguu

SEQ ID NO: 2788990 - RNA, 15 nt, Human
auuuaguaaauguua

SEQ ID NO: 2788991 - RNA, 19 nt, Human
auuuauuaaaaugauugua

SEQ ID NO: 2788992 - RNA, 22 nt, Human
auuuauguuugcacuugugauu

SEQ ID NO: 2788993 - RNA, 23 nt, Human
auuuagguuuuuguuuguuuccu

SEQ ID NO: 2788994 - RNA, 21 nt, Human
auuuauuaaaaugauuguaaa

SEQ ID NO: 2788995 - RNA, 23 nt, Human
auuuauuaaaaugauuguaaaau

SEQ ID NO: 2788996 - RNA, 13 nt, Human
auuuauuaaauaa

SEQ ID NO: 2788997 - RNA, 14 nt, Human
auuuauuaaauaaa

SEQ ID NO: 2788998 - RNA, 16 nt, Human
auuuauuaaauaaaau

SEQ ID NO: 2788999 - RNA, 17 nt, Human
auuuauuaaauaaaauc

SEQ ID NO: 2789000 - RNA, 18 nt, Human
auuuauuaaauaaaauca

SEQ ID NO: 2789001 - RNA, 19 nt, Human
auuuacgcuuugauucaua

SEQ ID NO: 2789002 - RNA, 17 nt, Human
auuuacgcuuugauuca

SEQ ID NO: 2789003 - RNA, 15 nt, Human
auuuacgcuuugauu

SEQ ID NO: 2789004 - RNA, 13 nt, Human
auuuaccugcagg

SEQ ID NO: 2789005 - RNA, 21 nt, Human
auuuaccugcaggcugagcca

SEQ ID NO: 2789006 - RNA, 22 nt, Human
auuuagcuaaacggauuccaaa

SEQ ID NO: 2789007 - RNA, 21 nt, Human
auuuagcuaaacggauuccaa

SEQ ID NO: 2789008 - RNA, 17 nt, Human
auuuaggguacuaaauu

SEQ ID NO: 2789009 - RNA, 19 nt, Human
auuuaggguacuaaauuua

SEQ ID NO: 2789010 - RNA, 20 nt, Human
auuuaggguacuaaauuuaa

SEQ ID NO: 2789011 - RNA, 22 nt, Human
auuuaggguacuaaauuuaaau

SEQ ID NO: 2789012 - RNA, 23 nt, Human
auuuagcuaaacggauuccaaag

SEQ ID NO: 2789013 - RNA, 23 nt, Human
auuuaggaaguugacuuauagua

SEQ ID NO: 2789014 - RNA, 16 nt, Human
auuuaggaaguugacu

SEQ ID NO: 2789015 - RNA, 21 nt, Human
auuuaggagugugugacauuc

SEQ ID NO: 2789016 - RNA, 14 nt, Human
auuuccugugucuu

SEQ ID NO: 2789017 - RNA, 12 nt, Human
auuuauuauuga

SEQ ID NO: 2789018 - RNA, 12 nt, Human
auuuccuguguc

SEQ ID NO: 2789019 - RNA, 16 nt, Human
auuuccugugucaauc

SEQ ID NO: 2789020 - RNA, 16 nt, Human
auuuccuguuggauuu

SEQ ID NO: 2789021 - RNA, 21 nt, Human
auuuccuguuggauuuguuua

SEQ ID NO: 2789022 - RNA, 22 nt, Human
auuuccuguuggauuuguuuaa

SEQ ID NO: 2789023 - RNA, 23 nt, Human
auuuccuguuggauuuguuuaaa

SEQ ID NO: 2789024 - RNA, 15 nt, Human
auuucuaaauaaaag

SEQ ID NO: 2789025 - RNA, 14 nt, Human
auuuggucucuauu

SEQ ID NO: 2789026 - RNA, 12 nt, Human
auuugguacuuu

SEQ ID NO: 2789027 - RNA, 23 nt, Human
auuugguacuuuugagugugugu

SEQ ID NO: 2789028 - RNA, 23 nt, Human
auuuggggaaaccuagagaagau

SEQ ID NO: 2789029 - RNA, 14 nt, Human
auuuggggacagau

SEQ ID NO: 2789030 - RNA, 19 nt, Human
auuuggggacagauucagu

SEQ ID NO: 2789031 - RNA, 22 nt, Human
auuuggggacagauucagucuu

SEQ ID NO: 2789032 - RNA, 20 nt, Human
auuuggagacacaacuauuu

SEQ ID NO: 2789033 - RNA, 13 nt, Human
auuuggaauacuu

SEQ ID NO: 2789034 - RNA, 21 nt, Human
auuuggaagaaaaaaaucuuc

SEQ ID NO: 2789035 - RNA, 15 nt, Human
auuuggaauacuuuu

SEQ ID NO: 2789036 - RNA, 11 nt, Human
auuuggaauag

SEQ ID NO: 2789037 - RNA, 14 nt, Human
auuuggaauacuuu

SEQ ID NO: 2789038 - RNA, 23 nt, Human
auuuguacugaaaaaugguaauu

SEQ ID NO: 2789039 - RNA, 21 nt, Human
auuuguacuguuuaauguucu

SEQ ID NO: 2789040 - RNA, 22 nt, Human
auuuguacuguuuaauguucug

SEQ ID NO: 2789041 - RNA, 12 nt, Human
auuugauaauga

SEQ ID NO: 2789042 - RNA, 16 nt, Human
auuugauaaugauaaa

SEQ ID NO: 2789043 - RNA, 19 nt, Human
auuugauaaugauaaaaca

SEQ ID NO: 2789044 - RNA, 20 nt, Human
auuugauaaugauaaaacac

SEQ ID NO: 2789045 - RNA, 13 nt, Human
auuugauacauaa

SEQ ID NO: 2789046 - RNA, 14 nt, Human
auuugauacauaau

SEQ ID NO: 2789047 - RNA, 15 nt, Human
auuugauacauaaua

SEQ ID NO: 2789048 - RNA, 19 nt, Human
auuugauacauaauaaaaa

SEQ ID NO: 2789049 - RNA, 16 nt, Human
auuugauaccccuggg

SEQ ID NO: 2789050 - RNA, 12 nt, Human
auuugauacuua

SEQ ID NO: 2789051 - RNA, 13 nt, Human
auuugauacuuau

SEQ ID NO: 2789052 - RNA, 14 nt, Human
auuugauacuuaua

SEQ ID NO: 2789053 - RNA, 15 nt, Human
auuugauacuuauau

SEQ ID NO: 2789054 - RNA, 19 nt, Human
auuugauacuuauauuuuc

SEQ ID NO: 2789055 - RNA, 22 nt, Human
auuugauacuuauauuuucgua

SEQ ID NO: 2789056 - RNA, 17 nt, Human
auuugagcagggcucag

SEQ ID NO: 2789057 - RNA, 22 nt, Human
auuugaggacaaccauuccaga

SEQ ID NO: 2789058 - RNA, 20 nt, Human
auuugaggauuuagaagugu

SEQ ID NO: 2789059 - RNA, 22 nt, Human
auuugaggauuuagaaguguca

SEQ ID NO: 2789060 - RNA, 23 nt, Human
auuugaggauuuagaagugucau

SEQ ID NO: 2789061 - RNA, 14 nt, Human
auuugaggcucaga

SEQ ID NO: 2789062 - RNA, 17 nt, Human
auuugaggggaaaacac

SEQ ID NO: 2789063 - RNA, 22 nt, Human
auuugaggggaaaacaccauaa

SEQ ID NO: 2789064 - RNA, 16 nt, Human
auuugagcagggcuca

SEQ ID NO: 2789065 - RNA, 21 nt, Human
auuucuuuguuaucaaacuuc

SEQ ID NO: 2789066 - RNA, 14 nt, Human
auuucuuugcugua

SEQ ID NO: 2789067 - RNA, 17 nt, Human
auuucuuugcuguaaga

SEQ ID NO: 2789068 - RNA, 21 nt, Human
auuucuuugcuguaagauguc

SEQ ID NO: 2789069 - RNA, 22 nt, Human
auuucuuugcuguaagaugucu

SEQ ID NO: 2789070 - RNA, 22 nt, Human
auuucuuuguuaucaaacuuca

SEQ ID NO: 2789071 - RNA, 23 nt, Human
auuucuuuguuaucaaacuucag

SEQ ID NO: 2789072 - RNA, 16 nt, Human
auuucuuuucuuccug

SEQ ID NO: 2789073 - RNA, 18 nt, Human
auuucuuuucuuccuggc

SEQ ID NO: 2789074 - RNA, 19 nt, Human
auuucuuuucuuuuuacau

SEQ ID NO: 2789075 - RNA, 20 nt, Human
auuucuuuucuuuuuacaua

SEQ ID NO: 2789076 - RNA, 18 nt, Human
auuucuaauguuggacac

SEQ ID NO: 2789077 - RNA, 15 nt, Human
auauauaaaaauaua

SEQ ID NO: 2789078 - RNA, 12 nt, Human
auauaagaaaga

SEQ ID NO: 2789079 - RNA, 14 nt, Human
auauaagaaagaca

SEQ ID NO: 2789080 - RNA, 15 nt, Human
auauauaaagaauau

SEQ ID NO: 2789081 - RNA, 16 nt, Human
auauauaaagaauaua

SEQ ID NO: 2789082 - RNA, 17 nt, Human
auauauaaagaauauau

SEQ ID NO: 2789083 - RNA, 19 nt, Human
auauauaaagaauauauau

SEQ ID NO: 2789084 - RNA, 13 nt, Human
auauauaaaguau

SEQ ID NO: 2789085 - RNA, 15 nt, Human
auauauaaaguauag

SEQ ID NO: 2789086 - RNA, 18 nt, Human
auauauaaaguauagaga

SEQ ID NO: 2789087 - RNA, 13 nt, Human
auauauaagaaag

SEQ ID NO: 2789088 - RNA, 14 nt, Human
auauauaagaaaga

SEQ ID NO: 2789089 - RNA, 17 nt, Human
auauauaagaaagacau

SEQ ID NO: 2789090 - RNA, 18 nt, Human
auauauaagaaagacauc

SEQ ID NO: 2789091 - RNA, 22 nt, Human
auauauaagaaagacaucuuuc

SEQ ID NO: 2789092 - RNA, 13 nt, Human
auauauaauauau

SEQ ID NO: 2789093 - RNA, 17 nt, Human
auauaaaacaaauaaaa

SEQ ID NO: 2789094 - RNA, 17 nt, Human
auauauaacagauacau

SEQ ID NO: 2789095 - RNA, 18 nt, Human
auauauaacagauacauu

SEQ ID NO: 2789096 - RNA, 13 nt, Human
auauaacaugaaa

SEQ ID NO: 2789097 - RNA, 15 nt, Human
auauaacaugaaaug

SEQ ID NO: 2789098 - RNA, 16 nt, Human
auauaacaugaaauga

SEQ ID NO: 2789099 - RNA, 18 nt, Human
auauaacaugaaaugaua

SEQ ID NO: 2789100 - RNA, 20 nt, Human
auauaacaugaaaugauaga

SEQ ID NO: 2789101 - RNA, 15 nt, Human
auauaacagauacau

SEQ ID NO: 2789102 - RNA, 16 nt, Human
auauaacagauacauu

SEQ ID NO: 2789103 - RNA, 23 nt, Human
auauaaccacaaagcacaguuug

SEQ ID NO: 2789104 - RNA, 23 nt, Human
auauaacccuaacacacacagaa

SEQ ID NO: 2789105 - RNA, 21 nt, Human
auauaacuuaaaaauguaaau

SEQ ID NO: 2789106 - RNA, 18 nt, Human
auauaacuauugcccagg

SEQ ID NO: 2789107 - RNA, 13 nt, Human
auauaaaguauag

SEQ ID NO: 2789108 - RNA, 14 nt, Human
auauaaaguauaga

SEQ ID NO: 2789109 - RNA, 20 nt, Human
auauaaagggggagggaaau

SEQ ID NO: 2789110 - RNA, 21 nt, Human
auauaaagggggagggaaaua

SEQ ID NO: 2789111 - RNA, 20 nt, Human
auauaaaaggcaaaugugua

SEQ ID NO: 2789112 - RNA, 18 nt, Human
auauaaaagaucuugcag

SEQ ID NO: 2789113 - RNA, 19 nt, Human
auauaaaagaucuugcaga

SEQ ID NO: 2789114 - RNA, 14 nt, Human
auauaaagauguua

SEQ ID NO: 2789115 - RNA, 21 nt, Human
auauauccuuuucuucuaugu

SEQ ID NO: 2789116 - RNA, 23 nt, Human
auauauccuuuucuucuauguag

SEQ ID NO: 2789117 - RNA, 16 nt, Human
auauaucccagaaauu

SEQ ID NO: 2789118 - RNA, 12 nt, Human
auauaucugaaa

SEQ ID NO: 2789119 - RNA, 18 nt, Human
auauaucugaaaacugga

SEQ ID NO: 2789120 - RNA, 13 nt, Human
auauaugaaaacu

SEQ ID NO: 2789121 - RNA, 18 nt, Human
auauaucugcuucagugg

SEQ ID NO: 2789122 - RNA, 15 nt, Human
auauaucugcuucag

SEQ ID NO: 2789123 - RNA, 17 nt, Human
auauaucugcuucagug

SEQ ID NO: 2789124 - RNA, 12 nt, Human
auauaugaauaa

SEQ ID NO: 2789125 - RNA, 15 nt, Human
auauaugaaaacuau

SEQ ID NO: 2789126 - RNA, 16 nt, Human
auauaugaaaacuaua

SEQ ID NO: 2789127 - RNA, 17 nt, Human
auauaugaaaacuauac

SEQ ID NO: 2789128 - RNA, 20 nt, Human
auauaugaaaacuauacaac

SEQ ID NO: 2789129 - RNA, 12 nt, Human
uucacuucaaaa

SEQ ID NO: 2789130 - RNA, 15 nt, Human
uucacuuacagcacc

SEQ ID NO: 2789131 - RNA, 21 nt, Human
uucacuguugaaaauuauuuu

SEQ ID NO: 2789132 - RNA, 16 nt, Human
uucacuguuagcuuuu

SEQ ID NO: 2789133 - RNA, 22 nt, Human
uucacuguuagcuuuuuaaaac

SEQ ID NO: 2789134 - RNA, 22 nt, Human
uucacuguccuccaagccagcg

SEQ ID NO: 2789135 - RNA, 13 nt, Human
auauaugaggacu

SEQ ID NO: 2789136 - RNA, 15 nt, Human
auauaugcacuaugu

SEQ ID NO: 2789137 - RNA, 19 nt, Human
auauaugcacuauguauau

SEQ ID NO: 2789138 - RNA, 22 nt, Human
uucacuguauaaauaggagagg

SEQ ID NO: 2789139 - RNA, 23 nt, Human
uucacuguauaaauaggagagga

SEQ ID NO: 2789140 - RNA, 10 nt, Human
auauauauuu

SEQ ID NO: 2789141 - RNA, 13 nt, Human
auauaucauauug

SEQ ID NO: 2789142 - RNA, 20 nt, Human
auauaucauauugguauuca

SEQ ID NO: 2789143 - RNA, 14 nt, Human
auauaucaguuuga

SEQ ID NO: 2789144 - RNA, 15 nt, Human
auauaucaguuugau

SEQ ID NO: 2789145 - RNA, 17 nt, Human
auauauauuauaaauau

SEQ ID NO: 2789146 - RNA, 19 nt, Human
auauauauuauaaauauau

SEQ ID NO: 2789147 - RNA, 14 nt, Human
auauauaugaauaa

SEQ ID NO: 2789148 - RNA, 15 nt, Human
auauauaugaauaaa

SEQ ID NO: 2789149 - RNA, 19 nt, Human
auauauaugccuuuuuccu

SEQ ID NO: 2789150 - RNA, 20 nt, Human
auauauaugccuuuuuccua

SEQ ID NO: 2789151 - RNA, 14 nt, Human
auauauauauauac

SEQ ID NO: 2789152 - RNA, 15 nt, Human
auauauauauauaca

SEQ ID NO: 2789153 - RNA, 14 nt, Human
auauauauauauau

SEQ ID NO: 2789154 - RNA, 16 nt, Human
auauauauauauauaa

SEQ ID NO: 2789155 - RNA, 14 nt, Human
auauauaucaguuu

SEQ ID NO: 2789156 - RNA, 15 nt, Human
auauauaucaguuug

SEQ ID NO: 2789157 - RNA, 13 nt, Human
auauauauauauc

SEQ ID NO: 2789158 - RNA, 14 nt, Human
auauauauauauca

SEQ ID NO: 2789159 - RNA, 15 nt, Human
auauauauauaugca

SEQ ID NO: 2789160 - RNA, 14 nt, Human
auauauauaucagu

SEQ ID NO: 2789161 - RNA, 16 nt, Human
auauauauaucaguuu

SEQ ID NO: 2789162 - RNA, 13 nt, Human
auauauauauaaa

SEQ ID NO: 2789163 - RNA, 14 nt, Human
auauauauauaaag

SEQ ID NO: 2789164 - RNA, 14 nt, Human
auauauauauauaa

SEQ ID NO: 2789165 - RNA, 15 nt, Human
auauauauauauaaa

SEQ ID NO: 2789166 - RNA, 14 nt, Human
auauauauaaauau

SEQ ID NO: 2789167 - RNA, 15 nt, Human
auauauauauaaagu

SEQ ID NO: 2789168 - RNA, 15 nt, Human
auauauauaauauau

SEQ ID NO: 2789169 - RNA, 13 nt, Human
auauauauacaca

SEQ ID NO: 2789170 - RNA, 15 nt, Human
auauauauacacaca

SEQ ID NO: 2789171 - RNA, 13 nt, Human
auauauauacaua

SEQ ID NO: 2789172 - RNA, 14 nt, Human
auauauauacauau

SEQ ID NO: 2789173 - RNA, 16 nt, Human
auauauauacauaugu

SEQ ID NO: 2789174 - RNA, 10 nt, Human
auauauauau

SEQ ID NO: 2789175 - RNA, 11 nt, Human
auauauauaua

SEQ ID NO: 2789176 - RNA, 13 nt, Human
auauauauaaaua

SEQ ID NO: 2789177 - RNA, 23 nt, Human
auauauaagcucagauuauuuaa

SEQ ID NO: 2789178 - RNA, 16 nt, Human
auaguuggucaucuag

SEQ ID NO: 2789179 - RNA, 22 nt, Human
auaguugucaguauuauucuac

SEQ ID NO: 2789180 - RNA, 19 nt, Human
auaguuguccauauuuuca

SEQ ID NO: 2789181 - RNA, 13 nt, Human
auaguuuaaaaca

SEQ ID NO: 2789182 - RNA, 22 nt, Human
auaguuggcuaggaccccucca

SEQ ID NO: 2789183 - RNA, 12 nt, Human
auaguugcuuuu

SEQ ID NO: 2789184 - RNA, 15 nt, Human
auaguugcuuuugaa

SEQ ID NO: 2789185 - RNA, 20 nt, Human
auaguugcuuuugaaggaau

SEQ ID NO: 2789186 - RNA, 21 nt, Human
auaguugcuuuugaaggaaua

SEQ ID NO: 2789187 - RNA, 13 nt, Human
auaguuuugauga

SEQ ID NO: 2789188 - RNA, 20 nt, Human
auaguuuugaugacuggcau

SEQ ID NO: 2789189 - RNA, 22 nt, Human
auaguuuugaugacuggcauuu

SEQ ID NO: 2789190 - RNA, 13 nt, Human
auaguuuauugac

SEQ ID NO: 2789191 - RNA, 17 nt, Human
auaguuuaccugaauaa

SEQ ID NO: 2789192 - RNA, 13 nt, Human
auauaaaaacaaa

SEQ ID NO: 2789193 - RNA, 14 nt, Human
auauaaaaacaaaa

SEQ ID NO: 2789194 - RNA, 21 nt, Human
auaguuuuuaccuuuuaugua

SEQ ID NO: 2789195 - RNA, 14 nt, Human
auauaaaaauauau

SEQ ID NO: 2789196 - RNA, 17 nt, Human
auauaaaaauauauaua

SEQ ID NO: 2789197 - RNA, 19 nt, Human
auauaaaaauauauauagu

SEQ ID NO: 2789198 - RNA, 15 nt, Human
auaguuagaaccugg

SEQ ID NO: 2789199 - RNA, 22 nt, Human
auaguuaacauaguaaguucag

SEQ ID NO: 2789200 - RNA, 23 nt, Human
auaguuaggauagcauuuuugau

SEQ ID NO: 2789201 - RNA, 15 nt, Human
auaguucaaggaacu

SEQ ID NO: 2789202 - RNA, 14 nt, Human
auaguucacccccu

SEQ ID NO: 2789203 - RNA, 21 nt, Human
auaguucuccaguuguaugga

SEQ ID NO: 2789204 - RNA, 12 nt, Human
auaguucuaggc

SEQ ID NO: 2789205 - RNA, 16 nt, Human
auaguuccuaagaagc

SEQ ID NO: 2789206 - RNA, 18 nt, Human
auaguuccuaagaagcuu

SEQ ID NO: 2789207 - RNA, 21 nt, Human
auaguuccuaagaagcuucua

SEQ ID NO: 2789208 - RNA, 23 nt, Human
auaguuccuaagaagcuucuaau

SEQ ID NO: 2789209 - RNA, 12 nt, Human
auaguucuagac

SEQ ID NO: 2789210 - RNA, 13 nt, Human
auaguucuagaca

SEQ ID NO: 2789211 - RNA, 14 nt, Human
auaguucuagacau

SEQ ID NO: 2789212 - RNA, 23 nt, Human
auaguucuagacauggagguucu

SEQ ID NO: 2789213 - RNA, 13 nt, Human
auagucuuucagu

SEQ ID NO: 2789214 - RNA, 14 nt, Human
auagucuaguguag

SEQ ID NO: 2789215 - RNA, 15 nt, Human
auagucuaguguagu

SEQ ID NO: 2789216 - RNA, 17 nt, Human
auagucuaguguaguau

SEQ ID NO: 2789217 - RNA, 23 nt, Human
uucacauuccccuggggacccac

SEQ ID NO: 2789218 - RNA, 15 nt, Human
auagugcaacuauga

SEQ ID NO: 2789219 - RNA, 20 nt, Human
auagugcaacuaugaaugua

SEQ ID NO: 2789220 - RNA, 21 nt, Human
auagugaggcaucgcaaugua

SEQ ID NO: 2789221 - RNA, 15 nt, Human
auagugcacaaaaug

SEQ ID NO: 2789222 - RNA, 17 nt, Human
auagugcacaaaaugaa

SEQ ID NO: 2789223 - RNA, 22 nt, Human
auagugcauuguuucugugggc

SEQ ID NO: 2789224 - RNA, 13 nt, Human
auagucuguguga

SEQ ID NO: 2789225 - RNA, 18 nt, Human
auagugacuaugaacuuc

SEQ ID NO: 2789226 - RNA, 17 nt, Human
auaguggcuuaaaacaa

SEQ ID NO: 2789227 - RNA, 20 nt, Human
auagugcugggauggagggg

SEQ ID NO: 2789228 - RNA, 22 nt, Human
auagugcugggauggaggggag

SEQ ID NO: 2789229 - RNA, 14 nt, Human
auagugcuauauau

SEQ ID NO: 2789230 - RNA, 15 nt, Human
auagugcuauauaua

SEQ ID NO: 2789231 - RNA, 16 nt, Human
auagugcuauauauau

SEQ ID NO: 2789232 - RNA, 19 nt, Human
auagugcuauauauauaaa

SEQ ID NO: 2789233 - RNA, 20 nt, Human
auagugcuauauauauaaau

SEQ ID NO: 2789234 - RNA, 22 nt, Human
auagugcuauauauauaaauau

SEQ ID NO: 2789235 - RNA, 16 nt, Human
auaguggggagacuuc

SEQ ID NO: 2789236 - RNA, 20 nt, Human
auagugggcaccccacugca

SEQ ID NO: 2789237 - RNA, 15 nt, Human
auaguggaaaaacac

SEQ ID NO: 2789238 - RNA, 18 nt, Human
auaguggaaaaacacaug

SEQ ID NO: 2789239 - RNA, 12 nt, Human
auagugucuuug

SEQ ID NO: 2789240 - RNA, 16 nt, Human
auaguguccuaugcaa

SEQ ID NO: 2789241 - RNA, 18 nt, Human
auaguguccuaugcaaua

SEQ ID NO: 2789242 - RNA, 20 nt, Human
auaguguccuaugcaauaaa

SEQ ID NO: 2789243 - RNA, 13 nt, Human
auaguguaaaaua

SEQ ID NO: 2789244 - RNA, 14 nt, Human
auaguguaaaauaa

SEQ ID NO: 2789245 - RNA, 17 nt, Human
uucaagugauucucaug

SEQ ID NO: 2789246 - RNA, 15 nt, Human
uucaagguucuaacc

SEQ ID NO: 2789247 - RNA, 21 nt, Human
uucaaguacuguaacuguguc

SEQ ID NO: 2789248 - RNA, 16 nt, Human
uucaaguagcugggau

SEQ ID NO: 2789249 - RNA, 20 nt, Human
uucaaguagcugggauuuua

SEQ ID NO: 2789250 - RNA, 16 nt, Human
uucacaaugucaguau

SEQ ID NO: 2789251 - RNA, 13 nt, Human
uucacaauguggc

SEQ ID NO: 2789252 - RNA, 20 nt, Human
uucacaaugaaaugcucucc

SEQ ID NO: 2789253 - RNA, 13 nt, Human
uucacaauaaaag

SEQ ID NO: 2789254 - RNA, 15 nt, Human
uucacaauaaaagcu

SEQ ID NO: 2789255 - RNA, 13 nt, Human
uucacacugucug

SEQ ID NO: 2789256 - RNA, 18 nt, Human
uucacacgcuguucuaau

SEQ ID NO: 2789257 - RNA, 11 nt, Human
uucacacccug

SEQ ID NO: 2789258 - RNA, 12 nt, Human
uucacacccugc

SEQ ID NO: 2789259 - RNA, 13 nt, Human
uucacacccugca

SEQ ID NO: 2789260 - RNA, 14 nt, Human
uucacacccugcaa

SEQ ID NO: 2789261 - RNA, 15 nt, Human
uucacacccugcaag

SEQ ID NO: 2789262 - RNA, 12 nt, Human
uucacagcuccu

SEQ ID NO: 2789263 - RNA, 23 nt, Human
uucacaguuggcuggaugaaauu

SEQ ID NO: 2789264 - RNA, 21 nt, Human
auaggaccaggauccagccuc

SEQ ID NO: 2789265 - RNA, 16 nt, Human
auaggaccuugggcca

SEQ ID NO: 2789266 - RNA, 17 nt, Human
auaggaccuugggccaa

SEQ ID NO: 2789267 - RNA, 17 nt, Human
auagcuuuuauuguaua

SEQ ID NO: 2789268 - RNA, 18 nt, Human
auagcuuuuauuguauaa

SEQ ID NO: 2789269 - RNA, 21 nt, Human
auaggaaaguauuuuuuuaag

SEQ ID NO: 2789270 - RNA, 14 nt, Human
auaggagaggauga

SEQ ID NO: 2789271 - RNA, 19 nt, Human
auaggagaggaugagagcc

SEQ ID NO: 2789272 - RNA, 20 nt, Human
auaggagaggaugagagccc

SEQ ID NO: 2789273 - RNA, 21 nt, Human
auaggagaggaugagagccca

SEQ ID NO: 2789274 - RNA, 15 nt, Human
auaggagccugcugg

SEQ ID NO: 2789275 - RNA, 23 nt, Human
auaggagaggaugagagcccaga

SEQ ID NO: 2789276 - RNA, 24 nt, Human
auaggagaggaugagagcccagag

SEQ ID NO: 2789277 - RNA, 12 nt, Human
auaggagccugc

SEQ ID NO: 2789278 - RNA, 13 nt, Human
auaggagccugcu

SEQ ID NO: 2789279 - RNA, 14 nt, Human
auagcuuuuauugu

SEQ ID NO: 2789280 - RNA, 15 nt, Human
auagcuuuuauugua

SEQ ID NO: 2789281 - RNA, 22 nt, Human
uucacauuaauauuugcugaca

SEQ ID NO: 2789282 - RNA, 20 nt, Human
uucacauuaauggucuaaaa

SEQ ID NO: 2789283 - RNA, 17 nt, Human
uucacauuaaaaaauga

SEQ ID NO: 2789284 - RNA, 18 nt, Human
uucacauuaaaaaaugaa

SEQ ID NO: 2789285 - RNA, 23 nt, Human
uucacauuaaaaaaugaaauauu

SEQ ID NO: 2789286 - RNA, 15 nt, Human
uucaaacacaaaugc

SEQ ID NO: 2789287 - RNA, 17 nt, Human
uucaaacacaaaugcag

SEQ ID NO: 2789288 - RNA, 14 nt, Human
uucaaacacaaaug

SEQ ID NO: 2789289 - RNA, 13 nt, Human
uucaaacaagaau

SEQ ID NO: 2789290 - RNA, 14 nt, Human
uucaaacaagaaug

SEQ ID NO: 2789291 - RNA, 15 nt, Human
uucaaacaagaaugu

SEQ ID NO: 2789292 - RNA, 11 nt, Human
uucaagaauga

SEQ ID NO: 2789293 - RNA, 16 nt, Human
uucaaaaguaaugccu

SEQ ID NO: 2789294 - RNA, 21 nt, Human
uucaaaaguaaugccucuguc

SEQ ID NO: 2789295 - RNA, 22 nt, Human
uucaaaaguaaugccucugucu

SEQ ID NO: 2789296 - RNA, 14 nt, Human
uucaaaagacaugu

SEQ ID NO: 2789297 - RNA, 19 nt, Human
uucaaaagacauguuguaa

SEQ ID NO: 2789298 - RNA, 12 nt, Human
uucaaaaguucc

SEQ ID NO: 2789299 - RNA, 14 nt, Human
uucaaaaguuccaa

SEQ ID NO: 2789300 - RNA, 15 nt, Human
uucaaaaguuccaag

SEQ ID NO: 2789301 - RNA, 16 nt, Human
uucaaaaguuccaaga

SEQ ID NO: 2789302 - RNA, 20 nt, Human
uucaaggaacuugaaaaaua

SEQ ID NO: 2789303 - RNA, 11 nt, Human
uucaaggaagg

SEQ ID NO: 2789304 - RNA, 17 nt, Human
uucaagguggccaaauu

SEQ ID NO: 2789305 - RNA, 14 nt, Human
uucaaggugacaga

SEQ ID NO: 2789306 - RNA, 22 nt, Human
uucaagguggccaaauuauuug

SEQ ID NO: 2789307 - RNA, 14 nt, Human
uucaagguucuaac

SEQ ID NO: 2789308 - RNA, 18 nt, Human
uucaagguggccaaauua

SEQ ID NO: 2789309 - RNA, 20 nt, Human
uucaagguggccaaauuauu

SEQ ID NO: 2789310 - RNA, 21 nt, Human
uucaagcgauucuucugcuuc

SEQ ID NO: 2789311 - RNA, 17 nt, Human
uucaagcacuuacagcu

SEQ ID NO: 2789312 - RNA, 16 nt, Human
uucaagaaccuggaaa

SEQ ID NO: 2789313 - RNA, 20 nt, Human
uucaagccugugcaaugcau

SEQ ID NO: 2789314 - RNA, 16 nt, Human
uucaagcagcaucuuc

SEQ ID NO: 2789315 - RNA, 14 nt, Human
uuauuuuuaaagau

SEQ ID NO: 2789316 - RNA, 17 nt, Human
uuauuuuuagacagagu

SEQ ID NO: 2789317 - RNA, 18 nt, Human
uuauuuuuagacagaguc

SEQ ID NO: 2789318 - RNA, 14 nt, Human
uuauuuuucaagga

SEQ ID NO: 2789319 - RNA, 18 nt, Human
uuaguuuuuguaauuuau

SEQ ID NO: 2789320 - RNA, 17 nt, Human
uuaguuuuuguaauuua

SEQ ID NO: 2789321 - RNA, 13 nt, Human
uuaguuuucuugu

SEQ ID NO: 2789322 - RNA, 14 nt, Human
uuaguuuucuuguu

SEQ ID NO: 2789323 - RNA, 16 nt, Human
uuauuuuuaaaaagaa

SEQ ID NO: 2789324 - RNA, 14 nt, Human
uuauuuuucauauu

SEQ ID NO: 2789325 - RNA, 16 nt, Human
uuauuuuucauauugu

SEQ ID NO: 2789326 - RNA, 19 nt, Human
uuauuuuucauauugugcc

SEQ ID NO: 2789327 - RNA, 13 nt, Human
uuauuuuucuaaa

SEQ ID NO: 2789328 - RNA, 23 nt, Human
uuauuuuugacaguguugaaaau

SEQ ID NO: 2789329 - RNA, 14 nt, Human
uuauuuuucuaaac

SEQ ID NO: 2789330 - RNA, 13 nt, Human
uuauuuuuuauug

SEQ ID NO: 2789331 - RNA, 14 nt, Human
uuauuuuuuacauu

SEQ ID NO: 2789332 - RNA, 18 nt, Human
uuauuuuuuacauuauua

SEQ ID NO: 2789333 - RNA, 18 nt, Human
uuauuuuuuaaguauuua

SEQ ID NO: 2789334 - RNA, 21 nt, Human
uucccaaccccuuaagcccug

SEQ ID NO: 2789335 - RNA, 20 nt, Human
uucccaacuucucuugcuuu

SEQ ID NO: 2789336 - RNA, 14 nt, Human
uucccaagaaaugc

SEQ ID NO: 2789337 - RNA, 16 nt, Human
uucccaagcucugcuc

SEQ ID NO: 2789338 - RNA, 15 nt, Human
uucccaagcucugcu

SEQ ID NO: 2789339 - RNA, 14 nt, Human
uucccaagcucugc

SEQ ID NO: 2789340 - RNA, 13 nt, Human
uucccaagcucug

SEQ ID NO: 2789341 - RNA, 17 nt, Human
uucccaccgcccucccu

SEQ ID NO: 2789342 - RNA, 22 nt, Human
uucccaccgcccucccucccca

SEQ ID NO: 2789343 - RNA, 14 nt, Human
uucccaccucccug

SEQ ID NO: 2789344 - RNA, 16 nt, Human
uucccaccucccugcc

SEQ ID NO: 2789345 - RNA, 21 nt, Human
uucccaccucccugcccaggc

SEQ ID NO: 2789346 - RNA, 18 nt, Human
uucccaagcucugcuccu

SEQ ID NO: 2789347 - RNA, 23 nt, Human
uucccaagccuucgggcgucugu

SEQ ID NO: 2789348 - RNA, 20 nt, Human
uucccaauagcaacguagcu

SEQ ID NO: 2789349 - RNA, 20 nt, Human
uucccaaguaagaggcugga

SEQ ID NO: 2789350 - RNA, 23 nt, Human
uucccaauagcaacguagcuucu

SEQ ID NO: 2789351 - RNA, 15 nt, Human
uucccaaucagcacu

SEQ ID NO: 2789352 - RNA, 16 nt, Human
uucccaaucagcacug

SEQ ID NO: 2789353 - RNA, 17 nt, Human
uucccaaucagcacuga

SEQ ID NO: 2789354 - RNA, 18 nt, Human
uucccaaucagcacugaa

SEQ ID NO: 2789355 - RNA, 19 nt, Human
uucccaaucagcacugaaa

SEQ ID NO: 2789356 - RNA, 20 nt, Human
uucccaaucagcacugaaaa

SEQ ID NO: 2789357 - RNA, 12 nt, Human
uucccaauggug

SEQ ID NO: 2789358 - RNA, 19 nt, Human
uucccaaugguguuuuucu

SEQ ID NO: 2789359 - RNA, 21 nt, Human
uucccaaugguguuuuucuug

SEQ ID NO: 2789360 - RNA, 22 nt, Human
uucccaaugguguuuuucuugu

SEQ ID NO: 2789361 - RNA, 13 nt, Human
uuccauagcaaca

SEQ ID NO: 2789362 - RNA, 15 nt, Human
uuccauagcaacagg

SEQ ID NO: 2789363 - RNA, 17 nt, Human
uuccauagcaacaggaa

SEQ ID NO: 2789364 - RNA, 13 nt, Human
uuccaguguucua

SEQ ID NO: 2789365 - RNA, 19 nt, Human
uuccauaaucuggacuccu

SEQ ID NO: 2789366 - RNA, 22 nt, Human
uuccauaaucuggacuccucug

SEQ ID NO: 2789367 - RNA, 23 nt, Human
uuccauaaucuggacuccucugu

SEQ ID NO: 2789368 - RNA, 21 nt, Human
auaugugaauccucuucuuua

SEQ ID NO: 2789369 - RNA, 21 nt, Human
auaugugagauuuuuuauugc

SEQ ID NO: 2789370 - RNA, 22 nt, Human
auaugugagauuuuuuauugcu

SEQ ID NO: 2789371 - RNA, 20 nt, Human
auaugugagugccuuuugca

SEQ ID NO: 2789372 - RNA, 13 nt, Human
auaugugaucugu

SEQ ID NO: 2789373 - RNA, 15 nt, Human
auaugugaucugucu

SEQ ID NO: 2789374 - RNA, 16 nt, Human
auaugugaucugucuu

SEQ ID NO: 2789375 - RNA, 20 nt, Human
auaugugaucugucuuguaa

SEQ ID NO: 2789376 - RNA, 21 nt, Human
auaugugaucugucuuguaau

SEQ ID NO: 2789377 - RNA, 15 nt, Human
uucauucacuucucu

SEQ ID NO: 2789378 - RNA, 17 nt, Human
uucauucacuucucuua

SEQ ID NO: 2789379 - RNA, 13 nt, Human
uucauucuccugc

SEQ ID NO: 2789380 - RNA, 15 nt, Human
uucauucugcagggu

SEQ ID NO: 2789381 - RNA, 12 nt, Human
uucauucugcau

SEQ ID NO: 2789382 - RNA, 14 nt, Human
uucauucugcauug

SEQ ID NO: 2789383 - RNA, 15 nt, Human
uucauucuccugccu

SEQ ID NO: 2789384 - RNA, 12 nt, Human
uucauucuccuu

SEQ ID NO: 2789385 - RNA, 15 nt, Human
uucauucuccuuguu

SEQ ID NO: 2789386 - RNA, 17 nt, Human
uucauucuccuuguugu

SEQ ID NO: 2789387 - RNA, 21 nt, Human
uucauucucgugagucauuua

SEQ ID NO: 2789388 - RNA, 12 nt, Human
uucauucucaua

SEQ ID NO: 2789389 - RNA, 18 nt, Human
uucauucucauaauuccu

SEQ ID NO: 2789390 - RNA, 23 nt, Human
uucauucucauaauuccuacagc

SEQ ID NO: 2789391 - RNA, 21 nt, Human
uucauucucauugcagaauaa

SEQ ID NO: 2789392 - RNA, 12 nt, Human
uucauucauccc

SEQ ID NO: 2789393 - RNA, 18 nt, Human
uucauucauggaccacug

SEQ ID NO: 2789394 - RNA, 23 nt, Human
uucauucauggaccacuguuucu

SEQ ID NO: 2789395 - RNA, 14 nt, Human
uucauucauucacu

SEQ ID NO: 2789396 - RNA, 15 nt, Human
uucauuccauugccu

SEQ ID NO: 2789397 - RNA, 21 nt, Human
uucauuccauugccuagcucu

SEQ ID NO: 2789398 - RNA, 12 nt, Human
uuccaagagucu

SEQ ID NO: 2789399 - RNA, 13 nt, Human
uuccaagagucua

SEQ ID NO: 2789400 - RNA, 14 nt, Human
uuccaagagucuaa

SEQ ID NO: 2789401 - RNA, 22 nt, Human
uuccaagacucuagaguccaag

SEQ ID NO: 2789402 - RNA, 21 nt, Human
uucauuuagcuaaacggauuc

SEQ ID NO: 2789403 - RNA, 14 nt, Human
uucauuguaugaug

SEQ ID NO: 2789404 - RNA, 16 nt, Human
uucauuguaugaugug

SEQ ID NO: 2789405 - RNA, 15 nt, Human
uucauugucccucuu

SEQ ID NO: 2789406 - RNA, 12 nt, Human
uucauugucucu

SEQ ID NO: 2789407 - RNA, 21 nt, Human
uucauuguuuuuaacuuugcu

SEQ ID NO: 2789408 - RNA, 22 nt, Human
uuccacaccuuuuauugacaca

SEQ ID NO: 2789409 - RNA, 15 nt, Human
uuccacaccuuuuau

SEQ ID NO: 2789410 - RNA, 19 nt, Human
uuccacaccuagcaucuca

SEQ ID NO: 2789411 - RNA, 22 nt, Human
uuccacaagugccgcaaauugu

SEQ ID NO: 2789412 - RNA, 23 nt, Human
uuccaauccuggcucuguggcuu

SEQ ID NO: 2789413 - RNA, 15 nt, Human
uuccaauccuggcuc

SEQ ID NO: 2789414 - RNA, 16 nt, Human
uuccaauaugaugacu

SEQ ID NO: 2789415 - RNA, 13 nt, Human
uuccaauauuucu

SEQ ID NO: 2789416 - RNA, 15 nt, Human
uuccaauauuucugc

SEQ ID NO: 2789417 - RNA, 24 nt, Human
uuccaauauuucugcuuucuuuga

SEQ ID NO: 2789418 - RNA, 15 nt, Human
uuccaagagucuaaa

SEQ ID NO: 2789419 - RNA, 17 nt, Human
uuccaagagucuaaaga

SEQ ID NO: 2789420 - RNA, 13 nt, Human
uuccaaggcuucu

SEQ ID NO: 2789421 - RNA, 18 nt, Human
uuccaaggggcaaauuuu

SEQ ID NO: 2789422 - RNA, 13 nt, Human
uuccaaguaauau

SEQ ID NO: 2789423 - RNA, 19 nt, Human
uuccaaguaauauaaugga

SEQ ID NO: 2789424 - RNA, 13 nt, Human
uuccacccuggaa

SEQ ID NO: 2789425 - RNA, 11 nt, Human
uuccacccugg

SEQ ID NO: 2789426 - RNA, 19 nt, Human
uuccagcucauucauuuua

SEQ ID NO: 2789427 - RNA, 21 nt, Human
uuccaggcuaguccggaccca

SEQ ID NO: 2789428 - RNA, 13 nt, Human
uuccaggaccccu

SEQ ID NO: 2789429 - RNA, 14 nt, Human
uuccaggauggugu

SEQ ID NO: 2789430 - RNA, 13 nt, Human
uuccagcuccuca

SEQ ID NO: 2789431 - RNA, 11 nt, Human
uuccagcuccu

SEQ ID NO: 2789432 - RNA, 14 nt, Human
uuccagcuccugua

SEQ ID NO: 2789433 - RNA, 19 nt, Human
uuccagcucuaauaaaaca

SEQ ID NO: 2789434 - RNA, 11 nt, Human
uuccagcugcu

SEQ ID NO: 2789435 - RNA, 12 nt, Human
uuccagcugcug

SEQ ID NO: 2789436 - RNA, 13 nt, Human
uuccagcugcugu

SEQ ID NO: 2789437 - RNA, 15 nt, Human
uuccagcugcugucu

SEQ ID NO: 2789438 - RNA, 20 nt, Human
uuccagcugcugucuucugg

SEQ ID NO: 2789439 - RNA, 22 nt, Human
uuccagcugcugucuucuggac

SEQ ID NO: 2789440 - RNA, 22 nt, Human
auauauuuguguauuuaacagg

SEQ ID NO: 2789441 - RNA, 17 nt, Human
auauauuuguguauuua

SEQ ID NO: 2789442 - RNA, 21 nt, Human
auauauuuguguauuuaacag

SEQ ID NO: 2789443 - RNA, 14 nt, Human
auaucuauuaauau

SEQ ID NO: 2789444 - RNA, 15 nt, Human
auaucuauuaauaua

SEQ ID NO: 2789445 - RNA, 18 nt, Human
auaucuauuaauauaugu

SEQ ID NO: 2789446 - RNA, 22 nt, Human
auaucuauuaauauauguauua

SEQ ID NO: 2789447 - RNA, 13 nt, Human
auaucuauuaaua

SEQ ID NO: 2789448 - RNA, 12 nt, Human
auaucuauuaau

SEQ ID NO: 2789449 - RNA, 11 nt, Human
auaucugaaaa

SEQ ID NO: 2789450 - RNA, 16 nt, Human
auaucugaaaacugga

SEQ ID NO: 2789451 - RNA, 17 nt, Human
auaucugaaaacuggaa

SEQ ID NO: 2789452 - RNA, 23 nt, Human
auaucugaaaacuggaauaagaa

SEQ ID NO: 2789453 - RNA, 16 nt, Human
auaucuuugugauaau

SEQ ID NO: 2789454 - RNA, 21 nt, Human
auaucuuugugauaauuuaag

SEQ ID NO: 2789455 - RNA, 22 nt, Human
auaucuuugugauaauuuaaga

SEQ ID NO: 2789456 - RNA, 23 nt, Human
auaucuuugugauaauuuaagag

SEQ ID NO: 2789457 - RNA, 12 nt, Human
auaucuuuuaug

SEQ ID NO: 2789458 - RNA, 17 nt, Human
auaucuuuuauguuuga

SEQ ID NO: 2789459 - RNA, 18 nt, Human
auaucuuuuauguuugaa

SEQ ID NO: 2789460 - RNA, 19 nt, Human
auaucuuuuauguuugaau

SEQ ID NO: 2789461 - RNA, 20 nt, Human
auaucuuuuauguuugaaua

SEQ ID NO: 2789462 - RNA, 21 nt, Human
auaucuuuuauguuugaauau

SEQ ID NO: 2789463 - RNA, 22 nt, Human
auaucuuuuauguuugaauaug

SEQ ID NO: 2789464 - RNA, 15 nt, Human
auaucuuuucuuuag

SEQ ID NO: 2789465 - RNA, 21 nt, Human
auaucuuuucuuuagagaacu

SEQ ID NO: 2789466 - RNA, 22 nt, Human
auaucuuuucuuuagagaacug

SEQ ID NO: 2789467 - RNA, 23 nt, Human
auaucuuuucuuuagagaacuga

SEQ ID NO: 2789468 - RNA, 13 nt, Human
auaugaaaacuau

SEQ ID NO: 2789469 - RNA, 15 nt, Human
auaugaaaacuauac

SEQ ID NO: 2789470 - RNA, 17 nt, Human
auaugaaaacuauacaa

SEQ ID NO: 2789471 - RNA, 22 nt, Human
auaucuauaguagacacacuau

SEQ ID NO: 2789472 - RNA, 20 nt, Human
auauggguuuauaauuuucu

SEQ ID NO: 2789473 - RNA, 22 nt, Human
auauggguuuauaauuuucuga

SEQ ID NO: 2789474 - RNA, 13 nt, Human
auaugaucuguuu

SEQ ID NO: 2789475 - RNA, 14 nt, Human
auaugaucuguuuu

SEQ ID NO: 2789476 - RNA, 15 nt, Human
auaugaguacaaaug

SEQ ID NO: 2789477 - RNA, 13 nt, Human
auaugaguauaca

SEQ ID NO: 2789478 - RNA, 14 nt, Human
auaugaguauacaa

SEQ ID NO: 2789479 - RNA, 15 nt, Human
auaugaguauacaau

SEQ ID NO: 2789480 - RNA, 16 nt, Human
auaugaguauacaaua

SEQ ID NO: 2789481 - RNA, 17 nt, Human
auaugaguauacaauau

SEQ ID NO: 2789482 - RNA, 18 nt, Human
auaugaguauacaauaua

SEQ ID NO: 2789483 - RNA, 20 nt, Human
auaugaguauacaauauaua

SEQ ID NO: 2789484 - RNA, 21 nt, Human
auaugaguauacaauauauaa

SEQ ID NO: 2789485 - RNA, 22 nt, Human
auaugaguauacaauauauaaa

SEQ ID NO: 2789486 - RNA, 16 nt, Human
auauguaacaagccac

SEQ ID NO: 2789487 - RNA, 16 nt, Human
auauguaaaauaaaau

SEQ ID NO: 2789488 - RNA, 15 nt, Human
auauguaaaauaaaa

SEQ ID NO: 2789489 - RNA, 14 nt, Human
auauguaaaauaaa

SEQ ID NO: 2789490 - RNA, 13 nt, Human
auauguaaaauaa

SEQ ID NO: 2789491 - RNA, 22 nt, Human
auauggucuaccaguuugcuga

SEQ ID NO: 2789492 - RNA, 12 nt, Human
auauguaaaaua

SEQ ID NO: 2789493 - RNA, 17 nt, Human
auauguaacaagccacc

SEQ ID NO: 2789494 - RNA, 17 nt, Human
auauguacaauuguggg

SEQ ID NO: 2789495 - RNA, 14 nt, Human
auauguacauaaau

SEQ ID NO: 2789496 - RNA, 15 nt, Human
auauguacauaaauu

SEQ ID NO: 2789497 - RNA, 20 nt, Human
auauguaaaauaaaauuaug

SEQ ID NO: 2789498 - RNA, 20 nt, Human
auauguaaacauaaguguac

SEQ ID NO: 2789499 - RNA, 11 nt, Human
auaugugaauc

SEQ ID NO: 2789500 - RNA, 14 nt, Human
auauguacaugaga

SEQ ID NO: 2789501 - RNA, 10 nt, Human
auauauguau

SEQ ID NO: 2789502 - RNA, 14 nt, Human
uucauccccuuacc

SEQ ID NO: 2789503 - RNA, 15 nt, Human
uucauccccuuaccc

SEQ ID NO: 2789504 - RNA, 19 nt, Human
auauauguauuauuuauaa

SEQ ID NO: 2789505 - RNA, 12 nt, Human
auauauguauuu

SEQ ID NO: 2789506 - RNA, 13 nt, Human
auauauguauuuu

SEQ ID NO: 2789507 - RNA, 20 nt, Human
auauauguauuauuuauaau

SEQ ID NO: 2789508 - RNA, 18 nt, Human
auauaugugaggauguau

SEQ ID NO: 2789509 - RNA, 12 nt, Human
auauauguguau

SEQ ID NO: 2789510 - RNA, 18 nt, Human
auauauguguauauauac

SEQ ID NO: 2789511 - RNA, 19 nt, Human
auauauguguauauauaca

SEQ ID NO: 2789512 - RNA, 20 nt, Human
auauauguguauauauacau

SEQ ID NO: 2789513 - RNA, 21 nt, Human
auauauguguauauauacaua

SEQ ID NO: 2789514 - RNA, 23 nt, Human
auauauguguauauauacauaca

SEQ ID NO: 2789515 - RNA, 13 nt, Human
uucaucccagccc

SEQ ID NO: 2789516 - RNA, 14 nt, Human
uucaucccagcccc

SEQ ID NO: 2789517 - RNA, 16 nt, Human
uucaucccagccccaa

SEQ ID NO: 2789518 - RNA, 21 nt, Human
uucauccaggcccaacuguga

SEQ ID NO: 2789519 - RNA, 22 nt, Human
uucauccaggcccaacugugag

SEQ ID NO: 2789520 - RNA, 12 nt, Human
uucauauugugc

SEQ ID NO: 2789521 - RNA, 14 nt, Human
uucauauugugcca

SEQ ID NO: 2789522 - RNA, 16 nt, Human
uucauauugugccaau

SEQ ID NO: 2789523 - RNA, 22 nt, Human
uucauauugugccaauauguau

SEQ ID NO: 2789524 - RNA, 13 nt, Human
auauauuuaauga

SEQ ID NO: 2789525 - RNA, 15 nt, Human
auauauuuaaugaua

SEQ ID NO: 2789526 - RNA, 14 nt, Human
auauauuucuuugu

SEQ ID NO: 2789527 - RNA, 13 nt, Human
auauauuuaagca

SEQ ID NO: 2789528 - RNA, 20 nt, Human
auauauuuaagcaacaucuu

SEQ ID NO: 2789529 - RNA, 13 nt, Human
auauauuugugua

SEQ ID NO: 2789530 - RNA, 15 nt, Human
auauauucccaauag

SEQ ID NO: 2789531 - RNA, 14 nt, Human
auauauuguuaauc

SEQ ID NO: 2789532 - RNA, 19 nt, Human
auauauuguuaaucucugu

SEQ ID NO: 2789533 - RNA, 14 nt, Human
auauauucuuauaa

SEQ ID NO: 2789534 - RNA, 17 nt, Human
auauauucuuauaaaaa

SEQ ID NO: 2789535 - RNA, 21 nt, Human
auauauucugaagcaacauuu

SEQ ID NO: 2789536 - RNA, 13 nt, Human
auauauguguaug

SEQ ID NO: 2789537 - RNA, 15 nt, Human
auauauguguaugua

SEQ ID NO: 2789538 - RNA, 18 nt, Human
uucauacacuaaccaaau

SEQ ID NO: 2789539 - RNA, 20 nt, Human
uucauacacuaaccaaaucu

SEQ ID NO: 2789540 - RNA, 13 nt, Human
uucauaugcugua

SEQ ID NO: 2789541 - RNA, 20 nt, Human
uucauaauggccugagacuu

SEQ ID NO: 2789542 - RNA, 14 nt, Human
uucauauugaauau

SEQ ID NO: 2789543 - RNA, 14 nt, Human
uucauauuggaaaa

SEQ ID NO: 2789544 - RNA, 22 nt, Human
uucauauucuucauauccuucu

SEQ ID NO: 2789545 - RNA, 16 nt, Human
uucauauucuuucaau

SEQ ID NO: 2789546 - RNA, 13 nt, Human
uucauauucuuuu

SEQ ID NO: 2789547 - RNA, 14 nt, Human
uucauauucuuuua

SEQ ID NO: 2789548 - RNA, 19 nt, Human
auauuuuuauagacaaaua

SEQ ID NO: 2789549 - RNA, 16 nt, Human
auauuuuuauauuuag

SEQ ID NO: 2789550 - RNA, 17 nt, Human
aucaaaugcaguauauu

SEQ ID NO: 2789551 - RNA, 19 nt, Human
aucaaaugcaguauauuuc

SEQ ID NO: 2789552 - RNA, 21 nt, Human
aucaaauggaagacacauuga

SEQ ID NO: 2789553 - RNA, 17 nt, Human
aucaaauggaagacaca

SEQ ID NO: 2789554 - RNA, 14 nt, Human
auauuuuuauagac

SEQ ID NO: 2789555 - RNA, 13 nt, Human
auauuuuuauaga

SEQ ID NO: 2789556 - RNA, 16 nt, Human
auauuuuuagacucau

SEQ ID NO: 2789557 - RNA, 13 nt, Human
auauuuuuagaua

SEQ ID NO: 2789558 - RNA, 17 nt, Human
auauuuuuauaauaaac

SEQ ID NO: 2789559 - RNA, 20 nt, Human
auauuuuuauaauaaacaua

SEQ ID NO: 2789560 - RNA, 17 nt, Human
auauuuuuaaaaaauga

SEQ ID NO: 2789561 - RNA, 19 nt, Human
auauuuuuaaaaaaugaaa

SEQ ID NO: 2789562 - RNA, 14 nt, Human
auauuuuuaaaaga

SEQ ID NO: 2789563 - RNA, 16 nt, Human
auauuuuguauuauug

SEQ ID NO: 2789564 - RNA, 18 nt, Human
auauuuuguauuauugcu

SEQ ID NO: 2789565 - RNA, 22 nt, Human
auauuuuguauuauugcuguug

SEQ ID NO: 2789566 - RNA, 20 nt, Human
auauuuuuaaaauauuuauu

SEQ ID NO: 2789567 - RNA, 13 nt, Human
auauuuuuaaaga

SEQ ID NO: 2789568 - RNA, 14 nt, Human
auauuuuuaaagau

SEQ ID NO: 2789569 - RNA, 15 nt, Human
auauuuuuaaagauc

SEQ ID NO: 2789570 - RNA, 22 nt, Human
aucaaccccuucgcuccugugu

SEQ ID NO: 2789571 - RNA, 16 nt, Human
aucaaguauuugggaa

SEQ ID NO: 2789572 - RNA, 20 nt, Human
aucaaccccuucgcuccugu

SEQ ID NO: 2789573 - RNA, 19 nt, Human
aucaaccccuucgcuccug

SEQ ID NO: 2789574 - RNA, 20 nt, Human
aucaaguauuugggaaguga

SEQ ID NO: 2789575 - RNA, 21 nt, Human
aucaaguauuugggaagugaa

SEQ ID NO: 2789576 - RNA, 13 nt, Human
aucaaguauuuug

SEQ ID NO: 2789577 - RNA, 15 nt, Human
aucaagucaaucauu

SEQ ID NO: 2789578 - RNA, 17 nt, Human
aucaagucaaucauuuc

SEQ ID NO: 2789579 - RNA, 18 nt, Human
aucaagucaaucauuucu

SEQ ID NO: 2789580 - RNA, 19 nt, Human
aucaagucaaucauuucuc

SEQ ID NO: 2789581 - RNA, 22 nt, Human
aucaaguuggcuucuaaucaaa

SEQ ID NO: 2789582 - RNA, 23 nt, Human
aucaaguuggcuucuaaucaaag

SEQ ID NO: 2789583 - RNA, 11 nt, Human
aucaaguuuua

SEQ ID NO: 2789584 - RNA, 13 nt, Human
aucaaguuuuaag

SEQ ID NO: 2789585 - RNA, 17 nt, Human
aucaaguuuuaagugaa

SEQ ID NO: 2789586 - RNA, 16 nt, Human
auauuuucguaugaaa

SEQ ID NO: 2789587 - RNA, 17 nt, Human
auauuuucguaugaaaa

SEQ ID NO: 2789588 - RNA, 19 nt, Human
auauuuucguaugaaaaug

SEQ ID NO: 2789589 - RNA, 20 nt, Human
uuccuuauuugcuucauugu

SEQ ID NO: 2789590 - RNA, 21 nt, Human
uuccuuauuuuaagcauugug

SEQ ID NO: 2789591 - RNA, 20 nt, Human
uuccuucaaagcaaaugucu

SEQ ID NO: 2789592 - RNA, 16 nt, Human
uuccuguauguugucc

SEQ ID NO: 2789593 - RNA, 18 nt, Human
uuccuguccccaucuguc

SEQ ID NO: 2789594 - RNA, 13 nt, Human
uuccucuccacug

SEQ ID NO: 2789595 - RNA, 14 nt, Human
uuccucuccacugc

SEQ ID NO: 2789596 - RNA, 15 nt, Human
uuccucuccacugcc

SEQ ID NO: 2789597 - RNA, 19 nt, Human
uuccucucacuaaacuuua

SEQ ID NO: 2789598 - RNA, 12 nt, Human
uuccucuccacu

SEQ ID NO: 2789599 - RNA, 17 nt, Human
uuccucucacuaaacuu

SEQ ID NO: 2789600 - RNA, 18 nt, Human
uuccucucacuaaacuuu

SEQ ID NO: 2789601 - RNA, 13 nt, Human
uucccuacuuccu

SEQ ID NO: 2789602 - RNA, 17 nt, Human
uucccaaggccuuaagc

SEQ ID NO: 2789603 - RNA, 17 nt, Human
uuccccuuccuuuuaag

SEQ ID NO: 2789604 - RNA, 14 nt, Human
uucccuacuuccug

SEQ ID NO: 2789605 - RNA, 16 nt, Human
uucccuacuuccugug

SEQ ID NO: 2789606 - RNA, 21 nt, Human
uucccuuuuaaacacauuuug

SEQ ID NO: 2789607 - RNA, 17 nt, Human
uucccuacuuccuguga

SEQ ID NO: 2789608 - RNA, 17 nt, Human
uuccccuguucacucua

SEQ ID NO: 2789609 - RNA, 14 nt, Human
uuccccuguucacu

SEQ ID NO: 2789610 - RNA, 16 nt, Human
uuccccuggggaccca

SEQ ID NO: 2789611 - RNA, 21 nt, Human
uuccccuggggacccacgugg

SEQ ID NO: 2789612 - RNA, 22 nt, Human
uuccccuuccuaauuccacagc

SEQ ID NO: 2789613 - RNA, 23 nt, Human
uuccuacguaggaugaaaagauu

SEQ ID NO: 2789614 - RNA, 23 nt, Human
uuccuacccacaccucugccaga

SEQ ID NO: 2789615 - RNA, 23 nt, Human
uuccuacccacuuaggcuuugua

SEQ ID NO: 2789616 - RNA, 20 nt, Human
uuccuacccacaccucugcc

SEQ ID NO: 2789617 - RNA, 21 nt, Human
uuccuacccacaccucugcca

SEQ ID NO: 2789618 - RNA, 14 nt, Human
uuccuacagcacua

SEQ ID NO: 2789619 - RNA, 15 nt, Human
uuccuacagcacuac

SEQ ID NO: 2789620 - RNA, 17 nt, Human
uuccuacagcacuacug

SEQ ID NO: 2789621 - RNA, 20 nt, Human
uuccuacagcacuacugggu

SEQ ID NO: 2789622 - RNA, 21 nt, Human
uuccuacagcacuacugggug

SEQ ID NO: 2789623 - RNA, 22 nt, Human
uuccuacagcacuacugggugu

SEQ ID NO: 2789624 - RNA, 23 nt, Human
uuccuacagcacuacuggguguc

SEQ ID NO: 2789625 - RNA, 13 nt, Human
uuccuacaggcag

SEQ ID NO: 2789626 - RNA, 17 nt, Human
uuccuacaggcagucuc

SEQ ID NO: 2789627 - RNA, 18 nt, Human
uuccuacaggcagucucu

SEQ ID NO: 2789628 - RNA, 20 nt, Human
uuccuacaggcagucucucu

SEQ ID NO: 2789629 - RNA, 19 nt, Human
auauuuuaaugcaguugcu

SEQ ID NO: 2789630 - RNA, 23 nt, Human
uucccagagcaaaauaauuuuaa

SEQ ID NO: 2789631 - RNA, 19 nt, Human
uucccagagucaucugauu

SEQ ID NO: 2789632 - RNA, 17 nt, Human
uucccacuuucccaccc

SEQ ID NO: 2789633 - RNA, 18 nt, Human
uucccacuuucccacccc

SEQ ID NO: 2789634 - RNA, 20 nt, Human
uucccacuuucccaccccac

SEQ ID NO: 2789635 - RNA, 18 nt, Human
uucccagagcaaaauaau

SEQ ID NO: 2789636 - RNA, 15 nt, Human
uucccacucaccccg

SEQ ID NO: 2789637 - RNA, 17 nt, Human
uuccccucccuggcucc

SEQ ID NO: 2789638 - RNA, 16 nt, Human
uuccccucccuggcuc

SEQ ID NO: 2789639 - RNA, 13 nt, Human
uuccccucccugg

SEQ ID NO: 2789640 - RNA, 15 nt, Human
uuccccuaucauuua

SEQ ID NO: 2789641 - RNA, 18 nt, Human
uuccccuccuucucccuu

SEQ ID NO: 2789642 - RNA, 12 nt, Human
uuccccucugcu

SEQ ID NO: 2789643 - RNA, 17 nt, Human
uuccccuccuucucccu

SEQ ID NO: 2789644 - RNA, 14 nt, Human
uuccccucugcugc

SEQ ID NO: 2789645 - RNA, 15 nt, Human
uuccccucugcugcu

SEQ ID NO: 2789646 - RNA, 18 nt, Human
uuccccucugcugcuguc

SEQ ID NO: 2789647 - RNA, 19 nt, Human
uuccccucuucccuucaac

SEQ ID NO: 2789648 - RNA, 17 nt, Human
uucccccuuccaaauaa

SEQ ID NO: 2789649 - RNA, 21 nt, Human
uucccccuuccaaauaauaaa

SEQ ID NO: 2789650 - RNA, 15 nt, Human
uucccccucccaggg

SEQ ID NO: 2789651 - RNA, 19 nt, Human
uucccccuccaaucccacc

SEQ ID NO: 2789652 - RNA, 17 nt, Human
auauuuuaccucuuauu

SEQ ID NO: 2789653 - RNA, 23 nt, Human
auauuuuaccucuuauugcaaaa

SEQ ID NO: 2789654 - RNA, 14 nt, Human
uucuaagauucuga

SEQ ID NO: 2789655 - RNA, 21 nt, Human
uucuaaggaccugaaauucca

SEQ ID NO: 2789656 - RNA, 22 nt, Human
uucuaaggaccugaaauuccaa

SEQ ID NO: 2789657 - RNA, 19 nt, Human
uucuaagauucuaaugaug

SEQ ID NO: 2789658 - RNA, 13 nt, Human
uucuaagauucug

SEQ ID NO: 2789659 - RNA, 15 nt, Human
uucuaacuccaguga

SEQ ID NO: 2789660 - RNA, 12 nt, Human
uucuaagaugug

SEQ ID NO: 2789661 - RNA, 19 nt, Human
uucuaagaugugauauucu

SEQ ID NO: 2789662 - RNA, 20 nt, Human
uucuaagaugugauauucua

SEQ ID NO: 2789663 - RNA, 21 nt, Human
uucuaagaugugauauucuaa

SEQ ID NO: 2789664 - RNA, 22 nt, Human
uucuaagaugugauauucuaag

SEQ ID NO: 2789665 - RNA, 23 nt, Human
uucuaagaugugauauucuaaga

SEQ ID NO: 2789666 - RNA, 12 nt, Human
uucuaagauucu

SEQ ID NO: 2789667 - RNA, 13 nt, Human
uucuaagauucua

SEQ ID NO: 2789668 - RNA, 14 nt, Human
uucuaagauucuaa

SEQ ID NO: 2789669 - RNA, 15 nt, Human
uucuaagauucuaaa

SEQ ID NO: 2789670 - RNA, 16 nt, Human
uucuaagauucuaaag

SEQ ID NO: 2789671 - RNA, 17 nt, Human
uucuaagauucuaaagg

SEQ ID NO: 2789672 - RNA, 15 nt, Human
uucuaagauucuaau

SEQ ID NO: 2789673 - RNA, 16 nt, Human
uucuaagauucuaaug

SEQ ID NO: 2789674 - RNA, 17 nt, Human
uucuaagauucuaauga

SEQ ID NO: 2789675 - RNA, 13 nt, Human
uucgcuccugugu

SEQ ID NO: 2789676 - RNA, 14 nt, Human
uucgccuggagccc

SEQ ID NO: 2789677 - RNA, 15 nt, Human
uucgccuggagcccu

SEQ ID NO: 2789678 - RNA, 21 nt, Human
uucgccuuaauacuuuuuuau

SEQ ID NO: 2789679 - RNA, 19 nt, Human
uucgcgugcccucgcugcu

SEQ ID NO: 2789680 - RNA, 15 nt, Human
uucgcgcucugcuca

SEQ ID NO: 2789681 - RNA, 12 nt, Human
uucuaaaguucu

SEQ ID NO: 2789682 - RNA, 13 nt, Human
uucuaaaguucua

SEQ ID NO: 2789683 - RNA, 13 nt, Human
uucuaaauagcaa

SEQ ID NO: 2789684 - RNA, 20 nt, Human
uucuaaaguucuaagauucu

SEQ ID NO: 2789685 - RNA, 21 nt, Human
uucuaaauaaaaguuuuacaa

SEQ ID NO: 2789686 - RNA, 14 nt, Human
uucuaaaguucuaa

SEQ ID NO: 2789687 - RNA, 16 nt, Human
uucuaaaguucuaaga

SEQ ID NO: 2789688 - RNA, 17 nt, Human
uucuaaaguucuaagau

SEQ ID NO: 2789689 - RNA, 18 nt, Human
uucuaaaguucuaagauu

SEQ ID NO: 2789690 - RNA, 20 nt, Human
uucuaacaaaaaaauauauu

SEQ ID NO: 2789691 - RNA, 19 nt, Human
uucuaacaaaaaaauauau

SEQ ID NO: 2789692 - RNA, 18 nt, Human
uucuaaccuugaaugcug

SEQ ID NO: 2789693 - RNA, 20 nt, Human
uucuaaccuugaaugcugcc

SEQ ID NO: 2789694 - RNA, 21 nt, Human
uucuaaccuugaaugcugcca

SEQ ID NO: 2789695 - RNA, 22 nt, Human
uucuaaccuugaaugcugccag

SEQ ID NO: 2789696 - RNA, 23 nt, Human
uucuaaccuugaaugcugccagu

SEQ ID NO: 2789697 - RNA, 24 nt, Human
uucuaaccuugaaugcugccagug

SEQ ID NO: 2789698 - RNA, 20 nt, Human
aucaaguuguaacuuauauu

SEQ ID NO: 2789699 - RNA, 22 nt, Human
aucaaguuguaacuuauauuga

SEQ ID NO: 2789700 - RNA, 23 nt, Human
aucaaguuguaacuuauauugaa

SEQ ID NO: 2789701 - RNA, 13 nt, Human
aucaauaagaagg

SEQ ID NO: 2789702 - RNA, 22 nt, Human
uucgaaaccugggauucaggaa

SEQ ID NO: 2789703 - RNA, 22 nt, Human
uucgaagccuugccuaaauuua

SEQ ID NO: 2789704 - RNA, 14 nt, Human
uucgagaccagccu

SEQ ID NO: 2789705 - RNA, 19 nt, Human
uucgagaccagccuggcca

SEQ ID NO: 2789706 - RNA, 17 nt, Human
uucgagaccagccuggc

SEQ ID NO: 2789707 - RNA, 16 nt, Human
uucgagaccagccugg

SEQ ID NO: 2789708 - RNA, 15 nt, Human
uucgagaccagccug

SEQ ID NO: 2789709 - RNA, 15 nt, Human
uucgacauauuuccu

SEQ ID NO: 2789710 - RNA, 23 nt, Human
uucgcaccuaccaucagggacag

SEQ ID NO: 2789711 - RNA, 23 nt, Human
uucgauacccaggaccaagccac

SEQ ID NO: 2789712 - RNA, 18 nt, Human
uucgaugguacgugaccc

SEQ ID NO: 2789713 - RNA, 20 nt, Human
uucgaugguacgugacccuc

SEQ ID NO: 2789714 - RNA, 23 nt, Human
uucgaugguacgugacccucugc

SEQ ID NO: 2789715 - RNA, 16 nt, Human
uucgaugaaggcugcc

SEQ ID NO: 2789716 - RNA, 20 nt, Human
uucgauacaccgggccugga

SEQ ID NO: 2789717 - RNA, 17 nt, Human
uucgaggacuacaacca

SEQ ID NO: 2789718 - RNA, 20 nt, Human
uucgauaaacaacaaggugg

SEQ ID NO: 2789719 - RNA, 20 nt, Human
uucgcccgagcuguuuaugu

SEQ ID NO: 2789720 - RNA, 23 nt, Human
uucgcauggucacacacugaugc

SEQ ID NO: 2789721 - RNA, 21 nt, Human
uucgcauggucacacacugau

SEQ ID NO: 2789722 - RNA, 20 nt, Human
uucgcauggucacacacuga

SEQ ID NO: 2789723 - RNA, 19 nt, Human
uucgcauggucacacacug

SEQ ID NO: 2789724 - RNA, 18 nt, Human
uucgcauggucacacacu

SEQ ID NO: 2789725 - RNA, 17 nt, Human
uucgcauggucacacac

SEQ ID NO: 2789726 - RNA, 16 nt, Human
uucgcauggucacaca

SEQ ID NO: 2789727 - RNA, 14 nt, Human
uucgcauggucaca

SEQ ID NO: 2789728 - RNA, 17 nt, Human
uucgcagcugaagugga

SEQ ID NO: 2789729 - RNA, 17 nt, Human
uucuaaggccuaggauu

SEQ ID NO: 2789730 - RNA, 23 nt, Human
uucuaaggaccugaaauuccaaa

SEQ ID NO: 2789731 - RNA, 15 nt, Human
uucuaaggccuagga

SEQ ID NO: 2789732 - RNA, 21 nt, Human
uucuagaauuuaucacacuuc

SEQ ID NO: 2789733 - RNA, 15 nt, Human
uucuagaauuuauca

SEQ ID NO: 2789734 - RNA, 18 nt, Human
uucuagaaguuucccuuc

SEQ ID NO: 2789735 - RNA, 20 nt, Human
uucuagaaguuucccuuccu

SEQ ID NO: 2789736 - RNA, 21 nt, Human
uucuagaaguuucccuuccuc

SEQ ID NO: 2789737 - RNA, 22 nt, Human
uucuagaauuauaagucacaaa

SEQ ID NO: 2789738 - RNA, 20 nt, Human
uucuagacauggagguucua

SEQ ID NO: 2789739 - RNA, 22 nt, Human
uucuagacauggagguucuaag

SEQ ID NO: 2789740 - RNA, 23 nt, Human
uucuagacauggagguucuaagg

SEQ ID NO: 2789741 - RNA, 15 nt, Human
uucuagacuuucugu

SEQ ID NO: 2789742 - RNA, 20 nt, Human
uucuaguggucuuuguaaga

SEQ ID NO: 2789743 - RNA, 21 nt, Human
uucuaguggucuuuguaagag

SEQ ID NO: 2789744 - RNA, 15 nt, Human
uucuaguggucuuug

SEQ ID NO: 2789745 - RNA, 17 nt, Human
uucuaguggucuuugua

SEQ ID NO: 2789746 - RNA, 18 nt, Human
uucuaguggucuuuguaa

SEQ ID NO: 2789747 - RNA, 19 nt, Human
uucuaguggucuuuguaag

SEQ ID NO: 2789748 - RNA, 19 nt, Human
uucuaguacacuuuuauga

SEQ ID NO: 2789749 - RNA, 16 nt, Human
uucuagaucagaugcu

SEQ ID NO: 2789750 - RNA, 22 nt, Human
uucuagaucagaugcuccaaga

SEQ ID NO: 2789751 - RNA, 21 nt, Human
uucuagguuucaaagaugcug

SEQ ID NO: 2789752 - RNA, 14 nt, Human
uucuagaguucaga

SEQ ID NO: 2789753 - RNA, 19 nt, Human
uucuagaguucagaguccu

SEQ ID NO: 2789754 - RNA, 22 nt, Human
uucuaguggucuuuguaagagu

SEQ ID NO: 2789755 - RNA, 19 nt, Human
uucucagauccuuguuuca

SEQ ID NO: 2789756 - RNA, 21 nt, Human
uucucagauggauugauaauu

SEQ ID NO: 2789757 - RNA, 15 nt, Human
uucucagauccuugu

SEQ ID NO: 2789758 - RNA, 13 nt, Human
uucucagcuccca

SEQ ID NO: 2789759 - RNA, 13 nt, Human
aucagaaaaggga

SEQ ID NO: 2789760 - RNA, 15 nt, Human
aucagaaaagggaag

SEQ ID NO: 2789761 - RNA, 15 nt, Human
aucacuuuuugaacu

SEQ ID NO: 2789762 - RNA, 16 nt, Human
aucacuuuuugaacua

SEQ ID NO: 2789763 - RNA, 17 nt, Human
aucacuuuuugaacuaa

SEQ ID NO: 2789764 - RNA, 18 nt, Human
aucacuuuuugaacuaag

SEQ ID NO: 2789765 - RNA, 21 nt, Human
aucacuuuuugaacuaagaaa

SEQ ID NO: 2789766 - RNA, 22 nt, Human
aucacuuuuugaacuaagaaac

SEQ ID NO: 2789767 - RNA, 17 nt, Human
aucagaaaaauggagca

SEQ ID NO: 2789768 - RNA, 18 nt, Human
aucagaaaaauggagcaa

SEQ ID NO: 2789769 - RNA, 16 nt, Human
aucacuuugucuaacu

SEQ ID NO: 2789770 - RNA, 21 nt, Human
aucacuuugucuaacucagaa

SEQ ID NO: 2789771 - RNA, 13 nt, Human
aucacuuuucagu

SEQ ID NO: 2789772 - RNA, 14 nt, Human
aucacuuuucagug

SEQ ID NO: 2789773 - RNA, 15 nt, Human
aucacuuuucaguga

SEQ ID NO: 2789774 - RNA, 13 nt, Human
aucaggagaaaaa

SEQ ID NO: 2789775 - RNA, 22 nt, Human
aucaggagaaaaagccuccagu

SEQ ID NO: 2789776 - RNA, 18 nt, Human
aucagaauugaaacacuu

SEQ ID NO: 2789777 - RNA, 22 nt, Human
aucagaccuuggaucagaugaa

SEQ ID NO: 2789778 - RNA, 13 nt, Human
auccauaaaaaaa

SEQ ID NO: 2789779 - RNA, 23 nt, Human
auccauuugcguuccaugaugcu

SEQ ID NO: 2789780 - RNA, 22 nt, Human
aucccacauccaacuccagcaa

SEQ ID NO: 2789781 - RNA, 13 nt, Human
aucccacauccaa

SEQ ID NO: 2789782 - RNA, 14 nt, Human
aucccacccacaug

SEQ ID NO: 2789783 - RNA, 15 nt, Human
aucccaccaacccuc

SEQ ID NO: 2789784 - RNA, 15 nt, Human
aucccaagugccagu

SEQ ID NO: 2789785 - RNA, 16 nt, Human
aucccaaucauuguug

SEQ ID NO: 2789786 - RNA, 17 nt, Human
aucccaaucauuguugc

SEQ ID NO: 2789787 - RNA, 12 nt, Human
aucccacacagg

SEQ ID NO: 2789788 - RNA, 14 nt, Human
aucccacacccugg

SEQ ID NO: 2789789 - RNA, 16 nt, Human
auccaaucucaaggaa

SEQ ID NO: 2789790 - RNA, 16 nt, Human
auccaaucagagacca

SEQ ID NO: 2789791 - RNA, 17 nt, Human
auccaaucagagaccag

SEQ ID NO: 2789792 - RNA, 22 nt, Human
auccaaucagagaccaggcccu

SEQ ID NO: 2789793 - RNA, 16 nt, Human
auccaaaaguggaagu

SEQ ID NO: 2789794 - RNA, 14 nt, Human
auccaaaaugugua

SEQ ID NO: 2789795 - RNA, 17 nt, Human
auccaaaauguguauuu

SEQ ID NO: 2789796 - RNA, 19 nt, Human
auccaaaauguguauuucu

SEQ ID NO: 2789797 - RNA, 23 nt, Human
auccaaaauguguauuucuuaua

SEQ ID NO: 2789798 - RNA, 13 nt, Human
auccaaacaauuu

SEQ ID NO: 2789799 - RNA, 18 nt, Human
auccaaacaauuuaaaaa

SEQ ID NO: 2789800 - RNA, 20 nt, Human
auccaaacauguauuuaugu

SEQ ID NO: 2789801 - RNA, 21 nt, Human
auccaaacauguauuuaugua

SEQ ID NO: 2789802 - RNA, 19 nt, Human
uucuguaaacucaaaacuu

SEQ ID NO: 2789803 - RNA, 20 nt, Human
uucuguaaacucaaaacuua

SEQ ID NO: 2789804 - RNA, 17 nt, Human
uucugguuuaaacuugu

SEQ ID NO: 2789805 - RNA, 22 nt, Human
uucugguuuaaacuuguuugcu

SEQ ID NO: 2789806 - RNA, 22 nt, Human
uucugguugaugccugugaacu

SEQ ID NO: 2789807 - RNA, 14 nt, Human
uucugguucuaaca

SEQ ID NO: 2789808 - RNA, 12 nt, Human
uucugguucuaa

SEQ ID NO: 2789809 - RNA, 14 nt, Human
uucuguagucauuu

SEQ ID NO: 2789810 - RNA, 15 nt, Human
uucuguagucauuua

SEQ ID NO: 2789811 - RNA, 20 nt, Human
uucuguagucauuuacuaaa

SEQ ID NO: 2789812 - RNA, 22 nt, Human
uucuguagucauuuacuaaaca

SEQ ID NO: 2789813 - RNA, 13 nt, Human
uucuguagauucu

SEQ ID NO: 2789814 - RNA, 16 nt, Human
uucuguagguuaaaaa

SEQ ID NO: 2789815 - RNA, 23 nt, Human
uucuguaaacucaaaacuuaaca

SEQ ID NO: 2789816 - RNA, 16 nt, Human
uucuguagguucugug

SEQ ID NO: 2789817 - RNA, 20 nt, Human
uucuguagagccuucugaug

SEQ ID NO: 2789818 - RNA, 14 nt, Human
aucauuuuuguauc

SEQ ID NO: 2789819 - RNA, 23 nt, Human
uucugcccugugggaccccaggc

SEQ ID NO: 2789820 - RNA, 22 nt, Human
uucugccgaccccuaguucccu

SEQ ID NO: 2789821 - RNA, 10 nt, Human
uucuggcuca

SEQ ID NO: 2789822 - RNA, 16 nt, Human
uucuggcucucccauu

SEQ ID NO: 2789823 - RNA, 14 nt, Human
uucuggcucccucu

SEQ ID NO: 2789824 - RNA, 22 nt, Human
uucuggcucucccauuuccuga

SEQ ID NO: 2789825 - RNA, 17 nt, Human
uucugguguguuaacau

SEQ ID NO: 2789826 - RNA, 16 nt, Human
uucucuaauaagaaaa

SEQ ID NO: 2789827 - RNA, 15 nt, Human
uucucuaaucgaaag

SEQ ID NO: 2789828 - RNA, 13 nt, Human
uucucuuucaaag

SEQ ID NO: 2789829 - RNA, 23 nt, Human
uucucuuguauaagauccuagau

SEQ ID NO: 2789830 - RNA, 16 nt, Human
uucucuuuucaaaaca

SEQ ID NO: 2789831 - RNA, 14 nt, Human
uucucuuucucucu

SEQ ID NO: 2789832 - RNA, 17 nt, Human
uucucuuucucucuucc

SEQ ID NO: 2789833 - RNA, 14 nt, Human
uucucuuucuuccu

SEQ ID NO: 2789834 - RNA, 11 nt, Human
uucucuuucuc

SEQ ID NO: 2789835 - RNA, 13 nt, Human
uucucuuucucuc

SEQ ID NO: 2789836 - RNA, 22 nt, Human
uucucuuuguggggcuuggcgu

SEQ ID NO: 2789837 - RNA, 19 nt, Human
uucugacaaaaaguuucca

SEQ ID NO: 2789838 - RNA, 15 nt, Human
uucucuuuucuaaaa

SEQ ID NO: 2789839 - RNA, 22 nt, Human
uucugacaaaaaguuuccauau

SEQ ID NO: 2789840 - RNA, 14 nt, Human
uucugacaaacugu

SEQ ID NO: 2789841 - RNA, 15 nt, Human
uucugacaaacugug

SEQ ID NO: 2789842 - RNA, 20 nt, Human
uucugacaaacuguguacau

SEQ ID NO: 2789843 - RNA, 18 nt, Human
uucugacaguuuuucugu

SEQ ID NO: 2789844 - RNA, 21 nt, Human
uucugacaguuuuucuguuuu

SEQ ID NO: 2789845 - RNA, 22 nt, Human
uucugcaagcacaucugcauuu

SEQ ID NO: 2789846 - RNA, 15 nt, Human
uucugcacacagcac

SEQ ID NO: 2789847 - RNA, 12 nt, Human
uucugcagaaga

SEQ ID NO: 2789848 - RNA, 15 nt, Human
uucugcagaagagga

SEQ ID NO: 2789849 - RNA, 20 nt, Human
uucugcagacacgccuuccc

SEQ ID NO: 2789850 - RNA, 12 nt, Human
uucugcacugaa

SEQ ID NO: 2789851 - RNA, 13 nt, Human
uucugcacugaaa

SEQ ID NO: 2789852 - RNA, 14 nt, Human
uucugcacugaaaa

SEQ ID NO: 2789853 - RNA, 15 nt, Human
uucugcacugaaaag

SEQ ID NO: 2789854 - RNA, 19 nt, Human
aucauugcuuccuccuccc

SEQ ID NO: 2789855 - RNA, 14 nt, Human
aucauugcugucug

SEQ ID NO: 2789856 - RNA, 16 nt, Human
aucauugcugucugca

SEQ ID NO: 2789857 - RNA, 21 nt, Human
aucauugcugucugcagccuu

SEQ ID NO: 2789858 - RNA, 22 nt, Human
aucauugcugucugcagccuug

SEQ ID NO: 2789859 - RNA, 14 nt, Human
aucaggcacagguc

SEQ ID NO: 2789860 - RNA, 15 nt, Human
aucaggcacagguca

SEQ ID NO: 2789861 - RNA, 17 nt, Human
aucaggcacaggucagg

SEQ ID NO: 2789862 - RNA, 18 nt, Human
aucauuguuuugaauauu

SEQ ID NO: 2789863 - RNA, 23 nt, Human
aucauugcuuugaagcaguugug

SEQ ID NO: 2789864 - RNA, 19 nt, Human
aucauuggaacaacugaua

SEQ ID NO: 2789865 - RNA, 20 nt, Human
aucauuggaacaacugauac

SEQ ID NO: 2789866 - RNA, 15 nt, Human
aucauuucucacugu

SEQ ID NO: 2789867 - RNA, 13 nt, Human
uucuccucccagg

SEQ ID NO: 2789868 - RNA, 22 nt, Human
aucauuuauuuuuuacauuauu

SEQ ID NO: 2789869 - RNA, 19 nt, Human
aucauuuauuuuuuacauu

SEQ ID NO: 2789870 - RNA, 15 nt, Human
aucauuuauuggaug

SEQ ID NO: 2789871 - RNA, 17 nt, Human
aucauuuauuuuaagca

SEQ ID NO: 2789872 - RNA, 21 nt, Human
aucauuuauuuuaagcacucu

SEQ ID NO: 2789873 - RNA, 18 nt, Human
aucauugcuuugaagcag

SEQ ID NO: 2789874 - RNA, 11 nt, Human
uucuccucccc

SEQ ID NO: 2789875 - RNA, 21 nt, Human
uucucuaacuucaaggcccau

SEQ ID NO: 2789876 - RNA, 14 nt, Human
uucuccugccucag

SEQ ID NO: 2789877 - RNA, 13 nt, Human
uucuccugccuca

SEQ ID NO: 2789878 - RNA, 12 nt, Human
uucuccugccuc

SEQ ID NO: 2789879 - RNA, 14 nt, Human
uugaacacaaacug

SEQ ID NO: 2789880 - RNA, 18 nt, Human
uugaacacaaacuguaaa

SEQ ID NO: 2789881 - RNA, 15 nt, Human
uugaacacaaacugu

SEQ ID NO: 2789882 - RNA, 19 nt, Human
uugaaaucaaugcaagagu

SEQ ID NO: 2789883 - RNA, 12 nt, Human
uugaaauuuuaa

SEQ ID NO: 2789884 - RNA, 15 nt, Human
uugaaauuuugcaaa

SEQ ID NO: 2789885 - RNA, 17 nt, Human
uugaaauuuugcaaaua

SEQ ID NO: 2789886 - RNA, 18 nt, Human
uugaaauuuugcaaauau

SEQ ID NO: 2789887 - RNA, 19 nt, Human
uugaaauuuugcaaauaua

SEQ ID NO: 2789888 - RNA, 20 nt, Human
uugaaauuuugcaaauauaa

SEQ ID NO: 2789889 - RNA, 22 nt, Human
uugaaauuuugcaaauauaaac

SEQ ID NO: 2789890 - RNA, 13 nt, Human
uugaaaugaaauu

SEQ ID NO: 2789891 - RNA, 14 nt, Human
uugaaaugaaauuu

SEQ ID NO: 2789892 - RNA, 19 nt, Human
uugaaaugaaauuuaaaca

SEQ ID NO: 2789893 - RNA, 20 nt, Human
uugaaaugaaauuuaaacau

SEQ ID NO: 2789894 - RNA, 21 nt, Human
uugaaaugaaauuuaaacauu

SEQ ID NO: 2789895 - RNA, 18 nt, Human
uugaaaugaggucuguuu

SEQ ID NO: 2789896 - RNA, 19 nt, Human
uugaaaugaggucuguuua

SEQ ID NO: 2789897 - RNA, 20 nt, Human
uugaaaugaggucuguuuaa

SEQ ID NO: 2789898 - RNA, 21 nt, Human
uugaaaugaggucuguuuaaa

SEQ ID NO: 2789899 - RNA, 13 nt, Human
uugaaaucuuuua

SEQ ID NO: 2789900 - RNA, 17 nt, Human
uugaaaguuuucagaac

SEQ ID NO: 2789901 - RNA, 13 nt, Human
uugaaauaccuca

SEQ ID NO: 2789902 - RNA, 14 nt, Human
uugaaauaccucau

SEQ ID NO: 2789903 - RNA, 17 nt, Human
uugaaauaccucauguu

SEQ ID NO: 2789904 - RNA, 18 nt, Human
uugaaauaccucauguuu

SEQ ID NO: 2789905 - RNA, 20 nt, Human
uugaaauaccucauguuuau

SEQ ID NO: 2789906 - RNA, 22 nt, Human
uugaaauaccucauguuuauga

SEQ ID NO: 2789907 - RNA, 12 nt, Human
uucuuuuucuga

SEQ ID NO: 2789908 - RNA, 16 nt, Human
uugaaaguuuacagga

SEQ ID NO: 2789909 - RNA, 16 nt, Human
uucuuuuuauuuucuu

SEQ ID NO: 2789910 - RNA, 16 nt, Human
uucuuuuuaaaauggu

SEQ ID NO: 2789911 - RNA, 20 nt, Human
uucuuuuuaaaauggugcuu

SEQ ID NO: 2789912 - RNA, 12 nt, Human
uucuuuuguuac

SEQ ID NO: 2789913 - RNA, 13 nt, Human
uucuuuuguuacu

SEQ ID NO: 2789914 - RNA, 14 nt, Human
uucuuuuguuacug

SEQ ID NO: 2789915 - RNA, 15 nt, Human
uucuuuuguuacugu

SEQ ID NO: 2789916 - RNA, 16 nt, Human
uucuuuuguuacuguu

SEQ ID NO: 2789917 - RNA, 17 nt, Human
uucuuuuguuacuguuc

SEQ ID NO: 2789918 - RNA, 18 nt, Human
uucuuuuguuacuguucu

SEQ ID NO: 2789919 - RNA, 19 nt, Human
uucuuuuguuacuguucuu

SEQ ID NO: 2789920 - RNA, 21 nt, Human
uucuuuuguuacuguucuugc

SEQ ID NO: 2789921 - RNA, 23 nt, Human
uucuuuuguuacuguucuugcug

SEQ ID NO: 2789922 - RNA, 15 nt, Human
uucuuuuuauugaau

SEQ ID NO: 2789923 - RNA, 15 nt, Human
uucuuuuuauuuucu

SEQ ID NO: 2789924 - RNA, 21 nt, Human
uucuuuuuaaguaauguggaa

SEQ ID NO: 2789925 - RNA, 13 nt, Human
uucuuuuuacaua

SEQ ID NO: 2789926 - RNA, 14 nt, Human
uucuuuuuacauaa

SEQ ID NO: 2789927 - RNA, 16 nt, Human
uucuuuuuacauaacu

SEQ ID NO: 2789928 - RNA, 18 nt, Human
uucuuuuuacauaacugc

SEQ ID NO: 2789929 - RNA, 23 nt, Human
uucuuuuuacauaacugccuuga

SEQ ID NO: 2789930 - RNA, 12 nt, Human
uucuuuuaucac

SEQ ID NO: 2789931 - RNA, 15 nt, Human
uucuuuuauuuguua

SEQ ID NO: 2789932 - RNA, 12 nt, Human
auccuaaugaau

SEQ ID NO: 2789933 - RNA, 13 nt, Human
auccuaaugaaug

SEQ ID NO: 2789934 - RNA, 22 nt, Human
auccuaagggucgaaagcucua

SEQ ID NO: 2789935 - RNA, 23 nt, Human
auccuaagggucgaaagcucuag

SEQ ID NO: 2789936 - RNA, 19 nt, Human
auccuaaugaaugcauaaa

SEQ ID NO: 2789937 - RNA, 11 nt, Human
uugaacacugg

SEQ ID NO: 2789938 - RNA, 20 nt, Human
uugaacacuggcuaaagaua

SEQ ID NO: 2789939 - RNA, 15 nt, Human
uugaaccaaaccucc

SEQ ID NO: 2789940 - RNA, 17 nt, Human
uugaacaaaaucuguug

SEQ ID NO: 2789941 - RNA, 21 nt, Human
uugaacacaaacuguaaauaa

SEQ ID NO: 2789942 - RNA, 20 nt, Human
uugaacacaaacuguaaaua

SEQ ID NO: 2789943 - RNA, 18 nt, Human
auccuaagggucgaaagc

SEQ ID NO: 2789944 - RNA, 19 nt, Human
auccuaagggucgaaagcu

SEQ ID NO: 2789945 - RNA, 21 nt, Human
auccuaagggucgaaagcucu

SEQ ID NO: 2789946 - RNA, 17 nt, Human
uugaacccaggaguuca

SEQ ID NO: 2789947 - RNA, 15 nt, Human
uugaaccauccacuu

SEQ ID NO: 2789948 - RNA, 16 nt, Human
uugaaccauccacuua

SEQ ID NO: 2789949 - RNA, 21 nt, Human
uugaaccauccacuuacauau

SEQ ID NO: 2789950 - RNA, 19 nt, Human
uucuuggcaaaagccuugu

SEQ ID NO: 2789951 - RNA, 20 nt, Human
uucuuggcaaaagccuugug

SEQ ID NO: 2789952 - RNA, 22 nt, Human
uucuuggcaaaagccuugugua

SEQ ID NO: 2789953 - RNA, 23 nt, Human
uucuuggcaaaagccuuguguau

SEQ ID NO: 2789954 - RNA, 23 nt, Human
uucuugcugcuagaacuuuuuua

SEQ ID NO: 2789955 - RNA, 14 nt, Human
uucuugguaaaguc

SEQ ID NO: 2789956 - RNA, 21 nt, Human
uucuugguaaaguccuuuucu

SEQ ID NO: 2789957 - RNA, 20 nt, Human
uucuugcuuaccuugacugu

SEQ ID NO: 2789958 - RNA, 12 nt, Human
uucuugcuugua

SEQ ID NO: 2789959 - RNA, 13 nt, Human
uucuugcuuguac

SEQ ID NO: 2789960 - RNA, 22 nt, Human
uucuugcuuguaccucuggcug

SEQ ID NO: 2789961 - RNA, 23 nt, Human
uucuugcuuguaccucuggcuga

SEQ ID NO: 2789962 - RNA, 17 nt, Human
uucuuccuuuacuuucc

SEQ ID NO: 2789963 - RNA, 18 nt, Human
uucuuccuuuacuuuccc

SEQ ID NO: 2789964 - RNA, 13 nt, Human
uucuuccuuucuc

SEQ ID NO: 2789965 - RNA, 20 nt, Human
uucuugacaaaaccuaacuu

SEQ ID NO: 2789966 - RNA, 21 nt, Human
uucuugacaaaaccuaacuug

SEQ ID NO: 2789967 - RNA, 13 nt, Human
uucuuucuuccuc

SEQ ID NO: 2789968 - RNA, 15 nt, Human
uucuuucuuccucug

SEQ ID NO: 2789969 - RNA, 19 nt, Human
uucuuuuaacuucuuucua

SEQ ID NO: 2789970 - RNA, 20 nt, Human
uucuuuuaacuucuuucuau

SEQ ID NO: 2789971 - RNA, 21 nt, Human
uucuuuuaacuucuuucuauu

SEQ ID NO: 2789972 - RNA, 19 nt, Human
uucuuuguguagcuuugcu

SEQ ID NO: 2789973 - RNA, 11 nt, Human
uucuuuguguu

SEQ ID NO: 2789974 - RNA, 12 nt, Human
uucuuuguguag

SEQ ID NO: 2789975 - RNA, 12 nt, Human
uucuuuguauca

SEQ ID NO: 2789976 - RNA, 10 nt, Human
uucuuugugu

SEQ ID NO: 2789977 - RNA, 12 nt, Human
uucuuugaagaa

SEQ ID NO: 2789978 - RNA, 13 nt, Human
uucuuucuuuaaa

SEQ ID NO: 2789979 - RNA, 12 nt, Human
uucuuacaagga

SEQ ID NO: 2789980 - RNA, 12 nt, Human
uucuuacacaua

SEQ ID NO: 2789981 - RNA, 16 nt, Human
uucuuacacauacagu

SEQ ID NO: 2789982 - RNA, 22 nt, Human
uucuuacacgacuaaguugaau

SEQ ID NO: 2789983 - RNA, 18 nt, Human
uucuuacacugccuguau

SEQ ID NO: 2789984 - RNA, 21 nt, Human
uucuuacacugccuguauacu

SEQ ID NO: 2789985 - RNA, 13 nt, Human
uucuuacauaauu

SEQ ID NO: 2789986 - RNA, 11 nt, Human
uucuuccucug

SEQ ID NO: 2789987 - RNA, 12 nt, Human
uucuuccucugc

SEQ ID NO: 2789988 - RNA, 13 nt, Human
uucuuccucugcu

SEQ ID NO: 2789989 - RNA, 18 nt, Human
uucuuccuguuaauguau

SEQ ID NO: 2789990 - RNA, 9 nt, Human
uucuuccuu

SEQ ID NO: 2789991 - RNA, 13 nt, Human
uucuuaauuaauu

SEQ ID NO: 2789992 - RNA, 14 nt, Human
uucuuaauuaauuu

SEQ ID NO: 2789993 - RNA, 16 nt, Human
uucuuaauuaauuuga

SEQ ID NO: 2789994 - RNA, 22 nt, Human
uucuuaauuaauuugauuaaca

SEQ ID NO: 2789995 - RNA, 16 nt, Human
uucuguugcugccuca

SEQ ID NO: 2789996 - RNA, 15 nt, Human
uucuguugcugccuc

SEQ ID NO: 2789997 - RNA, 18 nt, Human
aucccaccuccaucccag

SEQ ID NO: 2789998 - RNA, 15 nt, Human
aucccacccacaugu

SEQ ID NO: 2789999 - RNA, 18 nt, Human
aucccacccacaugugac

SEQ ID NO: 2790000 - RNA, 20 nt, Human
aucccacccacaugugacac

SEQ ID NO: 2790001 - RNA, 23 nt, Human
aucccacccacaugugacacaua

SEQ ID NO: 2790002 - RNA, 16 nt, Human
uucuuaaaaugcaaua

SEQ ID NO: 2790003 - RNA, 18 nt, Human
uucuuaaaaugcaauauu

SEQ ID NO: 2790004 - RNA, 21 nt, Human
uucuuaaaaugcaauauuugu

SEQ ID NO: 2790005 - RNA, 22 nt, Human
uucuuaaaaugcaauauuugua

SEQ ID NO: 2790006 - RNA, 23 nt, Human
uucuuaaaaugcaauauuuguaa

SEQ ID NO: 2790007 - RNA, 17 nt, Human
uucuguugcugccucau

SEQ ID NO: 2790008 - RNA, 22 nt, Human
uucuguuggauuccaugcuaag

SEQ ID NO: 2790009 - RNA, 23 nt, Human
uucuguuuuguuuggcaaggaaa

SEQ ID NO: 2790010 - RNA, 15 nt, Human
uugugguuuuaugga

SEQ ID NO: 2790011 - RNA, 16 nt, Human
uugugguuuuauggag

SEQ ID NO: 2790012 - RNA, 17 nt, Human
uugugguuuucaaauug

SEQ ID NO: 2790013 - RNA, 21 nt, Human
uuguggugugaguaucagaau

SEQ ID NO: 2790014 - RNA, 22 nt, Human
uuguggugugaguaucagaauu

SEQ ID NO: 2790015 - RNA, 22 nt, Human
uugugguaggccuuuuaacauu

SEQ ID NO: 2790016 - RNA, 17 nt, Human
uugugugaccaacugug

SEQ ID NO: 2790017 - RNA, 18 nt, Human
uugugugaccaacugugu

SEQ ID NO: 2790018 - RNA, 19 nt, Human
uugugugaccaacuguguu

SEQ ID NO: 2790019 - RNA, 21 nt, Human
uugugugaccaacuguguugu

SEQ ID NO: 2790020 - RNA, 23 nt, Human
uugugugaccaacuguguuguau

SEQ ID NO: 2790021 - RNA, 11 nt, Human
uugugugaccc

SEQ ID NO: 2790022 - RNA, 13 nt, Human
uuguguguugucu

SEQ ID NO: 2790023 - RNA, 18 nt, Human
uuguguguuuauuucacu

SEQ ID NO: 2790024 - RNA, 15 nt, Human
uuguguguuccaagu

SEQ ID NO: 2790025 - RNA, 22 nt, Human
uuguguguuccaaguuuccaaa

SEQ ID NO: 2790026 - RNA, 14 nt, Human
uuguucucugucca

SEQ ID NO: 2790027 - RNA, 14 nt, Human
augagacuugccuu

SEQ ID NO: 2790028 - RNA, 16 nt, Human
augagacuugccuucc

SEQ ID NO: 2790029 - RNA, 18 nt, Human
augagacucuagggucca

SEQ ID NO: 2790030 - RNA, 17 nt, Human
augagacucuagggucc

SEQ ID NO: 2790031 - RNA, 21 nt, Human
uugugacuauauagagauguu

SEQ ID NO: 2790032 - RNA, 22 nt, Human
uugugacuauauagagauguuu

SEQ ID NO: 2790033 - RNA, 19 nt, Human
uugugacuauauagagaug

SEQ ID NO: 2790034 - RNA, 15 nt, Human
uugugacuauauaga

SEQ ID NO: 2790035 - RNA, 20 nt, Human
uugugaguaaaucagauguu

SEQ ID NO: 2790036 - RNA, 12 nt, Human
uuguggccucag

SEQ ID NO: 2790037 - RNA, 11 nt, Human
uuguggccuca

SEQ ID NO: 2790038 - RNA, 13 nt, Human
uugugauaauuua

SEQ ID NO: 2790039 - RNA, 14 nt, Human
uugugauaauuuaa

SEQ ID NO: 2790040 - RNA, 11 nt, Human
uuguggcagag

SEQ ID NO: 2790041 - RNA, 21 nt, Human
uuguggccugggccuccucac

SEQ ID NO: 2790042 - RNA, 13 nt, Human
uuguggccucaga

SEQ ID NO: 2790043 - RNA, 14 nt, Human
uuguggcugggggc

SEQ ID NO: 2790044 - RNA, 16 nt, Human
uugugggaauuuaaga

SEQ ID NO: 2790045 - RNA, 20 nt, Human
uugugggacuuauuacaauu

SEQ ID NO: 2790046 - RNA, 16 nt, Human
uugugggcauaaacug

SEQ ID NO: 2790047 - RNA, 18 nt, Human
uugugggcauaaacuguu

SEQ ID NO: 2790048 - RNA, 20 nt, Human
uuguggguucuauguuuacu

SEQ ID NO: 2790049 - RNA, 15 nt, Human
uuguggggacccagg

SEQ ID NO: 2790050 - RNA, 20 nt, Human
uuguggggacccaggcuccg

SEQ ID NO: 2790051 - RNA, 19 nt, Human
augauuaaauaagauucua

SEQ ID NO: 2790052 - RNA, 20 nt, Human
augauuaaauaagauucuaa

SEQ ID NO: 2790053 - RNA, 19 nt, Human
uuguugugacuuugacgcu

SEQ ID NO: 2790054 - RNA, 16 nt, Human
uuguugugaugucuuu

SEQ ID NO: 2790055 - RNA, 17 nt, Human
uuguuguauaauuucga

SEQ ID NO: 2790056 - RNA, 20 nt, Human
uuguuguauaauuucgagau

SEQ ID NO: 2790057 - RNA, 21 nt, Human
uuguuguaaagcaauaaaauu

SEQ ID NO: 2790058 - RNA, 13 nt, Human
uuguuguaaaaag

SEQ ID NO: 2790059 - RNA, 15 nt, Human
uuguuguaaaaagaa

SEQ ID NO: 2790060 - RNA, 16 nt, Human
uuguuguaaaaagaaa

SEQ ID NO: 2790061 - RNA, 17 nt, Human
uuguuguaaaaagaaaa

SEQ ID NO: 2790062 - RNA, 17 nt, Human
augauuucagcucacug

SEQ ID NO: 2790063 - RNA, 18 nt, Human
augauuucacuagaaaag

SEQ ID NO: 2790064 - RNA, 20 nt, Human
augauuucacuagaaaagcu

SEQ ID NO: 2790065 - RNA, 21 nt, Human
augauuucacuagaaaagcug

SEQ ID NO: 2790066 - RNA, 14 nt, Human
augauucagaaauu

SEQ ID NO: 2790067 - RNA, 15 nt, Human
augauucauguuaua

SEQ ID NO: 2790068 - RNA, 17 nt, Human
augauucagaaauugga

SEQ ID NO: 2790069 - RNA, 14 nt, Human
augauucaggugca

SEQ ID NO: 2790070 - RNA, 22 nt, Human
augauucaggugcagaggaagu

SEQ ID NO: 2790071 - RNA, 23 nt, Human
augauuagcagaagaaaggaaca

SEQ ID NO: 2790072 - RNA, 24 nt, Human
augauuaaauaagauucuaacggu

SEQ ID NO: 2790073 - RNA, 15 nt, Human
augauuauuuucauu

SEQ ID NO: 2790074 - RNA, 18 nt, Human
augauuauuuucauuaca

SEQ ID NO: 2790075 - RNA, 16 nt, Human
augcaaauagcaaaac

SEQ ID NO: 2790076 - RNA, 14 nt, Human
augcaaaggcuggg

SEQ ID NO: 2790077 - RNA, 14 nt, Human
augcaaaguucugu

SEQ ID NO: 2790078 - RNA, 17 nt, Human
augcaaaguucuguguu

SEQ ID NO: 2790079 - RNA, 21 nt, Human
augcaaaguucuguguuuaau

SEQ ID NO: 2790080 - RNA, 15 nt, Human
augcaaaggcuggga

SEQ ID NO: 2790081 - RNA, 14 nt, Human
augcaaaguacaau

SEQ ID NO: 2790082 - RNA, 15 nt, Human
augcaaaguacaaug

SEQ ID NO: 2790083 - RNA, 16 nt, Human
augcaaaguacaaugu

SEQ ID NO: 2790084 - RNA, 17 nt, Human
augcaaaguacaaugug

SEQ ID NO: 2790085 - RNA, 18 nt, Human
augcaaaguacaaugugu

SEQ ID NO: 2790086 - RNA, 19 nt, Human
augcaaaguacaauguguu

SEQ ID NO: 2790087 - RNA, 11 nt, Human
augauuuuuag

SEQ ID NO: 2790088 - RNA, 15 nt, Human
augauuuucauaacu

SEQ ID NO: 2790089 - RNA, 20 nt, Human
augauuuucauaacuuauug

SEQ ID NO: 2790090 - RNA, 22 nt, Human
augauuuucauaacuuauugcu

SEQ ID NO: 2790091 - RNA, 13 nt, Human
augcaaaggcugg

SEQ ID NO: 2790092 - RNA, 21 nt, Human
augauuuccuugaauguggcu

SEQ ID NO: 2790093 - RNA, 12 nt, Human
augauuugcaau

SEQ ID NO: 2790094 - RNA, 19 nt, Human
augauuucagcucacugca

SEQ ID NO: 2790095 - RNA, 20 nt, Human
augauuuccuugaauguggc

SEQ ID NO: 2790096 - RNA, 21 nt, Human
augauuucaugcuaucucugu

SEQ ID NO: 2790097 - RNA, 20 nt, Human
augauuucaugcuaucucug

SEQ ID NO: 2790098 - RNA, 13 nt, Human
augcaccagcccu

SEQ ID NO: 2790099 - RNA, 11 nt, Human
augcaccaaac

SEQ ID NO: 2790100 - RNA, 21 nt, Human
augcacauauggacucugcac

SEQ ID NO: 2790101 - RNA, 17 nt, Human
augcacauccauuccca

SEQ ID NO: 2790102 - RNA, 21 nt, Human
augcacauccauucccaagaa

SEQ ID NO: 2790103 - RNA, 19 nt, Human
augcacauauggacucugc

SEQ ID NO: 2790104 - RNA, 17 nt, Human
augauuuguaguggaaa

SEQ ID NO: 2790105 - RNA, 14 nt, Human
augcaccagcccuu

SEQ ID NO: 2790106 - RNA, 13 nt, Human
uuuaaauguauac

SEQ ID NO: 2790107 - RNA, 15 nt, Human
uuguuuuacugucuu

SEQ ID NO: 2790108 - RNA, 19 nt, Human
uuguuuuaucaugacaugu

SEQ ID NO: 2790109 - RNA, 15 nt, Human
uuuaaauguauacua

SEQ ID NO: 2790110 - RNA, 14 nt, Human
uuuaaauguauacu

SEQ ID NO: 2790111 - RNA, 12 nt, Human
uuuaaauucuga

SEQ ID NO: 2790112 - RNA, 14 nt, Human
uuuaaauucugaga

SEQ ID NO: 2790113 - RNA, 17 nt, Human
uuuaaauucugagacau

SEQ ID NO: 2790114 - RNA, 14 nt, Human
uuuaaauguguaca

SEQ ID NO: 2790115 - RNA, 17 nt, Human
uuuaaauguguacaaug

SEQ ID NO: 2790116 - RNA, 18 nt, Human
uuuaaauguguacaaugu

SEQ ID NO: 2790117 - RNA, 19 nt, Human
uuuaaauguguacaaugua

SEQ ID NO: 2790118 - RNA, 23 nt, Human
uuuaaauguguacaauguacaca

SEQ ID NO: 2790119 - RNA, 22 nt, Human
uuuaaauuauguuuuuauuaag

SEQ ID NO: 2790120 - RNA, 14 nt, Human
uuuaagagugaagu

SEQ ID NO: 2790121 - RNA, 14 nt, Human
uuuaagaggcaggg

SEQ ID NO: 2790122 - RNA, 12 nt, Human
uuuaagauuuuu

SEQ ID NO: 2790123 - RNA, 14 nt, Human
uuuaagauuuuucu

SEQ ID NO: 2790124 - RNA, 16 nt, Human
uuuaagauuuuucuca

SEQ ID NO: 2790125 - RNA, 18 nt, Human
uuuaagauuuuucucaaa

SEQ ID NO: 2790126 - RNA, 12 nt, Human
uuuaagcaaaua

SEQ ID NO: 2790127 - RNA, 16 nt, Human
uuuaagcaaauacuua

SEQ ID NO: 2790128 - RNA, 15 nt, Human
uuuaagcaacaucuu

SEQ ID NO: 2790129 - RNA, 17 nt, Human
uuuaagcaacaucuuuu

SEQ ID NO: 2790130 - RNA, 17 nt, Human
uuuaagauuuuucucaa

SEQ ID NO: 2790131 - RNA, 15 nt, Human
uuuaagcacucuuaa

SEQ ID NO: 2790132 - RNA, 20 nt, Human
uuuaagcacucuuaaagcaa

SEQ ID NO: 2790133 - RNA, 19 nt, Human
uuuaagccucauauuuaaa

SEQ ID NO: 2790134 - RNA, 21 nt, Human
uuuaagugcguguguagaguu

SEQ ID NO: 2790135 - RNA, 18 nt, Human
uuuaaugcauuaaaccug

SEQ ID NO: 2790136 - RNA, 19 nt, Human
uuuaaugcauuaaaccugu

SEQ ID NO: 2790137 - RNA, 20 nt, Human
uuuaaugcauuaaaccuguc

SEQ ID NO: 2790138 - RNA, 21 nt, Human
uuuaaugcauuaaaccugucu

SEQ ID NO: 2790139 - RNA, 14 nt, Human
uuuaauguaaagau

SEQ ID NO: 2790140 - RNA, 15 nt, Human
uuuaauguaaagauu

SEQ ID NO: 2790141 - RNA, 16 nt, Human
uuuaauguaaagauuu

SEQ ID NO: 2790142 - RNA, 16 nt, Human
uuuaauuccaauauga

SEQ ID NO: 2790143 - RNA, 12 nt, Human
uuuaaugcugcc

SEQ ID NO: 2790144 - RNA, 13 nt, Human
uuuaaugcugccu

SEQ ID NO: 2790145 - RNA, 14 nt, Human
uuuaaugcugccuu

SEQ ID NO: 2790146 - RNA, 17 nt, Human
uuuaaugcuucauucaa

SEQ ID NO: 2790147 - RNA, 19 nt, Human
uuuaaugcuucauucaaua

SEQ ID NO: 2790148 - RNA, 19 nt, Human
uuuaauggacacuuuucac

SEQ ID NO: 2790149 - RNA, 21 nt, Human
uuuaauggacacuuuucaccu

SEQ ID NO: 2790150 - RNA, 22 nt, Human
uuuaauggacuuauuucuucaa

SEQ ID NO: 2790151 - RNA, 17 nt, Human
uuuaauggauuguuaau

SEQ ID NO: 2790152 - RNA, 20 nt, Human
uuuaauggauuguuaauuuc

SEQ ID NO: 2790153 - RNA, 21 nt, Human
uuuaauggauuguuaauuuca

SEQ ID NO: 2790154 - RNA, 23 nt, Human
uuuaauggauuguuaauuucagu

SEQ ID NO: 2790155 - RNA, 17 nt, Human
uuuaauggcagcagaaa

SEQ ID NO: 2790156 - RNA, 19 nt, Human
uuuaauggcagcagaaaac

SEQ ID NO: 2790157 - RNA, 21 nt, Human
uuuaauggcagcagaaaacuu

SEQ ID NO: 2790158 - RNA, 23 nt, Human
uuuaaugccgauauacucuagau

SEQ ID NO: 2790159 - RNA, 21 nt, Human
uuuaauuccaauaugaugacu

SEQ ID NO: 2790160 - RNA, 12 nt, Human
uuuaauugucau

SEQ ID NO: 2790161 - RNA, 14 nt, Human
augccacguuccac

SEQ ID NO: 2790162 - RNA, 21 nt, Human
augccacguuccacaguugcc

SEQ ID NO: 2790163 - RNA, 14 nt, Human
augccacuccuccc

SEQ ID NO: 2790164 - RNA, 16 nt, Human
augccacuccucccuc

SEQ ID NO: 2790165 - RNA, 17 nt, Human
augccacuccucccucc

SEQ ID NO: 2790166 - RNA, 18 nt, Human
augccacuccucccuccg

SEQ ID NO: 2790167 - RNA, 15 nt, Human
augcccaccugccca

SEQ ID NO: 2790168 - RNA, 19 nt, Human
augcccaccugcccaucac

SEQ ID NO: 2790169 - RNA, 16 nt, Human
augcccaccugcccau

SEQ ID NO: 2790170 - RNA, 21 nt, Human
augcccaccugcccaucacag

SEQ ID NO: 2790171 - RNA, 17 nt, Human
augcccacguucuuucc

SEQ ID NO: 2790172 - RNA, 20 nt, Human
augcccaccugcccaucaca

SEQ ID NO: 2790173 - RNA, 23 nt, Human
augcccagagggcccaggcaggc

SEQ ID NO: 2790174 - RNA, 22 nt, Human
augcccagagggcccaggcagg

SEQ ID NO: 2790175 - RNA, 21 nt, Human
augcccagagggcccaggcag

SEQ ID NO: 2790176 - RNA, 20 nt, Human
augcccagagggcccaggca

SEQ ID NO: 2790177 - RNA, 21 nt, Human
augcccauuugccuuuaaaaa

SEQ ID NO: 2790178 - RNA, 14 nt, Human
augccccaaauaua

SEQ ID NO: 2790179 - RNA, 15 nt, Human
augccccaaauauag

SEQ ID NO: 2790180 - RNA, 15 nt, Human
augcaguuuuccuua

SEQ ID NO: 2790181 - RNA, 18 nt, Human
augcagggauugcugcca

SEQ ID NO: 2790182 - RNA, 20 nt, Human
augccaagagugcacccaug

SEQ ID NO: 2790183 - RNA, 16 nt, Human
augccaagcacugugc

SEQ ID NO: 2790184 - RNA, 17 nt, Human
augccaagcacugugcu

SEQ ID NO: 2790185 - RNA, 14 nt, Human
augccaacuugucc

SEQ ID NO: 2790186 - RNA, 22 nt, Human
augccaagaaaagggcugacau

SEQ ID NO: 2790187 - RNA, 21 nt, Human
augccaagcacugugcucagg

SEQ ID NO: 2790188 - RNA, 18 nt, Human
augccaagcacugugcuc

SEQ ID NO: 2790189 - RNA, 19 nt, Human
augccaagcacugugcuca

SEQ ID NO: 2790190 - RNA, 22 nt, Human
augccaaagcuaggguggcccu

SEQ ID NO: 2790191 - RNA, 18 nt, Human
augccaaagcuagggugg

SEQ ID NO: 2790192 - RNA, 21 nt, Human
augcauaaauaugcagugaua

SEQ ID NO: 2790193 - RNA, 14 nt, Human
augcauaaauaugc

SEQ ID NO: 2790194 - RNA, 15 nt, Human
augcauaaauaugca

SEQ ID NO: 2790195 - RNA, 16 nt, Human
augcauaaauaugcag

SEQ ID NO: 2790196 - RNA, 17 nt, Human
augcauaaauaugcagu

SEQ ID NO: 2790197 - RNA, 13 nt, Human
augccaacaagaa

SEQ ID NO: 2790198 - RNA, 15 nt, Human
augccaacaagaaug

SEQ ID NO: 2790199 - RNA, 16 nt, Human
augccaacaagaaugc

SEQ ID NO: 2790200 - RNA, 18 nt, Human
augccaacaagaaugcau

SEQ ID NO: 2790201 - RNA, 19 nt, Human
augccaacaagaaugcauu

SEQ ID NO: 2790202 - RNA, 20 nt, Human
augccaacaagaaugcauug

SEQ ID NO: 2790203 - RNA, 21 nt, Human
augccaacaagaaugcauuga

SEQ ID NO: 2790204 - RNA, 13 nt, Human
augccaaccagcu

SEQ ID NO: 2790205 - RNA, 23 nt, Human
augcagugauauggcagaagaca

SEQ ID NO: 2790206 - RNA, 18 nt, Human
augcagugauauggcaga

SEQ ID NO: 2790207 - RNA, 19 nt, Human
augcagugauauggcagaa

SEQ ID NO: 2790208 - RNA, 21 nt, Human
augcagugauauggcagaaga

SEQ ID NO: 2790209 - RNA, 22 nt, Human
augcagugauauggcagaagac

SEQ ID NO: 2790210 - RNA, 13 nt, Human
augcagucuccuc

SEQ ID NO: 2790211 - RNA, 15 nt, Human
augcagucuccucuu

SEQ ID NO: 2790212 - RNA, 16 nt, Human
augcagucuccucuuu

SEQ ID NO: 2790213 - RNA, 17 nt, Human
augcagucuccucuuua

SEQ ID NO: 2790214 - RNA, 18 nt, Human
augcagucuccucuuuaa

SEQ ID NO: 2790215 - RNA, 19 nt, Human
augcagucuccucuuuaaa

SEQ ID NO: 2790216 - RNA, 20 nt, Human
augcagucuccucuuuaaaa

SEQ ID NO: 2790217 - RNA, 21 nt, Human
augcagucuccucuuuaaaac

SEQ ID NO: 2790218 - RNA, 23 nt, Human
augcagucuccucuuuaaaacaa

SEQ ID NO: 2790219 - RNA, 16 nt, Human
augcaguaaauuaucu

SEQ ID NO: 2790220 - RNA, 17 nt, Human
uuuaauuuuuuaaauaa

SEQ ID NO: 2790221 - RNA, 19 nt, Human
augcagggauugcugccac

SEQ ID NO: 2790222 - RNA, 20 nt, Human
augcagggauugcugccacu

SEQ ID NO: 2790223 - RNA, 22 nt, Human
augcagggauugcugccacuuu

SEQ ID NO: 2790224 - RNA, 19 nt, Human
augcagggccucacacggu

SEQ ID NO: 2790225 - RNA, 16 nt, Human
augcagggggcuccug

SEQ ID NO: 2790226 - RNA, 17 nt, Human
augcagggggcuccugg

SEQ ID NO: 2790227 - RNA, 21 nt, Human
augcaggucgcuacuggcaua

SEQ ID NO: 2790228 - RNA, 18 nt, Human
auggcuacuuugguuucu

SEQ ID NO: 2790229 - RNA, 22 nt, Human
auggcuacuuugguuucugucu

SEQ ID NO: 2790230 - RNA, 20 nt, Human
auggcgccaccagcucugcc

SEQ ID NO: 2790231 - RNA, 12 nt, Human
auggccuggcca

SEQ ID NO: 2790232 - RNA, 18 nt, Human
auggccuaugcacauaug

SEQ ID NO: 2790233 - RNA, 14 nt, Human
auggccucagcugc

SEQ ID NO: 2790234 - RNA, 23 nt, Human
auggcaaguuuugauaugaguau

SEQ ID NO: 2790235 - RNA, 13 nt, Human
auggccucagcug

SEQ ID NO: 2790236 - RNA, 20 nt, Human
auggccugccuugaagccac

SEQ ID NO: 2790237 - RNA, 19 nt, Human
auggccugccuugaagcca

SEQ ID NO: 2790238 - RNA, 18 nt, Human
auggcccuuccuccucca

SEQ ID NO: 2790239 - RNA, 21 nt, Human
auggcccuuccuccuccacca

SEQ ID NO: 2790240 - RNA, 20 nt, Human
auggccgcagggcugugcac

SEQ ID NO: 2790241 - RNA, 22 nt, Human
auggccagguggccacuccaga

SEQ ID NO: 2790242 - RNA, 18 nt, Human
auggccaggauccucucc

SEQ ID NO: 2790243 - RNA, 19 nt, Human
auggccaggauccucuccu

SEQ ID NO: 2790244 - RNA, 16 nt, Human
auggccagguggccac

SEQ ID NO: 2790245 - RNA, 22 nt, Human
auggccacaguagucuugauga

SEQ ID NO: 2790246 - RNA, 14 nt, Human
auggccacauuuaa

SEQ ID NO: 2790247 - RNA, 15 nt, Human
auggccacauuuaau

SEQ ID NO: 2790248 - RNA, 12 nt, Human
auggccacacug

SEQ ID NO: 2790249 - RNA, 18 nt, Human
auggccacacugugacac

SEQ ID NO: 2790250 - RNA, 21 nt, Human
auggccacacugugacacacu

SEQ ID NO: 2790251 - RNA, 22 nt, Human
auggccacacugugacacacua

SEQ ID NO: 2790252 - RNA, 23 nt, Human
auggccacacugugacacacuac

SEQ ID NO: 2790253 - RNA, 13 nt, Human
auggcauuugcag

SEQ ID NO: 2790254 - RNA, 14 nt, Human
auggcauuugcaga

SEQ ID NO: 2790255 - RNA, 17 nt, Human
auggcauuugcagauuu

SEQ ID NO: 2790256 - RNA, 19 nt, Human
auggcagaguuuguguguu

SEQ ID NO: 2790257 - RNA, 20 nt, Human
auggcagaguuuguguguug

SEQ ID NO: 2790258 - RNA, 22 nt, Human
auggcagaguuuguguguuguc

SEQ ID NO: 2790259 - RNA, 23 nt, Human
auggcagaguuuguguguugucu

SEQ ID NO: 2790260 - RNA, 14 nt, Human
auggauuuguuaca

SEQ ID NO: 2790261 - RNA, 17 nt, Human
auggauuuguuacagcc

SEQ ID NO: 2790262 - RNA, 21 nt, Human
auggacuaaccccaacgcaca

SEQ ID NO: 2790263 - RNA, 20 nt, Human
auggauuucugucuucucua

SEQ ID NO: 2790264 - RNA, 17 nt, Human
auggauuugaugcuguu

SEQ ID NO: 2790265 - RNA, 19 nt, Human
auggauuugaugcuguuug

SEQ ID NO: 2790266 - RNA, 14 nt, Human
auggcaaaaauggc

SEQ ID NO: 2790267 - RNA, 21 nt, Human
auggcagaaaaaaugucugua

SEQ ID NO: 2790268 - RNA, 16 nt, Human
auggcagaagacacca

SEQ ID NO: 2790269 - RNA, 13 nt, Human
auggcagaagaca

SEQ ID NO: 2790270 - RNA, 22 nt, Human
auggcagaagacaccagagcag

SEQ ID NO: 2790271 - RNA, 24 nt, Human
auggcagaagacaccagagcagau

SEQ ID NO: 2790272 - RNA, 17 nt, Human
auggcagaagacaccag

SEQ ID NO: 2790273 - RNA, 19 nt, Human
auggcagaagacaccagag

SEQ ID NO: 2790274 - RNA, 20 nt, Human
auggcagaagacaccagagc

SEQ ID NO: 2790275 - RNA, 21 nt, Human
auggcagaagacaccagagca

SEQ ID NO: 2790276 - RNA, 23 nt, Human
auggcaagaaagcugguaaacua

SEQ ID NO: 2790277 - RNA, 19 nt, Human
auggcaaggacugcaggga

SEQ ID NO: 2790278 - RNA, 22 nt, Human
auggcacaaucucggcucacug

SEQ ID NO: 2790279 - RNA, 16 nt, Human
auggcaauuuuguaac

SEQ ID NO: 2790280 - RNA, 15 nt, Human
auggcaauuuuguaa

SEQ ID NO: 2790281 - RNA, 23 nt, Human
uuucauguugcacacccacucag

SEQ ID NO: 2790282 - RNA, 18 nt, Human
uuucauguuuugugacua

SEQ ID NO: 2790283 - RNA, 16 nt, Human
uuucauguuuugugac

SEQ ID NO: 2790284 - RNA, 17 nt, Human
uuucauguuuugugacu

SEQ ID NO: 2790285 - RNA, 16 nt, Human
uuucaugcuaucucug

SEQ ID NO: 2790286 - RNA, 19 nt, Human
uuucaugcuaucucugugu

SEQ ID NO: 2790287 - RNA, 17 nt, Human
uuucaugcucugcaaaa

SEQ ID NO: 2790288 - RNA, 19 nt, Human
uuucaugcucugcaaaagg

SEQ ID NO: 2790289 - RNA, 20 nt, Human
auggacggugcuccaggcag

SEQ ID NO: 2790290 - RNA, 21 nt, Human
auggacggugcuccaggcagg

SEQ ID NO: 2790291 - RNA, 22 nt, Human
auggacggugcuccaggcaggc

SEQ ID NO: 2790292 - RNA, 13 nt, Human
auggacagaauuu

SEQ ID NO: 2790293 - RNA, 18 nt, Human
auggacagggcaugccac

SEQ ID NO: 2790294 - RNA, 18 nt, Human
auggacaguucacacccu

SEQ ID NO: 2790295 - RNA, 19 nt, Human
auggacaguucacacccug

SEQ ID NO: 2790296 - RNA, 21 nt, Human
auggacaguucacacccugca

SEQ ID NO: 2790297 - RNA, 22 nt, Human
auggacaguucacacccugcaa

SEQ ID NO: 2790298 - RNA, 23 nt, Human
auggacaguucacacccugcaag

SEQ ID NO: 2790299 - RNA, 13 nt, Human
auggacauccugu

SEQ ID NO: 2790300 - RNA, 15 nt, Human
auggacauccuguau

SEQ ID NO: 2790301 - RNA, 20 nt, Human
auggacauccuguauaagca

SEQ ID NO: 2790302 - RNA, 22 nt, Human
auggacauccuguauaagcacu

SEQ ID NO: 2790303 - RNA, 23 nt, Human
auggacauccuguauaagcacug

SEQ ID NO: 2790304 - RNA, 22 nt, Human
uuucccauuugugccagaggaa

SEQ ID NO: 2790305 - RNA, 21 nt, Human
uuucccauuugugccagagga

SEQ ID NO: 2790306 - RNA, 19 nt, Human
uuuccccagcaucacuccc

SEQ ID NO: 2790307 - RNA, 17 nt, Human
uuuccccccacucuccc

SEQ ID NO: 2790308 - RNA, 13 nt, Human
uuuccccccacuc

SEQ ID NO: 2790309 - RNA, 12 nt, Human
uuuccccccacu

SEQ ID NO: 2790310 - RNA, 15 nt, Human
uuuccccauaacuca

SEQ ID NO: 2790311 - RNA, 17 nt, Human
uuucauguggcuguaga

SEQ ID NO: 2790312 - RNA, 11 nt, Human
uuuccccagcc

SEQ ID NO: 2790313 - RNA, 13 nt, Human
uuuccccagccca

SEQ ID NO: 2790314 - RNA, 20 nt, Human
uuucacugcuggcugccuua

SEQ ID NO: 2790315 - RNA, 22 nt, Human
uuucacugcuggcugccuuaga

SEQ ID NO: 2790316 - RNA, 14 nt, Human
uuucacugcuggcu

SEQ ID NO: 2790317 - RNA, 19 nt, Human
auggaagacaaaauguuuu

SEQ ID NO: 2790318 - RNA, 21 nt, Human
auggaaucccacuguaugauu

SEQ ID NO: 2790319 - RNA, 17 nt, Human
uuucacugcuggcugcc

SEQ ID NO: 2790320 - RNA, 18 nt, Human
uuucacugcuggcugccu

SEQ ID NO: 2790321 - RNA, 16 nt, Human
auggaagacacauuga

SEQ ID NO: 2790322 - RNA, 16 nt, Human
auggaauaacucugug

SEQ ID NO: 2790323 - RNA, 16 nt, Human
auggaaugcuguguua

SEQ ID NO: 2790324 - RNA, 23 nt, Human
uuucagaaccucuuccccagaaa

SEQ ID NO: 2790325 - RNA, 20 nt, Human
uuucagaaccucuuccccag

SEQ ID NO: 2790326 - RNA, 19 nt, Human
uuucagaaccucuucccca

SEQ ID NO: 2790327 - RNA, 18 nt, Human
uuucagaaccucuucccc

SEQ ID NO: 2790328 - RNA, 13 nt, Human
uuucauauucuuu

SEQ ID NO: 2790329 - RNA, 16 nt, Human
uuucauauucuuucaa

SEQ ID NO: 2790330 - RNA, 18 nt, Human
uuucauauucuuucaauu

SEQ ID NO: 2790331 - RNA, 12 nt, Human
uuucauauugug

SEQ ID NO: 2790332 - RNA, 14 nt, Human
uuucauauugugcc

SEQ ID NO: 2790333 - RNA, 15 nt, Human
uuucauauugugcca

SEQ ID NO: 2790334 - RNA, 14 nt, Human
uuucaucaugagga

SEQ ID NO: 2790335 - RNA, 16 nt, Human
augcuguacaucuauu

SEQ ID NO: 2790336 - RNA, 12 nt, Human
augcuguacauc

SEQ ID NO: 2790337 - RNA, 20 nt, Human
augcuucaaaguccacauua

SEQ ID NO: 2790338 - RNA, 22 nt, Human
auggaacucagcugucuguggc

SEQ ID NO: 2790339 - RNA, 23 nt, Human
auggaacucagcugucuguggcu

SEQ ID NO: 2790340 - RNA, 20 nt, Human
augcuguaacuuaaaauagg

SEQ ID NO: 2790341 - RNA, 18 nt, Human
auggaacuucuaauauau

SEQ ID NO: 2790342 - RNA, 19 nt, Human
auggaacuucuaauauauu

SEQ ID NO: 2790343 - RNA, 13 nt, Human
auggaagacacau

SEQ ID NO: 2790344 - RNA, 14 nt, Human
auggaagacacauu

SEQ ID NO: 2790345 - RNA, 19 nt, Human
augcuucauaugaggagga

SEQ ID NO: 2790346 - RNA, 19 nt, Human
augcuucaucauucccucu

SEQ ID NO: 2790347 - RNA, 20 nt, Human
augcuucaucauucccucuc

SEQ ID NO: 2790348 - RNA, 22 nt, Human
augcuucaucauucccucucau

SEQ ID NO: 2790349 - RNA, 23 nt, Human
augcuacugucucacugaaacau

SEQ ID NO: 2790350 - RNA, 12 nt, Human
uuuauuaccagu

SEQ ID NO: 2790351 - RNA, 14 nt, Human
uuuauuaccagugg

SEQ ID NO: 2790352 - RNA, 12 nt, Human
uuuauuaccccc

SEQ ID NO: 2790353 - RNA, 17 nt, Human
uuuauuacccccuccuu

SEQ ID NO: 2790354 - RNA, 23 nt, Human
uuuauuacccccuccuucagaca

SEQ ID NO: 2790355 - RNA, 19 nt, Human
augcuggaugucugccaau

SEQ ID NO: 2790356 - RNA, 17 nt, Human
augcuggaugucugcca

SEQ ID NO: 2790357 - RNA, 23 nt, Human
augcucugagaagaggagcccuc

SEQ ID NO: 2790358 - RNA, 17 nt, Human
augcucugcaaaaggag

SEQ ID NO: 2790359 - RNA, 14 nt, Human
augcucuccuuucc

SEQ ID NO: 2790360 - RNA, 17 nt, Human
augcucucucaaauugu

SEQ ID NO: 2790361 - RNA, 18 nt, Human
augcucucucaaauuguc

SEQ ID NO: 2790362 - RNA, 19 nt, Human
augcucucucaaauuguca

SEQ ID NO: 2790363 - RNA, 23 nt, Human
augcuggcauuugcaccuaccuc

SEQ ID NO: 2790364 - RNA, 14 nt, Human
augcuggccagccu

SEQ ID NO: 2790365 - RNA, 15 nt, Human
augcuggccagccug

SEQ ID NO: 2790366 - RNA, 17 nt, Human
augcuggccagccuggg

SEQ ID NO: 2790367 - RNA, 22 nt, Human
augcuggccagccuggggccug

SEQ ID NO: 2790368 - RNA, 23 nt, Human
augcuggccagccuggggccugg

SEQ ID NO: 2790369 - RNA, 22 nt, Human
augcuggaugucugccaauuuu

SEQ ID NO: 2790370 - RNA, 17 nt, Human
augcuggccuuugcucu

SEQ ID NO: 2790371 - RNA, 15 nt, Human
uuuauagugcacaaa

SEQ ID NO: 2790372 - RNA, 18 nt, Human
uuuauagugcacaaaaug

SEQ ID NO: 2790373 - RNA, 19 nt, Human
uuuauagugcacaaaauga

SEQ ID NO: 2790374 - RNA, 13 nt, Human
uuuauaguggaaa

SEQ ID NO: 2790375 - RNA, 16 nt, Human
uuuauaggugagaaaa

SEQ ID NO: 2790376 - RNA, 18 nt, Human
uuuauaggugagaaaaaa

SEQ ID NO: 2790377 - RNA, 17 nt, Human
uuuauaguuuguacaug

SEQ ID NO: 2790378 - RNA, 19 nt, Human
uuuauaguuuguacaugca

SEQ ID NO: 2790379 - RNA, 14 nt, Human
uuuauauaauaucu

SEQ ID NO: 2790380 - RNA, 17 nt, Human
uuuauauaauaucuaaa

SEQ ID NO: 2790381 - RNA, 22 nt, Human
uuuauauaauaucuaaaguuau

SEQ ID NO: 2790382 - RNA, 14 nt, Human
uuuauauaaaugua

SEQ ID NO: 2790383 - RNA, 16 nt, Human
uuuauauacaauaaug

SEQ ID NO: 2790384 - RNA, 20 nt, Human
uuuauauacaauaauggaaa

SEQ ID NO: 2790385 - RNA, 16 nt, Human
uuuaugugaucaauuu

SEQ ID NO: 2790386 - RNA, 18 nt, Human
uuuaugggcauugacaaa

SEQ ID NO: 2790387 - RNA, 18 nt, Human
uuuaugguccuaaaagca

SEQ ID NO: 2790388 - RNA, 21 nt, Human
uuuaugguccuaaaagcaaaa

SEQ ID NO: 2790389 - RNA, 23 nt, Human
uuuaugguccuaaaagcaaaaua

SEQ ID NO: 2790390 - RNA, 21 nt, Human
uuuauuaaaaugauuguaaaa

SEQ ID NO: 2790391 - RNA, 22 nt, Human
uuuauuaaaaugauuguaaaau

SEQ ID NO: 2790392 - RNA, 23 nt, Human
uuuauuaaaaugauuguaaaaua

SEQ ID NO: 2790393 - RNA, 14 nt, Human
uuuauuaaaaugau

SEQ ID NO: 2790394 - RNA, 23 nt, Human
uuuauguuugcacuugugauuau

SEQ ID NO: 2790395 - RNA, 14 nt, Human
uuuauguuugucuu

SEQ ID NO: 2790396 - RNA, 22 nt, Human
uuuauguuugucuuuuaaugcu

SEQ ID NO: 2790397 - RNA, 14 nt, Human
uuuauguuuagaua

SEQ ID NO: 2790398 - RNA, 12 nt, Human
uuuauguuugaa

SEQ ID NO: 2790399 - RNA, 13 nt, Human
uuuauguuugaau

SEQ ID NO: 2790400 - RNA, 14 nt, Human
uuuauguuugaaua

SEQ ID NO: 2790401 - RNA, 22 nt, Human
uuuaugugugaggagcugcugg

SEQ ID NO: 2790402 - RNA, 18 nt, Human
uuuaugugugaggagcug

SEQ ID NO: 2790403 - RNA, 17 nt, Human
uuuauguucauuuguuu

SEQ ID NO: 2790404 - RNA, 17 nt, Human
uuuauguguaguugucu

SEQ ID NO: 2790405 - RNA, 15 nt, Human
uuuauguuaaaagau

SEQ ID NO: 2790406 - RNA, 17 nt, Human
uuuauguuaaaagauuu

SEQ ID NO: 2790407 - RNA, 22 nt, Human
uuuagcaauuuaauauuuugca

SEQ ID NO: 2790408 - RNA, 23 nt, Human
uuuagcaauuuaauauuuugcac

SEQ ID NO: 2790409 - RNA, 19 nt, Human
uuuagauugaaaacuuuuc

SEQ ID NO: 2790410 - RNA, 19 nt, Human
uuuagauuuucugguucua

SEQ ID NO: 2790411 - RNA, 12 nt, Human
uuuagauuucaa

SEQ ID NO: 2790412 - RNA, 16 nt, Human
uuuagauuucaagaaa

SEQ ID NO: 2790413 - RNA, 20 nt, Human
uuuagauuucaagaaaaaau

SEQ ID NO: 2790414 - RNA, 22 nt, Human
uuuagauugaaaacuuuucuca

SEQ ID NO: 2790415 - RNA, 15 nt, Human
augccccagagcugu

SEQ ID NO: 2790416 - RNA, 19 nt, Human
augccccggccaccucugc

SEQ ID NO: 2790417 - RNA, 20 nt, Human
augccccggccaccucugcg

SEQ ID NO: 2790418 - RNA, 15 nt, Human
augccccggccaccu

SEQ ID NO: 2790419 - RNA, 16 nt, Human
augccccggccaccuc

SEQ ID NO: 2790420 - RNA, 17 nt, Human
augccccggccaccucu

SEQ ID NO: 2790421 - RNA, 18 nt, Human
augccccggccaccucug

SEQ ID NO: 2790422 - RNA, 17 nt, Human
uuuagaugaggaaauga

SEQ ID NO: 2790423 - RNA, 15 nt, Human
uuuaggaacuucaga

SEQ ID NO: 2790424 - RNA, 16 nt, Human
uuuaggaacuucagag

SEQ ID NO: 2790425 - RNA, 17 nt, Human
uuuaggaacuucagaga

SEQ ID NO: 2790426 - RNA, 13 nt, Human
uuuaggaaaauca

SEQ ID NO: 2790427 - RNA, 22 nt, Human
uuuaggaaaaucacuuugucua

SEQ ID NO: 2790428 - RNA, 15 nt, Human
uuuaguagagacagg

SEQ ID NO: 2790429 - RNA, 13 nt, Human
uuuaggaaguguu

SEQ ID NO: 2790430 - RNA, 22 nt, Human
uuuaggaaguugacuuauagua

SEQ ID NO: 2790431 - RNA, 18 nt, Human
uuuaggaauccuuuggug

SEQ ID NO: 2790432 - RNA, 21 nt, Human
uuuaggacacauuuagaugca

SEQ ID NO: 2790433 - RNA, 17 nt, Human
uuuauagcuauuacugu

SEQ ID NO: 2790434 - RNA, 20 nt, Human
uuuauagcuauuacugucug

SEQ ID NO: 2790435 - RNA, 13 nt, Human
uuuaguauucauu

SEQ ID NO: 2790436 - RNA, 15 nt, Human
uuuaguauucauucu

SEQ ID NO: 2790437 - RNA, 21 nt, Human
uuuaguauucauucugcauug

SEQ ID NO: 2790438 - RNA, 21 nt, Human
uuuaguauugaauacuuacau

SEQ ID NO: 2790439 - RNA, 20 nt, Human
uuuaguaugacgcugauaca

SEQ ID NO: 2790440 - RNA, 21 nt, Human
uuuaguaugacgcugauacau

SEQ ID NO: 2790441 - RNA, 13 nt, Human
uuuagucucuuua

SEQ ID NO: 2790442 - RNA, 14 nt, Human
uuuagucucuuuau

SEQ ID NO: 2790443 - RNA, 22 nt, Human
uuuaguaucaguguuuuaaauu

SEQ ID NO: 2790444 - RNA, 13 nt, Human
uugcccugggaaa

SEQ ID NO: 2790445 - RNA, 16 nt, Human
uugcccuggggaucaa

SEQ ID NO: 2790446 - RNA, 22 nt, Human
uugcauuaaauucacaaacuuu

SEQ ID NO: 2790447 - RNA, 16 nt, Human
uugcauuauucauuua

SEQ ID NO: 2790448 - RNA, 17 nt, Human
uugcauuauucauuuag

SEQ ID NO: 2790449 - RNA, 17 nt, Human
uugcauuccuuugucuu

SEQ ID NO: 2790450 - RNA, 12 nt, Human
uugcauucuauu

SEQ ID NO: 2790451 - RNA, 15 nt, Human
uugcauucuauugcc

SEQ ID NO: 2790452 - RNA, 16 nt, Human
uugcauucuauugccu

SEQ ID NO: 2790453 - RNA, 17 nt, Human
uugcauucuauugccuu

SEQ ID NO: 2790454 - RNA, 18 nt, Human
uugcauucuauugccuuc

SEQ ID NO: 2790455 - RNA, 19 nt, Human
uugcauucuauugccuucu

SEQ ID NO: 2790456 - RNA, 20 nt, Human
uugcauucuauugccuucuu

SEQ ID NO: 2790457 - RNA, 22 nt, Human
uugcauucuauugccuucuuug

SEQ ID NO: 2790458 - RNA, 21 nt, Human
uugcauuaaauucacaaacuu

SEQ ID NO: 2790459 - RNA, 20 nt, Human
uugcauuaaauucacaaacu

SEQ ID NO: 2790460 - RNA, 13 nt, Human
uugcauuaaauuc

SEQ ID NO: 2790461 - RNA, 21 nt, Human
uugccgcgucgcccucccagg

SEQ ID NO: 2790462 - RNA, 18 nt, Human
uugccgcgucgcccuccc

SEQ ID NO: 2790463 - RNA, 17 nt, Human
uugccgaggagccaggc

SEQ ID NO: 2790464 - RNA, 18 nt, Human
uugcccuuucuguaccau

SEQ ID NO: 2790465 - RNA, 23 nt, Human
uugcccugguuucacuggcccaa

SEQ ID NO: 2790466 - RNA, 22 nt, Human
uugccgcgucgcccucccaggc

SEQ ID NO: 2790467 - RNA, 20 nt, Human
uugcccuuucuguaccauuu

SEQ ID NO: 2790468 - RNA, 18 nt, Human
uugccuaaauuuaaugcu

SEQ ID NO: 2790469 - RNA, 22 nt, Human
uugccuaaauuuaaugcugccu

SEQ ID NO: 2790470 - RNA, 19 nt, Human
uugccuaagcauugccugg

SEQ ID NO: 2790471 - RNA, 20 nt, Human
uugccuaagcauugccuggc

SEQ ID NO: 2790472 - RNA, 14 nt, Human
uugccuaaguauua

SEQ ID NO: 2790473 - RNA, 19 nt, Human
uugccuaauaaacauccuu

SEQ ID NO: 2790474 - RNA, 16 nt, Human
uugccuaaguauuaaa

SEQ ID NO: 2790475 - RNA, 20 nt, Human
uugccuaaguauuaaaacau

SEQ ID NO: 2790476 - RNA, 16 nt, Human
aucugagcugagccag

SEQ ID NO: 2790477 - RNA, 17 nt, Human
aucugagcugagccagg

SEQ ID NO: 2790478 - RNA, 18 nt, Human
aucugagcugagccaggc

SEQ ID NO: 2790479 - RNA, 19 nt, Human
aucugagcugagccaggcu

SEQ ID NO: 2790480 - RNA, 15 nt, Human
aucugagccagugcu

SEQ ID NO: 2790481 - RNA, 23 nt, Human
uugccuaaguauuaaaacauugg

SEQ ID NO: 2790482 - RNA, 15 nt, Human
uugccuauccugcug

SEQ ID NO: 2790483 - RNA, 16 nt, Human
uugccuauccugcugu

SEQ ID NO: 2790484 - RNA, 20 nt, Human
uugccuauccugcuguucua

SEQ ID NO: 2790485 - RNA, 23 nt, Human
aucugaggcauccagcagucucu

SEQ ID NO: 2790486 - RNA, 20 nt, Human
aucugagguccugugaucuu

SEQ ID NO: 2790487 - RNA, 20 nt, Human
aucugcagggggugugucug

SEQ ID NO: 2790488 - RNA, 21 nt, Human
aucugcaauucaaaaguucca

SEQ ID NO: 2790489 - RNA, 12 nt, Human
aucugcacccuu

SEQ ID NO: 2790490 - RNA, 16 nt, Human
aucugcacccuucuuu

SEQ ID NO: 2790491 - RNA, 17 nt, Human
aucugcacccuucuuuu

SEQ ID NO: 2790492 - RNA, 19 nt, Human
aucugcacccuucuuuucu

SEQ ID NO: 2790493 - RNA, 20 nt, Human
aucugcacccuucuuuucuc

SEQ ID NO: 2790494 - RNA, 22 nt, Human
aucugcacccuucuuuucucau

SEQ ID NO: 2790495 - RNA, 13 nt, Human
aucugauuugcau

SEQ ID NO: 2790496 - RNA, 19 nt, Human
aucugauuugcauauucau

SEQ ID NO: 2790497 - RNA, 21 nt, Human
aucugauuugcauauucauuc

SEQ ID NO: 2790498 - RNA, 14 nt, Human
aucugauggcuucu

SEQ ID NO: 2790499 - RNA, 17 nt, Human
aucugauggcuucucca

SEQ ID NO: 2790500 - RNA, 18 nt, Human
aucugauggcuucuccag

SEQ ID NO: 2790501 - RNA, 18 nt, Human
aucugaugcaagcaagaa

SEQ ID NO: 2790502 - RNA, 17 nt, Human
aucugaucugagugaga

SEQ ID NO: 2790503 - RNA, 13 nt, Human
aucugaguugcca

SEQ ID NO: 2790504 - RNA, 14 nt, Human
aucugaguugccaa

SEQ ID NO: 2790505 - RNA, 16 nt, Human
aucugaguugccaaga

SEQ ID NO: 2790506 - RNA, 18 nt, Human
aucugaguugccaagaca

SEQ ID NO: 2790507 - RNA, 20 nt, Human
aucugaguugccaagacaaa

SEQ ID NO: 2790508 - RNA, 23 nt, Human
aucugaguugccaagacaaauca

SEQ ID NO: 2790509 - RNA, 23 nt, Human
aucugcauuuucaccccacccuu

SEQ ID NO: 2790510 - RNA, 22 nt, Human
aucugcauuuucaccccacccu

SEQ ID NO: 2790511 - RNA, 19 nt, Human
aucugcauuuucaccccac

SEQ ID NO: 2790512 - RNA, 16 nt, Human
aucugcauugcccagu

SEQ ID NO: 2790513 - RNA, 17 nt, Human
aucugcauugcccaguc

SEQ ID NO: 2790514 - RNA, 20 nt, Human
aucugcauugcccagucuuu

SEQ ID NO: 2790515 - RNA, 21 nt, Human
aucugcauugcccagucuuuc

SEQ ID NO: 2790516 - RNA, 22 nt, Human
aucugcauugcccagucuuuca

SEQ ID NO: 2790517 - RNA, 17 nt, Human
aucuggguucacugcaa

SEQ ID NO: 2790518 - RNA, 19 nt, Human
aucuggguucacugcaacc

SEQ ID NO: 2790519 - RNA, 23 nt, Human
aucuguacuugguccaacugcaa

SEQ ID NO: 2790520 - RNA, 23 nt, Human
aucuguacaaaggggaaagaaca

SEQ ID NO: 2790521 - RNA, 17 nt, Human
aucuggucccuugcagc

SEQ ID NO: 2790522 - RNA, 18 nt, Human
aucuggucuuguuagaaa

SEQ ID NO: 2790523 - RNA, 19 nt, Human
aucuggucuuguuagaaaa

SEQ ID NO: 2790524 - RNA, 11 nt, Human
aucuguaacag

SEQ ID NO: 2790525 - RNA, 20 nt, Human
aucuguaacagguauuuugu

SEQ ID NO: 2790526 - RNA, 23 nt, Human
aucuguaacagguauuuuguuuc

SEQ ID NO: 2790527 - RNA, 11 nt, Human
aucuguacauu

SEQ ID NO: 2790528 - RNA, 15 nt, Human
aucuguacauuuugu

SEQ ID NO: 2790529 - RNA, 16 nt, Human
aucuguacauuuuguu

SEQ ID NO: 2790530 - RNA, 20 nt, Human
aucuguacauuuuguuguaa

SEQ ID NO: 2790531 - RNA, 21 nt, Human
aucuguacauuuuguuguaaa

SEQ ID NO: 2790532 - RNA, 22 nt, Human
aucuguacauuuuguuguaaaa

SEQ ID NO: 2790533 - RNA, 23 nt, Human
aucuguacauuuuguuguaaaaa

SEQ ID NO: 2790534 - RNA, 19 nt, Human
aucuugcucugcugacaga

SEQ ID NO: 2790535 - RNA, 17 nt, Human
aucuugcucugcugaca

SEQ ID NO: 2790536 - RNA, 15 nt, Human
aucuuagauucucug

SEQ ID NO: 2790537 - RNA, 18 nt, Human
aucuuagauucucugugu

SEQ ID NO: 2790538 - RNA, 20 nt, Human
aucuuagauucucugugucu

SEQ ID NO: 2790539 - RNA, 22 nt, Human
aucuuagauucucugugucuaa

SEQ ID NO: 2790540 - RNA, 16 nt, Human
aucuugaggugguagu

SEQ ID NO: 2790541 - RNA, 22 nt, Human
aucuugaggugguaguaaaaca

SEQ ID NO: 2790542 - RNA, 19 nt, Human
aucuugaguauaagaaaug

SEQ ID NO: 2790543 - RNA, 22 nt, Human
aucuugaguauaagaaaugcau

SEQ ID NO: 2790544 - RNA, 23 nt, Human
aucuuagauucucugugucuaag

SEQ ID NO: 2790545 - RNA, 19 nt, Human
aucuuagcauagcuuauua

SEQ ID NO: 2790546 - RNA, 14 nt, Human
aucuguucuaacau

SEQ ID NO: 2790547 - RNA, 16 nt, Human
aucuguucuaacaugu

SEQ ID NO: 2790548 - RNA, 20 nt, Human
aucuguucugggcucuuucc

SEQ ID NO: 2790549 - RNA, 21 nt, Human
aucugugaaaugcuggcauuu

SEQ ID NO: 2790550 - RNA, 19 nt, Human
aucuguaaguaacuucaca

SEQ ID NO: 2790551 - RNA, 13 nt, Human
aucugugugaaaa

SEQ ID NO: 2790552 - RNA, 15 nt, Human
aucugugugaaaaug

SEQ ID NO: 2790553 - RNA, 17 nt, Human
aucugugugaaaauggg

SEQ ID NO: 2790554 - RNA, 13 nt, Human
aucuuagauucuc

SEQ ID NO: 2790555 - RNA, 21 nt, Human
aucugugaaguaguucuguuu

SEQ ID NO: 2790556 - RNA, 18 nt, Human
aucuuagauguuucacac

SEQ ID NO: 2790557 - RNA, 13 nt, Human
aucuuacagcugg

SEQ ID NO: 2790558 - RNA, 21 nt, Human
aucuuacaacaggcuuaugaa

SEQ ID NO: 2790559 - RNA, 22 nt, Human
aucuuacaacaggcuuaugaau

SEQ ID NO: 2790560 - RNA, 15 nt, Human
aucuguuguuuuguu

SEQ ID NO: 2790561 - RNA, 14 nt, Human
aucuguuuaaagca

SEQ ID NO: 2790562 - RNA, 17 nt, Human
aucuguuuaaagcauau

SEQ ID NO: 2790563 - RNA, 21 nt, Human
aucuguuuaaagcauauagag

SEQ ID NO: 2790564 - RNA, 22 nt, Human
aucuguuuaaagcauauagaga

SEQ ID NO: 2790565 - RNA, 24 nt, Human
aucuguuuaaagcauauagagaug

SEQ ID NO: 2790566 - RNA, 18 nt, Human
aucucaaugaagccagcu

SEQ ID NO: 2790567 - RNA, 20 nt, Human
uugaacacuuggugcuggga

SEQ ID NO: 2790568 - RNA, 13 nt, Human
aucucaauccugc

SEQ ID NO: 2790569 - RNA, 18 nt, Human
auccuauccacugggcac

SEQ ID NO: 2790570 - RNA, 19 nt, Human
auccuaucaacaacaaggu

SEQ ID NO: 2790571 - RNA, 15 nt, Human
auccuaguuuccucu

SEQ ID NO: 2790572 - RNA, 17 nt, Human
auccuaguuuccucucc

SEQ ID NO: 2790573 - RNA, 18 nt, Human
auccuaguuuccucuccu

SEQ ID NO: 2790574 - RNA, 13 nt, Human
auccuauauagaa

SEQ ID NO: 2790575 - RNA, 15 nt, Human
auccuauauagaaug

SEQ ID NO: 2790576 - RNA, 18 nt, Human
auccuauauagaaugcug

SEQ ID NO: 2790577 - RNA, 20 nt, Human
auccuauauagaaugcugca

SEQ ID NO: 2790578 - RNA, 23 nt, Human
aucucagcuuugagaagccuuca

SEQ ID NO: 2790579 - RNA, 22 nt, Human
aucucagucaugcauaaauaug

SEQ ID NO: 2790580 - RNA, 13 nt, Human
aucucagcuuuga

SEQ ID NO: 2790581 - RNA, 22 nt, Human
aucucagcuuugagaagccuuc

SEQ ID NO: 2790582 - RNA, 18 nt, Human
aucucaggagauuucaug

SEQ ID NO: 2790583 - RNA, 19 nt, Human
aucucagaucacugcaacc

SEQ ID NO: 2790584 - RNA, 18 nt, Human
aucucacuugugccaaca

SEQ ID NO: 2790585 - RNA, 22 nt, Human
aucucacuugugccaacacuca

SEQ ID NO: 2790586 - RNA, 13 nt, Human
aucucacuugugc

SEQ ID NO: 2790587 - RNA, 16 nt, Human
aucucacucugccccc

SEQ ID NO: 2790588 - RNA, 14 nt, Human
aucucacucugccc

SEQ ID NO: 2790589 - RNA, 12 nt, Human
aucucacucugc

SEQ ID NO: 2790590 - RNA, 11 nt, Human
aucucagccca

SEQ ID NO: 2790591 - RNA, 20 nt, Human
aucucagaucaguguaccau

SEQ ID NO: 2790592 - RNA, 17 nt, Human
aucucauagguugccaa

SEQ ID NO: 2790593 - RNA, 15 nt, Human
aucucauaccucuga

SEQ ID NO: 2790594 - RNA, 18 nt, Human
aucucauaccucugacca

SEQ ID NO: 2790595 - RNA, 23 nt, Human
aucucauagguugccaauaauac

SEQ ID NO: 2790596 - RNA, 16 nt, Human
aucucaucaacaaaga

SEQ ID NO: 2790597 - RNA, 19 nt, Human
aucucauagguugccaaua

SEQ ID NO: 2790598 - RNA, 15 nt, Human
aucuccacuccagau

SEQ ID NO: 2790599 - RNA, 15 nt, Human
aucuccaguauucuu

SEQ ID NO: 2790600 - RNA, 15 nt, Human
aucuccaucugucaa

SEQ ID NO: 2790601 - RNA, 18 nt, Human
aucuccaguauucuuguc

SEQ ID NO: 2790602 - RNA, 20 nt, Human
aucucccaagcuaucuaaag

SEQ ID NO: 2790603 - RNA, 23 nt, Human
uugauggugaugaaauguaaaua

SEQ ID NO: 2790604 - RNA, 13 nt, Human
aucucauuugguu

SEQ ID NO: 2790605 - RNA, 20 nt, Human
uugauguacugauugagaag

SEQ ID NO: 2790606 - RNA, 22 nt, Human
uugauguacugauugagaaguu

SEQ ID NO: 2790607 - RNA, 22 nt, Human
uugauguauccaacaagccaga

SEQ ID NO: 2790608 - RNA, 12 nt, Human
uugauguaucug

SEQ ID NO: 2790609 - RNA, 13 nt, Human
uugauguaucuga

SEQ ID NO: 2790610 - RNA, 15 nt, Human
uugauguaucugagu

SEQ ID NO: 2790611 - RNA, 20 nt, Human
uugauguaucugaguugcca

SEQ ID NO: 2790612 - RNA, 11 nt, Human
uugauguguuu

SEQ ID NO: 2790613 - RNA, 14 nt, Human
uugaugugacaaua

SEQ ID NO: 2790614 - RNA, 15 nt, Human
uugaugugacaauaa

SEQ ID NO: 2790615 - RNA, 19 nt, Human
uugaugugacaauaauauu

SEQ ID NO: 2790616 - RNA, 15 nt, Human
uugaugccaggacac

SEQ ID NO: 2790617 - RNA, 11 nt, Human
aucucuuccug

SEQ ID NO: 2790618 - RNA, 12 nt, Human
aucucuuccugu

SEQ ID NO: 2790619 - RNA, 19 nt, Human
aucucuuauuuuacaauaa

SEQ ID NO: 2790620 - RNA, 16 nt, Human
aucucuuauuuuacaa

SEQ ID NO: 2790621 - RNA, 19 nt, Human
aucucuucuggguuccuuc

SEQ ID NO: 2790622 - RNA, 19 nt, Human
uugcacaauauugaacuuu

SEQ ID NO: 2790623 - RNA, 20 nt, Human
uugcacaauauugaacuuuu

SEQ ID NO: 2790624 - RNA, 21 nt, Human
uugcacaauauugaacuuuuu

SEQ ID NO: 2790625 - RNA, 18 nt, Human
uugcacacacucagugca

SEQ ID NO: 2790626 - RNA, 18 nt, Human
uugcacaggaugcuggcc

SEQ ID NO: 2790627 - RNA, 16 nt, Human
uugcacaguuagcaaa

SEQ ID NO: 2790628 - RNA, 15 nt, Human
uugcacaucuuggcu

SEQ ID NO: 2790629 - RNA, 15 nt, Human
uugcacagaaguccu

SEQ ID NO: 2790630 - RNA, 17 nt, Human
uugcacagaaguccugu

SEQ ID NO: 2790631 - RNA, 18 nt, Human
uugcacagaaguccugua

SEQ ID NO: 2790632 - RNA, 21 nt, Human
uugcacagaaguccuguaugu

SEQ ID NO: 2790633 - RNA, 23 nt, Human
uugcacagaaguccuguaugucu

SEQ ID NO: 2790634 - RNA, 21 nt, Human
uugcacacccacucagcuccg

SEQ ID NO: 2790635 - RNA, 19 nt, Human
uugcacacccacucagcuc

SEQ ID NO: 2790636 - RNA, 15 nt, Human
uugcaucaguauuaa

SEQ ID NO: 2790637 - RNA, 21 nt, Human
uugcaucaguauuaauacuaa

SEQ ID NO: 2790638 - RNA, 23 nt, Human
uugcaucaguauuaauacuaaaa

SEQ ID NO: 2790639 - RNA, 15 nt, Human
uugcauccuuccuau

SEQ ID NO: 2790640 - RNA, 18 nt, Human
uugcauccuuccuauaac

SEQ ID NO: 2790641 - RNA, 21 nt, Human
uugcauccuuccuauaacuug

SEQ ID NO: 2790642 - RNA, 19 nt, Human
uugcaucguccccuccccc

SEQ ID NO: 2790643 - RNA, 18 nt, Human
uugcaucuagguaauuuu

SEQ ID NO: 2790644 - RNA, 20 nt, Human
uugcaucuagguaauuuuua

SEQ ID NO: 2790645 - RNA, 17 nt, Human
uugcaucucaaaauuau

SEQ ID NO: 2790646 - RNA, 18 nt, Human
uugcaucucaaaauuauu

SEQ ID NO: 2790647 - RNA, 12 nt, Human
uugcacauuguu

SEQ ID NO: 2790648 - RNA, 13 nt, Human
uugcacauuguuc

SEQ ID NO: 2790649 - RNA, 14 nt, Human
uugcacauuguuca

SEQ ID NO: 2790650 - RNA, 23 nt, Human
uugcacauuguuguuuuuuuaau

SEQ ID NO: 2790651 - RNA, 14 nt, Human
uugcacauuuugau

SEQ ID NO: 2790652 - RNA, 16 nt, Human
uugcacauuuugauuu

SEQ ID NO: 2790653 - RNA, 13 nt, Human
uugcauguuugaa

SEQ ID NO: 2790654 - RNA, 20 nt, Human
uugcaugugaaaaucaaaua

SEQ ID NO: 2790655 - RNA, 14 nt, Human
uugcaugugaaaau

SEQ ID NO: 2790656 - RNA, 14 nt, Human
uugcaucugaaaua

SEQ ID NO: 2790657 - RNA, 18 nt, Human
uugcauccaacuccagga

SEQ ID NO: 2790658 - RNA, 17 nt, Human
uugcaucugaaauagga

SEQ ID NO: 2790659 - RNA, 16 nt, Human
uugcaugaagagaagc

SEQ ID NO: 2790660 - RNA, 18 nt, Human
uugcaugaagagaagcaa

SEQ ID NO: 2790661 - RNA, 21 nt, Human
uugcaugaagagaagcaauuu

SEQ ID NO: 2790662 - RNA, 15 nt, Human
aucuuuuuaaagcuu

SEQ ID NO: 2790663 - RNA, 22 nt, Human
aucuuugccuugggcugcuccu

SEQ ID NO: 2790664 - RNA, 20 nt, Human
augaaagcagggaauuucua

SEQ ID NO: 2790665 - RNA, 21 nt, Human
augaaagcagggaauuucuau

SEQ ID NO: 2790666 - RNA, 16 nt, Human
augaaaggcuuuuaaa

SEQ ID NO: 2790667 - RNA, 18 nt, Human
aucuuugcagacaggcaa

SEQ ID NO: 2790668 - RNA, 15 nt, Human
aucuuuagugcuuuc

SEQ ID NO: 2790669 - RNA, 23 nt, Human
uuggcucuggagacagccccaga

SEQ ID NO: 2790670 - RNA, 13 nt, Human
aucuuugccuugg

SEQ ID NO: 2790671 - RNA, 13 nt, Human
aucuuugccucuc

SEQ ID NO: 2790672 - RNA, 20 nt, Human
aucuuugccuugggcugcuc

SEQ ID NO: 2790673 - RNA, 14 nt, Human
aucuuugccuuggg

SEQ ID NO: 2790674 - RNA, 21 nt, Human
aucuuuacaaaacuacaugag

SEQ ID NO: 2790675 - RNA, 17 nt, Human
aucuuuacaaaacuaca

SEQ ID NO: 2790676 - RNA, 16 nt, Human
uuggaguguuauguau

SEQ ID NO: 2790677 - RNA, 18 nt, Human
uuggaguguuauguauuu

SEQ ID NO: 2790678 - RNA, 15 nt, Human
uuggauguaauuuag

SEQ ID NO: 2790679 - RNA, 15 nt, Human
uuggauuauccugag

SEQ ID NO: 2790680 - RNA, 22 nt, Human
uuggauacagcaguagacauuu

SEQ ID NO: 2790681 - RNA, 16 nt, Human
uuggauaaacaacauu

SEQ ID NO: 2790682 - RNA, 16 nt, Human
uuggaucuugaaugug

SEQ ID NO: 2790683 - RNA, 17 nt, Human
uuggaucuugaaugugg

SEQ ID NO: 2790684 - RNA, 17 nt, Human
uuggauuauuuaauaac

SEQ ID NO: 2790685 - RNA, 14 nt, Human
uuggauuauuuaau

SEQ ID NO: 2790686 - RNA, 15 nt, Human
uuggauuauuuaaua

SEQ ID NO: 2790687 - RNA, 20 nt, Human
uuggcucuggagacagcccc

SEQ ID NO: 2790688 - RNA, 22 nt, Human
uuggcucuggagacagccccag

SEQ ID NO: 2790689 - RNA, 14 nt, Human
uuggcucuggagac

SEQ ID NO: 2790690 - RNA, 17 nt, Human
uuggcucuggagacagc

SEQ ID NO: 2790691 - RNA, 19 nt, Human
uuggcucuggagacagccc

SEQ ID NO: 2790692 - RNA, 13 nt, Human
uuggcguggagca

SEQ ID NO: 2790693 - RNA, 14 nt, Human
uuggcguggagcag

SEQ ID NO: 2790694 - RNA, 20 nt, Human
uuggcuaacuauauuugcuu

SEQ ID NO: 2790695 - RNA, 13 nt, Human
uuggcucuggaga

SEQ ID NO: 2790696 - RNA, 17 nt, Human
augaaccuucuggccuc

SEQ ID NO: 2790697 - RNA, 24 nt, Human
augaaccuucuggccucccacaga

SEQ ID NO: 2790698 - RNA, 21 nt, Human
augaaccuucuggccucccac

SEQ ID NO: 2790699 - RNA, 20 nt, Human
augaacucuuagaaaugaag

SEQ ID NO: 2790700 - RNA, 12 nt, Human
augaacucugaa

SEQ ID NO: 2790701 - RNA, 15 nt, Human
augaaugagucuguu

SEQ ID NO: 2790702 - RNA, 20 nt, Human
augaaugaggucccaggcag

SEQ ID NO: 2790703 - RNA, 15 nt, Human
augaaugaggucugg

SEQ ID NO: 2790704 - RNA, 19 nt, Human
augaaugaggucugggcua

SEQ ID NO: 2790705 - RNA, 19 nt, Human
augaaugaggucccaggca

SEQ ID NO: 2790706 - RNA, 16 nt, Human
augaaugagaaucuac

SEQ ID NO: 2790707 - RNA, 11 nt, Human
uugggcccugc

SEQ ID NO: 2790708 - RNA, 12 nt, Human
uugggcccugca

SEQ ID NO: 2790709 - RNA, 13 nt, Human
uugggcccugcau

SEQ ID NO: 2790710 - RNA, 18 nt, Human
uugggccccagaggcugg

SEQ ID NO: 2790711 - RNA, 16 nt, Human
augaauuaaauaaacc

SEQ ID NO: 2790712 - RNA, 14 nt, Human
augaauuaaauaaa

SEQ ID NO: 2790713 - RNA, 15 nt, Human
uuggggcaaaaaucc

SEQ ID NO: 2790714 - RNA, 22 nt, Human
uuggggcaacauuguucaccuu

SEQ ID NO: 2790715 - RNA, 16 nt, Human
uuggggcaagucaugu

SEQ ID NO: 2790716 - RNA, 21 nt, Human
uuggggccaccaaagcugccc

SEQ ID NO: 2790717 - RNA, 23 nt, Human
uuggggccaccaaagcugcccac

SEQ ID NO: 2790718 - RNA, 13 nt, Human
uuggggcccugcc

SEQ ID NO: 2790719 - RNA, 19 nt, Human
uugggggacguuucucauu

SEQ ID NO: 2790720 - RNA, 21 nt, Human
uugggggggccaaaaggaaaa

SEQ ID NO: 2790721 - RNA, 21 nt, Human
uugggggggcucccguggccu

SEQ ID NO: 2790722 - RNA, 17 nt, Human
uuggggggacucugagc

SEQ ID NO: 2790723 - RNA, 16 nt, Human
uuggggguaaaaaaua

SEQ ID NO: 2790724 - RNA, 22 nt, Human
uugggggucaggcagccaguga

SEQ ID NO: 2790725 - RNA, 14 nt, Human
uugguucccuugug

SEQ ID NO: 2790726 - RNA, 14 nt, Human
uugguuccucucug

SEQ ID NO: 2790727 - RNA, 15 nt, Human
uugguuccucucugg

SEQ ID NO: 2790728 - RNA, 13 nt, Human
uugguucuaagga

SEQ ID NO: 2790729 - RNA, 14 nt, Human
uugguucuaaggac

SEQ ID NO: 2790730 - RNA, 18 nt, Human
uugguucuaaggaccuga

SEQ ID NO: 2790731 - RNA, 23 nt, Human
uuguaguagcguuuuuuaaaugu

SEQ ID NO: 2790732 - RNA, 22 nt, Human
uuguaguagcguuuuuuaaaug

SEQ ID NO: 2790733 - RNA, 19 nt, Human
uuguaggggucaaagaaau

SEQ ID NO: 2790734 - RNA, 13 nt, Human
uuguagguaaaau

SEQ ID NO: 2790735 - RNA, 15 nt, Human
uuguagguaaaaugu

SEQ ID NO: 2790736 - RNA, 19 nt, Human
uuguaggugcaagauggaa

SEQ ID NO: 2790737 - RNA, 21 nt, Human
uuguaguagcguuuuuuaaau

SEQ ID NO: 2790738 - RNA, 15 nt, Human
uuguaggagacuugc

SEQ ID NO: 2790739 - RNA, 20 nt, Human
uuguaggagcugagguuuca

SEQ ID NO: 2790740 - RNA, 17 nt, Human
uuguaggauaagugaaa

SEQ ID NO: 2790741 - RNA, 23 nt, Human
uuguacaaaauaaacaaauaaca

SEQ ID NO: 2790742 - RNA, 17 nt, Human
uuguaggggucaaagaa

SEQ ID NO: 2790743 - RNA, 20 nt, Human
uuguaggggucaaagaaaug

SEQ ID NO: 2790744 - RNA, 16 nt, Human
uuguaggguuacagag

SEQ ID NO: 2790745 - RNA, 14 nt, Human
uuguacaaaauaaa

SEQ ID NO: 2790746 - RNA, 13 nt, Human
uugguuuacauuu

SEQ ID NO: 2790747 - RNA, 14 nt, Human
uugguuuacauuua

SEQ ID NO: 2790748 - RNA, 20 nt, Human
uugguuuacauuuaaagcau

SEQ ID NO: 2790749 - RNA, 21 nt, Human
uugguuuacauuuaaagcauu

SEQ ID NO: 2790750 - RNA, 13 nt, Human
uugguuuacuuuc

SEQ ID NO: 2790751 - RNA, 15 nt, Human
uugguuuacuuucaa

SEQ ID NO: 2790752 - RNA, 16 nt, Human
uugguuuacuuucaaa

SEQ ID NO: 2790753 - RNA, 15 nt, Human
uugguugugucuuuu

SEQ ID NO: 2790754 - RNA, 18 nt, Human
uugguuguuuuuuccuuu

SEQ ID NO: 2790755 - RNA, 12 nt, Human
uugguuuaaaaa

SEQ ID NO: 2790756 - RNA, 15 nt, Human
uugguuggcuggccu

SEQ ID NO: 2790757 - RNA, 19 nt, Human
uugguucugcuucaauaaa

SEQ ID NO: 2790758 - RNA, 19 nt, Human
uuguauauuguguuugugu

SEQ ID NO: 2790759 - RNA, 21 nt, Human
augaauuuggagacucugugg

SEQ ID NO: 2790760 - RNA, 20 nt, Human
augaauuuggagacucugug

SEQ ID NO: 2790761 - RNA, 15 nt, Human
augaauuuggagacu

SEQ ID NO: 2790762 - RNA, 21 nt, Human
augaauuuauugcacauuguu

SEQ ID NO: 2790763 - RNA, 22 nt, Human
augaauuuauugcacauuguuc

SEQ ID NO: 2790764 - RNA, 11 nt, Human
augaauuuaaa

SEQ ID NO: 2790765 - RNA, 21 nt, Human
augaauugcguuggucucugc

SEQ ID NO: 2790766 - RNA, 13 nt, Human
augaauuuaaaua

SEQ ID NO: 2790767 - RNA, 14 nt, Human
augaauuuaaauau

SEQ ID NO: 2790768 - RNA, 16 nt, Human
augaauuuaaauauaa

SEQ ID NO: 2790769 - RNA, 23 nt, Human
augaauuuaaauauaauucugua

SEQ ID NO: 2790770 - RNA, 15 nt, Human
augaauuuuaagggu

SEQ ID NO: 2790771 - RNA, 16 nt, Human
augaauuuuaaggguu

SEQ ID NO: 2790772 - RNA, 13 nt, Human
augaauuuuacau

SEQ ID NO: 2790773 - RNA, 20 nt, Human
uuguauacaccauauacugu

SEQ ID NO: 2790774 - RNA, 15 nt, Human
uuguauacauccugg

SEQ ID NO: 2790775 - RNA, 18 nt, Human
uuguauacauccugggua

SEQ ID NO: 2790776 - RNA, 19 nt, Human
uuguauacauccuggguaa

SEQ ID NO: 2790777 - RNA, 15 nt, Human
uuguauacuuuaaau

SEQ ID NO: 2790778 - RNA, 19 nt, Human
uuguauacuuuaaauaauu

SEQ ID NO: 2790779 - RNA, 20 nt, Human
uuguauacuuuaaauaauuu

SEQ ID NO: 2790780 - RNA, 21 nt, Human
uuguauacuuuaaauaauuua

SEQ ID NO: 2790781 - RNA, 22 nt, Human
uuguauacuuuaaauaauuuaa

SEQ ID NO: 2790782 - RNA, 12 nt, Human
uuguauaauuuc

SEQ ID NO: 2790783 - RNA, 14 nt, Human
uuguauaauuucga

SEQ ID NO: 2790784 - RNA, 22 nt, Human
uuguauaauuucgagauuugua

SEQ ID NO: 2790785 - RNA, 13 nt, Human
uuguauacaaaua

SEQ ID NO: 2790786 - RNA, 14 nt, Human
uuguauacaaauau

SEQ ID NO: 2790787 - RNA, 16 nt, Human
uuguauacaaauauau

SEQ ID NO: 2790788 - RNA, 22 nt, Human
uuguauacaaauauauuguuaa

SEQ ID NO: 2790789 - RNA, 15 nt, Human
uuguauaguaaagug

SEQ ID NO: 2790790 - RNA, 14 nt, Human
uuguauaguaaagu

SEQ ID NO: 2790791 - RNA, 14 nt, Human
uuguauaguguaaa

SEQ ID NO: 2790792 - RNA, 15 nt, Human
uuguauaguguaaaa

SEQ ID NO: 2790793 - RNA, 16 nt, Human
uuguauaguguaaaau

SEQ ID NO: 2790794 - RNA, 15 nt, Human
uuguauauuguguuu

SEQ ID NO: 2790795 - RNA, 13 nt, Human
uuguauauugugu

SEQ ID NO: 2790796 - RNA, 15 nt, Human
augagacucuagggu

SEQ ID NO: 2790797 - RNA, 21 nt, Human
augagacccauuccuauuucu

SEQ ID NO: 2790798 - RNA, 22 nt, Human
augagacauaggccaugaaaaa

SEQ ID NO: 2790799 - RNA, 15 nt, Human
augagacaaacaugc

SEQ ID NO: 2790800 - RNA, 14 nt, Human
augagaauuucuaa

SEQ ID NO: 2790801 - RNA, 22 nt, Human
augagaauuucuaaaaagauua

SEQ ID NO: 2790802 - RNA, 13 nt, Human
augagaagaauag

SEQ ID NO: 2790803 - RNA, 16 nt, Human
augagaaggaacuucc

SEQ ID NO: 2790804 - RNA, 15 nt, Human
augagaaggcagcca

SEQ ID NO: 2790805 - RNA, 22 nt, Human
augagaaguugauauagaacag

SEQ ID NO: 2790806 - RNA, 23 nt, Human
augagaaucuacccccagaucca

SEQ ID NO: 2790807 - RNA, 11 nt, Human
augagaaucua

SEQ ID NO: 2790808 - RNA, 22 nt, Human
augagaaagguugaagcaccaa

SEQ ID NO: 2790809 - RNA, 21 nt, Human
augagaaagguugaagcacca

SEQ ID NO: 2790810 - RNA, 14 nt, Human
augagaacucugag

SEQ ID NO: 2790811 - RNA, 11 nt, Human
augagaaaugu

SEQ ID NO: 2790812 - RNA, 12 nt, Human
augagaaaugua

SEQ ID NO: 2790813 - RNA, 15 nt, Human
augagaaauguaaug

SEQ ID NO: 2790814 - RNA, 16 nt, Human
augagaaauguaaugc

SEQ ID NO: 2790815 - RNA, 13 nt, Human
augagaacaaaca

SEQ ID NO: 2790816 - RNA, 13 nt, Human
augagaacaaagc

SEQ ID NO: 2790817 - RNA, 14 nt, Human
augagaacaaagcu

SEQ ID NO: 2790818 - RNA, 15 nt, Human
augagaacaaagcug

SEQ ID NO: 2790819 - RNA, 16 nt, Human
augagaacaaagcugu

SEQ ID NO: 2790820 - RNA, 17 nt, Human
augagaacaaagcuguu

SEQ ID NO: 2790821 - RNA, 18 nt, Human
augagaacaaagcuguua

SEQ ID NO: 2790822 - RNA, 20 nt, Human
augagaacaaagcuguuaaa

SEQ ID NO: 2790823 - RNA, 22 nt, Human
augagaacaaagcuguuaaacu

SEQ ID NO: 2790824 - RNA, 23 nt, Human
augagaacaaagcuguuaaacug

SEQ ID NO: 2790825 - RNA, 21 nt, Human
augacauuuuuuuuaacuacu

SEQ ID NO: 2790826 - RNA, 15 nt, Human
augaccaaaguccuu

SEQ ID NO: 2790827 - RNA, 17 nt, Human
augacauucaugccugg

SEQ ID NO: 2790828 - RNA, 12 nt, Human
uugguuuaauau

SEQ ID NO: 2790829 - RNA, 15 nt, Human
augacaaugacugug

SEQ ID NO: 2790830 - RNA, 18 nt, Human
augacauucaugccuggc

SEQ ID NO: 2790831 - RNA, 22 nt, Human
augacuuauuguggauaacaaa

SEQ ID NO: 2790832 - RNA, 22 nt, Human
augacacccgugagcgccugug

SEQ ID NO: 2790833 - RNA, 23 nt, Human
augacuuuauauggaugauucag

SEQ ID NO: 2790834 - RNA, 16 nt, Human
augacuugcuacuuuu

SEQ ID NO: 2790835 - RNA, 20 nt, Human
augacuuguagcauauucuu

SEQ ID NO: 2790836 - RNA, 11 nt, Human
augagaaacug

SEQ ID NO: 2790837 - RNA, 14 nt, Human
augagaaacugcau

SEQ ID NO: 2790838 - RNA, 13 nt, Human
caauuuuugccuu

SEQ ID NO: 2790839 - RNA, 14 nt, Human
caauuuuugccuuc

SEQ ID NO: 2790840 - RNA, 15 nt, Human
caauuuuugccuuca

SEQ ID NO: 2790841 - RNA, 16 nt, Human
caauuuuugccuucau

SEQ ID NO: 2790842 - RNA, 17 nt, Human
caauuuuuuguucuuca

SEQ ID NO: 2790843 - RNA, 18 nt, Human
caauuuuuuguucuucag

SEQ ID NO: 2790844 - RNA, 16 nt, Human
caauuuuugucucaga

SEQ ID NO: 2790845 - RNA, 18 nt, Human
caauuuuugucucagaag

SEQ ID NO: 2790846 - RNA, 19 nt, Human
caauuuuugucucagaagu

SEQ ID NO: 2790847 - RNA, 18 nt, Human
cacaaagcccuuccaugu

SEQ ID NO: 2790848 - RNA, 15 nt, Human
cacaaaaucugucca

SEQ ID NO: 2790849 - RNA, 13 nt, Human
cacaaacacaagg

SEQ ID NO: 2790850 - RNA, 16 nt, Human
cacaaacacaagguca

SEQ ID NO: 2790851 - RNA, 21 nt, Human
cacaaacacauuguuauuuuc

SEQ ID NO: 2790852 - RNA, 23 nt, Human
cacaaacacauuguuauuuucag

SEQ ID NO: 2790853 - RNA, 23 nt, Human
caauuaaaaaaaaagaucuguuu

SEQ ID NO: 2790854 - RNA, 22 nt, Human
caauuaaaaauugucuucaugu

SEQ ID NO: 2790855 - RNA, 16 nt, Human
caauuaggauuuugau

SEQ ID NO: 2790856 - RNA, 13 nt, Human
caauuccacucug

SEQ ID NO: 2790857 - RNA, 16 nt, Human
caauuccacucugaua

SEQ ID NO: 2790858 - RNA, 21 nt, Human
caauuccacucugauagaauu

SEQ ID NO: 2790859 - RNA, 22 nt, Human
caauuccacucugauagaauua

SEQ ID NO: 2790860 - RNA, 14 nt, Human
caauuccaucaccc

SEQ ID NO: 2790861 - RNA, 21 nt, Human
caauuagcaauugacugucac

SEQ ID NO: 2790862 - RNA, 19 nt, Human
caauuagccucauaguuau

SEQ ID NO: 2790863 - RNA, 13 nt, Human
caauuccugggcc

SEQ ID NO: 2790864 - RNA, 12 nt, Human
caauuccugggc

SEQ ID NO: 2790865 - RNA, 15 nt, Human
caauuccucauccuc

SEQ ID NO: 2790866 - RNA, 18 nt, Human
caauuccucauccucaga

SEQ ID NO: 2790867 - RNA, 22 nt, Human
caauuccucauccucagaugcu

SEQ ID NO: 2790868 - RNA, 23 nt, Human
caauuccucauccucagaugcuc

SEQ ID NO: 2790869 - RNA, 11 nt, Human
caauuccccuc

SEQ ID NO: 2790870 - RNA, 12 nt, Human
caauuccccucu

SEQ ID NO: 2790871 - RNA, 13 nt, Human
caauuccccucug

SEQ ID NO: 2790872 - RNA, 22 nt, Human
caauuccgucuucuuaaucuga

SEQ ID NO: 2790873 - RNA, 14 nt, Human
caauuccccucugc

SEQ ID NO: 2790874 - RNA, 17 nt, Human
caauuccccucugcugc

SEQ ID NO: 2790875 - RNA, 16 nt, Human
caauaguuugcauaga

SEQ ID NO: 2790876 - RNA, 15 nt, Human
caauaucuaauauau

SEQ ID NO: 2790877 - RNA, 16 nt, Human
caauaucuaauauaua

SEQ ID NO: 2790878 - RNA, 17 nt, Human
caauaucuaauauauau

SEQ ID NO: 2790879 - RNA, 13 nt, Human
caauaucugaagc

SEQ ID NO: 2790880 - RNA, 23 nt, Human
caauaucugaagcccucccaggu

SEQ ID NO: 2790881 - RNA, 23 nt, Human
caauguggcaaggaaaaacaggu

SEQ ID NO: 2790882 - RNA, 13 nt, Human
caaugugcucucg

SEQ ID NO: 2790883 - RNA, 14 nt, Human
caauguucuuuaua

SEQ ID NO: 2790884 - RNA, 15 nt, Human
caauguucuuuauau

SEQ ID NO: 2790885 - RNA, 16 nt, Human
caauguucuuuauaua

SEQ ID NO: 2790886 - RNA, 18 nt, Human
caauguucuuuauauaca

SEQ ID NO: 2790887 - RNA, 22 nt, Human
caauguucuuuauauacaauaa

SEQ ID NO: 2790888 - RNA, 14 nt, Human
caauguguuuuucu

SEQ ID NO: 2790889 - RNA, 16 nt, Human
caauguguuuuucucc

SEQ ID NO: 2790890 - RNA, 17 nt, Human
caauguguuuuucucca

SEQ ID NO: 2790891 - RNA, 21 nt, Human
caauguggccuaaaaaugcaa

SEQ ID NO: 2790892 - RNA, 19 nt, Human
caauguguggcugaagacu

SEQ ID NO: 2790893 - RNA, 20 nt, Human
caauguguggcugaagacuu

SEQ ID NO: 2790894 - RNA, 18 nt, Human
caauguuucuuuuaucac

SEQ ID NO: 2790895 - RNA, 16 nt, Human
caauguuucuuuuauc

SEQ ID NO: 2790896 - RNA, 20 nt, Human
caauguuuaugcaaggaagg

SEQ ID NO: 2790897 - RNA, 23 nt, Human
caauguuuaugcaaggaaggaaa

SEQ ID NO: 2790898 - RNA, 13 nt, Human
caauguuucuuuu

SEQ ID NO: 2790899 - RNA, 15 nt, Human
cacaaagggcccaga

SEQ ID NO: 2790900 - RNA, 16 nt, Human
cacaaagggcccagau

SEQ ID NO: 2790901 - RNA, 22 nt, Human
cacaaaggggaucauaaaguua

SEQ ID NO: 2790902 - RNA, 13 nt, Human
cacaaagggccca

SEQ ID NO: 2790903 - RNA, 17 nt, Human
cacaaaggccaaacugc

SEQ ID NO: 2790904 - RNA, 18 nt, Human
cacaaaggccaaacugcu

SEQ ID NO: 2790905 - RNA, 19 nt, Human
cacaaaggccaaacugcug

SEQ ID NO: 2790906 - RNA, 21 nt, Human
cacaaaggccaaacugcugga

SEQ ID NO: 2790907 - RNA, 13 nt, Human
cacaauuuuuaau

SEQ ID NO: 2790908 - RNA, 14 nt, Human
cacaauuuuuaaug

SEQ ID NO: 2790909 - RNA, 15 nt, Human
cacaauuuuuaaugg

SEQ ID NO: 2790910 - RNA, 16 nt, Human
cacaauuuuuaauggc

SEQ ID NO: 2790911 - RNA, 22 nt, Human
cacaauuuuuaauggcagcaga

SEQ ID NO: 2790912 - RNA, 13 nt, Human
cacaauuugcacu

SEQ ID NO: 2790913 - RNA, 17 nt, Human
cacaaugguuuuuaaau

SEQ ID NO: 2790914 - RNA, 22 nt, Human
cacaaugguuuuuaaauuuugu

SEQ ID NO: 2790915 - RNA, 16 nt, Human
cacaaugucaguauuu

SEQ ID NO: 2790916 - RNA, 18 nt, Human
cacaaugucaguauuuca

SEQ ID NO: 2790917 - RNA, 21 nt, Human
cacacaaaaagugucucugcc

SEQ ID NO: 2790918 - RNA, 18 nt, Human
cacacaaaccuucugccu

SEQ ID NO: 2790919 - RNA, 15 nt, Human
cacacacacacacaa

SEQ ID NO: 2790920 - RNA, 15 nt, Human
cacacacacacacac

SEQ ID NO: 2790921 - RNA, 16 nt, Human
cacacacacacacaca

SEQ ID NO: 2790922 - RNA, 13 nt, Human
cacacacacacac

SEQ ID NO: 2790923 - RNA, 14 nt, Human
cacacacacacaca

SEQ ID NO: 2790924 - RNA, 19 nt, Human
cacaauacagauaacauua

SEQ ID NO: 2790925 - RNA, 13 nt, Human
cacaauaagcaaa

SEQ ID NO: 2790926 - RNA, 19 nt, Human
cacaauaacacuaaaauuu

SEQ ID NO: 2790927 - RNA, 21 nt, Human
cacaauaacacuaaaauuuua

SEQ ID NO: 2790928 - RNA, 15 nt, Human
cacaauguucuuuau

SEQ ID NO: 2790929 - RNA, 16 nt, Human
cacaauguucuuuaua

SEQ ID NO: 2790930 - RNA, 18 nt, Human
cacaauguucuuuauaua

SEQ ID NO: 2790931 - RNA, 22 nt, Human
cacaauguucuuuauauacaau

SEQ ID NO: 2790932 - RNA, 22 nt, Human
cacaaugaaaugcucuccuuuc

SEQ ID NO: 2790933 - RNA, 15 nt, Human
cacaauauugaacuu

SEQ ID NO: 2790934 - RNA, 17 nt, Human
cacacacgcgugcacac

SEQ ID NO: 2790935 - RNA, 20 nt, Human
cacacacggaggcauccuac

SEQ ID NO: 2790936 - RNA, 19 nt, Human
cacacacgcacgcacacac

SEQ ID NO: 2790937 - RNA, 17 nt, Human
cacacacgcacgcacac

SEQ ID NO: 2790938 - RNA, 18 nt, Human
cacacacgcacgcacaca

SEQ ID NO: 2790939 - RNA, 23 nt, Human
cacacacgcacgcacacacacaa

SEQ ID NO: 2790940 - RNA, 20 nt, Human
cacacacgcgcgcgcacaca

SEQ ID NO: 2790941 - RNA, 21 nt, Human
cacacacgcgcgcgcacacac

SEQ ID NO: 2790942 - RNA, 14 nt, Human
cacacacgcacgca

SEQ ID NO: 2790943 - RNA, 15 nt, Human
cacacacgcacgcac

SEQ ID NO: 2790944 - RNA, 16 nt, Human
cacacacgcacgcaca

SEQ ID NO: 2790945 - RNA, 14 nt, Human
cacacacgcacaua

SEQ ID NO: 2790946 - RNA, 13 nt, Human
cacacacacucua

SEQ ID NO: 2790947 - RNA, 14 nt, Human
cacacacacgcacg

SEQ ID NO: 2790948 - RNA, 12 nt, Human
cacacacacaua

SEQ ID NO: 2790949 - RNA, 13 nt, Human
cacacacacauac

SEQ ID NO: 2790950 - RNA, 14 nt, Human
cacacacacauaca

SEQ ID NO: 2790951 - RNA, 12 nt, Human
cacacacacaug

SEQ ID NO: 2790952 - RNA, 13 nt, Human
cacacacacgcac

SEQ ID NO: 2790953 - RNA, 15 nt, Human
cacacacacauacac

SEQ ID NO: 2790954 - RNA, 12 nt, Human
cacacacacauc

SEQ ID NO: 2790955 - RNA, 14 nt, Human
cacacacacaugcu

SEQ ID NO: 2790956 - RNA, 14 nt, Human
cacacacacacaua

SEQ ID NO: 2790957 - RNA, 14 nt, Human
cacacacacacaug

SEQ ID NO: 2790958 - RNA, 14 nt, Human
cacacacacacauc

SEQ ID NO: 2790959 - RNA, 14 nt, Human
cacacacacacgca

SEQ ID NO: 2790960 - RNA, 22 nt, Human
cacagaugugggcuuugauuuc

SEQ ID NO: 2790961 - RNA, 15 nt, Human
cacagcccagcuugg

SEQ ID NO: 2790962 - RNA, 21 nt, Human
cacagccgauucaccugagca

SEQ ID NO: 2790963 - RNA, 20 nt, Human
cacagccgauucaccugagc

SEQ ID NO: 2790964 - RNA, 21 nt, Human
cacagcucuucuccaggcugu

SEQ ID NO: 2790965 - RNA, 18 nt, Human
cacagcugagagacuuuu

SEQ ID NO: 2790966 - RNA, 19 nt, Human
cacagcugagagacuuuua

SEQ ID NO: 2790967 - RNA, 22 nt, Human
cacagcagcuucaccagagcau

SEQ ID NO: 2790968 - RNA, 14 nt, Human
cacagauuguuucu

SEQ ID NO: 2790969 - RNA, 15 nt, Human
cacagauuguuucua

SEQ ID NO: 2790970 - RNA, 20 nt, Human
cacagauuguuucuauacaa

SEQ ID NO: 2790971 - RNA, 21 nt, Human
cacagauuguuucuauacaaa

SEQ ID NO: 2790972 - RNA, 22 nt, Human
cacagauuguuucuauacaaau

SEQ ID NO: 2790973 - RNA, 21 nt, Human
cacagcagcuucaccagagca

SEQ ID NO: 2790974 - RNA, 22 nt, Human
cacagauuugagcucagcccug

SEQ ID NO: 2790975 - RNA, 18 nt, Human
cacagauuugagcucagc

SEQ ID NO: 2790976 - RNA, 17 nt, Human
cacagauuugagcucag

SEQ ID NO: 2790977 - RNA, 16 nt, Human
cacagauuugagcuca

SEQ ID NO: 2790978 - RNA, 13 nt, Human
cacagcagguccu

SEQ ID NO: 2790979 - RNA, 12 nt, Human
cacagagaaagu

SEQ ID NO: 2790980 - RNA, 22 nt, Human
cacacucuccaucacccucuuc

SEQ ID NO: 2790981 - RNA, 12 nt, Human
cacacucugacg

SEQ ID NO: 2790982 - RNA, 19 nt, Human
cacacucugccagcaaaga

SEQ ID NO: 2790983 - RNA, 14 nt, Human
cacacuccagcugg

SEQ ID NO: 2790984 - RNA, 19 nt, Human
cacacacgcuuucuuaugc

SEQ ID NO: 2790985 - RNA, 20 nt, Human
cacagagaaaguacuucucc

SEQ ID NO: 2790986 - RNA, 19 nt, Human
cacagagaaaguacuucuc

SEQ ID NO: 2790987 - RNA, 21 nt, Human
cacagagaaaguacuucucca

SEQ ID NO: 2790988 - RNA, 14 nt, Human
cacagagcggggac

SEQ ID NO: 2790989 - RNA, 15 nt, Human
cacagaguaagacau

SEQ ID NO: 2790990 - RNA, 16 nt, Human
cacagaguaagacauu

SEQ ID NO: 2790991 - RNA, 17 nt, Human
cacagaguaagacauug

SEQ ID NO: 2790992 - RNA, 19 nt, Human
cacagauguucccccaucu

SEQ ID NO: 2790993 - RNA, 23 nt, Human
cacagauguucgguuuuuuuccu

SEQ ID NO: 2790994 - RNA, 14 nt, Human
cacagauaaaaagu

SEQ ID NO: 2790995 - RNA, 15 nt, Human
cacagauaaaaagug

SEQ ID NO: 2790996 - RNA, 17 nt, Human
cacagauauacuuugug

SEQ ID NO: 2790997 - RNA, 19 nt, Human
cacagauauacuuugugga

SEQ ID NO: 2790998 - RNA, 20 nt, Human
cacagauauacuuuguggac

SEQ ID NO: 2790999 - RNA, 23 nt, Human
cacagauauacuuuguggaccaa

SEQ ID NO: 2791000 - RNA, 16 nt, Human
cacagauacacacaca

SEQ ID NO: 2791001 - RNA, 11 nt, Human
cacagaucaug

SEQ ID NO: 2791002 - RNA, 17 nt, Human
cacagaugaaacacaaa

SEQ ID NO: 2791003 - RNA, 20 nt, Human
cacagaugaguuaucuaaga

SEQ ID NO: 2791004 - RNA, 12 nt, Human
cacagauuuuaa

SEQ ID NO: 2791005 - RNA, 16 nt, Human
caauaaaugucuguug

SEQ ID NO: 2791006 - RNA, 14 nt, Human
caauaaaugucugu

SEQ ID NO: 2791007 - RNA, 15 nt, Human
caauaaaugucuguu

SEQ ID NO: 2791008 - RNA, 15 nt, Human
caaggcuucagucuc

SEQ ID NO: 2791009 - RNA, 23 nt, Human
caagggucauuauggguuaggca

SEQ ID NO: 2791010 - RNA, 14 nt, Human
caagggaaggacag

SEQ ID NO: 2791011 - RNA, 19 nt, Human
caaggguagggugggccuu

SEQ ID NO: 2791012 - RNA, 17 nt, Human
caaggcuuauauucaac

SEQ ID NO: 2791013 - RNA, 18 nt, Human
caaggcuuauauucaacc

SEQ ID NO: 2791014 - RNA, 15 nt, Human
caaggagcacaagcc

SEQ ID NO: 2791015 - RNA, 16 nt, Human
caaggagcacaagcca

SEQ ID NO: 2791016 - RNA, 16 nt, Human
caaggagcacaggucc

SEQ ID NO: 2791017 - RNA, 17 nt, Human
caaggagcacagguccc

SEQ ID NO: 2791018 - RNA, 18 nt, Human
caaggagcacagguccca

SEQ ID NO: 2791019 - RNA, 22 nt, Human
caaggagcacaggucccaccuc

SEQ ID NO: 2791020 - RNA, 20 nt, Human
caauaguguccuaugcaaua

SEQ ID NO: 2791021 - RNA, 21 nt, Human
caauaguguccuaugcaauaa

SEQ ID NO: 2791022 - RNA, 22 nt, Human
caauaguguccuaugcaauaaa

SEQ ID NO: 2791023 - RNA, 22 nt, Human
caauaguucaaggaacuugaaa

SEQ ID NO: 2791024 - RNA, 19 nt, Human
caauagcaacguagcuucu

SEQ ID NO: 2791025 - RNA, 20 nt, Human
caauagcauggauagaguau

SEQ ID NO: 2791026 - RNA, 19 nt, Human
caauaauaaauauuuuugc

SEQ ID NO: 2791027 - RNA, 11 nt, Human
caauaauaaaa

SEQ ID NO: 2791028 - RNA, 24 nt, Human
caauaauaaaaaauauucuuguca

SEQ ID NO: 2791029 - RNA, 21 nt, Human
caauacguuugauaauaguuu

SEQ ID NO: 2791030 - RNA, 17 nt, Human
caauacuagucacccca

SEQ ID NO: 2791031 - RNA, 19 nt, Human
caauagauauuuaccuuuu

SEQ ID NO: 2791032 - RNA, 13 nt, Human
caauaacacuguc

SEQ ID NO: 2791033 - RNA, 15 nt, Human
caauaacacacagcu

SEQ ID NO: 2791034 - RNA, 14 nt, Human
caauaacacuaaaa

SEQ ID NO: 2791035 - RNA, 17 nt, Human
caauaacacuaaaauuu

SEQ ID NO: 2791036 - RNA, 13 nt, Human
caauaacuucuga

SEQ ID NO: 2791037 - RNA, 16 nt, Human
caauaacuucugaccu

SEQ ID NO: 2791038 - RNA, 12 nt, Human
caauaagcaaaa

SEQ ID NO: 2791039 - RNA, 23 nt, Human
caagcuggucccacucaguccau

SEQ ID NO: 2791040 - RNA, 22 nt, Human
caagcuggucccacucagucca

SEQ ID NO: 2791041 - RNA, 17 nt, Human
caagcuguccagagaaa

SEQ ID NO: 2791042 - RNA, 18 nt, Human
caagcuguccagagaaaa

SEQ ID NO: 2791043 - RNA, 20 nt, Human
caaggagacacaacaacucc

SEQ ID NO: 2791044 - RNA, 13 nt, Human
caaggagaacaaa

SEQ ID NO: 2791045 - RNA, 14 nt, Human
caaggagaacaaau

SEQ ID NO: 2791046 - RNA, 15 nt, Human
caaggagaacaaaua

SEQ ID NO: 2791047 - RNA, 18 nt, Human
caaggagaacaaauauuc

SEQ ID NO: 2791048 - RNA, 13 nt, Human
caaggagaggagg

SEQ ID NO: 2791049 - RNA, 14 nt, Human
caaggagaggaggc

SEQ ID NO: 2791050 - RNA, 15 nt, Human
caaggagaggaggca

SEQ ID NO: 2791051 - RNA, 18 nt, Human
caaggagaggaggcaacu

SEQ ID NO: 2791052 - RNA, 21 nt, Human
caagcuggucccacucagucc

SEQ ID NO: 2791053 - RNA, 17 nt, Human
caagcgauucuucugcu

SEQ ID NO: 2791054 - RNA, 15 nt, Human
caagcgauucuucug

SEQ ID NO: 2791055 - RNA, 18 nt, Human
caagcgauucuucugcuu

SEQ ID NO: 2791056 - RNA, 16 nt, Human
caagcgauucuccugc

SEQ ID NO: 2791057 - RNA, 17 nt, Human
caagcgauucuccugcc

SEQ ID NO: 2791058 - RNA, 18 nt, Human
caagcgauucuccugccu

SEQ ID NO: 2791059 - RNA, 20 nt, Human
caagcgauucuccugccuca

SEQ ID NO: 2791060 - RNA, 14 nt, Human
caagccugucugag

SEQ ID NO: 2791061 - RNA, 15 nt, Human
caagccugugcaaaa

SEQ ID NO: 2791062 - RNA, 16 nt, Human
caagccugugcaaaaa

SEQ ID NO: 2791063 - RNA, 19 nt, Human
caagccugugcaaaaaaau

SEQ ID NO: 2791064 - RNA, 21 nt, Human
caagccugugcaaaaaaauua

SEQ ID NO: 2791065 - RNA, 19 nt, Human
caagaguaguuauauaauu

SEQ ID NO: 2791066 - RNA, 22 nt, Human
caagaguaguuauauaauuguu

SEQ ID NO: 2791067 - RNA, 18 nt, Human
caagagugauugcagcuu

SEQ ID NO: 2791068 - RNA, 14 nt, Human
caagagucuaaaga

SEQ ID NO: 2791069 - RNA, 15 nt, Human
caagagucuaaagau

SEQ ID NO: 2791070 - RNA, 22 nt, Human
caagaguuuauuuccaaauaaa

SEQ ID NO: 2791071 - RNA, 18 nt, Human
caagaguuuucuuccuug

SEQ ID NO: 2791072 - RNA, 17 nt, Human
caagauagauuuggaau

SEQ ID NO: 2791073 - RNA, 18 nt, Human
caagauagauuuggaaua

SEQ ID NO: 2791074 - RNA, 15 nt, Human
caagauaggaccuug

SEQ ID NO: 2791075 - RNA, 18 nt, Human
caagauaggaccuugggc

SEQ ID NO: 2791076 - RNA, 13 nt, Human
caaauauuuggag

SEQ ID NO: 2791077 - RNA, 20 nt, Human
caaauauuuauuuucuuucu

SEQ ID NO: 2791078 - RNA, 17 nt, Human
caaaucaauaagaaggu

SEQ ID NO: 2791079 - RNA, 13 nt, Human
caaaucaaagcag

SEQ ID NO: 2791080 - RNA, 14 nt, Human
caaaucaaagcaga

SEQ ID NO: 2791081 - RNA, 15 nt, Human
caaaucaaagcagau

SEQ ID NO: 2791082 - RNA, 13 nt, Human
caaaucaacagaa

SEQ ID NO: 2791083 - RNA, 14 nt, Human
caaaucaacagaag

SEQ ID NO: 2791084 - RNA, 15 nt, Human
caaaucaacagaagc

SEQ ID NO: 2791085 - RNA, 17 nt, Human
caaaucaacagaagcau

SEQ ID NO: 2791086 - RNA, 19 nt, Human
caaaucaacagaagcauuu

SEQ ID NO: 2791087 - RNA, 21 nt, Human
caaaucaacagaagcauuugu

SEQ ID NO: 2791088 - RNA, 11 nt, Human
caaauauauug

SEQ ID NO: 2791089 - RNA, 13 nt, Human
caaauauauuguu

SEQ ID NO: 2791090 - RNA, 14 nt, Human
caaauauauuguua

SEQ ID NO: 2791091 - RNA, 15 nt, Human
caaauauauuguuaa

SEQ ID NO: 2791092 - RNA, 15 nt, Human
caaauaucuuguguu

SEQ ID NO: 2791093 - RNA, 17 nt, Human
caaauaucuuguguugu

SEQ ID NO: 2791094 - RNA, 21 nt, Human
caaauaucuuguguuguccuu

SEQ ID NO: 2791095 - RNA, 22 nt, Human
caaauaucuuguguuguccuuu

SEQ ID NO: 2791096 - RNA, 21 nt, Human
caaauaugaguacaaaugccu

SEQ ID NO: 2791097 - RNA, 22 nt, Human
caaauaugaguacaaaugccuu

SEQ ID NO: 2791098 - RNA, 23 nt, Human
caaauaugaguacaaaugccuua

SEQ ID NO: 2791099 - RNA, 18 nt, Human
caaauaaacucuaaacau

SEQ ID NO: 2791100 - RNA, 17 nt, Human
caaauaaacucuaaaca

SEQ ID NO: 2791101 - RNA, 13 nt, Human
caaaguuauccag

SEQ ID NO: 2791102 - RNA, 21 nt, Human
caaauggcgucuggaagucca

SEQ ID NO: 2791103 - RNA, 19 nt, Human
caaauggcgucuggaaguc

SEQ ID NO: 2791104 - RNA, 22 nt, Human
caaauggcgucuggaaguccaa

SEQ ID NO: 2791105 - RNA, 19 nt, Human
caaauggaagacacauuga

SEQ ID NO: 2791106 - RNA, 15 nt, Human
caaauggaagacaca

SEQ ID NO: 2791107 - RNA, 18 nt, Human
caaauggcgucuggaagu

SEQ ID NO: 2791108 - RNA, 19 nt, Human
caaagugcugggauuacaa

SEQ ID NO: 2791109 - RNA, 13 nt, Human
caaagugcuggga

SEQ ID NO: 2791110 - RNA, 19 nt, Human
caaagagagaaaauaaaga

SEQ ID NO: 2791111 - RNA, 14 nt, Human
caaagagaguuuuu

SEQ ID NO: 2791112 - RNA, 21 nt, Human
caaagagaguuuuuaauagaa

SEQ ID NO: 2791113 - RNA, 22 nt, Human
caaagagaguuuuuaauagaac

SEQ ID NO: 2791114 - RNA, 17 nt, Human
caaagagcacaaacauu

SEQ ID NO: 2791115 - RNA, 19 nt, Human
caaagagcacaaacauuuu

SEQ ID NO: 2791116 - RNA, 20 nt, Human
caaagagcacaaacauuuuu

SEQ ID NO: 2791117 - RNA, 16 nt, Human
caaagagagaaaauaa

SEQ ID NO: 2791118 - RNA, 15 nt, Human
caaagagaaaacuua

SEQ ID NO: 2791119 - RNA, 18 nt, Human
caaauaaaaauauugugu

SEQ ID NO: 2791120 - RNA, 16 nt, Human
caaauaaaaauauugu

SEQ ID NO: 2791121 - RNA, 10 nt, Human
caaauaaaau

SEQ ID NO: 2791122 - RNA, 15 nt, Human
caaauaaaaauauug

SEQ ID NO: 2791123 - RNA, 20 nt, Human
caaaguucccuacuuccugu

SEQ ID NO: 2791124 - RNA, 16 nt, Human
caaaguuaacagauuu

SEQ ID NO: 2791125 - RNA, 23 nt, Human
caaagugcugggauuacaagcgu

SEQ ID NO: 2791126 - RNA, 18 nt, Human
caaagugcugggauuaca

SEQ ID NO: 2791127 - RNA, 15 nt, Human
caaaguuaacagauu

SEQ ID NO: 2791128 - RNA, 20 nt, Human
caaagaggacucgcuuguaa

SEQ ID NO: 2791129 - RNA, 21 nt, Human
caaagaggacucgcuuguaaa

SEQ ID NO: 2791130 - RNA, 22 nt, Human
caaagaggacucgcuuguaaau

SEQ ID NO: 2791131 - RNA, 18 nt, Human
caacagcucgauccaaau

SEQ ID NO: 2791132 - RNA, 19 nt, Human
caacaggaaucaagagcug

SEQ ID NO: 2791133 - RNA, 21 nt, Human
caacaggaaucaagagcugcc

SEQ ID NO: 2791134 - RNA, 23 nt, Human
caacaggaaucaagagcugcccu

SEQ ID NO: 2791135 - RNA, 14 nt, Human
caacagcuacaaca

SEQ ID NO: 2791136 - RNA, 15 nt, Human
caacagcuacaacag

SEQ ID NO: 2791137 - RNA, 16 nt, Human
caacagcuacaacagc

SEQ ID NO: 2791138 - RNA, 20 nt, Human
caacagcuacaacagccuca

SEQ ID NO: 2791139 - RNA, 21 nt, Human
caacagcuacaacagccucac

SEQ ID NO: 2791140 - RNA, 23 nt, Human
caacagcgacauagcccaucccu

SEQ ID NO: 2791141 - RNA, 21 nt, Human
caacagcgacauagcccaucc

SEQ ID NO: 2791142 - RNA, 12 nt, Human
caacagccaugc

SEQ ID NO: 2791143 - RNA, 14 nt, Human
caacagccucacuu

SEQ ID NO: 2791144 - RNA, 15 nt, Human
caacagccucacuug

SEQ ID NO: 2791145 - RNA, 16 nt, Human
caacagccaacagcua

SEQ ID NO: 2791146 - RNA, 12 nt, Human
caacaggcuggg

SEQ ID NO: 2791147 - RNA, 21 nt, Human
caaccugcucuccucuugcca

SEQ ID NO: 2791148 - RNA, 23 nt, Human
caaccugcucuccucuugccacu

SEQ ID NO: 2791149 - RNA, 18 nt, Human
caaccugcucuccucuug

SEQ ID NO: 2791150 - RNA, 13 nt, Human
caacauauaaaau

SEQ ID NO: 2791151 - RNA, 14 nt, Human
caacauauaaaaua

SEQ ID NO: 2791152 - RNA, 16 nt, Human
caaccuggucacagga

SEQ ID NO: 2791153 - RNA, 16 nt, Human
caaccuucuguggcuc

SEQ ID NO: 2791154 - RNA, 17 nt, Human
caaccuucuguggcuca

SEQ ID NO: 2791155 - RNA, 19 nt, Human
caaccuucuguggcucaca

SEQ ID NO: 2791156 - RNA, 20 nt, Human
caaccuucuguggcucacag

SEQ ID NO: 2791157 - RNA, 17 nt, Human
caaauuugauugauuug

SEQ ID NO: 2791158 - RNA, 14 nt, Human
caaauuugauugau

SEQ ID NO: 2791159 - RNA, 17 nt, Human
caaauuugucuugccuu

SEQ ID NO: 2791160 - RNA, 22 nt, Human
caaauuugucuugccuuauuaa

SEQ ID NO: 2791161 - RNA, 13 nt, Human
caaauuaauuuua

SEQ ID NO: 2791162 - RNA, 13 nt, Human
caaauuauaaaaa

SEQ ID NO: 2791163 - RNA, 14 nt, Human
caaauuagggcaau

SEQ ID NO: 2791164 - RNA, 15 nt, Human
caaauuagggcaauu

SEQ ID NO: 2791165 - RNA, 21 nt, Human
caaauuagggcaauuggaaca

SEQ ID NO: 2791166 - RNA, 13 nt, Human
caacacugugggu

SEQ ID NO: 2791167 - RNA, 19 nt, Human
caacacuguggguguguga

SEQ ID NO: 2791168 - RNA, 21 nt, Human
caacacugugggugugugacu

SEQ ID NO: 2791169 - RNA, 16 nt, Human
caacagaagcuucaga

SEQ ID NO: 2791170 - RNA, 22 nt, Human
caacagaaaccuauccucacug

SEQ ID NO: 2791171 - RNA, 14 nt, Human
caacagaaagucau

SEQ ID NO: 2791172 - RNA, 15 nt, Human
caacagaacuaaaug

SEQ ID NO: 2791173 - RNA, 16 nt, Human
caacagaacuaaaugu

SEQ ID NO: 2791174 - RNA, 12 nt, Human
caacagaagcag

SEQ ID NO: 2791175 - RNA, 15 nt, Human
caacagaagcauuug

SEQ ID NO: 2791176 - RNA, 17 nt, Human
caacagaagcauuugua

SEQ ID NO: 2791177 - RNA, 18 nt, Human
caacagaagcauuuguau

SEQ ID NO: 2791178 - RNA, 19 nt, Human
caacagaagcauuuguauu

SEQ ID NO: 2791179 - RNA, 23 nt, Human
caacagaagcauuuguauuuugu

SEQ ID NO: 2791180 - RNA, 17 nt, Human
caacagaagcuucagaa

SEQ ID NO: 2791181 - RNA, 13 nt, Human
caacagaaugaaa

SEQ ID NO: 2791182 - RNA, 14 nt, Human
caacagaaugaaaa

SEQ ID NO: 2791183 - RNA, 15 nt, Human
caacagaaugaaaaa

SEQ ID NO: 2791184 - RNA, 16 nt, Human
caacagaaugaaaaau

SEQ ID NO: 2791185 - RNA, 17 nt, Human
caacagaaugaaaaaug

SEQ ID NO: 2791186 - RNA, 18 nt, Human
caacagaaugaaaaauga

SEQ ID NO: 2791187 - RNA, 19 nt, Human
caacagaaugaaaaaugaa

SEQ ID NO: 2791188 - RNA, 20 nt, Human
caacagaaugaaaaaugaaa

SEQ ID NO: 2791189 - RNA, 21 nt, Human
caacagaaugaaaaaugaaag

SEQ ID NO: 2791190 - RNA, 22 nt, Human
caacagaaugaaaaaugaaaga

SEQ ID NO: 2791191 - RNA, 23 nt, Human
caacagaagucaugaagcccaag

SEQ ID NO: 2791192 - RNA, 22 nt, Human
caacagaagucaugaagcccaa

SEQ ID NO: 2791193 - RNA, 20 nt, Human
caacagaagucaugaagccc

SEQ ID NO: 2791194 - RNA, 23 nt, Human
caacagagugagacccugucucu

SEQ ID NO: 2791195 - RNA, 19 nt, Human
caacagagugagacccugu

SEQ ID NO: 2791196 - RNA, 20 nt, Human
caagaagcaggcuacacuga

SEQ ID NO: 2791197 - RNA, 13 nt, Human
caagaagcaggcu

SEQ ID NO: 2791198 - RNA, 14 nt, Human
caagaagcaggcua

SEQ ID NO: 2791199 - RNA, 11 nt, Human
caagaagauga

SEQ ID NO: 2791200 - RNA, 12 nt, Human
caagaagaugaa

SEQ ID NO: 2791201 - RNA, 13 nt, Human
caagaagaugaau

SEQ ID NO: 2791202 - RNA, 18 nt, Human
caagaagaugaauggcgu

SEQ ID NO: 2791203 - RNA, 15 nt, Human
caacguuacucaggg

SEQ ID NO: 2791204 - RNA, 16 nt, Human
caacguuacucagggc

SEQ ID NO: 2791205 - RNA, 17 nt, Human
caacguuacucagggcu

SEQ ID NO: 2791206 - RNA, 18 nt, Human
caacguuacucagggcuc

SEQ ID NO: 2791207 - RNA, 22 nt, Human
caacguuacucagggcuccucc

SEQ ID NO: 2791208 - RNA, 23 nt, Human
caacguuguacuguaugugauga

SEQ ID NO: 2791209 - RNA, 23 nt, Human
caacguuuacaccgacuagccag

SEQ ID NO: 2791210 - RNA, 18 nt, Human
caacguuucuucacuuuu

SEQ ID NO: 2791211 - RNA, 22 nt, Human
caacguuuggaagauccuguga

SEQ ID NO: 2791212 - RNA, 12 nt, Human
caacuugggaac

SEQ ID NO: 2791213 - RNA, 16 nt, Human
caacuuguaaaugugg

SEQ ID NO: 2791214 - RNA, 17 nt, Human
caacuugguucugcuuc

SEQ ID NO: 2791215 - RNA, 18 nt, Human
caacuugguucugcuuca

SEQ ID NO: 2791216 - RNA, 19 nt, Human
caacuugguucugcuucaa

SEQ ID NO: 2791217 - RNA, 13 nt, Human
caacgacaaagcc

SEQ ID NO: 2791218 - RNA, 12 nt, Human
caacgaccaggg

SEQ ID NO: 2791219 - RNA, 19 nt, Human
caacgaccagggccgagga

SEQ ID NO: 2791220 - RNA, 16 nt, Human
caaccuuuauucuuuu

SEQ ID NO: 2791221 - RNA, 17 nt, Human
caaccuuucaccuuugu

SEQ ID NO: 2791222 - RNA, 21 nt, Human
caaccuuucaccuuuguguau

SEQ ID NO: 2791223 - RNA, 23 nt, Human
caacguggcuuuuuuuuuuuccc

SEQ ID NO: 2791224 - RNA, 14 nt, Human
caagagauugcuaa

SEQ ID NO: 2791225 - RNA, 15 nt, Human
caagagauugcuaau

SEQ ID NO: 2791226 - RNA, 16 nt, Human
caagagauugcuaauu

SEQ ID NO: 2791227 - RNA, 19 nt, Human
caagagauugcuaauugcu

SEQ ID NO: 2791228 - RNA, 20 nt, Human
caagagauugcuaauugcug

SEQ ID NO: 2791229 - RNA, 18 nt, Human
caagagauauuuugggca

SEQ ID NO: 2791230 - RNA, 13 nt, Human
caagagaggauga

SEQ ID NO: 2791231 - RNA, 20 nt, Human
caagagagggccaugcaauu

SEQ ID NO: 2791232 - RNA, 24 nt, Human
caagagagggccaugcaauucauc

SEQ ID NO: 2791233 - RNA, 12 nt, Human
caagagagaacc

SEQ ID NO: 2791234 - RNA, 19 nt, Human
caagagagaaccuaacugu

SEQ ID NO: 2791235 - RNA, 21 nt, Human
caagagagaaccuaacuguau

SEQ ID NO: 2791236 - RNA, 19 nt, Human
caagagaaggggaagcacu

SEQ ID NO: 2791237 - RNA, 19 nt, Human
caagagacccuucaaacuu

SEQ ID NO: 2791238 - RNA, 16 nt, Human
caagaggcuccugucc

SEQ ID NO: 2791239 - RNA, 11 nt, Human
caagaggcuga

SEQ ID NO: 2791240 - RNA, 17 nt, Human
caagaggcugagacagg

SEQ ID NO: 2791241 - RNA, 17 nt, Human
caagagcuuaacagugu

SEQ ID NO: 2791242 - RNA, 20 nt, Human
caagagcugcccuccuuguc

SEQ ID NO: 2791243 - RNA, 22 nt, Human
caagaggaauaagaauggagca

SEQ ID NO: 2791244 - RNA, 16 nt, Human
caagagcugcccuccu

SEQ ID NO: 2791245 - RNA, 18 nt, Human
caagagcugcccuccuug

SEQ ID NO: 2791246 - RNA, 13 nt, Human
caagagcugcccu

SEQ ID NO: 2791247 - RNA, 14 nt, Human
caagagcugcccuc

SEQ ID NO: 2791248 - RNA, 21 nt, Human
caagagccauguagaagcugc

SEQ ID NO: 2791249 - RNA, 17 nt, Human
caagagcagccuguggc

SEQ ID NO: 2791250 - RNA, 16 nt, Human
caagagcagccugugg

SEQ ID NO: 2791251 - RNA, 15 nt, Human
caagagcagccugug

SEQ ID NO: 2791252 - RNA, 14 nt, Human
caagagcagccugu

SEQ ID NO: 2791253 - RNA, 16 nt, Human
caagagcagaggcagc

SEQ ID NO: 2791254 - RNA, 15 nt, Human
caagagcagaggcag

SEQ ID NO: 2791255 - RNA, 13 nt, Human
caagagcacacuu

SEQ ID NO: 2791256 - RNA, 14 nt, Human
caagagcacacuug

SEQ ID NO: 2791257 - RNA, 20 nt, Human
caagagcagccuguggcauc

SEQ ID NO: 2791258 - RNA, 18 nt, Human
caagagcagccuguggca

SEQ ID NO: 2791259 - RNA, 21 nt, Human
caagagcagccuguggcaucu

SEQ ID NO: 2791260 - RNA, 16 nt, Human
caagagcacacuuggc

SEQ ID NO: 2791261 - RNA, 20 nt, Human
caagagccauguagaagcug

SEQ ID NO: 2791262 - RNA, 15 nt, Human
caagauauuguacau

SEQ ID NO: 2791263 - RNA, 16 nt, Human
caagauauuguacaua

SEQ ID NO: 2791264 - RNA, 17 nt, Human
caagauauuguacauaa

SEQ ID NO: 2791265 - RNA, 19 nt, Human
caagauauuguacauaaaa

SEQ ID NO: 2791266 - RNA, 21 nt, Human
caagauauuguacauaaaaga

SEQ ID NO: 2791267 - RNA, 17 nt, Human
caaacugacucaacagu

SEQ ID NO: 2791268 - RNA, 21 nt, Human
caaacucuugaccucagguga

SEQ ID NO: 2791269 - RNA, 20 nt, Human
caaacucuugaccucaggug

SEQ ID NO: 2791270 - RNA, 19 nt, Human
caaacucuugaccucaggu

SEQ ID NO: 2791271 - RNA, 17 nt, Human
caaacucuugaccucag

SEQ ID NO: 2791272 - RNA, 14 nt, Human
caaacucucugaac

SEQ ID NO: 2791273 - RNA, 16 nt, Human
caaacucugccagcca

SEQ ID NO: 2791274 - RNA, 12 nt, Human
caaaccugccug

SEQ ID NO: 2791275 - RNA, 16 nt, Human
caaaccugccuggguu

SEQ ID NO: 2791276 - RNA, 13 nt, Human
caaaccugccugg

SEQ ID NO: 2791277 - RNA, 14 nt, Human
caaaccugccuggg

SEQ ID NO: 2791278 - RNA, 15 nt, Human
caaaccugccugggu

SEQ ID NO: 2791279 - RNA, 13 nt, Human
caaacagaacagg

SEQ ID NO: 2791280 - RNA, 15 nt, Human
caaacagaacagggu

SEQ ID NO: 2791281 - RNA, 16 nt, Human
caaacagaacaggguc

SEQ ID NO: 2791282 - RNA, 17 nt, Human
caaacagaacaggguca

SEQ ID NO: 2791283 - RNA, 12 nt, Human
caaacaccuucc

SEQ ID NO: 2791284 - RNA, 15 nt, Human
caaacaccucccagg

SEQ ID NO: 2791285 - RNA, 14 nt, Human
caaacaccucccag

SEQ ID NO: 2791286 - RNA, 20 nt, Human
caaacacugcaggcaucaca

SEQ ID NO: 2791287 - RNA, 21 nt, Human
caaacaaggggcuguuacaua

SEQ ID NO: 2791288 - RNA, 14 nt, Human
caaacaccuuccag

SEQ ID NO: 2791289 - RNA, 21 nt, Human
caaacaccuuccagcuccugu

SEQ ID NO: 2791290 - RNA, 20 nt, Human
caaacaccuucuuauuauau

SEQ ID NO: 2791291 - RNA, 21 nt, Human
caaacaccuucuuauuauaua

SEQ ID NO: 2791292 - RNA, 22 nt, Human
caaacaccuucuuauuauauau

SEQ ID NO: 2791293 - RNA, 16 nt, Human
caaaauuuuuuuaauc

SEQ ID NO: 2791294 - RNA, 14 nt, Human
caaacaaauaugca

SEQ ID NO: 2791295 - RNA, 15 nt, Human
caaacaaauaugcaa

SEQ ID NO: 2791296 - RNA, 17 nt, Human
caaacaagaaugucccu

SEQ ID NO: 2791297 - RNA, 17 nt, Human
caaacaaauaugcaaaa

SEQ ID NO: 2791298 - RNA, 18 nt, Human
caaacaacagaaagucau

SEQ ID NO: 2791299 - RNA, 22 nt, Human
caaacaacagaaagucauuccu

SEQ ID NO: 2791300 - RNA, 21 nt, Human
caaaaucuguccaaaggaggc

SEQ ID NO: 2791301 - RNA, 16 nt, Human
caaaaucuguucuaac

SEQ ID NO: 2791302 - RNA, 17 nt, Human
caaaaucuguucuaaca

SEQ ID NO: 2791303 - RNA, 13 nt, Human
caaaaucugucca

SEQ ID NO: 2791304 - RNA, 16 nt, Human
caaaaugacaucuuuu

SEQ ID NO: 2791305 - RNA, 18 nt, Human
caaaaugacaucuuuuua

SEQ ID NO: 2791306 - RNA, 19 nt, Human
caaaaugacaucuuuuuaa

SEQ ID NO: 2791307 - RNA, 22 nt, Human
caaaaugacaucuuuuuaaagc

SEQ ID NO: 2791308 - RNA, 23 nt, Human
caaaaugacaucuuuuuaaagcu

SEQ ID NO: 2791309 - RNA, 21 nt, Human
caaaaugagcccuguccugcc

SEQ ID NO: 2791310 - RNA, 19 nt, Human
caaaauuugaugccaggac

SEQ ID NO: 2791311 - RNA, 14 nt, Human
caaaauuuuauucc

SEQ ID NO: 2791312 - RNA, 13 nt, Human
caaaauuuuauuc

SEQ ID NO: 2791313 - RNA, 20 nt, Human
caaaauuuuaguccaaauaa

SEQ ID NO: 2791314 - RNA, 23 nt, Human
caaaauuuuauaagcaaauuuca

SEQ ID NO: 2791315 - RNA, 13 nt, Human
caaaauuuguuug

SEQ ID NO: 2791316 - RNA, 18 nt, Human
caaaauuuuauuccuaua

SEQ ID NO: 2791317 - RNA, 14 nt, Human
caaaauuuuauuuu

SEQ ID NO: 2791318 - RNA, 16 nt, Human
caaaauuuuauuuugu

SEQ ID NO: 2791319 - RNA, 19 nt, Human
caaaauuuuauuuugugcu

SEQ ID NO: 2791320 - RNA, 17 nt, Human
caaaauuuucucauuuu

SEQ ID NO: 2791321 - RNA, 20 nt, Human
caaaauuuucucauuuucuu

SEQ ID NO: 2791322 - RNA, 22 nt, Human
caaaauuuucucauuuucuuuu

SEQ ID NO: 2791323 - RNA, 15 nt, Human
caaaauuuuucaacc

SEQ ID NO: 2791324 - RNA, 18 nt, Human
caaaauuuuucaacccca

SEQ ID NO: 2791325 - RNA, 22 nt, Human
caaaauuuuucaaccccacccu

SEQ ID NO: 2791326 - RNA, 23 nt, Human
caaaauuuuucaaccccacccug

SEQ ID NO: 2791327 - RNA, 14 nt, Human
caaaaguuccaaga

SEQ ID NO: 2791328 - RNA, 18 nt, Human
caaaaguuccaagagucu

SEQ ID NO: 2791329 - RNA, 23 nt, Human
caaaaguuccaagagucuaaaga

SEQ ID NO: 2791330 - RNA, 21 nt, Human
caaaaguucccugaaacacga

SEQ ID NO: 2791331 - RNA, 14 nt, Human
caaaaguuucucuu

SEQ ID NO: 2791332 - RNA, 18 nt, Human
caaaaguuggacuaaaug

SEQ ID NO: 2791333 - RNA, 19 nt, Human
caaaaguuggacuaaaugc

SEQ ID NO: 2791334 - RNA, 21 nt, Human
caaaaguuggacuaaaugccu

SEQ ID NO: 2791335 - RNA, 13 nt, Human
caaaacggggcag

SEQ ID NO: 2791336 - RNA, 15 nt, Human
caaaacuauacuuga

SEQ ID NO: 2791337 - RNA, 17 nt, Human
caaaacuauacuugaac

SEQ ID NO: 2791338 - RNA, 18 nt, Human
caaaacuauacuugaaca

SEQ ID NO: 2791339 - RNA, 19 nt, Human
caaaacuauacuugaacaa

SEQ ID NO: 2791340 - RNA, 21 nt, Human
caaaacuauacuugaacaaaa

SEQ ID NO: 2791341 - RNA, 23 nt, Human
caaaacuauacuugaacaaaagg

SEQ ID NO: 2791342 - RNA, 17 nt, Human
caaaacuccgcccccag

SEQ ID NO: 2791343 - RNA, 18 nt, Human
caaaacuccgcccccagc

SEQ ID NO: 2791344 - RNA, 20 nt, Human
caaaacuccgcccccagccu

SEQ ID NO: 2791345 - RNA, 21 nt, Human
caaaacuccgcccccagccua

SEQ ID NO: 2791346 - RNA, 16 nt, Human
caaaacuccugucuuu

SEQ ID NO: 2791347 - RNA, 16 nt, Human
caaaacgcgcagaugu

SEQ ID NO: 2791348 - RNA, 17 nt, Human
caaaacgcgcagaugug

SEQ ID NO: 2791349 - RNA, 18 nt, Human
caaaacgcgcagaugugc

SEQ ID NO: 2791350 - RNA, 21 nt, Human
auuuuauuuugugcucauuua

SEQ ID NO: 2791351 - RNA, 22 nt, Human
auuuuauuuugugcucauuuaa

SEQ ID NO: 2791352 - RNA, 23 nt, Human
auuuuauuuugugcucauuuaag

SEQ ID NO: 2791353 - RNA, 23 nt, Human
caaaaccuugcuaauuuucucaa

SEQ ID NO: 2791354 - RNA, 20 nt, Human
caaaauccuugcuuaugaca

SEQ ID NO: 2791355 - RNA, 22 nt, Human
caaaauccaaaaagaaaugaug

SEQ ID NO: 2791356 - RNA, 16 nt, Human
caaaauccaaaaagaa

SEQ ID NO: 2791357 - RNA, 16 nt, Human
caaaauccuugcuuau

SEQ ID NO: 2791358 - RNA, 18 nt, Human
caaaauccugacuauuau

SEQ ID NO: 2791359 - RNA, 18 nt, Human
caaaauccuuccaaagaa

SEQ ID NO: 2791360 - RNA, 19 nt, Human
caaaauccuuccaaagaau

SEQ ID NO: 2791361 - RNA, 15 nt, Human
caaaauauuucccau

SEQ ID NO: 2791362 - RNA, 16 nt, Human
caaaaucauuuuaaug

SEQ ID NO: 2791363 - RNA, 17 nt, Human
caaaaucaagcaagccu

SEQ ID NO: 2791364 - RNA, 19 nt, Human
caaaaucaagcaagccucu

SEQ ID NO: 2791365 - RNA, 17 nt, Human
caaaauauuuguacaua

SEQ ID NO: 2791366 - RNA, 12 nt, Human
caaaauauuuuc

SEQ ID NO: 2791367 - RNA, 13 nt, Human
caaaauauuuuua

SEQ ID NO: 2791368 - RNA, 16 nt, Human
caaaauauuuuuaaaa

SEQ ID NO: 2791369 - RNA, 16 nt, Human
caaaauauuuguacau

SEQ ID NO: 2791370 - RNA, 12 nt, Human
caaaauauuuaa

SEQ ID NO: 2791371 - RNA, 13 nt, Human
caaaauauuuaaa

SEQ ID NO: 2791372 - RNA, 14 nt, Human
caaaauauuuaaaa

SEQ ID NO: 2791373 - RNA, 17 nt, Human
caaaauauuuaaaaaug

SEQ ID NO: 2791374 - RNA, 18 nt, Human
caaaauauuuaaaaaugu

SEQ ID NO: 2791375 - RNA, 19 nt, Human
caaaauauuuaaaaauguc

SEQ ID NO: 2791376 - RNA, 20 nt, Human
caaaauauuuaaaaaugucu

SEQ ID NO: 2791377 - RNA, 21 nt, Human
caaaauauuuaaaaaugucuu

SEQ ID NO: 2791378 - RNA, 15 nt, Human
caaaauagcauuugu

SEQ ID NO: 2791379 - RNA, 16 nt, Human
caaaauagcauuuguu

SEQ ID NO: 2791380 - RNA, 13 nt, Human
caaaauagaagcu

SEQ ID NO: 2791381 - RNA, 14 nt, Human
caaaauaaauguug

SEQ ID NO: 2791382 - RNA, 14 nt, Human
caaaauaaaucagu

SEQ ID NO: 2791383 - RNA, 22 nt, Human
caaaauaaaucagugggauuug

SEQ ID NO: 2791384 - RNA, 12 nt, Human
caaaauaaaaac

SEQ ID NO: 2791385 - RNA, 15 nt, Human
caaaaguuuuccuga

SEQ ID NO: 2791386 - RNA, 17 nt, Human
caaaaguuuuccugaga

SEQ ID NO: 2791387 - RNA, 22 nt, Human
caaaauaauuuuaagaaaucaa

SEQ ID NO: 2791388 - RNA, 18 nt, Human
caaaauaauuuuaagaaa

SEQ ID NO: 2791389 - RNA, 11 nt, Human
caaaauaauuc

SEQ ID NO: 2791390 - RNA, 14 nt, Human
caaaauaauucuaa

SEQ ID NO: 2791391 - RNA, 12 nt, Human
caaaauagaaaa

SEQ ID NO: 2791392 - RNA, 14 nt, Human
caaaauagaaaagu

SEQ ID NO: 2791393 - RNA, 17 nt, Human
caaaauagaaaaguuau

SEQ ID NO: 2791394 - RNA, 12 nt, Human
cacaggaaaagg

SEQ ID NO: 2791395 - RNA, 23 nt, Human
cacaggaaaccaacacccaaagc

SEQ ID NO: 2791396 - RNA, 22 nt, Human
cacaguggaaagacagcuucuc

SEQ ID NO: 2791397 - RNA, 21 nt, Human
cacaggcccuuccucuccacu

SEQ ID NO: 2791398 - RNA, 17 nt, Human
cacagugcaucucagcc

SEQ ID NO: 2791399 - RNA, 18 nt, Human
cacagugcaucucagccc

SEQ ID NO: 2791400 - RNA, 19 nt, Human
cacagugcaucucagccca

SEQ ID NO: 2791401 - RNA, 17 nt, Human
cacaguucaauucucau

SEQ ID NO: 2791402 - RNA, 23 nt, Human
cacaguguuaaaugaaauuguaa

SEQ ID NO: 2791403 - RNA, 19 nt, Human
cacaguguugcccaggcug

SEQ ID NO: 2791404 - RNA, 14 nt, Human
cacaguguugccca

SEQ ID NO: 2791405 - RNA, 16 nt, Human
cacaguguguuuguga

SEQ ID NO: 2791406 - RNA, 13 nt, Human
cacaguguguuug

SEQ ID NO: 2791407 - RNA, 11 nt, Human
cacagcuuccu

SEQ ID NO: 2791408 - RNA, 12 nt, Human
cacagcuuccug

SEQ ID NO: 2791409 - RNA, 15 nt, Human
cacagcuuccugucc

SEQ ID NO: 2791410 - RNA, 21 nt, Human
cacagcuuccuguccccaucu

SEQ ID NO: 2791411 - RNA, 22 nt, Human
cacagcuuccuguccccaucug

SEQ ID NO: 2791412 - RNA, 20 nt, Human
cacagcugaaaguucuugcu

SEQ ID NO: 2791413 - RNA, 22 nt, Human
cacagcugcucaauaaaguaca

SEQ ID NO: 2791414 - RNA, 12 nt, Human
cacagcugcuca

SEQ ID NO: 2791415 - RNA, 15 nt, Human
cacaggcccuuccuc

SEQ ID NO: 2791416 - RNA, 16 nt, Human
cacaggcccuuccucu

SEQ ID NO: 2791417 - RNA, 17 nt, Human
cacaggcccuuccucuc

SEQ ID NO: 2791418 - RNA, 18 nt, Human
cacaggcccuuccucucc

SEQ ID NO: 2791419 - RNA, 19 nt, Human
cacaggcccuuccucucca

SEQ ID NO: 2791420 - RNA, 11 nt, Human
cagugucauuu

SEQ ID NO: 2791421 - RNA, 15 nt, Human
caguguauuucaguu

SEQ ID NO: 2791422 - RNA, 16 nt, Human
caguguauuucaguuc

SEQ ID NO: 2791423 - RNA, 17 nt, Human
caguguauggaaauaaa

SEQ ID NO: 2791424 - RNA, 19 nt, Human
caguguagccuugcccgga

SEQ ID NO: 2791425 - RNA, 15 nt, Human
caguguaguuaauuu

SEQ ID NO: 2791426 - RNA, 16 nt, Human
caguguaguuaauuua

SEQ ID NO: 2791427 - RNA, 17 nt, Human
caguguaguuaauuuau

SEQ ID NO: 2791428 - RNA, 21 nt, Human
caguguaguuaauuuaucuaa

SEQ ID NO: 2791429 - RNA, 21 nt, Human
caguguccccuccacugucac

SEQ ID NO: 2791430 - RNA, 16 nt, Human
caguguccccuccacu

SEQ ID NO: 2791431 - RNA, 17 nt, Human
caguguccccuccacug

SEQ ID NO: 2791432 - RNA, 19 nt, Human
caguguccccuccacuguc

SEQ ID NO: 2791433 - RNA, 20 nt, Human
caguguccccuccacuguca

SEQ ID NO: 2791434 - RNA, 15 nt, Human
caguguccccuccac

SEQ ID NO: 2791435 - RNA, 22 nt, Human
caguguccaaagcagggucugg

SEQ ID NO: 2791436 - RNA, 16 nt, Human
caguguccaaagcagg

SEQ ID NO: 2791437 - RNA, 17 nt, Human
caguguccaaagcaggg

SEQ ID NO: 2791438 - RNA, 12 nt, Human
cagugucauuug

SEQ ID NO: 2791439 - RNA, 13 nt, Human
cagugucauuugc

SEQ ID NO: 2791440 - RNA, 17 nt, Human
cagugucauuugcucug

SEQ ID NO: 2791441 - RNA, 19 nt, Human
caguguacauaguguaaug

SEQ ID NO: 2791442 - RNA, 20 nt, Human
caguguacauaguguaaugu

SEQ ID NO: 2791443 - RNA, 15 nt, Human
caguguaauccccca

SEQ ID NO: 2791444 - RNA, 19 nt, Human
caguguaaucccccaggag

SEQ ID NO: 2791445 - RNA, 14 nt, Human
cagugugacaagga

SEQ ID NO: 2791446 - RNA, 21 nt, Human
cagugugaaguacaauaauuc

SEQ ID NO: 2791447 - RNA, 23 nt, Human
cagugugaaguacaauaauucau

SEQ ID NO: 2791448 - RNA, 19 nt, Human
cagugucuguaaaagagcc

SEQ ID NO: 2791449 - RNA, 23 nt, Human
cagugugucuaaauuugaauguu

SEQ ID NO: 2791450 - RNA, 14 nt, Human
cagugugucuaaau

SEQ ID NO: 2791451 - RNA, 13 nt, Human
caguguggagugg

SEQ ID NO: 2791452 - RNA, 14 nt, Human
cagugugcugaugg

SEQ ID NO: 2791453 - RNA, 11 nt, Human
caguguggaac

SEQ ID NO: 2791454 - RNA, 19 nt, Human
cagugugaucccaagugcc

SEQ ID NO: 2791455 - RNA, 18 nt, Human
cagugugaucccaagugc

SEQ ID NO: 2791456 - RNA, 22 nt, Human
cagugugaucccaagugccagu

SEQ ID NO: 2791457 - RNA, 18 nt, Human
caguggaaauucagguga

SEQ ID NO: 2791458 - RNA, 16 nt, Human
cagugcuuuaauggca

SEQ ID NO: 2791459 - RNA, 18 nt, Human
caguggaaccguugccaa

SEQ ID NO: 2791460 - RNA, 16 nt, Human
caguggcagcugcuuu

SEQ ID NO: 2791461 - RNA, 15 nt, Human
caguggcagcugcuu

SEQ ID NO: 2791462 - RNA, 14 nt, Human
caguggcagcugcu

SEQ ID NO: 2791463 - RNA, 13 nt, Human
caguggcagcugc

SEQ ID NO: 2791464 - RNA, 12 nt, Human
caguggcagcug

SEQ ID NO: 2791465 - RNA, 15 nt, Human
caguggagguuuguc

SEQ ID NO: 2791466 - RNA, 13 nt, Human
caguggagaauua

SEQ ID NO: 2791467 - RNA, 14 nt, Human
caguggagaauuau

SEQ ID NO: 2791468 - RNA, 17 nt, Human
cagugggaacucugaca

SEQ ID NO: 2791469 - RNA, 22 nt, Human
cagugggaacucugacaagggc

SEQ ID NO: 2791470 - RNA, 11 nt, Human
cagugggaacu

SEQ ID NO: 2791471 - RNA, 19 nt, Human
caguggcuucaucugucaa

SEQ ID NO: 2791472 - RNA, 21 nt, Human
caguggcuucaucugucaagu

SEQ ID NO: 2791473 - RNA, 14 nt, Human
caguggcugcugcc

SEQ ID NO: 2791474 - RNA, 15 nt, Human
caguggcugcugccc

SEQ ID NO: 2791475 - RNA, 17 nt, Human
caguggcugcugcccag

SEQ ID NO: 2791476 - RNA, 18 nt, Human
caguggcugcugcccagg

SEQ ID NO: 2791477 - RNA, 18 nt, Human
caguggccuuaccccugc

SEQ ID NO: 2791478 - RNA, 19 nt, Human
caguggccuuaccccugcc

SEQ ID NO: 2791479 - RNA, 21 nt, Human
caguggccuuaccccugccuu

SEQ ID NO: 2791480 - RNA, 13 nt, Human
caguggcugcugc

SEQ ID NO: 2791481 - RNA, 20 nt, Human
caguggcucacgccuaugau

SEQ ID NO: 2791482 - RNA, 19 nt, Human
caguggcguuguugcaugu

SEQ ID NO: 2791483 - RNA, 16 nt, Human
caguggauugcauuuc

SEQ ID NO: 2791484 - RNA, 17 nt, Human
caguggauuguuuauac

SEQ ID NO: 2791485 - RNA, 13 nt, Human
caguggccacuca

SEQ ID NO: 2791486 - RNA, 14 nt, Human
caguggccacucag

SEQ ID NO: 2791487 - RNA, 22 nt, Human
caguuaccacacaucuaugaua

SEQ ID NO: 2791488 - RNA, 13 nt, Human
caguucccuuggc

SEQ ID NO: 2791489 - RNA, 20 nt, Human
caguucccuuggccucagaa

SEQ ID NO: 2791490 - RNA, 19 nt, Human
caguucccuuggccucaga

SEQ ID NO: 2791491 - RNA, 18 nt, Human
caguucccuuggccucag

SEQ ID NO: 2791492 - RNA, 17 nt, Human
caguucccuuggccuca

SEQ ID NO: 2791493 - RNA, 16 nt, Human
caguucccuuggccuc

SEQ ID NO: 2791494 - RNA, 15 nt, Human
caguucccuuggccu

SEQ ID NO: 2791495 - RNA, 14 nt, Human
caguucccuuggcc

SEQ ID NO: 2791496 - RNA, 22 nt, Human
caguuaauuacucagcagaaug

SEQ ID NO: 2791497 - RNA, 15 nt, Human
caguuaauuagcauu

SEQ ID NO: 2791498 - RNA, 21 nt, Human
caguuaauuagcauucuggca

SEQ ID NO: 2791499 - RNA, 20 nt, Human
caguuaagccuuuggaaaca

SEQ ID NO: 2791500 - RNA, 23 nt, Human
caguguuguugcucuaggaagac

SEQ ID NO: 2791501 - RNA, 20 nt, Human
caguuaaggaccguggcccu

SEQ ID NO: 2791502 - RNA, 21 nt, Human
caguuaaggaccguggcccug

SEQ ID NO: 2791503 - RNA, 14 nt, Human
caguuaagccuuug

SEQ ID NO: 2791504 - RNA, 17 nt, Human
caguuaagccuuuggaa

SEQ ID NO: 2791505 - RNA, 15 nt, Human
caguuaagccuuugg

SEQ ID NO: 2791506 - RNA, 20 nt, Human
caguguuuuaaacucuccua

SEQ ID NO: 2791507 - RNA, 14 nt, Human
caguguuuuaaauu

SEQ ID NO: 2791508 - RNA, 16 nt, Human
caguguuuuaaauucu

SEQ ID NO: 2791509 - RNA, 17 nt, Human
caguguuuuaaauucug

SEQ ID NO: 2791510 - RNA, 12 nt, Human
caguguugagau

SEQ ID NO: 2791511 - RNA, 14 nt, Human
caguguugccuaag

SEQ ID NO: 2791512 - RNA, 20 nt, Human
caguguuuuggacuccaucu

SEQ ID NO: 2791513 - RNA, 22 nt, Human
caguguuuuggacuccaucucu

SEQ ID NO: 2791514 - RNA, 24 nt, Human
caguuaacuauugcauuuauaugu

SEQ ID NO: 2791515 - RNA, 21 nt, Human
caguuaacuauugcauuuaua

SEQ ID NO: 2791516 - RNA, 14 nt, Human
caguuaaaauguga

SEQ ID NO: 2791517 - RNA, 18 nt, Human
caguguugagccuuuucc

SEQ ID NO: 2791518 - RNA, 13 nt, Human
caguguugccuaa

SEQ ID NO: 2791519 - RNA, 19 nt, Human
caguguuccccaucugggu

SEQ ID NO: 2791520 - RNA, 21 nt, Human
caguguuccccaucugggucc

SEQ ID NO: 2791521 - RNA, 14 nt, Human
caguguucgcuugg

SEQ ID NO: 2791522 - RNA, 15 nt, Human
caguguucgcuuggc

SEQ ID NO: 2791523 - RNA, 16 nt, Human
caguguucgcuuggcu

SEQ ID NO: 2791524 - RNA, 17 nt, Human
caguguucgcuuggcuc

SEQ ID NO: 2791525 - RNA, 23 nt, Human
caguguucgcuuggcuccaugcu

SEQ ID NO: 2791526 - RNA, 17 nt, Human
caguguucuaugaacaa

SEQ ID NO: 2791527 - RNA, 18 nt, Human
caguguucuaugaacaac

SEQ ID NO: 2791528 - RNA, 16 nt, Human
caguguuaaaugaaau

SEQ ID NO: 2791529 - RNA, 17 nt, Human
caguguuaaaugaaauu

SEQ ID NO: 2791530 - RNA, 18 nt, Human
caguguuaaaugaaauug

SEQ ID NO: 2791531 - RNA, 15 nt, Human
caguguuaaaugaaa

SEQ ID NO: 2791532 - RNA, 17 nt, Human
caguguguuugugauug

SEQ ID NO: 2791533 - RNA, 14 nt, Human
caguguuccccauc

SEQ ID NO: 2791534 - RNA, 14 nt, Human
caguucugaagaau

SEQ ID NO: 2791535 - RNA, 15 nt, Human
caguuccuuugugug

SEQ ID NO: 2791536 - RNA, 22 nt, Human
caguuccuuuguguguacucac

SEQ ID NO: 2791537 - RNA, 17 nt, Human
caguucgccuggagccc

SEQ ID NO: 2791538 - RNA, 18 nt, Human
caguucgccuggagcccu

SEQ ID NO: 2791539 - RNA, 20 nt, Human
caguucgccuggagcccucc

SEQ ID NO: 2791540 - RNA, 17 nt, Human
caguucuaguuugcauu

SEQ ID NO: 2791541 - RNA, 18 nt, Human
caguucuaguuugcauuc

SEQ ID NO: 2791542 - RNA, 19 nt, Human
caguucuaguuugcauucc

SEQ ID NO: 2791543 - RNA, 18 nt, Human
caguucugucauauguua

SEQ ID NO: 2791544 - RNA, 21 nt, Human
caguucuguuauauccccugc

SEQ ID NO: 2791545 - RNA, 12 nt, Human
caguucuuagcc

SEQ ID NO: 2791546 - RNA, 14 nt, Human
caguucuugaguug

SEQ ID NO: 2791547 - RNA, 21 nt, Human
cauacaucaguuauucauucu

SEQ ID NO: 2791548 - RNA, 17 nt, Human
cauacaugcaaaaagaa

SEQ ID NO: 2791549 - RNA, 16 nt, Human
cauacauuaauuaaua

SEQ ID NO: 2791550 - RNA, 20 nt, Human
cauaaucuaccaacgaaaga

SEQ ID NO: 2791551 - RNA, 21 nt, Human
cauaaucuaguuuacagaaaa

SEQ ID NO: 2791552 - RNA, 22 nt, Human
cauaaucuaguuuacagaaaaa

SEQ ID NO: 2791553 - RNA, 14 nt, Human
cauaauacaaaagg

SEQ ID NO: 2791554 - RNA, 20 nt, Human
cauaauacacuugcccugcu

SEQ ID NO: 2791555 - RNA, 21 nt, Human
cauaauacacuugcccugcuc

SEQ ID NO: 2791556 - RNA, 22 nt, Human
cauaccagcucgcaccccccug

SEQ ID NO: 2791557 - RNA, 23 nt, Human
cauaccagcucgcaccccccugu

SEQ ID NO: 2791558 - RNA, 19 nt, Human
cauaagcggcguaaguuua

SEQ ID NO: 2791559 - RNA, 17 nt, Human
cauaagaucacugccag

SEQ ID NO: 2791560 - RNA, 20 nt, Human
cauaacguuuuuccuuuaaa

SEQ ID NO: 2791561 - RNA, 17 nt, Human
cauaacguuuuuccuuu

SEQ ID NO: 2791562 - RNA, 18 nt, Human
cauaacguuuuuccuuua

SEQ ID NO: 2791563 - RNA, 18 nt, Human
cauaacucuguaaaaaca

SEQ ID NO: 2791564 - RNA, 22 nt, Human
cauaacucuguaaaaacacuga

SEQ ID NO: 2791565 - RNA, 15 nt, Human
cauaacguuuuuccu

SEQ ID NO: 2791566 - RNA, 16 nt, Human
cauaacguuuuuccuu

SEQ ID NO: 2791567 - RNA, 21 nt, Human
cauaacguuuuuccuuuaaaa

SEQ ID NO: 2791568 - RNA, 13 nt, Human
cauaacuaaauuu

SEQ ID NO: 2791569 - RNA, 14 nt, Human
cauaacuaaauuug

SEQ ID NO: 2791570 - RNA, 16 nt, Human
cauaacuaaauuugau

SEQ ID NO: 2791571 - RNA, 17 nt, Human
cauaacuaaauuugaua

SEQ ID NO: 2791572 - RNA, 18 nt, Human
cauaacuaaauuugauac

SEQ ID NO: 2791573 - RNA, 19 nt, Human
cauaacuaaauuugauacu

SEQ ID NO: 2791574 - RNA, 20 nt, Human
cauaacuaaauuugauacuu

SEQ ID NO: 2791575 - RNA, 21 nt, Human
cauaacuaaauuugauacuua

SEQ ID NO: 2791576 - RNA, 22 nt, Human
cauaacuaaauuugauacuuau

SEQ ID NO: 2791577 - RNA, 12 nt, Human
cauaacugccuu

SEQ ID NO: 2791578 - RNA, 14 nt, Human
cauaacugccuuga

SEQ ID NO: 2791579 - RNA, 19 nt, Human
cauaacugccuugaaccug

SEQ ID NO: 2791580 - RNA, 23 nt, Human
cauaacugccuugaaccugugag

SEQ ID NO: 2791581 - RNA, 16 nt, Human
cauaacuuauugcuga

SEQ ID NO: 2791582 - RNA, 19 nt, Human
cauaacuuauugcugauuu

SEQ ID NO: 2791583 - RNA, 21 nt, Human
cauaacuuauugcugauuuua

SEQ ID NO: 2791584 - RNA, 22 nt, Human
cauaacuuauugcugauuuuaa

SEQ ID NO: 2791585 - RNA, 23 nt, Human
cauaacuuauugcugauuuuaau

SEQ ID NO: 2791586 - RNA, 13 nt, Human
cauaacuuccugu

SEQ ID NO: 2791587 - RNA, 14 nt, Human
cauaacuuccugua

SEQ ID NO: 2791588 - RNA, 23 nt, Human
cauaacuuccuguacuugaaguc

SEQ ID NO: 2791589 - RNA, 22 nt, Human
cauaaguaauucaagaaaacaa

SEQ ID NO: 2791590 - RNA, 18 nt, Human
cauaaguaauucaagaaa

SEQ ID NO: 2791591 - RNA, 16 nt, Human
cauaaguauacaguuc

SEQ ID NO: 2791592 - RNA, 21 nt, Human
cauaauaaaaaauuaugacaa

SEQ ID NO: 2791593 - RNA, 23 nt, Human
cauaauaaaaaauuaugacaaug

SEQ ID NO: 2791594 - RNA, 14 nt, Human
cauaagugaauuua

SEQ ID NO: 2791595 - RNA, 16 nt, Human
cauaagugaauuuaua

SEQ ID NO: 2791596 - RNA, 17 nt, Human
cauaaguaauucaagaa

SEQ ID NO: 2791597 - RNA, 16 nt, Human
cauaaguaauucaaga

SEQ ID NO: 2791598 - RNA, 22 nt, Human
cauaagguuucguuucuguaua

SEQ ID NO: 2791599 - RNA, 15 nt, Human
cauaagguuucguuu

SEQ ID NO: 2791600 - RNA, 21 nt, Human
cauaagguuucguuucuguau

SEQ ID NO: 2791601 - RNA, 21 nt, Human
cauaagggguuugccauuuga

SEQ ID NO: 2791602 - RNA, 23 nt, Human
cauaagggguuugccauuugaua

SEQ ID NO: 2791603 - RNA, 15 nt, Human
cauaaggcuucaaaa

SEQ ID NO: 2791604 - RNA, 19 nt, Human
cauaaggcuucaaaauguu

SEQ ID NO: 2791605 - RNA, 21 nt, Human
cauaaggccaguaugauuuau

SEQ ID NO: 2791606 - RNA, 20 nt, Human
cauaacauuuucagaauagu

SEQ ID NO: 2791607 - RNA, 16 nt, Human
cauaaccuagccuuag

SEQ ID NO: 2791608 - RNA, 18 nt, Human
cauaacccacuugucacu

SEQ ID NO: 2791609 - RNA, 13 nt, Human
cauaacagugcag

SEQ ID NO: 2791610 - RNA, 15 nt, Human
cauaacagugcaggg

SEQ ID NO: 2791611 - RNA, 16 nt, Human
cauaacagugcagggc

SEQ ID NO: 2791612 - RNA, 15 nt, Human
cauaacaacuucaua

SEQ ID NO: 2791613 - RNA, 13 nt, Human
cauaaauaugcag

SEQ ID NO: 2791614 - RNA, 15 nt, Human
cauaaauaugcagug

SEQ ID NO: 2791615 - RNA, 20 nt, Human
cauaaauaugcagugauaug

SEQ ID NO: 2791616 - RNA, 12 nt, Human
cauaaauaugca

SEQ ID NO: 2791617 - RNA, 18 nt, Human
cauaaaguuagaaucuau

SEQ ID NO: 2791618 - RNA, 22 nt, Human
cauaaaguuagaaucuauuuuc

SEQ ID NO: 2791619 - RNA, 12 nt, Human
cauaaaguacuu

SEQ ID NO: 2791620 - RNA, 16 nt, Human
cauaaagguaaaacaa

SEQ ID NO: 2791621 - RNA, 18 nt, Human
cauaaagcauaaguauac

SEQ ID NO: 2791622 - RNA, 22 nt, Human
cauaaagccauguuuccucuuu

SEQ ID NO: 2791623 - RNA, 20 nt, Human
cauaaauuuacuuuacacaa

SEQ ID NO: 2791624 - RNA, 13 nt, Human
cauaaaugaagca

SEQ ID NO: 2791625 - RNA, 14 nt, Human
cauaaaugaagcag

SEQ ID NO: 2791626 - RNA, 14 nt, Human
cauaaaugcagccc

SEQ ID NO: 2791627 - RNA, 15 nt, Human
cauaaaugcagccca

SEQ ID NO: 2791628 - RNA, 16 nt, Human
cauaaaugcagcccau

SEQ ID NO: 2791629 - RNA, 18 nt, Human
cauaaaugcagcccauuu

SEQ ID NO: 2791630 - RNA, 21 nt, Human
cauaaaugcagcccauuucuc

SEQ ID NO: 2791631 - RNA, 18 nt, Human
cauaaauaugcagugaua

SEQ ID NO: 2791632 - RNA, 22 nt, Human
cauaaagaggcguugcuuucac

SEQ ID NO: 2791633 - RNA, 16 nt, Human
cauaaauccaguucua

SEQ ID NO: 2791634 - RNA, 15 nt, Human
cauaaacauucuuuu

SEQ ID NO: 2791635 - RNA, 19 nt, Human
cauaaaaacauuuuaaaaa

SEQ ID NO: 2791636 - RNA, 18 nt, Human
cauaaacaaugaugcccu

SEQ ID NO: 2791637 - RNA, 23 nt, Human
cauaaaaagccugcaauuucaua

SEQ ID NO: 2791638 - RNA, 21 nt, Human
cauaaaaaggacaucagcaaa

SEQ ID NO: 2791639 - RNA, 20 nt, Human
cauaaaaaggacaucagcaa

SEQ ID NO: 2791640 - RNA, 19 nt, Human
cauaaaaaggacaucagca

SEQ ID NO: 2791641 - RNA, 13 nt, Human
cauaaaaaggaca

SEQ ID NO: 2791642 - RNA, 22 nt, Human
cauaaaaaggacaucagcaaac

SEQ ID NO: 2791643 - RNA, 12 nt, Human
cauaaaacaggu

SEQ ID NO: 2791644 - RNA, 14 nt, Human
cauaaaaucaaaac

SEQ ID NO: 2791645 - RNA, 22 nt, Human
cauaaaaucaaaacaagugaaa

SEQ ID NO: 2791646 - RNA, 20 nt, Human
cauaaaauaaaguauauaua

SEQ ID NO: 2791647 - RNA, 14 nt, Human
cauaaaagaauuuu

SEQ ID NO: 2791648 - RNA, 19 nt, Human
cauaaaauaaaguauauau

SEQ ID NO: 2791649 - RNA, 20 nt, Human
caguugaaugacaacagaag

SEQ ID NO: 2791650 - RNA, 21 nt, Human
caguugaaugacaacagaagc

SEQ ID NO: 2791651 - RNA, 20 nt, Human
caguugcagcccuugugaug

SEQ ID NO: 2791652 - RNA, 20 nt, Human
caguugagucgucaucacuu

SEQ ID NO: 2791653 - RNA, 19 nt, Human
caguuuugacaucagccag

SEQ ID NO: 2791654 - RNA, 20 nt, Human
caguuuugacaucagccagc

SEQ ID NO: 2791655 - RNA, 23 nt, Human
caguuuugacaucagccagcugc

SEQ ID NO: 2791656 - RNA, 17 nt, Human
caguuuuuggaguguua

SEQ ID NO: 2791657 - RNA, 19 nt, Human
caguuuugguguguaacuu

SEQ ID NO: 2791658 - RNA, 19 nt, Human
caguuuuuaacucuacugu

SEQ ID NO: 2791659 - RNA, 22 nt, Human
caguuuuuaacucuacugugua

SEQ ID NO: 2791660 - RNA, 12 nt, Human
caguuuuucagg

SEQ ID NO: 2791661 - RNA, 15 nt, Human
caguuuuucaggagc

SEQ ID NO: 2791662 - RNA, 12 nt, Human
caguugugcagc

SEQ ID NO: 2791663 - RNA, 17 nt, Human
caguuguggugugagua

SEQ ID NO: 2791664 - RNA, 21 nt, Human
caguuguggugugaguaucag

SEQ ID NO: 2791665 - RNA, 22 nt, Human
caguuguggugugaguaucaga

SEQ ID NO: 2791666 - RNA, 17 nt, Human
caguuguguuuguugcu

SEQ ID NO: 2791667 - RNA, 22 nt, Human
caguuguguuuguugcuggcuu

SEQ ID NO: 2791668 - RNA, 23 nt, Human
caguuguguuuguugcuggcuug

SEQ ID NO: 2791669 - RNA, 14 nt, Human
caguugguuguguc

SEQ ID NO: 2791670 - RNA, 17 nt, Human
caguugguugugucuuu

SEQ ID NO: 2791671 - RNA, 18 nt, Human
caguugguugugucuuuu

SEQ ID NO: 2791672 - RNA, 21 nt, Human
caguuguaggguuacagagac

SEQ ID NO: 2791673 - RNA, 23 nt, Human
caguuguaggguuacagagaccu

SEQ ID NO: 2791674 - RNA, 19 nt, Human
caguuggguggaugccugg

SEQ ID NO: 2791675 - RNA, 18 nt, Human
caguuggguggaugccug

SEQ ID NO: 2791676 - RNA, 12 nt, Human
caguugccacca

SEQ ID NO: 2791677 - RNA, 15 nt, Human
caguugccaccaccu

SEQ ID NO: 2791678 - RNA, 16 nt, Human
caguugccaccaccuc

SEQ ID NO: 2791679 - RNA, 18 nt, Human
caguugccaccaccucug

SEQ ID NO: 2791680 - RNA, 21 nt, Human
caguugccaccaccucugugg

SEQ ID NO: 2791681 - RNA, 22 nt, Human
caguugccaccaccucuguggc

SEQ ID NO: 2791682 - RNA, 15 nt, Human
caguugcuaaacacu

SEQ ID NO: 2791683 - RNA, 16 nt, Human
caguugcuaaacacug

SEQ ID NO: 2791684 - RNA, 21 nt, Human
caguugcuaaacacugcgcuu

SEQ ID NO: 2791685 - RNA, 16 nt, Human
caguuggguggaugcc

SEQ ID NO: 2791686 - RNA, 16 nt, Human
caguuggccuucagaa

SEQ ID NO: 2791687 - RNA, 21 nt, Human
caguuggaaauaauaaaagau

SEQ ID NO: 2791688 - RNA, 21 nt, Human
cauaccuuucacagcuuuuau

SEQ ID NO: 2791689 - RNA, 17 nt, Human
cauaccuuuuauuuuuu

SEQ ID NO: 2791690 - RNA, 22 nt, Human
cauaccuuuuauuuuuuuuaau

SEQ ID NO: 2791691 - RNA, 16 nt, Human
cauacgaaacacaaac

SEQ ID NO: 2791692 - RNA, 19 nt, Human
cauacggucagguuuaaca

SEQ ID NO: 2791693 - RNA, 23 nt, Human
cauacggucagguuuaacauuug

SEQ ID NO: 2791694 - RNA, 22 nt, Human
cauaccucagaauguaaaagaa

SEQ ID NO: 2791695 - RNA, 22 nt, Human
cauacccuggccgcccccugcc

SEQ ID NO: 2791696 - RNA, 17 nt, Human
cauaccuaaguacugua

SEQ ID NO: 2791697 - RNA, 18 nt, Human
cauaccuaaguacuguaa

SEQ ID NO: 2791698 - RNA, 13 nt, Human
cauaccucugacc

SEQ ID NO: 2791699 - RNA, 17 nt, Human
cauaccucugaccaaca

SEQ ID NO: 2791700 - RNA, 23 nt, Human
cauacuacauugaguagacacau

SEQ ID NO: 2791701 - RNA, 18 nt, Human
cauacuacugaaacagau

SEQ ID NO: 2791702 - RNA, 20 nt, Human
cauacuacugaaacagauuu

SEQ ID NO: 2791703 - RNA, 22 nt, Human
cauacuacugaaacagauuuca

SEQ ID NO: 2791704 - RNA, 20 nt, Human
cauacuaauuauacccccug

SEQ ID NO: 2791705 - RNA, 12 nt, Human
cauacucagccu

SEQ ID NO: 2791706 - RNA, 14 nt, Human
cauacucagccugc

SEQ ID NO: 2791707 - RNA, 15 nt, Human
cauacucagccugcu

SEQ ID NO: 2791708 - RNA, 17 nt, Human
cauacucagccugcugc

SEQ ID NO: 2791709 - RNA, 18 nt, Human
cauacucagccugcugcc

SEQ ID NO: 2791710 - RNA, 19 nt, Human
cauacucagccugcugccc

SEQ ID NO: 2791711 - RNA, 20 nt, Human
cauacucagccugcugccca

SEQ ID NO: 2791712 - RNA, 21 nt, Human
cauacucagccugcugcccag

SEQ ID NO: 2791713 - RNA, 17 nt, Human
caucuagguaauuuuua

SEQ ID NO: 2791714 - RNA, 18 nt, Human
caucuagguaauuuuuac

SEQ ID NO: 2791715 - RNA, 18 nt, Human
caucuaguacuugaaaaa

SEQ ID NO: 2791716 - RNA, 14 nt, Human
caucuauaaagaag

SEQ ID NO: 2791717 - RNA, 14 nt, Human
caucuauaaauugu

SEQ ID NO: 2791718 - RNA, 20 nt, Human
caucuaugggagagugucaa

SEQ ID NO: 2791719 - RNA, 19 nt, Human
caucuaugucccuugcugu

SEQ ID NO: 2791720 - RNA, 11 nt, Human
caucuauuuug

SEQ ID NO: 2791721 - RNA, 13 nt, Human
caucuauuuugau

SEQ ID NO: 2791722 - RNA, 14 nt, Human
caucuauuuugaug

SEQ ID NO: 2791723 - RNA, 17 nt, Human
caucuauuuugaugcag

SEQ ID NO: 2791724 - RNA, 19 nt, Human
caucuauuuugaugcagca

SEQ ID NO: 2791725 - RNA, 21 nt, Human
caucuauuuugaugcagcauu

SEQ ID NO: 2791726 - RNA, 22 nt, Human
caucuauuuugaugcagcauuu

SEQ ID NO: 2791727 - RNA, 23 nt, Human
caucuauuuugaugcagcauuug

SEQ ID NO: 2791728 - RNA, 16 nt, Human
caucuauuuuggauug

SEQ ID NO: 2791729 - RNA, 14 nt, Human
caucucaaaauuau

SEQ ID NO: 2791730 - RNA, 14 nt, Human
caucuauuuuggau

SEQ ID NO: 2791731 - RNA, 22 nt, Human
caucucaaggaauaaugggcuu

SEQ ID NO: 2791732 - RNA, 18 nt, Human
caucucaggagauuucau

SEQ ID NO: 2791733 - RNA, 19 nt, Human
caucucacuggaugcaaag

SEQ ID NO: 2791734 - RNA, 20 nt, Human
caucucagccuaccaugaga

SEQ ID NO: 2791735 - RNA, 13 nt, Human
caucucagcccac

SEQ ID NO: 2791736 - RNA, 17 nt, Human
caucucauuccaacuuc

SEQ ID NO: 2791737 - RNA, 23 nt, Human
caucucauguaucaucuggauag

SEQ ID NO: 2791738 - RNA, 22 nt, Human
caucucauucaaaccccacccu

SEQ ID NO: 2791739 - RNA, 20 nt, Human
caucucauguaucaucugga

SEQ ID NO: 2791740 - RNA, 12 nt, Human
caucucaggggc

SEQ ID NO: 2791741 - RNA, 15 nt, Human
caucucaggggccag

SEQ ID NO: 2791742 - RNA, 16 nt, Human
caucucaggggccaga

SEQ ID NO: 2791743 - RNA, 19 nt, Human
caucucaggggccagagga

SEQ ID NO: 2791744 - RNA, 18 nt, Human
caucucaggccucccuca

SEQ ID NO: 2791745 - RNA, 14 nt, Human
cauccuccuggaac

SEQ ID NO: 2791746 - RNA, 16 nt, Human
cauccuccuggaaccu

SEQ ID NO: 2791747 - RNA, 21 nt, Human
cauccuccuggaaccuugcug

SEQ ID NO: 2791748 - RNA, 22 nt, Human
cauccuccuggaaccuugcugu

SEQ ID NO: 2791749 - RNA, 23 nt, Human
cauccuccuggaaccuugcuguc

SEQ ID NO: 2791750 - RNA, 20 nt, Human
cauccuccguccagccgcca

SEQ ID NO: 2791751 - RNA, 19 nt, Human
cauccuccguccagccgcc

SEQ ID NO: 2791752 - RNA, 21 nt, Human
caucuaauucucuguggaaug

SEQ ID NO: 2791753 - RNA, 23 nt, Human
caucuaauagcggguuacuuuca

SEQ ID NO: 2791754 - RNA, 20 nt, Human
caucuaaguuauaagacucu

SEQ ID NO: 2791755 - RNA, 14 nt, Human
caucuaagcugcag

SEQ ID NO: 2791756 - RNA, 15 nt, Human
caucuaagcugcagc

SEQ ID NO: 2791757 - RNA, 16 nt, Human
caucuaagcugcagcu

SEQ ID NO: 2791758 - RNA, 17 nt, Human
caucuaagcugcagcuu

SEQ ID NO: 2791759 - RNA, 20 nt, Human
caucuaagcugcagcuuccu

SEQ ID NO: 2791760 - RNA, 21 nt, Human
caucuaagcugcagcuuccug

SEQ ID NO: 2791761 - RNA, 23 nt, Human
caucuaagcugcagcuuccuguc

SEQ ID NO: 2791762 - RNA, 16 nt, Human
cauccucaaacacugc

SEQ ID NO: 2791763 - RNA, 17 nt, Human
cauccucaaacacugca

SEQ ID NO: 2791764 - RNA, 18 nt, Human
cauccucaaacacugcag

SEQ ID NO: 2791765 - RNA, 19 nt, Human
cauccucaaacacugcagg

SEQ ID NO: 2791766 - RNA, 17 nt, Human
cauccuauccacugggc

SEQ ID NO: 2791767 - RNA, 14 nt, Human
cauccuacccuuuu

SEQ ID NO: 2791768 - RNA, 16 nt, Human
cauccuacaagacaca

SEQ ID NO: 2791769 - RNA, 22 nt, Human
cauccucaaacacugcaggcau

SEQ ID NO: 2791770 - RNA, 19 nt, Human
cauccucaagaucauucag

SEQ ID NO: 2791771 - RNA, 15 nt, Human
cauccucagaugcuc

SEQ ID NO: 2791772 - RNA, 19 nt, Human
cauccucagaugcucaaag

SEQ ID NO: 2791773 - RNA, 19 nt, Human
cauccuccaguaccuugcu

SEQ ID NO: 2791774 - RNA, 16 nt, Human
cauccuccguccagcc

SEQ ID NO: 2791775 - RNA, 20 nt, Human
cauccuccgccucccggguu

SEQ ID NO: 2791776 - RNA, 13 nt, Human
caucuucugccuu

SEQ ID NO: 2791777 - RNA, 13 nt, Human
caucuucccgaga

SEQ ID NO: 2791778 - RNA, 14 nt, Human
caucuucgggacca

SEQ ID NO: 2791779 - RNA, 14 nt, Human
caucuucccaaccc

SEQ ID NO: 2791780 - RNA, 15 nt, Human
caucuucgggaccag

SEQ ID NO: 2791781 - RNA, 18 nt, Human
caucuucgggaccaggau

SEQ ID NO: 2791782 - RNA, 15 nt, Human
caucuucgucuucac

SEQ ID NO: 2791783 - RNA, 17 nt, Human
caucuucgucuucacuc

SEQ ID NO: 2791784 - RNA, 19 nt, Human
caucuucgucuucacucuu

SEQ ID NO: 2791785 - RNA, 21 nt, Human
caucuucgucuucacucuuag

SEQ ID NO: 2791786 - RNA, 23 nt, Human
caucuucgucuucacucuuaggc

SEQ ID NO: 2791787 - RNA, 21 nt, Human
caucuucuaaacccaauccaa

SEQ ID NO: 2791788 - RNA, 20 nt, Human
caucuugcucugcugacaga

SEQ ID NO: 2791789 - RNA, 23 nt, Human
caucuuguaauuuccagcuuucu

SEQ ID NO: 2791790 - RNA, 17 nt, Human
caucuuguauacacaua

SEQ ID NO: 2791791 - RNA, 12 nt, Human
caucuugugaaa

SEQ ID NO: 2791792 - RNA, 13 nt, Human
caucuugugaaau

SEQ ID NO: 2791793 - RNA, 16 nt, Human
caucuuggagggacca

SEQ ID NO: 2791794 - RNA, 13 nt, Human
caucuugcucugc

SEQ ID NO: 2791795 - RNA, 14 nt, Human
caucuugcucugcu

SEQ ID NO: 2791796 - RNA, 15 nt, Human
caucuuauagcacuu

SEQ ID NO: 2791797 - RNA, 18 nt, Human
caucuuauagcacuuuga

SEQ ID NO: 2791798 - RNA, 19 nt, Human
caucuuauagcacuuugaa

SEQ ID NO: 2791799 - RNA, 21 nt, Human
caucuuauagcacuuugaaau

SEQ ID NO: 2791800 - RNA, 18 nt, Human
caucuuaucaaggacucu

SEQ ID NO: 2791801 - RNA, 20 nt, Human
caucuuaugcuaacuguaga

SEQ ID NO: 2791802 - RNA, 21 nt, Human
caucuuaugcuaacuguagau

SEQ ID NO: 2791803 - RNA, 13 nt, Human
caucuucacccag

SEQ ID NO: 2791804 - RNA, 17 nt, Human
caucuucacccaggccu

SEQ ID NO: 2791805 - RNA, 18 nt, Human
caucuucacccaggccua

SEQ ID NO: 2791806 - RNA, 20 nt, Human
caucuuauuuucauguauau

SEQ ID NO: 2791807 - RNA, 14 nt, Human
caucugauaucuau

SEQ ID NO: 2791808 - RNA, 22 nt, Human
caucugauaucuauaguagaca

SEQ ID NO: 2791809 - RNA, 18 nt, Human
caucugaugccgugaucc

SEQ ID NO: 2791810 - RNA, 13 nt, Human
caucugauuugca

SEQ ID NO: 2791811 - RNA, 15 nt, Human
caucugauuugcaua

SEQ ID NO: 2791812 - RNA, 19 nt, Human
caucugauuugcauauuca

SEQ ID NO: 2791813 - RNA, 16 nt, Human
caucugaggcauccag

SEQ ID NO: 2791814 - RNA, 17 nt, Human
caucugaggcauccagc

SEQ ID NO: 2791815 - RNA, 18 nt, Human
caucugaggcauccagca

SEQ ID NO: 2791816 - RNA, 20 nt, Human
caucugagguccugugaucu

SEQ ID NO: 2791817 - RNA, 23 nt, Human
caucugagguccugugaucuuau

SEQ ID NO: 2791818 - RNA, 13 nt, Human
caucucuguccca

SEQ ID NO: 2791819 - RNA, 18 nt, Human
caucucuguacuuugcuu

SEQ ID NO: 2791820 - RNA, 20 nt, Human
caucucuugaggccaggagu

SEQ ID NO: 2791821 - RNA, 15 nt, Human
caucucuugaggcca

SEQ ID NO: 2791822 - RNA, 22 nt, Human
caucucuucuggguuccuuccu

SEQ ID NO: 2791823 - RNA, 14 nt, Human
caucucccacccug

SEQ ID NO: 2791824 - RNA, 15 nt, Human
caucucccacccugu

SEQ ID NO: 2791825 - RNA, 16 nt, Human
caucucccacccugua

SEQ ID NO: 2791826 - RNA, 21 nt, Human
caucucccacccuguaccuca

SEQ ID NO: 2791827 - RNA, 14 nt, Human
caucuccacuccag

SEQ ID NO: 2791828 - RNA, 14 nt, Human
caucccuccccagu

SEQ ID NO: 2791829 - RNA, 13 nt, Human
caucccuccccag

SEQ ID NO: 2791830 - RNA, 15 nt, Human
cauccagguucagcu

SEQ ID NO: 2791831 - RNA, 19 nt, Human
cauccagggcucugaccag

SEQ ID NO: 2791832 - RNA, 22 nt, Human
caucccuacccccuaagagcca

SEQ ID NO: 2791833 - RNA, 14 nt, Human
caucccuacccccu

SEQ ID NO: 2791834 - RNA, 12 nt, Human
cauccagcaaga

SEQ ID NO: 2791835 - RNA, 13 nt, Human
cauccagcaagaa

SEQ ID NO: 2791836 - RNA, 14 nt, Human
cauccagcuugcca

SEQ ID NO: 2791837 - RNA, 15 nt, Human
cauccagcuugccag

SEQ ID NO: 2791838 - RNA, 15 nt, Human
cauccagcagucucu

SEQ ID NO: 2791839 - RNA, 16 nt, Human
cauccagcagucucug

SEQ ID NO: 2791840 - RNA, 17 nt, Human
cauccagcagucucugc

SEQ ID NO: 2791841 - RNA, 18 nt, Human
cauccagcagucucugcc

SEQ ID NO: 2791842 - RNA, 19 nt, Human
cauccagcagucucugccu

SEQ ID NO: 2791843 - RNA, 20 nt, Human
cauccagcagucucugccuu

SEQ ID NO: 2791844 - RNA, 21 nt, Human
cauccagcagucucugccuug

SEQ ID NO: 2791845 - RNA, 15 nt, Human
cauccacucuacccu

SEQ ID NO: 2791846 - RNA, 14 nt, Human
cauccacucuaccc

SEQ ID NO: 2791847 - RNA, 17 nt, Human
cauccacauuguuuuaa

SEQ ID NO: 2791848 - RNA, 18 nt, Human
cauccacauuguuuuaaa

SEQ ID NO: 2791849 - RNA, 14 nt, Human
cauccaccccaucc

SEQ ID NO: 2791850 - RNA, 18 nt, Human
cauccaccgcugcuccac

SEQ ID NO: 2791851 - RNA, 12 nt, Human
cauccaccccau

SEQ ID NO: 2791852 - RNA, 21 nt, Human
cauccacauuguuuuaaaaag

SEQ ID NO: 2791853 - RNA, 12 nt, Human
cauccaccccag

SEQ ID NO: 2791854 - RNA, 20 nt, Human
cauccaaucuauuauuucuc

SEQ ID NO: 2791855 - RNA, 22 nt, Human
caucacaggguugggcccagau

SEQ ID NO: 2791856 - RNA, 13 nt, Human
caucauugcagau

SEQ ID NO: 2791857 - RNA, 18 nt, Human
caucauugcugucugcag

SEQ ID NO: 2791858 - RNA, 21 nt, Human
caucauugcugucugcagccu

SEQ ID NO: 2791859 - RNA, 13 nt, Human
caucauuguuucu

SEQ ID NO: 2791860 - RNA, 17 nt, Human
caucauuguuucugcau

SEQ ID NO: 2791861 - RNA, 23 nt, Human
cauccaaaauaguuaagacauga

SEQ ID NO: 2791862 - RNA, 17 nt, Human
caucauuuuuguaucua

SEQ ID NO: 2791863 - RNA, 18 nt, Human
cauccaacuccagcaacu

SEQ ID NO: 2791864 - RNA, 17 nt, Human
cauccaacuccagcaac

SEQ ID NO: 2791865 - RNA, 16 nt, Human
cauccaacuccagcaa

SEQ ID NO: 2791866 - RNA, 15 nt, Human
cauccaacuccagca

SEQ ID NO: 2791867 - RNA, 14 nt, Human
cauccaacuccagc

SEQ ID NO: 2791868 - RNA, 16 nt, Human
cauccaaccuucccaa

SEQ ID NO: 2791869 - RNA, 15 nt, Human
cauccaaguggcaua

SEQ ID NO: 2791870 - RNA, 15 nt, Human
cauccaacuccagga

SEQ ID NO: 2791871 - RNA, 14 nt, Human
cauccaacuuaugu

SEQ ID NO: 2791872 - RNA, 14 nt, Human
cauccaaccuuccc

SEQ ID NO: 2791873 - RNA, 21 nt, Human
cauccaaccccccaccugcca

SEQ ID NO: 2791874 - RNA, 19 nt, Human
cauccaaccccccaccugc

SEQ ID NO: 2791875 - RNA, 16 nt, Human
cauccaaccccccacc

SEQ ID NO: 2791876 - RNA, 15 nt, Human
cauccaaccccccac

SEQ ID NO: 2791877 - RNA, 14 nt, Human
cauccuaacuccau

SEQ ID NO: 2791878 - RNA, 21 nt, Human
cauccuaacuccaugucucug

SEQ ID NO: 2791879 - RNA, 16 nt, Human
cauccuaaaagccacc

SEQ ID NO: 2791880 - RNA, 19 nt, Human
cauccuaaaagccacccca

SEQ ID NO: 2791881 - RNA, 14 nt, Human
cauccuaagaaaua

SEQ ID NO: 2791882 - RNA, 15 nt, Human
cauccuaagaaauau

SEQ ID NO: 2791883 - RNA, 16 nt, Human
cauccuaagaaauaug

SEQ ID NO: 2791884 - RNA, 17 nt, Human
cauccuaagaaauaugu

SEQ ID NO: 2791885 - RNA, 20 nt, Human
cauccuaagaaauaugugag

SEQ ID NO: 2791886 - RNA, 22 nt, Human
cauccuaagaaauaugugagau

SEQ ID NO: 2791887 - RNA, 19 nt, Human
caucaaucaaauaaguauu

SEQ ID NO: 2791888 - RNA, 22 nt, Human
caucaauaguguccuaugcaau

SEQ ID NO: 2791889 - RNA, 23 nt, Human
caucaauaguguccuaugcaaua

SEQ ID NO: 2791890 - RNA, 15 nt, Human
caucacaauacagau

SEQ ID NO: 2791891 - RNA, 11 nt, Human
caucaauuccc

SEQ ID NO: 2791892 - RNA, 14 nt, Human
caucaauucccauu

SEQ ID NO: 2791893 - RNA, 19 nt, Human
caucacaggguugggccca

SEQ ID NO: 2791894 - RNA, 20 nt, Human
caucacagggcagagccggg

SEQ ID NO: 2791895 - RNA, 15 nt, Human
caucacagggcagag

SEQ ID NO: 2791896 - RNA, 13 nt, Human
caucacagggcag

SEQ ID NO: 2791897 - RNA, 22 nt, Human
caucacaggacacggggcagug

SEQ ID NO: 2791898 - RNA, 17 nt, Human
caucacagcuaacaauu

SEQ ID NO: 2791899 - RNA, 12 nt, Human
caucacacacac

SEQ ID NO: 2791900 - RNA, 12 nt, Human
caucacacacau

SEQ ID NO: 2791901 - RNA, 13 nt, Human
caucacacacaug

SEQ ID NO: 2791902 - RNA, 15 nt, Human
caucacacacaugga

SEQ ID NO: 2791903 - RNA, 20 nt, Human
caucacacacauggaaaccc

SEQ ID NO: 2791904 - RNA, 11 nt, Human
caucacacaca

SEQ ID NO: 2791905 - RNA, 12 nt, Human
caucacagcagc

SEQ ID NO: 2791906 - RNA, 13 nt, Human
caucacagcagcc

SEQ ID NO: 2791907 - RNA, 14 nt, Human
caucacagcagccu

SEQ ID NO: 2791908 - RNA, 16 nt, Human
caucacagcagccucc

SEQ ID NO: 2791909 - RNA, 19 nt, Human
caucacagcagccuccaac

SEQ ID NO: 2791910 - RNA, 21 nt, Human
caucaagaggugggagggccc

SEQ ID NO: 2791911 - RNA, 16 nt, Human
caucaaggcacugccu

SEQ ID NO: 2791912 - RNA, 13 nt, Human
caucaagacugga

SEQ ID NO: 2791913 - RNA, 17 nt, Human
caucaaggcacugccug

SEQ ID NO: 2791914 - RNA, 18 nt, Human
caucaaggcacugccuga

SEQ ID NO: 2791915 - RNA, 16 nt, Human
caucaaggggucacuu

SEQ ID NO: 2791916 - RNA, 17 nt, Human
caucaaggggucacuua

SEQ ID NO: 2791917 - RNA, 15 nt, Human
caucaagacuggaag

SEQ ID NO: 2791918 - RNA, 16 nt, Human
caucaagacuggaagg

SEQ ID NO: 2791919 - RNA, 14 nt, Human
caucaaacuguaaa

SEQ ID NO: 2791920 - RNA, 15 nt, Human
caucaaaaugcuuuu

SEQ ID NO: 2791921 - RNA, 13 nt, Human
caucaaaaugcuu

SEQ ID NO: 2791922 - RNA, 18 nt, Human
caucaaaaacuuuggagu

SEQ ID NO: 2791923 - RNA, 19 nt, Human
cauauuuuuuauaucugga

SEQ ID NO: 2791924 - RNA, 13 nt, Human
cauauuuuguaua

SEQ ID NO: 2791925 - RNA, 13 nt, Human
cauauuuucacag

SEQ ID NO: 2791926 - RNA, 15 nt, Human
cauaugcccacauuu

SEQ ID NO: 2791927 - RNA, 20 nt, Human
cauaugcccacauuuagucu

SEQ ID NO: 2791928 - RNA, 23 nt, Human
cauaugcccacauuuagucucuu

SEQ ID NO: 2791929 - RNA, 16 nt, Human
cauaugcaccuugugu

SEQ ID NO: 2791930 - RNA, 17 nt, Human
cauaugcaccuuguguc

SEQ ID NO: 2791931 - RNA, 18 nt, Human
cauaugcaccuugugucu

SEQ ID NO: 2791932 - RNA, 19 nt, Human
cauaugcaccuugugucug

SEQ ID NO: 2791933 - RNA, 20 nt, Human
cauaugcaccuugugucugu

SEQ ID NO: 2791934 - RNA, 21 nt, Human
cauaugcaccuugugucugua

SEQ ID NO: 2791935 - RNA, 23 nt, Human
cauaugcaccuugugucuguaca

SEQ ID NO: 2791936 - RNA, 15 nt, Human
cauauuugagacuag

SEQ ID NO: 2791937 - RNA, 13 nt, Human
cauauuuacuacc

SEQ ID NO: 2791938 - RNA, 16 nt, Human
cauauuuacuaccuua

SEQ ID NO: 2791939 - RNA, 17 nt, Human
cauauuuacuaccuuau

SEQ ID NO: 2791940 - RNA, 12 nt, Human
cauauuuaucca

SEQ ID NO: 2791941 - RNA, 21 nt, Human
cauauuuauccaaaaugugua

SEQ ID NO: 2791942 - RNA, 22 nt, Human
cauauuuauccaaaauguguau

SEQ ID NO: 2791943 - RNA, 17 nt, Human
cauauuuauccauuugu

SEQ ID NO: 2791944 - RNA, 14 nt, Human
cauauuuauuuucu

SEQ ID NO: 2791945 - RNA, 18 nt, Human
cauauuuauuuucuuuug

SEQ ID NO: 2791946 - RNA, 15 nt, Human
cauauaccuauaaug

SEQ ID NO: 2791947 - RNA, 17 nt, Human
cauauaccuauaaugug

SEQ ID NO: 2791948 - RNA, 18 nt, Human
cauauaccuauaaugugu

SEQ ID NO: 2791949 - RNA, 19 nt, Human
cauauaccuauaaugugug

SEQ ID NO: 2791950 - RNA, 20 nt, Human
cauauaccuauaaugugugu

SEQ ID NO: 2791951 - RNA, 21 nt, Human
cauauaccuauaaugugugua

SEQ ID NO: 2791952 - RNA, 22 nt, Human
cauauaccuauaauguguguau

SEQ ID NO: 2791953 - RNA, 16 nt, Human
cauauauacaggcaua

SEQ ID NO: 2791954 - RNA, 20 nt, Human
cauauauagacagcuuugac

SEQ ID NO: 2791955 - RNA, 21 nt, Human
cauauauagacagcuuugacu

SEQ ID NO: 2791956 - RNA, 22 nt, Human
cauauauagacagcuuugacug

SEQ ID NO: 2791957 - RNA, 12 nt, Human
cauauacacuug

SEQ ID NO: 2791958 - RNA, 13 nt, Human
cauauacacuugg

SEQ ID NO: 2791959 - RNA, 13 nt, Human
cauauacacacac

SEQ ID NO: 2791960 - RNA, 14 nt, Human
cauauacacacaca

SEQ ID NO: 2791961 - RNA, 15 nt, Human
cauauacacacacac

SEQ ID NO: 2791962 - RNA, 19 nt, Human
cauauauaacagauacauu

SEQ ID NO: 2791963 - RNA, 20 nt, Human
cauauauaacagauacauuu

SEQ ID NO: 2791964 - RNA, 24 nt, Human
cauauaaguuugaaggaaacaguu

SEQ ID NO: 2791965 - RNA, 22 nt, Human
cauauaaguuugaaggaaacag

SEQ ID NO: 2791966 - RNA, 23 nt, Human
cauauaaguuugaaggaaacagu

SEQ ID NO: 2791967 - RNA, 20 nt, Human
cauaguuuugaugacuggca

SEQ ID NO: 2791968 - RNA, 23 nt, Human
cauaucaaaaaguauuaaaacua

SEQ ID NO: 2791969 - RNA, 22 nt, Human
cauauauauguuuuaagaggca

SEQ ID NO: 2791970 - RNA, 20 nt, Human
cauaugacucacaugaugca

SEQ ID NO: 2791971 - RNA, 22 nt, Human
cauaugacucacaugaugcaua

SEQ ID NO: 2791972 - RNA, 15 nt, Human
cauaugacuugaucu

SEQ ID NO: 2791973 - RNA, 22 nt, Human
cauaugagccgugaacugugca

SEQ ID NO: 2791974 - RNA, 14 nt, Human
cauaucaugcuuug

SEQ ID NO: 2791975 - RNA, 16 nt, Human
cauauccaccaccucc

SEQ ID NO: 2791976 - RNA, 20 nt, Human
cauaugauuucacuagaaaa

SEQ ID NO: 2791977 - RNA, 21 nt, Human
cauaugauuucacuagaaaag

SEQ ID NO: 2791978 - RNA, 13 nt, Human
cauaugaucuguu

SEQ ID NO: 2791979 - RNA, 15 nt, Human
cauaugaucuguuuu

SEQ ID NO: 2791980 - RNA, 22 nt, Human
cauaguggcuuaaaacaacacu

SEQ ID NO: 2791981 - RNA, 15 nt, Human
cauaguggugcagag

SEQ ID NO: 2791982 - RNA, 11 nt, Human
cauagugcugg

SEQ ID NO: 2791983 - RNA, 13 nt, Human
cauagugcuggga

SEQ ID NO: 2791984 - RNA, 17 nt, Human
cauagugcugggaugga

SEQ ID NO: 2791985 - RNA, 13 nt, Human
cauaguguaaugu

SEQ ID NO: 2791986 - RNA, 15 nt, Human
cauauaaguuugaag

SEQ ID NO: 2791987 - RNA, 14 nt, Human
cauauaaguuugaa

SEQ ID NO: 2791988 - RNA, 20 nt, Human
cauauaaguuugaaggaaac

SEQ ID NO: 2791989 - RNA, 21 nt, Human
cauauaaguuugaaggaaaca

SEQ ID NO: 2791990 - RNA, 20 nt, Human
cauauaaacaucacacacac

SEQ ID NO: 2791991 - RNA, 14 nt, Human
cauauaaaauaaug

SEQ ID NO: 2791992 - RNA, 15 nt, Human
cauauaaaauaaugc

SEQ ID NO: 2791993 - RNA, 21 nt, Human
cauauaaaauaaugcaaagaa

SEQ ID NO: 2791994 - RNA, 22 nt, Human
cauauaaaauaaugcaaagaau

SEQ ID NO: 2791995 - RNA, 23 nt, Human
cauauaaaauaaugcaaagaauc

SEQ ID NO: 2791996 - RNA, 19 nt, Human
cauauaaacaucacacaca

SEQ ID NO: 2791997 - RNA, 14 nt, Human
cauaguuuuaaacu

SEQ ID NO: 2791998 - RNA, 18 nt, Human
cauaguuuuaaacucauu

SEQ ID NO: 2791999 - RNA, 19 nt, Human
cauaguuuuaaacucauuu

SEQ ID NO: 2792000 - RNA, 19 nt, Human
cauaguaugguggcugggu

SEQ ID NO: 2792001 - RNA, 18 nt, Human
cauaguaugguggcuggg

SEQ ID NO: 2792002 - RNA, 20 nt, Human
cauaguaugguggcuggguu

SEQ ID NO: 2792003 - RNA, 19 nt, Human
cauagugcauuguuucugu

SEQ ID NO: 2792004 - RNA, 22 nt, Human
cauagugaugguuccccuguuc

SEQ ID NO: 2792005 - RNA, 14 nt, Human
cauagauauuuuca

SEQ ID NO: 2792006 - RNA, 13 nt, Human
cauagaucuucug

SEQ ID NO: 2792007 - RNA, 17 nt, Human
cauaguaugguggcugg

SEQ ID NO: 2792008 - RNA, 14 nt, Human
cauagaguuuaaca

SEQ ID NO: 2792009 - RNA, 17 nt, Human
cauagaguccccccucc

SEQ ID NO: 2792010 - RNA, 23 nt, Human
cauagagugacuccaagaacaau

SEQ ID NO: 2792011 - RNA, 15 nt, Human
cauagaguuuaacac

SEQ ID NO: 2792012 - RNA, 18 nt, Human
cauagaguuuaacacaag

SEQ ID NO: 2792013 - RNA, 17 nt, Human
cauagagauuugucuaa

SEQ ID NO: 2792014 - RNA, 19 nt, Human
cauacugagggaccaacug

SEQ ID NO: 2792015 - RNA, 15 nt, Human
cauacugagggacca

SEQ ID NO: 2792016 - RNA, 19 nt, Human
cauacugagccaaguauaa

SEQ ID NO: 2792017 - RNA, 22 nt, Human
cauacugagccaaguauaauuu

SEQ ID NO: 2792018 - RNA, 23 nt, Human
cauacuccaucaguuagagcuga

SEQ ID NO: 2792019 - RNA, 18 nt, Human
cauacucauuucuaaaag

SEQ ID NO: 2792020 - RNA, 20 nt, Human
cauacucauuucuaaaagaa

SEQ ID NO: 2792021 - RNA, 21 nt, Human
cauacucauuucuaaaagaau

SEQ ID NO: 2792022 - RNA, 15 nt, Human
cauacuggacucuuc

SEQ ID NO: 2792023 - RNA, 20 nt, Human
cauacugagggaccaacugg

SEQ ID NO: 2792024 - RNA, 13 nt, Human
cauacuuaucucu

SEQ ID NO: 2792025 - RNA, 16 nt, Human
cauacuuaucucucug

SEQ ID NO: 2792026 - RNA, 13 nt, Human
cauacuggccugg

SEQ ID NO: 2792027 - RNA, 15 nt, Human
cauacuggccuggac

SEQ ID NO: 2792028 - RNA, 18 nt, Human
cauacuggccuggacugu

SEQ ID NO: 2792029 - RNA, 22 nt, Human
cauacuggccuggacuguuuuc

SEQ ID NO: 2792030 - RNA, 14 nt, Human
cauagaacugggua

SEQ ID NO: 2792031 - RNA, 15 nt, Human
cauagaacuggguaa

SEQ ID NO: 2792032 - RNA, 16 nt, Human
cauagaacuggguaaa

SEQ ID NO: 2792033 - RNA, 19 nt, Human
cauagaacuggguaaaugc

SEQ ID NO: 2792034 - RNA, 20 nt, Human
cauagaacuggguaaaugca

SEQ ID NO: 2792035 - RNA, 23 nt, Human
cauagaacuggguaaaugcaaag

SEQ ID NO: 2792036 - RNA, 23 nt, Human
cauagaaauguaacuuuuguaag

SEQ ID NO: 2792037 - RNA, 17 nt, Human
cauacuuucauccugac

SEQ ID NO: 2792038 - RNA, 21 nt, Human
cauacuuucauccugacucug

SEQ ID NO: 2792039 - RNA, 22 nt, Human
cauacuuucauccugacucugc

SEQ ID NO: 2792040 - RNA, 12 nt, Human
cauacuuugucu

SEQ ID NO: 2792041 - RNA, 13 nt, Human
cauacuuugucug

SEQ ID NO: 2792042 - RNA, 14 nt, Human
cauacuuugucuga

SEQ ID NO: 2792043 - RNA, 16 nt, Human
cauacuuugucugaaa

SEQ ID NO: 2792044 - RNA, 18 nt, Human
cauacuuugucugaaaaa

SEQ ID NO: 2792045 - RNA, 11 nt, Human
cauagaaaaau

SEQ ID NO: 2792046 - RNA, 14 nt, Human
cauagaaacaugac

SEQ ID NO: 2792047 - RNA, 15 nt, Human
cauagaaacaugaca

SEQ ID NO: 2792048 - RNA, 16 nt, Human
cauagaaacaugacac

SEQ ID NO: 2792049 - RNA, 17 nt, Human
cauagaaacaugacacu

SEQ ID NO: 2792050 - RNA, 18 nt, Human
cauagaaacaugacacug

SEQ ID NO: 2792051 - RNA, 19 nt, Human
cauagaaacaugacacuga

SEQ ID NO: 2792052 - RNA, 20 nt, Human
cauagaaacaugacacugac

SEQ ID NO: 2792053 - RNA, 18 nt, Human
cauacuuaucucucugug

SEQ ID NO: 2792054 - RNA, 20 nt, Human
cauacuuaucucucugugcu

SEQ ID NO: 2792055 - RNA, 22 nt, Human
cauacuuaucucucugugcugu

SEQ ID NO: 2792056 - RNA, 14 nt, Human
cauacuuucauccu

SEQ ID NO: 2792057 - RNA, 13 nt, Human
caugcggucgggc

SEQ ID NO: 2792058 - RNA, 15 nt, Human
caugcuaagcaagcu

SEQ ID NO: 2792059 - RNA, 16 nt, Human
caugcuaagcaagcua

SEQ ID NO: 2792060 - RNA, 22 nt, Human
caugcuaagcaagcuaaccuua

SEQ ID NO: 2792061 - RNA, 20 nt, Human
caugccugccccccucaucu

SEQ ID NO: 2792062 - RNA, 13 nt, Human
caugccuggcuuc

SEQ ID NO: 2792063 - RNA, 20 nt, Human
caugccugccccaaacaaau

SEQ ID NO: 2792064 - RNA, 12 nt, Human
caugccuugugc

SEQ ID NO: 2792065 - RNA, 20 nt, Human
caugccuugugcuguuaaua

SEQ ID NO: 2792066 - RNA, 14 nt, Human
caugccuggcuucg

SEQ ID NO: 2792067 - RNA, 21 nt, Human
caugccuguccagccugggca

SEQ ID NO: 2792068 - RNA, 23 nt, Human
caugccuguccagccugggcagc

SEQ ID NO: 2792069 - RNA, 13 nt, Human
caugccuguggcu

SEQ ID NO: 2792070 - RNA, 14 nt, Human
caugccuguggcug

SEQ ID NO: 2792071 - RNA, 15 nt, Human
caugccuguggcugc

SEQ ID NO: 2792072 - RNA, 16 nt, Human
caugccuguggcugcg

SEQ ID NO: 2792073 - RNA, 17 nt, Human
caugccuguggcugcgc

SEQ ID NO: 2792074 - RNA, 19 nt, Human
caugccuguggcugcgcuu

SEQ ID NO: 2792075 - RNA, 20 nt, Human
caugccuguccagccugggc

SEQ ID NO: 2792076 - RNA, 18 nt, Human
caugccuguccagccugg

SEQ ID NO: 2792077 - RNA, 17 nt, Human
caugccuguccagccug

SEQ ID NO: 2792078 - RNA, 16 nt, Human
caugccuguccagccu

SEQ ID NO: 2792079 - RNA, 22 nt, Human
caugcuucaauaguucaaggaa

SEQ ID NO: 2792080 - RNA, 14 nt, Human
caugcuucaucauu

SEQ ID NO: 2792081 - RNA, 23 nt, Human
caugcuucaucauucccucucau

SEQ ID NO: 2792082 - RNA, 15 nt, Human
caugcuuaugacaau

SEQ ID NO: 2792083 - RNA, 19 nt, Human
caugcugugauugugccua

SEQ ID NO: 2792084 - RNA, 12 nt, Human
cauggacacucc

SEQ ID NO: 2792085 - RNA, 18 nt, Human
cauggaauggacauccug

SEQ ID NO: 2792086 - RNA, 19 nt, Human
cauggaauggacauccugu

SEQ ID NO: 2792087 - RNA, 13 nt, Human
cauggacuuuaua

SEQ ID NO: 2792088 - RNA, 14 nt, Human
cauggacagaauuu

SEQ ID NO: 2792089 - RNA, 14 nt, Human
cauggacacuccag

SEQ ID NO: 2792090 - RNA, 18 nt, Human
cauggacacuccagugcc

SEQ ID NO: 2792091 - RNA, 19 nt, Human
cauggacacuccagugcca

SEQ ID NO: 2792092 - RNA, 15 nt, Human
caugggccuccugug

SEQ ID NO: 2792093 - RNA, 21 nt, Human
cauggcagaauaaucuuuggg

SEQ ID NO: 2792094 - RNA, 17 nt, Human
caugggccuccugugug

SEQ ID NO: 2792095 - RNA, 16 nt, Human
caugggccuccugugu

SEQ ID NO: 2792096 - RNA, 22 nt, Human
cauggaguagagguacuagaau

SEQ ID NO: 2792097 - RNA, 16 nt, Human
cauggucacacacuga

SEQ ID NO: 2792098 - RNA, 21 nt, Human
cauggucacacacugaugcuu

SEQ ID NO: 2792099 - RNA, 17 nt, Human
cauggucacacacugau

SEQ ID NO: 2792100 - RNA, 20 nt, Human
cauggagagcuggagccugg

SEQ ID NO: 2792101 - RNA, 21 nt, Human
cauggagagcuggagccuggu

SEQ ID NO: 2792102 - RNA, 17 nt, Human
cauggagguucuaaggc

SEQ ID NO: 2792103 - RNA, 18 nt, Human
cauggagguucuaaggcc

SEQ ID NO: 2792104 - RNA, 14 nt, Human
cauggaguugugau

SEQ ID NO: 2792105 - RNA, 13 nt, Human
cauggcacucccu

SEQ ID NO: 2792106 - RNA, 16 nt, Human
cauggcacucccucca

SEQ ID NO: 2792107 - RNA, 17 nt, Human
cauggcacucccuccag

SEQ ID NO: 2792108 - RNA, 18 nt, Human
cauggcacucccuccagc

SEQ ID NO: 2792109 - RNA, 19 nt, Human
cauggcacucccuccagca

SEQ ID NO: 2792110 - RNA, 20 nt, Human
cauggcacucccuccagcac

SEQ ID NO: 2792111 - RNA, 21 nt, Human
cauggcacucccuccagcaca

SEQ ID NO: 2792112 - RNA, 22 nt, Human
cauggcacucccuccagcacaa

SEQ ID NO: 2792113 - RNA, 21 nt, Human
cauggauuucugucuucucua

SEQ ID NO: 2792114 - RNA, 20 nt, Human
cauggcaccaaagccaccag

SEQ ID NO: 2792115 - RNA, 19 nt, Human
cauggcaccaaagccacca

SEQ ID NO: 2792116 - RNA, 17 nt, Human
cauggacuuuauaagcc

SEQ ID NO: 2792117 - RNA, 10 nt, Human
cauggagcca

SEQ ID NO: 2792118 - RNA, 16 nt, Human
cauggagguucuaagg

SEQ ID NO: 2792119 - RNA, 16 nt, Human
cauggagacgcauuuc

SEQ ID NO: 2792120 - RNA, 13 nt, Human
cauggagagcugg

SEQ ID NO: 2792121 - RNA, 14 nt, Human
cauggagagcugga

SEQ ID NO: 2792122 - RNA, 16 nt, Human
cauggagagcuggagc

SEQ ID NO: 2792123 - RNA, 17 nt, Human
cauggagagcuggagcc

SEQ ID NO: 2792124 - RNA, 12 nt, Human
caugccucugau

SEQ ID NO: 2792125 - RNA, 21 nt, Human
caugccucugauaugggacug

SEQ ID NO: 2792126 - RNA, 22 nt, Human
caugccucugauaugggacuga

SEQ ID NO: 2792127 - RNA, 23 nt, Human
caugccucugauaugggacugag

SEQ ID NO: 2792128 - RNA, 14 nt, Human
caugccugagagac

SEQ ID NO: 2792129 - RNA, 21 nt, Human
caugccugagagacauggcuu

SEQ ID NO: 2792130 - RNA, 23 nt, Human
caugcagucuaaaaugcuucagu

SEQ ID NO: 2792131 - RNA, 21 nt, Human
caugccuauaugagaagaaua

SEQ ID NO: 2792132 - RNA, 21 nt, Human
caugcccggcuaauuuuugua

SEQ ID NO: 2792133 - RNA, 17 nt, Human
caugcccggucccaccc

SEQ ID NO: 2792134 - RNA, 18 nt, Human
caugcccggucccacccc

SEQ ID NO: 2792135 - RNA, 20 nt, Human
caugcccggucccaccccuc

SEQ ID NO: 2792136 - RNA, 19 nt, Human
caugccccggccaccucug

SEQ ID NO: 2792137 - RNA, 20 nt, Human
caugccccggccaccucugc

SEQ ID NO: 2792138 - RNA, 21 nt, Human
caugccccggccaccucugcg

SEQ ID NO: 2792139 - RNA, 16 nt, Human
caugccccggccaccu

SEQ ID NO: 2792140 - RNA, 17 nt, Human
caugccccggccaccuc

SEQ ID NO: 2792141 - RNA, 18 nt, Human
caugccccggccaccucu

SEQ ID NO: 2792142 - RNA, 21 nt, Human
caugcccaccugcccaucaca

SEQ ID NO: 2792143 - RNA, 19 nt, Human
caugcccacguucuuuccc

SEQ ID NO: 2792144 - RNA, 13 nt, Human
caugccaggaacc

SEQ ID NO: 2792145 - RNA, 19 nt, Human
caugccaggaaccuguccu

SEQ ID NO: 2792146 - RNA, 17 nt, Human
caugcccaccugcccau

SEQ ID NO: 2792147 - RNA, 16 nt, Human
caugcccaccugccca

SEQ ID NO: 2792148 - RNA, 14 nt, Human
caugcccaccugcc

SEQ ID NO: 2792149 - RNA, 13 nt, Human
caugcccaccugc

SEQ ID NO: 2792150 - RNA, 21 nt, Human
caugccagcuacuuccuccuc

SEQ ID NO: 2792151 - RNA, 21 nt, Human
caugccaccauggccagccaa

SEQ ID NO: 2792152 - RNA, 17 nt, Human
caugccacguuccacag

SEQ ID NO: 2792153 - RNA, 19 nt, Human
caugccacguuccacaguu

SEQ ID NO: 2792154 - RNA, 18 nt, Human
caugccaagcacugugcu

SEQ ID NO: 2792155 - RNA, 15 nt, Human
caugcaugacagccu

SEQ ID NO: 2792156 - RNA, 19 nt, Human
caugcaugacagccucuau

SEQ ID NO: 2792157 - RNA, 16 nt, Human
caugccaacaagaaug

SEQ ID NO: 2792158 - RNA, 17 nt, Human
caugccaacaagaaugc

SEQ ID NO: 2792159 - RNA, 20 nt, Human
caugccaacaagaaugcauu

SEQ ID NO: 2792160 - RNA, 21 nt, Human
caugccaacaagaaugcauug

SEQ ID NO: 2792161 - RNA, 22 nt, Human
caugccaacaagaaugcauuga

SEQ ID NO: 2792162 - RNA, 14 nt, Human
caugcauucauaca

SEQ ID NO: 2792163 - RNA, 22 nt, Human
caugcauaaauaugcagugaua

SEQ ID NO: 2792164 - RNA, 20 nt, Human
caugcagcucaacuuucugu

SEQ ID NO: 2792165 - RNA, 12 nt, Human
caugcaggcccu

SEQ ID NO: 2792166 - RNA, 13 nt, Human
caugcaggcccuu

SEQ ID NO: 2792167 - RNA, 18 nt, Human
caugcagggggcuccugg

SEQ ID NO: 2792168 - RNA, 19 nt, Human
caugcagggggcuccuggg

SEQ ID NO: 2792169 - RNA, 12 nt, Human
caugcauaaaua

SEQ ID NO: 2792170 - RNA, 13 nt, Human
caugcauaaauau

SEQ ID NO: 2792171 - RNA, 15 nt, Human
caugcauaaauaugc

SEQ ID NO: 2792172 - RNA, 16 nt, Human
caugcauaaauaugca

SEQ ID NO: 2792173 - RNA, 17 nt, Human
caugcauaaauaugcag

SEQ ID NO: 2792174 - RNA, 18 nt, Human
caugcauaaauaugcagu

SEQ ID NO: 2792175 - RNA, 19 nt, Human
caugcauaaauaugcagug

SEQ ID NO: 2792176 - RNA, 13 nt, Human
cauguuuaugaaa

SEQ ID NO: 2792177 - RNA, 14 nt, Human
cauguuuaugaaaa

SEQ ID NO: 2792178 - RNA, 15 nt, Human
cauguuuaugaaaau

SEQ ID NO: 2792179 - RNA, 16 nt, Human
cauguuuaugaaaaua

SEQ ID NO: 2792180 - RNA, 19 nt, Human
cauguuuaugaaaauaaau

SEQ ID NO: 2792181 - RNA, 20 nt, Human
cauguuuaugaaaauaaaua

SEQ ID NO: 2792182 - RNA, 23 nt, Human
cauguuuaugaaaauaaauagcu

SEQ ID NO: 2792183 - RNA, 21 nt, Human
cauguuuauaacuauucaguu

SEQ ID NO: 2792184 - RNA, 13 nt, Human
caugugugugugu

SEQ ID NO: 2792185 - RNA, 14 nt, Human
caugugugcugaac

SEQ ID NO: 2792186 - RNA, 11 nt, Human
cauguguguau

SEQ ID NO: 2792187 - RNA, 12 nt, Human
cauguguguaua

SEQ ID NO: 2792188 - RNA, 13 nt, Human
cauguguguauaa

SEQ ID NO: 2792189 - RNA, 14 nt, Human
cauguguguauaag

SEQ ID NO: 2792190 - RNA, 13 nt, Human
cauguguguauau

SEQ ID NO: 2792191 - RNA, 14 nt, Human
cauguguguauaua

SEQ ID NO: 2792192 - RNA, 15 nt, Human
cauguguguauauau

SEQ ID NO: 2792193 - RNA, 16 nt, Human
cauguguguauauaug

SEQ ID NO: 2792194 - RNA, 17 nt, Human
cauguguguauauaugu

SEQ ID NO: 2792195 - RNA, 18 nt, Human
cauguguguauauaugug

SEQ ID NO: 2792196 - RNA, 19 nt, Human
cauguguguauauaugugu

SEQ ID NO: 2792197 - RNA, 20 nt, Human
cauguguguauauaugugua

SEQ ID NO: 2792198 - RNA, 18 nt, Human
cauguuuuaaagcuugcu

SEQ ID NO: 2792199 - RNA, 15 nt, Human
cauguuuuaaaugua

SEQ ID NO: 2792200 - RNA, 23 nt, Human
cauguuuuaaauguacaguuugg

SEQ ID NO: 2792201 - RNA, 14 nt, Human
cauguuuuccguga

SEQ ID NO: 2792202 - RNA, 12 nt, Human
cauguuuuguau

SEQ ID NO: 2792203 - RNA, 13 nt, Human
cauguuuuguaua

SEQ ID NO: 2792204 - RNA, 14 nt, Human
cauguuuuguauac

SEQ ID NO: 2792205 - RNA, 15 nt, Human
cauguuuuguauaca

SEQ ID NO: 2792206 - RNA, 17 nt, Human
cauguuuuguauacaaa

SEQ ID NO: 2792207 - RNA, 19 nt, Human
cauguuuuguauacaaaua

SEQ ID NO: 2792208 - RNA, 20 nt, Human
cauguuuuguauacaaauau

SEQ ID NO: 2792209 - RNA, 22 nt, Human
cauguuuuguauacaaauauau

SEQ ID NO: 2792210 - RNA, 14 nt, Human
cauguuuugugacu

SEQ ID NO: 2792211 - RNA, 13 nt, Human
caugugggcuuca

SEQ ID NO: 2792212 - RNA, 11 nt, Human
cauguuuuggu

SEQ ID NO: 2792213 - RNA, 18 nt, Human
cauguuuuccagcuccuc

SEQ ID NO: 2792214 - RNA, 23 nt, Human
caugugguggcacaggcccccuu

SEQ ID NO: 2792215 - RNA, 15 nt, Human
caugugggucuucca

SEQ ID NO: 2792216 - RNA, 19 nt, Human
caugugggucuuccagggg

SEQ ID NO: 2792217 - RNA, 14 nt, Human
cauguggugaugau

SEQ ID NO: 2792218 - RNA, 23 nt, Human
cauguggugaugauguguauaua

SEQ ID NO: 2792219 - RNA, 22 nt, Human
caugugguggcacaggcccccu

SEQ ID NO: 2792220 - RNA, 20 nt, Human
caugugguuugguuccucuc

SEQ ID NO: 2792221 - RNA, 21 nt, Human
caugugguuugguuccucucu

SEQ ID NO: 2792222 - RNA, 22 nt, Human
caugugguuugguuccucucug

SEQ ID NO: 2792223 - RNA, 23 nt, Human
caugugguuugguuccucucugg

SEQ ID NO: 2792224 - RNA, 20 nt, Human
caugugguuuauagagggcc

SEQ ID NO: 2792225 - RNA, 15 nt, Human
caugugguuuauaga

SEQ ID NO: 2792226 - RNA, 22 nt, Human
cauguggcuguagaucccaaga

SEQ ID NO: 2792227 - RNA, 20 nt, Human
cauguggcuuuuuuaaaaaa

SEQ ID NO: 2792228 - RNA, 21 nt, Human
cauguggcuuuuuuaaaaaag

SEQ ID NO: 2792229 - RNA, 22 nt, Human
caugugggaaaaaaaugaauga

SEQ ID NO: 2792230 - RNA, 17 nt, Human
cauguggaauauaaaga

SEQ ID NO: 2792231 - RNA, 15 nt, Human
caugugcacaugcac

SEQ ID NO: 2792232 - RNA, 16 nt, Human
caugugacacauaugc

SEQ ID NO: 2792233 - RNA, 14 nt, Human
caugugacacauau

SEQ ID NO: 2792234 - RNA, 15 nt, Human
caugugacacauaug

SEQ ID NO: 2792235 - RNA, 12 nt, Human
caugugacacau

SEQ ID NO: 2792236 - RNA, 13 nt, Human
caugugacacaua

SEQ ID NO: 2792237 - RNA, 21 nt, Human
caugugaaaccuuuuuuaaga

SEQ ID NO: 2792238 - RNA, 22 nt, Human
caugugaaaccuuuuuuaagau

SEQ ID NO: 2792239 - RNA, 24 nt, Human
caugugaaaccuuuuuuaagauuu

SEQ ID NO: 2792240 - RNA, 21 nt, Human
caugugccagguuuuuggucu

SEQ ID NO: 2792241 - RNA, 16 nt, Human
caugugcauaacaaau

SEQ ID NO: 2792242 - RNA, 23 nt, Human
caugugcauaacaaauucugaau

SEQ ID NO: 2792243 - RNA, 24 nt, Human
caugugccagggcaaugaugaaug

SEQ ID NO: 2792244 - RNA, 22 nt, Human
caugugccagggcaaugaugaa

SEQ ID NO: 2792245 - RNA, 20 nt, Human
caugugccacaacgccuggc

SEQ ID NO: 2792246 - RNA, 22 nt, Human
caugugccacaacgccuggcua

SEQ ID NO: 2792247 - RNA, 19 nt, Human
caugugaaaaucaaauaca

SEQ ID NO: 2792248 - RNA, 17 nt, Human
caugugaaaaucaaaua

SEQ ID NO: 2792249 - RNA, 12 nt, Human
caugugaaaccu

SEQ ID NO: 2792250 - RNA, 13 nt, Human
caugugaaaccuu

SEQ ID NO: 2792251 - RNA, 14 nt, Human
caugugaaaccuuu

SEQ ID NO: 2792252 - RNA, 18 nt, Human
caugugaaaccuuuuuua

SEQ ID NO: 2792253 - RNA, 14 nt, Human
cauguacagacaga

SEQ ID NO: 2792254 - RNA, 16 nt, Human
cauguacagacagaga

SEQ ID NO: 2792255 - RNA, 23 nt, Human
caugucuuguacauguguagccu

SEQ ID NO: 2792256 - RNA, 20 nt, Human
caugucuuucuccaaaguua

SEQ ID NO: 2792257 - RNA, 21 nt, Human
caugucuuucuccaaaguuau

SEQ ID NO: 2792258 - RNA, 19 nt, Human
cauguccuuugcgccugug

SEQ ID NO: 2792259 - RNA, 21 nt, Human
cauguccuuugcgccugugac

SEQ ID NO: 2792260 - RNA, 18 nt, Human
caugucgccucugcauuc

SEQ ID NO: 2792261 - RNA, 20 nt, Human
caugucgccucugcauucag

SEQ ID NO: 2792262 - RNA, 14 nt, Human
caugucgccucugc

SEQ ID NO: 2792263 - RNA, 15 nt, Human
caugucgccucugca

SEQ ID NO: 2792264 - RNA, 13 nt, Human
cauggucccugcc

SEQ ID NO: 2792265 - RNA, 14 nt, Human
cauggucccugccu

SEQ ID NO: 2792266 - RNA, 15 nt, Human
cauggucccugccuu

SEQ ID NO: 2792267 - RNA, 17 nt, Human
cauggucccugccuuag

SEQ ID NO: 2792268 - RNA, 21 nt, Human
cauggugaaaauguacugaga

SEQ ID NO: 2792269 - RNA, 18 nt, Human
cauggugccccuagcuuu

SEQ ID NO: 2792270 - RNA, 17 nt, Human
cauguaaccggcauguu

SEQ ID NO: 2792271 - RNA, 18 nt, Human
cauguaaccggcauguuu

SEQ ID NO: 2792272 - RNA, 22 nt, Human
cauguaaccggcauguuuccag

SEQ ID NO: 2792273 - RNA, 19 nt, Human
cauguaacgaaacacuuca

SEQ ID NO: 2792274 - RNA, 16 nt, Human
cauguaacuauagacu

SEQ ID NO: 2792275 - RNA, 19 nt, Human
cauguaauguuaauguuau

SEQ ID NO: 2792276 - RNA, 23 nt, Human
cauguaauguuaauguuauauca

SEQ ID NO: 2792277 - RNA, 23 nt, Human
cauguaauauaaagauguuaaaa

SEQ ID NO: 2792278 - RNA, 15 nt, Human
caugguguaauaaga

SEQ ID NO: 2792279 - RNA, 16 nt, Human
caugguguaauaagac

SEQ ID NO: 2792280 - RNA, 18 nt, Human
caugguguaauaagacau

SEQ ID NO: 2792281 - RNA, 19 nt, Human
caugguguaauaagacaua

SEQ ID NO: 2792282 - RNA, 21 nt, Human
caugguguaauaagacauaac

SEQ ID NO: 2792283 - RNA, 22 nt, Human
cauggugugaaagucagaugcc

SEQ ID NO: 2792284 - RNA, 12 nt, Human
cauggugucugg

SEQ ID NO: 2792285 - RNA, 23 nt, Human
cauggugugaaagucagaugccc

SEQ ID NO: 2792286 - RNA, 14 nt, Human
caugguguguuaca

SEQ ID NO: 2792287 - RNA, 15 nt, Human
caugguguguuacac

SEQ ID NO: 2792288 - RNA, 19 nt, Human
caugguuaagguaaaguaa

SEQ ID NO: 2792289 - RNA, 19 nt, Human
caugguuaagaguccaaga

SEQ ID NO: 2792290 - RNA, 22 nt, Human
caugguguaauaagacauaacg

SEQ ID NO: 2792291 - RNA, 13 nt, Human
caugguuaagagu

SEQ ID NO: 2792292 - RNA, 16 nt, Human
caugguuaagagucca

SEQ ID NO: 2792293 - RNA, 22 nt, Human
cauuauuuauucagcuucauuu

SEQ ID NO: 2792294 - RNA, 13 nt, Human
cauuauuucuagu

SEQ ID NO: 2792295 - RNA, 20 nt, Human
cauuauuucuaguccaaaau

SEQ ID NO: 2792296 - RNA, 23 nt, Human
cauuauuuauauggggaauauau

SEQ ID NO: 2792297 - RNA, 16 nt, Human
cauuagcacagauuuu

SEQ ID NO: 2792298 - RNA, 20 nt, Human
cauuagcacagauuuuaauu

SEQ ID NO: 2792299 - RNA, 21 nt, Human
cauuagcacagauuuuaauug

SEQ ID NO: 2792300 - RNA, 22 nt, Human
cauuagcacagauuuuaauugu

SEQ ID NO: 2792301 - RNA, 23 nt, Human
cauuagcacagauuuuaauuguc

SEQ ID NO: 2792302 - RNA, 17 nt, Human
cauuagcaguuugcuuu

SEQ ID NO: 2792303 - RNA, 11 nt, Human
cauuagagcag

SEQ ID NO: 2792304 - RNA, 12 nt, Human
cauuagagcagg

SEQ ID NO: 2792305 - RNA, 17 nt, Human
cauuagacuccuccucc

SEQ ID NO: 2792306 - RNA, 15 nt, Human
cauuagacuccuccu

SEQ ID NO: 2792307 - RNA, 16 nt, Human
cauuagacuccuccuc

SEQ ID NO: 2792308 - RNA, 23 nt, Human
cauuagagcaggcguucagcuca

SEQ ID NO: 2792309 - RNA, 19 nt, Human
cauuagauuuuauuuuacu

SEQ ID NO: 2792310 - RNA, 21 nt, Human
cauuagauuuuauuuuacuau

SEQ ID NO: 2792311 - RNA, 13 nt, Human
cauuagagcaggc

SEQ ID NO: 2792312 - RNA, 14 nt, Human
cauuagagcaggcg

SEQ ID NO: 2792313 - RNA, 19 nt, Human
cauuagagcccauuucaau

SEQ ID NO: 2792314 - RNA, 17 nt, Human
cauuaccuuacugugga

SEQ ID NO: 2792315 - RNA, 13 nt, Human
cauuaccuuacug

SEQ ID NO: 2792316 - RNA, 20 nt, Human
cauuaccuuacuguggagga

SEQ ID NO: 2792317 - RNA, 18 nt, Human
cauuaccuuuuaccagcu

SEQ ID NO: 2792318 - RNA, 19 nt, Human
cauuaccuuuuaccagcuu

SEQ ID NO: 2792319 - RNA, 22 nt, Human
cauuaccuuuuaccagcuuuua

SEQ ID NO: 2792320 - RNA, 13 nt, Human
cauuaacacaaag

SEQ ID NO: 2792321 - RNA, 21 nt, Human
cauuaaauucacaaacuuuua

SEQ ID NO: 2792322 - RNA, 18 nt, Human
cauuaaauucacaaacuu

SEQ ID NO: 2792323 - RNA, 17 nt, Human
cauuaaauucacaaacu

SEQ ID NO: 2792324 - RNA, 14 nt, Human
cauuaaauucacaa

SEQ ID NO: 2792325 - RNA, 17 nt, Human
cauuaauauuugcugac

SEQ ID NO: 2792326 - RNA, 18 nt, Human
cauuaaucaaucaucugu

SEQ ID NO: 2792327 - RNA, 16 nt, Human
cauuaauauuugcuga

SEQ ID NO: 2792328 - RNA, 16 nt, Human
cauuaaucauuucccc

SEQ ID NO: 2792329 - RNA, 17 nt, Human
cauuaaucauuucccca

SEQ ID NO: 2792330 - RNA, 13 nt, Human
cauuacccuuccc

SEQ ID NO: 2792331 - RNA, 15 nt, Human
cauuacccuucccug

SEQ ID NO: 2792332 - RNA, 16 nt, Human
cauuacccuucccugc

SEQ ID NO: 2792333 - RNA, 19 nt, Human
cauuacccuucccugcacu

SEQ ID NO: 2792334 - RNA, 12 nt, Human
cauuaauguuuc

SEQ ID NO: 2792335 - RNA, 15 nt, Human
cauuaauguuucuau

SEQ ID NO: 2792336 - RNA, 22 nt, Human
cauuaaucaaucaucuguguga

SEQ ID NO: 2792337 - RNA, 23 nt, Human
cauuaaucaaucaucugugugaa

SEQ ID NO: 2792338 - RNA, 13 nt, Human
cauuaauguguug

SEQ ID NO: 2792339 - RNA, 14 nt, Human
cauuaauguguugg

SEQ ID NO: 2792340 - RNA, 13 nt, Human
cauuaaaccuguc

SEQ ID NO: 2792341 - RNA, 14 nt, Human
cauuaaaccugucu

SEQ ID NO: 2792342 - RNA, 22 nt, Human
cauuaaaccugucuccacugug

SEQ ID NO: 2792343 - RNA, 23 nt, Human
cauuaaaccugucuccacugugc

SEQ ID NO: 2792344 - RNA, 15 nt, Human
cauguuuugugacua

SEQ ID NO: 2792345 - RNA, 17 nt, Human
cauguuuugugacuaua

SEQ ID NO: 2792346 - RNA, 23 nt, Human
cauguuuugugacuauauagaga

SEQ ID NO: 2792347 - RNA, 21 nt, Human
cauguuuugugcauuuguaaa

SEQ ID NO: 2792348 - RNA, 20 nt, Human
cauuaaaggcauaaaugacu

SEQ ID NO: 2792349 - RNA, 12 nt, Human
cauuaaagccau

SEQ ID NO: 2792350 - RNA, 13 nt, Human
cauuaaagucuga

SEQ ID NO: 2792351 - RNA, 17 nt, Human
cauuaaagucugaauca

SEQ ID NO: 2792352 - RNA, 13 nt, Human
cauuaaauucaca

SEQ ID NO: 2792353 - RNA, 12 nt, Human
cauuaaauguuu

SEQ ID NO: 2792354 - RNA, 13 nt, Human
cauuaaauguuug

SEQ ID NO: 2792355 - RNA, 14 nt, Human
cauuaaauguuuga

SEQ ID NO: 2792356 - RNA, 11 nt, Human
cauuaaaugaa

SEQ ID NO: 2792357 - RNA, 14 nt, Human
cauuaaaugaauau

SEQ ID NO: 2792358 - RNA, 15 nt, Human
cauuaaaugaauauu

SEQ ID NO: 2792359 - RNA, 18 nt, Human
cauuaaaugaauauuuug

SEQ ID NO: 2792360 - RNA, 22 nt, Human
cauuaaaugaauauuuugauaa

SEQ ID NO: 2792361 - RNA, 20 nt, Human
ccaacacccaaagcauggac

SEQ ID NO: 2792362 - RNA, 22 nt, Human
ccaacacccaaagcauggacua

SEQ ID NO: 2792363 - RNA, 15 nt, Human
ccaacagucauguuu

SEQ ID NO: 2792364 - RNA, 20 nt, Human
ccaacacccugucuaaaaaa

SEQ ID NO: 2792365 - RNA, 12 nt, Human
ccaacagugagu

SEQ ID NO: 2792366 - RNA, 20 nt, Human
ccaacagugagucugucagc

SEQ ID NO: 2792367 - RNA, 12 nt, Human
ccaacaguuccu

SEQ ID NO: 2792368 - RNA, 18 nt, Human
ccaaauuuaagacucucg

SEQ ID NO: 2792369 - RNA, 12 nt, Human
ccaaauuuauca

SEQ ID NO: 2792370 - RNA, 14 nt, Human
ccaaauuuaucaaa

SEQ ID NO: 2792371 - RNA, 14 nt, Human
ccaaauugugcuuc

SEQ ID NO: 2792372 - RNA, 16 nt, Human
ccaaauugugcuucuc

SEQ ID NO: 2792373 - RNA, 17 nt, Human
ccaaauugugcuucucc

SEQ ID NO: 2792374 - RNA, 20 nt, Human
ccaaauugugcuucucccca

SEQ ID NO: 2792375 - RNA, 21 nt, Human
ccaaauugugcuucuccccag

SEQ ID NO: 2792376 - RNA, 23 nt, Human
ccaaauugugcuucuccccagaa

SEQ ID NO: 2792377 - RNA, 22 nt, Human
ccaaauugcuccuaagcuucaa

SEQ ID NO: 2792378 - RNA, 12 nt, Human
cauuuuuaucua

SEQ ID NO: 2792379 - RNA, 22 nt, Human
ccaaagaguagaauugcauuga

SEQ ID NO: 2792380 - RNA, 16 nt, Human
ccaaagaugcagccgc

SEQ ID NO: 2792381 - RNA, 18 nt, Human
ccaaagaugcagccgccu

SEQ ID NO: 2792382 - RNA, 19 nt, Human
ccaaagaugcagccgccuu

SEQ ID NO: 2792383 - RNA, 22 nt, Human
ccaaagaugcagccgccuuccu

SEQ ID NO: 2792384 - RNA, 23 nt, Human
ccaaagaugcagccgccuuccuu

SEQ ID NO: 2792385 - RNA, 12 nt, Human
ccaaagcagggu

SEQ ID NO: 2792386 - RNA, 15 nt, Human
ccaaagcagggucug

SEQ ID NO: 2792387 - RNA, 16 nt, Human
ccaaagcagggucugg

SEQ ID NO: 2792388 - RNA, 13 nt, Human
ccaaccuaaccug

SEQ ID NO: 2792389 - RNA, 14 nt, Human
ccaaccuaaccugu

SEQ ID NO: 2792390 - RNA, 16 nt, Human
ccaaccuaaccugugu

SEQ ID NO: 2792391 - RNA, 17 nt, Human
ccaaccuaaccuguguc

SEQ ID NO: 2792392 - RNA, 13 nt, Human
ccaaccgacaggc

SEQ ID NO: 2792393 - RNA, 16 nt, Human
ccaaccgacaggcccu

SEQ ID NO: 2792394 - RNA, 18 nt, Human
ccaaccgacaggcccugg

SEQ ID NO: 2792395 - RNA, 18 nt, Human
ccaacccuggcacccagg

SEQ ID NO: 2792396 - RNA, 24 nt, Human
ccaagacagaugccccagagcugu

SEQ ID NO: 2792397 - RNA, 22 nt, Human
ccaagacagaugccccagagcu

SEQ ID NO: 2792398 - RNA, 12 nt, Human
ccaaccuuccca

SEQ ID NO: 2792399 - RNA, 23 nt, Human
ccaagacagaugccccagagcug

SEQ ID NO: 2792400 - RNA, 12 nt, Human
ccaaccugcuga

SEQ ID NO: 2792401 - RNA, 14 nt, Human
ccaagaccagacuc

SEQ ID NO: 2792402 - RNA, 16 nt, Human
ccaagagauugcuaau

SEQ ID NO: 2792403 - RNA, 17 nt, Human
ccaagagauugcuaauu

SEQ ID NO: 2792404 - RNA, 20 nt, Human
ccaagagauugcuaauugcu

SEQ ID NO: 2792405 - RNA, 21 nt, Human
ccaagagauugcuaauugcug

SEQ ID NO: 2792406 - RNA, 13 nt, Human
ccaagacucuaga

SEQ ID NO: 2792407 - RNA, 19 nt, Human
ccaagagcagaggcagcga

SEQ ID NO: 2792408 - RNA, 13 nt, Human
ccaaagaugcagc

SEQ ID NO: 2792409 - RNA, 22 nt, Human
ccaaagaggcugccccucucac

SEQ ID NO: 2792410 - RNA, 21 nt, Human
ccaaagaggcugccccucuca

SEQ ID NO: 2792411 - RNA, 20 nt, Human
ccaaagaggcugccccucuc

SEQ ID NO: 2792412 - RNA, 17 nt, Human
ccaaagaggcugccccu

SEQ ID NO: 2792413 - RNA, 23 nt, Human
ccaaagaggcugccccucucacc

SEQ ID NO: 2792414 - RNA, 9 nt, Human
ccacaaagg

SEQ ID NO: 2792415 - RNA, 22 nt, Human
ccacaaaggccaaacugcugga

SEQ ID NO: 2792416 - RNA, 16 nt, Human
ccacaacgugcaacug

SEQ ID NO: 2792417 - RNA, 12 nt, Human
ccacaacugaca

SEQ ID NO: 2792418 - RNA, 14 nt, Human
ccacaacugacaca

SEQ ID NO: 2792419 - RNA, 15 nt, Human
ccacaacugacacag

SEQ ID NO: 2792420 - RNA, 16 nt, Human
ccacaacugacacagg

SEQ ID NO: 2792421 - RNA, 17 nt, Human
ccacaacugacacagga

SEQ ID NO: 2792422 - RNA, 19 nt, Human
ccacaacugacacaggaaa

SEQ ID NO: 2792423 - RNA, 14 nt, Human
ccacaacuuuuaac

SEQ ID NO: 2792424 - RNA, 13 nt, Human
ccacaacacacag

SEQ ID NO: 2792425 - RNA, 23 nt, Human
ccaauuuuuuguucuucagagau

SEQ ID NO: 2792426 - RNA, 13 nt, Human
ccacaaaaauuga

SEQ ID NO: 2792427 - RNA, 20 nt, Human
ccacaaagcacaguuugaac

SEQ ID NO: 2792428 - RNA, 16 nt, Human
ccaauuuuaauuuagu

SEQ ID NO: 2792429 - RNA, 21 nt, Human
ccaauuuuaauuuaguaaaug

SEQ ID NO: 2792430 - RNA, 22 nt, Human
ccaauuuuaauuuaguaaaugu

SEQ ID NO: 2792431 - RNA, 23 nt, Human
ccaauuuuaauuuaguaaauguu

SEQ ID NO: 2792432 - RNA, 13 nt, Human
ccaauuuucaaag

SEQ ID NO: 2792433 - RNA, 22 nt, Human
ccaauuucccacccccacccac

SEQ ID NO: 2792434 - RNA, 22 nt, Human
ccaauauuggagcauaucaaaa

SEQ ID NO: 2792435 - RNA, 21 nt, Human
ccaauuguugacaguucugaa

SEQ ID NO: 2792436 - RNA, 22 nt, Human
ccaauuguugacaguucugaag

SEQ ID NO: 2792437 - RNA, 13 nt, Human
ccaauuggaggaa

SEQ ID NO: 2792438 - RNA, 13 nt, Human
ccaauugugcugc

SEQ ID NO: 2792439 - RNA, 14 nt, Human
ccaauugugcugcc

SEQ ID NO: 2792440 - RNA, 15 nt, Human
ccaauugugcugcca

SEQ ID NO: 2792441 - RNA, 16 nt, Human
ccaauugugcugccau

SEQ ID NO: 2792442 - RNA, 20 nt, Human
ccaauuguugacaguucuga

SEQ ID NO: 2792443 - RNA, 23 nt, Human
ccaagugguuuccacaugcucug

SEQ ID NO: 2792444 - RNA, 14 nt, Human
ccaagugugaacaa

SEQ ID NO: 2792445 - RNA, 19 nt, Human
ccaaguggcagagcuugga

SEQ ID NO: 2792446 - RNA, 17 nt, Human
ccaaguggcagagcuug

SEQ ID NO: 2792447 - RNA, 18 nt, Human
ccaaguggcagagcuugg

SEQ ID NO: 2792448 - RNA, 16 nt, Human
ccaaguggcucccaca

SEQ ID NO: 2792449 - RNA, 22 nt, Human
ccaagguuuaaagagucuagau

SEQ ID NO: 2792450 - RNA, 16 nt, Human
ccaagugcacuuucua

SEQ ID NO: 2792451 - RNA, 17 nt, Human
ccaagugcacuuucuaa

SEQ ID NO: 2792452 - RNA, 13 nt, Human
ccaaguggcuccc

SEQ ID NO: 2792453 - RNA, 13 nt, Human
ccaaguggcagag

SEQ ID NO: 2792454 - RNA, 14 nt, Human
ccaaguggcagagc

SEQ ID NO: 2792455 - RNA, 15 nt, Human
ccaaguggcagagcu

SEQ ID NO: 2792456 - RNA, 22 nt, Human
ccaagugccagucuugugucug

SEQ ID NO: 2792457 - RNA, 13 nt, Human
ccaagugcgugcc

SEQ ID NO: 2792458 - RNA, 16 nt, Human
ccaagugccagucuug

SEQ ID NO: 2792459 - RNA, 16 nt, Human
ccaaggcggccccucc

SEQ ID NO: 2792460 - RNA, 16 nt, Human
ccaaggcucugagcaa

SEQ ID NO: 2792461 - RNA, 22 nt, Human
ccaaggcuucuccaauucugcc

SEQ ID NO: 2792462 - RNA, 23 nt, Human
ccaaggugggcugagcccuggca

SEQ ID NO: 2792463 - RNA, 20 nt, Human
ccaaggugggcugagcccug

SEQ ID NO: 2792464 - RNA, 18 nt, Human
ccaaggugggcugagccc

SEQ ID NO: 2792465 - RNA, 17 nt, Human
ccaaggugggcugagcc

SEQ ID NO: 2792466 - RNA, 21 nt, Human
ccaaggugucauuuauguguc

SEQ ID NO: 2792467 - RNA, 16 nt, Human
ccaagguucccuugug

SEQ ID NO: 2792468 - RNA, 19 nt, Human
ccaagguuuaaagagucua

SEQ ID NO: 2792469 - RNA, 20 nt, Human
ccaagguuuaaagagucuag

SEQ ID NO: 2792470 - RNA, 23 nt, Human
ccaagguuuaaagagucuagauu

SEQ ID NO: 2792471 - RNA, 14 nt, Human
ccaagucucagugg

SEQ ID NO: 2792472 - RNA, 14 nt, Human
ccaaggccuucucc

SEQ ID NO: 2792473 - RNA, 16 nt, Human
ccaaggccuucuccuc

SEQ ID NO: 2792474 - RNA, 14 nt, Human
ccaaggcggccccu

SEQ ID NO: 2792475 - RNA, 15 nt, Human
ccaaggcggccccuc

SEQ ID NO: 2792476 - RNA, 21 nt, Human
ccaaggcggccccucccgccc

SEQ ID NO: 2792477 - RNA, 20 nt, Human
ccaaggcgggcggaucacuu

SEQ ID NO: 2792478 - RNA, 16 nt, Human
ccaaggccagggacag

SEQ ID NO: 2792479 - RNA, 14 nt, Human
ccaagcuccaucuc

SEQ ID NO: 2792480 - RNA, 19 nt, Human
ccaagcucaggaccaggca

SEQ ID NO: 2792481 - RNA, 20 nt, Human
ccaagcucaggaccaggcaa

SEQ ID NO: 2792482 - RNA, 23 nt, Human
ccaagccguggcuucccgcucag

SEQ ID NO: 2792483 - RNA, 14 nt, Human
ccaagcaggagacg

SEQ ID NO: 2792484 - RNA, 17 nt, Human
ccaagcaggagacgaca

SEQ ID NO: 2792485 - RNA, 20 nt, Human
ccaagcaggagacgacaggc

SEQ ID NO: 2792486 - RNA, 22 nt, Human
ccaagcaggagacgacaggcga

SEQ ID NO: 2792487 - RNA, 14 nt, Human
ccaagccguggcuu

SEQ ID NO: 2792488 - RNA, 15 nt, Human
ccaagccguggcuuc

SEQ ID NO: 2792489 - RNA, 16 nt, Human
ccaagccguggcuucc

SEQ ID NO: 2792490 - RNA, 17 nt, Human
ccaagccguggcuuccc

SEQ ID NO: 2792491 - RNA, 21 nt, Human
ccaagccguggcuucccgcuc

SEQ ID NO: 2792492 - RNA, 21 nt, Human
ccacaagaaauuugauuucua

SEQ ID NO: 2792493 - RNA, 15 nt, Human
ccacaagaaauuuga

SEQ ID NO: 2792494 - RNA, 16 nt, Human
ccacaagaaauuugau

SEQ ID NO: 2792495 - RNA, 19 nt, Human
ccacaacuccuacaugaug

SEQ ID NO: 2792496 - RNA, 14 nt, Human
ccacaagggcucuc

SEQ ID NO: 2792497 - RNA, 15 nt, Human
ccacaagucuuccag

SEQ ID NO: 2792498 - RNA, 22 nt, Human
ccacaagucuuccagaggaugc

SEQ ID NO: 2792499 - RNA, 20 nt, Human
ccacaagugccgcaaauugu

SEQ ID NO: 2792500 - RNA, 21 nt, Human
ccacaagugccgcaaauugua

SEQ ID NO: 2792501 - RNA, 13 nt, Human
ccacacacaacag

SEQ ID NO: 2792502 - RNA, 14 nt, Human
ccacacacaacagc

SEQ ID NO: 2792503 - RNA, 21 nt, Human
ccacacacaacagccaacagc

SEQ ID NO: 2792504 - RNA, 22 nt, Human
ccacacacaacagccaacagcu

SEQ ID NO: 2792505 - RNA, 12 nt, Human
cauuuaaagcau

SEQ ID NO: 2792506 - RNA, 14 nt, Human
cauuuaaagcauug

SEQ ID NO: 2792507 - RNA, 15 nt, Human
cauuuaaagcauugc

SEQ ID NO: 2792508 - RNA, 16 nt, Human
cauuuaaagcauugcu

SEQ ID NO: 2792509 - RNA, 17 nt, Human
cauuuaaagcauugcug

SEQ ID NO: 2792510 - RNA, 18 nt, Human
cauuuaaagcauugcugu

SEQ ID NO: 2792511 - RNA, 21 nt, Human
cauuuacuuuguguucaccuu

SEQ ID NO: 2792512 - RNA, 17 nt, Human
cauuuacuuuguguuca

SEQ ID NO: 2792513 - RNA, 12 nt, Human
cauuuagaaaau

SEQ ID NO: 2792514 - RNA, 15 nt, Human
cauuuagaaaauaga

SEQ ID NO: 2792515 - RNA, 22 nt, Human
cauuuagaaaauagagcuuuua

SEQ ID NO: 2792516 - RNA, 21 nt, Human
cauuuccauguccccucccag

SEQ ID NO: 2792517 - RNA, 23 nt, Human
cauuuagagaacuguggccguua

SEQ ID NO: 2792518 - RNA, 12 nt, Human
cauugcauucua

SEQ ID NO: 2792519 - RNA, 16 nt, Human
cauugcauucuauugc

SEQ ID NO: 2792520 - RNA, 22 nt, Human
cauugcaucaccucuguaauuu

SEQ ID NO: 2792521 - RNA, 15 nt, Human
cauuuaaaauugcua

SEQ ID NO: 2792522 - RNA, 16 nt, Human
cauuuaaaauugcuau

SEQ ID NO: 2792523 - RNA, 19 nt, Human
cauuuaaaauugcuauguu

SEQ ID NO: 2792524 - RNA, 20 nt, Human
cauuuaaaauugcuauguua

SEQ ID NO: 2792525 - RNA, 22 nt, Human
cauuuaaaauugcuauguuacu

SEQ ID NO: 2792526 - RNA, 17 nt, Human
cauugcacuccagccug

SEQ ID NO: 2792527 - RNA, 12 nt, Human
cauugcaguuua

SEQ ID NO: 2792528 - RNA, 20 nt, Human
cauugcaguuuaagagcaga

SEQ ID NO: 2792529 - RNA, 16 nt, Human
cauugcagaauaaugu

SEQ ID NO: 2792530 - RNA, 22 nt, Human
cauugcagaauaauguucuauu

SEQ ID NO: 2792531 - RNA, 18 nt, Human
cauugagaguuuugucuu

SEQ ID NO: 2792532 - RNA, 18 nt, Human
cauugagcugauauaaau

SEQ ID NO: 2792533 - RNA, 19 nt, Human
cauugagcugauauaaauu

SEQ ID NO: 2792534 - RNA, 20 nt, Human
cauugagcugauauaaauuc

SEQ ID NO: 2792535 - RNA, 17 nt, Human
cauugauuuccuguguc

SEQ ID NO: 2792536 - RNA, 18 nt, Human
cauugauuuccuguguca

SEQ ID NO: 2792537 - RNA, 12 nt, Human
cauugcacccag

SEQ ID NO: 2792538 - RNA, 14 nt, Human
cauugcacccagcc

SEQ ID NO: 2792539 - RNA, 16 nt, Human
cauugcacccagccca

SEQ ID NO: 2792540 - RNA, 18 nt, Human
cauugcacccagcccaga

SEQ ID NO: 2792541 - RNA, 17 nt, Human
cauuucugaauagaaau

SEQ ID NO: 2792542 - RNA, 22 nt, Human
cauuucugaguuucauucuccu

SEQ ID NO: 2792543 - RNA, 12 nt, Human
cauuucuccaga

SEQ ID NO: 2792544 - RNA, 13 nt, Human
cauuucuccagaa

SEQ ID NO: 2792545 - RNA, 15 nt, Human
cauuucuccagaacc

SEQ ID NO: 2792546 - RNA, 18 nt, Human
cauuucuccagauuaucu

SEQ ID NO: 2792547 - RNA, 12 nt, Human
cauuucuccguu

SEQ ID NO: 2792548 - RNA, 10 nt, Human
cauugaaaug

SEQ ID NO: 2792549 - RNA, 16 nt, Human
cauugaaaugagcacc

SEQ ID NO: 2792550 - RNA, 19 nt, Human
cauugaaaugagcaccucc

SEQ ID NO: 2792551 - RNA, 20 nt, Human
cauugaaaugagcaccucca

SEQ ID NO: 2792552 - RNA, 21 nt, Human
cauugaaaugagcaccuccau

SEQ ID NO: 2792553 - RNA, 11 nt, Human
cauugaaaugu

SEQ ID NO: 2792554 - RNA, 13 nt, Human
cauugaaauguca

SEQ ID NO: 2792555 - RNA, 14 nt, Human
cauugaaaugucac

SEQ ID NO: 2792556 - RNA, 22 nt, Human
cauugacugguuuacaggcccu

SEQ ID NO: 2792557 - RNA, 23 nt, Human
cauugacugguuuacaggcccug

SEQ ID NO: 2792558 - RNA, 20 nt, Human
cauugacuuucaguaaacau

SEQ ID NO: 2792559 - RNA, 22 nt, Human
cauugacuuucaguaaacauaa

SEQ ID NO: 2792560 - RNA, 18 nt, Human
cauugacgauuccuucuc

SEQ ID NO: 2792561 - RNA, 19 nt, Human
cauugacgauuccuucucu

SEQ ID NO: 2792562 - RNA, 23 nt, Human
cauugacgauuccuucucugaac

SEQ ID NO: 2792563 - RNA, 15 nt, Human
cauugaacacaaacu

SEQ ID NO: 2792564 - RNA, 14 nt, Human
cauugaacacaaac

SEQ ID NO: 2792565 - RNA, 17 nt, Human
cauugaacacaaacugu

SEQ ID NO: 2792566 - RNA, 16 nt, Human
cauugaacacaaacug

SEQ ID NO: 2792567 - RNA, 22 nt, Human
cauugaccgcgacuaauuucaa

SEQ ID NO: 2792568 - RNA, 21 nt, Human
cauugaccgcgacuaauuuca

SEQ ID NO: 2792569 - RNA, 17 nt, Human
cauugacccauagcaca

SEQ ID NO: 2792570 - RNA, 12 nt, Human
cauugacauuau

SEQ ID NO: 2792571 - RNA, 15 nt, Human
cauugacauuauaga

SEQ ID NO: 2792572 - RNA, 21 nt, Human
cauugacauuauagacauuga

SEQ ID NO: 2792573 - RNA, 13 nt, Human
ccaaacugcugga

SEQ ID NO: 2792574 - RNA, 24 nt, Human
ccaaacugcuggacgucuuucuuu

SEQ ID NO: 2792575 - RNA, 16 nt, Human
ccaaacuguucaagaa

SEQ ID NO: 2792576 - RNA, 15 nt, Human
ccaaacuucacucug

SEQ ID NO: 2792577 - RNA, 14 nt, Human
ccaaagaaaugaac

SEQ ID NO: 2792578 - RNA, 16 nt, Human
ccaaagaaaugaacau

SEQ ID NO: 2792579 - RNA, 17 nt, Human
ccaaagaaaugaacauu

SEQ ID NO: 2792580 - RNA, 20 nt, Human
ccaaagaaaugaacauucca

SEQ ID NO: 2792581 - RNA, 23 nt, Human
ccaaagaaaugaacauuccaagg

SEQ ID NO: 2792582 - RNA, 13 nt, Human
ccaaacgccuccc

SEQ ID NO: 2792583 - RNA, 16 nt, Human
ccaaagaggcugcccc

SEQ ID NO: 2792584 - RNA, 14 nt, Human
ccaaagaggcugcc

SEQ ID NO: 2792585 - RNA, 13 nt, Human
ccaaagaggcugc

SEQ ID NO: 2792586 - RNA, 12 nt, Human
ccaaagaggcug

SEQ ID NO: 2792587 - RNA, 14 nt, Human
ccaaagagcacaaa

SEQ ID NO: 2792588 - RNA, 20 nt, Human
ccaaagagcacaaacauuuu

SEQ ID NO: 2792589 - RNA, 21 nt, Human
ccaaagagcacaaacauuuuu

SEQ ID NO: 2792590 - RNA, 22 nt, Human
ccaaagagcacaaacauuuuuc

SEQ ID NO: 2792591 - RNA, 11 nt, Human
ccaaagaaugu

SEQ ID NO: 2792592 - RNA, 18 nt, Human
ccaaagaauguuagagca

SEQ ID NO: 2792593 - RNA, 19 nt, Human
ccaaagaauguuagagcac

SEQ ID NO: 2792594 - RNA, 14 nt, Human
ccaaagaauucuua

SEQ ID NO: 2792595 - RNA, 20 nt, Human
cauuuuuaguagagacaggg

SEQ ID NO: 2792596 - RNA, 16 nt, Human
cauuuugguucuucuc

SEQ ID NO: 2792597 - RNA, 15 nt, Human
cauuuuuauuuauga

SEQ ID NO: 2792598 - RNA, 16 nt, Human
cauuuuuauuuaugaa

SEQ ID NO: 2792599 - RNA, 17 nt, Human
cauuuuuauuuaugaag

SEQ ID NO: 2792600 - RNA, 22 nt, Human
cauuuuuauuucagauuuugau

SEQ ID NO: 2792601 - RNA, 23 nt, Human
cauuuuuauuucagauuuugaua

SEQ ID NO: 2792602 - RNA, 13 nt, Human
ccaaaccucaagu

SEQ ID NO: 2792603 - RNA, 17 nt, Human
ccaaaaguuuuccugag

SEQ ID NO: 2792604 - RNA, 18 nt, Human
ccaaaaguuuuccugaga

SEQ ID NO: 2792605 - RNA, 13 nt, Human
cauuuuauauuga

SEQ ID NO: 2792606 - RNA, 15 nt, Human
cauuuuauauugaaa

SEQ ID NO: 2792607 - RNA, 16 nt, Human
cauuuuauauugaaaa

SEQ ID NO: 2792608 - RNA, 18 nt, Human
cauuuuauauugaaaaaa

SEQ ID NO: 2792609 - RNA, 19 nt, Human
cauuuuauauugaaaaaaa

SEQ ID NO: 2792610 - RNA, 22 nt, Human
cauuuuauauugaaaaaaauaa

SEQ ID NO: 2792611 - RNA, 18 nt, Human
cauuuuaaauaaaagaaa

SEQ ID NO: 2792612 - RNA, 12 nt, Human
cauuuuaaugua

SEQ ID NO: 2792613 - RNA, 13 nt, Human
cauuuuaauguaa

SEQ ID NO: 2792614 - RNA, 14 nt, Human
cauuuuaauguaaa

SEQ ID NO: 2792615 - RNA, 15 nt, Human
cauuuuaaauaaaag

SEQ ID NO: 2792616 - RNA, 18 nt, Human
cauguuuuuaaagggcua

SEQ ID NO: 2792617 - RNA, 16 nt, Human
cauuuuaaauaaaaga

SEQ ID NO: 2792618 - RNA, 17 nt, Human
cauuuuaaauaaaagaa

SEQ ID NO: 2792619 - RNA, 12 nt, Human
cauuuuaacaag

SEQ ID NO: 2792620 - RNA, 13 nt, Human
cauuuuaacaaga

SEQ ID NO: 2792621 - RNA, 14 nt, Human
cauuuuaacaagaa

SEQ ID NO: 2792622 - RNA, 15 nt, Human
cauuuuaacaagaag

SEQ ID NO: 2792623 - RNA, 16 nt, Human
cauuuuaacaagaaga

SEQ ID NO: 2792624 - RNA, 17 nt, Human
cauuuuaacaagaagau

SEQ ID NO: 2792625 - RNA, 18 nt, Human
cauuuuaacaagaagaug

SEQ ID NO: 2792626 - RNA, 20 nt, Human
cauuuuaacaagaagaugaa

SEQ ID NO: 2792627 - RNA, 13 nt, Human
cauuuuaaauaaa

SEQ ID NO: 2792628 - RNA, 18 nt, Human
cauuuucuuuucacuucg

SEQ ID NO: 2792629 - RNA, 20 nt, Human
cauuuucuuauugcgcugcu

SEQ ID NO: 2792630 - RNA, 23 nt, Human
cauuuucuuauugcgcugcuacc

SEQ ID NO: 2792631 - RNA, 15 nt, Human
cauuuugagaacaaa

SEQ ID NO: 2792632 - RNA, 18 nt, Human
cauuuuuaguagagacag

SEQ ID NO: 2792633 - RNA, 19 nt, Human
cauuuuuaguagagacagg

SEQ ID NO: 2792634 - RNA, 23 nt, Human
cauuuugggguacccacugcucu

SEQ ID NO: 2792635 - RNA, 22 nt, Human
cauuuugggacaauuguuuuaa

SEQ ID NO: 2792636 - RNA, 22 nt, Human
cauuuugguaagagacagaaug

SEQ ID NO: 2792637 - RNA, 23 nt, Human
cauuuugguaagagacagaaugu

SEQ ID NO: 2792638 - RNA, 21 nt, Human
cauuuuggcgcuauuacaaau

SEQ ID NO: 2792639 - RNA, 22 nt, Human
cauuuuggcgcuauuacaaaua

SEQ ID NO: 2792640 - RNA, 14 nt, Human
cauuuuguuguaaa

SEQ ID NO: 2792641 - RNA, 15 nt, Human
cauuuuguuguaaaa

SEQ ID NO: 2792642 - RNA, 16 nt, Human
cauuuuguuguaaaaa

SEQ ID NO: 2792643 - RNA, 18 nt, Human
cauuuuguuguaaaaaga

SEQ ID NO: 2792644 - RNA, 19 nt, Human
cauuuuguuguaaaaagaa

SEQ ID NO: 2792645 - RNA, 20 nt, Human
cauuuuguuguaaaaagaaa

SEQ ID NO: 2792646 - RNA, 23 nt, Human
cauuuuguuguaaaaagaaaaac

SEQ ID NO: 2792647 - RNA, 23 nt, Human
cauuuuuaaaguagaagaggguu

SEQ ID NO: 2792648 - RNA, 16 nt, Human
cauuuuuaaauuguua

SEQ ID NO: 2792649 - RNA, 22 nt, Human
cauuuugggguacccacugcuc

SEQ ID NO: 2792650 - RNA, 21 nt, Human
cauuuugggguacccacugcu

SEQ ID NO: 2792651 - RNA, 20 nt, Human
cauuuugggguacccacugc

SEQ ID NO: 2792652 - RNA, 14 nt, Human
cauuugagcagggc

SEQ ID NO: 2792653 - RNA, 23 nt, Human
cauuugacugaagaugcagcuca

SEQ ID NO: 2792654 - RNA, 12 nt, Human
cauuucuuagac

SEQ ID NO: 2792655 - RNA, 22 nt, Human
cauuucuucagucagaaaacuu

SEQ ID NO: 2792656 - RNA, 23 nt, Human
cauuucuucagucagaaaacuuu

SEQ ID NO: 2792657 - RNA, 14 nt, Human
cauuucuguaaaua

SEQ ID NO: 2792658 - RNA, 17 nt, Human
cauuucuguaaauacca

SEQ ID NO: 2792659 - RNA, 16 nt, Human
cauuugagcagggcuc

SEQ ID NO: 2792660 - RNA, 23 nt, Human
cauuugaggauuuagaaguguca

SEQ ID NO: 2792661 - RNA, 13 nt, Human
ccaugugccaggu

SEQ ID NO: 2792662 - RNA, 14 nt, Human
ccauguuggccagg

SEQ ID NO: 2792663 - RNA, 13 nt, Human
ccauguuggccag

SEQ ID NO: 2792664 - RNA, 17 nt, Human
ccauguggugaugaugu

SEQ ID NO: 2792665 - RNA, 18 nt, Human
ccauguggugaugaugug

SEQ ID NO: 2792666 - RNA, 15 nt, Human
ccaugugccucuuug

SEQ ID NO: 2792667 - RNA, 16 nt, Human
ccaugugccucuuugu

SEQ ID NO: 2792668 - RNA, 14 nt, Human
ccauggagccagcu

SEQ ID NO: 2792669 - RNA, 19 nt, Human
ccauggagagcuggagccu

SEQ ID NO: 2792670 - RNA, 22 nt, Human
ccauggagagcuggagccuggu

SEQ ID NO: 2792671 - RNA, 17 nt, Human
ccauggagccagcuccc

SEQ ID NO: 2792672 - RNA, 18 nt, Human
ccauggagccagcucccu

SEQ ID NO: 2792673 - RNA, 22 nt, Human
ccauggagccagcucccucuau

SEQ ID NO: 2792674 - RNA, 17 nt, Human
ccauggagacaagaagg

SEQ ID NO: 2792675 - RNA, 15 nt, Human
ccauggagagcugga

SEQ ID NO: 2792676 - RNA, 18 nt, Human
ccauggagagcuggagcc

SEQ ID NO: 2792677 - RNA, 21 nt, Human
ccauggacacuccagugccag

SEQ ID NO: 2792678 - RNA, 15 nt, Human
ccauggacacuccag

SEQ ID NO: 2792679 - RNA, 17 nt, Human
ccauggacacuccagug

SEQ ID NO: 2792680 - RNA, 19 nt, Human
ccauggacacuccagugcc

SEQ ID NO: 2792681 - RNA, 14 nt, Human
ccauggacacucca

SEQ ID NO: 2792682 - RNA, 18 nt, Human
ccaugccuguccagccug

SEQ ID NO: 2792683 - RNA, 19 nt, Human
ccaugccuguccagccugg

SEQ ID NO: 2792684 - RNA, 13 nt, Human
ccaugccuguggc

SEQ ID NO: 2792685 - RNA, 14 nt, Human
ccaugccuguggcu

SEQ ID NO: 2792686 - RNA, 15 nt, Human
ccaugccuguggcug

SEQ ID NO: 2792687 - RNA, 16 nt, Human
ccaugccuguggcugc

SEQ ID NO: 2792688 - RNA, 17 nt, Human
ccaugccuguggcugcg

SEQ ID NO: 2792689 - RNA, 18 nt, Human
ccaugccuguggcugcgc

SEQ ID NO: 2792690 - RNA, 17 nt, Human
ccaugccuguccagccu

SEQ ID NO: 2792691 - RNA, 14 nt, Human
ccaugccuguccag

SEQ ID NO: 2792692 - RNA, 13 nt, Human
ccaugccugucca

SEQ ID NO: 2792693 - RNA, 21 nt, Human
ccaugaaaaaaaugaucccca

SEQ ID NO: 2792694 - RNA, 13 nt, Human
ccaugaaacaaag

SEQ ID NO: 2792695 - RNA, 16 nt, Human
ccaugaacagaaaaca

SEQ ID NO: 2792696 - RNA, 22 nt, Human
ccaugaacagaaaacauucuga

SEQ ID NO: 2792697 - RNA, 22 nt, Human
ccaugcuucucaucuugugaaa

SEQ ID NO: 2792698 - RNA, 14 nt, Human
ccaugcugccucca

SEQ ID NO: 2792699 - RNA, 22 nt, Human
ccaugccugccccccucaucuc

SEQ ID NO: 2792700 - RNA, 17 nt, Human
cccagacuacuauuuuc

SEQ ID NO: 2792701 - RNA, 18 nt, Human
cccagacuacuauuuucu

SEQ ID NO: 2792702 - RNA, 22 nt, Human
cccagacuacuauuuucuuuuu

SEQ ID NO: 2792703 - RNA, 21 nt, Human
cccagaccuuuuauccacuua

SEQ ID NO: 2792704 - RNA, 13 nt, Human
cccagagauguca

SEQ ID NO: 2792705 - RNA, 20 nt, Human
cccagagaugucaucagagc

SEQ ID NO: 2792706 - RNA, 17 nt, Human
cccagagauucccaagc

SEQ ID NO: 2792707 - RNA, 22 nt, Human
cccagagauugcuucucauccc

SEQ ID NO: 2792708 - RNA, 14 nt, Human
cccagagcaggaag

SEQ ID NO: 2792709 - RNA, 16 nt, Human
cccagagcaggaagca

SEQ ID NO: 2792710 - RNA, 14 nt, Human
cccagagcagggug

SEQ ID NO: 2792711 - RNA, 16 nt, Human
cccacgagggucagga

SEQ ID NO: 2792712 - RNA, 18 nt, Human
cccacgauuuucuccagc

SEQ ID NO: 2792713 - RNA, 19 nt, Human
cccacgauuuucuccagcu

SEQ ID NO: 2792714 - RNA, 20 nt, Human
cccacgauuuucuccagcuc

SEQ ID NO: 2792715 - RNA, 21 nt, Human
cccacgauuuucuccagcuca

SEQ ID NO: 2792716 - RNA, 22 nt, Human
cccacgauuuucuccagcucag

SEQ ID NO: 2792717 - RNA, 19 nt, Human
cccagacagacaucucugc

SEQ ID NO: 2792718 - RNA, 11 nt, Human
cccagaauuca

SEQ ID NO: 2792719 - RNA, 20 nt, Human
cccagacagacaucucugca

SEQ ID NO: 2792720 - RNA, 23 nt, Human
cccagacagacaucucugcaccc

SEQ ID NO: 2792721 - RNA, 20 nt, Human
cccaccuuggcugcagggag

SEQ ID NO: 2792722 - RNA, 19 nt, Human
cccaccuuggcugcaggga

SEQ ID NO: 2792723 - RNA, 17 nt, Human
cccaccuuggcugcagg

SEQ ID NO: 2792724 - RNA, 16 nt, Human
cccaccuuggcugcag

SEQ ID NO: 2792725 - RNA, 17 nt, Human
cccaccugccuggccgg

SEQ ID NO: 2792726 - RNA, 18 nt, Human
cccaccugccuggccggc

SEQ ID NO: 2792727 - RNA, 20 nt, Human
cccaccugccuggccggcca

SEQ ID NO: 2792728 - RNA, 21 nt, Human
cccaccugccuggccggccag

SEQ ID NO: 2792729 - RNA, 15 nt, Human
ccauguuggccaggc

SEQ ID NO: 2792730 - RNA, 18 nt, Human
ccauguuggccaggcugg

SEQ ID NO: 2792731 - RNA, 21 nt, Human
ccauguuggccaggcuggucu

SEQ ID NO: 2792732 - RNA, 19 nt, Human
ccauguuggccaggcuggu

SEQ ID NO: 2792733 - RNA, 14 nt, Human
ccauuccaaagcuu

SEQ ID NO: 2792734 - RNA, 16 nt, Human
ccauuccaaagcuuua

SEQ ID NO: 2792735 - RNA, 22 nt, Human
ccauuccaaagcuuuauuacca

SEQ ID NO: 2792736 - RNA, 17 nt, Human
ccaugugguggcacagg

SEQ ID NO: 2792737 - RNA, 18 nt, Human
ccaugugguggcacaggc

SEQ ID NO: 2792738 - RNA, 12 nt, Human
ccaugugucacu

SEQ ID NO: 2792739 - RNA, 19 nt, Human
ccaugugucacuugugcuu

SEQ ID NO: 2792740 - RNA, 21 nt, Human
ccauucccaagaaaugcuuug

SEQ ID NO: 2792741 - RNA, 20 nt, Human
cccagagcuguuuauggccu

SEQ ID NO: 2792742 - RNA, 22 nt, Human
cccagagcuguuuauggccuca

SEQ ID NO: 2792743 - RNA, 21 nt, Human
cccagagcuguuuauggccuc

SEQ ID NO: 2792744 - RNA, 23 nt, Human
cccagagcuguuuauggccucag

SEQ ID NO: 2792745 - RNA, 23 nt, Human
cccagauugcaacaggcugggcu

SEQ ID NO: 2792746 - RNA, 13 nt, Human
cccagaggaggca

SEQ ID NO: 2792747 - RNA, 11 nt, Human
cccagagcugu

SEQ ID NO: 2792748 - RNA, 20 nt, Human
cccagagcugguggacccag

SEQ ID NO: 2792749 - RNA, 19 nt, Human
cccagagcugguggaccca

SEQ ID NO: 2792750 - RNA, 13 nt, Human
cccagagcuguuu

SEQ ID NO: 2792751 - RNA, 23 nt, Human
cccagagcugguggacccaggga

SEQ ID NO: 2792752 - RNA, 15 nt, Human
cccagagcagggugu

SEQ ID NO: 2792753 - RNA, 13 nt, Human
cccagagccacac

SEQ ID NO: 2792754 - RNA, 14 nt, Human
cccagagccacaca

SEQ ID NO: 2792755 - RNA, 15 nt, Human
cccagagccacacau

SEQ ID NO: 2792756 - RNA, 16 nt, Human
cccagagccacacaug

SEQ ID NO: 2792757 - RNA, 17 nt, Human
cccagagccacacaugg

SEQ ID NO: 2792758 - RNA, 19 nt, Human
cccagagccacacaugggc

SEQ ID NO: 2792759 - RNA, 21 nt, Human
cccagagccacacaugggcau

SEQ ID NO: 2792760 - RNA, 14 nt, Human
cccagaggcguccc

SEQ ID NO: 2792761 - RNA, 22 nt, Human
cccagaggcgucccgcaccugu

SEQ ID NO: 2792762 - RNA, 23 nt, Human
cccagaggcgucccgcaccuguc

SEQ ID NO: 2792763 - RNA, 24 nt, Human
cccagaggcgucccgcaccugucu

SEQ ID NO: 2792764 - RNA, 12 nt, Human
cccagaggcuga

SEQ ID NO: 2792765 - RNA, 15 nt, Human
cccagaggcugaguu

SEQ ID NO: 2792766 - RNA, 11 nt, Human
cccagccucag

SEQ ID NO: 2792767 - RNA, 23 nt, Human
cccagcccuccuuaucaaaggac

SEQ ID NO: 2792768 - RNA, 20 nt, Human
cccagcccggaccuuggcag

SEQ ID NO: 2792769 - RNA, 12 nt, Human
cccagccucagu

SEQ ID NO: 2792770 - RNA, 16 nt, Human
cccagccucaguccuc

SEQ ID NO: 2792771 - RNA, 22 nt, Human
cccagccucaguccuccccuca

SEQ ID NO: 2792772 - RNA, 18 nt, Human
cccagccuccaagcucca

SEQ ID NO: 2792773 - RNA, 20 nt, Human
cccagccuccaagcuccauc

SEQ ID NO: 2792774 - RNA, 15 nt, Human
cccagccucuggcau

SEQ ID NO: 2792775 - RNA, 13 nt, Human
cccagcucuggcu

SEQ ID NO: 2792776 - RNA, 21 nt, Human
cccaggacaccacacccagcc

SEQ ID NO: 2792777 - RNA, 22 nt, Human
cccaggacaccacacccagccu

SEQ ID NO: 2792778 - RNA, 23 nt, Human
cccaggacaccacacccagccuc

SEQ ID NO: 2792779 - RNA, 14 nt, Human
cccagcgagcccug

SEQ ID NO: 2792780 - RNA, 12 nt, Human
cccagcucaggg

SEQ ID NO: 2792781 - RNA, 13 nt, Human
cccagcucagggg

SEQ ID NO: 2792782 - RNA, 16 nt, Human
cccagcucaggggcag

SEQ ID NO: 2792783 - RNA, 17 nt, Human
cccagcucaggggcagc

SEQ ID NO: 2792784 - RNA, 18 nt, Human
cccagcucaggggcagcu

SEQ ID NO: 2792785 - RNA, 20 nt, Human
cccagcuauaccugugccuc

SEQ ID NO: 2792786 - RNA, 11 nt, Human
cccagcucaau

SEQ ID NO: 2792787 - RNA, 17 nt, Human
cccagcuauaccugugc

SEQ ID NO: 2792788 - RNA, 14 nt, Human
cccaggagccccga

SEQ ID NO: 2792789 - RNA, 13 nt, Human
cccaggagccccg

SEQ ID NO: 2792790 - RNA, 20 nt, Human
cccaggagagagaaagccag

SEQ ID NO: 2792791 - RNA, 17 nt, Human
cccaggagacaguucaa

SEQ ID NO: 2792792 - RNA, 15 nt, Human
cccaggagacaguuc

SEQ ID NO: 2792793 - RNA, 13 nt, Human
cccaggagagaga

SEQ ID NO: 2792794 - RNA, 14 nt, Human
cccaggagagagaa

SEQ ID NO: 2792795 - RNA, 15 nt, Human
cccaggagagagaaa

SEQ ID NO: 2792796 - RNA, 16 nt, Human
cccaggagagagaaag

SEQ ID NO: 2792797 - RNA, 13 nt, Human
cccaggacuccuc

SEQ ID NO: 2792798 - RNA, 15 nt, Human
cccaggacucugacc

SEQ ID NO: 2792799 - RNA, 23 nt, Human
cccaggacucugaccccagcauu

SEQ ID NO: 2792800 - RNA, 19 nt, Human
cccaggacucugaccccag

SEQ ID NO: 2792801 - RNA, 20 nt, Human
cccaggaccaucuucccgag

SEQ ID NO: 2792802 - RNA, 15 nt, Human
cccaggaccaagcca

SEQ ID NO: 2792803 - RNA, 20 nt, Human
cccaggaccaagccacagca

SEQ ID NO: 2792804 - RNA, 19 nt, Human
cccaguucaggagucccaa

SEQ ID NO: 2792805 - RNA, 20 nt, Human
cccaggacaccacacccagc

SEQ ID NO: 2792806 - RNA, 19 nt, Human
cccaguguaugucuuguau

SEQ ID NO: 2792807 - RNA, 16 nt, Human
cccaguggcugcugcc

SEQ ID NO: 2792808 - RNA, 17 nt, Human
cccaguggcugcugccc

SEQ ID NO: 2792809 - RNA, 15 nt, Human
cccaguggcugcugc

SEQ ID NO: 2792810 - RNA, 18 nt, Human
cccaguggcugcugccca

SEQ ID NO: 2792811 - RNA, 21 nt, Human
cccaguggcugcugcccaggc

SEQ ID NO: 2792812 - RNA, 19 nt, Human
cccagucuggaaugcagug

SEQ ID NO: 2792813 - RNA, 18 nt, Human
cccagucuggaaugcagu

SEQ ID NO: 2792814 - RNA, 10 nt, Human
cccagucugg

SEQ ID NO: 2792815 - RNA, 14 nt, Human
cccaguccuuccac

SEQ ID NO: 2792816 - RNA, 16 nt, Human
cccaguccuuccaccu

SEQ ID NO: 2792817 - RNA, 17 nt, Human
cccaguccuuccaccuc

SEQ ID NO: 2792818 - RNA, 13 nt, Human
cccagucgcccuu

SEQ ID NO: 2792819 - RNA, 21 nt, Human
cccagugcccacaggaucagu

SEQ ID NO: 2792820 - RNA, 15 nt, Human
cccagucucuggcag

SEQ ID NO: 2792821 - RNA, 21 nt, Human
cccagucucucuuaaaguugg

SEQ ID NO: 2792822 - RNA, 16 nt, Human
cccagucucugcucca

SEQ ID NO: 2792823 - RNA, 20 nt, Human
cccagucucuggcaguucug

SEQ ID NO: 2792824 - RNA, 13 nt, Human
cccagguuucuau

SEQ ID NO: 2792825 - RNA, 15 nt, Human
cccagguagcuggga

SEQ ID NO: 2792826 - RNA, 16 nt, Human
cccagguagcugggau

SEQ ID NO: 2792827 - RNA, 20 nt, Human
cccagguagcugggauuaca

SEQ ID NO: 2792828 - RNA, 13 nt, Human
cccagguuucugg

SEQ ID NO: 2792829 - RNA, 19 nt, Human
cccagguuucuggucucua

SEQ ID NO: 2792830 - RNA, 22 nt, Human
cccagguuucuggucucuaggc

SEQ ID NO: 2792831 - RNA, 20 nt, Human
cccaguaccuccugucucug

SEQ ID NO: 2792832 - RNA, 21 nt, Human
cccaguaccuccugucucugg

SEQ ID NO: 2792833 - RNA, 22 nt, Human
cccaguaccuccugucucuggc

SEQ ID NO: 2792834 - RNA, 14 nt, Human
cccaguaccuccug

SEQ ID NO: 2792835 - RNA, 15 nt, Human
cccaguccucuccca

SEQ ID NO: 2792836 - RNA, 23 nt, Human
cccaggcaggucuugaacuccug

SEQ ID NO: 2792837 - RNA, 20 nt, Human
cccaggguggagugcagugg

SEQ ID NO: 2792838 - RNA, 19 nt, Human
cccagggugggaagggcua

SEQ ID NO: 2792839 - RNA, 16 nt, Human
cccaugagccucagca

SEQ ID NO: 2792840 - RNA, 15 nt, Human
cccaugagccucagc

SEQ ID NO: 2792841 - RNA, 20 nt, Human
cccaugagccucagcauccu

SEQ ID NO: 2792842 - RNA, 13 nt, Human
cccaugccugucc

SEQ ID NO: 2792843 - RNA, 14 nt, Human
cccaugccugucca

SEQ ID NO: 2792844 - RNA, 19 nt, Human
cccaugccuguccagccug

SEQ ID NO: 2792845 - RNA, 16 nt, Human
cccaugccuguccagc

SEQ ID NO: 2792846 - RNA, 22 nt, Human
cccauggguuguguguuuauuu

SEQ ID NO: 2792847 - RNA, 23 nt, Human
cccauggguuguguguuuauuuc

SEQ ID NO: 2792848 - RNA, 20 nt, Human
cccaugccuguccagccugg

SEQ ID NO: 2792849 - RNA, 14 nt, Human
cccaugccuguggc

SEQ ID NO: 2792850 - RNA, 17 nt, Human
cccaugccuguggcugc

SEQ ID NO: 2792851 - RNA, 18 nt, Human
cccaugccuguggcugcg

SEQ ID NO: 2792852 - RNA, 16 nt, Human
cccaugggcucugaca

SEQ ID NO: 2792853 - RNA, 17 nt, Human
cccaugggcucugacag

SEQ ID NO: 2792854 - RNA, 21 nt, Human
cccaucuaugucccuugcugu

SEQ ID NO: 2792855 - RNA, 16 nt, Human
cccaucuaagcugcag

SEQ ID NO: 2792856 - RNA, 18 nt, Human
cccaucuaagcugcagcu

SEQ ID NO: 2792857 - RNA, 21 nt, Human
cccaucuaagcugcagcuucc

SEQ ID NO: 2792858 - RNA, 22 nt, Human
cccaucuaagcugcagcuuccu

SEQ ID NO: 2792859 - RNA, 15 nt, Human
cccaucuucgggacc

SEQ ID NO: 2792860 - RNA, 16 nt, Human
cccaucugugcauucu

SEQ ID NO: 2792861 - RNA, 13 nt, Human
cccaucuucaccc

SEQ ID NO: 2792862 - RNA, 21 nt, Human
cccaucuucgggaccaggauu

SEQ ID NO: 2792863 - RNA, 18 nt, Human
cccaucuucgggaccagg

SEQ ID NO: 2792864 - RNA, 17 nt, Human
cccaucuucgggaccag

SEQ ID NO: 2792865 - RNA, 22 nt, Human
cccaugaagacaggacagugcu

SEQ ID NO: 2792866 - RNA, 11 nt, Human
cccaugaagcc

SEQ ID NO: 2792867 - RNA, 12 nt, Human
cccaugaagccu

SEQ ID NO: 2792868 - RNA, 13 nt, Human
cccaugaagccuu

SEQ ID NO: 2792869 - RNA, 17 nt, Human
cccaugaagccuuuuga

SEQ ID NO: 2792870 - RNA, 19 nt, Human
cccaugaagacaggacagu

SEQ ID NO: 2792871 - RNA, 18 nt, Human
cccaugaagacaggacag

SEQ ID NO: 2792872 - RNA, 17 nt, Human
ccccaaagcagcccuuc

SEQ ID NO: 2792873 - RNA, 18 nt, Human
ccccaaagcagcccuucc

SEQ ID NO: 2792874 - RNA, 12 nt, Human
ccccaaagcccc

SEQ ID NO: 2792875 - RNA, 23 nt, Human
cccauguggugaugauguguaua

SEQ ID NO: 2792876 - RNA, 18 nt, Human
cccauguucugcccccag

SEQ ID NO: 2792877 - RNA, 19 nt, Human
cccauguucugcccccagc

SEQ ID NO: 2792878 - RNA, 21 nt, Human
cccauguucugcccccagccc

SEQ ID NO: 2792879 - RNA, 14 nt, Human
cccauguuguaaug

SEQ ID NO: 2792880 - RNA, 18 nt, Human
cccauguuguaaugcugc

SEQ ID NO: 2792881 - RNA, 19 nt, Human
cccauguuguaaugcugca

SEQ ID NO: 2792882 - RNA, 20 nt, Human
cccauguuguaaugcugcac

SEQ ID NO: 2792883 - RNA, 21 nt, Human
cccauguguccugguucccgu

SEQ ID NO: 2792884 - RNA, 14 nt, Human
cccauguagccccc

SEQ ID NO: 2792885 - RNA, 15 nt, Human
cccauguaaauacca

SEQ ID NO: 2792886 - RNA, 15 nt, Human
cccauguagcccccu

SEQ ID NO: 2792887 - RNA, 21 nt, Human
cccauguagcccccuggccuc

SEQ ID NO: 2792888 - RNA, 22 nt, Human
cccauguagcccccuggccucu

SEQ ID NO: 2792889 - RNA, 23 nt, Human
cccauguagcccccuggccucug

SEQ ID NO: 2792890 - RNA, 23 nt, Human
cccauguauuuaucucuauuuaa

SEQ ID NO: 2792891 - RNA, 22 nt, Human
cccaugucuuucuccaaaguua

SEQ ID NO: 2792892 - RNA, 17 nt, Human
cccaugucucgacucau

SEQ ID NO: 2792893 - RNA, 16 nt, Human
cccaugucucgacuca

SEQ ID NO: 2792894 - RNA, 13 nt, Human
ccccaacccccac

SEQ ID NO: 2792895 - RNA, 12 nt, Human
ccccaaauauag

SEQ ID NO: 2792896 - RNA, 15 nt, Human
ccccaaaguaaaaga

SEQ ID NO: 2792897 - RNA, 18 nt, Human
ccccaaaguaaaagaaac

SEQ ID NO: 2792898 - RNA, 14 nt, Human
ccccaaccugcuga

SEQ ID NO: 2792899 - RNA, 22 nt, Human
ccccacacuuguuccagcucuu

SEQ ID NO: 2792900 - RNA, 16 nt, Human
ccaucaugucuggcua

SEQ ID NO: 2792901 - RNA, 14 nt, Human
ccaucaugucuggc

SEQ ID NO: 2792902 - RNA, 19 nt, Human
ccaucauuacccuucccug

SEQ ID NO: 2792903 - RNA, 13 nt, Human
ccauccuggcugc

SEQ ID NO: 2792904 - RNA, 15 nt, Human
ccauccuucccuuug

SEQ ID NO: 2792905 - RNA, 16 nt, Human
ccaucgcugucaucuc

SEQ ID NO: 2792906 - RNA, 15 nt, Human
ccaucuuuacuccca

SEQ ID NO: 2792907 - RNA, 17 nt, Human
ccaucuuuacucccaag

SEQ ID NO: 2792908 - RNA, 20 nt, Human
ccaucuuuacucccaagacu

SEQ ID NO: 2792909 - RNA, 20 nt, Human
ccaucucauguaucaucugg

SEQ ID NO: 2792910 - RNA, 20 nt, Human
ccaucacccucuuccuguga

SEQ ID NO: 2792911 - RNA, 18 nt, Human
ccaucacccucuuccugu

SEQ ID NO: 2792912 - RNA, 16 nt, Human
ccaucacccucuuccu

SEQ ID NO: 2792913 - RNA, 13 nt, Human
ccaucacccucuu

SEQ ID NO: 2792914 - RNA, 11 nt, Human
ccauauuuuca

SEQ ID NO: 2792915 - RNA, 23 nt, Human
ccauauuuucacagguguggugu

SEQ ID NO: 2792916 - RNA, 19 nt, Human
ccaucaaaaugcuuuuuau

SEQ ID NO: 2792917 - RNA, 16 nt, Human
ccaucaaaaugcuuuu

SEQ ID NO: 2792918 - RNA, 22 nt, Human
ccauauucagugcuguggccug

SEQ ID NO: 2792919 - RNA, 12 nt, Human
ccauauuuauuc

SEQ ID NO: 2792920 - RNA, 14 nt, Human
ccauauuuggaaga

SEQ ID NO: 2792921 - RNA, 18 nt, Human
ccauauuuacuaccuuau

SEQ ID NO: 2792922 - RNA, 14 nt, Human
ccauauuuagcagu

SEQ ID NO: 2792923 - RNA, 17 nt, Human
ccauauuuagcagugca

SEQ ID NO: 2792924 - RNA, 21 nt, Human
ccauauuuauccauuuguaau

SEQ ID NO: 2792925 - RNA, 18 nt, Human
ccauauucuguuggccag

SEQ ID NO: 2792926 - RNA, 15 nt, Human
ccauauucuguuggc

SEQ ID NO: 2792927 - RNA, 18 nt, Human
ccauagccaccccagaaa

SEQ ID NO: 2792928 - RNA, 14 nt, Human
ccauagcaacagga

SEQ ID NO: 2792929 - RNA, 13 nt, Human
ccaguggucucac

SEQ ID NO: 2792930 - RNA, 19 nt, Human
ccauacuuugucugaaaaa

SEQ ID NO: 2792931 - RNA, 13 nt, Human
ccauagaaacaug

SEQ ID NO: 2792932 - RNA, 16 nt, Human
ccauagaaacaugaca

SEQ ID NO: 2792933 - RNA, 17 nt, Human
ccauagaaacaugacac

SEQ ID NO: 2792934 - RNA, 18 nt, Human
ccauagaaacaugacacu

SEQ ID NO: 2792935 - RNA, 20 nt, Human
ccauagaaacaugacacuga

SEQ ID NO: 2792936 - RNA, 21 nt, Human
ccauagaaacaugacacugac

SEQ ID NO: 2792937 - RNA, 22 nt, Human
ccauagaaacaugacacugacc

SEQ ID NO: 2792938 - RNA, 13 nt, Human
ccauagaguuuaa

SEQ ID NO: 2792939 - RNA, 14 nt, Human
ccaguggugccuug

SEQ ID NO: 2792940 - RNA, 17 nt, Human
ccaguggucucacaugg

SEQ ID NO: 2792941 - RNA, 21 nt, Human
ccauagcaagauugcuuaaaa

SEQ ID NO: 2792942 - RNA, 18 nt, Human
ccauagcaagauugcuua

SEQ ID NO: 2792943 - RNA, 16 nt, Human
ccauagaguuuaacac

SEQ ID NO: 2792944 - RNA, 17 nt, Human
ccauagaguuuaacaca

SEQ ID NO: 2792945 - RNA, 14 nt, Human
ccauagaucuucug

SEQ ID NO: 2792946 - RNA, 15 nt, Human
ccauagaucuucuga

SEQ ID NO: 2792947 - RNA, 16 nt, Human
ccauagaucuucugaa

SEQ ID NO: 2792948 - RNA, 17 nt, Human
ccauagaucuucugaaa

SEQ ID NO: 2792949 - RNA, 20 nt, Human
ccauagaucuucugaaauga

SEQ ID NO: 2792950 - RNA, 21 nt, Human
ccauagaucuucugaaaugaa

SEQ ID NO: 2792951 - RNA, 18 nt, Human
ccagggacgaagaagagc

SEQ ID NO: 2792952 - RNA, 19 nt, Human
ccagggacgaagaagagcc

SEQ ID NO: 2792953 - RNA, 20 nt, Human
ccagggacgaagaagagcca

SEQ ID NO: 2792954 - RNA, 21 nt, Human
ccagggacgaagaagagccac

SEQ ID NO: 2792955 - RNA, 23 nt, Human
ccagggacgaagaagagccacag

SEQ ID NO: 2792956 - RNA, 21 nt, Human
ccagggaauccaagccuccac

SEQ ID NO: 2792957 - RNA, 18 nt, Human
ccagggaauccaagccuc

SEQ ID NO: 2792958 - RNA, 17 nt, Human
ccagggaauccaagccu

SEQ ID NO: 2792959 - RNA, 15 nt, Human
ccagggaauccaagc

SEQ ID NO: 2792960 - RNA, 24 nt, Human
ccaggccuauguugauccauccag

SEQ ID NO: 2792961 - RNA, 16 nt, Human
ccaguggagguuuguc

SEQ ID NO: 2792962 - RNA, 21 nt, Human
ccagugcuguccaugcuucuc

SEQ ID NO: 2792963 - RNA, 22 nt, Human
ccagugcuguccaugcuucuca

SEQ ID NO: 2792964 - RNA, 16 nt, Human
ccagugggagauguua

SEQ ID NO: 2792965 - RNA, 21 nt, Human
ccaguggcugcugcccaggcc

SEQ ID NO: 2792966 - RNA, 19 nt, Human
ccaguggcugcugcccagg

SEQ ID NO: 2792967 - RNA, 18 nt, Human
ccaguggcugcugcccag

SEQ ID NO: 2792968 - RNA, 21 nt, Human
ccaguggaugccacagcccag

SEQ ID NO: 2792969 - RNA, 20 nt, Human
ccagugcuccaggcacccag

SEQ ID NO: 2792970 - RNA, 19 nt, Human
ccaguggaugccacagccc

SEQ ID NO: 2792971 - RNA, 13 nt, Human
ccaguggggccug

SEQ ID NO: 2792972 - RNA, 14 nt, Human
ccaguggggccugu

SEQ ID NO: 2792973 - RNA, 15 nt, Human
ccaguggggccugug

SEQ ID NO: 2792974 - RNA, 16 nt, Human
ccaguggggccugugg

SEQ ID NO: 2792975 - RNA, 17 nt, Human
ccaguggggccugugga

SEQ ID NO: 2792976 - RNA, 18 nt, Human
ccaguggggccuguggaa

SEQ ID NO: 2792977 - RNA, 22 nt, Human
ccaguggggccuguggaaugag

SEQ ID NO: 2792978 - RNA, 13 nt, Human
ccaggccugggcc

SEQ ID NO: 2792979 - RNA, 17 nt, Human
ccaggccugggccagag

SEQ ID NO: 2792980 - RNA, 18 nt, Human
ccaggccuuaucuccaag

SEQ ID NO: 2792981 - RNA, 12 nt, Human
ccagggaagggg

SEQ ID NO: 2792982 - RNA, 13 nt, Human
ccaggccucugug

SEQ ID NO: 2792983 - RNA, 15 nt, Human
ccaggccucuguguc

SEQ ID NO: 2792984 - RNA, 16 nt, Human
ccaggccucugugucc

SEQ ID NO: 2792985 - RNA, 17 nt, Human
ccaggccucuguguccu

SEQ ID NO: 2792986 - RNA, 18 nt, Human
ccaggccucuguguccuu

SEQ ID NO: 2792987 - RNA, 12 nt, Human
ccaggccugccu

SEQ ID NO: 2792988 - RNA, 13 nt, Human
ccaggccugcagc

SEQ ID NO: 2792989 - RNA, 14 nt, Human
ccaggccugcagca

SEQ ID NO: 2792990 - RNA, 16 nt, Human
ccaggccugcagcagg

SEQ ID NO: 2792991 - RNA, 18 nt, Human
ccaggccugcagcaggag

SEQ ID NO: 2792992 - RNA, 11 nt, Human
ccagccuggcc

SEQ ID NO: 2792993 - RNA, 10 nt, Human
ccagccuggc

SEQ ID NO: 2792994 - RNA, 12 nt, Human
ccagccuggcca

SEQ ID NO: 2792995 - RNA, 17 nt, Human
ccagccuggccaacaug

SEQ ID NO: 2792996 - RNA, 12 nt, Human
ccagccugagca

SEQ ID NO: 2792997 - RNA, 11 nt, Human
ccagccugagc

SEQ ID NO: 2792998 - RNA, 17 nt, Human
ccagccugaccuuccuu

SEQ ID NO: 2792999 - RNA, 20 nt, Human
ccagccuggagaugaaaucu

SEQ ID NO: 2793000 - RNA, 13 nt, Human
ccagccuggagau

SEQ ID NO: 2793001 - RNA, 13 nt, Human
ccagcugcaccag

SEQ ID NO: 2793002 - RNA, 16 nt, Human
ccagcugcaccagagc

SEQ ID NO: 2793003 - RNA, 17 nt, Human
ccagcugcaccagagca

SEQ ID NO: 2793004 - RNA, 22 nt, Human
ccagcucugccgucucuggagc

SEQ ID NO: 2793005 - RNA, 21 nt, Human
ccagcucugccgucucuggag

SEQ ID NO: 2793006 - RNA, 20 nt, Human
ccagcucugccgucucugga

SEQ ID NO: 2793007 - RNA, 20 nt, Human
ccagcuggccgggagccuga

SEQ ID NO: 2793008 - RNA, 14 nt, Human
ccagcuggccggga

SEQ ID NO: 2793009 - RNA, 12 nt, Human
ccagcuggccgg

SEQ ID NO: 2793010 - RNA, 23 nt, Human
ccagcugcaccugccagccuggc

SEQ ID NO: 2793011 - RNA, 22 nt, Human
ccagcugcaccugccagccugg

SEQ ID NO: 2793012 - RNA, 20 nt, Human
ccagcugcaccugccagccu

SEQ ID NO: 2793013 - RNA, 19 nt, Human
ccagcugcaccugccagcc

SEQ ID NO: 2793014 - RNA, 18 nt, Human
ccagcugcaccugccagc

SEQ ID NO: 2793015 - RNA, 17 nt, Human
ccagcugcaccugccag

SEQ ID NO: 2793016 - RNA, 21 nt, Human
ccagcugugcucuggacaggc

SEQ ID NO: 2793017 - RNA, 20 nt, Human
ccagcugugcucuggacagg

SEQ ID NO: 2793018 - RNA, 18 nt, Human
ccagcugugcucuggaca

SEQ ID NO: 2793019 - RNA, 14 nt, Human
ccagcugugagccu

SEQ ID NO: 2793020 - RNA, 21 nt, Human
ccagcuggugagugaugcggc

SEQ ID NO: 2793021 - RNA, 16 nt, Human
ccagcuggccuggaca

SEQ ID NO: 2793022 - RNA, 15 nt, Human
ccagcuggccuggac

SEQ ID NO: 2793023 - RNA, 13 nt, Human
ccagcuggccugg

SEQ ID NO: 2793024 - RNA, 12 nt, Human
ccagcuggccug

SEQ ID NO: 2793025 - RNA, 17 nt, Human
ccagcuggccuggacag

SEQ ID NO: 2793026 - RNA, 16 nt, Human
ccagcuggguuggaaa

SEQ ID NO: 2793027 - RNA, 17 nt, Human
ccagcuggguuggaaaa

SEQ ID NO: 2793028 - RNA, 14 nt, Human
ccagcugggcucug

SEQ ID NO: 2793029 - RNA, 19 nt, Human
ccagccucguuggaagagg

SEQ ID NO: 2793030 - RNA, 22 nt, Human
ccagccucguuggaagaggaac

SEQ ID NO: 2793031 - RNA, 15 nt, Human
ccagccucuggcauu

SEQ ID NO: 2793032 - RNA, 23 nt, Human
ccaggagaaccacuacaugcagc

SEQ ID NO: 2793033 - RNA, 21 nt, Human
ccaggagaaccacuacaugca

SEQ ID NO: 2793034 - RNA, 19 nt, Human
ccaggagaaccacuacaug

SEQ ID NO: 2793035 - RNA, 14 nt, Human
ccaggacugagccc

SEQ ID NO: 2793036 - RNA, 15 nt, Human
ccaggacugagcccc

SEQ ID NO: 2793037 - RNA, 16 nt, Human
ccaggacugagccccg

SEQ ID NO: 2793038 - RNA, 19 nt, Human
ccaggacugagccccgcag

SEQ ID NO: 2793039 - RNA, 13 nt, Human
ccaggacugagcc

SEQ ID NO: 2793040 - RNA, 23 nt, Human
ccagcugugcucuggacaggcau

SEQ ID NO: 2793041 - RNA, 22 nt, Human
ccagcugugcucuggacaggca

SEQ ID NO: 2793042 - RNA, 19 nt, Human
ccagcugugagccuuggcu

SEQ ID NO: 2793043 - RNA, 20 nt, Human
ccagcugugagccuuggcug

SEQ ID NO: 2793044 - RNA, 15 nt, Human
ccagcugugagccuu

SEQ ID NO: 2793045 - RNA, 16 nt, Human
ccagcugugagccuug

SEQ ID NO: 2793046 - RNA, 17 nt, Human
ccagcugugagccuugg

SEQ ID NO: 2793047 - RNA, 18 nt, Human
ccagcugugagccuuggc

SEQ ID NO: 2793048 - RNA, 21 nt, Human
ccaggccagagggagugacag

SEQ ID NO: 2793049 - RNA, 14 nt, Human
ccaggccagaggga

SEQ ID NO: 2793050 - RNA, 23 nt, Human
ccaggccccugccacccugggga

SEQ ID NO: 2793051 - RNA, 21 nt, Human
ccaggccccugccacccuggg

SEQ ID NO: 2793052 - RNA, 19 nt, Human
ccaggccccugccacccug

SEQ ID NO: 2793053 - RNA, 16 nt, Human
ccuaaaccaaaaacug

SEQ ID NO: 2793054 - RNA, 19 nt, Human
ccguuauaaagugugccac

SEQ ID NO: 2793055 - RNA, 16 nt, Human
ccuaaaauucagugga

SEQ ID NO: 2793056 - RNA, 22 nt, Human
ccguguugcaugaaggagcagc

SEQ ID NO: 2793057 - RNA, 13 nt, Human
ccuaaauuuaaug

SEQ ID NO: 2793058 - RNA, 16 nt, Human
ccuaaauuuaaugcug

SEQ ID NO: 2793059 - RNA, 18 nt, Human
ccuaaauuuaaugcugcc

SEQ ID NO: 2793060 - RNA, 19 nt, Human
ccuaaauuuaaugcugccu

SEQ ID NO: 2793061 - RNA, 20 nt, Human
ccuaaauuuaaugcugccuu

SEQ ID NO: 2793062 - RNA, 13 nt, Human
ccuacagagcugu

SEQ ID NO: 2793063 - RNA, 12 nt, Human
ccuacagcacua

SEQ ID NO: 2793064 - RNA, 15 nt, Human
ccuacagcacuacug

SEQ ID NO: 2793065 - RNA, 18 nt, Human
ccuacagcacuacugggu

SEQ ID NO: 2793066 - RNA, 19 nt, Human
ccuacagcacuacugggug

SEQ ID NO: 2793067 - RNA, 20 nt, Human
ccuacagcacuacugggugu

SEQ ID NO: 2793068 - RNA, 21 nt, Human
ccuacagcacuacuggguguc

SEQ ID NO: 2793069 - RNA, 22 nt, Human
ccuacagcacuacuggguguca

SEQ ID NO: 2793070 - RNA, 12 nt, Human
ccuacagcauug

SEQ ID NO: 2793071 - RNA, 17 nt, Human
ccuacagcuuugauccc

SEQ ID NO: 2793072 - RNA, 20 nt, Human
ccuacagcuuugaucccuga

SEQ ID NO: 2793073 - RNA, 21 nt, Human
ccuacagcuuugaucccugac

SEQ ID NO: 2793074 - RNA, 22 nt, Human
ccuacccagagauugcuucuca

SEQ ID NO: 2793075 - RNA, 18 nt, Human
ccuacccacccuccuuuc

SEQ ID NO: 2793076 - RNA, 17 nt, Human
ccuacccacaccucugc

SEQ ID NO: 2793077 - RNA, 18 nt, Human
ccuacccacaccucugcc

SEQ ID NO: 2793078 - RNA, 19 nt, Human
ccuacccacaccucugcca

SEQ ID NO: 2793079 - RNA, 20 nt, Human
ccuacccacaccucugccag

SEQ ID NO: 2793080 - RNA, 13 nt, Human
ccuacccacccuc

SEQ ID NO: 2793081 - RNA, 16 nt, Human
ccuacccacaccucug

SEQ ID NO: 2793082 - RNA, 19 nt, Human
ccuacaugaaacagaaaca

SEQ ID NO: 2793083 - RNA, 13 nt, Human
ccuaggugacaga

SEQ ID NO: 2793084 - RNA, 21 nt, Human
ccuagaacacuaacucaccag

SEQ ID NO: 2793085 - RNA, 12 nt, Human
ccuagaagaagc

SEQ ID NO: 2793086 - RNA, 21 nt, Human
ccuagacucuguaacaucacu

SEQ ID NO: 2793087 - RNA, 16 nt, Human
ccuagacccuccuccu

SEQ ID NO: 2793088 - RNA, 19 nt, Human
ccuagacuguaaaccucuc

SEQ ID NO: 2793089 - RNA, 12 nt, Human
ccuagacuuuag

SEQ ID NO: 2793090 - RNA, 20 nt, Human
ccuagacuuuaggcuuucag

SEQ ID NO: 2793091 - RNA, 23 nt, Human
ccuagacuuuaggcuuucagcuu

SEQ ID NO: 2793092 - RNA, 17 nt, Human
ccuagaaacccaagcuc

SEQ ID NO: 2793093 - RNA, 18 nt, Human
ccuagaaacccaagcucc

SEQ ID NO: 2793094 - RNA, 23 nt, Human
ccuagaaacccaagcuccuccuc

SEQ ID NO: 2793095 - RNA, 13 nt, Human
ccuacuuccccuu

SEQ ID NO: 2793096 - RNA, 13 nt, Human
ccuacuguucuaa

SEQ ID NO: 2793097 - RNA, 15 nt, Human
ccuacuguucuaaag

SEQ ID NO: 2793098 - RNA, 16 nt, Human
ccuacuguucuaaagc

SEQ ID NO: 2793099 - RNA, 19 nt, Human
ccuacuguucuaaagcucu

SEQ ID NO: 2793100 - RNA, 16 nt, Human
ccuacuuccccuuccu

SEQ ID NO: 2793101 - RNA, 22 nt, Human
ccuacuguucuaaagcucugac

SEQ ID NO: 2793102 - RNA, 23 nt, Human
ccuacuguucuaaagcucugaca

SEQ ID NO: 2793103 - RNA, 11 nt, Human
cccuucuuuuu

SEQ ID NO: 2793104 - RNA, 17 nt, Human
cccuugaaauuuuaaac

SEQ ID NO: 2793105 - RNA, 15 nt, Human
cccuugacaccgggg

SEQ ID NO: 2793106 - RNA, 19 nt, Human
cccuucuuuuucuucuuuu

SEQ ID NO: 2793107 - RNA, 15 nt, Human
cccuucuuuuaugag

SEQ ID NO: 2793108 - RNA, 22 nt, Human
cccuucuuuuaugagcagaagg

SEQ ID NO: 2793109 - RNA, 13 nt, Human
cccuuggccucag

SEQ ID NO: 2793110 - RNA, 12 nt, Human
cccuuggccuca

SEQ ID NO: 2793111 - RNA, 20 nt, Human
cccuuggcagguccuggcca

SEQ ID NO: 2793112 - RNA, 21 nt, Human
cccuuggcagguccuggccag

SEQ ID NO: 2793113 - RNA, 22 nt, Human
cccuuggacaagacaaaccaag

SEQ ID NO: 2793114 - RNA, 18 nt, Human
cccuugacaucuggaaac

SEQ ID NO: 2793115 - RNA, 12 nt, Human
cccuuggccugu

SEQ ID NO: 2793116 - RNA, 14 nt, Human
cccuuggccucaga

SEQ ID NO: 2793117 - RNA, 17 nt, Human
cccuugguggcaagagc

SEQ ID NO: 2793118 - RNA, 12 nt, Human
cccuugugugug

SEQ ID NO: 2793119 - RNA, 16 nt, Human
cccuuucagagacagc

SEQ ID NO: 2793120 - RNA, 13 nt, Human
cccuuuccaguua

SEQ ID NO: 2793121 - RNA, 15 nt, Human
cccuuccaaauaaua

SEQ ID NO: 2793122 - RNA, 19 nt, Human
cccuucccaaucagcacug

SEQ ID NO: 2793123 - RNA, 20 nt, Human
cccuucccaaucagcacuga

SEQ ID NO: 2793124 - RNA, 21 nt, Human
cccuucccaaucagcacugaa

SEQ ID NO: 2793125 - RNA, 11 nt, Human
cccuucauuug

SEQ ID NO: 2793126 - RNA, 19 nt, Human
cccuucauugauuuccugu

SEQ ID NO: 2793127 - RNA, 21 nt, Human
cccuucauugauuuccugugu

SEQ ID NO: 2793128 - RNA, 21 nt, Human
cccuucccaugacccaggcug

SEQ ID NO: 2793129 - RNA, 13 nt, Human
cccuucccccacc

SEQ ID NO: 2793130 - RNA, 14 nt, Human
cccuuccgacccuc

SEQ ID NO: 2793131 - RNA, 15 nt, Human
cccuuccgacccucu

SEQ ID NO: 2793132 - RNA, 16 nt, Human
cccuuccgacccucug

SEQ ID NO: 2793133 - RNA, 17 nt, Human
cccuuccgacccucugg

SEQ ID NO: 2793134 - RNA, 18 nt, Human
cccuuccgacccucuggg

SEQ ID NO: 2793135 - RNA, 19 nt, Human
cccuuccgacccucuggga

SEQ ID NO: 2793136 - RNA, 20 nt, Human
cccuuccgacccucugggaa

SEQ ID NO: 2793137 - RNA, 21 nt, Human
cccuuccgacccucugggaac

SEQ ID NO: 2793138 - RNA, 20 nt, Human
cccuuccuaauuccacagcu

SEQ ID NO: 2793139 - RNA, 19 nt, Human
cccuuccuaauuccacagc

SEQ ID NO: 2793140 - RNA, 14 nt, Human
cccuuccuaauucc

SEQ ID NO: 2793141 - RNA, 13 nt, Human
cccuuccuaauuc

SEQ ID NO: 2793142 - RNA, 13 nt, Human
cccuguucacucu

SEQ ID NO: 2793143 - RNA, 21 nt, Human
cccuucaguacccucucagcu

SEQ ID NO: 2793144 - RNA, 19 nt, Human
cccuucaguacccucucag

SEQ ID NO: 2793145 - RNA, 20 nt, Human
cccuucaguacccucucagc

SEQ ID NO: 2793146 - RNA, 12 nt, Human
cccuucagcccc

SEQ ID NO: 2793147 - RNA, 20 nt, Human
cccuucagcccccagccccu

SEQ ID NO: 2793148 - RNA, 22 nt, Human
cccuucagcccccagccccucc

SEQ ID NO: 2793149 - RNA, 17 nt, Human
cccuucaguacccucuc

SEQ ID NO: 2793150 - RNA, 16 nt, Human
cccuguuacaaagcug

SEQ ID NO: 2793151 - RNA, 12 nt, Human
cccuguuauuuu

SEQ ID NO: 2793152 - RNA, 21 nt, Human
cccuguuauuuucaaguagcu

SEQ ID NO: 2793153 - RNA, 14 nt, Human
cccuguucacucua

SEQ ID NO: 2793154 - RNA, 22 nt, Human
cccuguucacucuacuuagcau

SEQ ID NO: 2793155 - RNA, 17 nt, Human
ccgggaaccaagcagga

SEQ ID NO: 2793156 - RNA, 13 nt, Human
ccggaucagagca

SEQ ID NO: 2793157 - RNA, 17 nt, Human
ccggaucagagcaggac

SEQ ID NO: 2793158 - RNA, 19 nt, Human
ccggaucagagcaggaccu

SEQ ID NO: 2793159 - RNA, 20 nt, Human
ccggaucagagcaggaccuc

SEQ ID NO: 2793160 - RNA, 21 nt, Human
ccggaucagagcaggaccucc

SEQ ID NO: 2793161 - RNA, 17 nt, Human
ccggaggggccuggcag

SEQ ID NO: 2793162 - RNA, 21 nt, Human
ccggaggggccuggcagccgu

SEQ ID NO: 2793163 - RNA, 23 nt, Human
cccuuuccccgacgcccacccaa

SEQ ID NO: 2793164 - RNA, 22 nt, Human
cccuuuccccagcaucacuccc

SEQ ID NO: 2793165 - RNA, 21 nt, Human
ccggagauuggacggccugau

SEQ ID NO: 2793166 - RNA, 20 nt, Human
ccggagauuggacggccuga

SEQ ID NO: 2793167 - RNA, 19 nt, Human
ccggagauuggacggccug

SEQ ID NO: 2793168 - RNA, 17 nt, Human
ccggagauuggacggcc

SEQ ID NO: 2793169 - RNA, 12 nt, Human
ccggagaggaag

SEQ ID NO: 2793170 - RNA, 20 nt, Human
ccggagaggaagagacacuc

SEQ ID NO: 2793171 - RNA, 20 nt, Human
ccgguggcggccccagcacc

SEQ ID NO: 2793172 - RNA, 18 nt, Human
ccgguggcggccccagca

SEQ ID NO: 2793173 - RNA, 17 nt, Human
ccggugugccugcagcc

SEQ ID NO: 2793174 - RNA, 12 nt, Human
ccgguguucuaa

SEQ ID NO: 2793175 - RNA, 13 nt, Human
ccgguguucuaag

SEQ ID NO: 2793176 - RNA, 16 nt, Human
ccggugugccugcagc

SEQ ID NO: 2793177 - RNA, 15 nt, Human
ccggugugccugcag

SEQ ID NO: 2793178 - RNA, 21 nt, Human
ccggugugccugacugcccag

SEQ ID NO: 2793179 - RNA, 17 nt, Human
ccguggccaucccugug

SEQ ID NO: 2793180 - RNA, 19 nt, Human
ccguggccaucccugugag

SEQ ID NO: 2793181 - RNA, 20 nt, Human
ccguggccaucccugugagg

SEQ ID NO: 2793182 - RNA, 21 nt, Human
ccgguccagcuggccuggaca

SEQ ID NO: 2793183 - RNA, 18 nt, Human
ccggucccaccccucccu

SEQ ID NO: 2793184 - RNA, 20 nt, Human
ccggucccaccccucccucu

SEQ ID NO: 2793185 - RNA, 23 nt, Human
ccggucccaccccucccucuguc

SEQ ID NO: 2793186 - RNA, 15 nt, Human
ccgguccagcuggcc

SEQ ID NO: 2793187 - RNA, 16 nt, Human
ccggggccagcaccac

SEQ ID NO: 2793188 - RNA, 12 nt, Human
ccggggcccagg

SEQ ID NO: 2793189 - RNA, 13 nt, Human
ccggggcccaggg

SEQ ID NO: 2793190 - RNA, 15 nt, Human
ccggggacagaggcc

SEQ ID NO: 2793191 - RNA, 23 nt, Human
ccgggagccugaucaccugcccu

SEQ ID NO: 2793192 - RNA, 16 nt, Human
ccgggagccugaucac

SEQ ID NO: 2793193 - RNA, 17 nt, Human
ccgggagccuaggacca

SEQ ID NO: 2793194 - RNA, 18 nt, Human
ccgggagccuaggaccac

SEQ ID NO: 2793195 - RNA, 19 nt, Human
ccgggagccuaggaccacu

SEQ ID NO: 2793196 - RNA, 23 nt, Human
ccgggagccuaggaccacucagc

SEQ ID NO: 2793197 - RNA, 16 nt, Human
ccucacuguugaauuu

SEQ ID NO: 2793198 - RNA, 19 nt, Human
ccucacuuggucugccagg

SEQ ID NO: 2793199 - RNA, 21 nt, Human
ccucacuuggucugccaggcc

SEQ ID NO: 2793200 - RNA, 22 nt, Human
ccucacuuggucugccaggccc

SEQ ID NO: 2793201 - RNA, 23 nt, Human
ccucacuuggucugccaggcccc

SEQ ID NO: 2793202 - RNA, 17 nt, Human
ccucagacugcacccag

SEQ ID NO: 2793203 - RNA, 18 nt, Human
ccucagacugcacccagg

SEQ ID NO: 2793204 - RNA, 19 nt, Human
ccucagacugcacccagga

SEQ ID NO: 2793205 - RNA, 20 nt, Human
ccucagacugcacccaggag

SEQ ID NO: 2793206 - RNA, 21 nt, Human
ccucagacugcacccaggagg

SEQ ID NO: 2793207 - RNA, 16 nt, Human
ccucagagccaccccu

SEQ ID NO: 2793208 - RNA, 18 nt, Human
ccucacuggccaucccuc

SEQ ID NO: 2793209 - RNA, 22 nt, Human
ccucacuggccaucccucgugg

SEQ ID NO: 2793210 - RNA, 23 nt, Human
ccucacucuuuauagugcacaaa

SEQ ID NO: 2793211 - RNA, 14 nt, Human
ccucacugcccgca

SEQ ID NO: 2793212 - RNA, 15 nt, Human
ccucacugcccgcac

SEQ ID NO: 2793213 - RNA, 16 nt, Human
ccucacugcccgcaca

SEQ ID NO: 2793214 - RNA, 18 nt, Human
ccucacugcccgcacacc

SEQ ID NO: 2793215 - RNA, 20 nt, Human
ccucacugcccgcacacccu

SEQ ID NO: 2793216 - RNA, 21 nt, Human
ccucacugcccgcacacccuc

SEQ ID NO: 2793217 - RNA, 22 nt, Human
ccucacugcccgcacacccuca

SEQ ID NO: 2793218 - RNA, 16 nt, Human
ccucacugcucccuga

SEQ ID NO: 2793219 - RNA, 17 nt, Human
ccucacugcucccugaa

SEQ ID NO: 2793220 - RNA, 19 nt, Human
ccucacugcucccugaagc

SEQ ID NO: 2793221 - RNA, 21 nt, Human
ccucacugcucccugaagcca

SEQ ID NO: 2793222 - RNA, 12 nt, Human
ccucacuggcca

SEQ ID NO: 2793223 - RNA, 15 nt, Human
ccucacuggccaucc

SEQ ID NO: 2793224 - RNA, 17 nt, Human
ccucacuggccaucccu

SEQ ID NO: 2793225 - RNA, 17 nt, Human
ccucacucuggccucag

SEQ ID NO: 2793226 - RNA, 12 nt, Human
ccucacucugcc

SEQ ID NO: 2793227 - RNA, 13 nt, Human
ccucacucugcca

SEQ ID NO: 2793228 - RNA, 14 nt, Human
ccucacucugccag

SEQ ID NO: 2793229 - RNA, 15 nt, Human
ccucacucugccagg

SEQ ID NO: 2793230 - RNA, 16 nt, Human
ccucacucugccaggg

SEQ ID NO: 2793231 - RNA, 18 nt, Human
ccucacucugccagggca

SEQ ID NO: 2793232 - RNA, 19 nt, Human
ccucacucugccagggcag

SEQ ID NO: 2793233 - RNA, 22 nt, Human
ccucacucugccagggcagugc

SEQ ID NO: 2793234 - RNA, 13 nt, Human
ccucacccuugcg

SEQ ID NO: 2793235 - RNA, 16 nt, Human
ccucaccaugaugggg

SEQ ID NO: 2793236 - RNA, 14 nt, Human
ccucacccuggggc

SEQ ID NO: 2793237 - RNA, 18 nt, Human
ccucaccgagugggggca

SEQ ID NO: 2793238 - RNA, 14 nt, Human
ccucaccgcuuccc

SEQ ID NO: 2793239 - RNA, 15 nt, Human
ccucaccgcuucccu

SEQ ID NO: 2793240 - RNA, 17 nt, Human
ccucaccgcuucccucc

SEQ ID NO: 2793241 - RNA, 11 nt, Human
ccucacccugc

SEQ ID NO: 2793242 - RNA, 21 nt, Human
ccucagagugcaagccccugc

SEQ ID NO: 2793243 - RNA, 14 nt, Human
ccucagagugcaag

SEQ ID NO: 2793244 - RNA, 14 nt, Human
ccucagcaagcccu

SEQ ID NO: 2793245 - RNA, 16 nt, Human
ccucagaugucccuug

SEQ ID NO: 2793246 - RNA, 17 nt, Human
ccucagaugucccuuga

SEQ ID NO: 2793247 - RNA, 23 nt, Human
ccucagaugucccuugaugcaca

SEQ ID NO: 2793248 - RNA, 23 nt, Human
ccucagggagcagggaaggccug

SEQ ID NO: 2793249 - RNA, 22 nt, Human
ccucagggagcagggaaggccu

SEQ ID NO: 2793250 - RNA, 21 nt, Human
ccucagggagcagggaaggcc

SEQ ID NO: 2793251 - RNA, 17 nt, Human
ccucaggcuuccuuggc

SEQ ID NO: 2793252 - RNA, 16 nt, Human
ccucaggcuuccuugg

SEQ ID NO: 2793253 - RNA, 20 nt, Human
ccucagggagcagggaaggc

SEQ ID NO: 2793254 - RNA, 19 nt, Human
ccucagggagcagggaagg

SEQ ID NO: 2793255 - RNA, 17 nt, Human
ccucagggagcagggaa

SEQ ID NO: 2793256 - RNA, 18 nt, Human
ccuauuccugaacuauaa

SEQ ID NO: 2793257 - RNA, 20 nt, Human
ccuauguugauccauccagc

SEQ ID NO: 2793258 - RNA, 22 nt, Human
ccuauguugauccauccagcuu

SEQ ID NO: 2793259 - RNA, 15 nt, Human
ccuaucuccugacag

SEQ ID NO: 2793260 - RNA, 14 nt, Human
ccuaucuccugaca

SEQ ID NO: 2793261 - RNA, 16 nt, Human
ccuaucuccugacaga

SEQ ID NO: 2793262 - RNA, 22 nt, Human
ccucacagccucugaccccucc

SEQ ID NO: 2793263 - RNA, 23 nt, Human
ccucacagccucugaccccuccu

SEQ ID NO: 2793264 - RNA, 13 nt, Human
ccucacagugacc

SEQ ID NO: 2793265 - RNA, 18 nt, Human
ccucacagugacccuucc

SEQ ID NO: 2793266 - RNA, 19 nt, Human
ccucacagugacccuuccc

SEQ ID NO: 2793267 - RNA, 24 nt, Human
ccucacagugacccuucccaauca

SEQ ID NO: 2793268 - RNA, 21 nt, Human
ccucacauagcuacccaaaag

SEQ ID NO: 2793269 - RNA, 18 nt, Human
ccucacagccucugaccc

SEQ ID NO: 2793270 - RNA, 19 nt, Human
ccucacagccucugacccc

SEQ ID NO: 2793271 - RNA, 20 nt, Human
ccucacagccucugaccccu

SEQ ID NO: 2793272 - RNA, 21 nt, Human
ccucacagccucugaccccuc

SEQ ID NO: 2793273 - RNA, 12 nt, Human
ccucacagccuc

SEQ ID NO: 2793274 - RNA, 13 nt, Human
ccucacagccucu

SEQ ID NO: 2793275 - RNA, 14 nt, Human
ccucacagccucug

SEQ ID NO: 2793276 - RNA, 15 nt, Human
ccucacagccucuga

SEQ ID NO: 2793277 - RNA, 16 nt, Human
ccucacagccucugac

SEQ ID NO: 2793278 - RNA, 22 nt, Human
ccuauugcaaagguuccaacug

SEQ ID NO: 2793279 - RNA, 17 nt, Human
ccucacacacccugagg

SEQ ID NO: 2793280 - RNA, 23 nt, Human
ccucacacacccugaggucaggg

SEQ ID NO: 2793281 - RNA, 15 nt, Human
ccuaggugacagagu

SEQ ID NO: 2793282 - RNA, 12 nt, Human
ccuagugaaccu

SEQ ID NO: 2793283 - RNA, 18 nt, Human
ccuagugaaccucacccc

SEQ ID NO: 2793284 - RNA, 13 nt, Human
ccuaucuccugac

SEQ ID NO: 2793285 - RNA, 16 nt, Human
ccuaucuaucuuccaa

SEQ ID NO: 2793286 - RNA, 21 nt, Human
ccuaucuaucuuccaaaugca

SEQ ID NO: 2793287 - RNA, 13 nt, Human
ccuauccuuggca

SEQ ID NO: 2793288 - RNA, 14 nt, Human
ccuauccuuggcac

SEQ ID NO: 2793289 - RNA, 16 nt, Human
ccuauccuuggcacca

SEQ ID NO: 2793290 - RNA, 17 nt, Human
ccuauccuuggcaccaa

SEQ ID NO: 2793291 - RNA, 19 nt, Human
ccuauccuuggcaccaaag

SEQ ID NO: 2793292 - RNA, 22 nt, Human
ccuaucgcccccuacgcgccuu

SEQ ID NO: 2793293 - RNA, 15 nt, Human
ccuauccucacugcc

SEQ ID NO: 2793294 - RNA, 13 nt, Human
ccuauccugcugu

SEQ ID NO: 2793295 - RNA, 17 nt, Human
ccuauccacugggcaca

SEQ ID NO: 2793296 - RNA, 13 nt, Human
ccuaucccaccuc

SEQ ID NO: 2793297 - RNA, 13 nt, Human
ccuaguggcuugu

SEQ ID NO: 2793298 - RNA, 15 nt, Human
ccuaguggcuugucc

SEQ ID NO: 2793299 - RNA, 16 nt, Human
ccuaguggcuuguccu

SEQ ID NO: 2793300 - RNA, 15 nt, Human
ccuccccuccuccug

SEQ ID NO: 2793301 - RNA, 13 nt, Human
ccuccccucacag

SEQ ID NO: 2793302 - RNA, 15 nt, Human
ccuccccucacagcc

SEQ ID NO: 2793303 - RNA, 16 nt, Human
ccuccccucacagccu

SEQ ID NO: 2793304 - RNA, 21 nt, Human
ccuccccucacagccucugac

SEQ ID NO: 2793305 - RNA, 18 nt, Human
ccuccccucacagccucu

SEQ ID NO: 2793306 - RNA, 19 nt, Human
ccuccccucacagccucug

SEQ ID NO: 2793307 - RNA, 15 nt, Human
ccuccccuccccugc

SEQ ID NO: 2793308 - RNA, 16 nt, Human
ccuccccuccccugcu

SEQ ID NO: 2793309 - RNA, 19 nt, Human
ccuccccuccccugcugca

SEQ ID NO: 2793310 - RNA, 14 nt, Human
ccuccccuccccug

SEQ ID NO: 2793311 - RNA, 15 nt, Human
ccuccccugcccugg

SEQ ID NO: 2793312 - RNA, 13 nt, Human
ccuccccugcccu

SEQ ID NO: 2793313 - RNA, 14 nt, Human
ccuccccugccauu

SEQ ID NO: 2793314 - RNA, 18 nt, Human
ccucccgaauagcuggga

SEQ ID NO: 2793315 - RNA, 23 nt, Human
ccucccaaagugcugggauuaca

SEQ ID NO: 2793316 - RNA, 13 nt, Human
ccucccaacccag

SEQ ID NO: 2793317 - RNA, 16 nt, Human
ccucccccgccacucc

SEQ ID NO: 2793318 - RNA, 17 nt, Human
ccucccccgccacuccu

SEQ ID NO: 2793319 - RNA, 23 nt, Human
ccuccccggcucgagcaguccug

SEQ ID NO: 2793320 - RNA, 17 nt, Human
ccuccccgucucauucc

SEQ ID NO: 2793321 - RNA, 17 nt, Human
ccuccccggcacccucu

SEQ ID NO: 2793322 - RNA, 20 nt, Human
ccuccccggcacccucuggc

SEQ ID NO: 2793323 - RNA, 21 nt, Human
ccuccccgcaccccccaagcu

SEQ ID NO: 2793324 - RNA, 15 nt, Human
ccuccccgcaccccc

SEQ ID NO: 2793325 - RNA, 20 nt, Human
ccucccgaauagcugggacu

SEQ ID NO: 2793326 - RNA, 19 nt, Human
ccucccgaauagcugggac

SEQ ID NO: 2793327 - RNA, 21 nt, Human
ccucccgaauagcugggacua

SEQ ID NO: 2793328 - RNA, 16 nt, Human
ccuccccugcccuggu

SEQ ID NO: 2793329 - RNA, 13 nt, Human
ccuccccugccuu

SEQ ID NO: 2793330 - RNA, 14 nt, Human
ccuccccugccuug

SEQ ID NO: 2793331 - RNA, 15 nt, Human
ccuccccugccuugc

SEQ ID NO: 2793332 - RNA, 12 nt, Human
ccuccccugcug

SEQ ID NO: 2793333 - RNA, 13 nt, Human
ccuccccugcugc

SEQ ID NO: 2793334 - RNA, 14 nt, Human
ccuccccugcugca

SEQ ID NO: 2793335 - RNA, 18 nt, Human
ccucccgaguagcuggga

SEQ ID NO: 2793336 - RNA, 17 nt, Human
ccucccgaguagcuggg

SEQ ID NO: 2793337 - RNA, 18 nt, Human
ccucccucucucuucugc

SEQ ID NO: 2793338 - RNA, 13 nt, Human
ccucccucucucu

SEQ ID NO: 2793339 - RNA, 20 nt, Human
ccuccucacuggccaucccu

SEQ ID NO: 2793340 - RNA, 14 nt, Human
ccuccucacuggcc

SEQ ID NO: 2793341 - RNA, 15 nt, Human
ccuccucacuggcca

SEQ ID NO: 2793342 - RNA, 17 nt, Human
ccuccucacuggccauc

SEQ ID NO: 2793343 - RNA, 19 nt, Human
ccuccucacuggccauccc

SEQ ID NO: 2793344 - RNA, 22 nt, Human
ccuccucaccucuggacuggcu

SEQ ID NO: 2793345 - RNA, 21 nt, Human
ccuccucaccucuggacuggc

SEQ ID NO: 2793346 - RNA, 16 nt, Human
ccuccucaccucugga

SEQ ID NO: 2793347 - RNA, 18 nt, Human
ccucccucugaccugcag

SEQ ID NO: 2793348 - RNA, 14 nt, Human
ccucccucugaccu

SEQ ID NO: 2793349 - RNA, 22 nt, Human
ccucccucucucuucugcucca

SEQ ID NO: 2793350 - RNA, 20 nt, Human
ccucccucucucuucugcuc

SEQ ID NO: 2793351 - RNA, 15 nt, Human
ccucccucuuguuuu

SEQ ID NO: 2793352 - RNA, 18 nt, Human
ccucccucugauuuuuca

SEQ ID NO: 2793353 - RNA, 19 nt, Human
ccucccucugaccugcagg

SEQ ID NO: 2793354 - RNA, 13 nt, Human
ccuccucaccucu

SEQ ID NO: 2793355 - RNA, 15 nt, Human
ccuccucaccucugg

SEQ ID NO: 2793356 - RNA, 14 nt, Human
ccuccucaccucug

SEQ ID NO: 2793357 - RNA, 19 nt, Human
ccuccaugcugccuccaga

SEQ ID NO: 2793358 - RNA, 16 nt, Human
ccuccaugcugccucc

SEQ ID NO: 2793359 - RNA, 17 nt, Human
ccucccaaagugcuggg

SEQ ID NO: 2793360 - RNA, 15 nt, Human
ccuccaugugggcua

SEQ ID NO: 2793361 - RNA, 12 nt, Human
ccuccauguggg

SEQ ID NO: 2793362 - RNA, 23 nt, Human
ccuccaguccaaggaaaccacag

SEQ ID NO: 2793363 - RNA, 14 nt, Human
ccuccagucccccu

SEQ ID NO: 2793364 - RNA, 16 nt, Human
ccuccaguaccuugcu

SEQ ID NO: 2793365 - RNA, 17 nt, Human
ccuccaguaccuugcuu

SEQ ID NO: 2793366 - RNA, 19 nt, Human
ccuccauauuuucuuuaaa

SEQ ID NO: 2793367 - RNA, 21 nt, Human
ccuccauccuauccacugggc

SEQ ID NO: 2793368 - RNA, 22 nt, Human
ccucacugugguaaaugccaca

SEQ ID NO: 2793369 - RNA, 14 nt, Human
ccucaguugugcag

SEQ ID NO: 2793370 - RNA, 15 nt, Human
ccucaguugugcagc

SEQ ID NO: 2793371 - RNA, 16 nt, Human
ccucaguugugcagcu

SEQ ID NO: 2793372 - RNA, 17 nt, Human
ccucaguugugcagcuu

SEQ ID NO: 2793373 - RNA, 22 nt, Human
ccucaguucccuuggccucaga

SEQ ID NO: 2793374 - RNA, 21 nt, Human
ccucaguucccuuggccucag

SEQ ID NO: 2793375 - RNA, 20 nt, Human
ccucaguucccuuggccuca

SEQ ID NO: 2793376 - RNA, 19 nt, Human
ccucaguucccuuggccuc

SEQ ID NO: 2793377 - RNA, 18 nt, Human
ccucaguucccuuggccu

SEQ ID NO: 2793378 - RNA, 17 nt, Human
ccucaguucccuuggcc

SEQ ID NO: 2793379 - RNA, 16 nt, Human
ccucaguucccuuggc

SEQ ID NO: 2793380 - RNA, 15 nt, Human
ccucaguucccuugg

SEQ ID NO: 2793381 - RNA, 21 nt, Human
ccuccagaacucacuggggcc

SEQ ID NO: 2793382 - RNA, 22 nt, Human
ccuccagaacucacuggggccu

SEQ ID NO: 2793383 - RNA, 12 nt, Human
ccuccagaagcc

SEQ ID NO: 2793384 - RNA, 13 nt, Human
ccuccagaagccu

SEQ ID NO: 2793385 - RNA, 21 nt, Human
ccuccagccugcccaagccca

SEQ ID NO: 2793386 - RNA, 23 nt, Human
ccuccagccugcccaagcccagg

SEQ ID NO: 2793387 - RNA, 22 nt, Human
ccuccagccuuuggccuuggcu

SEQ ID NO: 2793388 - RNA, 12 nt, Human
ccuccacuguca

SEQ ID NO: 2793389 - RNA, 13 nt, Human
ccuccacugucac

SEQ ID NO: 2793390 - RNA, 16 nt, Human
ccuccaggcccgucug

SEQ ID NO: 2793391 - RNA, 20 nt, Human
ccuccaggcccgucugucca

SEQ ID NO: 2793392 - RNA, 19 nt, Human
ccuccagaagcacugggau

SEQ ID NO: 2793393 - RNA, 22 nt, Human
ccuccaggaaugaucucuucuu

SEQ ID NO: 2793394 - RNA, 20 nt, Human
ccuccagcuucaggcaggcc

SEQ ID NO: 2793395 - RNA, 14 nt, Human
ccuccagcugcacc

SEQ ID NO: 2793396 - RNA, 15 nt, Human
ccuccagcugcacca

SEQ ID NO: 2793397 - RNA, 16 nt, Human
ccuccagcugcaccag

SEQ ID NO: 2793398 - RNA, 18 nt, Human
ccuccagcugcaccagag

SEQ ID NO: 2793399 - RNA, 19 nt, Human
ccuccagcugcaccagagc

SEQ ID NO: 2793400 - RNA, 20 nt, Human
ccuccagcugcaccagagca

SEQ ID NO: 2793401 - RNA, 20 nt, Human
ccucuccccagcaagugaga

SEQ ID NO: 2793402 - RNA, 13 nt, Human
ccucuccccaccc

SEQ ID NO: 2793403 - RNA, 14 nt, Human
ccucuccccacccc

SEQ ID NO: 2793404 - RNA, 15 nt, Human
ccucuccccaccccu

SEQ ID NO: 2793405 - RNA, 10 nt, Human
ccucucccug

SEQ ID NO: 2793406 - RNA, 22 nt, Human
ccucucccgccagacuguuaga

SEQ ID NO: 2793407 - RNA, 19 nt, Human
ccucucccuguccccaccc

SEQ ID NO: 2793408 - RNA, 15 nt, Human
ccucuccccagcaag

SEQ ID NO: 2793409 - RNA, 11 nt, Human
ccucucccagg

SEQ ID NO: 2793410 - RNA, 15 nt, Human
ccucucccacgggac

SEQ ID NO: 2793411 - RNA, 15 nt, Human
ccucucccaagucca

SEQ ID NO: 2793412 - RNA, 15 nt, Human
ccucuccauccugcu

SEQ ID NO: 2793413 - RNA, 14 nt, Human
ccucuacuuuccag

SEQ ID NO: 2793414 - RNA, 16 nt, Human
ccucuacuuuccaggc

SEQ ID NO: 2793415 - RNA, 18 nt, Human
ccucuacuuuccaggcua

SEQ ID NO: 2793416 - RNA, 22 nt, Human
ccucuagaaacgaguugguguc

SEQ ID NO: 2793417 - RNA, 14 nt, Human
ccucuacccaaacc

SEQ ID NO: 2793418 - RNA, 16 nt, Human
ccucuacccaaacccu

SEQ ID NO: 2793419 - RNA, 19 nt, Human
ccucuacccaaacccuagg

SEQ ID NO: 2793420 - RNA, 18 nt, Human
ccucuacauggacucaga

SEQ ID NO: 2793421 - RNA, 21 nt, Human
ccucuacauggacucagagaa

SEQ ID NO: 2793422 - RNA, 12 nt, Human
ccuccuccaggg

SEQ ID NO: 2793423 - RNA, 20 nt, Human
ccuccuccagggugauuuua

SEQ ID NO: 2793424 - RNA, 19 nt, Human
ccuccucuaagguugggca

SEQ ID NO: 2793425 - RNA, 23 nt, Human
ccuccucggaaccgcucaccuag

SEQ ID NO: 2793426 - RNA, 24 nt, Human
ccuccucggaaccgcucaccuaga

SEQ ID NO: 2793427 - RNA, 16 nt, Human
ccuccucucugcccua

SEQ ID NO: 2793428 - RNA, 18 nt, Human
ccuccucguuccuuucuc

SEQ ID NO: 2793429 - RNA, 13 nt, Human
ccuccucucagug

SEQ ID NO: 2793430 - RNA, 14 nt, Human
ccuccucucagugu

SEQ ID NO: 2793431 - RNA, 15 nt, Human
ccuccucucugcccu

SEQ ID NO: 2793432 - RNA, 13 nt, Human
ccuccucucugcc

SEQ ID NO: 2793433 - RNA, 13 nt, Human
ccuccuuuaucac

SEQ ID NO: 2793434 - RNA, 17 nt, Human
ccuccuugcuuguuaca

SEQ ID NO: 2793435 - RNA, 15 nt, Human
ccuccuuggugccug

SEQ ID NO: 2793436 - RNA, 17 nt, Human
ccuccuuggugccuggc

SEQ ID NO: 2793437 - RNA, 15 nt, Human
ccuccuuguccaccc

SEQ ID NO: 2793438 - RNA, 16 nt, Human
ccuccuuguccaccca

SEQ ID NO: 2793439 - RNA, 14 nt, Human
ccucuaaugagacu

SEQ ID NO: 2793440 - RNA, 19 nt, Human
ccucuaagguugggcaggg

SEQ ID NO: 2793441 - RNA, 15 nt, Human
ccucuaaugagacug

SEQ ID NO: 2793442 - RNA, 18 nt, Human
ccucugauaugggacuga

SEQ ID NO: 2793443 - RNA, 19 nt, Human
ccucugagucaccaucuua

SEQ ID NO: 2793444 - RNA, 12 nt, Human
ccucugagccuu

SEQ ID NO: 2793445 - RNA, 11 nt, Human
ccucugagccu

SEQ ID NO: 2793446 - RNA, 13 nt, Human
ccucugaggcuga

SEQ ID NO: 2793447 - RNA, 20 nt, Human
ccucugacacacagcucugu

SEQ ID NO: 2793448 - RNA, 19 nt, Human
ccucugacacacagcucug

SEQ ID NO: 2793449 - RNA, 14 nt, Human
ccucugacacacag

SEQ ID NO: 2793450 - RNA, 20 nt, Human
ccucugaaugaaccuucugg

SEQ ID NO: 2793451 - RNA, 13 nt, Human
ccucugacacaca

SEQ ID NO: 2793452 - RNA, 14 nt, Human
ccucuccguuuauu

SEQ ID NO: 2793453 - RNA, 23 nt, Human
ccucuccguuuauuauaaacugu

SEQ ID NO: 2793454 - RNA, 15 nt, Human
ccucuccuacucacu

SEQ ID NO: 2793455 - RNA, 19 nt, Human
ccucugaaacccuggacca

SEQ ID NO: 2793456 - RNA, 17 nt, Human
ccucugaaaguuguaca

SEQ ID NO: 2793457 - RNA, 18 nt, Human
ccucugaaaguuguacau

SEQ ID NO: 2793458 - RNA, 19 nt, Human
ccucugaaaguuguacaug

SEQ ID NO: 2793459 - RNA, 16 nt, Human
ccucugaaacccugga

SEQ ID NO: 2793460 - RNA, 18 nt, Human
ccucuccucauguucugc

SEQ ID NO: 2793461 - RNA, 13 nt, Human
ccucucccuguug

SEQ ID NO: 2793462 - RNA, 17 nt, Human
ccucucccuuacccugg

SEQ ID NO: 2793463 - RNA, 21 nt, Human
ccucugacacacagcucuguc

SEQ ID NO: 2793464 - RNA, 13 nt, Human
ccucugaccaaca

SEQ ID NO: 2793465 - RNA, 17 nt, Human
ccucugaccaacaggcu

SEQ ID NO: 2793466 - RNA, 18 nt, Human
ccucugaccaacaggcug

SEQ ID NO: 2793467 - RNA, 20 nt, Human
ccucugaccaacaggcuguu

SEQ ID NO: 2793468 - RNA, 22 nt, Human
ccucugacccuagcucuuuccu

SEQ ID NO: 2793469 - RNA, 20 nt, Human
ccucugaccccuccucacug

SEQ ID NO: 2793470 - RNA, 22 nt, Human
ccucugaccccuccucacuggc

SEQ ID NO: 2793471 - RNA, 14 nt, Human
ccucugaccugcac

SEQ ID NO: 2793472 - RNA, 16 nt, Human
ccucugaccugcacug

SEQ ID NO: 2793473 - RNA, 13 nt, Human
ccucugaccccuc

SEQ ID NO: 2793474 - RNA, 14 nt, Human
ccucugaccccucc

SEQ ID NO: 2793475 - RNA, 15 nt, Human
ccucugaccccuccu

SEQ ID NO: 2793476 - RNA, 16 nt, Human
ccucugaccccuccuc

SEQ ID NO: 2793477 - RNA, 17 nt, Human
ccucugaccccuccuca

SEQ ID NO: 2793478 - RNA, 18 nt, Human
ccucugaccccuccucac

SEQ ID NO: 2793479 - RNA, 19 nt, Human
ccucugaccccuccucacu

SEQ ID NO: 2793480 - RNA, 17 nt, Human
ccucugaccugcaggcc

SEQ ID NO: 2793481 - RNA, 16 nt, Human
ccucugaccugcaggc

SEQ ID NO: 2793482 - RNA, 15 nt, Human
ccucugaccugcagg

SEQ ID NO: 2793483 - RNA, 17 nt, Human
ccucugaccugcacugg

SEQ ID NO: 2793484 - RNA, 20 nt, Human
ccucugaccugcaggccaag

SEQ ID NO: 2793485 - RNA, 19 nt, Human
ccucugaccugcaggccaa

SEQ ID NO: 2793486 - RNA, 12 nt, Human
cccuccccuccc

SEQ ID NO: 2793487 - RNA, 16 nt, Human
cccuccccuccccugc

SEQ ID NO: 2793488 - RNA, 17 nt, Human
cccuccccuccccugcu

SEQ ID NO: 2793489 - RNA, 22 nt, Human
cccuccaucuguacuuggucca

SEQ ID NO: 2793490 - RNA, 21 nt, Human
cccuccgaccacuuccagggg

SEQ ID NO: 2793491 - RNA, 14 nt, Human
cccucccuucaacc

SEQ ID NO: 2793492 - RNA, 17 nt, Human
cccuccaugugggcuag

SEQ ID NO: 2793493 - RNA, 16 nt, Human
cccuccacagccgcag

SEQ ID NO: 2793494 - RNA, 16 nt, Human
cccuccagcacaaaca

SEQ ID NO: 2793495 - RNA, 18 nt, Human
cccuccagcacaaacaca

SEQ ID NO: 2793496 - RNA, 12 nt, Human
cccuccagccuu

SEQ ID NO: 2793497 - RNA, 23 nt, Human
cccuccagccuuuggccuuggcu

SEQ ID NO: 2793498 - RNA, 21 nt, Human
cccuccccggcacccucuggc

SEQ ID NO: 2793499 - RNA, 17 nt, Human
cccuccccgcacccccc

SEQ ID NO: 2793500 - RNA, 16 nt, Human
cccuccccgcaccccc

SEQ ID NO: 2793501 - RNA, 13 nt, Human
cccucccccuugu

SEQ ID NO: 2793502 - RNA, 15 nt, Human
cccucccccuugucc

SEQ ID NO: 2793503 - RNA, 12 nt, Human
cccucccccuug

SEQ ID NO: 2793504 - RNA, 19 nt, Human
cccuccaucuaaacugccc

SEQ ID NO: 2793505 - RNA, 15 nt, Human
cccucccaagcuggc

SEQ ID NO: 2793506 - RNA, 21 nt, Human
cccucccaagcuggcuggggu

SEQ ID NO: 2793507 - RNA, 18 nt, Human
cccucaucuugaagggcc

SEQ ID NO: 2793508 - RNA, 21 nt, Human
cccucaucuugaagggcccag

SEQ ID NO: 2793509 - RNA, 23 nt, Human
cccucaucuugaagggcccagga

SEQ ID NO: 2793510 - RNA, 17 nt, Human
cccucaucuaugaggaa

SEQ ID NO: 2793511 - RNA, 16 nt, Human
cccucauuucaggagc

SEQ ID NO: 2793512 - RNA, 11 nt, Human
cccucauuuuu

SEQ ID NO: 2793513 - RNA, 17 nt, Human
cccucauuacugggccu

SEQ ID NO: 2793514 - RNA, 18 nt, Human
cccucauuacugggccuu

SEQ ID NO: 2793515 - RNA, 22 nt, Human
cccucauuccaccuucccaugc

SEQ ID NO: 2793516 - RNA, 21 nt, Human
cccucauggccccucugaccu

SEQ ID NO: 2793517 - RNA, 16 nt, Human
cccucauggccccucu

SEQ ID NO: 2793518 - RNA, 17 nt, Human
cccucauggccccucug

SEQ ID NO: 2793519 - RNA, 19 nt, Human
cccucauagcccucacccu

SEQ ID NO: 2793520 - RNA, 13 nt, Human
cccucaguugugc

SEQ ID NO: 2793521 - RNA, 14 nt, Human
cccucaguugugca

SEQ ID NO: 2793522 - RNA, 16 nt, Human
cccucaguugugcagc

SEQ ID NO: 2793523 - RNA, 17 nt, Human
cccucaguugugcagcu

SEQ ID NO: 2793524 - RNA, 18 nt, Human
cccucaguugugcagcuu

SEQ ID NO: 2793525 - RNA, 15 nt, Human
cccucaggggaaaac

SEQ ID NO: 2793526 - RNA, 22 nt, Human
cccucaggggaaaacuguuacc

SEQ ID NO: 2793527 - RNA, 15 nt, Human
cccucauagcccuca

SEQ ID NO: 2793528 - RNA, 13 nt, Human
cccucauagcccu

SEQ ID NO: 2793529 - RNA, 13 nt, Human
cccggcagacgcc

SEQ ID NO: 2793530 - RNA, 12 nt, Human
cccggcaggccc

SEQ ID NO: 2793531 - RNA, 13 nt, Human
cccggcaggcccu

SEQ ID NO: 2793532 - RNA, 14 nt, Human
cccggcaggcccug

SEQ ID NO: 2793533 - RNA, 15 nt, Human
cccggcaggcccugc

SEQ ID NO: 2793534 - RNA, 16 nt, Human
cccggcaggcccugca

SEQ ID NO: 2793535 - RNA, 17 nt, Human
cccggcaggcccugcag

SEQ ID NO: 2793536 - RNA, 18 nt, Human
cccggcaggcccugcagu

SEQ ID NO: 2793537 - RNA, 19 nt, Human
cccggcaggcccugcagug

SEQ ID NO: 2793538 - RNA, 16 nt, Human
cccggcacccucuggc

SEQ ID NO: 2793539 - RNA, 17 nt, Human
cccggcacccucuggcc

SEQ ID NO: 2793540 - RNA, 19 nt, Human
cccggcacccucuggccgc

SEQ ID NO: 2793541 - RNA, 14 nt, Human
cccggaggaaaucu

SEQ ID NO: 2793542 - RNA, 15 nt, Human
cccggaggaaaucug

SEQ ID NO: 2793543 - RNA, 16 nt, Human
cccggaggaaaucugc

SEQ ID NO: 2793544 - RNA, 20 nt, Human
cccggaggaaaucugcagag

SEQ ID NO: 2793545 - RNA, 22 nt, Human
cccggaggaaaucugcagaggg

SEQ ID NO: 2793546 - RNA, 17 nt, Human
cccggagcugccccucu

SEQ ID NO: 2793547 - RNA, 22 nt, Human
cccggagcugccccucucuggg

SEQ ID NO: 2793548 - RNA, 19 nt, Human
cccggagauuggacggccu

SEQ ID NO: 2793549 - RNA, 17 nt, Human
cccggaggggccuggca

SEQ ID NO: 2793550 - RNA, 18 nt, Human
cccggaggggccuggcag

SEQ ID NO: 2793551 - RNA, 16 nt, Human
cccggauucugggagg

SEQ ID NO: 2793552 - RNA, 14 nt, Human
cccggauucuggga

SEQ ID NO: 2793553 - RNA, 18 nt, Human
cccggagguugggugggc

SEQ ID NO: 2793554 - RNA, 14 nt, Human
cccggaucagagca

SEQ ID NO: 2793555 - RNA, 15 nt, Human
cccggaucagagcag

SEQ ID NO: 2793556 - RNA, 16 nt, Human
cccggaucagagcagg

SEQ ID NO: 2793557 - RNA, 17 nt, Human
cccggaucagagcagga

SEQ ID NO: 2793558 - RNA, 20 nt, Human
cccggaucagagcaggaccu

SEQ ID NO: 2793559 - RNA, 21 nt, Human
cccggaucagagcaggaccuc

SEQ ID NO: 2793560 - RNA, 22 nt, Human
cccggaucagagcaggaccucc

SEQ ID NO: 2793561 - RNA, 13 nt, Human
cccggaugcugcu

SEQ ID NO: 2793562 - RNA, 15 nt, Human
cccggaugcugcuuc

SEQ ID NO: 2793563 - RNA, 18 nt, Human
cccuaaaccccuguccca

SEQ ID NO: 2793564 - RNA, 14 nt, Human
cccuaaaagcacac

SEQ ID NO: 2793565 - RNA, 17 nt, Human
cccuaaccccuuccaga

SEQ ID NO: 2793566 - RNA, 21 nt, Human
cccuaaccccuuccagaucac

SEQ ID NO: 2793567 - RNA, 12 nt, Human
cccuaaacugua

SEQ ID NO: 2793568 - RNA, 12 nt, Human
cccguuucucca

SEQ ID NO: 2793569 - RNA, 16 nt, Human
cccguuucuccaccua

SEQ ID NO: 2793570 - RNA, 18 nt, Human
cccguggccaucccugug

SEQ ID NO: 2793571 - RNA, 19 nt, Human
cccguggccaucccuguga

SEQ ID NO: 2793572 - RNA, 20 nt, Human
cccuagcccagcgcucugcc

SEQ ID NO: 2793573 - RNA, 13 nt, Human
cccuagcccagga

SEQ ID NO: 2793574 - RNA, 16 nt, Human
cccuagcccaggagag

SEQ ID NO: 2793575 - RNA, 17 nt, Human
cccuagcccaggagaga

SEQ ID NO: 2793576 - RNA, 20 nt, Human
cccuagccaaugucuccucc

SEQ ID NO: 2793577 - RNA, 17 nt, Human
cccuagccagcacuugu

SEQ ID NO: 2793578 - RNA, 13 nt, Human
cccuagcagugaa

SEQ ID NO: 2793579 - RNA, 22 nt, Human
cccuagaucuuucuauuccaaa

SEQ ID NO: 2793580 - RNA, 13 nt, Human
cccuagacuuuag

SEQ ID NO: 2793581 - RNA, 22 nt, Human
cccuagacuuuaggcuuucagc

SEQ ID NO: 2793582 - RNA, 15 nt, Human
cccuagagccugccu

SEQ ID NO: 2793583 - RNA, 18 nt, Human
cccuagagccugccugga

SEQ ID NO: 2793584 - RNA, 13 nt, Human
cccuagauaguuu

SEQ ID NO: 2793585 - RNA, 18 nt, Human
cccuagauaguuuauuau

SEQ ID NO: 2793586 - RNA, 20 nt, Human
cccuagagccugccuggagc

SEQ ID NO: 2793587 - RNA, 21 nt, Human
cccuagagccugccuggagcg

SEQ ID NO: 2793588 - RNA, 18 nt, Human
cccuaaggcaugugugaa

SEQ ID NO: 2793589 - RNA, 20 nt, Human
cccuaaggcaugugugaaac

SEQ ID NO: 2793590 - RNA, 14 nt, Human
cccuaagccagccu

SEQ ID NO: 2793591 - RNA, 15 nt, Human
cccuaagccagccug

SEQ ID NO: 2793592 - RNA, 16 nt, Human
cccuaagccagccugg

SEQ ID NO: 2793593 - RNA, 23 nt, Human
cccuaagccagccugguccaugc

SEQ ID NO: 2793594 - RNA, 18 nt, Human
cccuacuucuuuugcucu

SEQ ID NO: 2793595 - RNA, 19 nt, Human
cccuacuucuuuugcucuu

SEQ ID NO: 2793596 - RNA, 17 nt, Human
cccuagaaacccaagcu

SEQ ID NO: 2793597 - RNA, 18 nt, Human
cccuagaaacccaagcuc

SEQ ID NO: 2793598 - RNA, 19 nt, Human
cccuagaaacccaagcucc

SEQ ID NO: 2793599 - RNA, 12 nt, Human
cccuaagagacu

SEQ ID NO: 2793600 - RNA, 19 nt, Human
ccccagggucuucccuacc

SEQ ID NO: 2793601 - RNA, 16 nt, Human
ccccagggucuucccu

SEQ ID NO: 2793602 - RNA, 17 nt, Human
ccccagguggaaggcag

SEQ ID NO: 2793603 - RNA, 17 nt, Human
ccccaggggucccagcc

SEQ ID NO: 2793604 - RNA, 22 nt, Human
ccccaggggucccagccacccc

SEQ ID NO: 2793605 - RNA, 19 nt, Human
ccccaggggucccagccac

SEQ ID NO: 2793606 - RNA, 21 nt, Human
ccccagggccugagccuggcc

SEQ ID NO: 2793607 - RNA, 19 nt, Human
ccccagggccugagccugg

SEQ ID NO: 2793608 - RNA, 14 nt, Human
ccccagggcacccu

SEQ ID NO: 2793609 - RNA, 15 nt, Human
ccccagggcacccug

SEQ ID NO: 2793610 - RNA, 16 nt, Human
ccccagggccugagcc

SEQ ID NO: 2793611 - RNA, 15 nt, Human
ccccagggccugagc

SEQ ID NO: 2793612 - RNA, 14 nt, Human
ccccagggccugag

SEQ ID NO: 2793613 - RNA, 13 nt, Human
ccccaccacacau

SEQ ID NO: 2793614 - RNA, 14 nt, Human
ccccaccacacauc

SEQ ID NO: 2793615 - RNA, 18 nt, Human
ccccaccacacaucccag

SEQ ID NO: 2793616 - RNA, 19 nt, Human
ccccaccacacaucccagc

SEQ ID NO: 2793617 - RNA, 23 nt, Human
ccccacacuuguuccagcucuuu

SEQ ID NO: 2793618 - RNA, 17 nt, Human
ccccaccacuucuuuua

SEQ ID NO: 2793619 - RNA, 22 nt, Human
ccccagcccccaaagcagcccu

SEQ ID NO: 2793620 - RNA, 15 nt, Human
ccccagccccuagcc

SEQ ID NO: 2793621 - RNA, 18 nt, Human
ccccagccccuagcccag

SEQ ID NO: 2793622 - RNA, 20 nt, Human
ccccagccccuagcccagga

SEQ ID NO: 2793623 - RNA, 22 nt, Human
ccccagccccuagcccaggaga

SEQ ID NO: 2793624 - RNA, 18 nt, Human
ccccagccccucccccau

SEQ ID NO: 2793625 - RNA, 20 nt, Human
ccccagccccucccccaucu

SEQ ID NO: 2793626 - RNA, 22 nt, Human
ccccagccccucccccaucucc

SEQ ID NO: 2793627 - RNA, 23 nt, Human
ccccagccccucccccaucuccc

SEQ ID NO: 2793628 - RNA, 13 nt, Human
ccccagccugcua

SEQ ID NO: 2793629 - RNA, 17 nt, Human
ccccagcucuggcuucc

SEQ ID NO: 2793630 - RNA, 15 nt, Human
cccgaggccuucucu

SEQ ID NO: 2793631 - RNA, 13 nt, Human
cccgaggcccugc

SEQ ID NO: 2793632 - RNA, 14 nt, Human
cccgaggcccugca

SEQ ID NO: 2793633 - RNA, 15 nt, Human
cccgaggcccugcau

SEQ ID NO: 2793634 - RNA, 16 nt, Human
cccgaggcccugcaug

SEQ ID NO: 2793635 - RNA, 19 nt, Human
cccgaggccgcgugcguga

SEQ ID NO: 2793636 - RNA, 20 nt, Human
cccgaggccuucucugaagg

SEQ ID NO: 2793637 - RNA, 14 nt, Human
cccgagucugggac

SEQ ID NO: 2793638 - RNA, 18 nt, Human
cccgagucugggacacaa

SEQ ID NO: 2793639 - RNA, 21 nt, Human
cccgcacacccucacucugcc

SEQ ID NO: 2793640 - RNA, 22 nt, Human
cccgcacacccucacucugcca

SEQ ID NO: 2793641 - RNA, 11 nt, Human
cccgcacagca

SEQ ID NO: 2793642 - RNA, 12 nt, Human
cccgcacagcag

SEQ ID NO: 2793643 - RNA, 13 nt, Human
cccgcacagcagc

SEQ ID NO: 2793644 - RNA, 14 nt, Human
cccgcacagcagcc

SEQ ID NO: 2793645 - RNA, 15 nt, Human
cccgcacagcagccu

SEQ ID NO: 2793646 - RNA, 16 nt, Human
cccgcacagcagccug

SEQ ID NO: 2793647 - RNA, 16 nt, Human
cccgauguggaccucu

SEQ ID NO: 2793648 - RNA, 12 nt, Human
cccgccugcccu

SEQ ID NO: 2793649 - RNA, 13 nt, Human
cccgccugcccuc

SEQ ID NO: 2793650 - RNA, 14 nt, Human
cccgccugcccuca

SEQ ID NO: 2793651 - RNA, 15 nt, Human
cccgcgccuccuucc

SEQ ID NO: 2793652 - RNA, 21 nt, Human
cccgcguguccccggggccca

SEQ ID NO: 2793653 - RNA, 15 nt, Human
cccgcucagcccucc

SEQ ID NO: 2793654 - RNA, 21 nt, Human
cccgcggggacauugggaagg

SEQ ID NO: 2793655 - RNA, 19 nt, Human
cccgcucagcccucccugc

SEQ ID NO: 2793656 - RNA, 23 nt, Human
cccgccuuccgccccuucccuuc

SEQ ID NO: 2793657 - RNA, 17 nt, Human
cccgccugcccucaugg

SEQ ID NO: 2793658 - RNA, 12 nt, Human
cccgcugcugcu

SEQ ID NO: 2793659 - RNA, 15 nt, Human
cccgcugcugcugcu

SEQ ID NO: 2793660 - RNA, 23 nt, Human
cccgcucagcccucccugccccu

SEQ ID NO: 2793661 - RNA, 21 nt, Human
cccgcucuacaucuucugccu

SEQ ID NO: 2793662 - RNA, 14 nt, Human
ccccuuaccacugc

SEQ ID NO: 2793663 - RNA, 19 nt, Human
ccccuguuucaaucacugu

SEQ ID NO: 2793664 - RNA, 20 nt, Human
ccccuguuucaaucacuguc

SEQ ID NO: 2793665 - RNA, 16 nt, Human
ccccuuaagcccuggc

SEQ ID NO: 2793666 - RNA, 10 nt, Human
ccccuuagau

SEQ ID NO: 2793667 - RNA, 22 nt, Human
ccccuuccuaauuccacagcug

SEQ ID NO: 2793668 - RNA, 21 nt, Human
ccccuuccuaauuccacagcu

SEQ ID NO: 2793669 - RNA, 20 nt, Human
ccccuuccuaauuccacagc

SEQ ID NO: 2793670 - RNA, 12 nt, Human
ccccuucccccu

SEQ ID NO: 2793671 - RNA, 13 nt, Human
ccccuucccuguc

SEQ ID NO: 2793672 - RNA, 18 nt, Human
ccccugucccaugcaggc

SEQ ID NO: 2793673 - RNA, 22 nt, Human
ccccugucccaugcaggcccuu

SEQ ID NO: 2793674 - RNA, 13 nt, Human
ccccuguccucac

SEQ ID NO: 2793675 - RNA, 14 nt, Human
ccccuguccucacu

SEQ ID NO: 2793676 - RNA, 15 nt, Human
ccccuguccucacug

SEQ ID NO: 2793677 - RNA, 16 nt, Human
ccccuguccucacugc

SEQ ID NO: 2793678 - RNA, 23 nt, Human
ccccuggcuuuucacugcuggcu

SEQ ID NO: 2793679 - RNA, 15 nt, Human
ccccugggcucugcc

SEQ ID NO: 2793680 - RNA, 13 nt, Human
ccccugggcucug

SEQ ID NO: 2793681 - RNA, 11 nt, Human
ccccugggcuc

SEQ ID NO: 2793682 - RNA, 22 nt, Human
ccccuggcuuuucacugcuggc

SEQ ID NO: 2793683 - RNA, 14 nt, Human
ccccuggggaccca

SEQ ID NO: 2793684 - RNA, 15 nt, Human
ccccuggggacccac

SEQ ID NO: 2793685 - RNA, 11 nt, Human
ccccuggggcc

SEQ ID NO: 2793686 - RNA, 12 nt, Human
ccccuggggccu

SEQ ID NO: 2793687 - RNA, 15 nt, Human
ccccuggggccuaga

SEQ ID NO: 2793688 - RNA, 23 nt, Human
ccccuggggccuagacucuguaa

SEQ ID NO: 2793689 - RNA, 23 nt, Human
ccccugggcucugccccagcucu

SEQ ID NO: 2793690 - RNA, 21 nt, Human
ccccugggcucugccccagcu

SEQ ID NO: 2793691 - RNA, 14 nt, Human
cccugcaaggccca

SEQ ID NO: 2793692 - RNA, 15 nt, Human
cccugcaaggcccac

SEQ ID NO: 2793693 - RNA, 16 nt, Human
cccugcaaggcccaca

SEQ ID NO: 2793694 - RNA, 17 nt, Human
cccugcaaggcccacag

SEQ ID NO: 2793695 - RNA, 18 nt, Human
cccugcaaggcccacagg

SEQ ID NO: 2793696 - RNA, 21 nt, Human
cccugcaaggcccacaggagg

SEQ ID NO: 2793697 - RNA, 22 nt, Human
cccugcacuugcagacucuaca

SEQ ID NO: 2793698 - RNA, 20 nt, Human
cccugcaauguaucccuucu

SEQ ID NO: 2793699 - RNA, 23 nt, Human
cccugcaauguaucccuucucac

SEQ ID NO: 2793700 - RNA, 13 nt, Human
cccucucaccaaa

SEQ ID NO: 2793701 - RNA, 15 nt, Human
cccucuaggcucugc

SEQ ID NO: 2793702 - RNA, 19 nt, Human
cccucuaggcucugccuuc

SEQ ID NO: 2793703 - RNA, 13 nt, Human
cccucucagcucc

SEQ ID NO: 2793704 - RNA, 20 nt, Human
cccugaguucauccaggccc

SEQ ID NO: 2793705 - RNA, 14 nt, Human
cccucucagcucca

SEQ ID NO: 2793706 - RNA, 17 nt, Human
cccucucagcuccaggu

SEQ ID NO: 2793707 - RNA, 16 nt, Human
cccugauuucuugcuu

SEQ ID NO: 2793708 - RNA, 20 nt, Human
cccugauguguccucaggga

SEQ ID NO: 2793709 - RNA, 15 nt, Human
cccugauccugugaa

SEQ ID NO: 2793710 - RNA, 16 nt, Human
cccugauugaccugcu

SEQ ID NO: 2793711 - RNA, 17 nt, Human
cccugauugaccugcuc

SEQ ID NO: 2793712 - RNA, 18 nt, Human
cccugauugaccugcucc

SEQ ID NO: 2793713 - RNA, 19 nt, Human
cccugauugaccugcuccg

SEQ ID NO: 2793714 - RNA, 21 nt, Human
cccugauugaccugcuccgcu

SEQ ID NO: 2793715 - RNA, 22 nt, Human
cccugauugaccugcuccgcug

SEQ ID NO: 2793716 - RNA, 23 nt, Human
cccugauugaccugcuccgcugc

SEQ ID NO: 2793717 - RNA, 24 nt, Human
cccugauugaccugcuccgcugcu

SEQ ID NO: 2793718 - RNA, 18 nt, Human
cccugccacccuggggag

SEQ ID NO: 2793719 - RNA, 17 nt, Human
cccugccacccugggga

SEQ ID NO: 2793720 - RNA, 14 nt, Human
cccugccaccuccc

SEQ ID NO: 2793721 - RNA, 17 nt, Human
cccugccaccucccuga

SEQ ID NO: 2793722 - RNA, 15 nt, Human
cccugccacccuggg

SEQ ID NO: 2793723 - RNA, 14 nt, Human
cccugccacccugg

SEQ ID NO: 2793724 - RNA, 12 nt, Human
cccugccacccu

SEQ ID NO: 2793725 - RNA, 16 nt, Human
cccugccaaacugaag

SEQ ID NO: 2793726 - RNA, 14 nt, Human
cccugcaugggcca

SEQ ID NO: 2793727 - RNA, 20 nt, Human
cccugcaugggccagccccu

SEQ ID NO: 2793728 - RNA, 22 nt, Human
cccugcaugggccagccccucc

SEQ ID NO: 2793729 - RNA, 22 nt, Human
cccugguggcagugggagcugc

SEQ ID NO: 2793730 - RNA, 19 nt, Human
cccugguggacaguccugg

SEQ ID NO: 2793731 - RNA, 18 nt, Human
cccugguggacaguccug

SEQ ID NO: 2793732 - RNA, 17 nt, Human
cccugguggacaguccu

SEQ ID NO: 2793733 - RNA, 21 nt, Human
cccugguggacaguccuggga

SEQ ID NO: 2793734 - RNA, 20 nt, Human
cccugguggacaguccuggg

SEQ ID NO: 2793735 - RNA, 23 nt, Human
cccugguggacaguccugggaga

SEQ ID NO: 2793736 - RNA, 16 nt, Human
cccuggugcugccaca

SEQ ID NO: 2793737 - RNA, 17 nt, Human
cccuggugcugccacac

SEQ ID NO: 2793738 - RNA, 21 nt, Human
cccuggugcugccacacuuca

SEQ ID NO: 2793739 - RNA, 18 nt, Human
cccuggagccuccacugc

SEQ ID NO: 2793740 - RNA, 19 nt, Human
cccuggaggcacugaagug

SEQ ID NO: 2793741 - RNA, 13 nt, Human
cccuggggcuggc

SEQ ID NO: 2793742 - RNA, 14 nt, Human
cccuggggcuggcu

SEQ ID NO: 2793743 - RNA, 16 nt, Human
cccuggggcuggcuuu

SEQ ID NO: 2793744 - RNA, 18 nt, Human
cccuggggcuggcuuuuc

SEQ ID NO: 2793745 - RNA, 14 nt, Human
cccuggggcugggc

SEQ ID NO: 2793746 - RNA, 16 nt, Human
cccuggggcugggccc

SEQ ID NO: 2793747 - RNA, 22 nt, Human
cccuggggcugggccccccagc

SEQ ID NO: 2793748 - RNA, 12 nt, Human
cccugggccagg

SEQ ID NO: 2793749 - RNA, 13 nt, Human
cccugggccaggg

SEQ ID NO: 2793750 - RNA, 16 nt, Human
cccugggccagggucu

SEQ ID NO: 2793751 - RNA, 17 nt, Human
cccugggccagggucug

SEQ ID NO: 2793752 - RNA, 22 nt, Human
cccugggccagggucuguguga

SEQ ID NO: 2793753 - RNA, 13 nt, Human
cccugcugguuca

SEQ ID NO: 2793754 - RNA, 13 nt, Human
cccugccugccau

SEQ ID NO: 2793755 - RNA, 14 nt, Human
cccugccugccaug

SEQ ID NO: 2793756 - RNA, 20 nt, Human
cccugccugccauguaccuc

SEQ ID NO: 2793757 - RNA, 9 nt, Human
cccugccug

SEQ ID NO: 2793758 - RNA, 20 nt, Human
cccugcugguucaggguugg

SEQ ID NO: 2793759 - RNA, 19 nt, Human
cccugcugguucaggguug

SEQ ID NO: 2793760 - RNA, 22 nt, Human
cccugcuuugggcugcccuggu

SEQ ID NO: 2793761 - RNA, 23 nt, Human
cccugcuuugggcugcccuggug

SEQ ID NO: 2793762 - RNA, 19 nt, Human
cccuggaacauccuuugca

SEQ ID NO: 2793763 - RNA, 20 nt, Human
cccuggaacucuaucugggc

SEQ ID NO: 2793764 - RNA, 22 nt, Human
cccuggaacucuaucugggccu

SEQ ID NO: 2793765 - RNA, 23 nt, Human
cccuggaacucuaucugggccug

SEQ ID NO: 2793766 - RNA, 15 nt, Human
cuaguaguucucuug

SEQ ID NO: 2793767 - RNA, 16 nt, Human
cuaguaguucucuugg

SEQ ID NO: 2793768 - RNA, 12 nt, Human
cuaguauuugaa

SEQ ID NO: 2793769 - RNA, 13 nt, Human
cuaguauuugaau

SEQ ID NO: 2793770 - RNA, 14 nt, Human
cuaguauuugaauu

SEQ ID NO: 2793771 - RNA, 15 nt, Human
cuaguauuugaauua

SEQ ID NO: 2793772 - RNA, 18 nt, Human
cuaguauuugaauuaaaa

SEQ ID NO: 2793773 - RNA, 20 nt, Human
cuaguauuugaauuaaaacu

SEQ ID NO: 2793774 - RNA, 21 nt, Human
cuaguauuugaauuaaaacuu

SEQ ID NO: 2793775 - RNA, 23 nt, Human
cuaguauuugaauuaaaacuucu

SEQ ID NO: 2793776 - RNA, 24 nt, Human
cuaguauuugaauuaaaacuucuu

SEQ ID NO: 2793777 - RNA, 17 nt, Human
cuaggcaucucuguacu

SEQ ID NO: 2793778 - RNA, 16 nt, Human
cuaggcaguaggccgg

SEQ ID NO: 2793779 - RNA, 12 nt, Human
cuaguacugugu

SEQ ID NO: 2793780 - RNA, 15 nt, Human
cuaguacuguguacu

SEQ ID NO: 2793781 - RNA, 17 nt, Human
cuaguacuguguacugu

SEQ ID NO: 2793782 - RNA, 20 nt, Human
cuaguacuguguacuguaua

SEQ ID NO: 2793783 - RNA, 22 nt, Human
cuaguacuguguacuguauaga

SEQ ID NO: 2793784 - RNA, 16 nt, Human
cuaguacuugaaaaag

SEQ ID NO: 2793785 - RNA, 19 nt, Human
cuaggccacaccaucuccu

SEQ ID NO: 2793786 - RNA, 14 nt, Human
cuaguguugcuugg

SEQ ID NO: 2793787 - RNA, 13 nt, Human
cuaguguucuguc

SEQ ID NO: 2793788 - RNA, 15 nt, Human
cuaguguucugucua

SEQ ID NO: 2793789 - RNA, 23 nt, Human
cuaguguucugucuaaaaaccag

SEQ ID NO: 2793790 - RNA, 18 nt, Human
cuaguguucuguuuguua

SEQ ID NO: 2793791 - RNA, 22 nt, Human
cuaguggucuuuguaagagugu

SEQ ID NO: 2793792 - RNA, 19 nt, Human
cuaguggucuuuguaagag

SEQ ID NO: 2793793 - RNA, 20 nt, Human
cuaguggucuuuguaagagu

SEQ ID NO: 2793794 - RNA, 19 nt, Human
cuaguguaccuccucucag

SEQ ID NO: 2793795 - RNA, 21 nt, Human
cuaguguaccuccucucagug

SEQ ID NO: 2793796 - RNA, 23 nt, Human
cuaguguaccuccucucaguguu

SEQ ID NO: 2793797 - RNA, 14 nt, Human
cuaguggucuuugu

SEQ ID NO: 2793798 - RNA, 15 nt, Human
cuaguggucuuugua

SEQ ID NO: 2793799 - RNA, 16 nt, Human
cuaguggucuuuguaa

SEQ ID NO: 2793800 - RNA, 17 nt, Human
cuaguggucuuuguaag

SEQ ID NO: 2793801 - RNA, 18 nt, Human
cuaguggucuuuguaaga

SEQ ID NO: 2793802 - RNA, 21 nt, Human
cuaguauuucaugcugggaau

SEQ ID NO: 2793803 - RNA, 21 nt, Human
cuagucccuuccccucccugg

SEQ ID NO: 2793804 - RNA, 20 nt, Human
cuagucccuuccccucccug

SEQ ID NO: 2793805 - RNA, 23 nt, Human
cuagucccuuccccucccuggcu

SEQ ID NO: 2793806 - RNA, 14 nt, Human
cuaguccggaccca

SEQ ID NO: 2793807 - RNA, 15 nt, Human
cuaguccggacccac

SEQ ID NO: 2793808 - RNA, 21 nt, Human
cuaguccggacccaccucacc

SEQ ID NO: 2793809 - RNA, 23 nt, Human
cuaguccggacccaccucacccc

SEQ ID NO: 2793810 - RNA, 17 nt, Human
cuaguccuagugaaccu

SEQ ID NO: 2793811 - RNA, 15 nt, Human
cuaguccuuuacuaa

SEQ ID NO: 2793812 - RNA, 22 nt, Human
cuagucccuuccccucccuggc

SEQ ID NO: 2793813 - RNA, 12 nt, Human
cuagucucuccu

SEQ ID NO: 2793814 - RNA, 16 nt, Human
cuagucucuccuguaa

SEQ ID NO: 2793815 - RNA, 23 nt, Human
cuagugcccuccacagccgcagc

SEQ ID NO: 2793816 - RNA, 19 nt, Human
cuagugcccuccacagccg

SEQ ID NO: 2793817 - RNA, 18 nt, Human
cuagugcccuccacagcc

SEQ ID NO: 2793818 - RNA, 17 nt, Human
cuaggaaauccagggug

SEQ ID NO: 2793819 - RNA, 16 nt, Human
cuaggaaauccagggu

SEQ ID NO: 2793820 - RNA, 23 nt, Human
cuagcagagcaggggcaggguga

SEQ ID NO: 2793821 - RNA, 19 nt, Human
cuagcagagcaggggcagg

SEQ ID NO: 2793822 - RNA, 13 nt, Human
cuaggagggagac

SEQ ID NO: 2793823 - RNA, 18 nt, Human
cuaggagggagacacugg

SEQ ID NO: 2793824 - RNA, 22 nt, Human
cuaggagggagacacuggcccc

SEQ ID NO: 2793825 - RNA, 18 nt, Human
cuaggaugcggaaauccc

SEQ ID NO: 2793826 - RNA, 23 nt, Human
cuaggagggagacacuggccccu

SEQ ID NO: 2793827 - RNA, 19 nt, Human
cuaggaguauauuuccgca

SEQ ID NO: 2793828 - RNA, 13 nt, Human
cuaggcaggacau

SEQ ID NO: 2793829 - RNA, 22 nt, Human
cuaggcaggacaugcugaagcc

SEQ ID NO: 2793830 - RNA, 20 nt, Human
cuaggcacuguaguucuaag

SEQ ID NO: 2793831 - RNA, 21 nt, Human
cuaggcacuguaguucuaaga

SEQ ID NO: 2793832 - RNA, 13 nt, Human
cuaggauucuaaa

SEQ ID NO: 2793833 - RNA, 19 nt, Human
cuaggcacuguaguucuaa

SEQ ID NO: 2793834 - RNA, 16 nt, Human
cuaggauuugaacacu

SEQ ID NO: 2793835 - RNA, 17 nt, Human
cuaggauuugaacacuu

SEQ ID NO: 2793836 - RNA, 16 nt, Human
cuaggacucugaggcu

SEQ ID NO: 2793837 - RNA, 15 nt, Human
cuaggacucugaggc

SEQ ID NO: 2793838 - RNA, 14 nt, Human
cuaggacucugagg

SEQ ID NO: 2793839 - RNA, 12 nt, Human
cuaggacucuga

SEQ ID NO: 2793840 - RNA, 22 nt, Human
cuaggacgccacccagcaaaag

SEQ ID NO: 2793841 - RNA, 12 nt, Human
cuaggacuccuu

SEQ ID NO: 2793842 - RNA, 13 nt, Human
cuaggagaagagu

SEQ ID NO: 2793843 - RNA, 20 nt, Human
cuaggagaagaguugaggaa

SEQ ID NO: 2793844 - RNA, 18 nt, Human
cuaggacgccacccagca

SEQ ID NO: 2793845 - RNA, 20 nt, Human
cuaggagaccaaggcgggag

SEQ ID NO: 2793846 - RNA, 16 nt, Human
cuaggagaccaaggcg

SEQ ID NO: 2793847 - RNA, 22 nt, Human
cuaggacucugaggcucuuucu

SEQ ID NO: 2793848 - RNA, 22 nt, Human
cuaggaccccuccaugugggcu

SEQ ID NO: 2793849 - RNA, 16 nt, Human
cuaggaccacucagcc

SEQ ID NO: 2793850 - RNA, 17 nt, Human
cuaggaccacucagccc

SEQ ID NO: 2793851 - RNA, 18 nt, Human
cuaggaccacucagcccc

SEQ ID NO: 2793852 - RNA, 19 nt, Human
cuaggaccacucagccccu

SEQ ID NO: 2793853 - RNA, 20 nt, Human
cuaggaccacucagccccua

SEQ ID NO: 2793854 - RNA, 21 nt, Human
cuaggaccacucagccccuag

SEQ ID NO: 2793855 - RNA, 22 nt, Human
cuaggaccacucagccccuagg

SEQ ID NO: 2793856 - RNA, 21 nt, Human
cuaggaccaugguuaagaguc

SEQ ID NO: 2793857 - RNA, 23 nt, Human
cuaggaccaugguuaagagucca

SEQ ID NO: 2793858 - RNA, 17 nt, Human
cuaggaaugaaauccug

SEQ ID NO: 2793859 - RNA, 16 nt, Human
cuaggaaugaaauccu

SEQ ID NO: 2793860 - RNA, 13 nt, Human
cuauaugauuuau

SEQ ID NO: 2793861 - RNA, 16 nt, Human
cuauaugauuuauagu

SEQ ID NO: 2793862 - RNA, 17 nt, Human
cuauaugauuuauaguu

SEQ ID NO: 2793863 - RNA, 18 nt, Human
cuauaugauuuauaguuu

SEQ ID NO: 2793864 - RNA, 15 nt, Human
cuauaugaauuuaaa

SEQ ID NO: 2793865 - RNA, 16 nt, Human
cuauaugaauuuaaau

SEQ ID NO: 2793866 - RNA, 20 nt, Human
cuauaugaauuuaaauauaa

SEQ ID NO: 2793867 - RNA, 23 nt, Human
cuauaugaauuuaaauauaauuc

SEQ ID NO: 2793868 - RNA, 16 nt, Human
cuauaugagaagaaua

SEQ ID NO: 2793869 - RNA, 17 nt, Human
cuauaugagaagaauag

SEQ ID NO: 2793870 - RNA, 18 nt, Human
cuauaugagaagaauagc

SEQ ID NO: 2793871 - RNA, 15 nt, Human
cuauauccugugacu

SEQ ID NO: 2793872 - RNA, 17 nt, Human
cuauauccugugacugu

SEQ ID NO: 2793873 - RNA, 23 nt, Human
cuaguuaccacauuacucugccu

SEQ ID NO: 2793874 - RNA, 14 nt, Human
cuaguaguuaaaaa

SEQ ID NO: 2793875 - RNA, 14 nt, Human
cuauauauauaugc

SEQ ID NO: 2793876 - RNA, 18 nt, Human
cuauauauauaugccuuu

SEQ ID NO: 2793877 - RNA, 15 nt, Human
cuauauauauaaaua

SEQ ID NO: 2793878 - RNA, 16 nt, Human
cuauauauauaaauau

SEQ ID NO: 2793879 - RNA, 13 nt, Human
cuauauauauaaa

SEQ ID NO: 2793880 - RNA, 22 nt, Human
cuauauaguuuauugacaauaa

SEQ ID NO: 2793881 - RNA, 16 nt, Human
cuauauaguuuauuga

SEQ ID NO: 2793882 - RNA, 14 nt, Human
cuauaucaugcuuu

SEQ ID NO: 2793883 - RNA, 20 nt, Human
cuauaucaugcuuuaaagug

SEQ ID NO: 2793884 - RNA, 15 nt, Human
cuauaucauuaaaag

SEQ ID NO: 2793885 - RNA, 21 nt, Human
cuauaucauuaaaagaacaua

SEQ ID NO: 2793886 - RNA, 17 nt, Human
cuauauauguguaugua

SEQ ID NO: 2793887 - RNA, 13 nt, Human
cuauauaugugua

SEQ ID NO: 2793888 - RNA, 15 nt, Human
cuauauauguguaug

SEQ ID NO: 2793889 - RNA, 13 nt, Human
cuaucuuccaaau

SEQ ID NO: 2793890 - RNA, 14 nt, Human
cuaucuuccaaaug

SEQ ID NO: 2793891 - RNA, 21 nt, Human
cuaucuuagugguuccccacc

SEQ ID NO: 2793892 - RNA, 17 nt, Human
cuaugacagaaaaguaa

SEQ ID NO: 2793893 - RNA, 17 nt, Human
cuaucuuguuccaaggc

SEQ ID NO: 2793894 - RNA, 18 nt, Human
cuaugaaaccuuuuuccu

SEQ ID NO: 2793895 - RNA, 15 nt, Human
cuaucaagucaauca

SEQ ID NO: 2793896 - RNA, 17 nt, Human
cuaucaagucaaucauu

SEQ ID NO: 2793897 - RNA, 19 nt, Human
cuaucaagucaaucauuuc

SEQ ID NO: 2793898 - RNA, 21 nt, Human
cuaucaagucaaucauuucuc

SEQ ID NO: 2793899 - RNA, 19 nt, Human
cuaucaagaggcugagaca

SEQ ID NO: 2793900 - RNA, 20 nt, Human
cuaucaagaggcugagacag

SEQ ID NO: 2793901 - RNA, 21 nt, Human
cuaucaagaggcugagacagg

SEQ ID NO: 2793902 - RNA, 23 nt, Human
cuaucaagaggcugagacaggag

SEQ ID NO: 2793903 - RNA, 15 nt, Human
cuaucaagcccaggu

SEQ ID NO: 2793904 - RNA, 16 nt, Human
cucacuaggcuucugg

SEQ ID NO: 2793905 - RNA, 13 nt, Human
cucacuaggcuuc

SEQ ID NO: 2793906 - RNA, 13 nt, Human
cucaccccugucc

SEQ ID NO: 2793907 - RNA, 15 nt, Human
cucaccccuguccuc

SEQ ID NO: 2793908 - RNA, 18 nt, Human
cucaccccuguccucacu

SEQ ID NO: 2793909 - RNA, 19 nt, Human
cucaccccuguccucacug

SEQ ID NO: 2793910 - RNA, 20 nt, Human
cucaccccuguccucacugc

SEQ ID NO: 2793911 - RNA, 21 nt, Human
cucaccccuguccucacugcu

SEQ ID NO: 2793912 - RNA, 22 nt, Human
cucaccccuguccucacugcuc

SEQ ID NO: 2793913 - RNA, 17 nt, Human
cucacuauguugcccag

SEQ ID NO: 2793914 - RNA, 16 nt, Human
cucacuauguugccca

SEQ ID NO: 2793915 - RNA, 20 nt, Human
cucacuaggcuucugguuga

SEQ ID NO: 2793916 - RNA, 21 nt, Human
cucacuaucccggcugcccuu

SEQ ID NO: 2793917 - RNA, 20 nt, Human
cucacuaucccggcugcccu

SEQ ID NO: 2793918 - RNA, 23 nt, Human
cucaccccagacuccugacuguc

SEQ ID NO: 2793919 - RNA, 20 nt, Human
cucaccccguuacagcuccc

SEQ ID NO: 2793920 - RNA, 13 nt, Human
cucaccccggcag

SEQ ID NO: 2793921 - RNA, 15 nt, Human
cucaccccgaggccc

SEQ ID NO: 2793922 - RNA, 16 nt, Human
cucaccccgaggcccu

SEQ ID NO: 2793923 - RNA, 17 nt, Human
cucaccccgaggcccug

SEQ ID NO: 2793924 - RNA, 18 nt, Human
cucaccccgaggcccugc

SEQ ID NO: 2793925 - RNA, 19 nt, Human
cucaccccgaggcccugca

SEQ ID NO: 2793926 - RNA, 20 nt, Human
cucaccccgaggcccugcau

SEQ ID NO: 2793927 - RNA, 21 nt, Human
cucaccccgaggcccugcaug

SEQ ID NO: 2793928 - RNA, 22 nt, Human
cucaccccgaggcccugcaugg

SEQ ID NO: 2793929 - RNA, 19 nt, Human
cucaccagccccagugccc

SEQ ID NO: 2793930 - RNA, 20 nt, Human
cucacauagcuuacaagcca

SEQ ID NO: 2793931 - RNA, 14 nt, Human
cucaaccuccugug

SEQ ID NO: 2793932 - RNA, 21 nt, Human
cucacauggugcuacgccugc

SEQ ID NO: 2793933 - RNA, 21 nt, Human
cucaccagccccagugcccac

SEQ ID NO: 2793934 - RNA, 20 nt, Human
cucaccagccccagugccca

SEQ ID NO: 2793935 - RNA, 23 nt, Human
cucacauggugcuacgccugcau

SEQ ID NO: 2793936 - RNA, 15 nt, Human
cucacauuccuaggg

SEQ ID NO: 2793937 - RNA, 20 nt, Human
cucaagugauucuccugccu

SEQ ID NO: 2793938 - RNA, 19 nt, Human
cucaagugauucuccugcc

SEQ ID NO: 2793939 - RNA, 18 nt, Human
cucaagugauucuccugc

SEQ ID NO: 2793940 - RNA, 12 nt, Human
cucacagugacc

SEQ ID NO: 2793941 - RNA, 14 nt, Human
cucacagugacccu

SEQ ID NO: 2793942 - RNA, 16 nt, Human
cucacagugacccuuc

SEQ ID NO: 2793943 - RNA, 18 nt, Human
cucacagugacccuuccc

SEQ ID NO: 2793944 - RNA, 19 nt, Human
cucacagugacccuuccca

SEQ ID NO: 2793945 - RNA, 21 nt, Human
cucacaguguugcccaggcug

SEQ ID NO: 2793946 - RNA, 17 nt, Human
cucacaguguugcccag

SEQ ID NO: 2793947 - RNA, 13 nt, Human
cucaacuuucugu

SEQ ID NO: 2793948 - RNA, 21 nt, Human
cucaacugcucuuuuauacug

SEQ ID NO: 2793949 - RNA, 17 nt, Human
cucaagagggcacuggu

SEQ ID NO: 2793950 - RNA, 19 nt, Human
cucaagagggcacuggugg

SEQ ID NO: 2793951 - RNA, 21 nt, Human
cucaagagggcacugguggcc

SEQ ID NO: 2793952 - RNA, 17 nt, Human
cucaaggaaaggccuga

SEQ ID NO: 2793953 - RNA, 23 nt, Human
cucaaggaauaaugggcuuagag

SEQ ID NO: 2793954 - RNA, 13 nt, Human
cucaaggaaucuu

SEQ ID NO: 2793955 - RNA, 14 nt, Human
cucaaggaaucuuu

SEQ ID NO: 2793956 - RNA, 21 nt, Human
cucaaggaaucuuuaagcaga

SEQ ID NO: 2793957 - RNA, 17 nt, Human
cucaagcgauucuccug

SEQ ID NO: 2793958 - RNA, 16 nt, Human
cucaagcgauucuccu

SEQ ID NO: 2793959 - RNA, 21 nt, Human
cucaaccucuucuggcucaaa

SEQ ID NO: 2793960 - RNA, 15 nt, Human
cuauuuucuuuuuua

SEQ ID NO: 2793961 - RNA, 17 nt, Human
cucaaauugucagcaau

SEQ ID NO: 2793962 - RNA, 16 nt, Human
cucaaccuuaagaccu

SEQ ID NO: 2793963 - RNA, 16 nt, Human
cucaacguauuguuuc

SEQ ID NO: 2793964 - RNA, 15 nt, Human
cucaacguauuguuu

SEQ ID NO: 2793965 - RNA, 13 nt, Human
cucaaccucuucu

SEQ ID NO: 2793966 - RNA, 14 nt, Human
cucaaccucuucug

SEQ ID NO: 2793967 - RNA, 18 nt, Human
cucaaccucuucuggcuc

SEQ ID NO: 2793968 - RNA, 20 nt, Human
cucaaccucuucuggcucaa

SEQ ID NO: 2793969 - RNA, 12 nt, Human
cucaaccucuuc

SEQ ID NO: 2793970 - RNA, 13 nt, Human
cucaaauguucua

SEQ ID NO: 2793971 - RNA, 15 nt, Human
cucaaauguucuaag

SEQ ID NO: 2793972 - RNA, 24 nt, Human
cucaaauguucuaaguuucuaaga

SEQ ID NO: 2793973 - RNA, 22 nt, Human
cucaaauguucuaaguuucuaa

SEQ ID NO: 2793974 - RNA, 23 nt, Human
cucaaauguucuaaguuucuaag

SEQ ID NO: 2793975 - RNA, 16 nt, Human
cucaaauguucuaagu

SEQ ID NO: 2793976 - RNA, 17 nt, Human
cucaaauguucuaaguu

SEQ ID NO: 2793977 - RNA, 19 nt, Human
cucaaauguucuaaguuuc

SEQ ID NO: 2793978 - RNA, 21 nt, Human
cucaaauguucuaaguuucua

SEQ ID NO: 2793979 - RNA, 19 nt, Human
cuauuugcuuauuuaauaa

SEQ ID NO: 2793980 - RNA, 18 nt, Human
cuauuugcuuauuuaaua

SEQ ID NO: 2793981 - RNA, 22 nt, Human
cuauuugccaugggcuucacug

SEQ ID NO: 2793982 - RNA, 23 nt, Human
cuauuugccaugggcuucacugu

SEQ ID NO: 2793983 - RNA, 13 nt, Human
cuauuuuaaaaua

SEQ ID NO: 2793984 - RNA, 14 nt, Human
cuauuuuaaaauaa

SEQ ID NO: 2793985 - RNA, 20 nt, Human
cuauuuuaaaauaaauuagu

SEQ ID NO: 2793986 - RNA, 22 nt, Human
cuauuuuaaaauaaauuaguug

SEQ ID NO: 2793987 - RNA, 12 nt, Human
cuauuuuauucc

SEQ ID NO: 2793988 - RNA, 23 nt, Human
cuauuuuauucuaaacagacuca

SEQ ID NO: 2793989 - RNA, 15 nt, Human
cuauuuuagaauaaa

SEQ ID NO: 2793990 - RNA, 17 nt, Human
cuauuugucuuucagga

SEQ ID NO: 2793991 - RNA, 22 nt, Human
cuauuuguucuucaagaacuuu

SEQ ID NO: 2793992 - RNA, 16 nt, Human
cuauuuguuuucaugg

SEQ ID NO: 2793993 - RNA, 14 nt, Human
cuauuuucuacaau

SEQ ID NO: 2793994 - RNA, 11 nt, Human
cuauuuucuau

SEQ ID NO: 2793995 - RNA, 16 nt, Human
cuauuuucuauguacu

SEQ ID NO: 2793996 - RNA, 17 nt, Human
cuauuuuggauuguaua

SEQ ID NO: 2793997 - RNA, 12 nt, Human
cuauuuuguaaa

SEQ ID NO: 2793998 - RNA, 19 nt, Human
cuauuuugacaguuauuuu

SEQ ID NO: 2793999 - RNA, 13 nt, Human
cuauuuugaugca

SEQ ID NO: 2794000 - RNA, 14 nt, Human
cuauuuugaugcag

SEQ ID NO: 2794001 - RNA, 15 nt, Human
cuauuuugaugcagc

SEQ ID NO: 2794002 - RNA, 21 nt, Human
cuauuuugaugcagcauuuga

SEQ ID NO: 2794003 - RNA, 22 nt, Human
cucaaaugcucagaccagcucu

SEQ ID NO: 2794004 - RNA, 15 nt, Human
cuaugacugcucccc

SEQ ID NO: 2794005 - RNA, 16 nt, Human
cuaugacugcucccca

SEQ ID NO: 2794006 - RNA, 17 nt, Human
cuaugacugcuccccag

SEQ ID NO: 2794007 - RNA, 19 nt, Human
cuacuucaggaacaccccc

SEQ ID NO: 2794008 - RNA, 13 nt, Human
cuacuugguuugu

SEQ ID NO: 2794009 - RNA, 14 nt, Human
cuacuugguuugug

SEQ ID NO: 2794010 - RNA, 15 nt, Human
cuacuugguuugugu

SEQ ID NO: 2794011 - RNA, 17 nt, Human
cuacuugguuuguguuc

SEQ ID NO: 2794012 - RNA, 22 nt, Human
cuacuucuuuugcucuuagcug

SEQ ID NO: 2794013 - RNA, 22 nt, Human
cuacuucuuugcuuugcccagc

SEQ ID NO: 2794014 - RNA, 17 nt, Human
cuacuugauuuuauugu

SEQ ID NO: 2794015 - RNA, 18 nt, Human
cuacuugauuuuauugua

SEQ ID NO: 2794016 - RNA, 22 nt, Human
cuacuuagcaugucccuaccga

SEQ ID NO: 2794017 - RNA, 20 nt, Human
cuacugugugugugaaugaa

SEQ ID NO: 2794018 - RNA, 11 nt, Human
cuacuguguaa

SEQ ID NO: 2794019 - RNA, 19 nt, Human
cuacugugugugugaauga

SEQ ID NO: 2794020 - RNA, 17 nt, Human
cuacugugugugugaau

SEQ ID NO: 2794021 - RNA, 15 nt, Human
cuacuguguguguga

SEQ ID NO: 2794022 - RNA, 19 nt, Human
cuacuucucucuguauuuu

SEQ ID NO: 2794023 - RNA, 20 nt, Human
cuacuuccugugacuucagc

SEQ ID NO: 2794024 - RNA, 20 nt, Human
cuacuuccuccuccccacuu

SEQ ID NO: 2794025 - RNA, 17 nt, Human
cuacuuccuccucccca

SEQ ID NO: 2794026 - RNA, 19 nt, Human
cuacuuccuccuccccacu

SEQ ID NO: 2794027 - RNA, 20 nt, Human
cuacuuccccuuccuaauuc

SEQ ID NO: 2794028 - RNA, 13 nt, Human
cuacuuccuccuc

SEQ ID NO: 2794029 - RNA, 15 nt, Human
cuacuuccccuuccu

SEQ ID NO: 2794030 - RNA, 14 nt, Human
cuacuuccccuucc

SEQ ID NO: 2794031 - RNA, 20 nt, Human
cuacugucuuuggaaaaaug

SEQ ID NO: 2794032 - RNA, 22 nt, Human
cuacugucuuuggaaaaauguu

SEQ ID NO: 2794033 - RNA, 17 nt, Human
cuacuggucuuguggaa

SEQ ID NO: 2794034 - RNA, 12 nt, Human
cuacucuuugau

SEQ ID NO: 2794035 - RNA, 14 nt, Human
cuacucuuugauuu

SEQ ID NO: 2794036 - RNA, 12 nt, Human
cuacugaaacag

SEQ ID NO: 2794037 - RNA, 13 nt, Human
cuacugaaacaga

SEQ ID NO: 2794038 - RNA, 18 nt, Human
cuacugaaacagauuuca

SEQ ID NO: 2794039 - RNA, 20 nt, Human
cuacugaaacagauuucaua

SEQ ID NO: 2794040 - RNA, 22 nt, Human
cuacugaaacagauuucauacc

SEQ ID NO: 2794041 - RNA, 21 nt, Human
cuacucugugucagguggggc

SEQ ID NO: 2794042 - RNA, 16 nt, Human
cuacucugugucaggu

SEQ ID NO: 2794043 - RNA, 13 nt, Human
cuacucuguguca

SEQ ID NO: 2794044 - RNA, 15 nt, Human
cuacccguuccaaaa

SEQ ID NO: 2794045 - RNA, 15 nt, Human
cuagauuauaucaaa

SEQ ID NO: 2794046 - RNA, 16 nt, Human
cuagauuauaucaaag

SEQ ID NO: 2794047 - RNA, 17 nt, Human
cuagauuauaucaaagu

SEQ ID NO: 2794048 - RNA, 18 nt, Human
cuagauuauaucaaagua

SEQ ID NO: 2794049 - RNA, 21 nt, Human
cuagauuauaucaaaguauuu

SEQ ID NO: 2794050 - RNA, 21 nt, Human
cuagauguuuauucuucuaga

SEQ ID NO: 2794051 - RNA, 23 nt, Human
cuagauguuuauucuucuagagu

SEQ ID NO: 2794052 - RNA, 15 nt, Human
cuagauccuaagggu

SEQ ID NO: 2794053 - RNA, 16 nt, Human
cuagauccuaaggguc

SEQ ID NO: 2794054 - RNA, 22 nt, Human
cuagaucauaaggcuucaaaau

SEQ ID NO: 2794055 - RNA, 14 nt, Human
cuagaucauuuguu

SEQ ID NO: 2794056 - RNA, 21 nt, Human
cuagaucauuuguucugggag

SEQ ID NO: 2794057 - RNA, 23 nt, Human
cuagaucauuuguucugggagua

SEQ ID NO: 2794058 - RNA, 17 nt, Human
cuagaucauaaggcuuc

SEQ ID NO: 2794059 - RNA, 18 nt, Human
cuagaucauaaggcuuca

SEQ ID NO: 2794060 - RNA, 15 nt, Human
cuagaucagaugcuc

SEQ ID NO: 2794061 - RNA, 18 nt, Human
cuagaucagaugcuccaa

SEQ ID NO: 2794062 - RNA, 20 nt, Human
cuagaucagaugcuccaaga

SEQ ID NO: 2794063 - RNA, 15 nt, Human
cuagaucauaaggcu

SEQ ID NO: 2794064 - RNA, 17 nt, Human
cuagaugaaguuuuaca

SEQ ID NO: 2794065 - RNA, 12 nt, Human
cuagaugaccuc

SEQ ID NO: 2794066 - RNA, 13 nt, Human
cuagaugaccuca

SEQ ID NO: 2794067 - RNA, 16 nt, Human
cuagaugaccucauua

SEQ ID NO: 2794068 - RNA, 23 nt, Human
cuagaugagcccagcccuguucu

SEQ ID NO: 2794069 - RNA, 17 nt, Human
cuagauccuaagggucg

SEQ ID NO: 2794070 - RNA, 21 nt, Human
cuagaugcuuuccuaaaucag

SEQ ID NO: 2794071 - RNA, 22 nt, Human
cuagaugauuaaauaagauucu

SEQ ID NO: 2794072 - RNA, 20 nt, Human
cuagaugauuaaauaagauu

SEQ ID NO: 2794073 - RNA, 21 nt, Human
cuagaugauuaaauaagauuc

SEQ ID NO: 2794074 - RNA, 23 nt, Human
cuagaugauuaaauaagauucua

SEQ ID NO: 2794075 - RNA, 18 nt, Human
cuagcaccugccagggag

SEQ ID NO: 2794076 - RNA, 14 nt, Human
cuagcacaugcuuc

SEQ ID NO: 2794077 - RNA, 15 nt, Human
cuagcacaugcuuca

SEQ ID NO: 2794078 - RNA, 16 nt, Human
cuagcacaugcuucaa

SEQ ID NO: 2794079 - RNA, 18 nt, Human
cuagcacaugcuucaaua

SEQ ID NO: 2794080 - RNA, 20 nt, Human
cuagcacaugcuucaauagu

SEQ ID NO: 2794081 - RNA, 18 nt, Human
cuagcacucauuuucuau

SEQ ID NO: 2794082 - RNA, 19 nt, Human
cuagcacucauuuucuaua

SEQ ID NO: 2794083 - RNA, 21 nt, Human
cuagcaaccgccucaaaaugu

SEQ ID NO: 2794084 - RNA, 21 nt, Human
cuagcaagcugccgaaccaaa

SEQ ID NO: 2794085 - RNA, 14 nt, Human
cuagcaagcuggcc

SEQ ID NO: 2794086 - RNA, 15 nt, Human
cuagcaagcuggccu

SEQ ID NO: 2794087 - RNA, 16 nt, Human
cuagcaagcuggccuc

SEQ ID NO: 2794088 - RNA, 17 nt, Human
cuagcaagcuggccucu

SEQ ID NO: 2794089 - RNA, 15 nt, Human
cuagcaagugagaga

SEQ ID NO: 2794090 - RNA, 18 nt, Human
cuagcaagugagagagau

SEQ ID NO: 2794091 - RNA, 17 nt, Human
cuagcacaauuugcacu

SEQ ID NO: 2794092 - RNA, 19 nt, Human
cuagcaagugagagagaug

SEQ ID NO: 2794093 - RNA, 22 nt, Human
cuagauuggaguggggaagugu

SEQ ID NO: 2794094 - RNA, 20 nt, Human
cuagauucuacauauucuuu

SEQ ID NO: 2794095 - RNA, 24 nt, Human
cuagauugagagaagagacaaaca

SEQ ID NO: 2794096 - RNA, 21 nt, Human
cuagauucaaagguucuaggu

SEQ ID NO: 2794097 - RNA, 22 nt, Human
cuagauuccauugguccaagau

SEQ ID NO: 2794098 - RNA, 23 nt, Human
cuagauuccauugguccaagauu

SEQ ID NO: 2794099 - RNA, 22 nt, Human
cuagauguuuauucuucuagag

SEQ ID NO: 2794100 - RNA, 12 nt, Human
cuagauucaaag

SEQ ID NO: 2794101 - RNA, 14 nt, Human
cuagauucaaaggu

SEQ ID NO: 2794102 - RNA, 15 nt, Human
cuagauucaaagguu

SEQ ID NO: 2794103 - RNA, 16 nt, Human
cuagauucaaagguuc

SEQ ID NO: 2794104 - RNA, 17 nt, Human
cuagauucaaagguucu

SEQ ID NO: 2794105 - RNA, 18 nt, Human
cuagauucaaagguucua

SEQ ID NO: 2794106 - RNA, 20 nt, Human
cuagauucaaagguucuagg

SEQ ID NO: 2794107 - RNA, 20 nt, Human
cuagacguucauuugugugc

SEQ ID NO: 2794108 - RNA, 21 nt, Human
cuagacccacuggacucaccu

SEQ ID NO: 2794109 - RNA, 14 nt, Human
cuacuuuccaggcu

SEQ ID NO: 2794110 - RNA, 20 nt, Human
cuacuuugguuucugucugu

SEQ ID NO: 2794111 - RNA, 21 nt, Human
cuacuuugguuucugucugua

SEQ ID NO: 2794112 - RNA, 15 nt, Human
cuagagccugccugg

SEQ ID NO: 2794113 - RNA, 16 nt, Human
cuagagccugccugga

SEQ ID NO: 2794114 - RNA, 17 nt, Human
cuagagccugccuggag

SEQ ID NO: 2794115 - RNA, 18 nt, Human
cuagagccugccuggagc

SEQ ID NO: 2794116 - RNA, 19 nt, Human
cuagagccugccuggagcg

SEQ ID NO: 2794117 - RNA, 17 nt, Human
cuagaccguuauaaagu

SEQ ID NO: 2794118 - RNA, 17 nt, Human
cuagaggccagccccac

SEQ ID NO: 2794119 - RNA, 19 nt, Human
cuagaguccucacucccag

SEQ ID NO: 2794120 - RNA, 15 nt, Human
cuagaguccucacuc

SEQ ID NO: 2794121 - RNA, 20 nt, Human
cuagaguccaagguuuaaag

SEQ ID NO: 2794122 - RNA, 23 nt, Human
cuagaguccaagguuuaaagagu

SEQ ID NO: 2794123 - RNA, 15 nt, Human
cuagaguccaagguu

SEQ ID NO: 2794124 - RNA, 21 nt, Human
cuagagggaccucucccaggg

SEQ ID NO: 2794125 - RNA, 20 nt, Human
cuagagggaccucucccagg

SEQ ID NO: 2794126 - RNA, 19 nt, Human
cuagagggaccucucccag

SEQ ID NO: 2794127 - RNA, 18 nt, Human
cuagagggaccucuccca

SEQ ID NO: 2794128 - RNA, 20 nt, Human
cuagaggccagccccaccca

SEQ ID NO: 2794129 - RNA, 19 nt, Human
cuagaggccagccccaccc

SEQ ID NO: 2794130 - RNA, 18 nt, Human
cuagaggccagccccacc

SEQ ID NO: 2794131 - RNA, 22 nt, Human
cuagaggggggauuuccagcca

SEQ ID NO: 2794132 - RNA, 17 nt, Human
cuagagggaccucuccc

SEQ ID NO: 2794133 - RNA, 19 nt, Human
cuaagauucugauuuuagg

SEQ ID NO: 2794134 - RNA, 15 nt, Human
cuaagcaagcuaacc

SEQ ID NO: 2794135 - RNA, 12 nt, Human
cuaagcaauuuc

SEQ ID NO: 2794136 - RNA, 13 nt, Human
cuaagcaauuucu

SEQ ID NO: 2794137 - RNA, 15 nt, Human
cuaagcaauuucuug

SEQ ID NO: 2794138 - RNA, 13 nt, Human
cuaagcaucuaag

SEQ ID NO: 2794139 - RNA, 21 nt, Human
cuaagcauagcaaacagagga

SEQ ID NO: 2794140 - RNA, 14 nt, Human
cuaagcaucuaagu

SEQ ID NO: 2794141 - RNA, 15 nt, Human
cuaagcaucuaaguu

SEQ ID NO: 2794142 - RNA, 15 nt, Human
cuaagcauugccugg

SEQ ID NO: 2794143 - RNA, 16 nt, Human
cuaagcauugccuggc

SEQ ID NO: 2794144 - RNA, 13 nt, Human
cuaagccagccug

SEQ ID NO: 2794145 - RNA, 14 nt, Human
cuaagccagccugg

SEQ ID NO: 2794146 - RNA, 18 nt, Human
cuaagccagccuggucca

SEQ ID NO: 2794147 - RNA, 14 nt, Human
cuaagauucuagau

SEQ ID NO: 2794148 - RNA, 15 nt, Human
cuaagauucuagauc

SEQ ID NO: 2794149 - RNA, 16 nt, Human
cuaagauucuagauca

SEQ ID NO: 2794150 - RNA, 18 nt, Human
cuaagauucuagaucaga

SEQ ID NO: 2794151 - RNA, 22 nt, Human
cuaagauucuagaucagaugcu

SEQ ID NO: 2794152 - RNA, 11 nt, Human
cuaagauucug

SEQ ID NO: 2794153 - RNA, 12 nt, Human
cuaagauucuga

SEQ ID NO: 2794154 - RNA, 18 nt, Human
cuaagauucugauuuuag

SEQ ID NO: 2794155 - RNA, 16 nt, Human
cuaagauucuaaaggu

SEQ ID NO: 2794156 - RNA, 18 nt, Human
cuaagauucuaaaggucc

SEQ ID NO: 2794157 - RNA, 13 nt, Human
cuaagauucuaau

SEQ ID NO: 2794158 - RNA, 15 nt, Human
cuaagauucuaauga

SEQ ID NO: 2794159 - RNA, 21 nt, Human
cuaagauucuaaugaugauca

SEQ ID NO: 2794160 - RNA, 12 nt, Human
cuaagauucuag

SEQ ID NO: 2794161 - RNA, 13 nt, Human
cuaagauucuaga

SEQ ID NO: 2794162 - RNA, 17 nt, Human
cuaaccacgcuggaccu

SEQ ID NO: 2794163 - RNA, 21 nt, Human
cuaaccacgucugucuucaca

SEQ ID NO: 2794164 - RNA, 20 nt, Human
cuaaccacgucugucuucac

SEQ ID NO: 2794165 - RNA, 22 nt, Human
cuaagcuaggaaugaaauccug

SEQ ID NO: 2794166 - RNA, 17 nt, Human
cuaagcuaggaaugaaa

SEQ ID NO: 2794167 - RNA, 22 nt, Human
cuaagcgcacauucaugugggc

SEQ ID NO: 2794168 - RNA, 15 nt, Human
cuaagcuaacccccu

SEQ ID NO: 2794169 - RNA, 14 nt, Human
cuaagcuaggaaug

SEQ ID NO: 2794170 - RNA, 11 nt, Human
cuaagccugug

SEQ ID NO: 2794171 - RNA, 13 nt, Human
cuaagccuguggc

SEQ ID NO: 2794172 - RNA, 14 nt, Human
cuaagccuguggcu

SEQ ID NO: 2794173 - RNA, 15 nt, Human
cuaagccuguggcug

SEQ ID NO: 2794174 - RNA, 16 nt, Human
cuaagccuaccugcuc

SEQ ID NO: 2794175 - RNA, 17 nt, Human
cuaagccuaccugcucu

SEQ ID NO: 2794176 - RNA, 20 nt, Human
cuaagccuaccugcucucca

SEQ ID NO: 2794177 - RNA, 23 nt, Human
cuaagccuaccugcucuccaagu

SEQ ID NO: 2794178 - RNA, 16 nt, Human
cuaagcccaugggaca

SEQ ID NO: 2794179 - RNA, 14 nt, Human
cuaagccuaccugc

SEQ ID NO: 2794180 - RNA, 17 nt, Human
cuaaggaggggaaaaaa

SEQ ID NO: 2794181 - RNA, 20 nt, Human
cuaaggaggggaaaaaaaug

SEQ ID NO: 2794182 - RNA, 21 nt, Human
cuaaggaggggaaaaaaaugu

SEQ ID NO: 2794183 - RNA, 22 nt, Human
cuaaggaggggaaaaaaauguu

SEQ ID NO: 2794184 - RNA, 23 nt, Human
cuaaggaggggaaaaaaauguug

SEQ ID NO: 2794185 - RNA, 20 nt, Human
cuaaggauagcaccgcuuuu

SEQ ID NO: 2794186 - RNA, 20 nt, Human
cuaaggcaugugugaaacau

SEQ ID NO: 2794187 - RNA, 20 nt, Human
cuaaggcucugagagucuag

SEQ ID NO: 2794188 - RNA, 21 nt, Human
cuaaggcucugagagucuaga

SEQ ID NO: 2794189 - RNA, 20 nt, Human
cuaaggaugucacagggcca

SEQ ID NO: 2794190 - RNA, 18 nt, Human
cuaaggaugucacagggc

SEQ ID NO: 2794191 - RNA, 19 nt, Human
cuaaggaugucacagggcc

SEQ ID NO: 2794192 - RNA, 14 nt, Human
cuaaggcugaacuu

SEQ ID NO: 2794193 - RNA, 22 nt, Human
cuaaggcucugagagucuagau

SEQ ID NO: 2794194 - RNA, 23 nt, Human
cuaaggcucugagagucuagauu

SEQ ID NO: 2794195 - RNA, 15 nt, Human
cuaaggcuguuugcu

SEQ ID NO: 2794196 - RNA, 17 nt, Human
cuaaggcuguuugcuuc

SEQ ID NO: 2794197 - RNA, 15 nt, Human
cuaagggaagacauu

SEQ ID NO: 2794198 - RNA, 16 nt, Human
cuaagggaagacauuu

SEQ ID NO: 2794199 - RNA, 17 nt, Human
cuaagggaagacauuuc

SEQ ID NO: 2794200 - RNA, 18 nt, Human
cuaagggaagacauuucu

SEQ ID NO: 2794201 - RNA, 19 nt, Human
cuaagggaagacauuucuu

SEQ ID NO: 2794202 - RNA, 15 nt, Human
cuaaggugugcucug

SEQ ID NO: 2794203 - RNA, 22 nt, Human
cuaagggucgaaagcucuagaa

SEQ ID NO: 2794204 - RNA, 19 nt, Human
cuaagguccgguguucuaa

SEQ ID NO: 2794205 - RNA, 20 nt, Human
cuaagguccgguguucuaag

SEQ ID NO: 2794206 - RNA, 21 nt, Human
cuaagguccgguguucuaaga

SEQ ID NO: 2794207 - RNA, 22 nt, Human
cuaagguccgguguucuaagau

SEQ ID NO: 2794208 - RNA, 11 nt, Human
cuaagggggag

SEQ ID NO: 2794209 - RNA, 18 nt, Human
cuaagggggaggggaagu

SEQ ID NO: 2794210 - RNA, 19 nt, Human
cuaagggggaggggaaguc

SEQ ID NO: 2794211 - RNA, 17 nt, Human
cuaagggucgaaagcuc

SEQ ID NO: 2794212 - RNA, 18 nt, Human
cuaagggucgaaagcucu

SEQ ID NO: 2794213 - RNA, 19 nt, Human
cuaagggucgaaagcucua

SEQ ID NO: 2794214 - RNA, 21 nt, Human
cuaagggucgaaagcucuaga

SEQ ID NO: 2794215 - RNA, 23 nt, Human
cuaagggucgaaagcucuagaau

SEQ ID NO: 2794216 - RNA, 14 nt, Human
cuaagggugggugc

SEQ ID NO: 2794217 - RNA, 18 nt, Human
cuaagggugggugcucag

SEQ ID NO: 2794218 - RNA, 19 nt, Human
cuaagggugggugcucaga

SEQ ID NO: 2794219 - RNA, 20 nt, Human
cuaagggugggugcucagaa

SEQ ID NO: 2794220 - RNA, 21 nt, Human
cuaagggugggugcucagaau

SEQ ID NO: 2794221 - RNA, 22 nt, Human
cuaagggugggugcucagaaua

SEQ ID NO: 2794222 - RNA, 16 nt, Human
cuacacuccagccuga

SEQ ID NO: 2794223 - RNA, 18 nt, Human
cuacacuccagccugagc

SEQ ID NO: 2794224 - RNA, 17 nt, Human
cuacacuccagccugag

SEQ ID NO: 2794225 - RNA, 21 nt, Human
cuacaauuaauaguuugucua

SEQ ID NO: 2794226 - RNA, 22 nt, Human
cuacaauuaauaguuugucuau

SEQ ID NO: 2794227 - RNA, 15 nt, Human
cuacagaggccaugg

SEQ ID NO: 2794228 - RNA, 21 nt, Human
cuacagagccgagcaauauuu

SEQ ID NO: 2794229 - RNA, 23 nt, Human
cuacagagccgagcaauauuuau

SEQ ID NO: 2794230 - RNA, 12 nt, Human
cuacagagcugu

SEQ ID NO: 2794231 - RNA, 13 nt, Human
cuacagagcugug

SEQ ID NO: 2794232 - RNA, 14 nt, Human
cuacagagcugugg

SEQ ID NO: 2794233 - RNA, 15 nt, Human
cuacagaccugcuuu

SEQ ID NO: 2794234 - RNA, 22 nt, Human
cuacagaccugcuuuuugaaau

SEQ ID NO: 2794235 - RNA, 23 nt, Human
cuacagaccugcuuuuugaaaug

SEQ ID NO: 2794236 - RNA, 18 nt, Human
cuaccagugcaggcuggc

SEQ ID NO: 2794237 - RNA, 19 nt, Human
cuaccagugcaggcuggcc

SEQ ID NO: 2794238 - RNA, 20 nt, Human
cuaccagugcaggcuggcca

SEQ ID NO: 2794239 - RNA, 21 nt, Human
cuaccagugcaggcuggccag

SEQ ID NO: 2794240 - RNA, 22 nt, Human
cuaccagugcaggcuggccagc

SEQ ID NO: 2794241 - RNA, 23 nt, Human
cuaccagugcaggcuggccagcc

SEQ ID NO: 2794242 - RNA, 21 nt, Human
cuaccagcguauauauaagaa

SEQ ID NO: 2794243 - RNA, 12 nt, Human
cuaccacuccug

SEQ ID NO: 2794244 - RNA, 14 nt, Human
cuaccacuccugcc

SEQ ID NO: 2794245 - RNA, 21 nt, Human
cuacagaggaaacaauauuua

SEQ ID NO: 2794246 - RNA, 18 nt, Human
cuaccagauaacugagga

SEQ ID NO: 2794247 - RNA, 17 nt, Human
cuaccacuccugccaag

SEQ ID NO: 2794248 - RNA, 22 nt, Human
cuacccacccuccuuucaccac

SEQ ID NO: 2794249 - RNA, 14 nt, Human
cuacccacuucuaa

SEQ ID NO: 2794250 - RNA, 15 nt, Human
cuacccacuauccuu

SEQ ID NO: 2794251 - RNA, 19 nt, Human
cuacccacuauccuucgug

SEQ ID NO: 2794252 - RNA, 20 nt, Human
cuacccacuauccuucguga

SEQ ID NO: 2794253 - RNA, 14 nt, Human
cuaccaucagggac

SEQ ID NO: 2794254 - RNA, 15 nt, Human
cuaccaucagggaca

SEQ ID NO: 2794255 - RNA, 16 nt, Human
cuaccaucagggacag

SEQ ID NO: 2794256 - RNA, 18 nt, Human
cuaccaucagggacagga

SEQ ID NO: 2794257 - RNA, 13 nt, Human
cuacccacccucc

SEQ ID NO: 2794258 - RNA, 17 nt, Human
cuacccacccuccuuuc

SEQ ID NO: 2794259 - RNA, 19 nt, Human
cuacccagcgagcccuggu

SEQ ID NO: 2794260 - RNA, 20 nt, Human
cuacccagcgagcccuggug

SEQ ID NO: 2794261 - RNA, 11 nt, Human
cuacccagggc

SEQ ID NO: 2794262 - RNA, 22 nt, Human
cuacccacuucuaaauagcaau

SEQ ID NO: 2794263 - RNA, 16 nt, Human
cuacccacuucuaaau

SEQ ID NO: 2794264 - RNA, 19 nt, Human
cuacccagggccugcagga

SEQ ID NO: 2794265 - RNA, 16 nt, Human
cuacccagggccugca

SEQ ID NO: 2794266 - RNA, 15 nt, Human
cuacccagggccugc

SEQ ID NO: 2794267 - RNA, 14 nt, Human
cuacccagggccug

SEQ ID NO: 2794268 - RNA, 17 nt, Human
cuacccgcaucuucugu

SEQ ID NO: 2794269 - RNA, 12 nt, Human
cuaccccuggcu

SEQ ID NO: 2794270 - RNA, 13 nt, Human
cuaccccuggcug

SEQ ID NO: 2794271 - RNA, 14 nt, Human
cuaccccuggcugu

SEQ ID NO: 2794272 - RNA, 19 nt, Human
cuaccccuggcuguacugc

SEQ ID NO: 2794273 - RNA, 19 nt, Human
cuaauguaauaacugugaa

SEQ ID NO: 2794274 - RNA, 13 nt, Human
cuaaugagacuga

SEQ ID NO: 2794275 - RNA, 17 nt, Human
cuaaugaggagagaaaa

SEQ ID NO: 2794276 - RNA, 18 nt, Human
cuaaugaggagagaaaau

SEQ ID NO: 2794277 - RNA, 19 nt, Human
cuaaugaggagagaaaaua

SEQ ID NO: 2794278 - RNA, 20 nt, Human
cuaaugaggagagaaaauau

SEQ ID NO: 2794279 - RNA, 21 nt, Human
cuaaugaggagagaaaauaua

SEQ ID NO: 2794280 - RNA, 23 nt, Human
cuaaugaggagagaaaauauaug

SEQ ID NO: 2794281 - RNA, 23 nt, Human
cuaaugacaugccuauaugagaa

SEQ ID NO: 2794282 - RNA, 19 nt, Human
cuaaugaaugcauaaaaug

SEQ ID NO: 2794283 - RNA, 22 nt, Human
cuaaugaaugcauaaaauguua

SEQ ID NO: 2794284 - RNA, 13 nt, Human
cuaaugaaaguga

SEQ ID NO: 2794285 - RNA, 18 nt, Human
cuaaugaaagugaugaca

SEQ ID NO: 2794286 - RNA, 20 nt, Human
cuaaugaaagugaugacaua

SEQ ID NO: 2794287 - RNA, 15 nt, Human
cuacaauacaucuga

SEQ ID NO: 2794288 - RNA, 12 nt, Human
cuacaaggccua

SEQ ID NO: 2794289 - RNA, 22 nt, Human
cuacaagagcagccuguggcau

SEQ ID NO: 2794290 - RNA, 21 nt, Human
cuacaagagcagccuguggca

SEQ ID NO: 2794291 - RNA, 23 nt, Human
cuacaagagcagccuguggcauc

SEQ ID NO: 2794292 - RNA, 15 nt, Human
cuacaagauuuagaa

SEQ ID NO: 2794293 - RNA, 20 nt, Human
cuacaagagcagccuguggc

SEQ ID NO: 2794294 - RNA, 19 nt, Human
cuacaagagcagccugugg

SEQ ID NO: 2794295 - RNA, 18 nt, Human
cuacaagagcagccugug

SEQ ID NO: 2794296 - RNA, 17 nt, Human
cuacaagagcagccugu

SEQ ID NO: 2794297 - RNA, 15 nt, Human
cuacaagagcagccu

SEQ ID NO: 2794298 - RNA, 15 nt, Human
cuacaagacacagug

SEQ ID NO: 2794299 - RNA, 15 nt, Human
cuaauuaaaaaguua

SEQ ID NO: 2794300 - RNA, 16 nt, Human
cuaauuaaaaaguuaa

SEQ ID NO: 2794301 - RNA, 20 nt, Human
cuaauuaaaacacuuucaaa

SEQ ID NO: 2794302 - RNA, 13 nt, Human
cuaaugucuucau

SEQ ID NO: 2794303 - RNA, 15 nt, Human
cuaaugucuucauaa

SEQ ID NO: 2794304 - RNA, 16 nt, Human
cuaaugucuucauaaa

SEQ ID NO: 2794305 - RNA, 17 nt, Human
cuaaugucuucauaaag

SEQ ID NO: 2794306 - RNA, 19 nt, Human
cuaaugucuucauuucauu

SEQ ID NO: 2794307 - RNA, 21 nt, Human
cuaaugucuucauuucauugu

SEQ ID NO: 2794308 - RNA, 22 nt, Human
cuaaugucuucauuucauugua

SEQ ID NO: 2794309 - RNA, 16 nt, Human
cuaaggugugcucuga

SEQ ID NO: 2794310 - RNA, 15 nt, Human
cuaaggugcuaaauc

SEQ ID NO: 2794311 - RNA, 13 nt, Human
cuaaucaaagcca

SEQ ID NO: 2794312 - RNA, 16 nt, Human
cuaaucaaagccaggg

SEQ ID NO: 2794313 - RNA, 19 nt, Human
cuaaucaaagccagggucu

SEQ ID NO: 2794314 - RNA, 20 nt, Human
cuaaucaaagccagggucuc

SEQ ID NO: 2794315 - RNA, 13 nt, Human
cuaauauuaaaaa

SEQ ID NO: 2794316 - RNA, 14 nt, Human
cuaauauuaaaaau

SEQ ID NO: 2794317 - RNA, 16 nt, Human
cuaauauuaaaaauau

SEQ ID NO: 2794318 - RNA, 18 nt, Human
cuaauauuaaaaauaugg

SEQ ID NO: 2794319 - RNA, 13 nt, Human
cuaauauuaaaag

SEQ ID NO: 2794320 - RNA, 16 nt, Human
cuaauauuaaaaguca

SEQ ID NO: 2794321 - RNA, 11 nt, Human
cuaagguucua

SEQ ID NO: 2794322 - RNA, 12 nt, Human
cuaagguucuaa

SEQ ID NO: 2794323 - RNA, 16 nt, Human
cuaauccucuuuuucu

SEQ ID NO: 2794324 - RNA, 15 nt, Human
cuaaucucauaccuc

SEQ ID NO: 2794325 - RNA, 18 nt, Human
cuaaucucauaccucuga

SEQ ID NO: 2794326 - RNA, 20 nt, Human
cuaaucucauaccucugacc

SEQ ID NO: 2794327 - RNA, 21 nt, Human
cuaaucucauaccucugacca

SEQ ID NO: 2794328 - RNA, 22 nt, Human
cuaaucucauaccucugaccaa

SEQ ID NO: 2794329 - RNA, 17 nt, Human
cuaaucagaaauuuuua

SEQ ID NO: 2794330 - RNA, 22 nt, Human
cuaaucagaaauuuuuaucagu

SEQ ID NO: 2794331 - RNA, 23 nt, Human
cuaaucagaaauuuuuaucaguu

SEQ ID NO: 2794332 - RNA, 17 nt, Human
cuaaucagcauucucac

SEQ ID NO: 2794333 - RNA, 19 nt, Human
cuaaucagcauucucacuc

SEQ ID NO: 2794334 - RNA, 22 nt, Human
cuaaauguucuaugguuaugaa

SEQ ID NO: 2794335 - RNA, 14 nt, Human
cuaaauuuaaauuu

SEQ ID NO: 2794336 - RNA, 15 nt, Human
cuaaauuuaaauuua

SEQ ID NO: 2794337 - RNA, 17 nt, Human
cuaaauuuaaauuuaaa

SEQ ID NO: 2794338 - RNA, 19 nt, Human
cuaaauuuaaauuuaaaga

SEQ ID NO: 2794339 - RNA, 13 nt, Human
cuaaauuuaaugc

SEQ ID NO: 2794340 - RNA, 15 nt, Human
cuaaauuuaaugcug

SEQ ID NO: 2794341 - RNA, 16 nt, Human
cuaaauuuaaugcugc

SEQ ID NO: 2794342 - RNA, 17 nt, Human
cuaaauuuaaugcugcc

SEQ ID NO: 2794343 - RNA, 18 nt, Human
cuaaauuuaaugcugccu

SEQ ID NO: 2794344 - RNA, 19 nt, Human
cuaaauggucgcccaggag

SEQ ID NO: 2794345 - RNA, 18 nt, Human
cuaaauggucgcccagga

SEQ ID NO: 2794346 - RNA, 21 nt, Human
cuaaauggucgcccaggagac

SEQ ID NO: 2794347 - RNA, 20 nt, Human
cuaaauggucgcccaggaga

SEQ ID NO: 2794348 - RNA, 15 nt, Human
cuaaaugcugaaaaa

SEQ ID NO: 2794349 - RNA, 20 nt, Human
cuaacacuggcauguucaaa

SEQ ID NO: 2794350 - RNA, 23 nt, Human
cuaaauuugaauguuaagcagau

SEQ ID NO: 2794351 - RNA, 14 nt, Human
cuaaauuugauacu

SEQ ID NO: 2794352 - RNA, 15 nt, Human
cuaaauuugauacuu

SEQ ID NO: 2794353 - RNA, 16 nt, Human
cuaaauuugauacuua

SEQ ID NO: 2794354 - RNA, 17 nt, Human
cuaaauuugauacuuau

SEQ ID NO: 2794355 - RNA, 18 nt, Human
cuaaauuugauacuuaua

SEQ ID NO: 2794356 - RNA, 19 nt, Human
cuaaauuugauacuuauau

SEQ ID NO: 2794357 - RNA, 20 nt, Human
cuaaauuugauacuuauauu

SEQ ID NO: 2794358 - RNA, 21 nt, Human
cuaaauuugauacuuauauuu

SEQ ID NO: 2794359 - RNA, 23 nt, Human
cuaaauuugauacuuauauuuuc

SEQ ID NO: 2794360 - RNA, 13 nt, Human
cuaaauuugggga

SEQ ID NO: 2794361 - RNA, 18 nt, Human
cuaaauuuggggacagau

SEQ ID NO: 2794362 - RNA, 15 nt, Human
cuaacacacagcucc

SEQ ID NO: 2794363 - RNA, 13 nt, Human
cuaacacaaggac

SEQ ID NO: 2794364 - RNA, 17 nt, Human
cuaacacacacagaaaa

SEQ ID NO: 2794365 - RNA, 15 nt, Human
cuaacaccagacaga

SEQ ID NO: 2794366 - RNA, 16 nt, Human
cuaacacacagcuccc

SEQ ID NO: 2794367 - RNA, 23 nt, Human
cuaacacggugcucauuuuuucu

SEQ ID NO: 2794368 - RNA, 18 nt, Human
cuaacacgugaugugaua

SEQ ID NO: 2794369 - RNA, 14 nt, Human
cuaaaucagagaca

SEQ ID NO: 2794370 - RNA, 15 nt, Human
cuaaaucagagacaa

SEQ ID NO: 2794371 - RNA, 23 nt, Human
cuaaauauucagaaucuuuguua

SEQ ID NO: 2794372 - RNA, 21 nt, Human
cuaaauaugaacccuuuguuu

SEQ ID NO: 2794373 - RNA, 23 nt, Human
cuaaauaugaacccuuuguuucu

SEQ ID NO: 2794374 - RNA, 17 nt, Human
cuaaacggauuccaaag

SEQ ID NO: 2794375 - RNA, 15 nt, Human
cuaaacgguucaguu

SEQ ID NO: 2794376 - RNA, 20 nt, Human
cuaaacgguucaguuucuuc

SEQ ID NO: 2794377 - RNA, 18 nt, Human
cuaaacguaagcacuguu

SEQ ID NO: 2794378 - RNA, 19 nt, Human
cuaaacguaagcacuguuu

SEQ ID NO: 2794379 - RNA, 16 nt, Human
cuaaacggauuccaaa

SEQ ID NO: 2794380 - RNA, 15 nt, Human
cuaaacggauuccaa

SEQ ID NO: 2794381 - RNA, 16 nt, Human
cuaaaucuauuuauua

SEQ ID NO: 2794382 - RNA, 19 nt, Human
cuaaaucuauuuauuaaua

SEQ ID NO: 2794383 - RNA, 12 nt, Human
cuaaaucuauuu

SEQ ID NO: 2794384 - RNA, 19 nt, Human
cuaaaucagagacaaaaua

SEQ ID NO: 2794385 - RNA, 14 nt, Human
cuaaaucuauuuau

SEQ ID NO: 2794386 - RNA, 21 nt, Human
cuaaaucuauuuauuaauauu

SEQ ID NO: 2794387 - RNA, 17 nt, Human
cuaaaugccuaauaaac

SEQ ID NO: 2794388 - RNA, 18 nt, Human
cuaaaugccuaauaaaca

SEQ ID NO: 2794389 - RNA, 19 nt, Human
cuaaaugccuaauaaacaa

SEQ ID NO: 2794390 - RNA, 17 nt, Human
cuaaaugccuaguuuuu

SEQ ID NO: 2794391 - RNA, 20 nt, Human
cuaaaugccuaguuuuuagu

SEQ ID NO: 2794392 - RNA, 21 nt, Human
cuaaaugccuaguuuuuagua

SEQ ID NO: 2794393 - RNA, 19 nt, Human
cuaaaugccuuagaaaugu

SEQ ID NO: 2794394 - RNA, 19 nt, Human
cuaaacaaugcugauuugg

SEQ ID NO: 2794395 - RNA, 16 nt, Human
cuaaacacugcgcuuu

SEQ ID NO: 2794396 - RNA, 18 nt, Human
cuaaacacugcgcuuuau

SEQ ID NO: 2794397 - RNA, 19 nt, Human
cuaaacacugcgcuuuauu

SEQ ID NO: 2794398 - RNA, 14 nt, Human
cuaaacagacucau

SEQ ID NO: 2794399 - RNA, 17 nt, Human
cuaaacauaugauuuca

SEQ ID NO: 2794400 - RNA, 16 nt, Human
cuaaacccaauccaaa

SEQ ID NO: 2794401 - RNA, 19 nt, Human
cuaaacccaauccaaaugg

SEQ ID NO: 2794402 - RNA, 15 nt, Human
cuaaaccccuguccc

SEQ ID NO: 2794403 - RNA, 16 nt, Human
cuaaaccccuguccca

SEQ ID NO: 2794404 - RNA, 15 nt, Human
cuaaacccaauccaa

SEQ ID NO: 2794405 - RNA, 21 nt, Human
cuaaaauuuguggguuuuuuu

SEQ ID NO: 2794406 - RNA, 23 nt, Human
cguggcugugcucucaccagcug

SEQ ID NO: 2794407 - RNA, 21 nt, Human
cuaaaauuguuuuuuguugua

SEQ ID NO: 2794408 - RNA, 20 nt, Human
cuaaaagaauauucagagaa

SEQ ID NO: 2794409 - RNA, 13 nt, Human
cuaaaagacaggc

SEQ ID NO: 2794410 - RNA, 14 nt, Human
cuaaaagacauuug

SEQ ID NO: 2794411 - RNA, 17 nt, Human
cuaaaagacauuuguua

SEQ ID NO: 2794412 - RNA, 22 nt, Human
cuaaaagacuucccuaacacuu

SEQ ID NO: 2794413 - RNA, 18 nt, Human
cuaaaacuggccugacuu

SEQ ID NO: 2794414 - RNA, 14 nt, Human
cguugguccagagc

SEQ ID NO: 2794415 - RNA, 15 nt, Human
cguugguccagagcg

SEQ ID NO: 2794416 - RNA, 13 nt, Human
cguuggucucugc

SEQ ID NO: 2794417 - RNA, 23 nt, Human
cguuggucucugcauuuuucugc

SEQ ID NO: 2794418 - RNA, 23 nt, Human
cguugggagggggagaaaaggaa

SEQ ID NO: 2794419 - RNA, 14 nt, Human
cguugcuuucacuc

SEQ ID NO: 2794420 - RNA, 20 nt, Human
cguuguugcauguuugaaau

SEQ ID NO: 2794421 - RNA, 18 nt, Human
cguuguuuacuuaaagau

SEQ ID NO: 2794422 - RNA, 20 nt, Human
cguuguuuacuuaaagauuu

SEQ ID NO: 2794423 - RNA, 17 nt, Human
cguugucuguggauggu

SEQ ID NO: 2794424 - RNA, 13 nt, Human
cuaaaaauccaga

SEQ ID NO: 2794425 - RNA, 17 nt, Human
cguuuacuaugccugug

SEQ ID NO: 2794426 - RNA, 15 nt, Human
cguuuaccuagaaga

SEQ ID NO: 2794427 - RNA, 17 nt, Human
cguuuaccuagaagaag

SEQ ID NO: 2794428 - RNA, 23 nt, Human
cguuuacaagcccccccuuccac

SEQ ID NO: 2794429 - RNA, 14 nt, Human
cguuuacuaugccu

SEQ ID NO: 2794430 - RNA, 11 nt, Human
cuaaaaccauu

SEQ ID NO: 2794431 - RNA, 17 nt, Human
cuaaaaccauuccauuu

SEQ ID NO: 2794432 - RNA, 13 nt, Human
cuaaaaaugcaac

SEQ ID NO: 2794433 - RNA, 20 nt, Human
cuaaaacaaaagcucaucca

SEQ ID NO: 2794434 - RNA, 20 nt, Human
cgugggcucccguguuuugu

SEQ ID NO: 2794435 - RNA, 18 nt, Human
cguugaagaggaagggca

SEQ ID NO: 2794436 - RNA, 17 nt, Human
cguugauguuggcuggg

SEQ ID NO: 2794437 - RNA, 18 nt, Human
cguugauguuggcuggga

SEQ ID NO: 2794438 - RNA, 20 nt, Human
cguggcuucccgcucagccc

SEQ ID NO: 2794439 - RNA, 21 nt, Human
cguggcuucccgcucagcccu

SEQ ID NO: 2794440 - RNA, 22 nt, Human
cgugggagacaagaaaucccug

SEQ ID NO: 2794441 - RNA, 16 nt, Human
cgugggauucagagaa

SEQ ID NO: 2794442 - RNA, 23 nt, Human
cgugggauucagagaaaggcaag

SEQ ID NO: 2794443 - RNA, 12 nt, Human
cgugggcucccg

SEQ ID NO: 2794444 - RNA, 22 nt, Human
cguggaggagcagugcaggcac

SEQ ID NO: 2794445 - RNA, 13 nt, Human
cguggcaaauaua

SEQ ID NO: 2794446 - RNA, 14 nt, Human
cguggcaaauauaa

SEQ ID NO: 2794447 - RNA, 15 nt, Human
cguggcaaauauaaa

SEQ ID NO: 2794448 - RNA, 17 nt, Human
cguggcaaauauaaaac

SEQ ID NO: 2794449 - RNA, 18 nt, Human
cguggcaaauauaaaacu

SEQ ID NO: 2794450 - RNA, 13 nt, Human
cguggauuaaacu

SEQ ID NO: 2794451 - RNA, 19 nt, Human
cguggauuaaacuuaugaa

SEQ ID NO: 2794452 - RNA, 20 nt, Human
cguggauuaaacuuaugaau

SEQ ID NO: 2794453 - RNA, 17 nt, Human
cguggauucgcuugagu

SEQ ID NO: 2794454 - RNA, 20 nt, Human
cguggcagauaaucagccuc

SEQ ID NO: 2794455 - RNA, 22 nt, Human
cguggcagauaaucagccucuu

SEQ ID NO: 2794456 - RNA, 21 nt, Human
cguggcagauaaucagccucu

SEQ ID NO: 2794457 - RNA, 16 nt, Human
cguggccaucccugug

SEQ ID NO: 2794458 - RNA, 17 nt, Human
cguggccaucccuguga

SEQ ID NO: 2794459 - RNA, 19 nt, Human
cguggccaucccugugagg

SEQ ID NO: 2794460 - RNA, 18 nt, Human
cguggcuucccgcucagc

SEQ ID NO: 2794461 - RNA, 19 nt, Human
cguggcuucccgcucagcc

SEQ ID NO: 2794462 - RNA, 21 nt, Human
cgugccagucaagaagaaaaa

SEQ ID NO: 2794463 - RNA, 19 nt, Human
cgugcgcugggcacuuccc

SEQ ID NO: 2794464 - RNA, 23 nt, Human
cgugcgcugggcacuucccugcu

SEQ ID NO: 2794465 - RNA, 20 nt, Human
cguggagagcuggugcccgg

SEQ ID NO: 2794466 - RNA, 17 nt, Human
cguggagagcuggugcc

SEQ ID NO: 2794467 - RNA, 16 nt, Human
cguggaggagcagugc

SEQ ID NO: 2794468 - RNA, 14 nt, Human
cguggagcugccug

SEQ ID NO: 2794469 - RNA, 15 nt, Human
cguggagcugccuga

SEQ ID NO: 2794470 - RNA, 22 nt, Human
cguggagcaggcgguggggaga

SEQ ID NO: 2794471 - RNA, 20 nt, Human
cguggagcgggguaugaaga

SEQ ID NO: 2794472 - RNA, 21 nt, Human
cguggagcgggguaugaagag

SEQ ID NO: 2794473 - RNA, 22 nt, Human
cguggagcgggguaugaagagc

SEQ ID NO: 2794474 - RNA, 16 nt, Human
cguggaaccucugucu

SEQ ID NO: 2794475 - RNA, 17 nt, Human
cguggaaccucugucuc

SEQ ID NO: 2794476 - RNA, 18 nt, Human
cguggaaccucugucuca

SEQ ID NO: 2794477 - RNA, 19 nt, Human
cguggaaccucugucucau

SEQ ID NO: 2794478 - RNA, 13 nt, Human
cguggacucugca

SEQ ID NO: 2794479 - RNA, 16 nt, Human
cguggacucugcacau

SEQ ID NO: 2794480 - RNA, 16 nt, Human
cguggacaggugugcc

SEQ ID NO: 2794481 - RNA, 22 nt, Human
cgugcacguggagagcuggugc

SEQ ID NO: 2794482 - RNA, 21 nt, Human
cgugcacguggagagcuggug

SEQ ID NO: 2794483 - RNA, 20 nt, Human
cgugcacguggagagcuggu

SEQ ID NO: 2794484 - RNA, 17 nt, Human
cgugcacguggagagcu

SEQ ID NO: 2794485 - RNA, 19 nt, Human
cgugcacacaccagagccc

SEQ ID NO: 2794486 - RNA, 18 nt, Human
cgugcacacaccagagcc

SEQ ID NO: 2794487 - RNA, 19 nt, Human
cgugcauuagcacagauuu

SEQ ID NO: 2794488 - RNA, 21 nt, Human
cgugcauuagcacagauuuua

SEQ ID NO: 2794489 - RNA, 22 nt, Human
cgugcauuagcacagauuuuaa

SEQ ID NO: 2794490 - RNA, 23 nt, Human
cgugcauuagcacagauuuuaau

SEQ ID NO: 2794491 - RNA, 18 nt, Human
cgugccaaagucucccuu

SEQ ID NO: 2794492 - RNA, 20 nt, Human
cgugccaaagucucccuucu

SEQ ID NO: 2794493 - RNA, 21 nt, Human
cgugcaguggugcgaucuggg

SEQ ID NO: 2794494 - RNA, 19 nt, Human
cgucuucuguauacugugg

SEQ ID NO: 2794495 - RNA, 17 nt, Human
cgucuuccgccccugcc

SEQ ID NO: 2794496 - RNA, 18 nt, Human
cgucuuccgccccugccu

SEQ ID NO: 2794497 - RNA, 19 nt, Human
cgucuuccgccccugccug

SEQ ID NO: 2794498 - RNA, 20 nt, Human
cgucuuccgccccugccugc

SEQ ID NO: 2794499 - RNA, 21 nt, Human
cgucuuccgccccugccugcc

SEQ ID NO: 2794500 - RNA, 13 nt, Human
cgucuuucuuuuu

SEQ ID NO: 2794501 - RNA, 16 nt, Human
cgugcacacaccagag

SEQ ID NO: 2794502 - RNA, 16 nt, Human
cgugaaaacggagcug

SEQ ID NO: 2794503 - RNA, 17 nt, Human
cgugaaaacggagcuga

SEQ ID NO: 2794504 - RNA, 15 nt, Human
cgugaaaacggagcu

SEQ ID NO: 2794505 - RNA, 22 nt, Human
cgucugacaggcaaugcuggcu

SEQ ID NO: 2794506 - RNA, 21 nt, Human
cgucugacaggcaaugcuggc

SEQ ID NO: 2794507 - RNA, 20 nt, Human
cgucugacaggcaaugcugg

SEQ ID NO: 2794508 - RNA, 13 nt, Human
cggugcccacacc

SEQ ID NO: 2794509 - RNA, 17 nt, Human
cgucucaaccccucaca

SEQ ID NO: 2794510 - RNA, 11 nt, Human
cgucucagugu

SEQ ID NO: 2794511 - RNA, 23 nt, Human
cgcuccaccagcaucaccugccu

SEQ ID NO: 2794512 - RNA, 14 nt, Human
cgcugggugguacc

SEQ ID NO: 2794513 - RNA, 19 nt, Human
cgcugggugguacccucug

SEQ ID NO: 2794514 - RNA, 22 nt, Human
cgcugggugguacccucuggag

SEQ ID NO: 2794515 - RNA, 13 nt, Human
cgcugucacaggc

SEQ ID NO: 2794516 - RNA, 12 nt, Human
cgcuaaggaaga

SEQ ID NO: 2794517 - RNA, 22 nt, Human
cgcuggguccuaauuaccaguc

SEQ ID NO: 2794518 - RNA, 12 nt, Human
cgcuggugcuga

SEQ ID NO: 2794519 - RNA, 13 nt, Human
cgcuggugcugag

SEQ ID NO: 2794520 - RNA, 23 nt, Human
cgcugucccuaguaaaaauacaa

SEQ ID NO: 2794521 - RNA, 16 nt, Human
cgcuuugauucauagu

SEQ ID NO: 2794522 - RNA, 11 nt, Human
cgcuuuggccu

SEQ ID NO: 2794523 - RNA, 15 nt, Human
cgcuuuggccugagu

SEQ ID NO: 2794524 - RNA, 12 nt, Human
cgcuuugucaca

SEQ ID NO: 2794525 - RNA, 18 nt, Human
cgcuuguaaauaccagga

SEQ ID NO: 2794526 - RNA, 12 nt, Human
cgcuuggcucca

SEQ ID NO: 2794527 - RNA, 16 nt, Human
cgcuuggcuccaugcu

SEQ ID NO: 2794528 - RNA, 21 nt, Human
cgcuuggcuccaugcuccuca

SEQ ID NO: 2794529 - RNA, 11 nt, Human
cgcuacccacu

SEQ ID NO: 2794530 - RNA, 20 nt, Human
cgcuacaaaacgcgcagaug

SEQ ID NO: 2794531 - RNA, 23 nt, Human
cgcuacaaaacgcgcagaugugc

SEQ ID NO: 2794532 - RNA, 16 nt, Human
cgcucagcccucccug

SEQ ID NO: 2794533 - RNA, 21 nt, Human
cgcucagcccucccugccccu

SEQ ID NO: 2794534 - RNA, 12 nt, Human
cgcucagcccuc

SEQ ID NO: 2794535 - RNA, 23 nt, Human
cgcggcggagcuggccccgccgc

SEQ ID NO: 2794536 - RNA, 15 nt, Human
cgcggcggagcuggc

SEQ ID NO: 2794537 - RNA, 12 nt, Human
cgcggccagccc

SEQ ID NO: 2794538 - RNA, 14 nt, Human
cgcggccagccccg

SEQ ID NO: 2794539 - RNA, 15 nt, Human
cgcggccagccccgg

SEQ ID NO: 2794540 - RNA, 22 nt, Human
cgcggccagccccggcccuggg

SEQ ID NO: 2794541 - RNA, 17 nt, Human
cgcggcggagcuggccc

SEQ ID NO: 2794542 - RNA, 18 nt, Human
cgcggcggagcuggcccc

SEQ ID NO: 2794543 - RNA, 21 nt, Human
cgcggcggagcuggccccgcc

SEQ ID NO: 2794544 - RNA, 22 nt, Human
cgcggcggagcuggccccgccg

SEQ ID NO: 2794545 - RNA, 16 nt, Human
cgcgcccgccccugca

SEQ ID NO: 2794546 - RNA, 17 nt, Human
cgcgcccgccccugcag

SEQ ID NO: 2794547 - RNA, 11 nt, Human
cgcgcgcacac

SEQ ID NO: 2794548 - RNA, 13 nt, Human
cgcgcgcacacac

SEQ ID NO: 2794549 - RNA, 14 nt, Human
cgcgcgcacacaca

SEQ ID NO: 2794550 - RNA, 13 nt, Human
cgcgcgcgcacac

SEQ ID NO: 2794551 - RNA, 13 nt, Human
cgcgcucugcuca

SEQ ID NO: 2794552 - RNA, 14 nt, Human
cgcgcucugcucag

SEQ ID NO: 2794553 - RNA, 19 nt, Human
cgcgcgcacacacacacau

SEQ ID NO: 2794554 - RNA, 18 nt, Human
cgcgccacucgcuucccc

SEQ ID NO: 2794555 - RNA, 15 nt, Human
cgcgccacucgcuuc

SEQ ID NO: 2794556 - RNA, 23 nt, Human
cgcgccacuacacuccagccuga

SEQ ID NO: 2794557 - RNA, 22 nt, Human
cgcgccacuacacuccagccug

SEQ ID NO: 2794558 - RNA, 22 nt, Human
cgcgccacucgcuucccccaua

SEQ ID NO: 2794559 - RNA, 20 nt, Human
cgcgccacucgcuuccccca

SEQ ID NO: 2794560 - RNA, 16 nt, Human
cgcgccccccucccag

SEQ ID NO: 2794561 - RNA, 17 nt, Human
cgcgccccccucccaga

SEQ ID NO: 2794562 - RNA, 18 nt, Human
cgcgccccccucccagag

SEQ ID NO: 2794563 - RNA, 19 nt, Human
cgcgccccccucccagagg

SEQ ID NO: 2794564 - RNA, 20 nt, Human
cgcgccccccucccagaggc

SEQ ID NO: 2794565 - RNA, 21 nt, Human
cgcgccccccucccagaggcg

SEQ ID NO: 2794566 - RNA, 14 nt, Human
cgcccaguccuucc

SEQ ID NO: 2794567 - RNA, 15 nt, Human
cgcccaguccuucca

SEQ ID NO: 2794568 - RNA, 20 nt, Human
cgcccaggcuggagugcagu

SEQ ID NO: 2794569 - RNA, 21 nt, Human
cgccccucauuuaucccucaa

SEQ ID NO: 2794570 - RNA, 15 nt, Human
cgcccccugcccucc

SEQ ID NO: 2794571 - RNA, 19 nt, Human
cgcccccugcccuccccuc

SEQ ID NO: 2794572 - RNA, 16 nt, Human
cgcccaguccuuccac

SEQ ID NO: 2794573 - RNA, 14 nt, Human
cgcccccugcccuc

SEQ ID NO: 2794574 - RNA, 20 nt, Human
cgcccuuggcuucugugaug

SEQ ID NO: 2794575 - RNA, 17 nt, Human
cgcccuuggcuucugug

SEQ ID NO: 2794576 - RNA, 11 nt, Human
cgcccuuggcu

SEQ ID NO: 2794577 - RNA, 15 nt, Human
cgcccuuaccuuccc

SEQ ID NO: 2794578 - RNA, 19 nt, Human
cgcccuuacuucuugcccu

SEQ ID NO: 2794579 - RNA, 20 nt, Human
cgcccuuacuucuugcccug

SEQ ID NO: 2794580 - RNA, 19 nt, Human
cgcccuuagucccccaacu

SEQ ID NO: 2794581 - RNA, 21 nt, Human
cgcccuuagucccccaacucu

SEQ ID NO: 2794582 - RNA, 19 nt, Human
cgcgcagaugugcagcaga

SEQ ID NO: 2794583 - RNA, 18 nt, Human
cgcgcacacacacacaua

SEQ ID NO: 2794584 - RNA, 12 nt, Human
cgcgcacacaca

SEQ ID NO: 2794585 - RNA, 12 nt, Human
cgccccugcagc

SEQ ID NO: 2794586 - RNA, 19 nt, Human
cgccccugcagcacggaca

SEQ ID NO: 2794587 - RNA, 14 nt, Human
cgccccugccaccu

SEQ ID NO: 2794588 - RNA, 12 nt, Human
cgccccugccug

SEQ ID NO: 2794589 - RNA, 13 nt, Human
cgccccugccugc

SEQ ID NO: 2794590 - RNA, 15 nt, Human
cgccccugccugcca

SEQ ID NO: 2794591 - RNA, 18 nt, Human
cgccccugccugccaugu

SEQ ID NO: 2794592 - RNA, 20 nt, Human
cgcccacaggaagccugcag

SEQ ID NO: 2794593 - RNA, 21 nt, Human
cgccaguguaaucccccagga

SEQ ID NO: 2794594 - RNA, 22 nt, Human
cgccaguguaaucccccaggag

SEQ ID NO: 2794595 - RNA, 13 nt, Human
cgccaucagccca

SEQ ID NO: 2794596 - RNA, 14 nt, Human
cgccaucagcccaa

SEQ ID NO: 2794597 - RNA, 18 nt, Human
cgcccacaggaagccugc

SEQ ID NO: 2794598 - RNA, 21 nt, Human
cgcccacaggaagccugcagu

SEQ ID NO: 2794599 - RNA, 22 nt, Human
cgcccacaggaagccugcaguc

SEQ ID NO: 2794600 - RNA, 11 nt, Human
cgcccaccucc

SEQ ID NO: 2794601 - RNA, 12 nt, Human
cgcccaccuccc

SEQ ID NO: 2794602 - RNA, 14 nt, Human
cgcccaccucccca

SEQ ID NO: 2794603 - RNA, 11 nt, Human
ccucugccaga

SEQ ID NO: 2794604 - RNA, 23 nt, Human
ccucugccagaagauccccucag

SEQ ID NO: 2794605 - RNA, 12 nt, Human
cggcugcccuuu

SEQ ID NO: 2794606 - RNA, 11 nt, Human
cggcugcccuu

SEQ ID NO: 2794607 - RNA, 11 nt, Human
cggcugcugag

SEQ ID NO: 2794608 - RNA, 24 nt, Human
cggccaggccagagggagugacag

SEQ ID NO: 2794609 - RNA, 10 nt, Human
cggccagcca

SEQ ID NO: 2794610 - RNA, 14 nt, Human
cggccagccagcca

SEQ ID NO: 2794611 - RNA, 12 nt, Human
cggccaccucug

SEQ ID NO: 2794612 - RNA, 13 nt, Human
cggccaccucugc

SEQ ID NO: 2794613 - RNA, 14 nt, Human
cggccaccucugcg

SEQ ID NO: 2794614 - RNA, 22 nt, Human
cggccaucucuuuguacaggaa

SEQ ID NO: 2794615 - RNA, 20 nt, Human
cggccagccccggcccuggg

SEQ ID NO: 2794616 - RNA, 19 nt, Human
cggccccugcugguucagg

SEQ ID NO: 2794617 - RNA, 18 nt, Human
cggccccugcugguucag

SEQ ID NO: 2794618 - RNA, 13 nt, Human
cggccccugcugg

SEQ ID NO: 2794619 - RNA, 22 nt, Human
cggccccugcauccccuuggcu

SEQ ID NO: 2794620 - RNA, 17 nt, Human
cgcuuuuguucucgcaa

SEQ ID NO: 2794621 - RNA, 17 nt, Human
cggaagguuuuuaaaca

SEQ ID NO: 2794622 - RNA, 18 nt, Human
cggaaggcuggcugggca

SEQ ID NO: 2794623 - RNA, 22 nt, Human
cggcagaaaggaaaaccugaag

SEQ ID NO: 2794624 - RNA, 17 nt, Human
cggcacggucuucccuc

SEQ ID NO: 2794625 - RNA, 20 nt, Human
cggcacuccaaccuaaccug

SEQ ID NO: 2794626 - RNA, 13 nt, Human
cggcacccucugg

SEQ ID NO: 2794627 - RNA, 15 nt, Human
cggcacccucuggcc

SEQ ID NO: 2794628 - RNA, 16 nt, Human
cggcacccucuggccg

SEQ ID NO: 2794629 - RNA, 17 nt, Human
cggaauaagagaccugu

SEQ ID NO: 2794630 - RNA, 21 nt, Human
cggaauaagagaccuguuuua

SEQ ID NO: 2794631 - RNA, 18 nt, Human
cggccaagauaggaccuu

SEQ ID NO: 2794632 - RNA, 19 nt, Human
cggccaagauaggaccuug

SEQ ID NO: 2794633 - RNA, 22 nt, Human
cggccaagauaggaccuugggc

SEQ ID NO: 2794634 - RNA, 23 nt, Human
cggccaagauaggaccuugggcc

SEQ ID NO: 2794635 - RNA, 12 nt, Human
cggccaauggaa

SEQ ID NO: 2794636 - RNA, 14 nt, Human
cggccaauggaaac

SEQ ID NO: 2794637 - RNA, 15 nt, Human
cggccaauggaaacc

SEQ ID NO: 2794638 - RNA, 11 nt, Human
cggccaccucu

SEQ ID NO: 2794639 - RNA, 14 nt, Human
cggcauuccugcuu

SEQ ID NO: 2794640 - RNA, 18 nt, Human
cggcauguuuccagcaga

SEQ ID NO: 2794641 - RNA, 15 nt, Human
cggcauuaaagccau

SEQ ID NO: 2794642 - RNA, 14 nt, Human
cggcauuucaaaug

SEQ ID NO: 2794643 - RNA, 17 nt, Human
cgggucccuucaccucc

SEQ ID NO: 2794644 - RNA, 16 nt, Human
cggguuccgcaggcag

SEQ ID NO: 2794645 - RNA, 15 nt, Human
cgguagggaggcagc

SEQ ID NO: 2794646 - RNA, 16 nt, Human
cgguagggaggcagcc

SEQ ID NO: 2794647 - RNA, 17 nt, Human
cgguagggaggcagccu

SEQ ID NO: 2794648 - RNA, 19 nt, Human
cgguagggaggcagccucc

SEQ ID NO: 2794649 - RNA, 20 nt, Human
cgguccacccaggagccccg

SEQ ID NO: 2794650 - RNA, 16 nt, Human
cgguccacccaggagc

SEQ ID NO: 2794651 - RNA, 15 nt, Human
cgguccacccaggag

SEQ ID NO: 2794652 - RNA, 14 nt, Human
cgguccacccagga

SEQ ID NO: 2794653 - RNA, 19 nt, Human
cgggguggugggaaccaug

SEQ ID NO: 2794654 - RNA, 11 nt, Human
cgggucacagg

SEQ ID NO: 2794655 - RNA, 12 nt, Human
cgggguggagca

SEQ ID NO: 2794656 - RNA, 18 nt, Human
cgggguggugggaaccau

SEQ ID NO: 2794657 - RNA, 19 nt, Human
cgggucacaggagggaggg

SEQ ID NO: 2794658 - RNA, 17 nt, Human
cggguugugugucuguu

SEQ ID NO: 2794659 - RNA, 16 nt, Human
cggguugugugucugu

SEQ ID NO: 2794660 - RNA, 19 nt, Human
cggguggaucaccugaggu

SEQ ID NO: 2794661 - RNA, 18 nt, Human
cggguggaucaccugagg

SEQ ID NO: 2794662 - RNA, 21 nt, Human
cgguccagcuggccuggacag

SEQ ID NO: 2794663 - RNA, 16 nt, Human
cgguccagcuggccug

SEQ ID NO: 2794664 - RNA, 15 nt, Human
cgguccagcuggccu

SEQ ID NO: 2794665 - RNA, 13 nt, Human
cggucccaccccu

SEQ ID NO: 2794666 - RNA, 16 nt, Human
cggucccaccccuccc

SEQ ID NO: 2794667 - RNA, 14 nt, Human
cgguccagcuggcc

SEQ ID NO: 2794668 - RNA, 13 nt, Human
cgguccagcuggc

SEQ ID NO: 2794669 - RNA, 11 nt, Human
cgguccagcug

SEQ ID NO: 2794670 - RNA, 14 nt, Human
cggucagguuuaac

SEQ ID NO: 2794671 - RNA, 16 nt, Human
cggucagguuuaacau

SEQ ID NO: 2794672 - RNA, 18 nt, Human
cggucagguuuaacauuu

SEQ ID NO: 2794673 - RNA, 21 nt, Human
cggucagguuuaacauuugcc

SEQ ID NO: 2794674 - RNA, 11 nt, Human
cggucucaggc

SEQ ID NO: 2794675 - RNA, 21 nt, Human
cggugacaaagauggcucaga

SEQ ID NO: 2794676 - RNA, 21 nt, Human
cggucuguucuguuucaaggc

SEQ ID NO: 2794677 - RNA, 21 nt, Human
cggucuucaacauccugccag

SEQ ID NO: 2794678 - RNA, 18 nt, Human
cggugaaggugacagcag

SEQ ID NO: 2794679 - RNA, 21 nt, Human
cggugagaggggaacagacug

SEQ ID NO: 2794680 - RNA, 20 nt, Human
cggugagaggggaacagacu

SEQ ID NO: 2794681 - RNA, 14 nt, Human
cgggagcaucucuu

SEQ ID NO: 2794682 - RNA, 22 nt, Human
cgggagcaucucuugaggccag

SEQ ID NO: 2794683 - RNA, 17 nt, Human
cgggagccuaggaccac

SEQ ID NO: 2794684 - RNA, 22 nt, Human
cgggcacucagaagacacugau

SEQ ID NO: 2794685 - RNA, 14 nt, Human
cgggcacucagaag

SEQ ID NO: 2794686 - RNA, 22 nt, Human
cggggacagcuccuucuguccu

SEQ ID NO: 2794687 - RNA, 21 nt, Human
cgggcaccuauagucccagcu

SEQ ID NO: 2794688 - RNA, 19 nt, Human
cgggcaccuauagucccag

SEQ ID NO: 2794689 - RNA, 14 nt, Human
cgggcaccagccag

SEQ ID NO: 2794690 - RNA, 15 nt, Human
cgggcaccagccagc

SEQ ID NO: 2794691 - RNA, 16 nt, Human
cgggcaccagccagcg

SEQ ID NO: 2794692 - RNA, 18 nt, Human
cgggaugguccuggggcu

SEQ ID NO: 2794693 - RNA, 16 nt, Human
cgggaugguccugggg

SEQ ID NO: 2794694 - RNA, 17 nt, Human
cgggauuaguacacacu

SEQ ID NO: 2794695 - RNA, 12 nt, Human
cgggggcagcug

SEQ ID NO: 2794696 - RNA, 13 nt, Human
cgggggcagcuga

SEQ ID NO: 2794697 - RNA, 20 nt, Human
cgggggcugcccuugggcca

SEQ ID NO: 2794698 - RNA, 15 nt, Human
cgggguauccugggg

SEQ ID NO: 2794699 - RNA, 21 nt, Human
cgggguauccugggggaccca

SEQ ID NO: 2794700 - RNA, 14 nt, Human
cgggguaugaagag

SEQ ID NO: 2794701 - RNA, 23 nt, Human
cggggacagcuccuucuguccua

SEQ ID NO: 2794702 - RNA, 18 nt, Human
cggggccucgggaccuca

SEQ ID NO: 2794703 - RNA, 17 nt, Human
cggggccucgggaccuc

SEQ ID NO: 2794704 - RNA, 23 nt, Human
cggggagcggcggaaagccugua

SEQ ID NO: 2794705 - RNA, 16 nt, Human
cgggaguuggagaccc

SEQ ID NO: 2794706 - RNA, 21 nt, Human
cucuccugacuuuuaauguca

SEQ ID NO: 2794707 - RNA, 20 nt, Human
cucuccuugcuccuggccuu

SEQ ID NO: 2794708 - RNA, 16 nt, Human
cucuccuuucuuucua

SEQ ID NO: 2794709 - RNA, 12 nt, Human
cucuccuuccuu

SEQ ID NO: 2794710 - RNA, 17 nt, Human
cucuccuuccuuaccca

SEQ ID NO: 2794711 - RNA, 14 nt, Human
cucuccuuccuugu

SEQ ID NO: 2794712 - RNA, 19 nt, Human
cucuccuguuucccuuccc

SEQ ID NO: 2794713 - RNA, 20 nt, Human
cucuccuguuucccuucccu

SEQ ID NO: 2794714 - RNA, 12 nt, Human
cucuccugccac

SEQ ID NO: 2794715 - RNA, 13 nt, Human
cucuccugccaca

SEQ ID NO: 2794716 - RNA, 12 nt, Human
cucuccuggagg

SEQ ID NO: 2794717 - RNA, 13 nt, Human
cucuccuggagga

SEQ ID NO: 2794718 - RNA, 22 nt, Human
cucucuagcacaauuugcacua

SEQ ID NO: 2794719 - RNA, 13 nt, Human
cucucuagcacaa

SEQ ID NO: 2794720 - RNA, 22 nt, Human
cucucuacuccuaccucagccu

SEQ ID NO: 2794721 - RNA, 20 nt, Human
cucucuacuccuaccucagc

SEQ ID NO: 2794722 - RNA, 19 nt, Human
cucucuacuccuaccucag

SEQ ID NO: 2794723 - RNA, 12 nt, Human
cucucuccagau

SEQ ID NO: 2794724 - RNA, 14 nt, Human
cucucuccacccua

SEQ ID NO: 2794725 - RNA, 14 nt, Human
cucucuccagaugu

SEQ ID NO: 2794726 - RNA, 17 nt, Human
cucucuccagauguuuc

SEQ ID NO: 2794727 - RNA, 14 nt, Human
cucucucaaaagag

SEQ ID NO: 2794728 - RNA, 13 nt, Human
cucuccccagcaa

SEQ ID NO: 2794729 - RNA, 14 nt, Human
cucuccagccugac

SEQ ID NO: 2794730 - RNA, 24 nt, Human
cucuccccagcaagugagagcugg

SEQ ID NO: 2794731 - RNA, 22 nt, Human
cucuccccagcaagugagagcu

SEQ ID NO: 2794732 - RNA, 14 nt, Human
cucuccccagcaag

SEQ ID NO: 2794733 - RNA, 21 nt, Human
cucuccugauagucuuucagu

SEQ ID NO: 2794734 - RNA, 19 nt, Human
cucuccucuugccacugcc

SEQ ID NO: 2794735 - RNA, 22 nt, Human
cucuccucuugccacugccucu

SEQ ID NO: 2794736 - RNA, 14 nt, Human
cucuccucuugcca

SEQ ID NO: 2794737 - RNA, 15 nt, Human
cucuccucuugccac

SEQ ID NO: 2794738 - RNA, 16 nt, Human
cucuccucuugccacu

SEQ ID NO: 2794739 - RNA, 17 nt, Human
cucuccucuugccacug

SEQ ID NO: 2794740 - RNA, 12 nt, Human
cucuccacugcc

SEQ ID NO: 2794741 - RNA, 14 nt, Human
cucuccacugccuu

SEQ ID NO: 2794742 - RNA, 11 nt, Human
cucuccacugc

SEQ ID NO: 2794743 - RNA, 17 nt, Human
cucuccaagucucagug

SEQ ID NO: 2794744 - RNA, 15 nt, Human
cucuauacaucucuc

SEQ ID NO: 2794745 - RNA, 18 nt, Human
cucuauacaucucucccc

SEQ ID NO: 2794746 - RNA, 21 nt, Human
cucuagugcccuccacagccg

SEQ ID NO: 2794747 - RNA, 12 nt, Human
cucuagauucca

SEQ ID NO: 2794748 - RNA, 14 nt, Human
cucuagaucauaag

SEQ ID NO: 2794749 - RNA, 15 nt, Human
cucuagaugagcugg

SEQ ID NO: 2794750 - RNA, 16 nt, Human
cucuagaugagcuggg

SEQ ID NO: 2794751 - RNA, 23 nt, Human
cucuagaugagcugggccggagg

SEQ ID NO: 2794752 - RNA, 13 nt, Human
cucuagaguccaa

SEQ ID NO: 2794753 - RNA, 15 nt, Human
cucuagaguccaagg

SEQ ID NO: 2794754 - RNA, 16 nt, Human
cucuagaguccaaggu

SEQ ID NO: 2794755 - RNA, 19 nt, Human
cucuagauaccuaaaacau

SEQ ID NO: 2794756 - RNA, 21 nt, Human
cucuagauaccuaaaacauaa

SEQ ID NO: 2794757 - RNA, 12 nt, Human
cucuagaaucug

SEQ ID NO: 2794758 - RNA, 16 nt, Human
cucuagacaagauauu

SEQ ID NO: 2794759 - RNA, 21 nt, Human
cucuagacaagauauuguaca

SEQ ID NO: 2794760 - RNA, 21 nt, Human
cucuagacacugccacacagg

SEQ ID NO: 2794761 - RNA, 16 nt, Human
cucuagacacugccac

SEQ ID NO: 2794762 - RNA, 12 nt, Human
cucuaggcucug

SEQ ID NO: 2794763 - RNA, 15 nt, Human
cucuaggcucugccu

SEQ ID NO: 2794764 - RNA, 16 nt, Human
cucuaggcucugccuu

SEQ ID NO: 2794765 - RNA, 17 nt, Human
cucuaggcucugccuuc

SEQ ID NO: 2794766 - RNA, 21 nt, Human
cucuaggaagacauuuuuccg

SEQ ID NO: 2794767 - RNA, 16 nt, Human
cucuagcugugggggu

SEQ ID NO: 2794768 - RNA, 12 nt, Human
cucuaggcuggg

SEQ ID NO: 2794769 - RNA, 13 nt, Human
cucuaggcugggg

SEQ ID NO: 2794770 - RNA, 14 nt, Human
cucuaggcugggga

SEQ ID NO: 2794771 - RNA, 15 nt, Human
cucuaggcuggggaa

SEQ ID NO: 2794772 - RNA, 12 nt, Human
cucuagggucca

SEQ ID NO: 2794773 - RNA, 14 nt, Human
cucuaggguugcug

SEQ ID NO: 2794774 - RNA, 18 nt, Human
cucuaggguugcuggagc

SEQ ID NO: 2794775 - RNA, 19 nt, Human
cucuaggguugcuggagcc

SEQ ID NO: 2794776 - RNA, 21 nt, Human
cucuaggguugcuggagccug

SEQ ID NO: 2794777 - RNA, 18 nt, Human
cucuagugcccuccacag

SEQ ID NO: 2794778 - RNA, 14 nt, Human
cucuagugcccucc

SEQ ID NO: 2794779 - RNA, 13 nt, Human
cucuagugcccuc

SEQ ID NO: 2794780 - RNA, 16 nt, Human
cucuaguaguuaaaaa

SEQ ID NO: 2794781 - RNA, 17 nt, Human
cucuaguaguuaaaaaa

SEQ ID NO: 2794782 - RNA, 18 nt, Human
cucuaguaguuaaaaaaa

SEQ ID NO: 2794783 - RNA, 22 nt, Human
cucuacccucccacccccuucu

SEQ ID NO: 2794784 - RNA, 18 nt, Human
cucuacccucccaccccc

SEQ ID NO: 2794785 - RNA, 17 nt, Human
cucuacccucccacccc

SEQ ID NO: 2794786 - RNA, 16 nt, Human
cucuacccucccaccc

SEQ ID NO: 2794787 - RNA, 15 nt, Human
cucuacccucccacc

SEQ ID NO: 2794788 - RNA, 14 nt, Human
cucuacccucccac

SEQ ID NO: 2794789 - RNA, 20 nt, Human
cucuaccagauaacugagga

SEQ ID NO: 2794790 - RNA, 20 nt, Human
cucuaccaagcuauccuggc

SEQ ID NO: 2794791 - RNA, 13 nt, Human
cucuacagugcca

SEQ ID NO: 2794792 - RNA, 20 nt, Human
cucuacagugccaacuccuc

SEQ ID NO: 2794793 - RNA, 12 nt, Human
cucuacauauuu

SEQ ID NO: 2794794 - RNA, 17 nt, Human
cucuacaucuucugccu

SEQ ID NO: 2794795 - RNA, 18 nt, Human
cucuacaucuucugccuu

SEQ ID NO: 2794796 - RNA, 19 nt, Human
cucuacauggacucagaga

SEQ ID NO: 2794797 - RNA, 14 nt, Human
cucuacccaaaccc

SEQ ID NO: 2794798 - RNA, 17 nt, Human
cucuacccaaacccuag

SEQ ID NO: 2794799 - RNA, 18 nt, Human
cucuacccaaacccuagg

SEQ ID NO: 2794800 - RNA, 21 nt, Human
cucuaccagauaacugaggag

SEQ ID NO: 2794801 - RNA, 23 nt, Human
cucuaccagauaacugaggaggg

SEQ ID NO: 2794802 - RNA, 17 nt, Human
cucuaccagugcaggcu

SEQ ID NO: 2794803 - RNA, 20 nt, Human
cucuaccagugcaggcuggc

SEQ ID NO: 2794804 - RNA, 22 nt, Human
cucuaccagugcaggcuggcca

SEQ ID NO: 2794805 - RNA, 23 nt, Human
cucuaccagugcaggcuggccag

SEQ ID NO: 2794806 - RNA, 18 nt, Human
cucuacccagggccugca

SEQ ID NO: 2794807 - RNA, 17 nt, Human
cucuacccagggccugc

SEQ ID NO: 2794808 - RNA, 14 nt, Human
cucuacccagggcc

SEQ ID NO: 2794809 - RNA, 13 nt, Human
cucuacccagggc

SEQ ID NO: 2794810 - RNA, 16 nt, Human
cucuacuuagcauguc

SEQ ID NO: 2794811 - RNA, 17 nt, Human
cucuacuuagcaugucc

SEQ ID NO: 2794812 - RNA, 19 nt, Human
cucuacuuagcaugucccu

SEQ ID NO: 2794813 - RNA, 13 nt, Human
cucuacuguguaa

SEQ ID NO: 2794814 - RNA, 14 nt, Human
cucuacuguguaau

SEQ ID NO: 2794815 - RNA, 13 nt, Human
cucuacuucagga

SEQ ID NO: 2794816 - RNA, 13 nt, Human
cucuacuuuccag

SEQ ID NO: 2794817 - RNA, 15 nt, Human
cucuacuuuccaggc

SEQ ID NO: 2794818 - RNA, 17 nt, Human
cucuacuuuccaggcua

SEQ ID NO: 2794819 - RNA, 18 nt, Human
cucuacuuuccaggcuag

SEQ ID NO: 2794820 - RNA, 20 nt, Human
cucuacuuagcaugucccua

SEQ ID NO: 2794821 - RNA, 19 nt, Human
cucuacuccuaccucagcc

SEQ ID NO: 2794822 - RNA, 16 nt, Human
cucuacuccuaccuca

SEQ ID NO: 2794823 - RNA, 19 nt, Human
cucuacuaaggcuuuccua

SEQ ID NO: 2794824 - RNA, 19 nt, Human
cucuacuaaaaauacagaa

SEQ ID NO: 2794825 - RNA, 23 nt, Human
cuccugauaaaacaacagcucga

SEQ ID NO: 2794826 - RNA, 14 nt, Human
cucgcuucccccau

SEQ ID NO: 2794827 - RNA, 18 nt, Human
cucgcuucccccauagcc

SEQ ID NO: 2794828 - RNA, 16 nt, Human
cucgcuucccccauag

SEQ ID NO: 2794829 - RNA, 19 nt, Human
cucgcuucccccauagcca

SEQ ID NO: 2794830 - RNA, 16 nt, Human
cucggcucagugcaac

SEQ ID NO: 2794831 - RNA, 18 nt, Human
cucggcucagugcaaccu

SEQ ID NO: 2794832 - RNA, 22 nt, Human
cucggcucagugcaaccucugc

SEQ ID NO: 2794833 - RNA, 23 nt, Human
cucggcucagugcaaccucugcu

SEQ ID NO: 2794834 - RNA, 19 nt, Human
cucggcuccccaugugucc

SEQ ID NO: 2794835 - RNA, 22 nt, Human
cucggcuccccauguguccugg

SEQ ID NO: 2794836 - RNA, 18 nt, Human
cucggcucacugcauccu

SEQ ID NO: 2794837 - RNA, 17 nt, Human
cucggcucacugcaucc

SEQ ID NO: 2794838 - RNA, 21 nt, Human
cucggaguguguaugccaaga

SEQ ID NO: 2794839 - RNA, 14 nt, Human
cucggcucacugca

SEQ ID NO: 2794840 - RNA, 16 nt, Human
cucggaggcugccccc

SEQ ID NO: 2794841 - RNA, 12 nt, Human
cucggaggcugc

SEQ ID NO: 2794842 - RNA, 13 nt, Human
cucggaggcugcc

SEQ ID NO: 2794843 - RNA, 15 nt, Human
cucggaggcugcccc

SEQ ID NO: 2794844 - RNA, 14 nt, Human
cuccugugugugcg

SEQ ID NO: 2794845 - RNA, 14 nt, Human
cuccuguguacugu

SEQ ID NO: 2794846 - RNA, 15 nt, Human
cuccuguguacugug

SEQ ID NO: 2794847 - RNA, 16 nt, Human
cuccuguguacugugu

SEQ ID NO: 2794848 - RNA, 17 nt, Human
cuccuguguacuguguc

SEQ ID NO: 2794849 - RNA, 20 nt, Human
cuccugugugugcgccuaca

SEQ ID NO: 2794850 - RNA, 15 nt, Human
cucgcugcuucugug

SEQ ID NO: 2794851 - RNA, 21 nt, Human
cucuaacuuauuuuauuucca

SEQ ID NO: 2794852 - RNA, 22 nt, Human
cucuaagaucuuagauucucug

SEQ ID NO: 2794853 - RNA, 14 nt, Human
cucuaagaucuuag

SEQ ID NO: 2794854 - RNA, 16 nt, Human
cucuaagaucuuagau

SEQ ID NO: 2794855 - RNA, 19 nt, Human
cucuaagaucuuagauucu

SEQ ID NO: 2794856 - RNA, 17 nt, Human
cucggcuuuucucagcu

SEQ ID NO: 2794857 - RNA, 16 nt, Human
cucuacagaggccaug

SEQ ID NO: 2794858 - RNA, 14 nt, Human
cucuacagaggcca

SEQ ID NO: 2794859 - RNA, 19 nt, Human
cucuacagaggccaugggc

SEQ ID NO: 2794860 - RNA, 21 nt, Human
cucuacagcuaaucagcauuc

SEQ ID NO: 2794861 - RNA, 15 nt, Human
cucuacaucuucugc

SEQ ID NO: 2794862 - RNA, 13 nt, Human
cucuacagaggcc

SEQ ID NO: 2794863 - RNA, 18 nt, Human
cucuaauucuauuaaagu

SEQ ID NO: 2794864 - RNA, 16 nt, Human
cucuacaaacucccac

SEQ ID NO: 2794865 - RNA, 17 nt, Human
cucuacaauuggaagau

SEQ ID NO: 2794866 - RNA, 17 nt, Human
cucuacaaacucccacu

SEQ ID NO: 2794867 - RNA, 14 nt, Human
cucccuccaccuac

SEQ ID NO: 2794868 - RNA, 13 nt, Human
cucccucauucca

SEQ ID NO: 2794869 - RNA, 23 nt, Human
cucccucagugcccucauuuuau

SEQ ID NO: 2794870 - RNA, 14 nt, Human
cucccucagugccc

SEQ ID NO: 2794871 - RNA, 15 nt, Human
cuccgaccagacacc

SEQ ID NO: 2794872 - RNA, 22 nt, Human
cuccgaacacccucgaagcgcg

SEQ ID NO: 2794873 - RNA, 21 nt, Human
cucccuuuuuauaucccauuu

SEQ ID NO: 2794874 - RNA, 22 nt, Human
cucccucauuucaggagcagcc

SEQ ID NO: 2794875 - RNA, 14 nt, Human
cucccuuuuuauau

SEQ ID NO: 2794876 - RNA, 14 nt, Human
cuccgcccuuaguc

SEQ ID NO: 2794877 - RNA, 15 nt, Human
cuccgcccccagccu

SEQ ID NO: 2794878 - RNA, 16 nt, Human
cuccgcccccagccua

SEQ ID NO: 2794879 - RNA, 17 nt, Human
cuccgcccccagccuau

SEQ ID NO: 2794880 - RNA, 20 nt, Human
cuccgcccccagccuaugag

SEQ ID NO: 2794881 - RNA, 21 nt, Human
cuccgcccccagccuaugagc

SEQ ID NO: 2794882 - RNA, 21 nt, Human
cuccucacccccagcuuugcu

SEQ ID NO: 2794883 - RNA, 20 nt, Human
cuccucacccccagcuuugc

SEQ ID NO: 2794884 - RNA, 15 nt, Human
cuccucacccccagc

SEQ ID NO: 2794885 - RNA, 17 nt, Human
cuccucacccccagcuu

SEQ ID NO: 2794886 - RNA, 12 nt, Human
cuccucaucccg

SEQ ID NO: 2794887 - RNA, 21 nt, Human
cuccucaccucuggacuggcu

SEQ ID NO: 2794888 - RNA, 18 nt, Human
cuccucaccucuggacug

SEQ ID NO: 2794889 - RNA, 16 nt, Human
cuccucaccucuggac

SEQ ID NO: 2794890 - RNA, 15 nt, Human
cuccucaccucugga

SEQ ID NO: 2794891 - RNA, 14 nt, Human
cuccucaccucugg

SEQ ID NO: 2794892 - RNA, 13 nt, Human
cuccucaccucug

SEQ ID NO: 2794893 - RNA, 14 nt, Human
cuccuccaaaggcc

SEQ ID NO: 2794894 - RNA, 18 nt, Human
cuccuccaaaggcccccu

SEQ ID NO: 2794895 - RNA, 16 nt, Human
cuccuccaccaccgcc

SEQ ID NO: 2794896 - RNA, 21 nt, Human
cuccuccaccaccgcccgucu

SEQ ID NO: 2794897 - RNA, 15 nt, Human
cuccucaucccgugu

SEQ ID NO: 2794898 - RNA, 11 nt, Human
cuccucaugua

SEQ ID NO: 2794899 - RNA, 20 nt, Human
cuccucauguacauacccug

SEQ ID NO: 2794900 - RNA, 21 nt, Human
cuccuccagggugauuuuaug

SEQ ID NO: 2794901 - RNA, 22 nt, Human
cuccucuccccagcaagugaga

SEQ ID NO: 2794902 - RNA, 19 nt, Human
cuccuccuuggugccuggc

SEQ ID NO: 2794903 - RNA, 16 nt, Human
cuccucgacaucacug

SEQ ID NO: 2794904 - RNA, 17 nt, Human
cuccucgacaucacugu

SEQ ID NO: 2794905 - RNA, 20 nt, Human
cuccucgacaucacuguuca

SEQ ID NO: 2794906 - RNA, 19 nt, Human
cuccuccccaacugugggg

SEQ ID NO: 2794907 - RNA, 18 nt, Human
cuccuccccacccuccug

SEQ ID NO: 2794908 - RNA, 19 nt, Human
cuccuccccacccuccugg

SEQ ID NO: 2794909 - RNA, 20 nt, Human
cuccuccccacccuccuggc

SEQ ID NO: 2794910 - RNA, 14 nt, Human
cuccucccggugcc

SEQ ID NO: 2794911 - RNA, 15 nt, Human
cuccucccggugccc

SEQ ID NO: 2794912 - RNA, 17 nt, Human
cuccucccggugcccaa

SEQ ID NO: 2794913 - RNA, 11 nt, Human
cuccucccucc

SEQ ID NO: 2794914 - RNA, 12 nt, Human
cuccugccuuug

SEQ ID NO: 2794915 - RNA, 15 nt, Human
cuccugccuuugccu

SEQ ID NO: 2794916 - RNA, 16 nt, Human
cuccugccuuugccuc

SEQ ID NO: 2794917 - RNA, 18 nt, Human
cuccugccugugcuguga

SEQ ID NO: 2794918 - RNA, 15 nt, Human
cuccugccucagccu

SEQ ID NO: 2794919 - RNA, 19 nt, Human
cuccugccuguagcaguga

SEQ ID NO: 2794920 - RNA, 14 nt, Human
cuccugccugugcu

SEQ ID NO: 2794921 - RNA, 14 nt, Human
cuccugccuguagc

SEQ ID NO: 2794922 - RNA, 15 nt, Human
cuccugccuguagca

SEQ ID NO: 2794923 - RNA, 16 nt, Human
cuccugccuguagcag

SEQ ID NO: 2794924 - RNA, 18 nt, Human
cuccugccuguagcagug

SEQ ID NO: 2794925 - RNA, 14 nt, Human
cuccugccugcccc

SEQ ID NO: 2794926 - RNA, 17 nt, Human
cuccugccugccccucu

SEQ ID NO: 2794927 - RNA, 19 nt, Human
cuccugugugugcgccuac

SEQ ID NO: 2794928 - RNA, 16 nt, Human
cuccugugugugcgcc

SEQ ID NO: 2794929 - RNA, 16 nt, Human
cuccuguggggaaagg

SEQ ID NO: 2794930 - RNA, 16 nt, Human
cuccuguggaacccag

SEQ ID NO: 2794931 - RNA, 18 nt, Human
cuccuguggaacccagca

SEQ ID NO: 2794932 - RNA, 20 nt, Human
cuccuguggaacccagcagu

SEQ ID NO: 2794933 - RNA, 13 nt, Human
cuccugugcuggg

SEQ ID NO: 2794934 - RNA, 17 nt, Human
cuccugugcaacuuucc

SEQ ID NO: 2794935 - RNA, 14 nt, Human
cuccugcacuguuu

SEQ ID NO: 2794936 - RNA, 15 nt, Human
cuccugcacuguuua

SEQ ID NO: 2794937 - RNA, 14 nt, Human
cuccugccucagcc

SEQ ID NO: 2794938 - RNA, 13 nt, Human
cuccugccucagc

SEQ ID NO: 2794939 - RNA, 20 nt, Human
cuccugcccgcagaccucug

SEQ ID NO: 2794940 - RNA, 21 nt, Human
cuccugcccgcagaccucugg

SEQ ID NO: 2794941 - RNA, 22 nt, Human
cuccugcccgcagaccucugga

SEQ ID NO: 2794942 - RNA, 23 nt, Human
cuccugcccgcagaccucuggau

SEQ ID NO: 2794943 - RNA, 19 nt, Human
cuccugcccgccacacaga

SEQ ID NO: 2794944 - RNA, 14 nt, Human
cuccugcagcaugg

SEQ ID NO: 2794945 - RNA, 19 nt, Human
cuccugcagcauggucccu

SEQ ID NO: 2794946 - RNA, 14 nt, Human
cuccaucuccacuc

SEQ ID NO: 2794947 - RNA, 18 nt, Human
cucacuauguugcccagg

SEQ ID NO: 2794948 - RNA, 17 nt, Human
cucacuauccuacccca

SEQ ID NO: 2794949 - RNA, 13 nt, Human
cuccaugugggcu

SEQ ID NO: 2794950 - RNA, 17 nt, Human
cucccaaagugcuggga

SEQ ID NO: 2794951 - RNA, 22 nt, Human
cuccaugucucugagcauuaga

SEQ ID NO: 2794952 - RNA, 13 nt, Human
cuccaugucucug

SEQ ID NO: 2794953 - RNA, 12 nt, Human
cuccaucuuauu

SEQ ID NO: 2794954 - RNA, 18 nt, Human
cuccaugcuccucacugc

SEQ ID NO: 2794955 - RNA, 19 nt, Human
cuccaugcuccucacugcc

SEQ ID NO: 2794956 - RNA, 20 nt, Human
cuccaugcuccucacugccc

SEQ ID NO: 2794957 - RNA, 20 nt, Human
cuccauccuauccacugggc

SEQ ID NO: 2794958 - RNA, 16 nt, Human
cuccaucuccacucca

SEQ ID NO: 2794959 - RNA, 19 nt, Human
cuccaucucucauccucca

SEQ ID NO: 2794960 - RNA, 20 nt, Human
cuccaucucucauccuccag

SEQ ID NO: 2794961 - RNA, 21 nt, Human
cuccaucucucauccuccagu

SEQ ID NO: 2794962 - RNA, 18 nt, Human
cucccaaagugcugggau

SEQ ID NO: 2794963 - RNA, 22 nt, Human
cucccaaagugcugggauuaca

SEQ ID NO: 2794964 - RNA, 21 nt, Human
cucccaagacuucauuguccc

SEQ ID NO: 2794965 - RNA, 22 nt, Human
cucccaagacuucauugucccu

SEQ ID NO: 2794966 - RNA, 20 nt, Human
cucccaagcuaucuaaaguu

SEQ ID NO: 2794967 - RNA, 15 nt, Human
cucccaagcuggcug

SEQ ID NO: 2794968 - RNA, 16 nt, Human
cucccaagcuggcugg

SEQ ID NO: 2794969 - RNA, 17 nt, Human
cucccaagcuggcuggg

SEQ ID NO: 2794970 - RNA, 18 nt, Human
cucccaagcuggcugggg

SEQ ID NO: 2794971 - RNA, 19 nt, Human
cucccaagcuggcuggggu

SEQ ID NO: 2794972 - RNA, 16 nt, Human
cucccaaggagaacaa

SEQ ID NO: 2794973 - RNA, 17 nt, Human
cucccaaggagaacaaa

SEQ ID NO: 2794974 - RNA, 18 nt, Human
cucccaaggagaacaaau

SEQ ID NO: 2794975 - RNA, 15 nt, Human
cuccaugugccucuu

SEQ ID NO: 2794976 - RNA, 23 nt, Human
cucccagggccagggcccugcag

SEQ ID NO: 2794977 - RNA, 22 nt, Human
cucccagggccagggcccugca

SEQ ID NO: 2794978 - RNA, 14 nt, Human
cuccccugcccugg

SEQ ID NO: 2794979 - RNA, 12 nt, Human
cuccccugccuu

SEQ ID NO: 2794980 - RNA, 13 nt, Human
cuccccugccuug

SEQ ID NO: 2794981 - RNA, 14 nt, Human
cuccccugccuugc

SEQ ID NO: 2794982 - RNA, 15 nt, Human
cuccccugccuugcu

SEQ ID NO: 2794983 - RNA, 16 nt, Human
cuccccugcccugcug

SEQ ID NO: 2794984 - RNA, 15 nt, Human
cuccccugcccugcu

SEQ ID NO: 2794985 - RNA, 18 nt, Human
cuccccaggaauuuggga

SEQ ID NO: 2794986 - RNA, 21 nt, Human
cuccccaggaauuugggaccc

SEQ ID NO: 2794987 - RNA, 20 nt, Human
cuccccagcaagugagagcu

SEQ ID NO: 2794988 - RNA, 15 nt, Human
cuccccagcccuggc

SEQ ID NO: 2794989 - RNA, 16 nt, Human
cuccccagcccuggcu

SEQ ID NO: 2794990 - RNA, 19 nt, Human
cuccccagccccuagccca

SEQ ID NO: 2794991 - RNA, 21 nt, Human
cuccccagccccuagcccagg

SEQ ID NO: 2794992 - RNA, 22 nt, Human
cuccccagccccuagcccagga

SEQ ID NO: 2794993 - RNA, 13 nt, Human
cuccccagcccug

SEQ ID NO: 2794994 - RNA, 20 nt, Human
cuccccagaguuccccaugc

SEQ ID NO: 2794995 - RNA, 13 nt, Human
cuccccagccccu

SEQ ID NO: 2794996 - RNA, 15 nt, Human
cuccccagccccuag

SEQ ID NO: 2794997 - RNA, 17 nt, Human
cuccccagccccuagcc

SEQ ID NO: 2794998 - RNA, 12 nt, Human
cuccccagcaag

SEQ ID NO: 2794999 - RNA, 11 nt, Human
cuccccagaau

SEQ ID NO: 2795000 - RNA, 14 nt, Human
cuccccagaauuca

SEQ ID NO: 2795001 - RNA, 23 nt, Human
cuccccagaauucacgccucucc

SEQ ID NO: 2795002 - RNA, 19 nt, Human
cuccccaacccuagguucc

SEQ ID NO: 2795003 - RNA, 23 nt, Human
cuccccaacccuagguucccugu

SEQ ID NO: 2795004 - RNA, 21 nt, Human
cuccccacacuaaccuggguu

SEQ ID NO: 2795005 - RNA, 23 nt, Human
cuccccaagugguuuccacaugc

SEQ ID NO: 2795006 - RNA, 18 nt, Human
cuccccaaugagacuugc

SEQ ID NO: 2795007 - RNA, 20 nt, Human
cuccccaaugagacuugccu

SEQ ID NO: 2795008 - RNA, 21 nt, Human
cuccccaaugagacuugccuu

SEQ ID NO: 2795009 - RNA, 22 nt, Human
cuccccaaugagacuugccuuc

SEQ ID NO: 2795010 - RNA, 23 nt, Human
cuccccaaugagacuugccuucc

SEQ ID NO: 2795011 - RNA, 18 nt, Human
cuccccaaggaagagcca

SEQ ID NO: 2795012 - RNA, 11 nt, Human
cuccccaaccc

SEQ ID NO: 2795013 - RNA, 15 nt, Human
cuccccaacccccau

SEQ ID NO: 2795014 - RNA, 22 nt, Human
cuccccaacccccauucucauc

SEQ ID NO: 2795015 - RNA, 14 nt, Human
cucccauuuccuga

SEQ ID NO: 2795016 - RNA, 21 nt, Human
cucccaugaccauacugaggg

SEQ ID NO: 2795017 - RNA, 16 nt, Human
cucccaugaccauacu

SEQ ID NO: 2795018 - RNA, 12 nt, Human
cucccaugaagc

SEQ ID NO: 2795019 - RNA, 13 nt, Human
cucccaugaagcc

SEQ ID NO: 2795020 - RNA, 14 nt, Human
cucccaugaagccu

SEQ ID NO: 2795021 - RNA, 15 nt, Human
cucccaugaagccuu

SEQ ID NO: 2795022 - RNA, 16 nt, Human
cucccaugaagccuuu

SEQ ID NO: 2795023 - RNA, 17 nt, Human
cucccaugaagccuuuu

SEQ ID NO: 2795024 - RNA, 19 nt, Human
cucccaugaagccuuuuga

SEQ ID NO: 2795025 - RNA, 22 nt, Human
cucccaugaagccuuuugaaag

SEQ ID NO: 2795026 - RNA, 17 nt, Human
cucccgaguagcuggga

SEQ ID NO: 2795027 - RNA, 16 nt, Human
cucccgaguagcuggg

SEQ ID NO: 2795028 - RNA, 18 nt, Human
cucccgaauagcugggac

SEQ ID NO: 2795029 - RNA, 15 nt, Human
cucccgaguagcugg

SEQ ID NO: 2795030 - RNA, 13 nt, Human
cuccccugcugca

SEQ ID NO: 2795031 - RNA, 15 nt, Human
cuccccugcugcagg

SEQ ID NO: 2795032 - RNA, 16 nt, Human
cuccccugcugcaggg

SEQ ID NO: 2795033 - RNA, 16 nt, Human
cucccgaauagcuggg

SEQ ID NO: 2795034 - RNA, 17 nt, Human
cucccgaauagcuggga

SEQ ID NO: 2795035 - RNA, 20 nt, Human
cucccggcuaugggggcacu

SEQ ID NO: 2795036 - RNA, 21 nt, Human
cucccuagccagcacuuguau

SEQ ID NO: 2795037 - RNA, 18 nt, Human
cucccuaucccucacaca

SEQ ID NO: 2795038 - RNA, 18 nt, Human
cuccccugcugcaggggc

SEQ ID NO: 2795039 - RNA, 13 nt, Human
cucccgcugcugc

SEQ ID NO: 2795040 - RNA, 14 nt, Human
cucccgcugcugcu

SEQ ID NO: 2795041 - RNA, 15 nt, Human
cucccgcugcugcug

SEQ ID NO: 2795042 - RNA, 16 nt, Human
cucccgcugcugcugc

SEQ ID NO: 2795043 - RNA, 19 nt, Human
cucccggagguuggguggg

SEQ ID NO: 2795044 - RNA, 20 nt, Human
cucccggagguugggugggc

SEQ ID NO: 2795045 - RNA, 17 nt, Human
cucccgcugcugcugcu

SEQ ID NO: 2795046 - RNA, 17 nt, Human
cugagccuucagucuug

SEQ ID NO: 2795047 - RNA, 12 nt, Human
cugagccuucag

SEQ ID NO: 2795048 - RNA, 17 nt, Human
cugagccuggccagccu

SEQ ID NO: 2795049 - RNA, 19 nt, Human
cugagccuggcccauagaa

SEQ ID NO: 2795050 - RNA, 22 nt, Human
cugagccuggcccauagaaaca

SEQ ID NO: 2795051 - RNA, 15 nt, Human
cugagccuggccagc

SEQ ID NO: 2795052 - RNA, 14 nt, Human
cugagccuggccag

SEQ ID NO: 2795053 - RNA, 13 nt, Human
cugagccuggcca

SEQ ID NO: 2795054 - RNA, 14 nt, Human
cugagccucugcuc

SEQ ID NO: 2795055 - RNA, 15 nt, Human
cugagccucugcucc

SEQ ID NO: 2795056 - RNA, 16 nt, Human
cugagccucugcuccc

SEQ ID NO: 2795057 - RNA, 18 nt, Human
cugagccucugcucccca

SEQ ID NO: 2795058 - RNA, 12 nt, Human
cugagccucugc

SEQ ID NO: 2795059 - RNA, 22 nt, Human
cugagccucagucucccucccu

SEQ ID NO: 2795060 - RNA, 13 nt, Human
cugagcucacucg

SEQ ID NO: 2795061 - RNA, 19 nt, Human
cugagcgccuggauuucug

SEQ ID NO: 2795062 - RNA, 21 nt, Human
cugagcgccuggauuucuggu

SEQ ID NO: 2795063 - RNA, 15 nt, Human
cugagcgccuggguc

SEQ ID NO: 2795064 - RNA, 23 nt, Human
cugagcgugcuuuccaaaaccca

SEQ ID NO: 2795065 - RNA, 22 nt, Human
cugagcgccuggguccagggga

SEQ ID NO: 2795066 - RNA, 13 nt, Human
cugagcgggaggc

SEQ ID NO: 2795067 - RNA, 14 nt, Human
cugagcgggaggca

SEQ ID NO: 2795068 - RNA, 15 nt, Human
cugagcgggaggcag

SEQ ID NO: 2795069 - RNA, 16 nt, Human
cugagcgggaggcaga

SEQ ID NO: 2795070 - RNA, 18 nt, Human
cugagcgggaggcagagu

SEQ ID NO: 2795071 - RNA, 22 nt, Human
cugagcggugggggaggagggu

SEQ ID NO: 2795072 - RNA, 18 nt, Human
cugagcguccagaaaugg

SEQ ID NO: 2795073 - RNA, 11 nt, Human
cugagccaggc

SEQ ID NO: 2795074 - RNA, 12 nt, Human
cugagccaggcu

SEQ ID NO: 2795075 - RNA, 14 nt, Human
cugagccaggcuag

SEQ ID NO: 2795076 - RNA, 23 nt, Human
cugagccaggcuagcuggagccu

SEQ ID NO: 2795077 - RNA, 22 nt, Human
cugagccagugcuuuaauggca

SEQ ID NO: 2795078 - RNA, 23 nt, Human
cugagcccuacucccugcagaug

SEQ ID NO: 2795079 - RNA, 22 nt, Human
cugagcccuacucccugcagau

SEQ ID NO: 2795080 - RNA, 21 nt, Human
cugagcccuacucccugcaga

SEQ ID NO: 2795081 - RNA, 20 nt, Human
cugagcccuacucccugcag

SEQ ID NO: 2795082 - RNA, 18 nt, Human
cugagcccuacucccugc

SEQ ID NO: 2795083 - RNA, 16 nt, Human
cugagccagugucagg

SEQ ID NO: 2795084 - RNA, 22 nt, Human
cugagccagugucaggaggaag

SEQ ID NO: 2795085 - RNA, 15 nt, Human
cugagcccuggcagg

SEQ ID NO: 2795086 - RNA, 14 nt, Human
cugagcccuggcag

SEQ ID NO: 2795087 - RNA, 13 nt, Human
cugagcccuggca

SEQ ID NO: 2795088 - RNA, 12 nt, Human
cugagcccuggc

SEQ ID NO: 2795089 - RNA, 11 nt, Human
cugagcccugg

SEQ ID NO: 2795090 - RNA, 21 nt, Human
cugagccucagucucccuccc

SEQ ID NO: 2795091 - RNA, 16 nt, Human
cugagccucagucucc

SEQ ID NO: 2795092 - RNA, 14 nt, Human
cugagcugagccag

SEQ ID NO: 2795093 - RNA, 15 nt, Human
cugagcugagccagg

SEQ ID NO: 2795094 - RNA, 16 nt, Human
cugagcugagccaggc

SEQ ID NO: 2795095 - RNA, 17 nt, Human
cugagcugagccaggcu

SEQ ID NO: 2795096 - RNA, 20 nt, Human
cugaggcacaagaaucacuu

SEQ ID NO: 2795097 - RNA, 15 nt, Human
cugaggcaggaggau

SEQ ID NO: 2795098 - RNA, 15 nt, Human
cugaggcauccagca

SEQ ID NO: 2795099 - RNA, 20 nt, Human
cugaggcauccagcagucuc

SEQ ID NO: 2795100 - RNA, 22 nt, Human
cugaggcauccagcagucucug

SEQ ID NO: 2795101 - RNA, 14 nt, Human
cugacuuugcucuu

SEQ ID NO: 2795102 - RNA, 21 nt, Human
cugacuuggggagauggaguu

SEQ ID NO: 2795103 - RNA, 22 nt, Human
cugacuuggggagauggaguuc

SEQ ID NO: 2795104 - RNA, 13 nt, Human
cugacuuggggga

SEQ ID NO: 2795105 - RNA, 15 nt, Human
cugacuuguuugucu

SEQ ID NO: 2795106 - RNA, 17 nt, Human
cugacuuguuugucuuc

SEQ ID NO: 2795107 - RNA, 20 nt, Human
cugacuuguuugucuuccau

SEQ ID NO: 2795108 - RNA, 13 nt, Human
cugacuuuacacu

SEQ ID NO: 2795109 - RNA, 20 nt, Human
cugacuuggggagauggagu

SEQ ID NO: 2795110 - RNA, 17 nt, Human
cugagaacacugugaaa

SEQ ID NO: 2795111 - RNA, 22 nt, Human
cugagaacacugugaaaacauu

SEQ ID NO: 2795112 - RNA, 15 nt, Human
cugacuuugcucuuu

SEQ ID NO: 2795113 - RNA, 11 nt, Human
cugagaacacu

SEQ ID NO: 2795114 - RNA, 15 nt, Human
cugagaacacuguga

SEQ ID NO: 2795115 - RNA, 18 nt, Human
cugacuucuaauaucauu

SEQ ID NO: 2795116 - RNA, 16 nt, Human
cugagaaagcccuguc

SEQ ID NO: 2795117 - RNA, 15 nt, Human
cugagaauaagaaag

SEQ ID NO: 2795118 - RNA, 18 nt, Human
cugagaagaggagcccuc

SEQ ID NO: 2795119 - RNA, 21 nt, Human
cugagaagaggagcccucauc

SEQ ID NO: 2795120 - RNA, 22 nt, Human
cugagaagaggagcccucaucu

SEQ ID NO: 2795121 - RNA, 13 nt, Human
cugagaacuccug

SEQ ID NO: 2795122 - RNA, 14 nt, Human
cugagaacuccuga

SEQ ID NO: 2795123 - RNA, 15 nt, Human
cugagaacuccugac

SEQ ID NO: 2795124 - RNA, 16 nt, Human
cugagaacuccugacu

SEQ ID NO: 2795125 - RNA, 14 nt, Human
cugagaagcugcuc

SEQ ID NO: 2795126 - RNA, 15 nt, Human
cugagaagcugcucc

SEQ ID NO: 2795127 - RNA, 17 nt, Human
cugagaagcugcuccag

SEQ ID NO: 2795128 - RNA, 18 nt, Human
cugagaagcugcuccagg

SEQ ID NO: 2795129 - RNA, 21 nt, Human
cugagaagcugcuccaggccu

SEQ ID NO: 2795130 - RNA, 23 nt, Human
cugagaagcugcuccaggccugc

SEQ ID NO: 2795131 - RNA, 18 nt, Human
cugacuuaagcaaaagaa

SEQ ID NO: 2795132 - RNA, 19 nt, Human
cugacuuaagcaaaagaaa

SEQ ID NO: 2795133 - RNA, 20 nt, Human
cugacuuaagcaaaagaaaa

SEQ ID NO: 2795134 - RNA, 24 nt, Human
cugacuuaagcaaaagaaaaagau

SEQ ID NO: 2795135 - RNA, 20 nt, Human
cugacuucauggaauggaca

SEQ ID NO: 2795136 - RNA, 22 nt, Human
cugacuucauggaauggacauc

SEQ ID NO: 2795137 - RNA, 18 nt, Human
cugacucucugugaccug

SEQ ID NO: 2795138 - RNA, 16 nt, Human
cugacucucugugacc

SEQ ID NO: 2795139 - RNA, 21 nt, Human
cugacucugcccccugcuggc

SEQ ID NO: 2795140 - RNA, 20 nt, Human
cugacugucucccgggacua

SEQ ID NO: 2795141 - RNA, 19 nt, Human
cugacucugcccccugcug

SEQ ID NO: 2795142 - RNA, 20 nt, Human
cugacucugcccccugcugg

SEQ ID NO: 2795143 - RNA, 12 nt, Human
cugacucugccc

SEQ ID NO: 2795144 - RNA, 14 nt, Human
cugacucugccccc

SEQ ID NO: 2795145 - RNA, 15 nt, Human
cugacucugcccccu

SEQ ID NO: 2795146 - RNA, 14 nt, Human
cugacucucuguga

SEQ ID NO: 2795147 - RNA, 13 nt, Human
cugacucucugug

SEQ ID NO: 2795148 - RNA, 23 nt, Human
cugacuauuauguuguuagagaa

SEQ ID NO: 2795149 - RNA, 21 nt, Human
cugacaggcaaugcuggcugu

SEQ ID NO: 2795150 - RNA, 23 nt, Human
cugaagaguugccccgucucugu

SEQ ID NO: 2795151 - RNA, 15 nt, Human
cugacagucuugugc

SEQ ID NO: 2795152 - RNA, 13 nt, Human
cugacaucacagc

SEQ ID NO: 2795153 - RNA, 14 nt, Human
cugacaucacagca

SEQ ID NO: 2795154 - RNA, 15 nt, Human
cugacaucacagcag

SEQ ID NO: 2795155 - RNA, 16 nt, Human
cugacaucacagcagc

SEQ ID NO: 2795156 - RNA, 17 nt, Human
cugacaucacagcagcc

SEQ ID NO: 2795157 - RNA, 18 nt, Human
cugacaucacagcagccu

SEQ ID NO: 2795158 - RNA, 23 nt, Human
cugacaucacagcagccuccaac

SEQ ID NO: 2795159 - RNA, 14 nt, Human
cugacaguuuuucu

SEQ ID NO: 2795160 - RNA, 15 nt, Human
cugacaguuuuucug

SEQ ID NO: 2795161 - RNA, 16 nt, Human
cugacaguuuuucugu

SEQ ID NO: 2795162 - RNA, 21 nt, Human
cugacauuguuggccaaagcc

SEQ ID NO: 2795163 - RNA, 13 nt, Human
cugacauggcucu

SEQ ID NO: 2795164 - RNA, 14 nt, Human
cugacauggcucug

SEQ ID NO: 2795165 - RNA, 17 nt, Human
cugacauggcucuggac

SEQ ID NO: 2795166 - RNA, 18 nt, Human
cugacauggcucuggacu

SEQ ID NO: 2795167 - RNA, 19 nt, Human
cugacauggcucuggacuc

SEQ ID NO: 2795168 - RNA, 16 nt, Human
cugacaucuggaaucu

SEQ ID NO: 2795169 - RNA, 16 nt, Human
cugaagcaacauuuua

SEQ ID NO: 2795170 - RNA, 21 nt, Human
cugaagcaaggcgguggacuu

SEQ ID NO: 2795171 - RNA, 15 nt, Human
cugacagcaugugcc

SEQ ID NO: 2795172 - RNA, 18 nt, Human
cugacagcaugugcccuc

SEQ ID NO: 2795173 - RNA, 20 nt, Human
cugacagcaugugcccuccu

SEQ ID NO: 2795174 - RNA, 22 nt, Human
cugacagcaugugcccuccuga

SEQ ID NO: 2795175 - RNA, 20 nt, Human
cugacagccucccaccccca

SEQ ID NO: 2795176 - RNA, 17 nt, Human
cugacagccucccaccc

SEQ ID NO: 2795177 - RNA, 14 nt, Human
cugacagccuccca

SEQ ID NO: 2795178 - RNA, 13 nt, Human
cugacagccuccc

SEQ ID NO: 2795179 - RNA, 12 nt, Human
cugacagccucc

SEQ ID NO: 2795180 - RNA, 16 nt, Human
cugaagaugcagcuca

SEQ ID NO: 2795181 - RNA, 22 nt, Human
cugaagaugcagcucacuaccc

SEQ ID NO: 2795182 - RNA, 23 nt, Human
cugaagauauaacuauugcccag

SEQ ID NO: 2795183 - RNA, 15 nt, Human
cugaagaugcagcuc

SEQ ID NO: 2795184 - RNA, 14 nt, Human
cugaagaguccucu

SEQ ID NO: 2795185 - RNA, 16 nt, Human
cugaagaguccucuga

SEQ ID NO: 2795186 - RNA, 15 nt, Human
cugaagaguccucug

SEQ ID NO: 2795187 - RNA, 18 nt, Human
cugaagaguccucugaau

SEQ ID NO: 2795188 - RNA, 14 nt, Human
cugacccacugcuu

SEQ ID NO: 2795189 - RNA, 13 nt, Human
cugacccacugcu

SEQ ID NO: 2795190 - RNA, 22 nt, Human
cugacuagaagggccaguccug

SEQ ID NO: 2795191 - RNA, 15 nt, Human
cugacuacuuugccu

SEQ ID NO: 2795192 - RNA, 23 nt, Human
cugacuagaagggccaguccugc

SEQ ID NO: 2795193 - RNA, 12 nt, Human
cugacccacugc

SEQ ID NO: 2795194 - RNA, 14 nt, Human
cugaccaauugugc

SEQ ID NO: 2795195 - RNA, 16 nt, Human
cugaccaauugugcug

SEQ ID NO: 2795196 - RNA, 17 nt, Human
cugaccaauugugcugc

SEQ ID NO: 2795197 - RNA, 18 nt, Human
cugaccaauugugcugcc

SEQ ID NO: 2795198 - RNA, 19 nt, Human
cugaccaauugugcugcca

SEQ ID NO: 2795199 - RNA, 20 nt, Human
cugaccaauugugcugccau

SEQ ID NO: 2795200 - RNA, 21 nt, Human
cugaccaauugugcugccauu

SEQ ID NO: 2795201 - RNA, 22 nt, Human
cugaccaauugugcugccauuu

SEQ ID NO: 2795202 - RNA, 22 nt, Human
cugacauuguuggccaaagcca

SEQ ID NO: 2795203 - RNA, 21 nt, Human
cugacauuuucuuucaugggc

SEQ ID NO: 2795204 - RNA, 19 nt, Human
cugaccaacaguuccuuca

SEQ ID NO: 2795205 - RNA, 12 nt, Human
cugaccaacagg

SEQ ID NO: 2795206 - RNA, 13 nt, Human
cugaccaacaggc

SEQ ID NO: 2795207 - RNA, 14 nt, Human
cugaccaacaggcu

SEQ ID NO: 2795208 - RNA, 15 nt, Human
cugaccaacaggcug

SEQ ID NO: 2795209 - RNA, 18 nt, Human
cugaccaacaggcuguuc

SEQ ID NO: 2795210 - RNA, 19 nt, Human
cucuggcuagaggccagcc

SEQ ID NO: 2795211 - RNA, 16 nt, Human
cucuggcuagaggcca

SEQ ID NO: 2795212 - RNA, 22 nt, Human
cucuggcuagaggccagcccca

SEQ ID NO: 2795213 - RNA, 21 nt, Human
cucuggcuagaggccagcccc

SEQ ID NO: 2795214 - RNA, 20 nt, Human
cucuggcuagaggccagccc

SEQ ID NO: 2795215 - RNA, 16 nt, Human
cucuggcuccagcugg

SEQ ID NO: 2795216 - RNA, 15 nt, Human
cucuggcuccagcug

SEQ ID NO: 2795217 - RNA, 18 nt, Human
cucuggccucagccgacu

SEQ ID NO: 2795218 - RNA, 19 nt, Human
cucuggaugccugauugcc

SEQ ID NO: 2795219 - RNA, 12 nt, Human
cucucucccucu

SEQ ID NO: 2795220 - RNA, 22 nt, Human
cucuggacaggcauguucucug

SEQ ID NO: 2795221 - RNA, 16 nt, Human
cucuggacaggcaugu

SEQ ID NO: 2795222 - RNA, 14 nt, Human
cucuggacaggcau

SEQ ID NO: 2795223 - RNA, 13 nt, Human
cucuggagcccua

SEQ ID NO: 2795224 - RNA, 19 nt, Human
cucuggagggguguggcuc

SEQ ID NO: 2795225 - RNA, 20 nt, Human
cucuggagggguguggcucc

SEQ ID NO: 2795226 - RNA, 21 nt, Human
cucuggagggguguggcuccu

SEQ ID NO: 2795227 - RNA, 15 nt, Human
cucuggaugccugau

SEQ ID NO: 2795228 - RNA, 15 nt, Human
cucuggacaggcaug

SEQ ID NO: 2795229 - RNA, 13 nt, Human
cucugcuuucuga

SEQ ID NO: 2795230 - RNA, 18 nt, Human
cucugcuuucugauguug

SEQ ID NO: 2795231 - RNA, 18 nt, Human
cucugcuugccuggagac

SEQ ID NO: 2795232 - RNA, 17 nt, Human
cucugcuucucucaccu

SEQ ID NO: 2795233 - RNA, 18 nt, Human
cucugcuucuccaaggaa

SEQ ID NO: 2795234 - RNA, 12 nt, Human
cucugcuuccca

SEQ ID NO: 2795235 - RNA, 13 nt, Human
cucugcuucccag

SEQ ID NO: 2795236 - RNA, 14 nt, Human
cucugcuucccagg

SEQ ID NO: 2795237 - RNA, 23 nt, Human
cucugcuguacauauuugagacu

SEQ ID NO: 2795238 - RNA, 21 nt, Human
cucugccugaagucacacagu

SEQ ID NO: 2795239 - RNA, 16 nt, Human
cucucugaaccccucc

SEQ ID NO: 2795240 - RNA, 21 nt, Human
cucucucuucugcuccacccu

SEQ ID NO: 2795241 - RNA, 22 nt, Human
cucugccugaagucacacagug

SEQ ID NO: 2795242 - RNA, 18 nt, Human
cucucucuucugcuccac

SEQ ID NO: 2795243 - RNA, 12 nt, Human
cucucucuucug

SEQ ID NO: 2795244 - RNA, 15 nt, Human
cucucuccuuugcug

SEQ ID NO: 2795245 - RNA, 22 nt, Human
cucucuccuguuucccuucccu

SEQ ID NO: 2795246 - RNA, 15 nt, Human
cucugugucaggugg

SEQ ID NO: 2795247 - RNA, 13 nt, Human
cucuguggugucu

SEQ ID NO: 2795248 - RNA, 14 nt, Human
cucuguggugucug

SEQ ID NO: 2795249 - RNA, 16 nt, Human
cucuguggugucugcc

SEQ ID NO: 2795250 - RNA, 11 nt, Human
cucuguggaug

SEQ ID NO: 2795251 - RNA, 19 nt, Human
cucuguggcauugaaauga

SEQ ID NO: 2795252 - RNA, 22 nt, Human
cucugugcuuuuaaaugcauaa

SEQ ID NO: 2795253 - RNA, 18 nt, Human
cucugugcuguggaagca

SEQ ID NO: 2795254 - RNA, 13 nt, Human
cucugugugcucc

SEQ ID NO: 2795255 - RNA, 22 nt, Human
cucuguuacccaggguggagug

SEQ ID NO: 2795256 - RNA, 19 nt, Human
cucuguuauguacuguacu

SEQ ID NO: 2795257 - RNA, 20 nt, Human
cucuguuauguacuguacua

SEQ ID NO: 2795258 - RNA, 22 nt, Human
cucuuacgaauauuuucaguaa

SEQ ID NO: 2795259 - RNA, 13 nt, Human
cucuguuccaugu

SEQ ID NO: 2795260 - RNA, 15 nt, Human
cucuguuccaugucu

SEQ ID NO: 2795261 - RNA, 16 nt, Human
cucuguuccaugucuc

SEQ ID NO: 2795262 - RNA, 16 nt, Human
cucuuacuaauguaaa

SEQ ID NO: 2795263 - RNA, 17 nt, Human
cucuuacuaauguaaaa

SEQ ID NO: 2795264 - RNA, 18 nt, Human
cucuuacuacacugagga

SEQ ID NO: 2795265 - RNA, 14 nt, Human
cucuuacugcuaac

SEQ ID NO: 2795266 - RNA, 22 nt, Human
cucuuacuuuccuuuccccagc

SEQ ID NO: 2795267 - RNA, 23 nt, Human
cucuuacuuuccuuuccccagcc

SEQ ID NO: 2795268 - RNA, 14 nt, Human
cucuggcuuggccu

SEQ ID NO: 2795269 - RNA, 16 nt, Human
cucuggcuuggccuau

SEQ ID NO: 2795270 - RNA, 17 nt, Human
cucuggcuuggccuauc

SEQ ID NO: 2795271 - RNA, 23 nt, Human
cucugggaaaugagaaggcagcc

SEQ ID NO: 2795272 - RNA, 13 nt, Human
cucugggaaccuc

SEQ ID NO: 2795273 - RNA, 15 nt, Human
cucugggaaccuccc

SEQ ID NO: 2795274 - RNA, 17 nt, Human
cucugggaaccucccag

SEQ ID NO: 2795275 - RNA, 18 nt, Human
cucugggaaccucccaga

SEQ ID NO: 2795276 - RNA, 19 nt, Human
cucugggaaccucccagag

SEQ ID NO: 2795277 - RNA, 20 nt, Human
cucugggaaccucccagagg

SEQ ID NO: 2795278 - RNA, 19 nt, Human
cucugucuagcaugccaac

SEQ ID NO: 2795279 - RNA, 20 nt, Human
cucugucuagcaugccaaca

SEQ ID NO: 2795280 - RNA, 10 nt, Human
cucugucuca

SEQ ID NO: 2795281 - RNA, 14 nt, Human
cucugucucauccu

SEQ ID NO: 2795282 - RNA, 17 nt, Human
cucugucucauccuccu

SEQ ID NO: 2795283 - RNA, 18 nt, Human
cucugucucauccuccug

SEQ ID NO: 2795284 - RNA, 19 nt, Human
cucugucucauccuccugg

SEQ ID NO: 2795285 - RNA, 21 nt, Human
cucugucucauccuccuggaa

SEQ ID NO: 2795286 - RNA, 22 nt, Human
cucugucucauccuccuggaac

SEQ ID NO: 2795287 - RNA, 20 nt, Human
cucugggaaaugagaaggca

SEQ ID NO: 2795288 - RNA, 22 nt, Human
cucugggaaaugagaaggcagc

SEQ ID NO: 2795289 - RNA, 22 nt, Human
cucugucucagacuuuuguaca

SEQ ID NO: 2795290 - RNA, 23 nt, Human
cucugucucagacuuuuguacau

SEQ ID NO: 2795291 - RNA, 22 nt, Human
cucugucugaguaagaaacaga

SEQ ID NO: 2795292 - RNA, 14 nt, Human
cucugucugcccuu

SEQ ID NO: 2795293 - RNA, 17 nt, Human
cucugucugcccuucac

SEQ ID NO: 2795294 - RNA, 19 nt, Human
cucuggcuguaaggcucua

SEQ ID NO: 2795295 - RNA, 20 nt, Human
cucuggcuguaaggcucuag

SEQ ID NO: 2795296 - RNA, 21 nt, Human
cucuggcuguaaggcucuaga

SEQ ID NO: 2795297 - RNA, 22 nt, Human
cucuggcuguaaggcucuagau

SEQ ID NO: 2795298 - RNA, 19 nt, Human
cucuggcugacuaaauuug

SEQ ID NO: 2795299 - RNA, 12 nt, Human
cucuggcucuca

SEQ ID NO: 2795300 - RNA, 13 nt, Human
cucuggcucucau

SEQ ID NO: 2795301 - RNA, 16 nt, Human
cucuggcucucauggg

SEQ ID NO: 2795302 - RNA, 22 nt, Human
cucuggcuccagcuggccggga

SEQ ID NO: 2795303 - RNA, 15 nt, Human
cucugugcuguggaa

SEQ ID NO: 2795304 - RNA, 14 nt, Human
cucugugcugugga

SEQ ID NO: 2795305 - RNA, 15 nt, Human
cucugugccuucuuu

SEQ ID NO: 2795306 - RNA, 16 nt, Human
cucugugccuucuuuu

SEQ ID NO: 2795307 - RNA, 14 nt, Human
cucugugcugacau

SEQ ID NO: 2795308 - RNA, 22 nt, Human
cucugucugcccuucaccccag

SEQ ID NO: 2795309 - RNA, 21 nt, Human
cucuucuuuauacuguaauuu

SEQ ID NO: 2795310 - RNA, 22 nt, Human
cucuucuuuauacuguaauuua

SEQ ID NO: 2795311 - RNA, 16 nt, Human
cucuucuuuuggcuuc

SEQ ID NO: 2795312 - RNA, 19 nt, Human
cucuucuuuuggcuuccau

SEQ ID NO: 2795313 - RNA, 22 nt, Human
cucuugaaaaaugcccauuugc

SEQ ID NO: 2795314 - RNA, 24 nt, Human
cucuucuuuauacuguaauuuagu

SEQ ID NO: 2795315 - RNA, 20 nt, Human
cucuucuuucagacuugcca

SEQ ID NO: 2795316 - RNA, 22 nt, Human
cucuucuuucagacuugccaug

SEQ ID NO: 2795317 - RNA, 19 nt, Human
cucuuggguucaagcgauu

SEQ ID NO: 2795318 - RNA, 15 nt, Human
cucuugaacuccuga

SEQ ID NO: 2795319 - RNA, 21 nt, Human
cucuuggguucaagcgauucu

SEQ ID NO: 2795320 - RNA, 19 nt, Human
cucuuggguucaagugauu

SEQ ID NO: 2795321 - RNA, 16 nt, Human
cucuuccuauuuuugu

SEQ ID NO: 2795322 - RNA, 19 nt, Human
cucuucuuaacuuaaauuu

SEQ ID NO: 2795323 - RNA, 18 nt, Human
cucuucuggguuccuucc

SEQ ID NO: 2795324 - RNA, 20 nt, Human
cucuuccgugacgucacugg

SEQ ID NO: 2795325 - RNA, 22 nt, Human
cucuucccugcgccugugaugc

SEQ ID NO: 2795326 - RNA, 14 nt, Human
cucuucccuucaac

SEQ ID NO: 2795327 - RNA, 14 nt, Human
cucuucccuuuccc

SEQ ID NO: 2795328 - RNA, 17 nt, Human
cucuucccuuuccccag

SEQ ID NO: 2795329 - RNA, 21 nt, Human
cucuucccuuuccccagcauc

SEQ ID NO: 2795330 - RNA, 13 nt, Human
cucuuuauagugc

SEQ ID NO: 2795331 - RNA, 21 nt, Human
cucuuuaagaguuaguuucuu

SEQ ID NO: 2795332 - RNA, 19 nt, Human
cucuuuaagggcaugccuu

SEQ ID NO: 2795333 - RNA, 20 nt, Human
cucuuuaagggcaugccuug

SEQ ID NO: 2795334 - RNA, 21 nt, Human
cucuuuaagggcaugccuugu

SEQ ID NO: 2795335 - RNA, 22 nt, Human
cucuuuaagggcaugccuugug

SEQ ID NO: 2795336 - RNA, 23 nt, Human
cucuuuaaugucacaggcagguc

SEQ ID NO: 2795337 - RNA, 22 nt, Human
cucuuuaaugucacaggcaggu

SEQ ID NO: 2795338 - RNA, 21 nt, Human
cucuuuaaugucacaggcagg

SEQ ID NO: 2795339 - RNA, 20 nt, Human
cucuuuaaugucacaggcag

SEQ ID NO: 2795340 - RNA, 18 nt, Human
cucuuuaaugucacaggc

SEQ ID NO: 2795341 - RNA, 17 nt, Human
cucuuuaaaucaagucc

SEQ ID NO: 2795342 - RNA, 13 nt, Human
cucuuuaaaaaca

SEQ ID NO: 2795343 - RNA, 12 nt, Human
cucuuuaaaaca

SEQ ID NO: 2795344 - RNA, 14 nt, Human
cucuuuaaaacaaa

SEQ ID NO: 2795345 - RNA, 15 nt, Human
cucuuuaaaacaaaa

SEQ ID NO: 2795346 - RNA, 17 nt, Human
cucuuuaaaacaaaaca

SEQ ID NO: 2795347 - RNA, 16 nt, Human
cucuuguuuucaguuu

SEQ ID NO: 2795348 - RNA, 13 nt, Human
cucuuguuuuguu

SEQ ID NO: 2795349 - RNA, 15 nt, Human
cucuuguuuuguuug

SEQ ID NO: 2795350 - RNA, 17 nt, Human
cucuuguuuuguuuguc

SEQ ID NO: 2795351 - RNA, 18 nt, Human
cucuuguuuuguuugucu

SEQ ID NO: 2795352 - RNA, 20 nt, Human
cucuuguuuuguuugucucu

SEQ ID NO: 2795353 - RNA, 19 nt, Human
cucuuguuuuuauuaauuu

SEQ ID NO: 2795354 - RNA, 20 nt, Human
cucuuguuuuuauuaauuua

SEQ ID NO: 2795355 - RNA, 21 nt, Human
cucuuguuuuuauuaauuuau

SEQ ID NO: 2795356 - RNA, 23 nt, Human
cucuuguuuuuauuaauuuauau

SEQ ID NO: 2795357 - RNA, 17 nt, Human
cucuuguugaguucugu

SEQ ID NO: 2795358 - RNA, 19 nt, Human
cugaacugauggguuucuc

SEQ ID NO: 2795359 - RNA, 15 nt, Human
cugaacuguguguaa

SEQ ID NO: 2795360 - RNA, 20 nt, Human
cugaacuguguguaauuguu

SEQ ID NO: 2795361 - RNA, 21 nt, Human
cugaacuguuaagaaaucugu

SEQ ID NO: 2795362 - RNA, 15 nt, Human
cugaagaauuaagau

SEQ ID NO: 2795363 - RNA, 17 nt, Human
cugaagaauuaagauac

SEQ ID NO: 2795364 - RNA, 20 nt, Human
cugaagaauuaagauacaaa

SEQ ID NO: 2795365 - RNA, 23 nt, Human
cugaagacgccgucuccauggca

SEQ ID NO: 2795366 - RNA, 17 nt, Human
cugaacucugacaacag

SEQ ID NO: 2795367 - RNA, 16 nt, Human
cugaacucugacaaca

SEQ ID NO: 2795368 - RNA, 13 nt, Human
cugaacucacuuu

SEQ ID NO: 2795369 - RNA, 14 nt, Human
cugaaauuucagau

SEQ ID NO: 2795370 - RNA, 14 nt, Human
cugaaauuucacca

SEQ ID NO: 2795371 - RNA, 13 nt, Human
cugaaauuucaga

SEQ ID NO: 2795372 - RNA, 18 nt, Human
cugaaaugaaacaaauaa

SEQ ID NO: 2795373 - RNA, 19 nt, Human
cugaaaugaaacaaauaau

SEQ ID NO: 2795374 - RNA, 22 nt, Human
cugaaaugaaacaaauaaucac

SEQ ID NO: 2795375 - RNA, 14 nt, Human
cugaaaucuccuuu

SEQ ID NO: 2795376 - RNA, 11 nt, Human
cucuuguugag

SEQ ID NO: 2795377 - RNA, 22 nt, Human
cucuuugaaauagucuguguga

SEQ ID NO: 2795378 - RNA, 13 nt, Human
cucuuuauuccua

SEQ ID NO: 2795379 - RNA, 14 nt, Human
cucuuuauuccuag

SEQ ID NO: 2795380 - RNA, 21 nt, Human
cucuuuauuccuaguugguga

SEQ ID NO: 2795381 - RNA, 19 nt, Human
cucuuucugucccuucugu

SEQ ID NO: 2795382 - RNA, 21 nt, Human
cucuuucuuauaauacucugu

SEQ ID NO: 2795383 - RNA, 23 nt, Human
cucuuucuuauaauacucuguug

SEQ ID NO: 2795384 - RNA, 13 nt, Human
cucuuucuuccuu

SEQ ID NO: 2795385 - RNA, 14 nt, Human
cucuuucuuccuuu

SEQ ID NO: 2795386 - RNA, 17 nt, Human
cucuuucuuccuuuacu

SEQ ID NO: 2795387 - RNA, 23 nt, Human
cucuuucuuccuuuacuuucccu

SEQ ID NO: 2795388 - RNA, 15 nt, Human
cucuuucuguauaua

SEQ ID NO: 2795389 - RNA, 15 nt, Human
cucuuucgucacccu

SEQ ID NO: 2795390 - RNA, 16 nt, Human
cucuuucgucacccuu

SEQ ID NO: 2795391 - RNA, 18 nt, Human
cucuuucgucacccuugg

SEQ ID NO: 2795392 - RNA, 19 nt, Human
cucuuucgucacccuugga

SEQ ID NO: 2795393 - RNA, 16 nt, Human
cucuuucuaaugcuga

SEQ ID NO: 2795394 - RNA, 14 nt, Human
cucuuucuguauau

SEQ ID NO: 2795395 - RNA, 20 nt, Human
cugaaagccuuagggaagcu

SEQ ID NO: 2795396 - RNA, 18 nt, Human
cugaaauaggaaacaagu

SEQ ID NO: 2795397 - RNA, 16 nt, Human
cugaaauaggaaacaa

SEQ ID NO: 2795398 - RNA, 22 nt, Human
cugaaauagacccacaagaggc

SEQ ID NO: 2795399 - RNA, 17 nt, Human
cugaaaggaaagugcuu

SEQ ID NO: 2795400 - RNA, 12 nt, Human
cugcccucuccu

SEQ ID NO: 2795401 - RNA, 16 nt, Human
cugccugaagucacac

SEQ ID NO: 2795402 - RNA, 18 nt, Human
cugccugaagucacacag

SEQ ID NO: 2795403 - RNA, 19 nt, Human
cugccugaagucacacagu

SEQ ID NO: 2795404 - RNA, 20 nt, Human
cugccugcaauauuugaauu

SEQ ID NO: 2795405 - RNA, 20 nt, Human
cugccugcaguacuuuaccu

SEQ ID NO: 2795406 - RNA, 21 nt, Human
cugccugcaguacuuuaccuc

SEQ ID NO: 2795407 - RNA, 23 nt, Human
cugccugccgguaaacacgccug

SEQ ID NO: 2795408 - RNA, 15 nt, Human
cugccugcgucuucc

SEQ ID NO: 2795409 - RNA, 17 nt, Human
cugccugcgucuuccgc

SEQ ID NO: 2795410 - RNA, 12 nt, Human
cugccugcccac

SEQ ID NO: 2795411 - RNA, 12 nt, Human
cugccugccaug

SEQ ID NO: 2795412 - RNA, 17 nt, Human
cugccugccauguaccu

SEQ ID NO: 2795413 - RNA, 22 nt, Human
cugccugccauguaccuccccu

SEQ ID NO: 2795414 - RNA, 23 nt, Human
cugcgguccacccaggagccccg

SEQ ID NO: 2795415 - RNA, 23 nt, Human
cugcgggucacaggagggagggg

SEQ ID NO: 2795416 - RNA, 22 nt, Human
cugcgggucacaggagggaggg

SEQ ID NO: 2795417 - RNA, 21 nt, Human
cugcgggucacaggagggagg

SEQ ID NO: 2795418 - RNA, 15 nt, Human
cugcgggucacagga

SEQ ID NO: 2795419 - RNA, 12 nt, Human
cugcgccucagg

SEQ ID NO: 2795420 - RNA, 13 nt, Human
cugcgccucaggc

SEQ ID NO: 2795421 - RNA, 17 nt, Human
cugcgcccuuaccuucc

SEQ ID NO: 2795422 - RNA, 18 nt, Human
cugcgcccuuaccuuccc

SEQ ID NO: 2795423 - RNA, 18 nt, Human
cugccuucccaugaaucu

SEQ ID NO: 2795424 - RNA, 12 nt, Human
cugccugcuuug

SEQ ID NO: 2795425 - RNA, 13 nt, Human
cugccugcuuugg

SEQ ID NO: 2795426 - RNA, 20 nt, Human
cugccuucgaggucagagga

SEQ ID NO: 2795427 - RNA, 18 nt, Human
cugcgcccaguccuucca

SEQ ID NO: 2795428 - RNA, 19 nt, Human
cugcgcccaguccuuccac

SEQ ID NO: 2795429 - RNA, 23 nt, Human
cugcgcccaguccuuccaccucg

SEQ ID NO: 2795430 - RNA, 17 nt, Human
cugcgauuuugccugug

SEQ ID NO: 2795431 - RNA, 21 nt, Human
cugcucuauuccaaaaagguu

SEQ ID NO: 2795432 - RNA, 20 nt, Human
cugcucuagaugagcugggc

SEQ ID NO: 2795433 - RNA, 22 nt, Human
cugcucuagaugagcugggccg

SEQ ID NO: 2795434 - RNA, 15 nt, Human
cugcucuccgaccag

SEQ ID NO: 2795435 - RNA, 20 nt, Human
cugcuccucuccccagcaag

SEQ ID NO: 2795436 - RNA, 19 nt, Human
cugcuccucuccccagcaa

SEQ ID NO: 2795437 - RNA, 23 nt, Human
cugcuccucuccccagcaaguga

SEQ ID NO: 2795438 - RNA, 16 nt, Human
cugcuccccaggggag

SEQ ID NO: 2795439 - RNA, 19 nt, Human
cugcuccccagcccuggcu

SEQ ID NO: 2795440 - RNA, 20 nt, Human
cugcuccccagcccuggcuc

SEQ ID NO: 2795441 - RNA, 16 nt, Human
cugcuccccagcccug

SEQ ID NO: 2795442 - RNA, 17 nt, Human
cugcuccccagcccugg

SEQ ID NO: 2795443 - RNA, 18 nt, Human
cugcuccccagcccuggc

SEQ ID NO: 2795444 - RNA, 21 nt, Human
cugcugccugcccgcacagca

SEQ ID NO: 2795445 - RNA, 22 nt, Human
cugcugccugcccgcacagcag

SEQ ID NO: 2795446 - RNA, 21 nt, Human
cugcugccgccucccagccug

SEQ ID NO: 2795447 - RNA, 20 nt, Human
cugcugccgccucccagccu

SEQ ID NO: 2795448 - RNA, 21 nt, Human
cugcugcaggggcucuggaga

SEQ ID NO: 2795449 - RNA, 20 nt, Human
cugcugcaggggcucuggag

SEQ ID NO: 2795450 - RNA, 12 nt, Human
cugcucugguua

SEQ ID NO: 2795451 - RNA, 19 nt, Human
cugcucuugaacuccugac

SEQ ID NO: 2795452 - RNA, 18 nt, Human
cugcucuugaacuccuga

SEQ ID NO: 2795453 - RNA, 16 nt, Human
cugcucuugaacuccu

SEQ ID NO: 2795454 - RNA, 20 nt, Human
cugcucuccaagucucagug

SEQ ID NO: 2795455 - RNA, 20 nt, Human
cugcucugaugaagaggagu

SEQ ID NO: 2795456 - RNA, 20 nt, Human
cugcuugaguucccagaugg

SEQ ID NO: 2795457 - RNA, 21 nt, Human
cugcuugauaggaauucaucu

SEQ ID NO: 2795458 - RNA, 16 nt, Human
cugcuugaugaagcaa

SEQ ID NO: 2795459 - RNA, 17 nt, Human
cugcuugaugaagcaag

SEQ ID NO: 2795460 - RNA, 18 nt, Human
cugcuugaugaagcaagg

SEQ ID NO: 2795461 - RNA, 20 nt, Human
cugcuugaugaagcaaggaa

SEQ ID NO: 2795462 - RNA, 21 nt, Human
cugcuugaugaagcaaggaag

SEQ ID NO: 2795463 - RNA, 14 nt, Human
cugcuuucuuugau

SEQ ID NO: 2795464 - RNA, 15 nt, Human
cugcuuucuuugauu

SEQ ID NO: 2795465 - RNA, 16 nt, Human
cugcuuuagagcuagg

SEQ ID NO: 2795466 - RNA, 17 nt, Human
cugcuuuaaagggccug

SEQ ID NO: 2795467 - RNA, 19 nt, Human
cugcuuuaaagggccugcc

SEQ ID NO: 2795468 - RNA, 20 nt, Human
cugcuuuaaagggccugccu

SEQ ID NO: 2795469 - RNA, 21 nt, Human
cugcuuuaaagggccugccug

SEQ ID NO: 2795470 - RNA, 22 nt, Human
cugcuuuaaagggccugccugg

SEQ ID NO: 2795471 - RNA, 15 nt, Human
cugcuuuuggucugu

SEQ ID NO: 2795472 - RNA, 22 nt, Human
cugcuuugggauuuaauuucca

SEQ ID NO: 2795473 - RNA, 23 nt, Human
cugcuuugggauuuaauuuccag

SEQ ID NO: 2795474 - RNA, 16 nt, Human
cugcuuugggcugccc

SEQ ID NO: 2795475 - RNA, 13 nt, Human
cugcuuuggaaau

SEQ ID NO: 2795476 - RNA, 17 nt, Human
cugcuuuuggucugugu

SEQ ID NO: 2795477 - RNA, 17 nt, Human
cuggaagcuaauuugca

SEQ ID NO: 2795478 - RNA, 14 nt, Human
cuggaagcccugga

SEQ ID NO: 2795479 - RNA, 16 nt, Human
cuggaagcccuggaga

SEQ ID NO: 2795480 - RNA, 17 nt, Human
cuggaagcccuggagac

SEQ ID NO: 2795481 - RNA, 13 nt, Human
cugcuuuuggccu

SEQ ID NO: 2795482 - RNA, 14 nt, Human
cugcuuuuggccug

SEQ ID NO: 2795483 - RNA, 15 nt, Human
cugcuuuuggccugg

SEQ ID NO: 2795484 - RNA, 19 nt, Human
cuggaaggggaagggacac

SEQ ID NO: 2795485 - RNA, 13 nt, Human
cuggaagggccaa

SEQ ID NO: 2795486 - RNA, 19 nt, Human
cuggaaguccaauguggca

SEQ ID NO: 2795487 - RNA, 16 nt, Human
cuggaaguccaaugug

SEQ ID NO: 2795488 - RNA, 14 nt, Human
cuggaagcuuuguc

SEQ ID NO: 2795489 - RNA, 15 nt, Human
cuggaagcuuugucc

SEQ ID NO: 2795490 - RNA, 18 nt, Human
cuggaagcuuuguccccu

SEQ ID NO: 2795491 - RNA, 20 nt, Human
cuggaagcuuuguccccugc

SEQ ID NO: 2795492 - RNA, 21 nt, Human
cuggaagcuuuguccccugcu

SEQ ID NO: 2795493 - RNA, 22 nt, Human
cuggaagcuuuguccccugcuu

SEQ ID NO: 2795494 - RNA, 22 nt, Human
cuggaagcuaauuugcauuaaa

SEQ ID NO: 2795495 - RNA, 19 nt, Human
cuggaagcuaauuugcauu

SEQ ID NO: 2795496 - RNA, 18 nt, Human
cuggaagcuaauuugcau

SEQ ID NO: 2795497 - RNA, 15 nt, Human
cugcuucugaaugug

SEQ ID NO: 2795498 - RNA, 19 nt, Human
cugcuucugaaugugcuga

SEQ ID NO: 2795499 - RNA, 20 nt, Human
cugcuugagaauauugaagu

SEQ ID NO: 2795500 - RNA, 20 nt, Human
cugcuugagcucaggaguuc

SEQ ID NO: 2795501 - RNA, 17 nt, Human
cugcugucccucccccu

SEQ ID NO: 2795502 - RNA, 18 nt, Human
cugcuguccccuuggcag

SEQ ID NO: 2795503 - RNA, 13 nt, Human
cugcuucuccaag

SEQ ID NO: 2795504 - RNA, 16 nt, Human
cugcuucuccaaggaa

SEQ ID NO: 2795505 - RNA, 15 nt, Human
cugcugucaccucuc

SEQ ID NO: 2795506 - RNA, 16 nt, Human
cugcugucaccucucc

SEQ ID NO: 2795507 - RNA, 18 nt, Human
cugcugucaccucuccca

SEQ ID NO: 2795508 - RNA, 19 nt, Human
cugcugucaccucucccac

SEQ ID NO: 2795509 - RNA, 20 nt, Human
cugcugucaccucucccacg

SEQ ID NO: 2795510 - RNA, 21 nt, Human
cugcugucaccucucccacgg

SEQ ID NO: 2795511 - RNA, 15 nt, Human
cugcugcaguagggg

SEQ ID NO: 2795512 - RNA, 15 nt, Human
cugcuguaagaaauc

SEQ ID NO: 2795513 - RNA, 20 nt, Human
cugcuggucacagccuccuc

SEQ ID NO: 2795514 - RNA, 17 nt, Human
cugcuggucacagccuc

SEQ ID NO: 2795515 - RNA, 18 nt, Human
cugcuggucacagccucc

SEQ ID NO: 2795516 - RNA, 15 nt, Human
cugcuggucacagcc

SEQ ID NO: 2795517 - RNA, 16 nt, Human
cugcuggucacagccu

SEQ ID NO: 2795518 - RNA, 18 nt, Human
cugcugggggcaacuggc

SEQ ID NO: 2795519 - RNA, 20 nt, Human
cugcugggggcaacuggcca

SEQ ID NO: 2795520 - RNA, 17 nt, Human
cugcuggggccucagac

SEQ ID NO: 2795521 - RNA, 23 nt, Human
cugcuggggccucagacgagacc

SEQ ID NO: 2795522 - RNA, 15 nt, Human
cugcugcugcgcccu

SEQ ID NO: 2795523 - RNA, 16 nt, Human
cugcugcugcgcccuu

SEQ ID NO: 2795524 - RNA, 20 nt, Human
cugcugcugcgcccuuaccu

SEQ ID NO: 2795525 - RNA, 16 nt, Human
cugcugcugcugcgcc

SEQ ID NO: 2795526 - RNA, 14 nt, Human
cugcugcugccugg

SEQ ID NO: 2795527 - RNA, 15 nt, Human
cugcugcugccuggc

SEQ ID NO: 2795528 - RNA, 17 nt, Human
cugcugcugccuggcca

SEQ ID NO: 2795529 - RNA, 11 nt, Human
cugcugccugg

SEQ ID NO: 2795530 - RNA, 12 nt, Human
cugcugccuggc

SEQ ID NO: 2795531 - RNA, 14 nt, Human
cugcugccuggcca

SEQ ID NO: 2795532 - RNA, 16 nt, Human
cugcugccuggccacu

SEQ ID NO: 2795533 - RNA, 19 nt, Human
cugcugccuggccacugcu

SEQ ID NO: 2795534 - RNA, 21 nt, Human
cugcugccuggccacugcucc

SEQ ID NO: 2795535 - RNA, 23 nt, Human
cugcugccuggccacugcucccu

SEQ ID NO: 2795536 - RNA, 23 nt, Human
cugcugccuucugacggcccugc

SEQ ID NO: 2795537 - RNA, 13 nt, Human
cugcuggcugccu

SEQ ID NO: 2795538 - RNA, 14 nt, Human
cugcuggcugccuu

SEQ ID NO: 2795539 - RNA, 15 nt, Human
cugcuggcugccuua

SEQ ID NO: 2795540 - RNA, 17 nt, Human
cugcugggacuggccag

SEQ ID NO: 2795541 - RNA, 16 nt, Human
cugcuggcuugcagug

SEQ ID NO: 2795542 - RNA, 14 nt, Human
cugcuggcuugcag

SEQ ID NO: 2795543 - RNA, 12 nt, Human
cugcuggcugcc

SEQ ID NO: 2795544 - RNA, 19 nt, Human
cugcugggacuggccaggu

SEQ ID NO: 2795545 - RNA, 19 nt, Human
cugcugggauggugggcuu

SEQ ID NO: 2795546 - RNA, 23 nt, Human
cugcugggauggugggcuucagg

SEQ ID NO: 2795547 - RNA, 16 nt, Human
cugcacuggggagccc

SEQ ID NO: 2795548 - RNA, 22 nt, Human
cugcacuggggagcccgucuca

SEQ ID NO: 2795549 - RNA, 14 nt, Human
cugcagacacgccu

SEQ ID NO: 2795550 - RNA, 13 nt, Human
cugcacuuacaau

SEQ ID NO: 2795551 - RNA, 21 nt, Human
cugcacuuacaaucccaccuu

SEQ ID NO: 2795552 - RNA, 13 nt, Human
cugcagacugcua

SEQ ID NO: 2795553 - RNA, 14 nt, Human
cugcagacugcuag

SEQ ID NO: 2795554 - RNA, 21 nt, Human
cugcagaggggaaaccagugu

SEQ ID NO: 2795555 - RNA, 23 nt, Human
cugcacccuggggccuggaccug

SEQ ID NO: 2795556 - RNA, 13 nt, Human
cugcacccuucuu

SEQ ID NO: 2795557 - RNA, 14 nt, Human
cugcacccuucuuu

SEQ ID NO: 2795558 - RNA, 17 nt, Human
cugcacccuucuuuucu

SEQ ID NO: 2795559 - RNA, 18 nt, Human
cugcacccuucuuuucuc

SEQ ID NO: 2795560 - RNA, 19 nt, Human
cugcacccuucuuuucuca

SEQ ID NO: 2795561 - RNA, 20 nt, Human
cugcacccuucuuuucucau

SEQ ID NO: 2795562 - RNA, 22 nt, Human
cugcacccuucuuuucucaugu

SEQ ID NO: 2795563 - RNA, 18 nt, Human
cugcaccgggccacagag

SEQ ID NO: 2795564 - RNA, 21 nt, Human
cugaggccccuucuagguggc

SEQ ID NO: 2795565 - RNA, 16 nt, Human
cugaggcccugcccaa

SEQ ID NO: 2795566 - RNA, 16 nt, Human
cugcacccuggggccu

SEQ ID NO: 2795567 - RNA, 21 nt, Human
cugcacccuggggccuggacc

SEQ ID NO: 2795568 - RNA, 22 nt, Human
cugcacccuggggccuggaccu

SEQ ID NO: 2795569 - RNA, 15 nt, Human
cugcaccgggccaca

SEQ ID NO: 2795570 - RNA, 14 nt, Human
cugcaccgggccac

SEQ ID NO: 2795571 - RNA, 23 nt, Human
cugcagauuugggcuggaacaga

SEQ ID NO: 2795572 - RNA, 18 nt, Human
cugcagauuugggcugga

SEQ ID NO: 2795573 - RNA, 19 nt, Human
cugcagauuugggcuggaa

SEQ ID NO: 2795574 - RNA, 20 nt, Human
cugcagauuugggcuggaac

SEQ ID NO: 2795575 - RNA, 14 nt, Human
cugcagcacggaca

SEQ ID NO: 2795576 - RNA, 19 nt, Human
cugcagcacggacaauaaa

SEQ ID NO: 2795577 - RNA, 20 nt, Human
cugcagcacggacaauaaac

SEQ ID NO: 2795578 - RNA, 22 nt, Human
cugcagcacggacaauaaaccu

SEQ ID NO: 2795579 - RNA, 20 nt, Human
cugcacuccaggcuggguga

SEQ ID NO: 2795580 - RNA, 18 nt, Human
cugcagcaaucuuugaaa

SEQ ID NO: 2795581 - RNA, 20 nt, Human
cugcagcauggucccugccu

SEQ ID NO: 2795582 - RNA, 23 nt, Human
cugcagcauggucccugccuuag

SEQ ID NO: 2795583 - RNA, 13 nt, Human
cugcagcaggagu

SEQ ID NO: 2795584 - RNA, 20 nt, Human
cugcagcaggaguggugcag

SEQ ID NO: 2795585 - RNA, 21 nt, Human
cugcagcaggaguggugcaga

SEQ ID NO: 2795586 - RNA, 15 nt, Human
cugcaggggcucugg

SEQ ID NO: 2795587 - RNA, 14 nt, Human
cugcaggggcucug

SEQ ID NO: 2795588 - RNA, 16 nt, Human
cugcaggggcucugga

SEQ ID NO: 2795589 - RNA, 17 nt, Human
cugcaggggcucuggag

SEQ ID NO: 2795590 - RNA, 23 nt, Human
cugcagggggugugucugcucag

SEQ ID NO: 2795591 - RNA, 23 nt, Human
cugcagggguuauguggaagugu

SEQ ID NO: 2795592 - RNA, 21 nt, Human
cugcaggggcucuggagagaa

SEQ ID NO: 2795593 - RNA, 20 nt, Human
cugcagggggugugucugcu

SEQ ID NO: 2795594 - RNA, 17 nt, Human
cugcagggggugugucu

SEQ ID NO: 2795595 - RNA, 18 nt, Human
cugcaggggcucuggaga

SEQ ID NO: 2795596 - RNA, 19 nt, Human
cugcaggggcucuggagag

SEQ ID NO: 2795597 - RNA, 22 nt, Human
cugcaggggcucuggagagaaa

SEQ ID NO: 2795598 - RNA, 20 nt, Human
cugcaggggguggacaaacu

SEQ ID NO: 2795599 - RNA, 14 nt, Human
cugcaguuuuucag

SEQ ID NO: 2795600 - RNA, 15 nt, Human
cugcaguuuuucagg

SEQ ID NO: 2795601 - RNA, 18 nt, Human
cugcaguuuuucaggagc

SEQ ID NO: 2795602 - RNA, 24 nt, Human
cugcaguuuuucaggagcgcaaga

SEQ ID NO: 2795603 - RNA, 19 nt, Human
cugcaguccuccgguugca

SEQ ID NO: 2795604 - RNA, 23 nt, Human
cugcaguccguguggauccaaug

SEQ ID NO: 2795605 - RNA, 13 nt, Human
cugcaguccugga

SEQ ID NO: 2795606 - RNA, 21 nt, Human
cugcagucagucaugauggca

SEQ ID NO: 2795607 - RNA, 17 nt, Human
cugcaguguucgcuugg

SEQ ID NO: 2795608 - RNA, 18 nt, Human
cugcaguguucgcuuggc

SEQ ID NO: 2795609 - RNA, 19 nt, Human
cugcaguguucgcuuggcu

SEQ ID NO: 2795610 - RNA, 20 nt, Human
cugcaguguucgcuuggcuc

SEQ ID NO: 2795611 - RNA, 22 nt, Human
cugcaguguucgcuuggcucca

SEQ ID NO: 2795612 - RNA, 13 nt, Human
cugcaguuaauua

SEQ ID NO: 2795613 - RNA, 14 nt, Human
cugcaguuaauuag

SEQ ID NO: 2795614 - RNA, 16 nt, Human
cugcaguuaauuagca

SEQ ID NO: 2795615 - RNA, 21 nt, Human
cugcaguuaauuagcauucug

SEQ ID NO: 2795616 - RNA, 23 nt, Human
cugcagguucucucucacugcca

SEQ ID NO: 2795617 - RNA, 17 nt, Human
cugcaguaaaucuuuua

SEQ ID NO: 2795618 - RNA, 14 nt, Human
cugcaguaaaucuu

SEQ ID NO: 2795619 - RNA, 16 nt, Human
cugcagguuggacccc

SEQ ID NO: 2795620 - RNA, 17 nt, Human
cugcagguuggacccca

SEQ ID NO: 2795621 - RNA, 18 nt, Human
cugcagguuggaccccag

SEQ ID NO: 2795622 - RNA, 19 nt, Human
cugcagguuggaccccaga

SEQ ID NO: 2795623 - RNA, 21 nt, Human
cugcagguuggaccccagaga

SEQ ID NO: 2795624 - RNA, 10 nt, Human
cugccagagg

SEQ ID NO: 2795625 - RNA, 21 nt, Human
cugccauccagguucagcuug

SEQ ID NO: 2795626 - RNA, 17 nt, Human
cugccauguaccucccc

SEQ ID NO: 2795627 - RNA, 18 nt, Human
cugccauguaccuccccu

SEQ ID NO: 2795628 - RNA, 20 nt, Human
cugccauguaccuccccugc

SEQ ID NO: 2795629 - RNA, 21 nt, Human
cugccauguaccuccccugcc

SEQ ID NO: 2795630 - RNA, 22 nt, Human
cugccauguaccuccccugccu

SEQ ID NO: 2795631 - RNA, 23 nt, Human
cugccauguaccuccccugccuu

SEQ ID NO: 2795632 - RNA, 19 nt, Human
cugccauguacuaguuuua

SEQ ID NO: 2795633 - RNA, 22 nt, Human
cugccauggcgugucccucucg

SEQ ID NO: 2795634 - RNA, 21 nt, Human
cugccauggcgugucccucuc

SEQ ID NO: 2795635 - RNA, 14 nt, Human
cugccauggcgugu

SEQ ID NO: 2795636 - RNA, 21 nt, Human
cugcauauguugaauacuuuu

SEQ ID NO: 2795637 - RNA, 14 nt, Human
cugcauauguugaa

SEQ ID NO: 2795638 - RNA, 16 nt, Human
cugcauaccaaccugg

SEQ ID NO: 2795639 - RNA, 20 nt, Human
cugcauaagugaaaaucuua

SEQ ID NO: 2795640 - RNA, 15 nt, Human
cugcauaccaaccug

SEQ ID NO: 2795641 - RNA, 12 nt, Human
cugccacccugg

SEQ ID NO: 2795642 - RNA, 21 nt, Human
cugccacccuggggagaaagu

SEQ ID NO: 2795643 - RNA, 15 nt, Human
cugccacccuguagc

SEQ ID NO: 2795644 - RNA, 23 nt, Human
cugccagaagauccccucaggac

SEQ ID NO: 2795645 - RNA, 17 nt, Human
cugccaccucccugacc

SEQ ID NO: 2795646 - RNA, 23 nt, Human
cugccacuuugguacauggccag

SEQ ID NO: 2795647 - RNA, 21 nt, Human
cugccagaagauccccucagg

SEQ ID NO: 2795648 - RNA, 22 nt, Human
cugccagaagauccccucagga

SEQ ID NO: 2795649 - RNA, 12 nt, Human
cugccaccuccc

SEQ ID NO: 2795650 - RNA, 13 nt, Human
cugccaccucccu

SEQ ID NO: 2795651 - RNA, 15 nt, Human
cugccaccucccuga

SEQ ID NO: 2795652 - RNA, 16 nt, Human
cugccaccucccugac

SEQ ID NO: 2795653 - RNA, 21 nt, Human
cugcccuaaugcgcaggcugg

SEQ ID NO: 2795654 - RNA, 20 nt, Human
cugcccuaaugcgcaggcug

SEQ ID NO: 2795655 - RNA, 14 nt, Human
cugcccguguacau

SEQ ID NO: 2795656 - RNA, 15 nt, Human
cugcccguguacaua

SEQ ID NO: 2795657 - RNA, 22 nt, Human
cugcccuaaugcgcaggcuggc

SEQ ID NO: 2795658 - RNA, 21 nt, Human
cugcccgggcgcggccagccc

SEQ ID NO: 2795659 - RNA, 19 nt, Human
cugcccgggcgcggccagc

SEQ ID NO: 2795660 - RNA, 19 nt, Human
cugcccguaaacacgccug

SEQ ID NO: 2795661 - RNA, 18 nt, Human
cugcccguaaacacgccu

SEQ ID NO: 2795662 - RNA, 21 nt, Human
cugcccguaaacacgccugca

SEQ ID NO: 2795663 - RNA, 13 nt, Human
cugccccagcucu

SEQ ID NO: 2795664 - RNA, 14 nt, Human
cugccccagcucug

SEQ ID NO: 2795665 - RNA, 22 nt, Human
cugccccuuccuuuaaaaaacu

SEQ ID NO: 2795666 - RNA, 16 nt, Human
cugcccgcacacccuc

SEQ ID NO: 2795667 - RNA, 17 nt, Human
cugcccgcacacccuca

SEQ ID NO: 2795668 - RNA, 22 nt, Human
cugcccgcacacccucacucug

SEQ ID NO: 2795669 - RNA, 15 nt, Human
cugcccgcacagcag

SEQ ID NO: 2795670 - RNA, 16 nt, Human
cugcccgcacagcagc

SEQ ID NO: 2795671 - RNA, 17 nt, Human
cugcccgcacagcagcc

SEQ ID NO: 2795672 - RNA, 18 nt, Human
cugcccgcacagcagccu

SEQ ID NO: 2795673 - RNA, 20 nt, Human
cugcccgcacagcagccugc

SEQ ID NO: 2795674 - RNA, 21 nt, Human
cugcccgcacagcagccugcu

SEQ ID NO: 2795675 - RNA, 17 nt, Human
cugcccgcagaccucug

SEQ ID NO: 2795676 - RNA, 18 nt, Human
cugcccgcagaccucugg

SEQ ID NO: 2795677 - RNA, 19 nt, Human
cugcccgcagaccucugga

SEQ ID NO: 2795678 - RNA, 20 nt, Human
cugcccgcagaccucuggau

SEQ ID NO: 2795679 - RNA, 13 nt, Human
cugcccgccugcc

SEQ ID NO: 2795680 - RNA, 15 nt, Human
cugcccgccugccca

SEQ ID NO: 2795681 - RNA, 16 nt, Human
cugcccgccugcccac

SEQ ID NO: 2795682 - RNA, 17 nt, Human
cugcccgccugcccacc

SEQ ID NO: 2795683 - RNA, 19 nt, Human
cugcccgccugcccaccug

SEQ ID NO: 2795684 - RNA, 20 nt, Human
cugcccgccugcccaccugc

SEQ ID NO: 2795685 - RNA, 21 nt, Human
cugcccgccugcccaccugcc

SEQ ID NO: 2795686 - RNA, 22 nt, Human
cugcccgccugcccaccugccu

SEQ ID NO: 2795687 - RNA, 15 nt, Human
cugccauuauuuucu

SEQ ID NO: 2795688 - RNA, 19 nt, Human
cugccauuauuuucuguca

SEQ ID NO: 2795689 - RNA, 20 nt, Human
cugccauuauuuucugucag

SEQ ID NO: 2795690 - RNA, 21 nt, Human
cugccauuauuuucugucaga

SEQ ID NO: 2795691 - RNA, 22 nt, Human
cugccauuauuuucugucagau

SEQ ID NO: 2795692 - RNA, 13 nt, Human
cugccauuuaaaa

SEQ ID NO: 2795693 - RNA, 19 nt, Human
cugcccaaccugcucuccu

SEQ ID NO: 2795694 - RNA, 17 nt, Human
cugcccacauuggaccc

SEQ ID NO: 2795695 - RNA, 16 nt, Human
cugcccaauuggagga

SEQ ID NO: 2795696 - RNA, 14 nt, Human
cugcccaacugugu

SEQ ID NO: 2795697 - RNA, 14 nt, Human
cugcccaagcccag

SEQ ID NO: 2795698 - RNA, 16 nt, Human
cugcccaagcccaggc

SEQ ID NO: 2795699 - RNA, 18 nt, Human
cugcccaagcccaggcca

SEQ ID NO: 2795700 - RNA, 21 nt, Human
cugcccaccucagccucccaa

SEQ ID NO: 2795701 - RNA, 11 nt, Human
cugcccaccug

SEQ ID NO: 2795702 - RNA, 15 nt, Human
cugcccaggccccug

SEQ ID NO: 2795703 - RNA, 14 nt, Human
cugcccaggccccu

SEQ ID NO: 2795704 - RNA, 14 nt, Human
cugcccaccugccu

SEQ ID NO: 2795705 - RNA, 15 nt, Human
cugcccaccugccug

SEQ ID NO: 2795706 - RNA, 16 nt, Human
cugcccaccugccugg

SEQ ID NO: 2795707 - RNA, 17 nt, Human
cugcccaccugccuggc

SEQ ID NO: 2795708 - RNA, 18 nt, Human
cugcccaccugccuggcc

SEQ ID NO: 2795709 - RNA, 19 nt, Human
cugcccaccugccuggccg

SEQ ID NO: 2795710 - RNA, 20 nt, Human
cugcccaccugccuggccgg

SEQ ID NO: 2795711 - RNA, 21 nt, Human
cugcccaccugccuggccggc

SEQ ID NO: 2795712 - RNA, 20 nt, Human
cugcccaggccccugccacc

SEQ ID NO: 2795713 - RNA, 19 nt, Human
cugcccaggccccugccac

SEQ ID NO: 2795714 - RNA, 18 nt, Human
cugcccaggccccugcca

SEQ ID NO: 2795715 - RNA, 16 nt, Human
cugcccaggccccugc

SEQ ID NO: 2795716 - RNA, 13 nt, Human
cugcccaccugcc

SEQ ID NO: 2795717 - RNA, 18 nt, Human
cugcccaggccggccagc

SEQ ID NO: 2795718 - RNA, 22 nt, Human
cugcccaggccggccagccuca

SEQ ID NO: 2795719 - RNA, 23 nt, Human
cuggccuggacaguaucccacau

SEQ ID NO: 2795720 - RNA, 18 nt, Human
cuggccucucuagcacaa

SEQ ID NO: 2795721 - RNA, 17 nt, Human
cuggccucucuagcaca

SEQ ID NO: 2795722 - RNA, 16 nt, Human
cuggccucucuagcac

SEQ ID NO: 2795723 - RNA, 14 nt, Human
cuggccucucuagc

SEQ ID NO: 2795724 - RNA, 22 nt, Human
cuggccucaagugauucuccug

SEQ ID NO: 2795725 - RNA, 12 nt, Human
cuggccucagac

SEQ ID NO: 2795726 - RNA, 13 nt, Human
cuggccucagacu

SEQ ID NO: 2795727 - RNA, 21 nt, Human
cuggccucagacugcacccag

SEQ ID NO: 2795728 - RNA, 22 nt, Human
cuggccucagacugcacccagg

SEQ ID NO: 2795729 - RNA, 23 nt, Human
cuggccucagacugcacccagga

SEQ ID NO: 2795730 - RNA, 11 nt, Human
cuggccuccag

SEQ ID NO: 2795731 - RNA, 12 nt, Human
cuggccuccagg

SEQ ID NO: 2795732 - RNA, 15 nt, Human
cuggccuccaggccc

SEQ ID NO: 2795733 - RNA, 20 nt, Human
cuggccuccaggcccgucug

SEQ ID NO: 2795734 - RNA, 23 nt, Human
cuggccuccaggcccgucugucc

SEQ ID NO: 2795735 - RNA, 14 nt, Human
cuggccucccacag

SEQ ID NO: 2795736 - RNA, 13 nt, Human
cuggccucccaca

SEQ ID NO: 2795737 - RNA, 23 nt, Human
cuggccucaagugauucuccugc

SEQ ID NO: 2795738 - RNA, 20 nt, Human
cuggccccagguagaaacuu

SEQ ID NO: 2795739 - RNA, 14 nt, Human
cuggccccagggca

SEQ ID NO: 2795740 - RNA, 15 nt, Human
cuggccccagggcac

SEQ ID NO: 2795741 - RNA, 16 nt, Human
cuggccccagggcacc

SEQ ID NO: 2795742 - RNA, 18 nt, Human
cuggccccagggcacccu

SEQ ID NO: 2795743 - RNA, 23 nt, Human
cuggccagggccuggaagacaga

SEQ ID NO: 2795744 - RNA, 15 nt, Human
cuggccagggccugg

SEQ ID NO: 2795745 - RNA, 16 nt, Human
cuggccagggccugga

SEQ ID NO: 2795746 - RNA, 22 nt, Human
cuggccaggcagaucugugccc

SEQ ID NO: 2795747 - RNA, 21 nt, Human
cuggccaggcagaucugugcc

SEQ ID NO: 2795748 - RNA, 14 nt, Human
cuggccaggcagau

SEQ ID NO: 2795749 - RNA, 13 nt, Human
cuggccaggcaga

SEQ ID NO: 2795750 - RNA, 14 nt, Human
cuggccagggccug

SEQ ID NO: 2795751 - RNA, 12 nt, Human
cuggccaggagc

SEQ ID NO: 2795752 - RNA, 13 nt, Human
cuggccagccgcu

SEQ ID NO: 2795753 - RNA, 14 nt, Human
cuggccagccgcuc

SEQ ID NO: 2795754 - RNA, 19 nt, Human
cuggccagccgcucuccug

SEQ ID NO: 2795755 - RNA, 20 nt, Human
cuggccagccgcucuccugc

SEQ ID NO: 2795756 - RNA, 22 nt, Human
cuggccagccgcucuccugcca

SEQ ID NO: 2795757 - RNA, 23 nt, Human
cuggccagccgcucuccugccac

SEQ ID NO: 2795758 - RNA, 12 nt, Human
cuggccagccug

SEQ ID NO: 2795759 - RNA, 13 nt, Human
cuggccagccugg

SEQ ID NO: 2795760 - RNA, 14 nt, Human
cuggccagccuggg

SEQ ID NO: 2795761 - RNA, 15 nt, Human
cuggccagccugggg

SEQ ID NO: 2795762 - RNA, 17 nt, Human
cuggccagccuggggcc

SEQ ID NO: 2795763 - RNA, 19 nt, Human
cuggccagccuggggccug

SEQ ID NO: 2795764 - RNA, 20 nt, Human
cuggccagccuggggccugg

SEQ ID NO: 2795765 - RNA, 21 nt, Human
cuggccagccuggggccuggc

SEQ ID NO: 2795766 - RNA, 22 nt, Human
cuggccagccuggggccuggca

SEQ ID NO: 2795767 - RNA, 23 nt, Human
cuggccagccuggggccuggcag

SEQ ID NO: 2795768 - RNA, 24 nt, Human
cuggccagccuggggccuggcagg

SEQ ID NO: 2795769 - RNA, 13 nt, Human
cuggccaggagcu

SEQ ID NO: 2795770 - RNA, 17 nt, Human
cuggccaggagcucuuc

SEQ ID NO: 2795771 - RNA, 15 nt, Human
cuggccaggagcucu

SEQ ID NO: 2795772 - RNA, 11 nt, Human
cuggccaggca

SEQ ID NO: 2795773 - RNA, 22 nt, Human
cuggccaggagcucuucaggcc

SEQ ID NO: 2795774 - RNA, 20 nt, Human
cuggccaggagcucuucagg

SEQ ID NO: 2795775 - RNA, 22 nt, Human
cuggccagaugcaccagcccuu

SEQ ID NO: 2795776 - RNA, 16 nt, Human
cuggccaccucucucc

SEQ ID NO: 2795777 - RNA, 18 nt, Human
cuggccaccucucuccuu

SEQ ID NO: 2795778 - RNA, 16 nt, Human
cuggcauuacagcugg

SEQ ID NO: 2795779 - RNA, 15 nt, Human
cuggcauuacagcug

SEQ ID NO: 2795780 - RNA, 18 nt, Human
cuggcauuagaauuauuu

SEQ ID NO: 2795781 - RNA, 20 nt, Human
cuggcauguucaaagccaca

SEQ ID NO: 2795782 - RNA, 21 nt, Human
cuggcacgguggcucaggccu

SEQ ID NO: 2795783 - RNA, 13 nt, Human
cuggcaagaaugg

SEQ ID NO: 2795784 - RNA, 16 nt, Human
cuggcaaggacacaga

SEQ ID NO: 2795785 - RNA, 24 nt, Human
cuggaaucuggagaccagggagcc

SEQ ID NO: 2795786 - RNA, 18 nt, Human
cuggaaucuggagaccag

SEQ ID NO: 2795787 - RNA, 19 nt, Human
cuggaaucuggagaccagg

SEQ ID NO: 2795788 - RNA, 17 nt, Human
cuggaaucuggagacca

SEQ ID NO: 2795789 - RNA, 23 nt, Human
cuggaaucaagaugucagacugg

SEQ ID NO: 2795790 - RNA, 18 nt, Human
cuggaauacaugaaauau

SEQ ID NO: 2795791 - RNA, 15 nt, Human
cuggaauacaugaaa

SEQ ID NO: 2795792 - RNA, 20 nt, Human
cuggaagguggggacaggga

SEQ ID NO: 2795793 - RNA, 22 nt, Human
cuggcacccggccccugcuggu

SEQ ID NO: 2795794 - RNA, 18 nt, Human
cuggcacccggccccugc

SEQ ID NO: 2795795 - RNA, 17 nt, Human
cuggcacccggccccug

SEQ ID NO: 2795796 - RNA, 16 nt, Human
cuggcacccggccccu

SEQ ID NO: 2795797 - RNA, 17 nt, Human
cuggcaaggacacagau

SEQ ID NO: 2795798 - RNA, 18 nt, Human
cuggcaaggacacagaug

SEQ ID NO: 2795799 - RNA, 15 nt, Human
cuggcacagggcagu

SEQ ID NO: 2795800 - RNA, 14 nt, Human
cuggcacaggacug

SEQ ID NO: 2795801 - RNA, 15 nt, Human
cuggcacaggacuga

SEQ ID NO: 2795802 - RNA, 18 nt, Human
cuggcacaggacugauuc

SEQ ID NO: 2795803 - RNA, 22 nt, Human
cuggcacaggacugauucuggg

SEQ ID NO: 2795804 - RNA, 16 nt, Human
cugggagaaccucagg

SEQ ID NO: 2795805 - RNA, 15 nt, Human
cugggagaaccucag

SEQ ID NO: 2795806 - RNA, 14 nt, Human
cugggagaaccuca

SEQ ID NO: 2795807 - RNA, 12 nt, Human
cugggagaaccu

SEQ ID NO: 2795808 - RNA, 18 nt, Human
cugggagaaccucaggcu

SEQ ID NO: 2795809 - RNA, 12 nt, Human
cugggagacaga

SEQ ID NO: 2795810 - RNA, 14 nt, Human
cugggagacagacc

SEQ ID NO: 2795811 - RNA, 17 nt, Human
cugggagaaccucaggc

SEQ ID NO: 2795812 - RNA, 18 nt, Human
cuggcuguuggcuggggg

SEQ ID NO: 2795813 - RNA, 13 nt, Human
cuggcuuggccua

SEQ ID NO: 2795814 - RNA, 16 nt, Human
cuggcuuguuguaaag

SEQ ID NO: 2795815 - RNA, 17 nt, Human
cuggcuuguuguaaagc

SEQ ID NO: 2795816 - RNA, 20 nt, Human
cuggcuuguuguaaagcaau

SEQ ID NO: 2795817 - RNA, 13 nt, Human
cuggcuuguuuau

SEQ ID NO: 2795818 - RNA, 14 nt, Human
cuggcuuguuuauu

SEQ ID NO: 2795819 - RNA, 18 nt, Human
cuggcuuguuuauuuugu

SEQ ID NO: 2795820 - RNA, 15 nt, Human
cuggcuuuuuaacuc

SEQ ID NO: 2795821 - RNA, 12 nt, Human
cuggcuuuucug

SEQ ID NO: 2795822 - RNA, 20 nt, Human
cuggcuuuucuguuuccugu

SEQ ID NO: 2795823 - RNA, 23 nt, Human
cuggcuuuucacugcuggcugcc

SEQ ID NO: 2795824 - RNA, 16 nt, Human
cugggaaacagaggcu

SEQ ID NO: 2795825 - RNA, 21 nt, Human
cugggaaaccccuucucugug

SEQ ID NO: 2795826 - RNA, 23 nt, Human
cugggaaaccccuucucugugac

SEQ ID NO: 2795827 - RNA, 15 nt, Human
cugggaaacagaggc

SEQ ID NO: 2795828 - RNA, 11 nt, Human
cugggaaacag

SEQ ID NO: 2795829 - RNA, 12 nt, Human
cugggaaacacu

SEQ ID NO: 2795830 - RNA, 17 nt, Human
cugggaaacacuccuug

SEQ ID NO: 2795831 - RNA, 18 nt, Human
cugggaaacacuccuugc

SEQ ID NO: 2795832 - RNA, 19 nt, Human
cugggaaacacuccuugca

SEQ ID NO: 2795833 - RNA, 21 nt, Human
cugggaaacacuccuugcauc

SEQ ID NO: 2795834 - RNA, 22 nt, Human
cugggaaacacuccuugcauca

SEQ ID NO: 2795835 - RNA, 17 nt, Human
cuggccuuccacuuggc

SEQ ID NO: 2795836 - RNA, 15 nt, Human
cuggccuuuccucuc

SEQ ID NO: 2795837 - RNA, 22 nt, Human
cuggcgagugaaugccagugug

SEQ ID NO: 2795838 - RNA, 23 nt, Human
cuggcgagugaaugccagugugc

SEQ ID NO: 2795839 - RNA, 19 nt, Human
cuggcuggagaauguggag

SEQ ID NO: 2795840 - RNA, 17 nt, Human
cuggcuggcugcaguga

SEQ ID NO: 2795841 - RNA, 15 nt, Human
cuggcuggcugcagu

SEQ ID NO: 2795842 - RNA, 15 nt, Human
cuggcuguaaggcuc

SEQ ID NO: 2795843 - RNA, 16 nt, Human
cuggcuguaaggcucu

SEQ ID NO: 2795844 - RNA, 17 nt, Human
cuggcuguaaggcucua

SEQ ID NO: 2795845 - RNA, 17 nt, Human
cuggcuguuggcugggg

SEQ ID NO: 2795846 - RNA, 16 nt, Human
cuggcuguuggcuggg

SEQ ID NO: 2795847 - RNA, 20 nt, Human
cuggcuguaaggcucuagau

SEQ ID NO: 2795848 - RNA, 18 nt, Human
cuggcuguacugcucagg

SEQ ID NO: 2795849 - RNA, 21 nt, Human
cuggcuguacugcucaggcug

SEQ ID NO: 2795850 - RNA, 19 nt, Human
cuggcuguaaggcucuaga

SEQ ID NO: 2795851 - RNA, 20 nt, Human
cugggaucacauguggacuu

SEQ ID NO: 2795852 - RNA, 20 nt, Human
cugggauuacaggugugaac

SEQ ID NO: 2795853 - RNA, 18 nt, Human
cugggauuacagguguga

SEQ ID NO: 2795854 - RNA, 16 nt, Human
cugggauuacaggugu

SEQ ID NO: 2795855 - RNA, 17 nt, Human
cugggauuacaggugug

SEQ ID NO: 2795856 - RNA, 17 nt, Human
cugggauggaggggagu

SEQ ID NO: 2795857 - RNA, 23 nt, Human
cugggauuacaggcuccugccac

SEQ ID NO: 2795858 - RNA, 20 nt, Human
cugggaugggaggagaggac

SEQ ID NO: 2795859 - RNA, 17 nt, Human
cugggaugagccgcugu

SEQ ID NO: 2795860 - RNA, 21 nt, Human
cugggaugagccgcugugagc

SEQ ID NO: 2795861 - RNA, 22 nt, Human
cugggaugagccgcugugagcc

SEQ ID NO: 2795862 - RNA, 17 nt, Human
cugggccccccagcuca

SEQ ID NO: 2795863 - RNA, 18 nt, Human
cugggccccccagcucag

SEQ ID NO: 2795864 - RNA, 19 nt, Human
cugggccccccagcucagg

SEQ ID NO: 2795865 - RNA, 20 nt, Human
cugggccccccagcucaggg

SEQ ID NO: 2795866 - RNA, 17 nt, Human
cugggccggagggucag

SEQ ID NO: 2795867 - RNA, 13 nt, Human
cugggccccagcu

SEQ ID NO: 2795868 - RNA, 15 nt, Human
cugggccccaguugu

SEQ ID NO: 2795869 - RNA, 19 nt, Human
cugggccccaguuguauuu

SEQ ID NO: 2795870 - RNA, 24 nt, Human
cugggccccaaacgggcugcccug

SEQ ID NO: 2795871 - RNA, 21 nt, Human
cugggaguaguugucuuuccu

SEQ ID NO: 2795872 - RNA, 23 nt, Human
cugggaguaguugucuuuccugg

SEQ ID NO: 2795873 - RNA, 18 nt, Human
cuggccagauggcccgga

SEQ ID NO: 2795874 - RNA, 21 nt, Human
cugggagguugguuuaaugca

SEQ ID NO: 2795875 - RNA, 22 nt, Human
cugggaggaauggacagacaga

SEQ ID NO: 2795876 - RNA, 19 nt, Human
cugggaggaauggacagac

SEQ ID NO: 2795877 - RNA, 15 nt, Human
cugggaggaagcagg

SEQ ID NO: 2795878 - RNA, 21 nt, Human
cugggaggaagcagguugagg

SEQ ID NO: 2795879 - RNA, 17 nt, Human
cugggaggaauggacag

SEQ ID NO: 2795880 - RNA, 23 nt, Human
cugucuccuuucaccccagggcc

SEQ ID NO: 2795881 - RNA, 22 nt, Human
cugucuccuuucaccccagggc

SEQ ID NO: 2795882 - RNA, 16 nt, Human
cugucucuaacuuauu

SEQ ID NO: 2795883 - RNA, 20 nt, Human
cugucucuaacuuauuuuau

SEQ ID NO: 2795884 - RNA, 20 nt, Human
cugucuccuuaacacugagc

SEQ ID NO: 2795885 - RNA, 20 nt, Human
cugucucauccccagggguc

SEQ ID NO: 2795886 - RNA, 21 nt, Human
cugucucauccccaggggucc

SEQ ID NO: 2795887 - RNA, 14 nt, Human
cugucucauccucc

SEQ ID NO: 2795888 - RNA, 15 nt, Human
cugucucauccuccu

SEQ ID NO: 2795889 - RNA, 16 nt, Human
cugucucauccuccug

SEQ ID NO: 2795890 - RNA, 17 nt, Human
cugucucauccuccugg

SEQ ID NO: 2795891 - RNA, 18 nt, Human
cugucucauccuccugga

SEQ ID NO: 2795892 - RNA, 22 nt, Human
cugucucauccuccuggaaccu

SEQ ID NO: 2795893 - RNA, 14 nt, Human
cugucuccacugug

SEQ ID NO: 2795894 - RNA, 15 nt, Human
cugucuccacugugc

SEQ ID NO: 2795895 - RNA, 19 nt, Human
cugucucauccccaggggu

SEQ ID NO: 2795896 - RNA, 17 nt, Human
cugucucauccccaggg

SEQ ID NO: 2795897 - RNA, 16 nt, Human
cugucucauccccagg

SEQ ID NO: 2795898 - RNA, 15 nt, Human
cugucucauccccag

SEQ ID NO: 2795899 - RNA, 14 nt, Human
cugucucaucccca

SEQ ID NO: 2795900 - RNA, 13 nt, Human
cugucucaucccc

SEQ ID NO: 2795901 - RNA, 21 nt, Human
cuguccuacucugugucaggu

SEQ ID NO: 2795902 - RNA, 15 nt, Human
cuguccuaggccaca

SEQ ID NO: 2795903 - RNA, 16 nt, Human
cuguccuaugaaugcu

SEQ ID NO: 2795904 - RNA, 23 nt, Human
cuguccuaugaaugcuuugcauu

SEQ ID NO: 2795905 - RNA, 13 nt, Human
cuguccucacugc

SEQ ID NO: 2795906 - RNA, 14 nt, Human
cuguccucacugcu

SEQ ID NO: 2795907 - RNA, 16 nt, Human
cuguccucacugcucc

SEQ ID NO: 2795908 - RNA, 18 nt, Human
cugucucaagagggcacu

SEQ ID NO: 2795909 - RNA, 19 nt, Human
cugucucaagagggcacug

SEQ ID NO: 2795910 - RNA, 20 nt, Human
cugucucaagagggcacugg

SEQ ID NO: 2795911 - RNA, 21 nt, Human
cugucucaagagggcacuggu

SEQ ID NO: 2795912 - RNA, 19 nt, Human
cuguccucacugcucccug

SEQ ID NO: 2795913 - RNA, 21 nt, Human
cuguccucacugcucccugaa

SEQ ID NO: 2795914 - RNA, 18 nt, Human
cugucccauggacacucc

SEQ ID NO: 2795915 - RNA, 21 nt, Human
cugucccuaguaaaaauacaa

SEQ ID NO: 2795916 - RNA, 19 nt, Human
cugucccuaguaaaaauac

SEQ ID NO: 2795917 - RNA, 12 nt, Human
cugucccucaca

SEQ ID NO: 2795918 - RNA, 16 nt, Human
cugucccucacagcac

SEQ ID NO: 2795919 - RNA, 13 nt, Human
cugucccucacag

SEQ ID NO: 2795920 - RNA, 13 nt, Human
cugucccucacug

SEQ ID NO: 2795921 - RNA, 12 nt, Human
cugucccucacu

SEQ ID NO: 2795922 - RNA, 13 nt, Human
cugucccucccac

SEQ ID NO: 2795923 - RNA, 15 nt, Human
cugucccucccaccu

SEQ ID NO: 2795924 - RNA, 16 nt, Human
cugucccucccaccuc

SEQ ID NO: 2795925 - RNA, 15 nt, Human
cugucccucccccuu

SEQ ID NO: 2795926 - RNA, 17 nt, Human
cugucccucccaccucu

SEQ ID NO: 2795927 - RNA, 18 nt, Human
cugucccucccaccucug

SEQ ID NO: 2795928 - RNA, 19 nt, Human
cugucccucccaccucugu

SEQ ID NO: 2795929 - RNA, 21 nt, Human
cugucccucccaccucuguga

SEQ ID NO: 2795930 - RNA, 20 nt, Human
cuguccuacucugugucagg

SEQ ID NO: 2795931 - RNA, 18 nt, Human
cuguccuacucuguguca

SEQ ID NO: 2795932 - RNA, 17 nt, Human
cuguccuacucuguguc

SEQ ID NO: 2795933 - RNA, 16 nt, Human
cuguccuacucugugu

SEQ ID NO: 2795934 - RNA, 19 nt, Human
cugucccuuggaacucuug

SEQ ID NO: 2795935 - RNA, 14 nt, Human
cugucccuugcugu

SEQ ID NO: 2795936 - RNA, 18 nt, Human
cugucccuugcuguaugc

SEQ ID NO: 2795937 - RNA, 23 nt, Human
cugucccucccaccucugugacc

SEQ ID NO: 2795938 - RNA, 17 nt, Human
cugucccuucugucccu

SEQ ID NO: 2795939 - RNA, 19 nt, Human
cugucccuucugucccuca

SEQ ID NO: 2795940 - RNA, 18 nt, Human
cugucccuucugucccuc

SEQ ID NO: 2795941 - RNA, 23 nt, Human
cuguauuuguaucucugaagcau

SEQ ID NO: 2795942 - RNA, 18 nt, Human
cuguccaaaggaggcugg

SEQ ID NO: 2795943 - RNA, 17 nt, Human
cuguccaaaggaggcug

SEQ ID NO: 2795944 - RNA, 22 nt, Human
cuguccaaaggaggcuggcagg

SEQ ID NO: 2795945 - RNA, 21 nt, Human
cuguccaaaggaggcuggcag

SEQ ID NO: 2795946 - RNA, 20 nt, Human
cuguccaaaggaggcuggca

SEQ ID NO: 2795947 - RNA, 19 nt, Human
cuguccaaaggaggcuggc

SEQ ID NO: 2795948 - RNA, 16 nt, Human
cugucauuuguuguga

SEQ ID NO: 2795949 - RNA, 18 nt, Human
cugucauuuguugugaug

SEQ ID NO: 2795950 - RNA, 17 nt, Human
cugucccauggacacuc

SEQ ID NO: 2795951 - RNA, 15 nt, Human
cugucccaugcaggc

SEQ ID NO: 2795952 - RNA, 18 nt, Human
cugucccaugcaggcccu

SEQ ID NO: 2795953 - RNA, 19 nt, Human
cugucccauggacacucca

SEQ ID NO: 2795954 - RNA, 16 nt, Human
cugucccacccccacc

SEQ ID NO: 2795955 - RNA, 19 nt, Human
cugucccagguuaucuggg

SEQ ID NO: 2795956 - RNA, 22 nt, Human
cugucccagguuaucugggcau

SEQ ID NO: 2795957 - RNA, 17 nt, Human
cuguccaggcacugcug

SEQ ID NO: 2795958 - RNA, 14 nt, Human
cuguauagcuccuu

SEQ ID NO: 2795959 - RNA, 14 nt, Human
cugucccaccccca

SEQ ID NO: 2795960 - RNA, 16 nt, Human
cuguccaccagcccau

SEQ ID NO: 2795961 - RNA, 18 nt, Human
cuguccaggcacugcugc

SEQ ID NO: 2795962 - RNA, 19 nt, Human
cuguccaggcacugcugcc

SEQ ID NO: 2795963 - RNA, 20 nt, Human
cuguccaggcacugcugccc

SEQ ID NO: 2795964 - RNA, 21 nt, Human
cuguccaggcacugcugccca

SEQ ID NO: 2795965 - RNA, 22 nt, Human
cuguccaggcacugcugcccag

SEQ ID NO: 2795966 - RNA, 23 nt, Human
cuguccaucugcccgccugccca

SEQ ID NO: 2795967 - RNA, 14 nt, Human
cuguccaugcuucu

SEQ ID NO: 2795968 - RNA, 16 nt, Human
cuguccaugcuucuca

SEQ ID NO: 2795969 - RNA, 21 nt, Human
cuguccauuuauccacaggaa

SEQ ID NO: 2795970 - RNA, 18 nt, Human
cuguaucccaugagccuc

SEQ ID NO: 2795971 - RNA, 12 nt, Human
cuguaugucugu

SEQ ID NO: 2795972 - RNA, 15 nt, Human
cuguaugucugucau

SEQ ID NO: 2795973 - RNA, 17 nt, Human
cuguaugucugucauug

SEQ ID NO: 2795974 - RNA, 12 nt, Human
cuguaugucaga

SEQ ID NO: 2795975 - RNA, 16 nt, Human
cuguauguauuaguga

SEQ ID NO: 2795976 - RNA, 17 nt, Human
cuguauguauuagugau

SEQ ID NO: 2795977 - RNA, 20 nt, Human
cuguauguauuagugauauu

SEQ ID NO: 2795978 - RNA, 13 nt, Human
cuguauauacuuu

SEQ ID NO: 2795979 - RNA, 12 nt, Human
cuguaugauuua

SEQ ID NO: 2795980 - RNA, 15 nt, Human
cuguaugcugaucau

SEQ ID NO: 2795981 - RNA, 16 nt, Human
cuguaugcugaucauc

SEQ ID NO: 2795982 - RNA, 22 nt, Human
cuguaugcugaucaucgccaga

SEQ ID NO: 2795983 - RNA, 14 nt, Human
cuguauuuguaucu

SEQ ID NO: 2795984 - RNA, 17 nt, Human
cuguauuuaugugugag

SEQ ID NO: 2795985 - RNA, 23 nt, Human
cuguauuuaugugugaggagcug

SEQ ID NO: 2795986 - RNA, 14 nt, Human
cuguauuucaugug

SEQ ID NO: 2795987 - RNA, 15 nt, Human
cuguauuucaugugg

SEQ ID NO: 2795988 - RNA, 17 nt, Human
cuguauuucauguggcu

SEQ ID NO: 2795989 - RNA, 19 nt, Human
cuguauuucauguggcugu

SEQ ID NO: 2795990 - RNA, 18 nt, Human
cuguauuuaugugugagg

SEQ ID NO: 2795991 - RNA, 15 nt, Human
cuguauguuguccaa

SEQ ID NO: 2795992 - RNA, 18 nt, Human
cuguauguuguccaauug

SEQ ID NO: 2795993 - RNA, 13 nt, Human
cuguauguugucc

SEQ ID NO: 2795994 - RNA, 18 nt, Human
cuguaugugcuguaauuu

SEQ ID NO: 2795995 - RNA, 19 nt, Human
cuguaugugcuguaauuua

SEQ ID NO: 2795996 - RNA, 15 nt, Human
cuguauaguacuggc

SEQ ID NO: 2795997 - RNA, 22 nt, Human
cuguaccuuuugaggagcccca

SEQ ID NO: 2795998 - RNA, 21 nt, Human
cuguaccuguuccuuagaccu

SEQ ID NO: 2795999 - RNA, 20 nt, Human
cuguaccuuuugaggagccc

SEQ ID NO: 2796000 - RNA, 15 nt, Human
cuguaucccaugagc

SEQ ID NO: 2796001 - RNA, 14 nt, Human
cuguaucccaugag

SEQ ID NO: 2796002 - RNA, 13 nt, Human
cuguauauaaaug

SEQ ID NO: 2796003 - RNA, 14 nt, Human
cuguauauaaaugg

SEQ ID NO: 2796004 - RNA, 15 nt, Human
cuguauauaaauggg

SEQ ID NO: 2796005 - RNA, 16 nt, Human
cuguauauaaauggga

SEQ ID NO: 2796006 - RNA, 18 nt, Human
cuguauauaaaugggaac

SEQ ID NO: 2796007 - RNA, 19 nt, Human
cuguauauaaaugggaaca

SEQ ID NO: 2796008 - RNA, 22 nt, Human
cuguauauaaaugggaacauuu

SEQ ID NO: 2796009 - RNA, 16 nt, Human
cuguauaguuaggaua

SEQ ID NO: 2796010 - RNA, 21 nt, Human
cuguauaguuaggauagcauu

SEQ ID NO: 2796011 - RNA, 23 nt, Human
cuguauauacaauaacauaauuu

SEQ ID NO: 2796012 - RNA, 19 nt, Human
cuguauauacaauaacaua

SEQ ID NO: 2796013 - RNA, 18 nt, Human
cuguauauacaauaacau

SEQ ID NO: 2796014 - RNA, 15 nt, Human
cuguauauacaauaa

SEQ ID NO: 2796015 - RNA, 13 nt, Human
cuguaaggcucua

SEQ ID NO: 2796016 - RNA, 14 nt, Human
cuguaaggcucuag

SEQ ID NO: 2796017 - RNA, 15 nt, Human
cuguaaggcucuaga

SEQ ID NO: 2796018 - RNA, 16 nt, Human
cuguaaggcucuagau

SEQ ID NO: 2796019 - RNA, 17 nt, Human
cuguaaggcucuagauc

SEQ ID NO: 2796020 - RNA, 18 nt, Human
cuguaaggcucuagauca

SEQ ID NO: 2796021 - RNA, 20 nt, Human
cuguaaggcucuagaucaua

SEQ ID NO: 2796022 - RNA, 22 nt, Human
cuguaaggcucuagaucauaag

SEQ ID NO: 2796023 - RNA, 13 nt, Human
cuguacauuuaaa

SEQ ID NO: 2796024 - RNA, 14 nt, Human
cuguacauuuaaaa

SEQ ID NO: 2796025 - RNA, 16 nt, Human
cuguacauuuaaaauu

SEQ ID NO: 2796026 - RNA, 19 nt, Human
cuguacauuuaaaauugcu

SEQ ID NO: 2796027 - RNA, 16 nt, Human
cuguacauuuuguugu

SEQ ID NO: 2796028 - RNA, 17 nt, Human
cuguacauuuuguugua

SEQ ID NO: 2796029 - RNA, 18 nt, Human
cuguacauuuuguuguaa

SEQ ID NO: 2796030 - RNA, 19 nt, Human
cuguacauuuuguuguaaa

SEQ ID NO: 2796031 - RNA, 20 nt, Human
cuguacauuuuguuguaaaa

SEQ ID NO: 2796032 - RNA, 21 nt, Human
cuguacauuuuguuguaaaaa

SEQ ID NO: 2796033 - RNA, 23 nt, Human
cuguacauuuuguuguaaaaaga

SEQ ID NO: 2796034 - RNA, 23 nt, Human
cuguaccauauagcaaaacuuuu

SEQ ID NO: 2796035 - RNA, 13 nt, Human
cuguaccucaucc

SEQ ID NO: 2796036 - RNA, 15 nt, Human
cuguaccucauccca

SEQ ID NO: 2796037 - RNA, 18 nt, Human
cuguaccucaucccauga

SEQ ID NO: 2796038 - RNA, 11 nt, Human
cuguacagucu

SEQ ID NO: 2796039 - RNA, 13 nt, Human
cuguacagucugu

SEQ ID NO: 2796040 - RNA, 14 nt, Human
cuguacagucuguc

SEQ ID NO: 2796041 - RNA, 15 nt, Human
cuguacagucugucu

SEQ ID NO: 2796042 - RNA, 16 nt, Human
cuguacagucugucuu

SEQ ID NO: 2796043 - RNA, 17 nt, Human
cuguacagucugucuuc

SEQ ID NO: 2796044 - RNA, 19 nt, Human
cuguacagucugucuucug

SEQ ID NO: 2796045 - RNA, 20 nt, Human
cuguacagucugucuucugu

SEQ ID NO: 2796046 - RNA, 22 nt, Human
cuguacagucugucuucuguau

SEQ ID NO: 2796047 - RNA, 23 nt, Human
cuguacagucugucuucuguaua

SEQ ID NO: 2796048 - RNA, 17 nt, Human
cuguacauaaacaauga

SEQ ID NO: 2796049 - RNA, 20 nt, Human
cugguucaggguuggccccu

SEQ ID NO: 2796050 - RNA, 20 nt, Human
cugguuaacagcaguccuuu

SEQ ID NO: 2796051 - RNA, 16 nt, Human
cugguuauaagcagca

SEQ ID NO: 2796052 - RNA, 22 nt, Human
cugguguuuaggugaauuaauu

SEQ ID NO: 2796053 - RNA, 20 nt, Human
cugguuaacuuguuuggccu

SEQ ID NO: 2796054 - RNA, 16 nt, Human
cuggugugaccugagg

SEQ ID NO: 2796055 - RNA, 17 nt, Human
cuggugugaccugaggg

SEQ ID NO: 2796056 - RNA, 18 nt, Human
cuggugugaccugagggc

SEQ ID NO: 2796057 - RNA, 12 nt, Human
cugguggcagcu

SEQ ID NO: 2796058 - RNA, 16 nt, Human
cuggucucgaacuccu

SEQ ID NO: 2796059 - RNA, 21 nt, Human
cuggucucaaacuccugggcu

SEQ ID NO: 2796060 - RNA, 16 nt, Human
cuggucaggcccuggu

SEQ ID NO: 2796061 - RNA, 23 nt, Human
cuggucucaaacucuugaccuca

SEQ ID NO: 2796062 - RNA, 13 nt, Human
cuggucccacuca

SEQ ID NO: 2796063 - RNA, 16 nt, Human
cugguccaugcagggg

SEQ ID NO: 2796064 - RNA, 18 nt, Human
cugguccaugcagggggc

SEQ ID NO: 2796065 - RNA, 22 nt, Human
cugguccagggaagcuggccga

SEQ ID NO: 2796066 - RNA, 21 nt, Human
cugguccagggaagcuggccg

SEQ ID NO: 2796067 - RNA, 17 nt, Human
cugguccagggaagcug

SEQ ID NO: 2796068 - RNA, 15 nt, Human
cugguccagggaagc

SEQ ID NO: 2796069 - RNA, 19 nt, Human
cuggucacaggacucugcc

SEQ ID NO: 2796070 - RNA, 19 nt, Human
cugguacuuagaguuucug

SEQ ID NO: 2796071 - RNA, 20 nt, Human
cugguacuuagaguuucugu

SEQ ID NO: 2796072 - RNA, 18 nt, Human
cugguaggaaagggcaag

SEQ ID NO: 2796073 - RNA, 23 nt, Human
cugguaggaaagggcaagucuuu

SEQ ID NO: 2796074 - RNA, 23 nt, Human
cuggucacagggcaugccccggc

SEQ ID NO: 2796075 - RNA, 20 nt, Human
cuggucacaggacucugccu

SEQ ID NO: 2796076 - RNA, 21 nt, Human
cuggucacaggacucugccuc

SEQ ID NO: 2796077 - RNA, 22 nt, Human
cuggucacaggacucugccucc

SEQ ID NO: 2796078 - RNA, 23 nt, Human
cuggucacaggacucugccuccu

SEQ ID NO: 2796079 - RNA, 14 nt, Human
cuggguacuugugg

SEQ ID NO: 2796080 - RNA, 16 nt, Human
cuggguacuuguggac

SEQ ID NO: 2796081 - RNA, 18 nt, Human
cuggguacuuguggacac

SEQ ID NO: 2796082 - RNA, 15 nt, Human
cuggguuggagggug

SEQ ID NO: 2796083 - RNA, 18 nt, Human
cuggguuucucuguauag

SEQ ID NO: 2796084 - RNA, 18 nt, Human
cuggguuuaaggggagag

SEQ ID NO: 2796085 - RNA, 22 nt, Human
cuggguuuaaggggagaggaaa

SEQ ID NO: 2796086 - RNA, 21 nt, Human
cugggucuucagcauucccuc

SEQ ID NO: 2796087 - RNA, 22 nt, Human
cugggucucgcuuuguugccca

SEQ ID NO: 2796088 - RNA, 15 nt, Human
gaacuccuaaaucaa

SEQ ID NO: 2796089 - RNA, 14 nt, Human
gaacuguguguaau

SEQ ID NO: 2796090 - RNA, 18 nt, Human
gaacuguguguaauuguu

SEQ ID NO: 2796091 - RNA, 16 nt, Human
gaacuccuaaaucaag

SEQ ID NO: 2796092 - RNA, 13 nt, Human
gaacuccugaccu

SEQ ID NO: 2796093 - RNA, 18 nt, Human
gaaccacaucuugcucug

SEQ ID NO: 2796094 - RNA, 14 nt, Human
gaacuucuaauaua

SEQ ID NO: 2796095 - RNA, 17 nt, Human
gaacuucucucagacuu

SEQ ID NO: 2796096 - RNA, 13 nt, Human
gaacuucuaauau

SEQ ID NO: 2796097 - RNA, 15 nt, Human
gaacuucuaauauau

SEQ ID NO: 2796098 - RNA, 16 nt, Human
gaacuucuccguccuc

SEQ ID NO: 2796099 - RNA, 19 nt, Human
gaacuucuccguccucgau

SEQ ID NO: 2796100 - RNA, 14 nt, Human
gaacuugaaugugu

SEQ ID NO: 2796101 - RNA, 23 nt, Human
gaacuccuaaaccuuugccccug

SEQ ID NO: 2796102 - RNA, 24 nt, Human
gaacuuuccacauucagagcuuac

SEQ ID NO: 2796103 - RNA, 14 nt, Human
gaacuuguagcugu

SEQ ID NO: 2796104 - RNA, 15 nt, Human
gaacuuguagcugua

SEQ ID NO: 2796105 - RNA, 17 nt, Human
gaacuuguagcuguaaa

SEQ ID NO: 2796106 - RNA, 18 nt, Human
gaacuuguagcuguaaaa

SEQ ID NO: 2796107 - RNA, 15 nt, Human
gaacuuguuuucugg

SEQ ID NO: 2796108 - RNA, 23 nt, Human
gaacuuucucuucauacuuuuuu

SEQ ID NO: 2796109 - RNA, 15 nt, Human
gaacuuugaagaccc

SEQ ID NO: 2796110 - RNA, 15 nt, Human
gaacuuuccauuuug

SEQ ID NO: 2796111 - RNA, 12 nt, Human
gaacuuuccugg

SEQ ID NO: 2796112 - RNA, 20 nt, Human
gaacuuuccuggaugucuga

SEQ ID NO: 2796113 - RNA, 21 nt, Human
gaacuuucucuucauacuuuu

SEQ ID NO: 2796114 - RNA, 18 nt, Human
gaagaaauuauaaagaua

SEQ ID NO: 2796115 - RNA, 22 nt, Human
gaagaaauuauaaagauaaagc

SEQ ID NO: 2796116 - RNA, 17 nt, Human
gaagaaauacugcacuu

SEQ ID NO: 2796117 - RNA, 15 nt, Human
gaagagcucaaggga

SEQ ID NO: 2796118 - RNA, 20 nt, Human
gaagagcucaagggacaagg

SEQ ID NO: 2796119 - RNA, 21 nt, Human
gaagagcucaagggacaagga

SEQ ID NO: 2796120 - RNA, 23 nt, Human
gaagagcucaagggacaaggaca

SEQ ID NO: 2796121 - RNA, 22 nt, Human
gaagagcuccccuacggaccag

SEQ ID NO: 2796122 - RNA, 14 nt, Human
gaagagcuugcuuu

SEQ ID NO: 2796123 - RNA, 16 nt, Human
gaagagcuugcuuuga

SEQ ID NO: 2796124 - RNA, 20 nt, Human
gaagagcuugcuuugauuua

SEQ ID NO: 2796125 - RNA, 16 nt, Human
gaagaguccucugaau

SEQ ID NO: 2796126 - RNA, 14 nt, Human
gaagaguccucuga

SEQ ID NO: 2796127 - RNA, 17 nt, Human
gaagaggaacugggccu

SEQ ID NO: 2796128 - RNA, 16 nt, Human
gaagaagggcacccua

SEQ ID NO: 2796129 - RNA, 18 nt, Human
gaagaaggggacaauggc

SEQ ID NO: 2796130 - RNA, 20 nt, Human
gaagaagguggaccuuuuaa

SEQ ID NO: 2796131 - RNA, 21 nt, Human
gaagaagguggaccuuuuaaa

SEQ ID NO: 2796132 - RNA, 23 nt, Human
gaagaagguggaccuuuuaaagu

SEQ ID NO: 2796133 - RNA, 18 nt, Human
gaagcauuuacuuugugu

SEQ ID NO: 2796134 - RNA, 22 nt, Human
gaagaugcuccagcaacacagc

SEQ ID NO: 2796135 - RNA, 13 nt, Human
gaagaugcagcuc

SEQ ID NO: 2796136 - RNA, 14 nt, Human
gaagaugcagcuca

SEQ ID NO: 2796137 - RNA, 18 nt, Human
gaagaugcauuguaguuu

SEQ ID NO: 2796138 - RNA, 24 nt, Human
gaagaugcgagcgcuaucuucaca

SEQ ID NO: 2796139 - RNA, 13 nt, Human
gaagauggcuguu

SEQ ID NO: 2796140 - RNA, 16 nt, Human
gaagauggcuguuagc

SEQ ID NO: 2796141 - RNA, 13 nt, Human
gaagaugaucaga

SEQ ID NO: 2796142 - RNA, 16 nt, Human
gaagaugaucagaccu

SEQ ID NO: 2796143 - RNA, 15 nt, Human
gaagaugaauggcgu

SEQ ID NO: 2796144 - RNA, 14 nt, Human
gaagaguugaggaa

SEQ ID NO: 2796145 - RNA, 23 nt, Human
gaagaguugaggaacuguacaga

SEQ ID NO: 2796146 - RNA, 21 nt, Human
gaagaguugccccgucucugu

SEQ ID NO: 2796147 - RNA, 22 nt, Human
gaagaguugccccgucucuguu

SEQ ID NO: 2796148 - RNA, 14 nt, Human
gaagaguugugcac

SEQ ID NO: 2796149 - RNA, 21 nt, Human
gaagaguugugcacgcagauu

SEQ ID NO: 2796150 - RNA, 13 nt, Human
gaagagugugugu

SEQ ID NO: 2796151 - RNA, 14 nt, Human
gaagagugugugug

SEQ ID NO: 2796152 - RNA, 14 nt, Human
gaagauaguaacug

SEQ ID NO: 2796153 - RNA, 22 nt, Human
gaagauauaacuauugcccagg

SEQ ID NO: 2796154 - RNA, 15 nt, Human
gaagauauacaugaa

SEQ ID NO: 2796155 - RNA, 21 nt, Human
gaagauauaacuauugcccag

SEQ ID NO: 2796156 - RNA, 22 nt, Human
gaagagucuugguuucucucua

SEQ ID NO: 2796157 - RNA, 15 nt, Human
gaagauccccucagg

SEQ ID NO: 2796158 - RNA, 16 nt, Human
gaagauccccucagga

SEQ ID NO: 2796159 - RNA, 20 nt, Human
gaagauccccucaggacugc

SEQ ID NO: 2796160 - RNA, 17 nt, Human
gaagauccuaaaacaaa

SEQ ID NO: 2796161 - RNA, 13 nt, Human
gaagauccuguga

SEQ ID NO: 2796162 - RNA, 14 nt, Human
gaagauccugugag

SEQ ID NO: 2796163 - RNA, 15 nt, Human
gaagauccugugagg

SEQ ID NO: 2796164 - RNA, 20 nt, Human
gaagauccugugaggagccc

SEQ ID NO: 2796165 - RNA, 13 nt, Human
gaagaucuguaau

SEQ ID NO: 2796166 - RNA, 21 nt, Human
gaagaucucacucugcccccc

SEQ ID NO: 2796167 - RNA, 17 nt, Human
gaaguccaauguggcaa

SEQ ID NO: 2796168 - RNA, 14 nt, Human
gaaguccaaugugg

SEQ ID NO: 2796169 - RNA, 22 nt, Human
gaagucaccuuguguguuccaa

SEQ ID NO: 2796170 - RNA, 18 nt, Human
gaagucccuugccauccu

SEQ ID NO: 2796171 - RNA, 18 nt, Human
gaaguccuauggaaaccc

SEQ ID NO: 2796172 - RNA, 22 nt, Human
gaaguccuauggaaacccgagg

SEQ ID NO: 2796173 - RNA, 18 nt, Human
gaaguccuguaugucugu

SEQ ID NO: 2796174 - RNA, 15 nt, Human
gaagucacugcacag

SEQ ID NO: 2796175 - RNA, 16 nt, Human
gaagucaagcucaaca

SEQ ID NO: 2796176 - RNA, 13 nt, Human
gaagucacacagu

SEQ ID NO: 2796177 - RNA, 12 nt, Human
gaaguaaagccu

SEQ ID NO: 2796178 - RNA, 15 nt, Human
gaaguaaagccucaa

SEQ ID NO: 2796179 - RNA, 14 nt, Human
gaaguaacaguaac

SEQ ID NO: 2796180 - RNA, 19 nt, Human
gaaguaaccauuugcacug

SEQ ID NO: 2796181 - RNA, 14 nt, Human
gaaggaggggaagc

SEQ ID NO: 2796182 - RNA, 16 nt, Human
gaaggaggggaagcug

SEQ ID NO: 2796183 - RNA, 17 nt, Human
gaaggaggggaagcugc

SEQ ID NO: 2796184 - RNA, 18 nt, Human
gaaggaggggaagcugca

SEQ ID NO: 2796185 - RNA, 19 nt, Human
gaaggaggggaagcugcag

SEQ ID NO: 2796186 - RNA, 20 nt, Human
gaaggaggggaagcugcagc

SEQ ID NO: 2796187 - RNA, 20 nt, Human
gaaggaggguacagcugggc

SEQ ID NO: 2796188 - RNA, 13 nt, Human
gaaggauuguaaa

SEQ ID NO: 2796189 - RNA, 18 nt, Human
gaaggcagggagggccug

SEQ ID NO: 2796190 - RNA, 14 nt, Human
gaaggauuguaaaa

SEQ ID NO: 2796191 - RNA, 21 nt, Human
gaaggcagggggaaggugggg

SEQ ID NO: 2796192 - RNA, 23 nt, Human
gaaggcagggagggccugggccc

SEQ ID NO: 2796193 - RNA, 22 nt, Human
gaaggcagggagggccugggcc

SEQ ID NO: 2796194 - RNA, 20 nt, Human
gaaggcagggagggccuggg

SEQ ID NO: 2796195 - RNA, 23 nt, Human
gaaggggcccugguccuuccagg

SEQ ID NO: 2796196 - RNA, 22 nt, Human
gaaggggccucaccgagugggg

SEQ ID NO: 2796197 - RNA, 19 nt, Human
gaaggauuuuuuaaaguuu

SEQ ID NO: 2796198 - RNA, 22 nt, Human
gaaggcagggggaagguggggu

SEQ ID NO: 2796199 - RNA, 17 nt, Human
gaaggcaucagucccua

SEQ ID NO: 2796200 - RNA, 23 nt, Human
gaaggggcaaauucuuuugaauu

SEQ ID NO: 2796201 - RNA, 14 nt, Human
gaaggucaccagca

SEQ ID NO: 2796202 - RNA, 14 nt, Human
gaaggugacagcag

SEQ ID NO: 2796203 - RNA, 15 nt, Human
gaaggugacagcagu

SEQ ID NO: 2796204 - RNA, 15 nt, Human
gaaggucucauucuu

SEQ ID NO: 2796205 - RNA, 13 nt, Human
gaagccucuggga

SEQ ID NO: 2796206 - RNA, 13 nt, Human
gaagccugaggcu

SEQ ID NO: 2796207 - RNA, 12 nt, Human
gaagccugaggc

SEQ ID NO: 2796208 - RNA, 21 nt, Human
gaagccucugggucagugguc

SEQ ID NO: 2796209 - RNA, 16 nt, Human
gaagccaaauuuauca

SEQ ID NO: 2796210 - RNA, 15 nt, Human
gaagauuuucagucu

SEQ ID NO: 2796211 - RNA, 16 nt, Human
gaagauuuucagucua

SEQ ID NO: 2796212 - RNA, 17 nt, Human
gaagauuuucagucuag

SEQ ID NO: 2796213 - RNA, 12 nt, Human
gaagcauuugua

SEQ ID NO: 2796214 - RNA, 14 nt, Human
gaagcauuuguauu

SEQ ID NO: 2796215 - RNA, 15 nt, Human
gaagcauuuguauuu

SEQ ID NO: 2796216 - RNA, 16 nt, Human
gaagcauuuguauuuu

SEQ ID NO: 2796217 - RNA, 18 nt, Human
gaagcauuuguauuuugu

SEQ ID NO: 2796218 - RNA, 20 nt, Human
gaagcauuuguauuuugugu

SEQ ID NO: 2796219 - RNA, 22 nt, Human
gaagcauuuguauuuuguguga

SEQ ID NO: 2796220 - RNA, 15 nt, Human
gaagcuucagaaguu

SEQ ID NO: 2796221 - RNA, 22 nt, Human
gaagcuguuguacauuuaugau

SEQ ID NO: 2796222 - RNA, 16 nt, Human
gaagcuguuguacauu

SEQ ID NO: 2796223 - RNA, 18 nt, Human
gaagcuguuguacauuua

SEQ ID NO: 2796224 - RNA, 19 nt, Human
gaagcuguuguacauuuau

SEQ ID NO: 2796225 - RNA, 21 nt, Human
gaagcuguuguacauuuauga

SEQ ID NO: 2796226 - RNA, 18 nt, Human
gaagccuguggaugauca

SEQ ID NO: 2796227 - RNA, 20 nt, Human
gaagccuguggaugaucaau

SEQ ID NO: 2796228 - RNA, 23 nt, Human
gaagccugcguugguccagagcg

SEQ ID NO: 2796229 - RNA, 13 nt, Human
gaagccuggaaca

SEQ ID NO: 2796230 - RNA, 15 nt, Human
gaagccuucagcucc

SEQ ID NO: 2796231 - RNA, 17 nt, Human
gaagccuucagcuccag

SEQ ID NO: 2796232 - RNA, 16 nt, Human
gaagccuucagcucca

SEQ ID NO: 2796233 - RNA, 13 nt, Human
gaagcuguuguac

SEQ ID NO: 2796234 - RNA, 21 nt, Human
gaaggacauugcggacagcca

SEQ ID NO: 2796235 - RNA, 20 nt, Human
gaaggacauugcggacagcc

SEQ ID NO: 2796236 - RNA, 19 nt, Human
gaaggacauugcggacagc

SEQ ID NO: 2796237 - RNA, 22 nt, Human
gaaggaauaaauugcuccuuga

SEQ ID NO: 2796238 - RNA, 15 nt, Human
gaaggacagaaagga

SEQ ID NO: 2796239 - RNA, 17 nt, Human
gaaggacagaaaggaga

SEQ ID NO: 2796240 - RNA, 13 nt, Human
gaaggacauagag

SEQ ID NO: 2796241 - RNA, 15 nt, Human
gaaggaccagcccuu

SEQ ID NO: 2796242 - RNA, 22 nt, Human
gaaggacccggaggggccuggc

SEQ ID NO: 2796243 - RNA, 11 nt, Human
gaagcuucuaa

SEQ ID NO: 2796244 - RNA, 13 nt, Human
gaagcuucuaaua

SEQ ID NO: 2796245 - RNA, 15 nt, Human
gaagcuucuaauaaa

SEQ ID NO: 2796246 - RNA, 19 nt, Human
gaagcuucuaauaaauuau

SEQ ID NO: 2796247 - RNA, 19 nt, Human
gaaggaaagaaagaaggaa

SEQ ID NO: 2796248 - RNA, 22 nt, Human
gaaggaagccaaauuuaucaaa

SEQ ID NO: 2796249 - RNA, 16 nt, Human
gaaggaagugaagagg

SEQ ID NO: 2796250 - RNA, 15 nt, Human
gaaaugagaaggcag

SEQ ID NO: 2796251 - RNA, 24 nt, Human
gaaaugaccuucauucugagacca

SEQ ID NO: 2796252 - RNA, 23 nt, Human
gaaauauauuuuaccauacauuu

SEQ ID NO: 2796253 - RNA, 13 nt, Human
gaaauaucauuua

SEQ ID NO: 2796254 - RNA, 14 nt, Human
gaaauaucauuuau

SEQ ID NO: 2796255 - RNA, 19 nt, Human
gaaauaaaagugaaugaaa

SEQ ID NO: 2796256 - RNA, 21 nt, Human
gaaauaaaagugaaugaaaga

SEQ ID NO: 2796257 - RNA, 23 nt, Human
gaaauaaaagugaaugaaagauu

SEQ ID NO: 2796258 - RNA, 17 nt, Human
gaaauaaaggaugugau

SEQ ID NO: 2796259 - RNA, 12 nt, Human
gaaauaucauuu

SEQ ID NO: 2796260 - RNA, 16 nt, Human
gaaauauauacgaaca

SEQ ID NO: 2796261 - RNA, 20 nt, Human
gaaaguuuacccaugaagau

SEQ ID NO: 2796262 - RNA, 17 nt, Human
gaaauaaacuucacuga

SEQ ID NO: 2796263 - RNA, 20 nt, Human
gaaauaaaggaugugauugu

SEQ ID NO: 2796264 - RNA, 18 nt, Human
gaaauauauacgaacaaa

SEQ ID NO: 2796265 - RNA, 19 nt, Human
gaaauauauacgaacaaaa

SEQ ID NO: 2796266 - RNA, 20 nt, Human
gaaauauauacgaacaaaac

SEQ ID NO: 2796267 - RNA, 22 nt, Human
gaaauauauacgaacaaaacac

SEQ ID NO: 2796268 - RNA, 14 nt, Human
gaaauauauauaca

SEQ ID NO: 2796269 - RNA, 15 nt, Human
gaaauauauauacau

SEQ ID NO: 2796270 - RNA, 16 nt, Human
gaaauauauauacaua

SEQ ID NO: 2796271 - RNA, 18 nt, Human
gaaauauauauacauaug

SEQ ID NO: 2796272 - RNA, 19 nt, Human
gaaauauauauacauaugu

SEQ ID NO: 2796273 - RNA, 21 nt, Human
gaaauauauauacauauguag

SEQ ID NO: 2796274 - RNA, 18 nt, Human
gaaaugcugauggauaac

SEQ ID NO: 2796275 - RNA, 16 nt, Human
gaaaugugguuuuccu

SEQ ID NO: 2796276 - RNA, 14 nt, Human
gaaauguaguugau

SEQ ID NO: 2796277 - RNA, 18 nt, Human
gaaauguaguugauguau

SEQ ID NO: 2796278 - RNA, 21 nt, Human
gaaaugucacguacugucuga

SEQ ID NO: 2796279 - RNA, 22 nt, Human
gaaauguaggcaucaugcaugu

SEQ ID NO: 2796280 - RNA, 13 nt, Human
gaaaugacuaauu

SEQ ID NO: 2796281 - RNA, 12 nt, Human
gaaauguaaugc

SEQ ID NO: 2796282 - RNA, 16 nt, Human
gaaauguaccuucuuu

SEQ ID NO: 2796283 - RNA, 17 nt, Human
gaaaugaggcaugaguu

SEQ ID NO: 2796284 - RNA, 19 nt, Human
gaaaugagaaggcagccac

SEQ ID NO: 2796285 - RNA, 22 nt, Human
gaaaugagcaccuccauuaaag

SEQ ID NO: 2796286 - RNA, 17 nt, Human
gaaaugagaaggcagcc

SEQ ID NO: 2796287 - RNA, 18 nt, Human
gaaaugagaaggcagcca

SEQ ID NO: 2796288 - RNA, 18 nt, Human
gaaaugaggucagagccu

SEQ ID NO: 2796289 - RNA, 11 nt, Human
gaaaugauguu

SEQ ID NO: 2796290 - RNA, 16 nt, Human
gaaaugaggucuguuu

SEQ ID NO: 2796291 - RNA, 17 nt, Human
gaaaugaggucuguuua

SEQ ID NO: 2796292 - RNA, 21 nt, Human
gaaaugaggucuguuuaaagu

SEQ ID NO: 2796293 - RNA, 22 nt, Human
gaaaugaggucuguuuaaagug

SEQ ID NO: 2796294 - RNA, 23 nt, Human
gaaaugaggucuguuuaaagugg

SEQ ID NO: 2796295 - RNA, 16 nt, Human
gaaaugauagauuuga

SEQ ID NO: 2796296 - RNA, 17 nt, Human
gaaaugauagauuugac

SEQ ID NO: 2796297 - RNA, 21 nt, Human
gaaaugauagauuugaccucc

SEQ ID NO: 2796298 - RNA, 16 nt, Human
gaacaggugguuuuua

SEQ ID NO: 2796299 - RNA, 15 nt, Human
gaacagguguuuuuc

SEQ ID NO: 2796300 - RNA, 17 nt, Human
gaacagcuucagguuau

SEQ ID NO: 2796301 - RNA, 14 nt, Human
gaacaggcugggcu

SEQ ID NO: 2796302 - RNA, 14 nt, Human
gaacaguaacugcc

SEQ ID NO: 2796303 - RNA, 14 nt, Human
gaacagcuucaggu

SEQ ID NO: 2796304 - RNA, 15 nt, Human
gaacagcuucagguu

SEQ ID NO: 2796305 - RNA, 16 nt, Human
gaacagcuucagguua

SEQ ID NO: 2796306 - RNA, 22 nt, Human
gaacagacuggaagcacagcuu

SEQ ID NO: 2796307 - RNA, 18 nt, Human
gaacagauaaucagugug

SEQ ID NO: 2796308 - RNA, 19 nt, Human
gaacauccuuugcagggca

SEQ ID NO: 2796309 - RNA, 20 nt, Human
gaacauccuuugcagggcag

SEQ ID NO: 2796310 - RNA, 21 nt, Human
gaacauccuuugcagggcagc

SEQ ID NO: 2796311 - RNA, 22 nt, Human
gaacauccuuugcagggcagcc

SEQ ID NO: 2796312 - RNA, 23 nt, Human
gaacauccuuugcagggcagccc

SEQ ID NO: 2796313 - RNA, 22 nt, Human
gaacaucgcgaugggaaccgau

SEQ ID NO: 2796314 - RNA, 20 nt, Human
gaacaucuuugacacucugc

SEQ ID NO: 2796315 - RNA, 21 nt, Human
gaacaucuuugacacucugca

SEQ ID NO: 2796316 - RNA, 22 nt, Human
gaacaucuuugacacucugcag

SEQ ID NO: 2796317 - RNA, 13 nt, Human
gaaccaaagcuca

SEQ ID NO: 2796318 - RNA, 22 nt, Human
gaacauguccuaauucuucugu

SEQ ID NO: 2796319 - RNA, 24 nt, Human
gaacauguccuaauucuucugucc

SEQ ID NO: 2796320 - RNA, 17 nt, Human
gaaccaagcaggagacg

SEQ ID NO: 2796321 - RNA, 20 nt, Human
gaaccaagcaggagacgaca

SEQ ID NO: 2796322 - RNA, 16 nt, Human
gaaccaagcuauuccu

SEQ ID NO: 2796323 - RNA, 19 nt, Human
gaacagacuggaagcacag

SEQ ID NO: 2796324 - RNA, 20 nt, Human
gaacagacuggaagcacagc

SEQ ID NO: 2796325 - RNA, 17 nt, Human
gaaauuucucaucacag

SEQ ID NO: 2796326 - RNA, 13 nt, Human
gaaauuucuguga

SEQ ID NO: 2796327 - RNA, 14 nt, Human
gaaauuucugugaa

SEQ ID NO: 2796328 - RNA, 13 nt, Human
gaaauuauaucug

SEQ ID NO: 2796329 - RNA, 15 nt, Human
gaaauuauaucugug

SEQ ID NO: 2796330 - RNA, 19 nt, Human
gaaauuauaucuguggucu

SEQ ID NO: 2796331 - RNA, 21 nt, Human
gaaauuacuuaucauccacau

SEQ ID NO: 2796332 - RNA, 13 nt, Human
gaaauuagccggg

SEQ ID NO: 2796333 - RNA, 17 nt, Human
gaaauuauuuaauaaaa

SEQ ID NO: 2796334 - RNA, 12 nt, Human
gaaauuccaaag

SEQ ID NO: 2796335 - RNA, 13 nt, Human
gaaauuauuuaau

SEQ ID NO: 2796336 - RNA, 15 nt, Human
gaaauuauuuaauaa

SEQ ID NO: 2796337 - RNA, 23 nt, Human
gaaauuaugugacauuuuacauu

SEQ ID NO: 2796338 - RNA, 22 nt, Human
gaaauuaugugacauuuuacau

SEQ ID NO: 2796339 - RNA, 23 nt, Human
gaaauuucagauucccagagcaa

SEQ ID NO: 2796340 - RNA, 22 nt, Human
gaaacugaggaauuuucuuugu

SEQ ID NO: 2796341 - RNA, 18 nt, Human
gaaacugaggaauuuucu

SEQ ID NO: 2796342 - RNA, 11 nt, Human
gaaagagagag

SEQ ID NO: 2796343 - RNA, 17 nt, Human
gaaagagagagaaacaa

SEQ ID NO: 2796344 - RNA, 12 nt, Human
gaaagcaacuuu

SEQ ID NO: 2796345 - RNA, 11 nt, Human
gaaagcacaca

SEQ ID NO: 2796346 - RNA, 23 nt, Human
gaaagauggcugugccucugccu

SEQ ID NO: 2796347 - RNA, 13 nt, Human
gaaagcaaaaaug

SEQ ID NO: 2796348 - RNA, 14 nt, Human
gaaagcaaaaaugc

SEQ ID NO: 2796349 - RNA, 15 nt, Human
gaaagcaaaaaugcu

SEQ ID NO: 2796350 - RNA, 16 nt, Human
gaaagcaaaaaugcua

SEQ ID NO: 2796351 - RNA, 17 nt, Human
gaaagcaaaaaugcuaa

SEQ ID NO: 2796352 - RNA, 18 nt, Human
gaaagcaaaaaugcuaau

SEQ ID NO: 2796353 - RNA, 23 nt, Human
gaaagcaaaaaugcuaauauuaa

SEQ ID NO: 2796354 - RNA, 22 nt, Human
gaaagauggcugugccucugcc

SEQ ID NO: 2796355 - RNA, 17 nt, Human
gaaagaugauuugcaau

SEQ ID NO: 2796356 - RNA, 16 nt, Human
gaaagauaaaauagug

SEQ ID NO: 2796357 - RNA, 17 nt, Human
gaaagagucuucaacau

SEQ ID NO: 2796358 - RNA, 22 nt, Human
gaaagagagagagagagagaaa

SEQ ID NO: 2796359 - RNA, 13 nt, Human
gaaagagagcagg

SEQ ID NO: 2796360 - RNA, 21 nt, Human
gaaagagagagaaacaaacuu

SEQ ID NO: 2796361 - RNA, 23 nt, Human
gaaagagauaccaagaugccauc

SEQ ID NO: 2796362 - RNA, 23 nt, Human
gaaaccuuuuuuaagauuuuucu

SEQ ID NO: 2796363 - RNA, 21 nt, Human
gaaaccuuuuuuaagauuuuu

SEQ ID NO: 2796364 - RNA, 22 nt, Human
gaaaccuuuuuuaagauuuuuc

SEQ ID NO: 2796365 - RNA, 13 nt, Human
gaaacgcuaccuc

SEQ ID NO: 2796366 - RNA, 14 nt, Human
gaaacgcuaccucu

SEQ ID NO: 2796367 - RNA, 18 nt, Human
gaaacgcuaccucucugu

SEQ ID NO: 2796368 - RNA, 20 nt, Human
gaaacgcuaccucucugucc

SEQ ID NO: 2796369 - RNA, 21 nt, Human
gaaacgcuaccucucuguccc

SEQ ID NO: 2796370 - RNA, 23 nt, Human
gaaacgcuaccucucugucccuu

SEQ ID NO: 2796371 - RNA, 20 nt, Human
gaaaaaugcccuuaaaucau

SEQ ID NO: 2796372 - RNA, 11 nt, Human
gaaaaaucuug

SEQ ID NO: 2796373 - RNA, 14 nt, Human
gaaaaaucuugugc

SEQ ID NO: 2796374 - RNA, 21 nt, Human
gaaaaaucuugugcuagaaua

SEQ ID NO: 2796375 - RNA, 22 nt, Human
gaaaaaucuugugcuagaauac

SEQ ID NO: 2796376 - RNA, 15 nt, Human
gaaaaaugaaagaug

SEQ ID NO: 2796377 - RNA, 16 nt, Human
gaaaaaugaaagauga

SEQ ID NO: 2796378 - RNA, 17 nt, Human
gaaaaaugaaagaugau

SEQ ID NO: 2796379 - RNA, 18 nt, Human
gaaaaaugaaagaugauu

SEQ ID NO: 2796380 - RNA, 19 nt, Human
gaaaaaugaaagaugauuu

SEQ ID NO: 2796381 - RNA, 20 nt, Human
gaaaaagacuuuaaaaguga

SEQ ID NO: 2796382 - RNA, 14 nt, Human
gaaaaagaaaauaa

SEQ ID NO: 2796383 - RNA, 16 nt, Human
gaaaaaugcuuugcuu

SEQ ID NO: 2796384 - RNA, 16 nt, Human
gaaaaauggagcaaag

SEQ ID NO: 2796385 - RNA, 11 nt, Human
gaaaaauguuu

SEQ ID NO: 2796386 - RNA, 12 nt, Human
gaaaaauguuug

SEQ ID NO: 2796387 - RNA, 13 nt, Human
gaaaaauguuugu

SEQ ID NO: 2796388 - RNA, 14 nt, Human
gaaaaauguuuguc

SEQ ID NO: 2796389 - RNA, 16 nt, Human
gaaaccuuuaagaaaa

SEQ ID NO: 2796390 - RNA, 14 nt, Human
gaaaccuuuuuuaa

SEQ ID NO: 2796391 - RNA, 17 nt, Human
gaaaccuuuuuuaagau

SEQ ID NO: 2796392 - RNA, 18 nt, Human
gaaaccuuuuuuaagauu

SEQ ID NO: 2796393 - RNA, 19 nt, Human
gaaaccuuuuuuaagauuu

SEQ ID NO: 2796394 - RNA, 20 nt, Human
gaaaccuuuuuuaagauuuu

SEQ ID NO: 2796395 - RNA, 15 nt, Human
gaaagcuuuggcagu

SEQ ID NO: 2796396 - RNA, 23 nt, Human
gaaagccaggcagguagccaggg

SEQ ID NO: 2796397 - RNA, 11 nt, Human
gaaagccaggc

SEQ ID NO: 2796398 - RNA, 14 nt, Human
gaaagccaggcagg

SEQ ID NO: 2796399 - RNA, 15 nt, Human
gaaagcacagguggg

SEQ ID NO: 2796400 - RNA, 23 nt, Human
gaaagcacaggugggcuucccag

SEQ ID NO: 2796401 - RNA, 16 nt, Human
gaaagcacaggagaca

SEQ ID NO: 2796402 - RNA, 22 nt, Human
gaaaguacuucuccacccugcu

SEQ ID NO: 2796403 - RNA, 14 nt, Human
gaaaggauucaugu

SEQ ID NO: 2796404 - RNA, 13 nt, Human
gaaaggcaaggga

SEQ ID NO: 2796405 - RNA, 20 nt, Human
gaaagucagaugcccagagg

SEQ ID NO: 2796406 - RNA, 17 nt, Human
gaaagucagaugcccag

SEQ ID NO: 2796407 - RNA, 22 nt, Human
gaaagucgaauuaauagcuuuu

SEQ ID NO: 2796408 - RNA, 21 nt, Human
gaaagucuaucuaaugacaug

SEQ ID NO: 2796409 - RNA, 13 nt, Human
gaaaggagacuag

SEQ ID NO: 2796410 - RNA, 17 nt, Human
gaaaggaggcaugccuc

SEQ ID NO: 2796411 - RNA, 18 nt, Human
gaaaggaggcaugccucu

SEQ ID NO: 2796412 - RNA, 19 nt, Human
gaaaggaggcaugccucug

SEQ ID NO: 2796413 - RNA, 20 nt, Human
gaaaggaggcaugccucuga

SEQ ID NO: 2796414 - RNA, 21 nt, Human
gaaaggaggcaugccucugau

SEQ ID NO: 2796415 - RNA, 11 nt, Human
gaaaggagacu

SEQ ID NO: 2796416 - RNA, 18 nt, Human
gaaaggaagcuccacugu

SEQ ID NO: 2796417 - RNA, 22 nt, Human
gaaaggaagcuccacugucacc

SEQ ID NO: 2796418 - RNA, 18 nt, Human
gaaaggaaaaccugaaga

SEQ ID NO: 2796419 - RNA, 20 nt, Human
gaaaggaaaaccugaagacu

SEQ ID NO: 2796420 - RNA, 17 nt, Human
gaaaguguuauuuuuca

SEQ ID NO: 2796421 - RNA, 23 nt, Human
gaaaguguuauuuuucaaggaag

SEQ ID NO: 2796422 - RNA, 15 nt, Human
gaaaguguaaauguu

SEQ ID NO: 2796423 - RNA, 16 nt, Human
gaaaguagaacuuacu

SEQ ID NO: 2796424 - RNA, 23 nt, Human
gaaagugggugagaugcuggaga

SEQ ID NO: 2796425 - RNA, 21 nt, Human
gaaagugggugagaugcugga

SEQ ID NO: 2796426 - RNA, 21 nt, Human
gaaagugggaggucaggaaac

SEQ ID NO: 2796427 - RNA, 14 nt, Human
gaaagugaugacau

SEQ ID NO: 2796428 - RNA, 15 nt, Human
gaaagugaugacaua

SEQ ID NO: 2796429 - RNA, 13 nt, Human
gaaagugaggaaa

SEQ ID NO: 2796430 - RNA, 20 nt, Human
gaaagugaggaaauaaaguu

SEQ ID NO: 2796431 - RNA, 15 nt, Human
gaaagugaauaaacu

SEQ ID NO: 2796432 - RNA, 17 nt, Human
gaaagugaauaaacuuc

SEQ ID NO: 2796433 - RNA, 18 nt, Human
gaaagugaauaaacuuca

SEQ ID NO: 2796434 - RNA, 20 nt, Human
gaaagugaauaaacuucagc

SEQ ID NO: 2796435 - RNA, 21 nt, Human
gaaagugaauaaacuucagca

SEQ ID NO: 2796436 - RNA, 22 nt, Human
gaaagugaauaaacuucagcac

SEQ ID NO: 2796437 - RNA, 16 nt, Human
gaaagugaaaguccag

SEQ ID NO: 2796438 - RNA, 19 nt, Human
gaaaguugcacggcugcug

SEQ ID NO: 2796439 - RNA, 20 nt, Human
gaaaguugcacggcugcuga

SEQ ID NO: 2796440 - RNA, 13 nt, Human
gaaaguuguacau

SEQ ID NO: 2796441 - RNA, 17 nt, Human
gaaaguuguacaugaaa

SEQ ID NO: 2796442 - RNA, 18 nt, Human
gaaaguuguacaugaaau

SEQ ID NO: 2796443 - RNA, 16 nt, Human
gaaaguuuacaggaaa

SEQ ID NO: 2796444 - RNA, 18 nt, Human
gaaaguugcacggcugcu

SEQ ID NO: 2796445 - RNA, 14 nt, Human
gaaaguuuacagga

SEQ ID NO: 2796446 - RNA, 20 nt, Human
gaaaguuucguuauauuaaa

SEQ ID NO: 2796447 - RNA, 22 nt, Human
gaaaguuuucagaaccucuucc

SEQ ID NO: 2796448 - RNA, 23 nt, Human
gaaaguuuugaguagauauuacu

SEQ ID NO: 2796449 - RNA, 14 nt, Human
gaaauaaaaccuuu

SEQ ID NO: 2796450 - RNA, 18 nt, Human
gaaauaaaaccuuucaaa

SEQ ID NO: 2796451 - RNA, 17 nt, Human
gaaauaaaaccuuucaa

SEQ ID NO: 2796452 - RNA, 16 nt, Human
gaaauaaaaccuuuca

SEQ ID NO: 2796453 - RNA, 15 nt, Human
gaaauaaaaccuuuc

SEQ ID NO: 2796454 - RNA, 11 nt, Human
cuugcauugac

SEQ ID NO: 2796455 - RNA, 14 nt, Human
cuugcauugacauu

SEQ ID NO: 2796456 - RNA, 10 nt, Human
cuugcauuga

SEQ ID NO: 2796457 - RNA, 21 nt, Human
cuugcuggacggggacugggg

SEQ ID NO: 2796458 - RNA, 17 nt, Human
cuugcuggacggggacu

SEQ ID NO: 2796459 - RNA, 12 nt, Human
cuugcugcuaga

SEQ ID NO: 2796460 - RNA, 13 nt, Human
cuugcugcuagaa

SEQ ID NO: 2796461 - RNA, 14 nt, Human
cuugcugcuagaac

SEQ ID NO: 2796462 - RNA, 15 nt, Human
cuugcugcuagaacu

SEQ ID NO: 2796463 - RNA, 16 nt, Human
cuugcugcuagaacuu

SEQ ID NO: 2796464 - RNA, 17 nt, Human
cuugcugcuagaacuuu

SEQ ID NO: 2796465 - RNA, 18 nt, Human
cuugcugcuagaacuuuu

SEQ ID NO: 2796466 - RNA, 14 nt, Human
cuugcuguccuagg

SEQ ID NO: 2796467 - RNA, 13 nt, Human
cuugcuguaugcu

SEQ ID NO: 2796468 - RNA, 19 nt, Human
cuugcuguaugcugaucau

SEQ ID NO: 2796469 - RNA, 19 nt, Human
cuugcugucccuuggaacu

SEQ ID NO: 2796470 - RNA, 11 nt, Human
cuugcuuucua

SEQ ID NO: 2796471 - RNA, 21 nt, Human
cuugcuuucuaugcuguuugu

SEQ ID NO: 2796472 - RNA, 18 nt, Human
cuugcuuucuuuuuuaaa

SEQ ID NO: 2796473 - RNA, 22 nt, Human
cuugcuuucuuuuuuaaaauca

SEQ ID NO: 2796474 - RNA, 23 nt, Human
cuugcuuucuuuuuuaaaaucaa

SEQ ID NO: 2796475 - RNA, 13 nt, Human
cuugcuuugauuu

SEQ ID NO: 2796476 - RNA, 14 nt, Human
cuugcuuugauuua

SEQ ID NO: 2796477 - RNA, 20 nt, Human
cuugcuuugauuuacagcaa

SEQ ID NO: 2796478 - RNA, 21 nt, Human
cuugcuuugauuuacagcaag

SEQ ID NO: 2796479 - RNA, 12 nt, Human
cuugcuuguacc

SEQ ID NO: 2796480 - RNA, 16 nt, Human
cuugcuuguaccucug

SEQ ID NO: 2796481 - RNA, 18 nt, Human
cuugcuuguaccucuggc

SEQ ID NO: 2796482 - RNA, 13 nt, Human
cuugcuuguuaca

SEQ ID NO: 2796483 - RNA, 14 nt, Human
cuugcuuguuacau

SEQ ID NO: 2796484 - RNA, 22 nt, Human
cuugcuggacggggacugggga

SEQ ID NO: 2796485 - RNA, 15 nt, Human
cuuggcguggagcag

SEQ ID NO: 2796486 - RNA, 16 nt, Human
cuuggcguggagcagg

SEQ ID NO: 2796487 - RNA, 18 nt, Human
cuuggcguggagcaggcg

SEQ ID NO: 2796488 - RNA, 17 nt, Human
cuuggcuacacagggau

SEQ ID NO: 2796489 - RNA, 23 nt, Human
cuuggcucaaguccucuuuucug

SEQ ID NO: 2796490 - RNA, 12 nt, Human
cuuggcucagac

SEQ ID NO: 2796491 - RNA, 21 nt, Human
cuuggcucaauccucuaagcu

SEQ ID NO: 2796492 - RNA, 24 nt, Human
cuuggcucacugcaacuucugccu

SEQ ID NO: 2796493 - RNA, 13 nt, Human
cuuggcugcaggg

SEQ ID NO: 2796494 - RNA, 12 nt, Human
cuuggcugcagg

SEQ ID NO: 2796495 - RNA, 14 nt, Human
cuuggcucagacau

SEQ ID NO: 2796496 - RNA, 16 nt, Human
cuuggcucagacaugu

SEQ ID NO: 2796497 - RNA, 14 nt, Human
cuuggcuccaugcu

SEQ ID NO: 2796498 - RNA, 16 nt, Human
cuuggcuccaugcucc

SEQ ID NO: 2796499 - RNA, 22 nt, Human
cuuggcuccaugcuccucacug

SEQ ID NO: 2796500 - RNA, 21 nt, Human
cuuggauagcuaauaaugagc

SEQ ID NO: 2796501 - RNA, 23 nt, Human
cuuggauaccuagaccguuauaa

SEQ ID NO: 2796502 - RNA, 21 nt, Human
cuuggauuauuuuaaaucauu

SEQ ID NO: 2796503 - RNA, 22 nt, Human
cuuggaguauuggggucugacc

SEQ ID NO: 2796504 - RNA, 22 nt, Human
cuuggaguuuuucauugucgcu

SEQ ID NO: 2796505 - RNA, 21 nt, Human
cuuguaaauagcucagguguc

SEQ ID NO: 2796506 - RNA, 22 nt, Human
cuuggggccaccaaagcugccc

SEQ ID NO: 2796507 - RNA, 21 nt, Human
cuuggggccaccaaagcugcc

SEQ ID NO: 2796508 - RNA, 23 nt, Human
cuuggggccaccaaagcugccca

SEQ ID NO: 2796509 - RNA, 18 nt, Human
cuuguaaaaauuaaaagu

SEQ ID NO: 2796510 - RNA, 19 nt, Human
cuuggggccaccaaagcug

SEQ ID NO: 2796511 - RNA, 20 nt, Human
cuuggggcaacauuguucac

SEQ ID NO: 2796512 - RNA, 23 nt, Human
cuuggggcaacauuguucaccuu

SEQ ID NO: 2796513 - RNA, 21 nt, Human
cuuggcuucugugaugagcug

SEQ ID NO: 2796514 - RNA, 14 nt, Human
cuuggcuugcccac

SEQ ID NO: 2796515 - RNA, 14 nt, Human
cuuggcuuaccuga

SEQ ID NO: 2796516 - RNA, 15 nt, Human
cuuggcuuaccugac

SEQ ID NO: 2796517 - RNA, 16 nt, Human
cuuggcuuaccugacc

SEQ ID NO: 2796518 - RNA, 17 nt, Human
cuuggcuuaccugaccu

SEQ ID NO: 2796519 - RNA, 18 nt, Human
cuuggcuuaccugaccuc

SEQ ID NO: 2796520 - RNA, 19 nt, Human
cuuggcuuaccugaccucu

SEQ ID NO: 2796521 - RNA, 22 nt, Human
cuuggcuuaccugaccucuugc

SEQ ID NO: 2796522 - RNA, 23 nt, Human
cuuggcuuaccugaccucuugcu

SEQ ID NO: 2796523 - RNA, 24 nt, Human
cuuggcuuaccugaccucuugcug

SEQ ID NO: 2796524 - RNA, 12 nt, Human
cuuggcugugag

SEQ ID NO: 2796525 - RNA, 13 nt, Human
cuuggcugugagg

SEQ ID NO: 2796526 - RNA, 21 nt, Human
cuuggcugugaggccccugga

SEQ ID NO: 2796527 - RNA, 17 nt, Human
cuuggcuucugugauga

SEQ ID NO: 2796528 - RNA, 13 nt, Human
cuuggcuucugug

SEQ ID NO: 2796529 - RNA, 20 nt, Human
cuuggcuguuggcagugagu

SEQ ID NO: 2796530 - RNA, 13 nt, Human
cuuggcuggugca

SEQ ID NO: 2796531 - RNA, 16 nt, Human
cuuggcuggugcaccu

SEQ ID NO: 2796532 - RNA, 23 nt, Human
cuugucacugguagaccaaaaua

SEQ ID NO: 2796533 - RNA, 11 nt, Human
cuugucacuug

SEQ ID NO: 2796534 - RNA, 13 nt, Human
cuugucacuugca

SEQ ID NO: 2796535 - RNA, 16 nt, Human
cuugucacuugcaugu

SEQ ID NO: 2796536 - RNA, 15 nt, Human
cuugucagacauaaa

SEQ ID NO: 2796537 - RNA, 16 nt, Human
cuugucagacauaaag

SEQ ID NO: 2796538 - RNA, 17 nt, Human
cuugucagacauaaagc

SEQ ID NO: 2796539 - RNA, 18 nt, Human
cuugucagacauaaagcc

SEQ ID NO: 2796540 - RNA, 19 nt, Human
cuugucagacauaaagcca

SEQ ID NO: 2796541 - RNA, 20 nt, Human
cuugucagacauaaagccau

SEQ ID NO: 2796542 - RNA, 15 nt, Human
cuugucacugguaga

SEQ ID NO: 2796543 - RNA, 17 nt, Human
cuugucacugacacaaa

SEQ ID NO: 2796544 - RNA, 18 nt, Human
cuugucacugacacaaag

SEQ ID NO: 2796545 - RNA, 20 nt, Human
cuugucacugacacaaagga

SEQ ID NO: 2796546 - RNA, 21 nt, Human
cuugucacugacacaaaggaa

SEQ ID NO: 2796547 - RNA, 23 nt, Human
cuugucacugacacaaaggaagu

SEQ ID NO: 2796548 - RNA, 18 nt, Human
cuuguggacacagcucuu

SEQ ID NO: 2796549 - RNA, 17 nt, Human
cuuguggacacagcucu

SEQ ID NO: 2796550 - RNA, 16 nt, Human
cuuguggacacagcuc

SEQ ID NO: 2796551 - RNA, 22 nt, Human
cuugucacugguagaccaaaau

SEQ ID NO: 2796552 - RNA, 18 nt, Human
cuuguauccucugguucu

SEQ ID NO: 2796553 - RNA, 15 nt, Human
cuuguaaggcuuuga

SEQ ID NO: 2796554 - RNA, 16 nt, Human
cuuguaauauuuugua

SEQ ID NO: 2796555 - RNA, 17 nt, Human
cuuguaauauuuuguau

SEQ ID NO: 2796556 - RNA, 18 nt, Human
cuuguaauauuuuguauu

SEQ ID NO: 2796557 - RNA, 20 nt, Human
cuuguaauauuuuguauuau

SEQ ID NO: 2796558 - RNA, 21 nt, Human
cuuguaugaaagauggcugug

SEQ ID NO: 2796559 - RNA, 20 nt, Human
cuuguaucaacacuguuacu

SEQ ID NO: 2796560 - RNA, 19 nt, Human
cuuguaucaacacuguuac

SEQ ID NO: 2796561 - RNA, 23 nt, Human
cuuguaaauguguuggacaaaug

SEQ ID NO: 2796562 - RNA, 13 nt, Human
cuugcaucaaggg

SEQ ID NO: 2796563 - RNA, 14 nt, Human
cuugcaucaagggg

SEQ ID NO: 2796564 - RNA, 17 nt, Human
cuugcaucaagggguca

SEQ ID NO: 2796565 - RNA, 18 nt, Human
cuugcagacucuacagag

SEQ ID NO: 2796566 - RNA, 18 nt, Human
cuugcaguucagcaccac

SEQ ID NO: 2796567 - RNA, 15 nt, Human
cuugcagucaucaga

SEQ ID NO: 2796568 - RNA, 16 nt, Human
cuugcagucaucagaa

SEQ ID NO: 2796569 - RNA, 17 nt, Human
cuugcagucaucagaag

SEQ ID NO: 2796570 - RNA, 22 nt, Human
cuugcaguucagcaccacccua

SEQ ID NO: 2796571 - RNA, 14 nt, Human
cuugcaguucuuga

SEQ ID NO: 2796572 - RNA, 16 nt, Human
cuugcaguucuugagu

SEQ ID NO: 2796573 - RNA, 21 nt, Human
cuugagugggguuaucucugu

SEQ ID NO: 2796574 - RNA, 18 nt, Human
cuugaguauaagaaaugc

SEQ ID NO: 2796575 - RNA, 22 nt, Human
cuugagugggguuaucucugug

SEQ ID NO: 2796576 - RNA, 17 nt, Human
cuugaguucccagaugg

SEQ ID NO: 2796577 - RNA, 23 nt, Human
cuugagugggguuaucucugugu

SEQ ID NO: 2796578 - RNA, 16 nt, Human
cuugaguguaauguuu

SEQ ID NO: 2796579 - RNA, 20 nt, Human
cuugaguguaauguuuguua

SEQ ID NO: 2796580 - RNA, 14 nt, Human
cuugcaauggcagc

SEQ ID NO: 2796581 - RNA, 18 nt, Human
cuugcaagcaugcuugug

SEQ ID NO: 2796582 - RNA, 16 nt, Human
cuugcaagcaugcuug

SEQ ID NO: 2796583 - RNA, 17 nt, Human
cuugcaagcaugcuugu

SEQ ID NO: 2796584 - RNA, 21 nt, Human
cuugcacuaaaguauguaaag

SEQ ID NO: 2796585 - RNA, 21 nt, Human
cuugcacgcgcccuuucuacc

SEQ ID NO: 2796586 - RNA, 22 nt, Human
cuugcacgcgcccuuucuacca

SEQ ID NO: 2796587 - RNA, 13 nt, Human
cuugcagaacugc

SEQ ID NO: 2796588 - RNA, 15 nt, Human
cuugcagaacugcca

SEQ ID NO: 2796589 - RNA, 16 nt, Human
cuugcagaacugccau

SEQ ID NO: 2796590 - RNA, 17 nt, Human
cuugcagaacugccauu

SEQ ID NO: 2796591 - RNA, 18 nt, Human
cuugcagaacugccauua

SEQ ID NO: 2796592 - RNA, 21 nt, Human
cuugaggaaacaacagcuuua

SEQ ID NO: 2796593 - RNA, 14 nt, Human
cuugaggccaggag

SEQ ID NO: 2796594 - RNA, 24 nt, Human
cuugaggcuuagcuuugcucugcc

SEQ ID NO: 2796595 - RNA, 14 nt, Human
cuugagggcccaga

SEQ ID NO: 2796596 - RNA, 16 nt, Human
cuugagggcccagagc

SEQ ID NO: 2796597 - RNA, 17 nt, Human
cuugagggcccagagca

SEQ ID NO: 2796598 - RNA, 18 nt, Human
cuugagggcccagagcag

SEQ ID NO: 2796599 - RNA, 19 nt, Human
cuugagggcccagagcagg

SEQ ID NO: 2796600 - RNA, 15 nt, Human
cuugagguggccucc

SEQ ID NO: 2796601 - RNA, 22 nt, Human
cuugagguggccuccuugcuug

SEQ ID NO: 2796602 - RNA, 21 nt, Human
cuugaggugguaguaaaacac

SEQ ID NO: 2796603 - RNA, 22 nt, Human
cuugagaguaucaggucuccca

SEQ ID NO: 2796604 - RNA, 21 nt, Human
cuugagauguaugaaggcuuu

SEQ ID NO: 2796605 - RNA, 22 nt, Human
cuugagauguaugaaggcuuuu

SEQ ID NO: 2796606 - RNA, 20 nt, Human
cuugaacccgggaggcagag

SEQ ID NO: 2796607 - RNA, 18 nt, Human
cuugaacuccuggccuca

SEQ ID NO: 2796608 - RNA, 17 nt, Human
cuugaacuccuggccuc

SEQ ID NO: 2796609 - RNA, 15 nt, Human
cuugaacuccuggcc

SEQ ID NO: 2796610 - RNA, 14 nt, Human
cuugaacuccuggc

SEQ ID NO: 2796611 - RNA, 16 nt, Human
cuugaacuggguacuu

SEQ ID NO: 2796612 - RNA, 19 nt, Human
cuugaacuccuggccucaa

SEQ ID NO: 2796613 - RNA, 20 nt, Human
cuugaaauuaagaaggcaaa

SEQ ID NO: 2796614 - RNA, 19 nt, Human
cuugaaauuuuaaacuaua

SEQ ID NO: 2796615 - RNA, 14 nt, Human
cuugaacucugggc

SEQ ID NO: 2796616 - RNA, 18 nt, Human
cuugaacucugggcucaa

SEQ ID NO: 2796617 - RNA, 20 nt, Human
cuugaacuggguacuugugg

SEQ ID NO: 2796618 - RNA, 18 nt, Human
cuugaacuggguacuugu

SEQ ID NO: 2796619 - RNA, 24 nt, Human
cuugaacuucaccugcaaagcucu

SEQ ID NO: 2796620 - RNA, 19 nt, Human
cuugaacuuuccuggaugu

SEQ ID NO: 2796621 - RNA, 23 nt, Human
cuugaacuuuccuggaugucuga

SEQ ID NO: 2796622 - RNA, 17 nt, Human
cuugaccaggccugggc

SEQ ID NO: 2796623 - RNA, 15 nt, Human
cuugaccaggccugg

SEQ ID NO: 2796624 - RNA, 14 nt, Human
cuucuuugauaaug

SEQ ID NO: 2796625 - RNA, 23 nt, Human
cuucuuucucucagccuuacauu

SEQ ID NO: 2796626 - RNA, 17 nt, Human
cuucuuugauaauguua

SEQ ID NO: 2796627 - RNA, 19 nt, Human
cuucuuugauaauguuaaa

SEQ ID NO: 2796628 - RNA, 12 nt, Human
cuucuuugaaga

SEQ ID NO: 2796629 - RNA, 13 nt, Human
cuucuuugaagaa

SEQ ID NO: 2796630 - RNA, 14 nt, Human
cuucuuugaagaag

SEQ ID NO: 2796631 - RNA, 20 nt, Human
cugucugacaaccucuuggu

SEQ ID NO: 2796632 - RNA, 15 nt, Human
cugucugagacucac

SEQ ID NO: 2796633 - RNA, 14 nt, Human
cuucuuuauacugu

SEQ ID NO: 2796634 - RNA, 20 nt, Human
cuucuuuauacuguaauuua

SEQ ID NO: 2796635 - RNA, 19 nt, Human
cugucucugaaguacuaac

SEQ ID NO: 2796636 - RNA, 11 nt, Human
cugucucucuc

SEQ ID NO: 2796637 - RNA, 12 nt, Human
cugucucugcuc

SEQ ID NO: 2796638 - RNA, 13 nt, Human
cugucucugcucg

SEQ ID NO: 2796639 - RNA, 17 nt, Human
cugucucugcucgcccu

SEQ ID NO: 2796640 - RNA, 21 nt, Human
cugucucugcucgcccuccuu

SEQ ID NO: 2796641 - RNA, 13 nt, Human
cugucucuggccu

SEQ ID NO: 2796642 - RNA, 15 nt, Human
cugucucuugaaaaa

SEQ ID NO: 2796643 - RNA, 18 nt, Human
cugucucuugaaaaaugc

SEQ ID NO: 2796644 - RNA, 19 nt, Human
cugucucuuuaagggcaug

SEQ ID NO: 2796645 - RNA, 23 nt, Human
cugucucuuuaagggcaugccuu

SEQ ID NO: 2796646 - RNA, 21 nt, Human
cugucugaaccacgcgggggc

SEQ ID NO: 2796647 - RNA, 21 nt, Human
cuugaaauuaagaaggcaaaa

SEQ ID NO: 2796648 - RNA, 17 nt, Human
cuugaaauuauaucugu

SEQ ID NO: 2796649 - RNA, 20 nt, Human
cuugaaauuauaucuguggu

SEQ ID NO: 2796650 - RNA, 21 nt, Human
cuugaaauuauaucugugguc

SEQ ID NO: 2796651 - RNA, 24 nt, Human
cuugaaauuauaucuguggucuuc

SEQ ID NO: 2796652 - RNA, 23 nt, Human
cuucuuuuuauuuucuuuuguaa

SEQ ID NO: 2796653 - RNA, 15 nt, Human
cuucuuuuggcuucc

SEQ ID NO: 2796654 - RNA, 16 nt, Human
cuucuuuugauuaugu

SEQ ID NO: 2796655 - RNA, 13 nt, Human
cuucuuuugcucu

SEQ ID NO: 2796656 - RNA, 13 nt, Human
cuucuuuugauua

SEQ ID NO: 2796657 - RNA, 14 nt, Human
cuucuuuugauuau

SEQ ID NO: 2796658 - RNA, 20 nt, Human
cuucuuuuuauuuucuuuug

SEQ ID NO: 2796659 - RNA, 15 nt, Human
cuucuuuuuauuuuc

SEQ ID NO: 2796660 - RNA, 14 nt, Human
cuucuuuugcucuu

SEQ ID NO: 2796661 - RNA, 14 nt, Human
cuucuuuucucaug

SEQ ID NO: 2796662 - RNA, 15 nt, Human
cuucuuuucuuugua

SEQ ID NO: 2796663 - RNA, 16 nt, Human
cuucuuuucuuuguau

SEQ ID NO: 2796664 - RNA, 19 nt, Human
cuucuuugcuuugcccagc

SEQ ID NO: 2796665 - RNA, 19 nt, Human
cuuuuuagggccaggcagg

SEQ ID NO: 2796666 - RNA, 15 nt, Human
cuuuuucauuuucca

SEQ ID NO: 2796667 - RNA, 17 nt, Human
cuuuuucauuuuccaau

SEQ ID NO: 2796668 - RNA, 18 nt, Human
cuuuuucauuuuccaaua

SEQ ID NO: 2796669 - RNA, 18 nt, Human
cuuuuuccuagccuguuu

SEQ ID NO: 2796670 - RNA, 23 nt, Human
cuuuuuccuagccuguuucuucc

SEQ ID NO: 2796671 - RNA, 12 nt, Human
cuuuuuccuccu

SEQ ID NO: 2796672 - RNA, 13 nt, Human
cuuuuuccagagg

SEQ ID NO: 2796673 - RNA, 12 nt, Human
cuuuuucuaaug

SEQ ID NO: 2796674 - RNA, 13 nt, Human
cuuuuucuaauga

SEQ ID NO: 2796675 - RNA, 20 nt, Human
cuuuuucuaaugaggagaga

SEQ ID NO: 2796676 - RNA, 22 nt, Human
cuuuuucuaaugaggagagaaa

SEQ ID NO: 2796677 - RNA, 21 nt, Human
cuuuuucuccagcugggcucu

SEQ ID NO: 2796678 - RNA, 16 nt, Human
cuuuuuaaccugcaaa

SEQ ID NO: 2796679 - RNA, 13 nt, Human
cuuuuuucaaaau

SEQ ID NO: 2796680 - RNA, 22 nt, Human
cuuuuuucaaaauccaaaaaga

SEQ ID NO: 2796681 - RNA, 14 nt, Human
cuuuuuucaaaauc

SEQ ID NO: 2796682 - RNA, 12 nt, Human
cuuuuuucaaaa

SEQ ID NO: 2796683 - RNA, 15 nt, Human
cuuuuuucacaaauu

SEQ ID NO: 2796684 - RNA, 12 nt, Human
gaaaaacuugug

SEQ ID NO: 2796685 - RNA, 18 nt, Human
cuuuucuaaaagacuucc

SEQ ID NO: 2796686 - RNA, 12 nt, Human
cuuuucuuugua

SEQ ID NO: 2796687 - RNA, 13 nt, Human
cuuuucuuuguau

SEQ ID NO: 2796688 - RNA, 14 nt, Human
cuuuucuuuguauc

SEQ ID NO: 2796689 - RNA, 15 nt, Human
cuuuucuuuguuaua

SEQ ID NO: 2796690 - RNA, 13 nt, Human
cuuuucuuuuguu

SEQ ID NO: 2796691 - RNA, 14 nt, Human
cuuuucuuuuguua

SEQ ID NO: 2796692 - RNA, 15 nt, Human
cuuuucuuuuguuac

SEQ ID NO: 2796693 - RNA, 16 nt, Human
cuuuucuuuuguuacu

SEQ ID NO: 2796694 - RNA, 17 nt, Human
cuuuucuuuuguuacug

SEQ ID NO: 2796695 - RNA, 18 nt, Human
cuuuucuuuuguuacugu

SEQ ID NO: 2796696 - RNA, 19 nt, Human
cuuuucuuuuguuacuguu

SEQ ID NO: 2796697 - RNA, 20 nt, Human
cuuuucuuuuguuacuguuc

SEQ ID NO: 2796698 - RNA, 21 nt, Human
cuuuucuuuuguuacuguucu

SEQ ID NO: 2796699 - RNA, 14 nt, Human
cuuuuuaauuguug

SEQ ID NO: 2796700 - RNA, 15 nt, Human
cuuuuuaauuguugu

SEQ ID NO: 2796701 - RNA, 16 nt, Human
cuuuuuaauuguuguu

SEQ ID NO: 2796702 - RNA, 22 nt, Human
cuuuuuaauuguuguuucuuuc

SEQ ID NO: 2796703 - RNA, 12 nt, Human
cuuuuuaguuua

SEQ ID NO: 2796704 - RNA, 21 nt, Human
cuuuuuaguuuacccgguuuc

SEQ ID NO: 2796705 - RNA, 23 nt, Human
cuuuuuaauuguuguuucuuucu

SEQ ID NO: 2796706 - RNA, 11 nt, Human
cuuuuuacaua

SEQ ID NO: 2796707 - RNA, 18 nt, Human
cuuuuuacauaacugccu

SEQ ID NO: 2796708 - RNA, 19 nt, Human
cuuuuuacauaacugccuu

SEQ ID NO: 2796709 - RNA, 21 nt, Human
cuuuuuacauaacugccuuga

SEQ ID NO: 2796710 - RNA, 22 nt, Human
cuuuuuacauaacugccuugaa

SEQ ID NO: 2796711 - RNA, 15 nt, Human
cuuuuuaaguaaugu

SEQ ID NO: 2796712 - RNA, 18 nt, Human
cuuuuuaaguaaugugga

SEQ ID NO: 2796713 - RNA, 19 nt, Human
cuuuuuaaguaauguggaa

SEQ ID NO: 2796714 - RNA, 19 nt, Human
cuuuuuaaaguguuucugu

SEQ ID NO: 2796715 - RNA, 23 nt, Human
cuuuuuaaaguguuucuguuauu

SEQ ID NO: 2796716 - RNA, 18 nt, Human
cuuuugcaagguuccaca

SEQ ID NO: 2796717 - RNA, 19 nt, Human
cuuuugcaagguuccacag

SEQ ID NO: 2796718 - RNA, 20 nt, Human
cuuuugcaagguuccacaga

SEQ ID NO: 2796719 - RNA, 14 nt, Human
cuuuugcagaagag

SEQ ID NO: 2796720 - RNA, 18 nt, Human
cuuuugcagaagagggug

SEQ ID NO: 2796721 - RNA, 23 nt, Human
cuuuugcagaagaggguguguuu

SEQ ID NO: 2796722 - RNA, 12 nt, Human
cuuuggaagcag

SEQ ID NO: 2796723 - RNA, 15 nt, Human
cuuuggagacuuucu

SEQ ID NO: 2796724 - RNA, 20 nt, Human
cuuuggagacuuucuuuaaa

SEQ ID NO: 2796725 - RNA, 16 nt, Human
cuuuggagaucaagga

SEQ ID NO: 2796726 - RNA, 23 nt, Human
cuuuggagaucaaggagaggagg

SEQ ID NO: 2796727 - RNA, 18 nt, Human
cuuuggagaugcugaggg

SEQ ID NO: 2796728 - RNA, 14 nt, Human
cuuuggaguccccu

SEQ ID NO: 2796729 - RNA, 16 nt, Human
cuuuggaguccccuca

SEQ ID NO: 2796730 - RNA, 18 nt, Human
cuuuggaguccccucacc

SEQ ID NO: 2796731 - RNA, 22 nt, Human
cuuuggaguccccucaccuccu

SEQ ID NO: 2796732 - RNA, 18 nt, Human
cuuuuaaaacacuuccau

SEQ ID NO: 2796733 - RNA, 12 nt, Human
cuuuuaaacaca

SEQ ID NO: 2796734 - RNA, 13 nt, Human
cuuuuaaacacau

SEQ ID NO: 2796735 - RNA, 11 nt, Human
cuuuuaaagug

SEQ ID NO: 2796736 - RNA, 13 nt, Human
cuuuuaaaguguu

SEQ ID NO: 2796737 - RNA, 17 nt, Human
cuuuuaaaguguuacuu

SEQ ID NO: 2796738 - RNA, 20 nt, Human
cuuuuaaaguguuacuuuuu

SEQ ID NO: 2796739 - RNA, 16 nt, Human
cuuuuaaaguguuuca

SEQ ID NO: 2796740 - RNA, 17 nt, Human
cuuuuaaaguguuucag

SEQ ID NO: 2796741 - RNA, 19 nt, Human
cuuuuaaaguguuucagcu

SEQ ID NO: 2796742 - RNA, 14 nt, Human
cuuuuaacuucuuu

SEQ ID NO: 2796743 - RNA, 15 nt, Human
cuuuuaacuucuuuc

SEQ ID NO: 2796744 - RNA, 17 nt, Human
cuuuuaacuucuuucua

SEQ ID NO: 2796745 - RNA, 16 nt, Human
cuuuuaaguaaggucc

SEQ ID NO: 2796746 - RNA, 14 nt, Human
cuuuuaaucagaca

SEQ ID NO: 2796747 - RNA, 14 nt, Human
cuuuuaacugugca

SEQ ID NO: 2796748 - RNA, 15 nt, Human
cuuuuaacugugcaa

SEQ ID NO: 2796749 - RNA, 10 nt, Human
cuuuuaacau

SEQ ID NO: 2796750 - RNA, 12 nt, Human
cuuuuaacauuu

SEQ ID NO: 2796751 - RNA, 13 nt, Human
cuuuuaacauuuu

SEQ ID NO: 2796752 - RNA, 14 nt, Human
cuuuuaacauuuug

SEQ ID NO: 2796753 - RNA, 15 nt, Human
cuuuuaacauuuugu

SEQ ID NO: 2796754 - RNA, 18 nt, Human
cuuuuaacauuuuguucu

SEQ ID NO: 2796755 - RNA, 20 nt, Human
cuuuuaacauuuuguucuua

SEQ ID NO: 2796756 - RNA, 21 nt, Human
cuuuuaacauuuuguucuuac

SEQ ID NO: 2796757 - RNA, 16 nt, Human
cuuuuaaccaaacaau

SEQ ID NO: 2796758 - RNA, 15 nt, Human
cuuuuaaccaucuga

SEQ ID NO: 2796759 - RNA, 16 nt, Human
cuuuuaaccaucugau

SEQ ID NO: 2796760 - RNA, 17 nt, Human
cuuuuaaccaucugaua

SEQ ID NO: 2796761 - RNA, 18 nt, Human
cuuuuaaccaucugauau

SEQ ID NO: 2796762 - RNA, 21 nt, Human
cuuuuaaccucuuuaaguauu

SEQ ID NO: 2796763 - RNA, 16 nt, Human
cuuuuccuuugugguu

SEQ ID NO: 2796764 - RNA, 18 nt, Human
cuuuuccucucucccgga

SEQ ID NO: 2796765 - RNA, 19 nt, Human
cuuuuccugauaaagcaca

SEQ ID NO: 2796766 - RNA, 22 nt, Human
cuuuuccugauaaagcacagcu

SEQ ID NO: 2796767 - RNA, 16 nt, Human
cuuuuccuguuguauu

SEQ ID NO: 2796768 - RNA, 15 nt, Human
cuuuucaaugacauu

SEQ ID NO: 2796769 - RNA, 14 nt, Human
cuuuucccuucuuu

SEQ ID NO: 2796770 - RNA, 16 nt, Human
cuuuuccuauuuguuu

SEQ ID NO: 2796771 - RNA, 15 nt, Human
cuuuucccuugcuuc

SEQ ID NO: 2796772 - RNA, 16 nt, Human
cuuuuccucucucccg

SEQ ID NO: 2796773 - RNA, 12 nt, Human
cuuuucacugcu

SEQ ID NO: 2796774 - RNA, 16 nt, Human
cuuuucaccuccuuca

SEQ ID NO: 2796775 - RNA, 18 nt, Human
cuuuucaccuccuucaau

SEQ ID NO: 2796776 - RNA, 19 nt, Human
cuuuucaccuccuucaauu

SEQ ID NO: 2796777 - RNA, 12 nt, Human
cuuuucaccuuu

SEQ ID NO: 2796778 - RNA, 21 nt, Human
cuuuucaccuuuacuuuagaa

SEQ ID NO: 2796779 - RNA, 20 nt, Human
cuuuucacauagcugucuag

SEQ ID NO: 2796780 - RNA, 15 nt, Human
cuuuuaaugcuucau

SEQ ID NO: 2796781 - RNA, 17 nt, Human
cuuuuaaugcuucauuc

SEQ ID NO: 2796782 - RNA, 23 nt, Human
cuuuuaaugcuucauucaauauu

SEQ ID NO: 2796783 - RNA, 20 nt, Human
cuuuuaauuaaauaaaagcu

SEQ ID NO: 2796784 - RNA, 22 nt, Human
cuuuuaauuaaauaaaagcugg

SEQ ID NO: 2796785 - RNA, 21 nt, Human
cuuguggacacagcucuucuc

SEQ ID NO: 2796786 - RNA, 18 nt, Human
cuugugucucugugcuuu

SEQ ID NO: 2796787 - RNA, 17 nt, Human
cuugugucucugugcuu

SEQ ID NO: 2796788 - RNA, 15 nt, Human
cuugugucucugugc

SEQ ID NO: 2796789 - RNA, 14 nt, Human
cuugucaugugaca

SEQ ID NO: 2796790 - RNA, 14 nt, Human
cuugugugcaaaag

SEQ ID NO: 2796791 - RNA, 15 nt, Human
cuugugucuguacac

SEQ ID NO: 2796792 - RNA, 18 nt, Human
cuugugucuguacacgug

SEQ ID NO: 2796793 - RNA, 13 nt, Human
cuugugucugcgu

SEQ ID NO: 2796794 - RNA, 21 nt, Human
cuugugucucugugcuuuuaa

SEQ ID NO: 2796795 - RNA, 12 nt, Human
cuugugucugua

SEQ ID NO: 2796796 - RNA, 14 nt, Human
cuugugucuguaca

SEQ ID NO: 2796797 - RNA, 21 nt, Human
cuuguguguuccaaguuucca

SEQ ID NO: 2796798 - RNA, 23 nt, Human
cuuuauuuuuuaaguauuuauau

SEQ ID NO: 2796799 - RNA, 22 nt, Human
cuuuauuuuuuaaguauuuaua

SEQ ID NO: 2796800 - RNA, 21 nt, Human
cuuuauuuuuuaaguauuuau

SEQ ID NO: 2796801 - RNA, 18 nt, Human
cuuuauuuuuuaaguauu

SEQ ID NO: 2796802 - RNA, 15 nt, Human
cuuucaaauuucaca

SEQ ID NO: 2796803 - RNA, 14 nt, Human
cuuucaaauuucac

SEQ ID NO: 2796804 - RNA, 14 nt, Human
cuuucaacuugcau

SEQ ID NO: 2796805 - RNA, 19 nt, Human
cuuucaaaauuaaaucugu

SEQ ID NO: 2796806 - RNA, 11 nt, Human
cuuucaaauuu

SEQ ID NO: 2796807 - RNA, 14 nt, Human
cuuucaaauuuaga

SEQ ID NO: 2796808 - RNA, 19 nt, Human
cuuucaaauuuagaaacua

SEQ ID NO: 2796809 - RNA, 21 nt, Human
cuuucaaauuuagaaacuaau

SEQ ID NO: 2796810 - RNA, 13 nt, Human
cuuucaaaucggu

SEQ ID NO: 2796811 - RNA, 13 nt, Human
cuuucaagaauga

SEQ ID NO: 2796812 - RNA, 14 nt, Human
cuuucaagugccuu

SEQ ID NO: 2796813 - RNA, 23 nt, Human
cuuucaagugccuuucugcaguu

SEQ ID NO: 2796814 - RNA, 17 nt, Human
cuuucauccugacucug

SEQ ID NO: 2796815 - RNA, 18 nt, Human
cuuucauccugacucugc

SEQ ID NO: 2796816 - RNA, 19 nt, Human
cuuucauccugacucugcc

SEQ ID NO: 2796817 - RNA, 20 nt, Human
cuuucauccugacucugccc

SEQ ID NO: 2796818 - RNA, 21 nt, Human
cuuucauccugacucugcccc

SEQ ID NO: 2796819 - RNA, 22 nt, Human
cuuucauccugacucugccccc

SEQ ID NO: 2796820 - RNA, 16 nt, Human
cuuucauccuugacua

SEQ ID NO: 2796821 - RNA, 22 nt, Human
cuuucaugugugccaaggcuga

SEQ ID NO: 2796822 - RNA, 14 nt, Human
cuuuccacuucuuc

SEQ ID NO: 2796823 - RNA, 17 nt, Human
cuuuccacuucuuccuu

SEQ ID NO: 2796824 - RNA, 20 nt, Human
cuuuccacuucuuccuuucu

SEQ ID NO: 2796825 - RNA, 21 nt, Human
cuuuccaaaggccauggagag

SEQ ID NO: 2796826 - RNA, 20 nt, Human
cuuuccccagcaucacuccc

SEQ ID NO: 2796827 - RNA, 21 nt, Human
cuuuccccagcaucacucccc

SEQ ID NO: 2796828 - RNA, 22 nt, Human
cuuuccccagcaucacucccca

SEQ ID NO: 2796829 - RNA, 13 nt, Human
cuuuccccagccc

SEQ ID NO: 2796830 - RNA, 14 nt, Human
cuuuccccagccca

SEQ ID NO: 2796831 - RNA, 15 nt, Human
cuuuccccagcccag

SEQ ID NO: 2796832 - RNA, 16 nt, Human
cuuuccccagcccagg

SEQ ID NO: 2796833 - RNA, 17 nt, Human
cuuuccccagcccaggg

SEQ ID NO: 2796834 - RNA, 13 nt, Human
cuuuccccauucc

SEQ ID NO: 2796835 - RNA, 19 nt, Human
cuuuccccauuccuaccca

SEQ ID NO: 2796836 - RNA, 21 nt, Human
cuuuccccaugucucgacuca

SEQ ID NO: 2796837 - RNA, 20 nt, Human
cuuuccccaugucucgacuc

SEQ ID NO: 2796838 - RNA, 15 nt, Human
cuuuccccaugucuc

SEQ ID NO: 2796839 - RNA, 13 nt, Human
cuuucccuugcuu

SEQ ID NO: 2796840 - RNA, 16 nt, Human
cuuucccuugcuuuuc

SEQ ID NO: 2796841 - RNA, 19 nt, Human
cuuucccuugcuuuucccu

SEQ ID NO: 2796842 - RNA, 21 nt, Human
cuuucccuugcuuuucccucu

SEQ ID NO: 2796843 - RNA, 22 nt, Human
cuuucccuugcuuuucccucuu

SEQ ID NO: 2796844 - RNA, 23 nt, Human
cuuucccuugcuuuucccucuuu

SEQ ID NO: 2796845 - RNA, 21 nt, Human
cuuuccgguguuuaagacauu

SEQ ID NO: 2796846 - RNA, 21 nt, Human
cuuuccgucaacguuguacug

SEQ ID NO: 2796847 - RNA, 22 nt, Human
cuuuccgucaacguuguacugu

SEQ ID NO: 2796848 - RNA, 16 nt, Human
cuuuccuaagaccugg

SEQ ID NO: 2796849 - RNA, 20 nt, Human
cuuuccuaagaccugggguu

SEQ ID NO: 2796850 - RNA, 15 nt, Human
cuuucuguuggugua

SEQ ID NO: 2796851 - RNA, 21 nt, Human
cuuucuguuggauuccaugcu

SEQ ID NO: 2796852 - RNA, 22 nt, Human
cuuucuuacaaggaagguggug

SEQ ID NO: 2796853 - RNA, 21 nt, Human
cuuucuuauaauacucuguug

SEQ ID NO: 2796854 - RNA, 22 nt, Human
cuuucuuauccuagcacaugcu

SEQ ID NO: 2796855 - RNA, 17 nt, Human
cuuucuuucuaacucca

SEQ ID NO: 2796856 - RNA, 12 nt, Human
cuuucuuugauu

SEQ ID NO: 2796857 - RNA, 17 nt, Human
cuuucuuugauucuccu

SEQ ID NO: 2796858 - RNA, 19 nt, Human
cuuugaaauagucugugug

SEQ ID NO: 2796859 - RNA, 22 nt, Human
cuuugaaauaccucauguuuau

SEQ ID NO: 2796860 - RNA, 11 nt, Human
cuuucuuuucu

SEQ ID NO: 2796861 - RNA, 21 nt, Human
cuuugaaauagucugugugaa

SEQ ID NO: 2796862 - RNA, 22 nt, Human
cuuugaacuaaugauaaaguaa

SEQ ID NO: 2796863 - RNA, 16 nt, Human
cuuugaagaaggugga

SEQ ID NO: 2796864 - RNA, 14 nt, Human
cuuugaagcaguug

SEQ ID NO: 2796865 - RNA, 16 nt, Human
cuuugaaggggccuca

SEQ ID NO: 2796866 - RNA, 19 nt, Human
cuuugaagcaguuguguca

SEQ ID NO: 2796867 - RNA, 13 nt, Human
cuuugaagccuca

SEQ ID NO: 2796868 - RNA, 16 nt, Human
cuuugaagccucagcu

SEQ ID NO: 2796869 - RNA, 17 nt, Human
cuuugaagcugaaaaua

SEQ ID NO: 2796870 - RNA, 19 nt, Human
cuuugaagcugaaaauaua

SEQ ID NO: 2796871 - RNA, 23 nt, Human
cuuugaagcugaaaauauaaaac

SEQ ID NO: 2796872 - RNA, 15 nt, Human
cuuugcagacaggca

SEQ ID NO: 2796873 - RNA, 14 nt, Human
cuuugcagacaggc

SEQ ID NO: 2796874 - RNA, 13 nt, Human
cuuugaauguuaa

SEQ ID NO: 2796875 - RNA, 14 nt, Human
cuuugaauguuaau

SEQ ID NO: 2796876 - RNA, 17 nt, Human
cuuugaauguuaauuuu

SEQ ID NO: 2796877 - RNA, 13 nt, Human
cuuugaaugcuuu

SEQ ID NO: 2796878 - RNA, 16 nt, Human
cuuugaaugcuuuuug

SEQ ID NO: 2796879 - RNA, 23 nt, Human
cuuugaaugcuuuuugaauguua

SEQ ID NO: 2796880 - RNA, 18 nt, Human
cuuugaaggggccucacc

SEQ ID NO: 2796881 - RNA, 13 nt, Human
gaccugcaggcca

SEQ ID NO: 2796882 - RNA, 20 nt, Human
gaccugcacuggggagcccg

SEQ ID NO: 2796883 - RNA, 16 nt, Human
gaccugcacuggggag

SEQ ID NO: 2796884 - RNA, 20 nt, Human
gaccugcaggccaagagcag

SEQ ID NO: 2796885 - RNA, 21 nt, Human
gaccugccccuccucucugcc

SEQ ID NO: 2796886 - RNA, 21 nt, Human
gaccugccccgcccagcugca

SEQ ID NO: 2796887 - RNA, 13 nt, Human
gaccugccuccug

SEQ ID NO: 2796888 - RNA, 14 nt, Human
gaccugccuccugc

SEQ ID NO: 2796889 - RNA, 15 nt, Human
gaccugccucggccu

SEQ ID NO: 2796890 - RNA, 16 nt, Human
gaccugccuccugccu

SEQ ID NO: 2796891 - RNA, 19 nt, Human
gaccugccuccugccugcc

SEQ ID NO: 2796892 - RNA, 20 nt, Human
gaccugccuccugccugccc

SEQ ID NO: 2796893 - RNA, 22 nt, Human
gaccugccuccugccugccccu

SEQ ID NO: 2796894 - RNA, 14 nt, Human
gaccugaucacuag

SEQ ID NO: 2796895 - RNA, 17 nt, Human
gaccucaggcacuagcc

SEQ ID NO: 2796896 - RNA, 18 nt, Human
gaccucaggcacuagccu

SEQ ID NO: 2796897 - RNA, 19 nt, Human
gaccucaggcacuagccuu

SEQ ID NO: 2796898 - RNA, 21 nt, Human
gaccucaggcacuagccuuug

SEQ ID NO: 2796899 - RNA, 16 nt, Human
gaccucacugugaccu

SEQ ID NO: 2796900 - RNA, 22 nt, Human
gaccguuauaaagugugccaca

SEQ ID NO: 2796901 - RNA, 21 nt, Human
gaccucacagugacccuuccc

SEQ ID NO: 2796902 - RNA, 22 nt, Human
gaccucacagugacccuuccca

SEQ ID NO: 2796903 - RNA, 13 nt, Human
gaccguggcccug

SEQ ID NO: 2796904 - RNA, 17 nt, Human
gaccguggcccugcccu

SEQ ID NO: 2796905 - RNA, 13 nt, Human
gaccguccucacc

SEQ ID NO: 2796906 - RNA, 15 nt, Human
gacccuuccagacau

SEQ ID NO: 2796907 - RNA, 17 nt, Human
gacccuuccagacauac

SEQ ID NO: 2796908 - RNA, 20 nt, Human
gacccuuccagacauacgaa

SEQ ID NO: 2796909 - RNA, 21 nt, Human
gacccuucccaaucagcacug

SEQ ID NO: 2796910 - RNA, 22 nt, Human
gacccuucccaaucagcacuga

SEQ ID NO: 2796911 - RNA, 23 nt, Human
gacccuucccaaucagcacugaa

SEQ ID NO: 2796912 - RNA, 12 nt, Human
gacccugucucu

SEQ ID NO: 2796913 - RNA, 14 nt, Human
gaccaacugucacu

SEQ ID NO: 2796914 - RNA, 12 nt, Human
gaccaacugugu

SEQ ID NO: 2796915 - RNA, 13 nt, Human
gaccaacuguguu

SEQ ID NO: 2796916 - RNA, 15 nt, Human
gaccaacuguguugu

SEQ ID NO: 2796917 - RNA, 18 nt, Human
gaccaacuguguuguauu

SEQ ID NO: 2796918 - RNA, 19 nt, Human
gaccaacuguguuguauua

SEQ ID NO: 2796919 - RNA, 21 nt, Human
gaccaacuguguuguauuaac

SEQ ID NO: 2796920 - RNA, 22 nt, Human
gaccaacuguguuguauuaaca

SEQ ID NO: 2796921 - RNA, 19 nt, Human
gaccaacugggcccaagac

SEQ ID NO: 2796922 - RNA, 14 nt, Human
gaccaacugggccc

SEQ ID NO: 2796923 - RNA, 13 nt, Human
gaccaacugggcc

SEQ ID NO: 2796924 - RNA, 20 nt, Human
gaccaacguuacucagggcu

SEQ ID NO: 2796925 - RNA, 21 nt, Human
gaccaacguuacucagggcuc

SEQ ID NO: 2796926 - RNA, 12 nt, Human
gacccacugcuu

SEQ ID NO: 2796927 - RNA, 18 nt, Human
gacccacguggcugcgug

SEQ ID NO: 2796928 - RNA, 16 nt, Human
gacccaccucaccccg

SEQ ID NO: 2796929 - RNA, 11 nt, Human
gacccacugcu

SEQ ID NO: 2796930 - RNA, 23 nt, Human
gacccacagacugguuuugcaac

SEQ ID NO: 2796931 - RNA, 13 nt, Human
gacccacauguaa

SEQ ID NO: 2796932 - RNA, 15 nt, Human
gacccaccccaccug

SEQ ID NO: 2796933 - RNA, 16 nt, Human
gacccaccccaccugc

SEQ ID NO: 2796934 - RNA, 17 nt, Human
gacccaccccaccugca

SEQ ID NO: 2796935 - RNA, 18 nt, Human
gacccaccccaccugcag

SEQ ID NO: 2796936 - RNA, 13 nt, Human
gacccagggggag

SEQ ID NO: 2796937 - RNA, 22 nt, Human
gacccagggaacagccacuccc

SEQ ID NO: 2796938 - RNA, 20 nt, Human
gacccagggaacagccacuc

SEQ ID NO: 2796939 - RNA, 13 nt, Human
gacccaggcuggg

SEQ ID NO: 2796940 - RNA, 14 nt, Human
gacccaggcugggc

SEQ ID NO: 2796941 - RNA, 15 nt, Human
gacccaggcugggca

SEQ ID NO: 2796942 - RNA, 15 nt, Human
gacccagggaacagc

SEQ ID NO: 2796943 - RNA, 19 nt, Human
gacccagggaacagccacu

SEQ ID NO: 2796944 - RNA, 17 nt, Human
gacccagggaacagcca

SEQ ID NO: 2796945 - RNA, 13 nt, Human
gacccaggacucc

SEQ ID NO: 2796946 - RNA, 20 nt, Human
gacccaggacuccuccccac

SEQ ID NO: 2796947 - RNA, 12 nt, Human
gacccaggcucc

SEQ ID NO: 2796948 - RNA, 16 nt, Human
gacccaggcuccgccc

SEQ ID NO: 2796949 - RNA, 17 nt, Human
gacccaggcuccgcccu

SEQ ID NO: 2796950 - RNA, 18 nt, Human
gacccaggcuccgcccuu

SEQ ID NO: 2796951 - RNA, 23 nt, Human
gacccaggcuccgcccuuagucc

SEQ ID NO: 2796952 - RNA, 23 nt, Human
gaccccucauagcccucacccug

SEQ ID NO: 2796953 - RNA, 13 nt, Human
gaccccuccaugu

SEQ ID NO: 2796954 - RNA, 22 nt, Human
gaccccgguggcggccccagca

SEQ ID NO: 2796955 - RNA, 14 nt, Human
gaccccuaguuccc

SEQ ID NO: 2796956 - RNA, 17 nt, Human
gaccccuaguucccucu

SEQ ID NO: 2796957 - RNA, 18 nt, Human
gaccccuaguucccucug

SEQ ID NO: 2796958 - RNA, 21 nt, Human
gaccccuaguucccucugcuc

SEQ ID NO: 2796959 - RNA, 22 nt, Human
gaccccuaguucccucugcuca

SEQ ID NO: 2796960 - RNA, 21 nt, Human
gaccccuaugaaguaaagaac

SEQ ID NO: 2796961 - RNA, 19 nt, Human
gaccccggcuuccuuuccc

SEQ ID NO: 2796962 - RNA, 22 nt, Human
gaccccucauagcccucacccu

SEQ ID NO: 2796963 - RNA, 21 nt, Human
gaccccagcugugagccuugg

SEQ ID NO: 2796964 - RNA, 18 nt, Human
gaccccagcugugagccu

SEQ ID NO: 2796965 - RNA, 22 nt, Human
gaccccagcugugagccuuggc

SEQ ID NO: 2796966 - RNA, 13 nt, Human
gaccccaggccca

SEQ ID NO: 2796967 - RNA, 15 nt, Human
gaccccaggcccacu

SEQ ID NO: 2796968 - RNA, 17 nt, Human
gaccccaggcccacuca

SEQ ID NO: 2796969 - RNA, 18 nt, Human
gaccccaggcccacucag

SEQ ID NO: 2796970 - RNA, 19 nt, Human
gaccccaggcccacucagg

SEQ ID NO: 2796971 - RNA, 17 nt, Human
gaccccaggcuggacau

SEQ ID NO: 2796972 - RNA, 17 nt, Human
gacuccaagaacaauug

SEQ ID NO: 2796973 - RNA, 20 nt, Human
gacucauucccuagaucuuu

SEQ ID NO: 2796974 - RNA, 18 nt, Human
gacuccacgauccugcca

SEQ ID NO: 2796975 - RNA, 19 nt, Human
gacuccacgauccugccac

SEQ ID NO: 2796976 - RNA, 20 nt, Human
gacuccacgauccugccacc

SEQ ID NO: 2796977 - RNA, 23 nt, Human
gacuccacgauccugccacccug

SEQ ID NO: 2796978 - RNA, 15 nt, Human
gacucagguugucug

SEQ ID NO: 2796979 - RNA, 15 nt, Human
gacucaguggggagg

SEQ ID NO: 2796980 - RNA, 22 nt, Human
gacucaucaaucaaauaaguau

SEQ ID NO: 2796981 - RNA, 14 nt, Human
gacucaucauuugu

SEQ ID NO: 2796982 - RNA, 15 nt, Human
gacucauccugaaca

SEQ ID NO: 2796983 - RNA, 17 nt, Human
gacucauccugaacagc

SEQ ID NO: 2796984 - RNA, 19 nt, Human
gacucauccugaacagcau

SEQ ID NO: 2796985 - RNA, 20 nt, Human
gacucauccugaacagcaug

SEQ ID NO: 2796986 - RNA, 22 nt, Human
gacucaugaggaggggcccccc

SEQ ID NO: 2796987 - RNA, 18 nt, Human
gacucaugguguguuaca

SEQ ID NO: 2796988 - RNA, 19 nt, Human
gacucaugguguguuacac

SEQ ID NO: 2796989 - RNA, 18 nt, Human
gacucaugaggaggggcc

SEQ ID NO: 2796990 - RNA, 15 nt, Human
gacucaugaggaggg

SEQ ID NO: 2796991 - RNA, 13 nt, Human
gacucaugaggag

SEQ ID NO: 2796992 - RNA, 24 nt, Human
gacucccuccucaccucuggacug

SEQ ID NO: 2796993 - RNA, 22 nt, Human
gacucccuuaaaauagaaauaa

SEQ ID NO: 2796994 - RNA, 23 nt, Human
gacucccuccucaccucuggacu

SEQ ID NO: 2796995 - RNA, 20 nt, Human
gacucccuccucaccucugg

SEQ ID NO: 2796996 - RNA, 17 nt, Human
gacucccaaguuuccau

SEQ ID NO: 2796997 - RNA, 21 nt, Human
gacucccaaguuuccauagca

SEQ ID NO: 2796998 - RNA, 22 nt, Human
gacucccaaguuuccauagcaa

SEQ ID NO: 2796999 - RNA, 13 nt, Human
gacucccaugaag

SEQ ID NO: 2797000 - RNA, 14 nt, Human
gacucccaugaagc

SEQ ID NO: 2797001 - RNA, 15 nt, Human
gacucccaugaagcc

SEQ ID NO: 2797002 - RNA, 16 nt, Human
gacucccaugaagccu

SEQ ID NO: 2797003 - RNA, 17 nt, Human
gacucccaugaagccuu

SEQ ID NO: 2797004 - RNA, 18 nt, Human
gacucccaugaagccuuu

SEQ ID NO: 2797005 - RNA, 21 nt, Human
gacucccaugaagccuuuuga

SEQ ID NO: 2797006 - RNA, 12 nt, Human
gacuccaucucu

SEQ ID NO: 2797007 - RNA, 17 nt, Human
gacuccaucucucaucc

SEQ ID NO: 2797008 - RNA, 21 nt, Human
gacuccaucucucauccucca

SEQ ID NO: 2797009 - RNA, 19 nt, Human
gacucccuccucaccucug

SEQ ID NO: 2797010 - RNA, 16 nt, Human
gacucccuccucaccu

SEQ ID NO: 2797011 - RNA, 14 nt, Human
gacucccuccucac

SEQ ID NO: 2797012 - RNA, 13 nt, Human
gacucccuccuca

SEQ ID NO: 2797013 - RNA, 12 nt, Human
gacucccuccuc

SEQ ID NO: 2797014 - RNA, 21 nt, Human
gacucagggccaugccugccc

SEQ ID NO: 2797015 - RNA, 22 nt, Human
gacucagggccaugccugcccc

SEQ ID NO: 2797016 - RNA, 19 nt, Human
gacucagggccaugccugc

SEQ ID NO: 2797017 - RNA, 20 nt, Human
gacucagggccaugccugcc

SEQ ID NO: 2797018 - RNA, 22 nt, Human
gacucaggauuuaaaaacugga

SEQ ID NO: 2797019 - RNA, 23 nt, Human
gacucaggauuuaaaaacuggaa

SEQ ID NO: 2797020 - RNA, 16 nt, Human
gacuagacguucauuu

SEQ ID NO: 2797021 - RNA, 23 nt, Human
gacuagaagggccaguccugccu

SEQ ID NO: 2797022 - RNA, 22 nt, Human
gacuaauuaggguacauuuaua

SEQ ID NO: 2797023 - RNA, 14 nt, Human
gacguguuuguguu

SEQ ID NO: 2797024 - RNA, 20 nt, Human
gacguucauuugugugcuca

SEQ ID NO: 2797025 - RNA, 15 nt, Human
gacuacaaaaaugaa

SEQ ID NO: 2797026 - RNA, 18 nt, Human
gacuaauuuaaaaaauaa

SEQ ID NO: 2797027 - RNA, 22 nt, Human
gacuaauuucaaaaugcuuuuu

SEQ ID NO: 2797028 - RNA, 13 nt, Human
gacuaauuucaaa

SEQ ID NO: 2797029 - RNA, 12 nt, Human
gacuaauuucaa

SEQ ID NO: 2797030 - RNA, 12 nt, Human
gacuacaggcac

SEQ ID NO: 2797031 - RNA, 14 nt, Human
gacuacuauuuucu

SEQ ID NO: 2797032 - RNA, 13 nt, Human
gacuacuuagcau

SEQ ID NO: 2797033 - RNA, 14 nt, Human
gacuacuuagcauc

SEQ ID NO: 2797034 - RNA, 21 nt, Human
gacuacuuagcauccuaagaa

SEQ ID NO: 2797035 - RNA, 15 nt, Human
gacuagaagggccag

SEQ ID NO: 2797036 - RNA, 23 nt, Human
gaccuugaacuggguacuugugg

SEQ ID NO: 2797037 - RNA, 15 nt, Human
gaccuggauaacuua

SEQ ID NO: 2797038 - RNA, 17 nt, Human
gaccuggauaacuuagg

SEQ ID NO: 2797039 - RNA, 16 nt, Human
gaccuggcaaggacac

SEQ ID NO: 2797040 - RNA, 13 nt, Human
gaccugcuuuuug

SEQ ID NO: 2797041 - RNA, 14 nt, Human
gaccugcuuuuuga

SEQ ID NO: 2797042 - RNA, 16 nt, Human
gaccugcuuuuugaaa

SEQ ID NO: 2797043 - RNA, 17 nt, Human
gaccugcuuuuugaaau

SEQ ID NO: 2797044 - RNA, 18 nt, Human
gaccugcuuuuugaaaug

SEQ ID NO: 2797045 - RNA, 19 nt, Human
gaccugcuuuuugaaauga

SEQ ID NO: 2797046 - RNA, 20 nt, Human
gaccugcuuuuugaaaugaa

SEQ ID NO: 2797047 - RNA, 19 nt, Human
gaccugccucggccuccca

SEQ ID NO: 2797048 - RNA, 23 nt, Human
gaccugccuccugccugccccuc

SEQ ID NO: 2797049 - RNA, 18 nt, Human
gaccugccucucacacac

SEQ ID NO: 2797050 - RNA, 20 nt, Human
gaccugccucucacacacau

SEQ ID NO: 2797051 - RNA, 22 nt, Human
gaccugccucucacacacauag

SEQ ID NO: 2797052 - RNA, 12 nt, Human
gaccugccugua

SEQ ID NO: 2797053 - RNA, 15 nt, Human
gaccugcuccgcugc

SEQ ID NO: 2797054 - RNA, 17 nt, Human
gaccugcuccgcugcuc

SEQ ID NO: 2797055 - RNA, 18 nt, Human
gaccugcuccgcugcucc

SEQ ID NO: 2797056 - RNA, 19 nt, Human
gaccugcuccgcugcuccu

SEQ ID NO: 2797057 - RNA, 21 nt, Human
gaccugcuccgcugcuccuug

SEQ ID NO: 2797058 - RNA, 23 nt, Human
gaccugcuccgcugcuccuuggc

SEQ ID NO: 2797059 - RNA, 16 nt, Human
gaccuuggagagacac

SEQ ID NO: 2797060 - RNA, 18 nt, Human
gaccuuggagagacacag

SEQ ID NO: 2797061 - RNA, 13 nt, Human
gaccuugggccaa

SEQ ID NO: 2797062 - RNA, 21 nt, Human
gaccuugggccaaauccgcuc

SEQ ID NO: 2797063 - RNA, 21 nt, Human
gacgaacauccaaccuuccca

SEQ ID NO: 2797064 - RNA, 21 nt, Human
gaccuuugucaucuuucuucu

SEQ ID NO: 2797065 - RNA, 13 nt, Human
gaccuuuuaaagu

SEQ ID NO: 2797066 - RNA, 14 nt, Human
gaccuuuuaaagug

SEQ ID NO: 2797067 - RNA, 20 nt, Human
gaccuuuuaaaguguuucag

SEQ ID NO: 2797068 - RNA, 22 nt, Human
gaccuuuuaaaguguuucagcu

SEQ ID NO: 2797069 - RNA, 16 nt, Human
gacgaagaagagccac

SEQ ID NO: 2797070 - RNA, 18 nt, Human
gaccuuuguacagcccag

SEQ ID NO: 2797071 - RNA, 19 nt, Human
gaccuuuguacagcccaga

SEQ ID NO: 2797072 - RNA, 21 nt, Human
gacggagucccaccuuggcug

SEQ ID NO: 2797073 - RNA, 19 nt, Human
gacgcagcaggaggccagg

SEQ ID NO: 2797074 - RNA, 18 nt, Human
gacggcugggcacacgcc

SEQ ID NO: 2797075 - RNA, 22 nt, Human
gacggcugggcacacgccuccc

SEQ ID NO: 2797076 - RNA, 16 nt, Human
gacggggacuggggau

SEQ ID NO: 2797077 - RNA, 17 nt, Human
gacgggguuucaccaug

SEQ ID NO: 2797078 - RNA, 18 nt, Human
gacggagucccaccuugg

SEQ ID NO: 2797079 - RNA, 14 nt, Human
gacggagucccacc

SEQ ID NO: 2797080 - RNA, 15 nt, Human
gacgauuccuucucu

SEQ ID NO: 2797081 - RNA, 17 nt, Human
gacgauuccuucucuga

SEQ ID NO: 2797082 - RNA, 18 nt, Human
gacgauuccuucucugaa

SEQ ID NO: 2797083 - RNA, 18 nt, Human
gacgaagaagagccacag

SEQ ID NO: 2797084 - RNA, 15 nt, Human
gacgacaggcgagag

SEQ ID NO: 2797085 - RNA, 22 nt, Human
gacgagacccaagggcagagca

SEQ ID NO: 2797086 - RNA, 14 nt, Human
gacgguuuuuuauu

SEQ ID NO: 2797087 - RNA, 19 nt, Human
gacgguuuuuuauuauugu

SEQ ID NO: 2797088 - RNA, 19 nt, Human
gacggguuggggccgggca

SEQ ID NO: 2797089 - RNA, 21 nt, Human
gacggucaguuuggugucaac

SEQ ID NO: 2797090 - RNA, 22 nt, Human
gacggucaguuuggugucaaca

SEQ ID NO: 2797091 - RNA, 14 nt, Human
gacggugacaaaga

SEQ ID NO: 2797092 - RNA, 21 nt, Human
gacggugacaaagauggcuca

SEQ ID NO: 2797093 - RNA, 24 nt, Human
gacggugacaaagauggcucagag

SEQ ID NO: 2797094 - RNA, 17 nt, Human
gacggugcuccaggcag

SEQ ID NO: 2797095 - RNA, 13 nt, Human
gacggugucuugu

SEQ ID NO: 2797096 - RNA, 23 nt, Human
gacauggcucuggacucuaaaga

SEQ ID NO: 2797097 - RNA, 20 nt, Human
gacauggagguucuaaggcc

SEQ ID NO: 2797098 - RNA, 21 nt, Human
gacauggagguucuaaggccu

SEQ ID NO: 2797099 - RNA, 15 nt, Human
gacaugcugaagcca

SEQ ID NO: 2797100 - RNA, 18 nt, Human
gacaugcugaagccaaag

SEQ ID NO: 2797101 - RNA, 19 nt, Human
gacaugcugaagccaaagc

SEQ ID NO: 2797102 - RNA, 15 nt, Human
gacaugcugacuguc

SEQ ID NO: 2797103 - RNA, 21 nt, Human
gacaugcugacuguccucucc

SEQ ID NO: 2797104 - RNA, 14 nt, Human
gacauggagguucu

SEQ ID NO: 2797105 - RNA, 15 nt, Human
gacauggagguucua

SEQ ID NO: 2797106 - RNA, 16 nt, Human
gacauggagguucuaa

SEQ ID NO: 2797107 - RNA, 19 nt, Human
gacauggagguucuaaggc

SEQ ID NO: 2797108 - RNA, 14 nt, Human
gacaugcugaagcc

SEQ ID NO: 2797109 - RNA, 18 nt, Human
gaccaaacuucacucugg

SEQ ID NO: 2797110 - RNA, 12 nt, Human
gacaugugaaac

SEQ ID NO: 2797111 - RNA, 14 nt, Human
gacaugugaaaccu

SEQ ID NO: 2797112 - RNA, 15 nt, Human
gacaugugaaaccuu

SEQ ID NO: 2797113 - RNA, 23 nt, Human
gacauuuuuccguuugcuuuugu

SEQ ID NO: 2797114 - RNA, 18 nt, Human
gacaugugaaaccuuuuu

SEQ ID NO: 2797115 - RNA, 23 nt, Human
gacauaggccaugaaaaaaauga

SEQ ID NO: 2797116 - RNA, 11 nt, Human
gacauauuuaa

SEQ ID NO: 2797117 - RNA, 14 nt, Human
gacauauuuaacug

SEQ ID NO: 2797118 - RNA, 15 nt, Human
gacauauuuaacugg

SEQ ID NO: 2797119 - RNA, 12 nt, Human
gacauauuuaau

SEQ ID NO: 2797120 - RNA, 16 nt, Human
gacauauuuaauguuu

SEQ ID NO: 2797121 - RNA, 17 nt, Human
gacauauuuaauguuuu

SEQ ID NO: 2797122 - RNA, 18 nt, Human
gacauauuuaauguuuua

SEQ ID NO: 2797123 - RNA, 20 nt, Human
gacauauuuaauguuuuaaa

SEQ ID NO: 2797124 - RNA, 21 nt, Human
gacauauuuaauguuuuaaau

SEQ ID NO: 2797125 - RNA, 22 nt, Human
gacauauuuaauguuuuaaaug

SEQ ID NO: 2797126 - RNA, 23 nt, Human
gacauauuuaauguuuuaaaugu

SEQ ID NO: 2797127 - RNA, 18 nt, Human
gacauagcccaucccugc

SEQ ID NO: 2797128 - RNA, 22 nt, Human
gacauagcccaucccugccugg

SEQ ID NO: 2797129 - RNA, 15 nt, Human
gacauagagguauau

SEQ ID NO: 2797130 - RNA, 14 nt, Human
gacauagauauuuu

SEQ ID NO: 2797131 - RNA, 20 nt, Human
gacauagauauuuucacaau

SEQ ID NO: 2797132 - RNA, 20 nt, Human
gacauagcauccaaguggca

SEQ ID NO: 2797133 - RNA, 21 nt, Human
gacauagcauccaaguggcau

SEQ ID NO: 2797134 - RNA, 14 nt, Human
gacaucuggaaucu

SEQ ID NO: 2797135 - RNA, 15 nt, Human
gacaucucugcaccc

SEQ ID NO: 2797136 - RNA, 17 nt, Human
gacaucucugcacccug

SEQ ID NO: 2797137 - RNA, 18 nt, Human
gacaucuggaaucuggag

SEQ ID NO: 2797138 - RNA, 19 nt, Human
gacaucuggaaucuggaga

SEQ ID NO: 2797139 - RNA, 20 nt, Human
gacaucuggaaucuggagac

SEQ ID NO: 2797140 - RNA, 22 nt, Human
gacaucuggaaucuggagacca

SEQ ID NO: 2797141 - RNA, 21 nt, Human
gacaucuguuucuaaauguuu

SEQ ID NO: 2797142 - RNA, 13 nt, Human
gacaucuuucucu

SEQ ID NO: 2797143 - RNA, 13 nt, Human
gacaucuuuuuaa

SEQ ID NO: 2797144 - RNA, 19 nt, Human
gacaucuuuuuaaagcuua

SEQ ID NO: 2797145 - RNA, 23 nt, Human
gacauaauauauucuauuuuuau

SEQ ID NO: 2797146 - RNA, 12 nt, Human
gacauacgaaac

SEQ ID NO: 2797147 - RNA, 17 nt, Human
gacauacgaaacacaaa

SEQ ID NO: 2797148 - RNA, 15 nt, Human
gacagggaagagcag

SEQ ID NO: 2797149 - RNA, 22 nt, Human
gacauaacguuuuuccuuuaaa

SEQ ID NO: 2797150 - RNA, 23 nt, Human
gacauaacguuuuuccuuuaaaa

SEQ ID NO: 2797151 - RNA, 20 nt, Human
gacagggaacaguauuucca

SEQ ID NO: 2797152 - RNA, 23 nt, Human
gacaggaugggggcuggccucug

SEQ ID NO: 2797153 - RNA, 13 nt, Human
gacaggcccuggc

SEQ ID NO: 2797154 - RNA, 11 nt, Human
gacaggccuca

SEQ ID NO: 2797155 - RNA, 15 nt, Human
gacaggccucaccuc

SEQ ID NO: 2797156 - RNA, 19 nt, Human
gacaggccucaccucuacc

SEQ ID NO: 2797157 - RNA, 20 nt, Human
gacaggccucaccucuaccc

SEQ ID NO: 2797158 - RNA, 21 nt, Human
gacaggccucaccucuaccca

SEQ ID NO: 2797159 - RNA, 15 nt, Human
gacaggccugaagau

SEQ ID NO: 2797160 - RNA, 19 nt, Human
gacaggccugaagauauua

SEQ ID NO: 2797161 - RNA, 15 nt, Human
gacaggcgagagagg

SEQ ID NO: 2797162 - RNA, 19 nt, Human
gacaggcgagagaggagcc

SEQ ID NO: 2797163 - RNA, 21 nt, Human
gacaggcgagagaggagccag

SEQ ID NO: 2797164 - RNA, 23 nt, Human
gacaggcgagagaggagccagac

SEQ ID NO: 2797165 - RNA, 24 nt, Human
gacaggcgagagaggagccagaca

SEQ ID NO: 2797166 - RNA, 22 nt, Human
gacagcuucucauccugcaggc

SEQ ID NO: 2797167 - RNA, 21 nt, Human
gacagcuucucauccugcagg

SEQ ID NO: 2797168 - RNA, 20 nt, Human
gacaggagaaacacuugaac

SEQ ID NO: 2797169 - RNA, 19 nt, Human
gacaggcauguucucugag

SEQ ID NO: 2797170 - RNA, 18 nt, Human
gacaggcauguucucuga

SEQ ID NO: 2797171 - RNA, 17 nt, Human
gacaggcaaugcuggcu

SEQ ID NO: 2797172 - RNA, 24 nt, Human
gacaggcaaugcuggcuguuggcu

SEQ ID NO: 2797173 - RNA, 16 nt, Human
gacaggcaaugcuggc

SEQ ID NO: 2797174 - RNA, 14 nt, Human
gacaggcaaugcug

SEQ ID NO: 2797175 - RNA, 16 nt, Human
gacaggaugggggcug

SEQ ID NO: 2797176 - RNA, 16 nt, Human
gacagacacaggcccg

SEQ ID NO: 2797177 - RNA, 15 nt, Human
gacagacacaggccc

SEQ ID NO: 2797178 - RNA, 15 nt, Human
gacagauccccguuc

SEQ ID NO: 2797179 - RNA, 23 nt, Human
gacagauccccguuccugacauc

SEQ ID NO: 2797180 - RNA, 19 nt, Human
gacagaucucugcuuugga

SEQ ID NO: 2797181 - RNA, 21 nt, Human
gacagaucucugcuuuggaaa

SEQ ID NO: 2797182 - RNA, 23 nt, Human
gacagaucucugcuuuggaaauc

SEQ ID NO: 2797183 - RNA, 21 nt, Human
gacacuaaccacgcuggaccu

SEQ ID NO: 2797184 - RNA, 20 nt, Human
gacacuaaccacgcuggacc

SEQ ID NO: 2797185 - RNA, 14 nt, Human
gacagacacaggcc

SEQ ID NO: 2797186 - RNA, 21 nt, Human
gacacguguggcgggcagugg

SEQ ID NO: 2797187 - RNA, 12 nt, Human
gacagacacagg

SEQ ID NO: 2797188 - RNA, 13 nt, Human
gacagccacggcc

SEQ ID NO: 2797189 - RNA, 18 nt, Human
gacagaugccccagagcu

SEQ ID NO: 2797190 - RNA, 13 nt, Human
gacagcaugugcc

SEQ ID NO: 2797191 - RNA, 18 nt, Human
gacagcaugugcccuccu

SEQ ID NO: 2797192 - RNA, 19 nt, Human
gacagcaugugcccuccug

SEQ ID NO: 2797193 - RNA, 20 nt, Human
gacagcaugugcccuccuga

SEQ ID NO: 2797194 - RNA, 21 nt, Human
gacagcaugugcccuccugag

SEQ ID NO: 2797195 - RNA, 14 nt, Human
gacagaugccccag

SEQ ID NO: 2797196 - RNA, 22 nt, Human
gacaaggauugcuacuguccua

SEQ ID NO: 2797197 - RNA, 21 nt, Human
gacaaggauugcuacuguccu

SEQ ID NO: 2797198 - RNA, 14 nt, Human
gacaagauauugua

SEQ ID NO: 2797199 - RNA, 18 nt, Human
gacaagauauuguacaua

SEQ ID NO: 2797200 - RNA, 19 nt, Human
gacaagauauuguacauaa

SEQ ID NO: 2797201 - RNA, 19 nt, Human
gacaagcaauuagacaaga

SEQ ID NO: 2797202 - RNA, 12 nt, Human
gacaagcagagg

SEQ ID NO: 2797203 - RNA, 21 nt, Human
gacaagcagauacugcugugu

SEQ ID NO: 2797204 - RNA, 9 nt, Human
gaagucuug

SEQ ID NO: 2797205 - RNA, 11 nt, Human
gaagucuugua

SEQ ID NO: 2797206 - RNA, 12 nt, Human
gaagucuuguau

SEQ ID NO: 2797207 - RNA, 14 nt, Human
gaagucuuguauaa

SEQ ID NO: 2797208 - RNA, 17 nt, Human
gaagucuuucaagaaug

SEQ ID NO: 2797209 - RNA, 18 nt, Human
gaagucuuucaagaauga

SEQ ID NO: 2797210 - RNA, 22 nt, Human
gacaagagccugaucucuuccu

SEQ ID NO: 2797211 - RNA, 23 nt, Human
gacaagagccugaucucuuccug

SEQ ID NO: 2797212 - RNA, 19 nt, Human
gacaagagguacaggguuu

SEQ ID NO: 2797213 - RNA, 21 nt, Human
gacaaucaugaaauaugcauc

SEQ ID NO: 2797214 - RNA, 19 nt, Human
gacaaucaugaaauaugca

SEQ ID NO: 2797215 - RNA, 20 nt, Human
gacaaucaugaaauaugcau

SEQ ID NO: 2797216 - RNA, 19 nt, Human
gacaauaauucuggagaua

SEQ ID NO: 2797217 - RNA, 19 nt, Human
gacaauaauuucagguuuu

SEQ ID NO: 2797218 - RNA, 16 nt, Human
gacaauacguuugaua

SEQ ID NO: 2797219 - RNA, 13 nt, Human
gacaauaauuuca

SEQ ID NO: 2797220 - RNA, 21 nt, Human
gacaauaauauuguuguauaa

SEQ ID NO: 2797221 - RNA, 21 nt, Human
gacaauaaaccuccgccaaug

SEQ ID NO: 2797222 - RNA, 14 nt, Human
gacaaguuccaugg

SEQ ID NO: 2797223 - RNA, 20 nt, Human
gacaagugacuguaucugug

SEQ ID NO: 2797224 - RNA, 19 nt, Human
gacaagugacuguaucugu

SEQ ID NO: 2797225 - RNA, 12 nt, Human
gacaagggcuga

SEQ ID NO: 2797226 - RNA, 13 nt, Human
gacaagggcugac

SEQ ID NO: 2797227 - RNA, 15 nt, Human
gacaagggcugaccu

SEQ ID NO: 2797228 - RNA, 19 nt, Human
gacaagggcugaccugccu

SEQ ID NO: 2797229 - RNA, 21 nt, Human
gacaagggcugaccugccucu

SEQ ID NO: 2797230 - RNA, 22 nt, Human
gacaagggcugaccugccucuc

SEQ ID NO: 2797231 - RNA, 21 nt, Human
gacaauuguuuuaaucugaaa

SEQ ID NO: 2797232 - RNA, 22 nt, Human
gacaauugagguaaguuuuuug

SEQ ID NO: 2797233 - RNA, 19 nt, Human
gacaauaugugagugccuu

SEQ ID NO: 2797234 - RNA, 14 nt, Human
gacaaucauuguuu

SEQ ID NO: 2797235 - RNA, 17 nt, Human
gacaaucauuguuuuga

SEQ ID NO: 2797236 - RNA, 20 nt, Human
gacaaucauuguuuugaaua

SEQ ID NO: 2797237 - RNA, 22 nt, Human
gacacaaguggaccuuaggccu

SEQ ID NO: 2797238 - RNA, 16 nt, Human
gacaauuugauacaua

SEQ ID NO: 2797239 - RNA, 17 nt, Human
gacaauuugauacauaa

SEQ ID NO: 2797240 - RNA, 18 nt, Human
gacaauuugauacauaau

SEQ ID NO: 2797241 - RNA, 19 nt, Human
gacaauuugauacauaaua

SEQ ID NO: 2797242 - RNA, 22 nt, Human
gacaauuugauacauaauaaaa

SEQ ID NO: 2797243 - RNA, 12 nt, Human
gacacacacaca

SEQ ID NO: 2797244 - RNA, 12 nt, Human
gacacacacacg

SEQ ID NO: 2797245 - RNA, 13 nt, Human
gacacacacacgc

SEQ ID NO: 2797246 - RNA, 14 nt, Human
gacacacacacgca

SEQ ID NO: 2797247 - RNA, 15 nt, Human
gacacacacacgcac

SEQ ID NO: 2797248 - RNA, 17 nt, Human
gacacaggcccggcucc

SEQ ID NO: 2797249 - RNA, 15 nt, Human
gacacaggcccggcu

SEQ ID NO: 2797250 - RNA, 12 nt, Human
gacacaggcccg

SEQ ID NO: 2797251 - RNA, 22 nt, Human
gacacacacacgcacgcacaca

SEQ ID NO: 2797252 - RNA, 23 nt, Human
gacacacacacgcacgcacacac

SEQ ID NO: 2797253 - RNA, 18 nt, Human
gacacacacacgcacgca

SEQ ID NO: 2797254 - RNA, 19 nt, Human
gacacacacacgcacgcac

SEQ ID NO: 2797255 - RNA, 20 nt, Human
gacacacacacgcacgcaca

SEQ ID NO: 2797256 - RNA, 21 nt, Human
gacacacacacgcacgcacac

SEQ ID NO: 2797257 - RNA, 18 nt, Human
gacacaggcccggcucca

SEQ ID NO: 2797258 - RNA, 23 nt, Human
gacacagggugacggugacaaag

SEQ ID NO: 2797259 - RNA, 17 nt, Human
gacacagugaccauacu

SEQ ID NO: 2797260 - RNA, 13 nt, Human
gacacccccucgc

SEQ ID NO: 2797261 - RNA, 22 nt, Human
gacacauaugcaccuugugucu

SEQ ID NO: 2797262 - RNA, 13 nt, Human
gacacccucaacc

SEQ ID NO: 2797263 - RNA, 13 nt, Human
gacacccuggcag

SEQ ID NO: 2797264 - RNA, 10 nt, Human
gacacccggc

SEQ ID NO: 2797265 - RNA, 19 nt, Human
gacacccgugagcgccugu

SEQ ID NO: 2797266 - RNA, 19 nt, Human
gacaccggcuggcagggcu

SEQ ID NO: 2797267 - RNA, 17 nt, Human
gacaccuacugaguggc

SEQ ID NO: 2797268 - RNA, 20 nt, Human
gacaccgggguggugggaac

SEQ ID NO: 2797269 - RNA, 19 nt, Human
gacaccgggccaguaucua

SEQ ID NO: 2797270 - RNA, 22 nt, Human
gacaccgggccaguaucuauau

SEQ ID NO: 2797271 - RNA, 17 nt, Human
gacaccugaacccucca

SEQ ID NO: 2797272 - RNA, 18 nt, Human
gacacuaaccacgcugga

SEQ ID NO: 2797273 - RNA, 17 nt, Human
gacacuaaccacgcugg

SEQ ID NO: 2797274 - RNA, 16 nt, Human
gacacuaaccacgcug

SEQ ID NO: 2797275 - RNA, 15 nt, Human
gacacuaaccacgcu

SEQ ID NO: 2797276 - RNA, 15 nt, Human
gacacggggcagugg

SEQ ID NO: 2797277 - RNA, 17 nt, Human
gacaccuugacagggca

SEQ ID NO: 2797278 - RNA, 15 nt, Human
gacaccuugacaggg

SEQ ID NO: 2797279 - RNA, 15 nt, Human
gacaccugcccugcc

SEQ ID NO: 2797280 - RNA, 14 nt, Human
gacaccugcccugc

SEQ ID NO: 2797281 - RNA, 13 nt, Human
gacaccugcccug

SEQ ID NO: 2797282 - RNA, 20 nt, Human
gacaccuugacagggcacac

SEQ ID NO: 2797283 - RNA, 18 nt, Human
gacaccuugacagggcac

SEQ ID NO: 2797284 - RNA, 14 nt, Human
gacaccuuuagguu

SEQ ID NO: 2797285 - RNA, 20 nt, Human
gagcuugcucauuaauuuug

SEQ ID NO: 2797286 - RNA, 13 nt, Human
gagcuugcuuuga

SEQ ID NO: 2797287 - RNA, 19 nt, Human
gagcuugcuuugauuuaca

SEQ ID NO: 2797288 - RNA, 13 nt, Human
gagcuugggaaug

SEQ ID NO: 2797289 - RNA, 12 nt, Human
gagcuuggggca

SEQ ID NO: 2797290 - RNA, 11 nt, Human
gagcuuuaugg

SEQ ID NO: 2797291 - RNA, 21 nt, Human
gagcuuuaugguccuaaaagc

SEQ ID NO: 2797292 - RNA, 23 nt, Human
gagcuuuaugguccuaaaagcaa

SEQ ID NO: 2797293 - RNA, 20 nt, Human
gaggaaaaccaagccguggc

SEQ ID NO: 2797294 - RNA, 21 nt, Human
gaggaaaaccaagccguggcu

SEQ ID NO: 2797295 - RNA, 23 nt, Human
gaggaaaaccaagccguggcuuc

SEQ ID NO: 2797296 - RNA, 17 nt, Human
gaggaaagacaacacaa

SEQ ID NO: 2797297 - RNA, 22 nt, Human
gaggaaagacaacacaaccaac

SEQ ID NO: 2797298 - RNA, 13 nt, Human
gaggaaagagagc

SEQ ID NO: 2797299 - RNA, 14 nt, Human
gaggaaagagagca

SEQ ID NO: 2797300 - RNA, 16 nt, Human
gaggaaagagagcagg

SEQ ID NO: 2797301 - RNA, 16 nt, Human
gaggaaagagucuuca

SEQ ID NO: 2797302 - RNA, 20 nt, Human
gaggaaagagucuucaacau

SEQ ID NO: 2797303 - RNA, 21 nt, Human
gaggaaagagucuucaacaua

SEQ ID NO: 2797304 - RNA, 18 nt, Human
gaggaaacaacagcuuua

SEQ ID NO: 2797305 - RNA, 21 nt, Human
gaggaaaauaauguaauugua

SEQ ID NO: 2797306 - RNA, 13 nt, Human
gaggaagagucuu

SEQ ID NO: 2797307 - RNA, 18 nt, Human
gaggaaaucugcagaggg

SEQ ID NO: 2797308 - RNA, 15 nt, Human
gaggaacuccuuggc

SEQ ID NO: 2797309 - RNA, 16 nt, Human
gaggaacuccuuggcc

SEQ ID NO: 2797310 - RNA, 23 nt, Human
gaggaacuccuuggccuagccca

SEQ ID NO: 2797311 - RNA, 14 nt, Human
gaggaacugggccu

SEQ ID NO: 2797312 - RNA, 15 nt, Human
gaggaacuguacaga

SEQ ID NO: 2797313 - RNA, 16 nt, Human
gaggaacuguacagaa

SEQ ID NO: 2797314 - RNA, 15 nt, Human
gaggaacuguccaga

SEQ ID NO: 2797315 - RNA, 16 nt, Human
gaggaacuguccagag

SEQ ID NO: 2797316 - RNA, 17 nt, Human
gaggaacuguccagaga

SEQ ID NO: 2797317 - RNA, 18 nt, Human
gaggaacuguccagagag

SEQ ID NO: 2797318 - RNA, 19 nt, Human
gaggaacuguccagagagc

SEQ ID NO: 2797319 - RNA, 21 nt, Human
gaggaacuguccagagagcaa

SEQ ID NO: 2797320 - RNA, 21 nt, Human
gaggaaauaaaguuaaguuug

SEQ ID NO: 2797321 - RNA, 23 nt, Human
gagcucuacccagggccugcagg

SEQ ID NO: 2797322 - RNA, 21 nt, Human
gagcucuacccagggccugca

SEQ ID NO: 2797323 - RNA, 20 nt, Human
gagcucuacccagggccugc

SEQ ID NO: 2797324 - RNA, 15 nt, Human
gagcucuacccaggg

SEQ ID NO: 2797325 - RNA, 14 nt, Human
gagcucuacccagg

SEQ ID NO: 2797326 - RNA, 16 nt, Human
gagcugauauaaauuc

SEQ ID NO: 2797327 - RNA, 17 nt, Human
gagcugauauaaauucu

SEQ ID NO: 2797328 - RNA, 19 nt, Human
gagcugauauaaauucugu

SEQ ID NO: 2797329 - RNA, 14 nt, Human
gagcugaugaaacu

SEQ ID NO: 2797330 - RNA, 21 nt, Human
gagcugaugaaacucacaaau

SEQ ID NO: 2797331 - RNA, 14 nt, Human
gagcugagguuuca

SEQ ID NO: 2797332 - RNA, 23 nt, Human
gagcugagguuucacccuuaacc

SEQ ID NO: 2797333 - RNA, 19 nt, Human
gagcucaagggacaaggac

SEQ ID NO: 2797334 - RNA, 12 nt, Human
gagcugagccag

SEQ ID NO: 2797335 - RNA, 13 nt, Human
gagcugagccagg

SEQ ID NO: 2797336 - RNA, 14 nt, Human
gagcugagccaggc

SEQ ID NO: 2797337 - RNA, 15 nt, Human
gagcugagccaggcu

SEQ ID NO: 2797338 - RNA, 22 nt, Human
gagcugagccaggcuagcugga

SEQ ID NO: 2797339 - RNA, 23 nt, Human
gagcugagccaggcuagcuggag

SEQ ID NO: 2797340 - RNA, 22 nt, Human
gagcugagaucgugccacugca

SEQ ID NO: 2797341 - RNA, 16 nt, Human
gagcugacacaggaug

SEQ ID NO: 2797342 - RNA, 17 nt, Human
gagcugacacaggauga

SEQ ID NO: 2797343 - RNA, 18 nt, Human
gagcugacacaaaccugc

SEQ ID NO: 2797344 - RNA, 22 nt, Human
gagcugacacaaaccugccugg

SEQ ID NO: 2797345 - RNA, 23 nt, Human
gagcugacacaaaccugccuggg

SEQ ID NO: 2797346 - RNA, 15 nt, Human
gagccugcaguuauu

SEQ ID NO: 2797347 - RNA, 13 nt, Human
gagccugccugga

SEQ ID NO: 2797348 - RNA, 14 nt, Human
gagccugccuggag

SEQ ID NO: 2797349 - RNA, 15 nt, Human
gagccugccuggagc

SEQ ID NO: 2797350 - RNA, 14 nt, Human
gagcuauuaaaacu

SEQ ID NO: 2797351 - RNA, 16 nt, Human
gagcuauuaaaacuca

SEQ ID NO: 2797352 - RNA, 20 nt, Human
gagcuauuaaaacucagccu

SEQ ID NO: 2797353 - RNA, 22 nt, Human
gagcuauuaaaacucagccugg

SEQ ID NO: 2797354 - RNA, 13 nt, Human
gagcuauugcugu

SEQ ID NO: 2797355 - RNA, 16 nt, Human
gagcucacucggcacc

SEQ ID NO: 2797356 - RNA, 22 nt, Human
gagcuccagagcaacgaccagg

SEQ ID NO: 2797357 - RNA, 18 nt, Human
gagcucagagagggcagg

SEQ ID NO: 2797358 - RNA, 20 nt, Human
gagcucagagagggcaggca

SEQ ID NO: 2797359 - RNA, 21 nt, Human
gagcucagagagggcaggcau

SEQ ID NO: 2797360 - RNA, 23 nt, Human
gagcucagccccgagcugucccc

SEQ ID NO: 2797361 - RNA, 17 nt, Human
gagccucccaaggagaa

SEQ ID NO: 2797362 - RNA, 20 nt, Human
gagccucccaaggagaacaa

SEQ ID NO: 2797363 - RNA, 21 nt, Human
gagccucccaaggagaacaaa

SEQ ID NO: 2797364 - RNA, 22 nt, Human
gagccucccaaggagaacaaau

SEQ ID NO: 2797365 - RNA, 16 nt, Human
gagccucugcucccca

SEQ ID NO: 2797366 - RNA, 14 nt, Human
gagccucgcucugu

SEQ ID NO: 2797367 - RNA, 12 nt, Human
gagccugcaguu

SEQ ID NO: 2797368 - RNA, 15 nt, Human
gagccugagucaggg

SEQ ID NO: 2797369 - RNA, 16 nt, Human
gagccugagucagggc

SEQ ID NO: 2797370 - RNA, 17 nt, Human
gagccucugcuccccag

SEQ ID NO: 2797371 - RNA, 12 nt, Human
gagccucugggg

SEQ ID NO: 2797372 - RNA, 20 nt, Human
gagccucuucugccaagaga

SEQ ID NO: 2797373 - RNA, 19 nt, Human
gagccugaauuuuguugcu

SEQ ID NO: 2797374 - RNA, 15 nt, Human
gagccucagcauccu

SEQ ID NO: 2797375 - RNA, 14 nt, Human
gagccucagcaucc

SEQ ID NO: 2797376 - RNA, 17 nt, Human
gagccucagcauccugg

SEQ ID NO: 2797377 - RNA, 18 nt, Human
gagccucagucucccucc

SEQ ID NO: 2797378 - RNA, 19 nt, Human
gagccucagucucccuccc

SEQ ID NO: 2797379 - RNA, 13 nt, Human
gagccucagcauc

SEQ ID NO: 2797380 - RNA, 15 nt, Human
gagccuagaagcugg

SEQ ID NO: 2797381 - RNA, 15 nt, Human
gagccuaggaccacu

SEQ ID NO: 2797382 - RNA, 19 nt, Human
gagccuaggaccacucagc

SEQ ID NO: 2797383 - RNA, 20 nt, Human
gagccuaggaccacucagcc

SEQ ID NO: 2797384 - RNA, 21 nt, Human
gagccuaggaccacucagccc

SEQ ID NO: 2797385 - RNA, 22 nt, Human
gagccuaggaccacucagcccc

SEQ ID NO: 2797386 - RNA, 21 nt, Human
gagccuaguuuuuaauagcua

SEQ ID NO: 2797387 - RNA, 18 nt, Human
gagcccacggcuaagagg

SEQ ID NO: 2797388 - RNA, 21 nt, Human
gagcccacggcuaagaggcug

SEQ ID NO: 2797389 - RNA, 22 nt, Human
gagcccacggcuaagaggcugc

SEQ ID NO: 2797390 - RNA, 23 nt, Human
gagcccacggcuaagaggcugcu

SEQ ID NO: 2797391 - RNA, 20 nt, Human
gagccgagaucacgccacug

SEQ ID NO: 2797392 - RNA, 19 nt, Human
gagccgagaucacgccacu

SEQ ID NO: 2797393 - RNA, 22 nt, Human
gagccgagaucacgccacugca

SEQ ID NO: 2797394 - RNA, 21 nt, Human
gagccgagaucacgccacugc

SEQ ID NO: 2797395 - RNA, 20 nt, Human
gagccgagaucgcgccacug

SEQ ID NO: 2797396 - RNA, 19 nt, Human
gagccgcugugagccccug

SEQ ID NO: 2797397 - RNA, 20 nt, Human
gagccgcugugagccccugg

SEQ ID NO: 2797398 - RNA, 21 nt, Human
gagccgggcacauugagcugu

SEQ ID NO: 2797399 - RNA, 17 nt, Human
gagccgugaacugugca

SEQ ID NO: 2797400 - RNA, 18 nt, Human
gagccgugaacugugcau

SEQ ID NO: 2797401 - RNA, 17 nt, Human
gagcagccucagaacaa

SEQ ID NO: 2797402 - RNA, 15 nt, Human
gagcagagcaggcaa

SEQ ID NO: 2797403 - RNA, 13 nt, Human
gagcagaggcagc

SEQ ID NO: 2797404 - RNA, 12 nt, Human
gagcagagagcu

SEQ ID NO: 2797405 - RNA, 21 nt, Human
gagcagagagcuuagccugga

SEQ ID NO: 2797406 - RNA, 18 nt, Human
gagauauaucugaaaacu

SEQ ID NO: 2797407 - RNA, 14 nt, Human
gagauagccugugg

SEQ ID NO: 2797408 - RNA, 16 nt, Human
gagauagccuguggcc

SEQ ID NO: 2797409 - RNA, 17 nt, Human
gagauagccuguggccc

SEQ ID NO: 2797410 - RNA, 19 nt, Human
gagauagccuguggcccug

SEQ ID NO: 2797411 - RNA, 20 nt, Human
gagauagccuguggcccugu

SEQ ID NO: 2797412 - RNA, 21 nt, Human
gagauagccuguggcccuguc

SEQ ID NO: 2797413 - RNA, 17 nt, Human
gagauaccaagaugcca

SEQ ID NO: 2797414 - RNA, 17 nt, Human
gagagugagcuacagag

SEQ ID NO: 2797415 - RNA, 15 nt, Human
gagaguuuugucuug

SEQ ID NO: 2797416 - RNA, 22 nt, Human
gagaguuuugucuugaaugucu

SEQ ID NO: 2797417 - RNA, 17 nt, Human
gagaguuuuuaauagaa

SEQ ID NO: 2797418 - RNA, 18 nt, Human
gagaguuuuuaauagaac

SEQ ID NO: 2797419 - RNA, 17 nt, Human
gagaguuuugucuugaa

SEQ ID NO: 2797420 - RNA, 20 nt, Human
gagccacugcaccgggccac

SEQ ID NO: 2797421 - RNA, 13 nt, Human
gagccacugcacc

SEQ ID NO: 2797422 - RNA, 18 nt, Human
gagcagccuguggcaucu

SEQ ID NO: 2797423 - RNA, 16 nt, Human
gagcagccuguggcau

SEQ ID NO: 2797424 - RNA, 15 nt, Human
gagcagccuguggca

SEQ ID NO: 2797425 - RNA, 14 nt, Human
gagcagccuguggc

SEQ ID NO: 2797426 - RNA, 13 nt, Human
gagcagccugugg

SEQ ID NO: 2797427 - RNA, 11 nt, Human
gagcagccugu

SEQ ID NO: 2797428 - RNA, 19 nt, Human
gagccacugcaccgggcca

SEQ ID NO: 2797429 - RNA, 18 nt, Human
gagccacugcaccgggcc

SEQ ID NO: 2797430 - RNA, 17 nt, Human
gagcccaccuuggcuca

SEQ ID NO: 2797431 - RNA, 15 nt, Human
gagcccaccuuggcu

SEQ ID NO: 2797432 - RNA, 13 nt, Human
gagcccaccuugg

SEQ ID NO: 2797433 - RNA, 21 nt, Human
gagccaggcuagcuggagccu

SEQ ID NO: 2797434 - RNA, 22 nt, Human
gagccaggcuagcuggagccug

SEQ ID NO: 2797435 - RNA, 20 nt, Human
gagccagcuuggggccacca

SEQ ID NO: 2797436 - RNA, 13 nt, Human
gagccagcucccu

SEQ ID NO: 2797437 - RNA, 18 nt, Human
gagccagcucccucuauu

SEQ ID NO: 2797438 - RNA, 14 nt, Human
gagagucugucuca

SEQ ID NO: 2797439 - RNA, 18 nt, Human
gagaggggaacagacugg

SEQ ID NO: 2797440 - RNA, 13 nt, Human
gagaggggaacag

SEQ ID NO: 2797441 - RNA, 20 nt, Human
gagacagagccucgcucugu

SEQ ID NO: 2797442 - RNA, 16 nt, Human
gagagggcaggcauga

SEQ ID NO: 2797443 - RNA, 22 nt, Human
gagagagcuucuguugcugccu

SEQ ID NO: 2797444 - RNA, 15 nt, Human
gagagaggcagagag

SEQ ID NO: 2797445 - RNA, 13 nt, Human
gagagaggcagag

SEQ ID NO: 2797446 - RNA, 16 nt, Human
gagagaauuggcucaa

SEQ ID NO: 2797447 - RNA, 17 nt, Human
gagagaauuggcucaau

SEQ ID NO: 2797448 - RNA, 12 nt, Human
gagagaaggggc

SEQ ID NO: 2797449 - RNA, 16 nt, Human
gagagaaccuaacugu

SEQ ID NO: 2797450 - RNA, 17 nt, Human
gagagaaccuaacugua

SEQ ID NO: 2797451 - RNA, 18 nt, Human
gagagaaccuaacuguau

SEQ ID NO: 2797452 - RNA, 20 nt, Human
gagagaaccuaacuguaucu

SEQ ID NO: 2797453 - RNA, 21 nt, Human
gagagaaccuaacuguaucuu

SEQ ID NO: 2797454 - RNA, 20 nt, Human
gagacuuucuuucuguaggu

SEQ ID NO: 2797455 - RNA, 13 nt, Human
gagacuuuguaga

SEQ ID NO: 2797456 - RNA, 22 nt, Human
gagacuuuuaaucagacaaagu

SEQ ID NO: 2797457 - RNA, 14 nt, Human
gagagaaaaacaaa

SEQ ID NO: 2797458 - RNA, 14 nt, Human
gagacuuuuuucua

SEQ ID NO: 2797459 - RNA, 16 nt, Human
gagacuuuuuucuagu

SEQ ID NO: 2797460 - RNA, 11 nt, Human
gagagaaaaaa

SEQ ID NO: 2797461 - RNA, 14 nt, Human
gagagccugcugca

SEQ ID NO: 2797462 - RNA, 13 nt, Human
gagagccugcugc

SEQ ID NO: 2797463 - RNA, 11 nt, Human
gagagcccagc

SEQ ID NO: 2797464 - RNA, 21 nt, Human
gagagcccagagguaacagaa

SEQ ID NO: 2797465 - RNA, 23 nt, Human
gagagcccagagguaacagaaca

SEQ ID NO: 2797466 - RNA, 14 nt, Human
gagagccauuuugu

SEQ ID NO: 2797467 - RNA, 10 nt, Human
gagagcccag

SEQ ID NO: 2797468 - RNA, 17 nt, Human
gagagccauuuugugaa

SEQ ID NO: 2797469 - RNA, 14 nt, Human
gagagcccagaggu

SEQ ID NO: 2797470 - RNA, 16 nt, Human
gagagaggcagagagc

SEQ ID NO: 2797471 - RNA, 17 nt, Human
gagagaggcagagagcg

SEQ ID NO: 2797472 - RNA, 20 nt, Human
gagacauggcuuucagaaaa

SEQ ID NO: 2797473 - RNA, 21 nt, Human
gagacauggcuuucagaaaac

SEQ ID NO: 2797474 - RNA, 13 nt, Human
gagacagccccag

SEQ ID NO: 2797475 - RNA, 14 nt, Human
gagacagccccaga

SEQ ID NO: 2797476 - RNA, 15 nt, Human
gagacagccccagag

SEQ ID NO: 2797477 - RNA, 18 nt, Human
gagacagccccagagcag

SEQ ID NO: 2797478 - RNA, 19 nt, Human
gagacagccccagagcagg

SEQ ID NO: 2797479 - RNA, 21 nt, Human
gagacaguuucuuagcuuuuu

SEQ ID NO: 2797480 - RNA, 22 nt, Human
gagacaguuucuuagcuuuuua

SEQ ID NO: 2797481 - RNA, 16 nt, Human
gagaccagggagccuu

SEQ ID NO: 2797482 - RNA, 14 nt, Human
gagaccaggcaaag

SEQ ID NO: 2797483 - RNA, 18 nt, Human
gagaccaggcaaagcaag

SEQ ID NO: 2797484 - RNA, 14 nt, Human
gagaccaggcccug

SEQ ID NO: 2797485 - RNA, 15 nt, Human
gagaccaggcccugg

SEQ ID NO: 2797486 - RNA, 18 nt, Human
gagaccaggcccuggcua

SEQ ID NO: 2797487 - RNA, 17 nt, Human
gagaccaggcugugucc

SEQ ID NO: 2797488 - RNA, 23 nt, Human
gagaccaguugaauaaaagugca

SEQ ID NO: 2797489 - RNA, 14 nt, Human
gagaccagccuggc

SEQ ID NO: 2797490 - RNA, 18 nt, Human
gagaccaaggcgggagca

SEQ ID NO: 2797491 - RNA, 19 nt, Human
gagaccagccugggcagca

SEQ ID NO: 2797492 - RNA, 16 nt, Human
gagaccagccugggca

SEQ ID NO: 2797493 - RNA, 23 nt, Human
gagaccagccugggcaacaaagu

SEQ ID NO: 2797494 - RNA, 13 nt, Human
gagaccagccugg

SEQ ID NO: 2797495 - RNA, 14 nt, Human
gagacucugucuca

SEQ ID NO: 2797496 - RNA, 23 nt, Human
gagacucuguggggccuugguuc

SEQ ID NO: 2797497 - RNA, 12 nt, Human
gagacucugugg

SEQ ID NO: 2797498 - RNA, 19 nt, Human
gagacugcgggaugguccu

SEQ ID NO: 2797499 - RNA, 22 nt, Human
gagacugucucaagagggcacu

SEQ ID NO: 2797500 - RNA, 23 nt, Human
gagacugcgggaugguccugggg

SEQ ID NO: 2797501 - RNA, 16 nt, Human
gagacugcguucugca

SEQ ID NO: 2797502 - RNA, 17 nt, Human
gagacugcguucugcaa

SEQ ID NO: 2797503 - RNA, 23 nt, Human
gagacugcguucugcaagcauca

SEQ ID NO: 2797504 - RNA, 22 nt, Human
gagacugcgggaugguccuggg

SEQ ID NO: 2797505 - RNA, 13 nt, Human
gagacuugccaga

SEQ ID NO: 2797506 - RNA, 12 nt, Human
gagacuugccuu

SEQ ID NO: 2797507 - RNA, 13 nt, Human
gagacuugccuuc

SEQ ID NO: 2797508 - RNA, 13 nt, Human
gagacuuguauga

SEQ ID NO: 2797509 - RNA, 23 nt, Human
gagacugucucaagagggcacug

SEQ ID NO: 2797510 - RNA, 22 nt, Human
gagacaaguuccaugggauaca

SEQ ID NO: 2797511 - RNA, 20 nt, Human
gagacacaacaacuccuagg

SEQ ID NO: 2797512 - RNA, 13 nt, Human
gagacacagaugu

SEQ ID NO: 2797513 - RNA, 14 nt, Human
gagacacagauguu

SEQ ID NO: 2797514 - RNA, 16 nt, Human
gagacacagcgucccu

SEQ ID NO: 2797515 - RNA, 14 nt, Human
gagaauugggggcu

SEQ ID NO: 2797516 - RNA, 13 nt, Human
gagaauuggcuca

SEQ ID NO: 2797517 - RNA, 12 nt, Human
gagaauuucuaa

SEQ ID NO: 2797518 - RNA, 13 nt, Human
gagaauuucuaaa

SEQ ID NO: 2797519 - RNA, 23 nt, Human
gagaauuucuaaaaagauuagca

SEQ ID NO: 2797520 - RNA, 19 nt, Human
gagaauugggcggcucuga

SEQ ID NO: 2797521 - RNA, 21 nt, Human
gagaauuucuaccauuucaga

SEQ ID NO: 2797522 - RNA, 18 nt, Human
gagacaaaauauuuccca

SEQ ID NO: 2797523 - RNA, 16 nt, Human
gagacaaaauuuuagu

SEQ ID NO: 2797524 - RNA, 19 nt, Human
gagacaaacaccucccagg

SEQ ID NO: 2797525 - RNA, 22 nt, Human
gagacaaacaccucccaggaga

SEQ ID NO: 2797526 - RNA, 20 nt, Human
gagacaaacaccucccagga

SEQ ID NO: 2797527 - RNA, 17 nt, Human
gagacaagaaaucccug

SEQ ID NO: 2797528 - RNA, 14 nt, Human
gagacaaugucugc

SEQ ID NO: 2797529 - RNA, 19 nt, Human
gagacaaugucugcagccc

SEQ ID NO: 2797530 - RNA, 20 nt, Human
gagacaaugucugcagcccu

SEQ ID NO: 2797531 - RNA, 22 nt, Human
gagacaaugucugcagcccuga

SEQ ID NO: 2797532 - RNA, 19 nt, Human
gagacagaguuuucacucu

SEQ ID NO: 2797533 - RNA, 21 nt, Human
gagaauugcugaagggcauuc

SEQ ID NO: 2797534 - RNA, 16 nt, Human
gagacacggagcccag

SEQ ID NO: 2797535 - RNA, 19 nt, Human
gagacacguguggcgggca

SEQ ID NO: 2797536 - RNA, 21 nt, Human
gagacacucagaccagagaag

SEQ ID NO: 2797537 - RNA, 15 nt, Human
gagacacuggccccu

SEQ ID NO: 2797538 - RNA, 17 nt, Human
gagacacuggccccuca

SEQ ID NO: 2797539 - RNA, 20 nt, Human
gagacacugugcuauaaauc

SEQ ID NO: 2797540 - RNA, 14 nt, Human
gagacagaauguau

SEQ ID NO: 2797541 - RNA, 16 nt, Human
gagacagaauguaucu

SEQ ID NO: 2797542 - RNA, 18 nt, Human
gagacagaauguaucugu

SEQ ID NO: 2797543 - RNA, 20 nt, Human
gagacagaauguaucuguga

SEQ ID NO: 2797544 - RNA, 21 nt, Human
gagacagaauguaucugugaa

SEQ ID NO: 2797545 - RNA, 22 nt, Human
gagaagauaauuguugaaauuu

SEQ ID NO: 2797546 - RNA, 20 nt, Human
gagaaccgagcaaagaucaa

SEQ ID NO: 2797547 - RNA, 22 nt, Human
gagaaccgagcaaagaucaaaa

SEQ ID NO: 2797548 - RNA, 23 nt, Human
gagaaccgagcaaagaucaaaau

SEQ ID NO: 2797549 - RNA, 9 nt, Human
gagaagaag

SEQ ID NO: 2797550 - RNA, 11 nt, Human
gagaagaagaa

SEQ ID NO: 2797551 - RNA, 14 nt, Human
gagaagaagaaaaa

SEQ ID NO: 2797552 - RNA, 15 nt, Human
gagaagaagaaaaaa

SEQ ID NO: 2797553 - RNA, 11 nt, Human
gagaagaauag

SEQ ID NO: 2797554 - RNA, 14 nt, Human
gagaagaauagccu

SEQ ID NO: 2797555 - RNA, 23 nt, Human
gagaagaauagccuagauaugaa

SEQ ID NO: 2797556 - RNA, 12 nt, Human
gagaagaggagc

SEQ ID NO: 2797557 - RNA, 13 nt, Human
gagaaugagccuc

SEQ ID NO: 2797558 - RNA, 16 nt, Human
gagaaaccuguaucuu

SEQ ID NO: 2797559 - RNA, 17 nt, Human
gagaaaccuguaucuuu

SEQ ID NO: 2797560 - RNA, 18 nt, Human
gagaaaccuguaucuuuc

SEQ ID NO: 2797561 - RNA, 21 nt, Human
gagaaaccuguaucuuucuau

SEQ ID NO: 2797562 - RNA, 22 nt, Human
gagaaaguacuucuccacccug

SEQ ID NO: 2797563 - RNA, 16 nt, Human
gagaaagaggaagcuu

SEQ ID NO: 2797564 - RNA, 23 nt, Human
gagaaauaaaguuugcuuagaaa

SEQ ID NO: 2797565 - RNA, 20 nt, Human
gagaaauauggacacuuaau

SEQ ID NO: 2797566 - RNA, 23 nt, Human
gagaaaguacuucuccacccugc

SEQ ID NO: 2797567 - RNA, 15 nt, Human
gagaaacuuuauaca

SEQ ID NO: 2797568 - RNA, 17 nt, Human
gagaaacuuuauacauu

SEQ ID NO: 2797569 - RNA, 19 nt, Human
gagaaacuuuauacauuag

SEQ ID NO: 2797570 - RNA, 17 nt, Human
gagaacaaacagaucga

SEQ ID NO: 2797571 - RNA, 13 nt, Human
gagaacaaagaug

SEQ ID NO: 2797572 - RNA, 12 nt, Human
gagaacaaagcu

SEQ ID NO: 2797573 - RNA, 14 nt, Human
gagaacaaagcugu

SEQ ID NO: 2797574 - RNA, 15 nt, Human
gagaacaaagcuguu

SEQ ID NO: 2797575 - RNA, 22 nt, Human
gagaacaaagcuguuaaacugu

SEQ ID NO: 2797576 - RNA, 12 nt, Human
gagaacaaauau

SEQ ID NO: 2797577 - RNA, 15 nt, Human
gagaacaaauauuca

SEQ ID NO: 2797578 - RNA, 18 nt, Human
gagaacaggugguuuuua

SEQ ID NO: 2797579 - RNA, 22 nt, Human
gagaacacagccgauucaccug

SEQ ID NO: 2797580 - RNA, 23 nt, Human
gagaaauuucugugaaaccugug

SEQ ID NO: 2797581 - RNA, 19 nt, Human
gagaaccacuacaugcagc

SEQ ID NO: 2797582 - RNA, 18 nt, Human
gacuuguuugucuuccau

SEQ ID NO: 2797583 - RNA, 22 nt, Human
gacuuguuugucuuccauucca

SEQ ID NO: 2797584 - RNA, 16 nt, Human
gacuugugucucugug

SEQ ID NO: 2797585 - RNA, 13 nt, Human
gacuugugucucu

SEQ ID NO: 2797586 - RNA, 13 nt, Human
gacuuggaagcuc

SEQ ID NO: 2797587 - RNA, 18 nt, Human
gacuuguuuuaugcucag

SEQ ID NO: 2797588 - RNA, 11 nt, Human
gagaaaauaua

SEQ ID NO: 2797589 - RNA, 16 nt, Human
gagaaaauauauguau

SEQ ID NO: 2797590 - RNA, 17 nt, Human
gagaaaauauauguauu

SEQ ID NO: 2797591 - RNA, 18 nt, Human
gagaaaauauauguauuu

SEQ ID NO: 2797592 - RNA, 19 nt, Human
gagaaaauauauguauuuu

SEQ ID NO: 2797593 - RNA, 15 nt, Human
gagaaacaaacuuuu

SEQ ID NO: 2797594 - RNA, 13 nt, Human
gagaaacacuuga

SEQ ID NO: 2797595 - RNA, 14 nt, Human
gagaaacacuugaa

SEQ ID NO: 2797596 - RNA, 17 nt, Human
gagaaacaauaaagaga

SEQ ID NO: 2797597 - RNA, 13 nt, Human
gagaaacaaacuu

SEQ ID NO: 2797598 - RNA, 14 nt, Human
gacuccggcccucc

SEQ ID NO: 2797599 - RNA, 13 nt, Human
gacucgcuuguaa

SEQ ID NO: 2797600 - RNA, 14 nt, Human
gacucgcuuguaaa

SEQ ID NO: 2797601 - RNA, 15 nt, Human
gacucgcuuguaaau

SEQ ID NO: 2797602 - RNA, 19 nt, Human
gacucgcuuguaaauacca

SEQ ID NO: 2797603 - RNA, 16 nt, Human
gacuuggaagcuccgc

SEQ ID NO: 2797604 - RNA, 15 nt, Human
gacuuggaagcuccg

SEQ ID NO: 2797605 - RNA, 14 nt, Human
gacuuggaagcucc

SEQ ID NO: 2797606 - RNA, 16 nt, Human
gaugaaacucacaaau

SEQ ID NO: 2797607 - RNA, 20 nt, Human
gaugaagcaaggaagauaua

SEQ ID NO: 2797608 - RNA, 21 nt, Human
gaugaagcaaggaagauauac

SEQ ID NO: 2797609 - RNA, 23 nt, Human
gaugaagcaaggaagauauacau

SEQ ID NO: 2797610 - RNA, 19 nt, Human
gaugaagccgaccuuagau

SEQ ID NO: 2797611 - RNA, 17 nt, Human
gaugaacuuauucugua

SEQ ID NO: 2797612 - RNA, 19 nt, Human
gaugaacuuauucuguaga

SEQ ID NO: 2797613 - RNA, 13 nt, Human
gaugaacuuucuc

SEQ ID NO: 2797614 - RNA, 19 nt, Human
gaugaaagagaaggugggu

SEQ ID NO: 2797615 - RNA, 21 nt, Human
gaucugugauaguucaccccc

SEQ ID NO: 2797616 - RNA, 15 nt, Human
gaugaaaauuugaga

SEQ ID NO: 2797617 - RNA, 19 nt, Human
gaugaaaucuuacagcugg

SEQ ID NO: 2797618 - RNA, 18 nt, Human
gaugaacucuuagaaaug

SEQ ID NO: 2797619 - RNA, 22 nt, Human
gaugaacucuuagaaaugaagg

SEQ ID NO: 2797620 - RNA, 17 nt, Human
gaucuuugcagacaggc

SEQ ID NO: 2797621 - RNA, 18 nt, Human
gaucuuugcagacaggca

SEQ ID NO: 2797622 - RNA, 18 nt, Human
gaucuguuuugaaggcaa

SEQ ID NO: 2797623 - RNA, 13 nt, Human
gaucuuuuaaagu

SEQ ID NO: 2797624 - RNA, 17 nt, Human
gaucuuuuaaaguguua

SEQ ID NO: 2797625 - RNA, 20 nt, Human
gaucuuuuaaaguguuacuu

SEQ ID NO: 2797626 - RNA, 22 nt, Human
gaucucagcuuugagaagccuu

SEQ ID NO: 2797627 - RNA, 12 nt, Human
gaucugucuugu

SEQ ID NO: 2797628 - RNA, 13 nt, Human
gaucugucuugua

SEQ ID NO: 2797629 - RNA, 14 nt, Human
gaucugucuuguaa

SEQ ID NO: 2797630 - RNA, 22 nt, Human
gaucugucuuguaauauuuugu

SEQ ID NO: 2797631 - RNA, 13 nt, Human
gaucugugcccca

SEQ ID NO: 2797632 - RNA, 18 nt, Human
gaucugugccccaugccu

SEQ ID NO: 2797633 - RNA, 14 nt, Human
gaucugugccccau

SEQ ID NO: 2797634 - RNA, 17 nt, Human
gaucuguuuugaaggca

SEQ ID NO: 2797635 - RNA, 13 nt, Human
gaucuguuuugaa

SEQ ID NO: 2797636 - RNA, 14 nt, Human
gauccugccacccu

SEQ ID NO: 2797637 - RNA, 15 nt, Human
gauccugccacccug

SEQ ID NO: 2797638 - RNA, 16 nt, Human
gauccugccacccugu

SEQ ID NO: 2797639 - RNA, 17 nt, Human
gauccugccacccugua

SEQ ID NO: 2797640 - RNA, 18 nt, Human
gauccugccacccuguag

SEQ ID NO: 2797641 - RNA, 17 nt, Human
gauccccucaggacugc

SEQ ID NO: 2797642 - RNA, 21 nt, Human
gauccccucugucuacaaaua

SEQ ID NO: 2797643 - RNA, 13 nt, Human
gauccccugagcc

SEQ ID NO: 2797644 - RNA, 14 nt, Human
gauccccugagccc

SEQ ID NO: 2797645 - RNA, 13 nt, Human
gauccccucagga

SEQ ID NO: 2797646 - RNA, 14 nt, Human
gauccccucaggac

SEQ ID NO: 2797647 - RNA, 14 nt, Human
gaucucagcuuuga

SEQ ID NO: 2797648 - RNA, 21 nt, Human
gaucucagcuuugagaagccu

SEQ ID NO: 2797649 - RNA, 16 nt, Human
gaucucagcuuugaga

SEQ ID NO: 2797650 - RNA, 13 nt, Human
gaucucacucugc

SEQ ID NO: 2797651 - RNA, 15 nt, Human
gaucucacucugccc

SEQ ID NO: 2797652 - RNA, 15 nt, Human
gaucuauguuucauc

SEQ ID NO: 2797653 - RNA, 13 nt, Human
gaucuauaaagcg

SEQ ID NO: 2797654 - RNA, 21 nt, Human
gaucgcggcggagcuggcccc

SEQ ID NO: 2797655 - RNA, 23 nt, Human
gaucgcgccacuacacuccagcc

SEQ ID NO: 2797656 - RNA, 22 nt, Human
gaucauuuauuuuaagcacucu

SEQ ID NO: 2797657 - RNA, 14 nt, Human
gauggcucagaggg

SEQ ID NO: 2797658 - RNA, 15 nt, Human
gauggcucagagggg

SEQ ID NO: 2797659 - RNA, 24 nt, Human
gauggcucagagggggacugcugc

SEQ ID NO: 2797660 - RNA, 13 nt, Human
gauggcugugccu

SEQ ID NO: 2797661 - RNA, 17 nt, Human
gauggcugugccucugc

SEQ ID NO: 2797662 - RNA, 18 nt, Human
gauggcugugccucugcc

SEQ ID NO: 2797663 - RNA, 19 nt, Human
gauggcugugccucugccu

SEQ ID NO: 2797664 - RNA, 19 nt, Human
gauggcuggaaggggucca

SEQ ID NO: 2797665 - RNA, 20 nt, Human
gauggcugugccucugccug

SEQ ID NO: 2797666 - RNA, 20 nt, Human
gauggccuggccagggccug

SEQ ID NO: 2797667 - RNA, 21 nt, Human
gauggccuggccagggccugg

SEQ ID NO: 2797668 - RNA, 14 nt, Human
gauggccuggccag

SEQ ID NO: 2797669 - RNA, 19 nt, Human
gaugccugguggcagcugc

SEQ ID NO: 2797670 - RNA, 18 nt, Human
gaugccugguggcagcug

SEQ ID NO: 2797671 - RNA, 20 nt, Human
gaugccugguggcagcugcg

SEQ ID NO: 2797672 - RNA, 23 nt, Human
gauggaugccaauauuaaaucug

SEQ ID NO: 2797673 - RNA, 17 nt, Human
gaugacaacuucccagu

SEQ ID NO: 2797674 - RNA, 16 nt, Human
gaugaaguuuuacauu

SEQ ID NO: 2797675 - RNA, 22 nt, Human
gaugaaguuuguaguuguuuua

SEQ ID NO: 2797676 - RNA, 17 nt, Human
gaugacaagaugguaca

SEQ ID NO: 2797677 - RNA, 20 nt, Human
gaugacaugcacucagcucu

SEQ ID NO: 2797678 - RNA, 13 nt, Human
gaugcaccagccc

SEQ ID NO: 2797679 - RNA, 20 nt, Human
gaugcauuguaguuuaacca

SEQ ID NO: 2797680 - RNA, 14 nt, Human
gaugcagccgccuu

SEQ ID NO: 2797681 - RNA, 20 nt, Human
gaugcagccgccuuccuuga

SEQ ID NO: 2797682 - RNA, 22 nt, Human
gaugcagccgccuuccuugacc

SEQ ID NO: 2797683 - RNA, 23 nt, Human
gaugcagagagccauuuugugaa

SEQ ID NO: 2797684 - RNA, 12 nt, Human
gaugcagcauuu

SEQ ID NO: 2797685 - RNA, 13 nt, Human
gaugcagcauuug

SEQ ID NO: 2797686 - RNA, 15 nt, Human
gaugcagcauuugau

SEQ ID NO: 2797687 - RNA, 23 nt, Human
gaugcagcauuugauaaugauaa

SEQ ID NO: 2797688 - RNA, 16 nt, Human
gaugccacccuagcca

SEQ ID NO: 2797689 - RNA, 15 nt, Human
gaugccacuccuccc

SEQ ID NO: 2797690 - RNA, 17 nt, Human
gaugccacuccucccuc

SEQ ID NO: 2797691 - RNA, 18 nt, Human
gaugccacuccucccucc

SEQ ID NO: 2797692 - RNA, 19 nt, Human
gaugccacuccucccuccg

SEQ ID NO: 2797693 - RNA, 17 nt, Human
gaugccugguggcagcu

SEQ ID NO: 2797694 - RNA, 12 nt, Human
gaugccacccua

SEQ ID NO: 2797695 - RNA, 19 nt, Human
gaugccaauauuaaaucug

SEQ ID NO: 2797696 - RNA, 22 nt, Human
gaugccaauacuagucacccca

SEQ ID NO: 2797697 - RNA, 19 nt, Human
gauacaccgggccuggaga

SEQ ID NO: 2797698 - RNA, 18 nt, Human
gauacaggaaaagcugcu

SEQ ID NO: 2797699 - RNA, 21 nt, Human
gauagaugcacuuaugcagua

SEQ ID NO: 2797700 - RNA, 16 nt, Human
gauacagcaguagaca

SEQ ID NO: 2797701 - RNA, 18 nt, Human
gauacagcaguagacauu

SEQ ID NO: 2797702 - RNA, 23 nt, Human
gauacagcaguagacauuuuaac

SEQ ID NO: 2797703 - RNA, 16 nt, Human
gauaaaguuucucaga

SEQ ID NO: 2797704 - RNA, 14 nt, Human
gauaaaguuucuca

SEQ ID NO: 2797705 - RNA, 15 nt, Human
gauaaaguuucucag

SEQ ID NO: 2797706 - RNA, 14 nt, Human
gauaaggacaugau

SEQ ID NO: 2797707 - RNA, 20 nt, Human
gauaaggacaugaugcuuuu

SEQ ID NO: 2797708 - RNA, 12 nt, Human
gauaaggaagaa

SEQ ID NO: 2797709 - RNA, 13 nt, Human
gauaaggaagaaa

SEQ ID NO: 2797710 - RNA, 15 nt, Human
gauaaggaagaaaca

SEQ ID NO: 2797711 - RNA, 21 nt, Human
gauaaggaagaaacagaagag

SEQ ID NO: 2797712 - RNA, 23 nt, Human
gauaagccacucugucccuuccu

SEQ ID NO: 2797713 - RNA, 20 nt, Human
gauaagagggcacacacugu

SEQ ID NO: 2797714 - RNA, 13 nt, Human
gauaaauauuuga

SEQ ID NO: 2797715 - RNA, 14 nt, Human
gauaaauauuugac

SEQ ID NO: 2797716 - RNA, 16 nt, Human
gauaaauauuugacuu

SEQ ID NO: 2797717 - RNA, 22 nt, Human
gauaaagaugcaaggaccagga

SEQ ID NO: 2797718 - RNA, 14 nt, Human
gauaaagcacagcu

SEQ ID NO: 2797719 - RNA, 15 nt, Human
gauaaagcacagcug

SEQ ID NO: 2797720 - RNA, 16 nt, Human
gauaaagcagcucagg

SEQ ID NO: 2797721 - RNA, 17 nt, Human
gauaaagccucaagguu

SEQ ID NO: 2797722 - RNA, 21 nt, Human
gauaaagcugccccaucuggg

SEQ ID NO: 2797723 - RNA, 14 nt, Human
gauagucuuucagu

SEQ ID NO: 2797724 - RNA, 15 nt, Human
gauaguaacaaugaa

SEQ ID NO: 2797725 - RNA, 17 nt, Human
gauaguacuaagcauuu

SEQ ID NO: 2797726 - RNA, 22 nt, Human
gauagucuuucaguuaaggaga

SEQ ID NO: 2797727 - RNA, 18 nt, Human
gaucaaggagaggaggca

SEQ ID NO: 2797728 - RNA, 16 nt, Human
gaucaaggagaggagg

SEQ ID NO: 2797729 - RNA, 18 nt, Human
gaucacgccacugcacua

SEQ ID NO: 2797730 - RNA, 16 nt, Human
gaucacgccacugcac

SEQ ID NO: 2797731 - RNA, 14 nt, Human
gaucaauccuuuau

SEQ ID NO: 2797732 - RNA, 15 nt, Human
gaucaauccuuuauu

SEQ ID NO: 2797733 - RNA, 22 nt, Human
gaucaauccuuuauuauuauuu

SEQ ID NO: 2797734 - RNA, 12 nt, Human
gaucacggcuca

SEQ ID NO: 2797735 - RNA, 24 nt, Human
gaucacgccacugcacuccagccu

SEQ ID NO: 2797736 - RNA, 14 nt, Human
gaucacgccuggcu

SEQ ID NO: 2797737 - RNA, 15 nt, Human
gaucacgccuggcua

SEQ ID NO: 2797738 - RNA, 23 nt, Human
gaucacgccacugcacuccagcc

SEQ ID NO: 2797739 - RNA, 16 nt, Human
gaucaauuauaguuuc

SEQ ID NO: 2797740 - RNA, 18 nt, Human
gaucaauuauaguuucug

SEQ ID NO: 2797741 - RNA, 14 nt, Human
gaucagcaucugug

SEQ ID NO: 2797742 - RNA, 22 nt, Human
gaucagaugcuccaagauucua

SEQ ID NO: 2797743 - RNA, 17 nt, Human
gaucagaugcuccaaga

SEQ ID NO: 2797744 - RNA, 21 nt, Human
gaucagaugcuccaagauucu

SEQ ID NO: 2797745 - RNA, 19 nt, Human
gaucaauuauaguuucuga

SEQ ID NO: 2797746 - RNA, 22 nt, Human
gaucagucugauucccaagcuc

SEQ ID NO: 2797747 - RNA, 21 nt, Human
gaucauccacugugccaugug

SEQ ID NO: 2797748 - RNA, 16 nt, Human
gaucauccacugugcc

SEQ ID NO: 2797749 - RNA, 14 nt, Human
gaucaucgccagag

SEQ ID NO: 2797750 - RNA, 16 nt, Human
gaucaucgccagaggu

SEQ ID NO: 2797751 - RNA, 19 nt, Human
gaucaucgccagaggugcu

SEQ ID NO: 2797752 - RNA, 21 nt, Human
gaucaucgccagaggugcuuc

SEQ ID NO: 2797753 - RNA, 23 nt, Human
gaucaucgccagaggugcuucac

SEQ ID NO: 2797754 - RNA, 23 nt, Human
gaucaucgucauuugcugugaac

SEQ ID NO: 2797755 - RNA, 19 nt, Human
gaucaugaaaguagacagu

SEQ ID NO: 2797756 - RNA, 14 nt, Human
gaucaugguguaau

SEQ ID NO: 2797757 - RNA, 15 nt, Human
gaucaugguguaaua

SEQ ID NO: 2797758 - RNA, 18 nt, Human
gaucaugguguaauaaga

SEQ ID NO: 2797759 - RNA, 20 nt, Human
gaucaugguguaauaagaca

SEQ ID NO: 2797760 - RNA, 21 nt, Human
gaucaugguguaauaagacau

SEQ ID NO: 2797761 - RNA, 23 nt, Human
gaucaugguguaauaagacauaa

SEQ ID NO: 2797762 - RNA, 22 nt, Human
gaucaucccaucuaagcugcag

SEQ ID NO: 2797763 - RNA, 23 nt, Human
gaucaucccaucuaagcugcagc

SEQ ID NO: 2797764 - RNA, 19 nt, Human
gaucauccacugugccaug

SEQ ID NO: 2797765 - RNA, 17 nt, Human
gaucauccacugugcca

SEQ ID NO: 2797766 - RNA, 18 nt, Human
gaucaguuauaaguagca

SEQ ID NO: 2797767 - RNA, 15 nt, Human
gaucauaaacugacu

SEQ ID NO: 2797768 - RNA, 13 nt, Human
gaucaguggacag

SEQ ID NO: 2797769 - RNA, 20 nt, Human
gaucaguguaccauuugccu

SEQ ID NO: 2797770 - RNA, 11 nt, Human
gaucaguguug

SEQ ID NO: 2797771 - RNA, 14 nt, Human
gaucaguuaacuau

SEQ ID NO: 2797772 - RNA, 17 nt, Human
gauccccguuccugaca

SEQ ID NO: 2797773 - RNA, 23 nt, Human
gaucauuuuccccccacucuccc

SEQ ID NO: 2797774 - RNA, 14 nt, Human
gauccccaagugug

SEQ ID NO: 2797775 - RNA, 18 nt, Human
gauccccaagugugaaca

SEQ ID NO: 2797776 - RNA, 20 nt, Human
gauccccaagugugaacaaa

SEQ ID NO: 2797777 - RNA, 19 nt, Human
gaucauuuuccccccacuc

SEQ ID NO: 2797778 - RNA, 18 nt, Human
gaucauuuuccccccacu

SEQ ID NO: 2797779 - RNA, 20 nt, Human
gauccccaagccuggcaagg

SEQ ID NO: 2797780 - RNA, 15 nt, Human
gaucauguuguuaaa

SEQ ID NO: 2797781 - RNA, 19 nt, Human
gaucauguuguuaaaauua

SEQ ID NO: 2797782 - RNA, 21 nt, Human
gaucauguuguuaaaauuaug

SEQ ID NO: 2797783 - RNA, 18 nt, Human
gaucauguuuuggugaaa

SEQ ID NO: 2797784 - RNA, 15 nt, Human
gaucauuuucccccc

SEQ ID NO: 2797785 - RNA, 14 nt, Human
gaucauuuuccccc

SEQ ID NO: 2797786 - RNA, 18 nt, Human
gaucauuuguuggaauga

SEQ ID NO: 2797787 - RNA, 15 nt, Human
gcaaggcuaugugau

SEQ ID NO: 2797788 - RNA, 16 nt, Human
gcaaggagcacaagcc

SEQ ID NO: 2797789 - RNA, 23 nt, Human
gcaaggcgguggacuugaacuuu

SEQ ID NO: 2797790 - RNA, 14 nt, Human
gcaaggcccugcug

SEQ ID NO: 2797791 - RNA, 15 nt, Human
gcaaggcccugcugc

SEQ ID NO: 2797792 - RNA, 16 nt, Human
gcaaggcccugcugcc

SEQ ID NO: 2797793 - RNA, 19 nt, Human
gcaaggcccugcugcccaa

SEQ ID NO: 2797794 - RNA, 13 nt, Human
gcaaggcccacag

SEQ ID NO: 2797795 - RNA, 14 nt, Human
gcaaggcccacagg

SEQ ID NO: 2797796 - RNA, 16 nt, Human
gcaaggcccacaggag

SEQ ID NO: 2797797 - RNA, 18 nt, Human
gcaagagugauugcagcu

SEQ ID NO: 2797798 - RNA, 19 nt, Human
gcaagagugauugcagcuu

SEQ ID NO: 2797799 - RNA, 19 nt, Human
gcaagaguguggaggcuga

SEQ ID NO: 2797800 - RNA, 19 nt, Human
gcaagauagauuuggaaua

SEQ ID NO: 2797801 - RNA, 15 nt, Human
gcaagccccugcucc

SEQ ID NO: 2797802 - RNA, 15 nt, Human
gcaagcccuacagag

SEQ ID NO: 2797803 - RNA, 20 nt, Human
gcaagcccuacagagcugug

SEQ ID NO: 2797804 - RNA, 21 nt, Human
gcaagcccuacagagcugugg

SEQ ID NO: 2797805 - RNA, 16 nt, Human
gcaagcgacgacagau

SEQ ID NO: 2797806 - RNA, 14 nt, Human
gcaagcuaaccuua

SEQ ID NO: 2797807 - RNA, 15 nt, Human
gcaagcuaaccuuau

SEQ ID NO: 2797808 - RNA, 23 nt, Human
gcaagcuaaccuuauccugcauu

SEQ ID NO: 2797809 - RNA, 13 nt, Human
gcaagcucccaag

SEQ ID NO: 2797810 - RNA, 19 nt, Human
gcaagcucccaagggaugg

SEQ ID NO: 2797811 - RNA, 21 nt, Human
gcaaggaccaggacucccucc

SEQ ID NO: 2797812 - RNA, 15 nt, Human
gcaaucacagaugag

SEQ ID NO: 2797813 - RNA, 18 nt, Human
gcaauauuugaauuuuaa

SEQ ID NO: 2797814 - RNA, 21 nt, Human
gcaauauuuauggaugcaaca

SEQ ID NO: 2797815 - RNA, 14 nt, Human
gcaauauuugaauu

SEQ ID NO: 2797816 - RNA, 22 nt, Human
gcaagggcacaaguccuggaug

SEQ ID NO: 2797817 - RNA, 15 nt, Human
gcaaggucauuucuu

SEQ ID NO: 2797818 - RNA, 23 nt, Human
gcaaugcuggcuguuggcugggg

SEQ ID NO: 2797819 - RNA, 22 nt, Human
gcaaugcuggcuguuggcuggg

SEQ ID NO: 2797820 - RNA, 14 nt, Human
gcaaugcuggcugu

SEQ ID NO: 2797821 - RNA, 13 nt, Human
gcaaugcuggcug

SEQ ID NO: 2797822 - RNA, 17 nt, Human
gcaaugaugaaugagaa

SEQ ID NO: 2797823 - RNA, 16 nt, Human
gcaaugaugaaugaga

SEQ ID NO: 2797824 - RNA, 23 nt, Human
gcaaacagaggaagaauuuguua

SEQ ID NO: 2797825 - RNA, 21 nt, Human
gcaaacaggaucaguuaacua

SEQ ID NO: 2797826 - RNA, 13 nt, Human
gcaaagcccagcu

SEQ ID NO: 2797827 - RNA, 21 nt, Human
gcaaagcccagcuugaaaccu

SEQ ID NO: 2797828 - RNA, 17 nt, Human
gcaaaauugauguguuu

SEQ ID NO: 2797829 - RNA, 15 nt, Human
gauuuuuuaaaagaa

SEQ ID NO: 2797830 - RNA, 16 nt, Human
gauuuuuuaaaagaaa

SEQ ID NO: 2797831 - RNA, 17 nt, Human
gauuuuuuaaaagaaau

SEQ ID NO: 2797832 - RNA, 20 nt, Human
gauuuuugcaauaccaagua

SEQ ID NO: 2797833 - RNA, 14 nt, Human
gauuuuuguugauu

SEQ ID NO: 2797834 - RNA, 13 nt, Human
gcaaacagaacag

SEQ ID NO: 2797835 - RNA, 14 nt, Human
gcaaacagaacagg

SEQ ID NO: 2797836 - RNA, 15 nt, Human
gcaaacagaacaggg

SEQ ID NO: 2797837 - RNA, 16 nt, Human
gcaaacagaacagggu

SEQ ID NO: 2797838 - RNA, 21 nt, Human
gcaaaauuugaugccaggaca

SEQ ID NO: 2797839 - RNA, 22 nt, Human
gcaaaauuugaugccaggacac

SEQ ID NO: 2797840 - RNA, 21 nt, Human
gcaaaauuguuuuugguugga

SEQ ID NO: 2797841 - RNA, 15 nt, Human
gcaaaauuugaugcc

SEQ ID NO: 2797842 - RNA, 20 nt, Human
gcaaaauuugaugccaggac

SEQ ID NO: 2797843 - RNA, 17 nt, Human
gcaaaauugcaaaucuu

SEQ ID NO: 2797844 - RNA, 13 nt, Human
gcaaaauugcaaa

SEQ ID NO: 2797845 - RNA, 21 nt, Human
gcaaagguuccaacuguauau

SEQ ID NO: 2797846 - RNA, 12 nt, Human
gcaaaguacaau

SEQ ID NO: 2797847 - RNA, 16 nt, Human
gcaaaguacaaugugu

SEQ ID NO: 2797848 - RNA, 19 nt, Human
gcaaaguacaauguguuuu

SEQ ID NO: 2797849 - RNA, 12 nt, Human
gcaaaucaaugc

SEQ ID NO: 2797850 - RNA, 19 nt, Human
gcaaagguuccaacuguau

SEQ ID NO: 2797851 - RNA, 15 nt, Human
gcaaaguauuguaaa

SEQ ID NO: 2797852 - RNA, 16 nt, Human
gcaaaguauuguaaau

SEQ ID NO: 2797853 - RNA, 17 nt, Human
gcaaaguauuguaaauu

SEQ ID NO: 2797854 - RNA, 18 nt, Human
gcaaaguauuguaaauua

SEQ ID NO: 2797855 - RNA, 20 nt, Human
gcaaaguauuguaaauuaua

SEQ ID NO: 2797856 - RNA, 21 nt, Human
gcaaaguauuguaaauuauau

SEQ ID NO: 2797857 - RNA, 15 nt, Human
gcaaauauaaacauc

SEQ ID NO: 2797858 - RNA, 16 nt, Human
gcaaauauaaacaucu

SEQ ID NO: 2797859 - RNA, 17 nt, Human
gcaaauauaaacaucuc

SEQ ID NO: 2797860 - RNA, 20 nt, Human
gcaaauaucauacuguucaa

SEQ ID NO: 2797861 - RNA, 19 nt, Human
gcaaaucaguguuuuucuu

SEQ ID NO: 2797862 - RNA, 13 nt, Human
gcaagaaguagca

SEQ ID NO: 2797863 - RNA, 16 nt, Human
gcaagaauaaaaaaga

SEQ ID NO: 2797864 - RNA, 17 nt, Human
gcaagaauaaaaaagaa

SEQ ID NO: 2797865 - RNA, 16 nt, Human
gcaagaacucaucacu

SEQ ID NO: 2797866 - RNA, 20 nt, Human
gcaagaacucaucacugugg

SEQ ID NO: 2797867 - RNA, 21 nt, Human
gcaagaacucaucacuguggc

SEQ ID NO: 2797868 - RNA, 22 nt, Human
gcaagaacucaucacuguggcu

SEQ ID NO: 2797869 - RNA, 19 nt, Human
gcaagaaaaaaaaaugcca

SEQ ID NO: 2797870 - RNA, 16 nt, Human
gcaacacagccugggc

SEQ ID NO: 2797871 - RNA, 18 nt, Human
gcaacacagccugggccc

SEQ ID NO: 2797872 - RNA, 23 nt, Human
gcaacacagccugggccccagcu

SEQ ID NO: 2797873 - RNA, 16 nt, Human
gcaacacgcaugguca

SEQ ID NO: 2797874 - RNA, 17 nt, Human
gcaacacucuauauuua

SEQ ID NO: 2797875 - RNA, 14 nt, Human
gcaacagagugaga

SEQ ID NO: 2797876 - RNA, 13 nt, Human
gcaacagacaagu

SEQ ID NO: 2797877 - RNA, 19 nt, Human
gcaacagagugagacccug

SEQ ID NO: 2797878 - RNA, 19 nt, Human
gcaacagacaagugacugu

SEQ ID NO: 2797879 - RNA, 20 nt, Human
gcaagaaugguggcuucuuu

SEQ ID NO: 2797880 - RNA, 21 nt, Human
gcaagaaugguggcuucuuuu

SEQ ID NO: 2797881 - RNA, 22 nt, Human
gcaagagauauuuugggcaugu

SEQ ID NO: 2797882 - RNA, 13 nt, Human
gcaagagagaacc

SEQ ID NO: 2797883 - RNA, 14 nt, Human
gcaagagagaaccu

SEQ ID NO: 2797884 - RNA, 22 nt, Human
gcaagagagaaccuaacuguau

SEQ ID NO: 2797885 - RNA, 21 nt, Human
gauuuuccugaaacacuaaag

SEQ ID NO: 2797886 - RNA, 22 nt, Human
gauuuuauuacuggcguggauu

SEQ ID NO: 2797887 - RNA, 14 nt, Human
gauuuucauaacuu

SEQ ID NO: 2797888 - RNA, 16 nt, Human
gauuuucauaacuuau

SEQ ID NO: 2797889 - RNA, 23 nt, Human
gauuuucauaacuuauugcugau

SEQ ID NO: 2797890 - RNA, 14 nt, Human
gauuuucauguucu

SEQ ID NO: 2797891 - RNA, 15 nt, Human
gauuuucauguucuu

SEQ ID NO: 2797892 - RNA, 13 nt, Human
gauuuucuccagc

SEQ ID NO: 2797893 - RNA, 14 nt, Human
gauuuucuccagcu

SEQ ID NO: 2797894 - RNA, 15 nt, Human
gauuuucuccagcuc

SEQ ID NO: 2797895 - RNA, 16 nt, Human
gauuuucuccagcuca

SEQ ID NO: 2797896 - RNA, 21 nt, Human
gauuuucugggccuaaaggau

SEQ ID NO: 2797897 - RNA, 16 nt, Human
gauuuuuacuguguuu

SEQ ID NO: 2797898 - RNA, 15 nt, Human
gauuuucugguucua

SEQ ID NO: 2797899 - RNA, 16 nt, Human
gauuuucugguucuaa

SEQ ID NO: 2797900 - RNA, 20 nt, Human
gauuuuuauauuaguugcuu

SEQ ID NO: 2797901 - RNA, 22 nt, Human
gauuuuuauauuaguugcuuug

SEQ ID NO: 2797902 - RNA, 18 nt, Human
gauuuuuacuguguuuua

SEQ ID NO: 2797903 - RNA, 12 nt, Human
gauuuuucucaa

SEQ ID NO: 2797904 - RNA, 13 nt, Human
gauuuuucucaaa

SEQ ID NO: 2797905 - RNA, 23 nt, Human
gauuuuucggaggccccacugau

SEQ ID NO: 2797906 - RNA, 16 nt, Human
gauuuuucuaaccuug

SEQ ID NO: 2797907 - RNA, 22 nt, Human
gauuuuucuaaccuugaaugcu

SEQ ID NO: 2797908 - RNA, 23 nt, Human
gauuuuucuaaccuugaaugcug

SEQ ID NO: 2797909 - RNA, 18 nt, Human
gauuuuucucaaaguuuu

SEQ ID NO: 2797910 - RNA, 15 nt, Human
gauuuuauuuuacua

SEQ ID NO: 2797911 - RNA, 19 nt, Human
gauuuucaaagcuuuuucc

SEQ ID NO: 2797912 - RNA, 21 nt, Human
gauuuucaaccagauaacaua

SEQ ID NO: 2797913 - RNA, 18 nt, Human
gauuuucaaagcuuuuuc

SEQ ID NO: 2797914 - RNA, 14 nt, Human
gauuugucccaggu

SEQ ID NO: 2797915 - RNA, 14 nt, Human
gauuuguacugaaa

SEQ ID NO: 2797916 - RNA, 21 nt, Human
gauuuguaggaaggucucauu

SEQ ID NO: 2797917 - RNA, 23 nt, Human
gauuuguaggaaggucucauucu

SEQ ID NO: 2797918 - RNA, 12 nt, Human
gauuuccccucu

SEQ ID NO: 2797919 - RNA, 18 nt, Human
gauuuccagccagggcug

SEQ ID NO: 2797920 - RNA, 19 nt, Human
gauuuccagccagggcugc

SEQ ID NO: 2797921 - RNA, 11 nt, Human
gauugcagcuu

SEQ ID NO: 2797922 - RNA, 12 nt, Human
gauugcagcuuu

SEQ ID NO: 2797923 - RNA, 18 nt, Human
gauugcagcuuuauguuc

SEQ ID NO: 2797924 - RNA, 21 nt, Human
gauugcaauaucugaagcccu

SEQ ID NO: 2797925 - RNA, 14 nt, Human
gauugcacauuguu

SEQ ID NO: 2797926 - RNA, 21 nt, Human
gauuugcauugaacacaaacu

SEQ ID NO: 2797927 - RNA, 18 nt, Human
gauuugccacaucuuaaa

SEQ ID NO: 2797928 - RNA, 16 nt, Human
gauuucugguucugau

SEQ ID NO: 2797929 - RNA, 18 nt, Human
gauuucugguucugaugc

SEQ ID NO: 2797930 - RNA, 17 nt, Human
gauuugcauugaacaca

SEQ ID NO: 2797931 - RNA, 12 nt, Human
gauuuggaaaaa

SEQ ID NO: 2797932 - RNA, 23 nt, Human
gauuugggcuggaacagauucac

SEQ ID NO: 2797933 - RNA, 22 nt, Human
gauuugguacuuuugagugugu

SEQ ID NO: 2797934 - RNA, 12 nt, Human
gauuugggcugg

SEQ ID NO: 2797935 - RNA, 15 nt, Human
gauuugggaaccaag

SEQ ID NO: 2797936 - RNA, 18 nt, Human
gauucagauuguuaucua

SEQ ID NO: 2797937 - RNA, 19 nt, Human
gauucauaguaacuucuua

SEQ ID NO: 2797938 - RNA, 18 nt, Human
gauucccaagcucugcuc

SEQ ID NO: 2797939 - RNA, 22 nt, Human
gauuccauuuggcagagcuucu

SEQ ID NO: 2797940 - RNA, 18 nt, Human
gauuccauugguccaaga

SEQ ID NO: 2797941 - RNA, 14 nt, Human
gauuccaugcuaag

SEQ ID NO: 2797942 - RNA, 15 nt, Human
gauuccaugcuaagc

SEQ ID NO: 2797943 - RNA, 20 nt, Human
gauuccaugcuaagcaagcu

SEQ ID NO: 2797944 - RNA, 15 nt, Human
gauuccagcccacau

SEQ ID NO: 2797945 - RNA, 18 nt, Human
gauuccagcccacauugg

SEQ ID NO: 2797946 - RNA, 22 nt, Human
gauuccagagaguggcuccucc

SEQ ID NO: 2797947 - RNA, 19 nt, Human
gauuccagagaguggcucc

SEQ ID NO: 2797948 - RNA, 20 nt, Human
gauuccagagaguggcuccu

SEQ ID NO: 2797949 - RNA, 21 nt, Human
gauggggauaaaaugacuacu

SEQ ID NO: 2797950 - RNA, 22 nt, Human
gauggggauaaaaugacuacuu

SEQ ID NO: 2797951 - RNA, 23 nt, Human
gauggggauaaaaugacuacuua

SEQ ID NO: 2797952 - RNA, 17 nt, Human
gaugggggaaagcacag

SEQ ID NO: 2797953 - RNA, 21 nt, Human
gaugggggaaagcacaggugg

SEQ ID NO: 2797954 - RNA, 21 nt, Human
gauggggcccuaauucagcca

SEQ ID NO: 2797955 - RNA, 23 nt, Human
gauggggggggauguggaucagg

SEQ ID NO: 2797956 - RNA, 23 nt, Human
gauggggucucacaguguugccc

SEQ ID NO: 2797957 - RNA, 20 nt, Human
gauucccaagcucugcuccu

SEQ ID NO: 2797958 - RNA, 19 nt, Human
gauucccaagcucugcucc

SEQ ID NO: 2797959 - RNA, 21 nt, Human
gauucccaagcucugcuccuc

SEQ ID NO: 2797960 - RNA, 21 nt, Human
gauucagagaaaggcaaggga

SEQ ID NO: 2797961 - RNA, 13 nt, Human
gauuccuucucug

SEQ ID NO: 2797962 - RNA, 15 nt, Human
gauuccuucucugaa

SEQ ID NO: 2797963 - RNA, 22 nt, Human
gauuccuucucugaacacaggc

SEQ ID NO: 2797964 - RNA, 11 nt, Human
gauucuaaaau

SEQ ID NO: 2797965 - RNA, 12 nt, Human
gauucuaaaaug

SEQ ID NO: 2797966 - RNA, 22 nt, Human
gauucuaaaaugugauguucua

SEQ ID NO: 2797967 - RNA, 11 nt, Human
gauucuaaaga

SEQ ID NO: 2797968 - RNA, 12 nt, Human
gauucuaaagau

SEQ ID NO: 2797969 - RNA, 13 nt, Human
gauucuaaagauu

SEQ ID NO: 2797970 - RNA, 16 nt, Human
gauuccuuuuuucaaa

SEQ ID NO: 2797971 - RNA, 20 nt, Human
gauugcaacaggcugggcuu

SEQ ID NO: 2797972 - RNA, 21 nt, Human
gauugcaacaggcugggcuuc

SEQ ID NO: 2797973 - RNA, 14 nt, Human
gauucuaaagauuc

SEQ ID NO: 2797974 - RNA, 18 nt, Human
gauugcaauaucugaagc

SEQ ID NO: 2797975 - RNA, 17 nt, Human
gcaguuauuaacacuaa

SEQ ID NO: 2797976 - RNA, 11 nt, Human
gcaguucuguu

SEQ ID NO: 2797977 - RNA, 12 nt, Human
gcaguucuguua

SEQ ID NO: 2797978 - RNA, 15 nt, Human
gcagugggagcugcc

SEQ ID NO: 2797979 - RNA, 14 nt, Human
gcagugggagcugc

SEQ ID NO: 2797980 - RNA, 12 nt, Human
gcagugggagcu

SEQ ID NO: 2797981 - RNA, 13 nt, Human
gcagugggagcug

SEQ ID NO: 2797982 - RNA, 23 nt, Human
gcagugucuguaaaagagccuag

SEQ ID NO: 2797983 - RNA, 19 nt, Human
gcagugugaaguacaauaa

SEQ ID NO: 2797984 - RNA, 13 nt, Human
gcaguucaccugc

SEQ ID NO: 2797985 - RNA, 14 nt, Human
gcaguucuugaguu

SEQ ID NO: 2797986 - RNA, 16 nt, Human
gcauagaacuggguaa

SEQ ID NO: 2797987 - RNA, 17 nt, Human
gcauagaacuggguaaa

SEQ ID NO: 2797988 - RNA, 18 nt, Human
gcauauccaccaccuccc

SEQ ID NO: 2797989 - RNA, 18 nt, Human
gcauaucaugcuuugaaa

SEQ ID NO: 2797990 - RNA, 20 nt, Human
gcauaucaugcuuugaaaaa

SEQ ID NO: 2797991 - RNA, 22 nt, Human
gcauagagguaccagcaauaug

SEQ ID NO: 2797992 - RNA, 19 nt, Human
gcauagaugcaggugagcc

SEQ ID NO: 2797993 - RNA, 23 nt, Human
gcauagauguuuugguagauuaa

SEQ ID NO: 2797994 - RNA, 16 nt, Human
gcauagaugcagguga

SEQ ID NO: 2797995 - RNA, 14 nt, Human
gcaucaccucaggc

SEQ ID NO: 2797996 - RNA, 17 nt, Human
gcaucaccucaggccag

SEQ ID NO: 2797997 - RNA, 15 nt, Human
gcaucaccucaggcc

SEQ ID NO: 2797998 - RNA, 12 nt, Human
gcauagugcugg

SEQ ID NO: 2797999 - RNA, 17 nt, Human
gcauauggguuagaugu

SEQ ID NO: 2798000 - RNA, 21 nt, Human
gcauauuuauccaaaaugugu

SEQ ID NO: 2798001 - RNA, 23 nt, Human
gcauauuuauccaaaauguguau

SEQ ID NO: 2798002 - RNA, 21 nt, Human
gcaguggccccuuaggccagu

SEQ ID NO: 2798003 - RNA, 14 nt, Human
gcaguggagguggg

SEQ ID NO: 2798004 - RNA, 23 nt, Human
gcaguggaggugggguguuuggg

SEQ ID NO: 2798005 - RNA, 15 nt, Human
gcagugcaggcacag

SEQ ID NO: 2798006 - RNA, 18 nt, Human
gcagugcaggcacaguau

SEQ ID NO: 2798007 - RNA, 22 nt, Human
gcagguccaggguuugaguuca

SEQ ID NO: 2798008 - RNA, 19 nt, Human
gcagguagccagggggacu

SEQ ID NO: 2798009 - RNA, 21 nt, Human
gcagguagccagggggacuag

SEQ ID NO: 2798010 - RNA, 21 nt, Human
gcaggucaacagcuaugcugg

SEQ ID NO: 2798011 - RNA, 14 nt, Human
gcaggguguuggga

SEQ ID NO: 2798012 - RNA, 20 nt, Human
gcaggucuugaacuccuggc

SEQ ID NO: 2798013 - RNA, 19 nt, Human
gcaggucuugaacuccugg

SEQ ID NO: 2798014 - RNA, 14 nt, Human
gcaggucuuuaaau

SEQ ID NO: 2798015 - RNA, 21 nt, Human
gcaggucuuuaaaucauuuua

SEQ ID NO: 2798016 - RNA, 21 nt, Human
gcagggcucagcggggacagc

SEQ ID NO: 2798017 - RNA, 19 nt, Human
gcagggcucagcggggaca

SEQ ID NO: 2798018 - RNA, 15 nt, Human
gcagggccaggacug

SEQ ID NO: 2798019 - RNA, 19 nt, Human
gcagggccaggacugagcc

SEQ ID NO: 2798020 - RNA, 14 nt, Human
gcagggccaggacu

SEQ ID NO: 2798021 - RNA, 22 nt, Human
gcagggcucagcggggacagcu

SEQ ID NO: 2798022 - RNA, 14 nt, Human
gcagggcucagcgg

SEQ ID NO: 2798023 - RNA, 18 nt, Human
gcagggucucacucuguc

SEQ ID NO: 2798024 - RNA, 14 nt, Human
gcagggucugggca

SEQ ID NO: 2798025 - RNA, 17 nt, Human
gcagggucugggcagga

SEQ ID NO: 2798026 - RNA, 20 nt, Human
gcagggucugggcaggacuc

SEQ ID NO: 2798027 - RNA, 19 nt, Human
gcagggucuguuuggacug

SEQ ID NO: 2798028 - RNA, 21 nt, Human
gcagggucuguuuggacugca

SEQ ID NO: 2798029 - RNA, 17 nt, Human
gcagggucucacucugu

SEQ ID NO: 2798030 - RNA, 17 nt, Human
gcaggggcuacaagagg

SEQ ID NO: 2798031 - RNA, 19 nt, Human
gcaggggcuacaagaggga

SEQ ID NO: 2798032 - RNA, 22 nt, Human
gcauguucucugaggacacuaa

SEQ ID NO: 2798033 - RNA, 21 nt, Human
gcauguucucugaggacacua

SEQ ID NO: 2798034 - RNA, 15 nt, Human
gcauguucucugagg

SEQ ID NO: 2798035 - RNA, 14 nt, Human
gcauguucucugag

SEQ ID NO: 2798036 - RNA, 14 nt, Human
gcauggcacucccu

SEQ ID NO: 2798037 - RNA, 20 nt, Human
gcauggcacucccuccagca

SEQ ID NO: 2798038 - RNA, 21 nt, Human
gcauggcacucccuccagcac

SEQ ID NO: 2798039 - RNA, 20 nt, Human
gcauggcaaggacugcaggg

SEQ ID NO: 2798040 - RNA, 21 nt, Human
gcauggcaagucacaugcgua

SEQ ID NO: 2798041 - RNA, 18 nt, Human
gcauggaguugggcguua

SEQ ID NO: 2798042 - RNA, 14 nt, Human
gcauggauuucugu

SEQ ID NO: 2798043 - RNA, 15 nt, Human
gcauggauuucuguc

SEQ ID NO: 2798044 - RNA, 12 nt, Human
gcauggagcugg

SEQ ID NO: 2798045 - RNA, 15 nt, Human
gcauggagcuggccg

SEQ ID NO: 2798046 - RNA, 16 nt, Human
gcauggaggcccuccu

SEQ ID NO: 2798047 - RNA, 13 nt, Human
gcaugcuggggca

SEQ ID NO: 2798048 - RNA, 15 nt, Human
gcaugcuggggcaag

SEQ ID NO: 2798049 - RNA, 20 nt, Human
gcaugagauagcugguguua

SEQ ID NO: 2798050 - RNA, 22 nt, Human
gcaugagcauuggauacagcag

SEQ ID NO: 2798051 - RNA, 21 nt, Human
gcaugacuuguagcauauucu

SEQ ID NO: 2798052 - RNA, 15 nt, Human
gcaucuuugccucuc

SEQ ID NO: 2798053 - RNA, 23 nt, Human
gcaugagugcuggauauuuuacu

SEQ ID NO: 2798054 - RNA, 16 nt, Human
gcaucucuugaggcca

SEQ ID NO: 2798055 - RNA, 14 nt, Human
gcaucucuugaggc

SEQ ID NO: 2798056 - RNA, 15 nt, Human
gcaucaccugccugu

SEQ ID NO: 2798057 - RNA, 14 nt, Human
gcaucaccugccug

SEQ ID NO: 2798058 - RNA, 15 nt, Human
gcaucaccuccacca

SEQ ID NO: 2798059 - RNA, 15 nt, Human
gcaucaccucuguaa

SEQ ID NO: 2798060 - RNA, 16 nt, Human
gcaucaccugccuguu

SEQ ID NO: 2798061 - RNA, 20 nt, Human
gcaucacuccccaaggaaga

SEQ ID NO: 2798062 - RNA, 21 nt, Human
gcaucacuccccaaggaagag

SEQ ID NO: 2798063 - RNA, 15 nt, Human
gcaucugauuugcau

SEQ ID NO: 2798064 - RNA, 16 nt, Human
gcaucugauuugcaua

SEQ ID NO: 2798065 - RNA, 20 nt, Human
gcaucugauuugcauauuca

SEQ ID NO: 2798066 - RNA, 21 nt, Human
gcaucugauuugcauauucau

SEQ ID NO: 2798067 - RNA, 20 nt, Human
gcaucugaaauaggaaacaa

SEQ ID NO: 2798068 - RNA, 21 nt, Human
gcaucucuugaggccaggagu

SEQ ID NO: 2798069 - RNA, 20 nt, Human
gcaucucuugaggccaggag

SEQ ID NO: 2798070 - RNA, 18 nt, Human
gcaucucuugaggccagg

SEQ ID NO: 2798071 - RNA, 17 nt, Human
gcaucucuugaggccag

SEQ ID NO: 2798072 - RNA, 14 nt, Human
gcaugaagagaagc

SEQ ID NO: 2798073 - RNA, 22 nt, Human
gcaugaagagaagcaauuuugg

SEQ ID NO: 2798074 - RNA, 15 nt, Human
gcaugaagagcaaaa

SEQ ID NO: 2798075 - RNA, 18 nt, Human
gcaugaagagcaaaaaua

SEQ ID NO: 2798076 - RNA, 20 nt, Human
gcaugaagagcaaaaauauc

SEQ ID NO: 2798077 - RNA, 18 nt, Human
gcaugaaggaaacugaac

SEQ ID NO: 2798078 - RNA, 14 nt, Human
gcaugaaaggcuuu

SEQ ID NO: 2798079 - RNA, 18 nt, Human
gcaugaaaggcuuuuaaa

SEQ ID NO: 2798080 - RNA, 12 nt, Human
gcaugaaauuuu

SEQ ID NO: 2798081 - RNA, 15 nt, Human
gcaugaaauuuuuaa

SEQ ID NO: 2798082 - RNA, 17 nt, Human
gcaugaacaaguuuuaa

SEQ ID NO: 2798083 - RNA, 23 nt, Human
gcaucuuugccuugggcugcucc

SEQ ID NO: 2798084 - RNA, 16 nt, Human
gcaucuuuggggaggu

SEQ ID NO: 2798085 - RNA, 23 nt, Human
gcaucuuuggggagguguucacu

SEQ ID NO: 2798086 - RNA, 22 nt, Human
gcaucuuugccuugggcugcuc

SEQ ID NO: 2798087 - RNA, 16 nt, Human
gcaucuuauagcacuu

SEQ ID NO: 2798088 - RNA, 22 nt, Human
gcaucuuauagcacuuugaaau

SEQ ID NO: 2798089 - RNA, 20 nt, Human
gcaucuucgucuucacucuu

SEQ ID NO: 2798090 - RNA, 23 nt, Human
gcaucuucgucuucacucuuagg

SEQ ID NO: 2798091 - RNA, 13 nt, Human
gcaucuuugccuu

SEQ ID NO: 2798092 - RNA, 18 nt, Human
gcaucuuugccuugggcu

SEQ ID NO: 2798093 - RNA, 15 nt, Human
gcaucuuugccuugg

SEQ ID NO: 2798094 - RNA, 20 nt, Human
gcaucuuuagugcuuucuug

SEQ ID NO: 2798095 - RNA, 16 nt, Human
gccaaaaaaagacagg

SEQ ID NO: 2798096 - RNA, 20 nt, Human
gccaaaaaccuuagcucccu

SEQ ID NO: 2798097 - RNA, 13 nt, Human
gccaaaaaggaua

SEQ ID NO: 2798098 - RNA, 16 nt, Human
gccaaaaaggauacau

SEQ ID NO: 2798099 - RNA, 19 nt, Human
gccaaaaaggauacauaau

SEQ ID NO: 2798100 - RNA, 15 nt, Human
gccaaacccugucug

SEQ ID NO: 2798101 - RNA, 22 nt, Human
gccaaacccaugaggcaauguc

SEQ ID NO: 2798102 - RNA, 19 nt, Human
gcauuuuuauuucagauuu

SEQ ID NO: 2798103 - RNA, 23 nt, Human
gcauuuuuauuucagauuuugau

SEQ ID NO: 2798104 - RNA, 12 nt, Human
gcauuuuucugc

SEQ ID NO: 2798105 - RNA, 20 nt, Human
gcauuuuugauuuaugcaug

SEQ ID NO: 2798106 - RNA, 12 nt, Human
gcauuuguucac

SEQ ID NO: 2798107 - RNA, 21 nt, Human
gcauuuuugauuuaugcaugg

SEQ ID NO: 2798108 - RNA, 14 nt, Human
gccaaaaaaagaca

SEQ ID NO: 2798109 - RNA, 20 nt, Human
gccaaagcuaggguggcccu

SEQ ID NO: 2798110 - RNA, 11 nt, Human
gccaaauuauu

SEQ ID NO: 2798111 - RNA, 15 nt, Human
gccaaauuauuugug

SEQ ID NO: 2798112 - RNA, 16 nt, Human
gccaaagcuagggugg

SEQ ID NO: 2798113 - RNA, 22 nt, Human
gccaaagcuaggccuggccaga

SEQ ID NO: 2798114 - RNA, 16 nt, Human
gccaaagcuaggccug

SEQ ID NO: 2798115 - RNA, 20 nt, Human
gccaaagccaaagcuaggcc

SEQ ID NO: 2798116 - RNA, 13 nt, Human
gccaaagccaaag

SEQ ID NO: 2798117 - RNA, 15 nt, Human
gcauuauauaccauu

SEQ ID NO: 2798118 - RNA, 19 nt, Human
gcauuauauaccauuuauc

SEQ ID NO: 2798119 - RNA, 14 nt, Human
gcauuauugcauua

SEQ ID NO: 2798120 - RNA, 15 nt, Human
gcauuauugcauuau

SEQ ID NO: 2798121 - RNA, 23 nt, Human
gcauuauguccacuguguauaga

SEQ ID NO: 2798122 - RNA, 12 nt, Human
gcauuauucauu

SEQ ID NO: 2798123 - RNA, 13 nt, Human
gcauuauucauuu

SEQ ID NO: 2798124 - RNA, 16 nt, Human
gcauuauucauuuagu

SEQ ID NO: 2798125 - RNA, 18 nt, Human
gcauuauucauuuaguga

SEQ ID NO: 2798126 - RNA, 14 nt, Human
gcauuauucucuuu

SEQ ID NO: 2798127 - RNA, 16 nt, Human
gcauuauucucuuuua

SEQ ID NO: 2798128 - RNA, 21 nt, Human
gcauuauucucuuuuaucugu

SEQ ID NO: 2798129 - RNA, 22 nt, Human
gcauuauucucuuuuaucuguu

SEQ ID NO: 2798130 - RNA, 23 nt, Human
gcauuauucucuuuuaucuguuu

SEQ ID NO: 2798131 - RNA, 13 nt, Human
gcauucagagagc

SEQ ID NO: 2798132 - RNA, 16 nt, Human
gcauucagagagcagc

SEQ ID NO: 2798133 - RNA, 20 nt, Human
gcauucugccucucuaggac

SEQ ID NO: 2798134 - RNA, 15 nt, Human
gcauucuggcaguuu

SEQ ID NO: 2798135 - RNA, 21 nt, Human
gcauucuugguuggcuggccu

SEQ ID NO: 2798136 - RNA, 15 nt, Human
gcauucuuguacagu

SEQ ID NO: 2798137 - RNA, 11 nt, Human
gcauucuuucc

SEQ ID NO: 2798138 - RNA, 12 nt, Human
gcauucuuuccc

SEQ ID NO: 2798139 - RNA, 13 nt, Human
gcauucuuuccca

SEQ ID NO: 2798140 - RNA, 18 nt, Human
gcauucuuucccagugag

SEQ ID NO: 2798141 - RNA, 15 nt, Human
gcauuugugucaucu

SEQ ID NO: 2798142 - RNA, 12 nt, Human
gcauuugugaaa

SEQ ID NO: 2798143 - RNA, 23 nt, Human
gcauuugcucuuucaucucugcu

SEQ ID NO: 2798144 - RNA, 17 nt, Human
gcauuugcagauuuuua

SEQ ID NO: 2798145 - RNA, 20 nt, Human
gcauuugauaaugauaaaac

SEQ ID NO: 2798146 - RNA, 21 nt, Human
gcauuugauaaugauaaaaca

SEQ ID NO: 2798147 - RNA, 19 nt, Human
gcauugaacacaaacugua

SEQ ID NO: 2798148 - RNA, 18 nt, Human
gcauugaacacaaacugu

SEQ ID NO: 2798149 - RNA, 16 nt, Human
gcauugaacacaaacu

SEQ ID NO: 2798150 - RNA, 12 nt, Human
gcauugaacaca

SEQ ID NO: 2798151 - RNA, 17 nt, Human
gcauugaaaugagcacc

SEQ ID NO: 2798152 - RNA, 11 nt, Human
gcauugaaauu

SEQ ID NO: 2798153 - RNA, 17 nt, Human
gcauucuugguuggcug

SEQ ID NO: 2798154 - RNA, 17 nt, Human
gcagcaauuuaaauguu

SEQ ID NO: 2798155 - RNA, 23 nt, Human
gcagcaauauauuaccagcaaga

SEQ ID NO: 2798156 - RNA, 14 nt, Human
gcagcaaucuuuga

SEQ ID NO: 2798157 - RNA, 13 nt, Human
gcagcccuagagc

SEQ ID NO: 2798158 - RNA, 17 nt, Human
gcagcccuagagccugc

SEQ ID NO: 2798159 - RNA, 18 nt, Human
gcagcccuagagccugcc

SEQ ID NO: 2798160 - RNA, 19 nt, Human
gcagcccuagagccugccu

SEQ ID NO: 2798161 - RNA, 22 nt, Human
gcagcccuagagccugccugga

SEQ ID NO: 2798162 - RNA, 23 nt, Human
gcagccccgcgccuccuuccuug

SEQ ID NO: 2798163 - RNA, 14 nt, Human
gcagccccgggagg

SEQ ID NO: 2798164 - RNA, 23 nt, Human
gcagccccgggagggcggcacag

SEQ ID NO: 2798165 - RNA, 24 nt, Human
gcagccccauucugccugcccagg

SEQ ID NO: 2798166 - RNA, 21 nt, Human
gcagccccauucugccugccc

SEQ ID NO: 2798167 - RNA, 19 nt, Human
gcagccccauucugccugc

SEQ ID NO: 2798168 - RNA, 18 nt, Human
gcagccccauucugccug

SEQ ID NO: 2798169 - RNA, 17 nt, Human
gcagccccauucugccu

SEQ ID NO: 2798170 - RNA, 12 nt, Human
gcagcaauuuaa

SEQ ID NO: 2798171 - RNA, 16 nt, Human
gcagcaauuuaaaugu

SEQ ID NO: 2798172 - RNA, 15 nt, Human
gcagcaauuuaaaug

SEQ ID NO: 2798173 - RNA, 13 nt, Human
gcagaccucccca

SEQ ID NO: 2798174 - RNA, 15 nt, Human
gcagaccuccccagc

SEQ ID NO: 2798175 - RNA, 16 nt, Human
gcagaccuccccagcc

SEQ ID NO: 2798176 - RNA, 17 nt, Human
gcagaccuccccagccc

SEQ ID NO: 2798177 - RNA, 19 nt, Human
gcagaccuccccagccccu

SEQ ID NO: 2798178 - RNA, 21 nt, Human
gcagaccaccccgccugcccu

SEQ ID NO: 2798179 - RNA, 13 nt, Human
gcagaccaccccg

SEQ ID NO: 2798180 - RNA, 17 nt, Human
gcagaccaccccgccug

SEQ ID NO: 2798181 - RNA, 16 nt, Human
gcagauacugcugugu

SEQ ID NO: 2798182 - RNA, 18 nt, Human
gcagauacugcuguguaa

SEQ ID NO: 2798183 - RNA, 16 nt, Human
gcagauuugggcugga

SEQ ID NO: 2798184 - RNA, 14 nt, Human
gcagauuggaagga

SEQ ID NO: 2798185 - RNA, 16 nt, Human
gcagauuggaaggaga

SEQ ID NO: 2798186 - RNA, 20 nt, Human
gcagauuggaaggagacaca

SEQ ID NO: 2798187 - RNA, 22 nt, Human
gcagauuggaaggagacacaga

SEQ ID NO: 2798188 - RNA, 14 nt, Human
gcagaucaccugag

SEQ ID NO: 2798189 - RNA, 16 nt, Human
gcagaucaccugaggu

SEQ ID NO: 2798190 - RNA, 17 nt, Human
gcagaucaccugagguc

SEQ ID NO: 2798191 - RNA, 18 nt, Human
gcagauaccucacccugc

SEQ ID NO: 2798192 - RNA, 22 nt, Human
gcagauacaggaaaagcugcug

SEQ ID NO: 2798193 - RNA, 21 nt, Human
gcagauaacaaugcagcaagg

SEQ ID NO: 2798194 - RNA, 20 nt, Human
gcagauaacauuuguguguu

SEQ ID NO: 2798195 - RNA, 21 nt, Human
gcagauaacauuuguguguua

SEQ ID NO: 2798196 - RNA, 20 nt, Human
gcagaguuuguguguugucu

SEQ ID NO: 2798197 - RNA, 24 nt, Human
gcagaguuuguguguugucuugaa

SEQ ID NO: 2798198 - RNA, 13 nt, Human
gcagaguuugccu

SEQ ID NO: 2798199 - RNA, 19 nt, Human
gcagauaaucagccucuua

SEQ ID NO: 2798200 - RNA, 18 nt, Human
gcagauaaucagccucuu

SEQ ID NO: 2798201 - RNA, 17 nt, Human
gcagauaaucagccucu

SEQ ID NO: 2798202 - RNA, 16 nt, Human
gcagauaaucagccuc

SEQ ID NO: 2798203 - RNA, 22 nt, Human
gcagccuguggcaucuuugccu

SEQ ID NO: 2798204 - RNA, 19 nt, Human
gcagccuugaacucugggc

SEQ ID NO: 2798205 - RNA, 20 nt, Human
gcagccuugaacucugggcu

SEQ ID NO: 2798206 - RNA, 16 nt, Human
gcagccuguggcaucu

SEQ ID NO: 2798207 - RNA, 14 nt, Human
gcagccuguggcau

SEQ ID NO: 2798208 - RNA, 21 nt, Human
gcagcccugagaaagcccugu

SEQ ID NO: 2798209 - RNA, 13 nt, Human
gcagcccugcuuu

SEQ ID NO: 2798210 - RNA, 23 nt, Human
gcagcucaagcagcgaccgcccc

SEQ ID NO: 2798211 - RNA, 21 nt, Human
gcagcuugggagagccccugg

SEQ ID NO: 2798212 - RNA, 22 nt, Human
gcagcuugggagagccccuggg

SEQ ID NO: 2798213 - RNA, 17 nt, Human
gcagcuuuaaacucagg

SEQ ID NO: 2798214 - RNA, 19 nt, Human
gcagcuuuaaacucaggga

SEQ ID NO: 2798215 - RNA, 21 nt, Human
gcagcuugugugcaaaagcag

SEQ ID NO: 2798216 - RNA, 20 nt, Human
gcagcuuuaaacucagggac

SEQ ID NO: 2798217 - RNA, 21 nt, Human
gcagcuuuaaacucagggaca

SEQ ID NO: 2798218 - RNA, 22 nt, Human
gcagcuuuaaacucagggacag

SEQ ID NO: 2798219 - RNA, 15 nt, Human
gcagccuuggcaaac

SEQ ID NO: 2798220 - RNA, 17 nt, Human
gcagccuuugccucccc

SEQ ID NO: 2798221 - RNA, 18 nt, Human
gcagccuuugccuccccg

SEQ ID NO: 2798222 - RNA, 20 nt, Human
gcagcuaguccuagugaacc

SEQ ID NO: 2798223 - RNA, 21 nt, Human
gcagcuaguccuagugaaccu

SEQ ID NO: 2798224 - RNA, 14 nt, Human
gcagcuaguuuucu

SEQ ID NO: 2798225 - RNA, 17 nt, Human
gcagcucaacuuucugu

SEQ ID NO: 2798226 - RNA, 14 nt, Human
gcaggaggauugcu

SEQ ID NO: 2798227 - RNA, 19 nt, Human
gcaggaaucaaaaauugaa

SEQ ID NO: 2798228 - RNA, 20 nt, Human
gcaggaaggcugagaggaga

SEQ ID NO: 2798229 - RNA, 23 nt, Human
gcaggaaggagagccugcugcau

SEQ ID NO: 2798230 - RNA, 13 nt, Human
gcaggaaggccug

SEQ ID NO: 2798231 - RNA, 14 nt, Human
gcaggaaggccugg

SEQ ID NO: 2798232 - RNA, 15 nt, Human
gcaggaaggccuggg

SEQ ID NO: 2798233 - RNA, 17 nt, Human
gcaggaaggccugggug

SEQ ID NO: 2798234 - RNA, 17 nt, Human
gcaggaaggagagccug

SEQ ID NO: 2798235 - RNA, 16 nt, Human
gcaggaaggagagccu

SEQ ID NO: 2798236 - RNA, 15 nt, Human
gcaggaaggagagcc

SEQ ID NO: 2798237 - RNA, 21 nt, Human
gcaggaaaguuuacccaugaa

SEQ ID NO: 2798238 - RNA, 14 nt, Human
gcagcuuuauguuc

SEQ ID NO: 2798239 - RNA, 14 nt, Human
gcagcuuucuagaa

SEQ ID NO: 2798240 - RNA, 15 nt, Human
gcagcuuucuagaag

SEQ ID NO: 2798241 - RNA, 16 nt, Human
gcaggcagaucaccug

SEQ ID NO: 2798242 - RNA, 18 nt, Human
gcaggcagaucaccugag

SEQ ID NO: 2798243 - RNA, 20 nt, Human
gcaggcagaucaccugaggu

SEQ ID NO: 2798244 - RNA, 19 nt, Human
gcaggcacuuauuguaaau

SEQ ID NO: 2798245 - RNA, 20 nt, Human
gcaggcaccuagcaauucca

SEQ ID NO: 2798246 - RNA, 20 nt, Human
gcaggcagacuacacaggau

SEQ ID NO: 2798247 - RNA, 23 nt, Human
gcaggaggauugcuugagcccag

SEQ ID NO: 2798248 - RNA, 14 nt, Human
gcaggaggccaggc

SEQ ID NO: 2798249 - RNA, 16 nt, Human
gcaggaggccaggccg

SEQ ID NO: 2798250 - RNA, 15 nt, Human
gcaggaggccaggcc

SEQ ID NO: 2798251 - RNA, 17 nt, Human
gcaggaggccaggccgg

SEQ ID NO: 2798252 - RNA, 12 nt, Human
gcacggcugcug

SEQ ID NO: 2798253 - RNA, 23 nt, Human
gcacggccccgaagggcccccac

SEQ ID NO: 2798254 - RNA, 18 nt, Human
gcacggccucgcgucugu

SEQ ID NO: 2798255 - RNA, 12 nt, Human
gcacggacucuu

SEQ ID NO: 2798256 - RNA, 20 nt, Human
gcaccuugugucuguacacg

SEQ ID NO: 2798257 - RNA, 22 nt, Human
gcaccuugugucuguacacgug

SEQ ID NO: 2798258 - RNA, 22 nt, Human
gcaccuuuccuucaagccagca

SEQ ID NO: 2798259 - RNA, 21 nt, Human
gcaccuuaccaacuuucugua

SEQ ID NO: 2798260 - RNA, 16 nt, Human
gcaccuuugcacagga

SEQ ID NO: 2798261 - RNA, 19 nt, Human
gcaccuuugcacaggaugc

SEQ ID NO: 2798262 - RNA, 14 nt, Human
gcacgacgcccucu

SEQ ID NO: 2798263 - RNA, 16 nt, Human
gcacgacgcccucucc

SEQ ID NO: 2798264 - RNA, 17 nt, Human
gcacgacgcccucuccc

SEQ ID NO: 2798265 - RNA, 19 nt, Human
gcacgacgcccucucccca

SEQ ID NO: 2798266 - RNA, 20 nt, Human
gcacgacgcccucuccccac

SEQ ID NO: 2798267 - RNA, 21 nt, Human
gcacgacgcccucuccccacc

SEQ ID NO: 2798268 - RNA, 21 nt, Human
gcacccuaguucuaccucagg

SEQ ID NO: 2798269 - RNA, 20 nt, Human
gcaccuuaccaacuuucugu

SEQ ID NO: 2798270 - RNA, 19 nt, Human
gcacccggccccugcuggu

SEQ ID NO: 2798271 - RNA, 18 nt, Human
gcacccggccccugcugg

SEQ ID NO: 2798272 - RNA, 22 nt, Human
gcacccaccaucaugucuggcu

SEQ ID NO: 2798273 - RNA, 11 nt, Human
gcaccagccag

SEQ ID NO: 2798274 - RNA, 12 nt, Human
gcaccagccagc

SEQ ID NO: 2798275 - RNA, 13 nt, Human
gcaccagccagcg

SEQ ID NO: 2798276 - RNA, 19 nt, Human
gcaccagccagcguagcag

SEQ ID NO: 2798277 - RNA, 20 nt, Human
gcaccaucucugauuuucaa

SEQ ID NO: 2798278 - RNA, 23 nt, Human
gcaccacugcacuccagccuggg

SEQ ID NO: 2798279 - RNA, 23 nt, Human
gcaaugccauccucaaacacugc

SEQ ID NO: 2798280 - RNA, 20 nt, Human
gcaaugcugaugaaucacug

SEQ ID NO: 2798281 - RNA, 13 nt, Human
gcaauggcagccu

SEQ ID NO: 2798282 - RNA, 12 nt, Human
gcaauggcagcc

SEQ ID NO: 2798283 - RNA, 14 nt, Human
gcaauggcagccuu

SEQ ID NO: 2798284 - RNA, 22 nt, Human
gcacugguggcccgacagccug

SEQ ID NO: 2798285 - RNA, 23 nt, Human
gcacugguggcccgacagccugg

SEQ ID NO: 2798286 - RNA, 24 nt, Human
gcacugguggcccgacagccuggc

SEQ ID NO: 2798287 - RNA, 19 nt, Human
gcacugguggcccgacagc

SEQ ID NO: 2798288 - RNA, 22 nt, Human
gcacugguggcuugcaguuugc

SEQ ID NO: 2798289 - RNA, 11 nt, Human
gcacugccuga

SEQ ID NO: 2798290 - RNA, 18 nt, Human
gcacugccugauggaccu

SEQ ID NO: 2798291 - RNA, 18 nt, Human
gcacguggagagcuggug

SEQ ID NO: 2798292 - RNA, 16 nt, Human
gcacguggagagcugg

SEQ ID NO: 2798293 - RNA, 15 nt, Human
gcacguggagagcug

SEQ ID NO: 2798294 - RNA, 13 nt, Human
gcacggcugcuga

SEQ ID NO: 2798295 - RNA, 20 nt, Human
gcacguggagagcuggugcc

SEQ ID NO: 2798296 - RNA, 14 nt, Human
gcacugccaugcag

SEQ ID NO: 2798297 - RNA, 15 nt, Human
gcacugccaugcagg

SEQ ID NO: 2798298 - RNA, 17 nt, Human
gcacugccaugcagggc

SEQ ID NO: 2798299 - RNA, 13 nt, Human
gcacugccacugg

SEQ ID NO: 2798300 - RNA, 14 nt, Human
gcacugccacuggg

SEQ ID NO: 2798301 - RNA, 19 nt, Human
gcagacaggcaagcaccuc

SEQ ID NO: 2798302 - RNA, 23 nt, Human
gcagacaggcaagcaccuccugc

SEQ ID NO: 2798303 - RNA, 19 nt, Human
gcagacagcaggcagcgcc

SEQ ID NO: 2798304 - RNA, 20 nt, Human
gcagacagcaggcagcgcca

SEQ ID NO: 2798305 - RNA, 17 nt, Human
gcacuucaucuggcugc

SEQ ID NO: 2798306 - RNA, 18 nt, Human
gcacuucaucuggcugcc

SEQ ID NO: 2798307 - RNA, 23 nt, Human
gcacuucaucuggcugccuuugc

SEQ ID NO: 2798308 - RNA, 23 nt, Human
gcacuucauugagaguuuugucu

SEQ ID NO: 2798309 - RNA, 11 nt, Human
gcacuuccaaa

SEQ ID NO: 2798310 - RNA, 12 nt, Human
gcacuuccaaaa

SEQ ID NO: 2798311 - RNA, 18 nt, Human
gcacuuccaaaauucuua

SEQ ID NO: 2798312 - RNA, 11 nt, Human
gcacuucccug

SEQ ID NO: 2798313 - RNA, 12 nt, Human
gcacuucccugc

SEQ ID NO: 2798314 - RNA, 13 nt, Human
gcacuucccugcu

SEQ ID NO: 2798315 - RNA, 14 nt, Human
gcacuucccugcug

SEQ ID NO: 2798316 - RNA, 22 nt, Human
gcacuuccuguuuuauaaugaa

SEQ ID NO: 2798317 - RNA, 13 nt, Human
gcagaauguuuuu

SEQ ID NO: 2798318 - RNA, 17 nt, Human
gcagaauguuuuuaaaa

SEQ ID NO: 2798319 - RNA, 18 nt, Human
gcagaauaaucuuugggu

SEQ ID NO: 2798320 - RNA, 23 nt, Human
gcagaauccuaggcuccacccca

SEQ ID NO: 2798321 - RNA, 17 nt, Human
gcacuuagcuaucagaa

SEQ ID NO: 2798322 - RNA, 19 nt, Human
gcacuuagcuaucagaaga

SEQ ID NO: 2798323 - RNA, 14 nt, Human
gcacuuauuguaaa

SEQ ID NO: 2798324 - RNA, 16 nt, Human
gcacuuauuguaaauu

SEQ ID NO: 2798325 - RNA, 17 nt, Human
gcacuucagaauuccau

SEQ ID NO: 2798326 - RNA, 21 nt, Human
gcacuucagaauuccauaucu

SEQ ID NO: 2798327 - RNA, 18 nt, Human
gcacuuauuuaaugccga

SEQ ID NO: 2798328 - RNA, 22 nt, Human
gcacuuaagcacaagcagagug

SEQ ID NO: 2798329 - RNA, 19 nt, Human
gcacuuaaggcacucuguu

SEQ ID NO: 2798330 - RNA, 15 nt, Human
gcacuuacaauccca

SEQ ID NO: 2798331 - RNA, 19 nt, Human
gcgacagagcgagagucug

SEQ ID NO: 2798332 - RNA, 21 nt, Human
gcgccgcaaaccacacuggac

SEQ ID NO: 2798333 - RNA, 19 nt, Human
gcgccgcaaaccacacugg

SEQ ID NO: 2798334 - RNA, 23 nt, Human
gcgacagagcgagagucugucuc

SEQ ID NO: 2798335 - RNA, 18 nt, Human
gcgacaggaguauuuuuu

SEQ ID NO: 2798336 - RNA, 18 nt, Human
gcgccgcaaaccacacug

SEQ ID NO: 2798337 - RNA, 15 nt, Human
gcgccuacaggagug

SEQ ID NO: 2798338 - RNA, 18 nt, Human
gcgcgcacacacacacau

SEQ ID NO: 2798339 - RNA, 13 nt, Human
gcgcgcacacaca

SEQ ID NO: 2798340 - RNA, 20 nt, Human
gcgcgagggccucaaaggcc

SEQ ID NO: 2798341 - RNA, 21 nt, Human
gcgcgaucccacacaggcugg

SEQ ID NO: 2798342 - RNA, 23 nt, Human
gcgccuugucuccuacuccugac

SEQ ID NO: 2798343 - RNA, 21 nt, Human
gcgcggccagccccggcccug

SEQ ID NO: 2798344 - RNA, 23 nt, Human
gcgcggccagccccggcccuggg

SEQ ID NO: 2798345 - RNA, 17 nt, Human
gcgcgcucuucgcgccc

SEQ ID NO: 2798346 - RNA, 23 nt, Human
gcgcgcucuucgcgcccgccccu

SEQ ID NO: 2798347 - RNA, 19 nt, Human
gcgcgcacacacacacaua

SEQ ID NO: 2798348 - RNA, 14 nt, Human
gcgcgccacucgcu

SEQ ID NO: 2798349 - RNA, 13 nt, Human
gcgcggccagccc

SEQ ID NO: 2798350 - RNA, 14 nt, Human
gcgcggccagcccc

SEQ ID NO: 2798351 - RNA, 15 nt, Human
gcgcggccagccccg

SEQ ID NO: 2798352 - RNA, 16 nt, Human
gcgcggccagccccgg

SEQ ID NO: 2798353 - RNA, 13 nt, Human
gcggacagccacg

SEQ ID NO: 2798354 - RNA, 11 nt, Human
gcggacagcca

SEQ ID NO: 2798355 - RNA, 14 nt, Human
gcgcuaucuucaca

SEQ ID NO: 2798356 - RNA, 14 nt, Human
gcgcuauuacaaau

SEQ ID NO: 2798357 - RNA, 17 nt, Human
gcgcucaauaggaccag

SEQ ID NO: 2798358 - RNA, 19 nt, Human
gcgcucagaacaguaucuu

SEQ ID NO: 2798359 - RNA, 16 nt, Human
gcgcuacccacuucua

SEQ ID NO: 2798360 - RNA, 13 nt, Human
gcgcuacccacuu

SEQ ID NO: 2798361 - RNA, 17 nt, Human
gcgucgcccucccaggc

SEQ ID NO: 2798362 - RNA, 23 nt, Human
gcgguuaugaaauucacccccuu

SEQ ID NO: 2798363 - RNA, 18 nt, Human
gcggugggcacccacccu

SEQ ID NO: 2798364 - RNA, 16 nt, Human
gcgguggggagagaug

SEQ ID NO: 2798365 - RNA, 14 nt, Human
gcggugggggagga

SEQ ID NO: 2798366 - RNA, 14 nt, Human
gcgguggcccuguc

SEQ ID NO: 2798367 - RNA, 15 nt, Human
gcgguggcccugucc

SEQ ID NO: 2798368 - RNA, 20 nt, Human
gcgggucacaggagggaggg

SEQ ID NO: 2798369 - RNA, 19 nt, Human
gcgggucacaggagggagg

SEQ ID NO: 2798370 - RNA, 15 nt, Human
gcggacagccacggc

SEQ ID NO: 2798371 - RNA, 15 nt, Human
gcgggaugguccugg

SEQ ID NO: 2798372 - RNA, 17 nt, Human
gcgggaugguccugggg

SEQ ID NO: 2798373 - RNA, 16 nt, Human
gcgggaugguccuggg

SEQ ID NO: 2798374 - RNA, 19 nt, Human
gcgcgggccccggcgcccc

SEQ ID NO: 2798375 - RNA, 20 nt, Human
gcgggcaccuauagucccag

SEQ ID NO: 2798376 - RNA, 17 nt, Human
gcgggcaccuguagucc

SEQ ID NO: 2798377 - RNA, 15 nt, Human
gcgggucacaggagg

SEQ ID NO: 2798378 - RNA, 13 nt, Human
gcgggucacagga

SEQ ID NO: 2798379 - RNA, 14 nt, Human
gcgggcccagcacu

SEQ ID NO: 2798380 - RNA, 18 nt, Human
gcgggcagguucugccug

SEQ ID NO: 2798381 - RNA, 10 nt, Human
gcuagaacuu

SEQ ID NO: 2798382 - RNA, 11 nt, Human
gcuagaacuuu

SEQ ID NO: 2798383 - RNA, 12 nt, Human
gcuagaacuuuu

SEQ ID NO: 2798384 - RNA, 13 nt, Human
gcuagaacuuuuu

SEQ ID NO: 2798385 - RNA, 14 nt, Human
gcuagaacuuuuuu

SEQ ID NO: 2798386 - RNA, 17 nt, Human
gcuagaacuuuuuuaaa

SEQ ID NO: 2798387 - RNA, 19 nt, Human
gcuagaacuuuuuuaaaua

SEQ ID NO: 2798388 - RNA, 20 nt, Human
gcuagaacuuuuuuaaauaa

SEQ ID NO: 2798389 - RNA, 21 nt, Human
gcuagaacuuuuuuaaauaaa

SEQ ID NO: 2798390 - RNA, 22 nt, Human
gcuagaacuuuuuuaaauaaac

SEQ ID NO: 2798391 - RNA, 23 nt, Human
gcuagaacuuuuuuaaauaaacu

SEQ ID NO: 2798392 - RNA, 14 nt, Human
gcuagaagaaaaca

SEQ ID NO: 2798393 - RNA, 23 nt, Human
gcuagaagaaaacaaacugucac

SEQ ID NO: 2798394 - RNA, 13 nt, Human
gcuacauaaauug

SEQ ID NO: 2798395 - RNA, 23 nt, Human
gcuacauaaauuggccugguaug

SEQ ID NO: 2798396 - RNA, 12 nt, Human
gcuaccucccuc

SEQ ID NO: 2798397 - RNA, 13 nt, Human
gcuaccucccucc

SEQ ID NO: 2798398 - RNA, 14 nt, Human
gcuaccucccuccc

SEQ ID NO: 2798399 - RNA, 14 nt, Human
gcuaccucucuguc

SEQ ID NO: 2798400 - RNA, 15 nt, Human
gcuaccucucugucc

SEQ ID NO: 2798401 - RNA, 16 nt, Human
gcuaccucucuguccc

SEQ ID NO: 2798402 - RNA, 21 nt, Human
gcuaccucucugucccuugcu

SEQ ID NO: 2798403 - RNA, 22 nt, Human
gcuaccucucugucccuugcug

SEQ ID NO: 2798404 - RNA, 23 nt, Human
gcuacaggaagcaccccaugcca

SEQ ID NO: 2798405 - RNA, 22 nt, Human
gcuacaggaagcaccccaugcc

SEQ ID NO: 2798406 - RNA, 18 nt, Human
gcuauagcuacaggaagc

SEQ ID NO: 2798407 - RNA, 16 nt, Human
gcuauagcuacaggaa

SEQ ID NO: 2798408 - RNA, 22 nt, Human
gcuaggaaauccaggguggugg

SEQ ID NO: 2798409 - RNA, 16 nt, Human
gcuagcuuuuaggaaa

SEQ ID NO: 2798410 - RNA, 21 nt, Human
gcuagcuuuuaggaaaaucac

SEQ ID NO: 2798411 - RNA, 19 nt, Human
gcuaggaaauccagggugg

SEQ ID NO: 2798412 - RNA, 13 nt, Human
gcuagaauacuuu

SEQ ID NO: 2798413 - RNA, 15 nt, Human
gcuagaauacuuuuu

SEQ ID NO: 2798414 - RNA, 17 nt, Human
gcuaaacguuggugacg

SEQ ID NO: 2798415 - RNA, 13 nt, Human
gcgucugugugcg

SEQ ID NO: 2798416 - RNA, 20 nt, Human
gcgucuccuguuuuucuggg

SEQ ID NO: 2798417 - RNA, 11 nt, Human
gcgucuccugu

SEQ ID NO: 2798418 - RNA, 21 nt, Human
gcgucuggaaguccaaugugg

SEQ ID NO: 2798419 - RNA, 21 nt, Human
gcgucuccuguuuuucugggu

SEQ ID NO: 2798420 - RNA, 21 nt, Human
gcuaaagauaauugcuauuua

SEQ ID NO: 2798421 - RNA, 13 nt, Human
gcuaagaggcugc

SEQ ID NO: 2798422 - RNA, 14 nt, Human
gcuaagaggcugcu

SEQ ID NO: 2798423 - RNA, 14 nt, Human
gcuacacagggaug

SEQ ID NO: 2798424 - RNA, 21 nt, Human
gcuacaggaagcaccccaugc

SEQ ID NO: 2798425 - RNA, 20 nt, Human
gcuacaggaagcaccccaug

SEQ ID NO: 2798426 - RNA, 19 nt, Human
gcuacaggaagcaccccau

SEQ ID NO: 2798427 - RNA, 19 nt, Human
gcuacagcuuucuugcucc

SEQ ID NO: 2798428 - RNA, 21 nt, Human
gcuacagcuuucuugcucccu

SEQ ID NO: 2798429 - RNA, 12 nt, Human
gcuacagagccg

SEQ ID NO: 2798430 - RNA, 22 nt, Human
gcuacagagccgagcaauauuu

SEQ ID NO: 2798431 - RNA, 13 nt, Human
gccuuuggcucug

SEQ ID NO: 2798432 - RNA, 15 nt, Human
gccuuuggcucugga

SEQ ID NO: 2798433 - RNA, 16 nt, Human
gccuuuggccuuggcu

SEQ ID NO: 2798434 - RNA, 16 nt, Human
gccuuuggcucuggag

SEQ ID NO: 2798435 - RNA, 17 nt, Human
gccuuuuucauuuucca

SEQ ID NO: 2798436 - RNA, 19 nt, Human
gccuuuuucauuuuccaau

SEQ ID NO: 2798437 - RNA, 21 nt, Human
gccuuuuuccuagccuguuuc

SEQ ID NO: 2798438 - RNA, 11 nt, Human
gcgaaaauagu

SEQ ID NO: 2798439 - RNA, 19 nt, Human
gcgaaaauaguuuguuuaa

SEQ ID NO: 2798440 - RNA, 15 nt, Human
gccuuugccuccccg

SEQ ID NO: 2798441 - RNA, 17 nt, Human
gccuuugauguuacaga

SEQ ID NO: 2798442 - RNA, 15 nt, Human
gccuuugcaaaucag

SEQ ID NO: 2798443 - RNA, 18 nt, Human
gccuuugcaaaucagugu

SEQ ID NO: 2798444 - RNA, 23 nt, Human
gccuuugagacaguuucuuagcu

SEQ ID NO: 2798445 - RNA, 22 nt, Human
gccuuuggaaacagcucgacuu

SEQ ID NO: 2798446 - RNA, 14 nt, Human
gccuuggcucagac

SEQ ID NO: 2798447 - RNA, 15 nt, Human
gccuuggcucagaca

SEQ ID NO: 2798448 - RNA, 16 nt, Human
gccuuggcucagacau

SEQ ID NO: 2798449 - RNA, 14 nt, Human
gccuuugaauguua

SEQ ID NO: 2798450 - RNA, 15 nt, Human
gccuuugaauguuaa

SEQ ID NO: 2798451 - RNA, 20 nt, Human
gccuuugaauguuaauuuuu

SEQ ID NO: 2798452 - RNA, 12 nt, Human
gccuuugacauu

SEQ ID NO: 2798453 - RNA, 13 nt, Human
gccuuugacauuu

SEQ ID NO: 2798454 - RNA, 15 nt, Human
gccuuugacauuuaa

SEQ ID NO: 2798455 - RNA, 14 nt, Human
gccuuugagacagu

SEQ ID NO: 2798456 - RNA, 19 nt, Human
gccuuugagacaguuucuu

SEQ ID NO: 2798457 - RNA, 20 nt, Human
gccuuugagacaguuucuua

SEQ ID NO: 2798458 - RNA, 21 nt, Human
gccuuugagacaguuucuuag

SEQ ID NO: 2798459 - RNA, 12 nt, Human
gccuuggcucag

SEQ ID NO: 2798460 - RNA, 15 nt, Human
gccuuggccggcugu

SEQ ID NO: 2798461 - RNA, 15 nt, Human
gccuuggccucccaa

SEQ ID NO: 2798462 - RNA, 13 nt, Human
gccuucauuaccu

SEQ ID NO: 2798463 - RNA, 13 nt, Human
gccuucaucuccc

SEQ ID NO: 2798464 - RNA, 16 nt, Human
gccuucagcucuacag

SEQ ID NO: 2798465 - RNA, 21 nt, Human
gccuucagggagugagggauu

SEQ ID NO: 2798466 - RNA, 13 nt, Human
gccuucagggagu

SEQ ID NO: 2798467 - RNA, 13 nt, Human
gccuuccagcugc

SEQ ID NO: 2798468 - RNA, 14 nt, Human
gccuuccagcugcu

SEQ ID NO: 2798469 - RNA, 15 nt, Human
gccuuccagcugcug

SEQ ID NO: 2798470 - RNA, 16 nt, Human
gccuuccagcugcugu

SEQ ID NO: 2798471 - RNA, 17 nt, Human
gccuuccagcugcuguc

SEQ ID NO: 2798472 - RNA, 18 nt, Human
gccuuccagcugcugucu

SEQ ID NO: 2798473 - RNA, 22 nt, Human
gccuuccacuuggcuacacagg

SEQ ID NO: 2798474 - RNA, 14 nt, Human
gccuugcuggacgg

SEQ ID NO: 2798475 - RNA, 19 nt, Human
gccuuggaaguugcauggc

SEQ ID NO: 2798476 - RNA, 23 nt, Human
gccuucgauacaccgggccugga

SEQ ID NO: 2798477 - RNA, 18 nt, Human
gccuucgauacaccgggc

SEQ ID NO: 2798478 - RNA, 22 nt, Human
gccuucgauacaccgggccugg

SEQ ID NO: 2798479 - RNA, 11 nt, Human
gccuuccuucc

SEQ ID NO: 2798480 - RNA, 23 nt, Human
gccuuccuucccgccagagggcu

SEQ ID NO: 2798481 - RNA, 13 nt, Human
gccuuccuugacc

SEQ ID NO: 2798482 - RNA, 18 nt, Human
gccuuccuugaccuuccu

SEQ ID NO: 2798483 - RNA, 19 nt, Human
gccuuccuugaccuuccuc

SEQ ID NO: 2798484 - RNA, 20 nt, Human
gccuuccuugaccuuccucu

SEQ ID NO: 2798485 - RNA, 13 nt, Human
gccuuccuuucuc

SEQ ID NO: 2798486 - RNA, 17 nt, Human
gccuuccuuucuccagg

SEQ ID NO: 2798487 - RNA, 19 nt, Human
gccuuccuuucuccaggac

SEQ ID NO: 2798488 - RNA, 20 nt, Human
gccuuccuuucuccaggacc

SEQ ID NO: 2798489 - RNA, 21 nt, Human
gccuuccuuucuccaggacca

SEQ ID NO: 2798490 - RNA, 16 nt, Human
gccuucgaggucagag

SEQ ID NO: 2798491 - RNA, 20 nt, Human
gccuggugcuuccaaauauu

SEQ ID NO: 2798492 - RNA, 13 nt, Human
gccuguuucuucc

SEQ ID NO: 2798493 - RNA, 16 nt, Human
gccuguuucuuccugu

SEQ ID NO: 2798494 - RNA, 20 nt, Human
gccuguuuuagaagguucuc

SEQ ID NO: 2798495 - RNA, 22 nt, Human
gccuguuuggcguuucccagag

SEQ ID NO: 2798496 - RNA, 18 nt, Human
gccuuagaagucacacag

SEQ ID NO: 2798497 - RNA, 17 nt, Human
gccuuagaagucacaca

SEQ ID NO: 2798498 - RNA, 19 nt, Human
gccuuagaagucacacagu

SEQ ID NO: 2798499 - RNA, 17 nt, Human
gccuuagaaccuuucuu

SEQ ID NO: 2798500 - RNA, 14 nt, Human
gccuuagugggcca

SEQ ID NO: 2798501 - RNA, 16 nt, Human
gccuuagugggccagg

SEQ ID NO: 2798502 - RNA, 17 nt, Human
gccuuagugggccaggg

SEQ ID NO: 2798503 - RNA, 19 nt, Human
gccuuagugggccagggcu

SEQ ID NO: 2798504 - RNA, 20 nt, Human
gccuuagugggccagggcug

SEQ ID NO: 2798505 - RNA, 15 nt, Human
gccuuacauuuguga

SEQ ID NO: 2798506 - RNA, 13 nt, Human
gccuuaccccugc

SEQ ID NO: 2798507 - RNA, 14 nt, Human
gccuuaccccugcc

SEQ ID NO: 2798508 - RNA, 23 nt, Human
gccuuaucuccaagaccagagau

SEQ ID NO: 2798509 - RNA, 23 nt, Human
gccuuaugaggguccucuacuuc

SEQ ID NO: 2798510 - RNA, 22 nt, Human
gccugggguaccaagagacucc

SEQ ID NO: 2798511 - RNA, 15 nt, Human
gccugcaauuucaua

SEQ ID NO: 2798512 - RNA, 18 nt, Human
gccugcaaucugagccag

SEQ ID NO: 2798513 - RNA, 13 nt, Human
gccugguggcagc

SEQ ID NO: 2798514 - RNA, 21 nt, Human
gccugggucacacacggaggc

SEQ ID NO: 2798515 - RNA, 16 nt, Human
gccuggguccagggga

SEQ ID NO: 2798516 - RNA, 21 nt, Human
gccugguggcagcugcggucc

SEQ ID NO: 2798517 - RNA, 19 nt, Human
gccugguggcagcugcggu

SEQ ID NO: 2798518 - RNA, 18 nt, Human
gccugguggcagcugcgg

SEQ ID NO: 2798519 - RNA, 14 nt, Human
gccgugugagugug

SEQ ID NO: 2798520 - RNA, 18 nt, Human
gccgugugagugugacag

SEQ ID NO: 2798521 - RNA, 19 nt, Human
gccgugugagugugacagg

SEQ ID NO: 2798522 - RNA, 22 nt, Human
gccgugugagugugacagggcc

SEQ ID NO: 2798523 - RNA, 23 nt, Human
gccgugugagugugacagggcca

SEQ ID NO: 2798524 - RNA, 18 nt, Human
gccuaaauuuaaugcugc

SEQ ID NO: 2798525 - RNA, 19 nt, Human
gccuaaauuuaaugcugcc

SEQ ID NO: 2798526 - RNA, 20 nt, Human
gccuaaauuuaaugcugccu

SEQ ID NO: 2798527 - RNA, 15 nt, Human
gccuaugaucccagc

SEQ ID NO: 2798528 - RNA, 21 nt, Human
gccuaugagcauccugagccc

SEQ ID NO: 2798529 - RNA, 22 nt, Human
gccuaugagcauccugagcccc

SEQ ID NO: 2798530 - RNA, 18 nt, Human
gccuaugaucccagcacu

SEQ ID NO: 2798531 - RNA, 14 nt, Human
gccuaugcacauau

SEQ ID NO: 2798532 - RNA, 23 nt, Human
gccuaugcacauauggacucugc

SEQ ID NO: 2798533 - RNA, 20 nt, Human
gccuaugcacauauggacuc

SEQ ID NO: 2798534 - RNA, 22 nt, Human
gccuaugcacauauggacucug

SEQ ID NO: 2798535 - RNA, 17 nt, Human
gccucaaccuccugggc

SEQ ID NO: 2798536 - RNA, 20 nt, Human
gccucaagguuuuagguucu

SEQ ID NO: 2798537 - RNA, 21 nt, Human
gccucaagguuuuagguucua

SEQ ID NO: 2798538 - RNA, 22 nt, Human
gccucaagguuuuagguucuaa

SEQ ID NO: 2798539 - RNA, 19 nt, Human
gccucaaccuccugggcua

SEQ ID NO: 2798540 - RNA, 18 nt, Human
gccucaaccuccugggcu

SEQ ID NO: 2798541 - RNA, 16 nt, Human
gccuauggcagaaaaa

SEQ ID NO: 2798542 - RNA, 22 nt, Human
gccuaugugcaugcagcaucua

SEQ ID NO: 2798543 - RNA, 18 nt, Human
gccguggggguugaggca

SEQ ID NO: 2798544 - RNA, 15 nt, Human
gccgugggccugggg

SEQ ID NO: 2798545 - RNA, 21 nt, Human
gccguggcuucccgcucagcc

SEQ ID NO: 2798546 - RNA, 22 nt, Human
gccguggcuucccgcucagccc

SEQ ID NO: 2798547 - RNA, 15 nt, Human
gccguggcuucccgc

SEQ ID NO: 2798548 - RNA, 19 nt, Human
gccguggcuucccgcucag

SEQ ID NO: 2798549 - RNA, 14 nt, Human
gccgugccuucagc

SEQ ID NO: 2798550 - RNA, 15 nt, Human
gccgugccuucagcu

SEQ ID NO: 2798551 - RNA, 17 nt, Human
gccgugccuucagcucu

SEQ ID NO: 2798552 - RNA, 19 nt, Human
gccgugccuucagcucuac

SEQ ID NO: 2798553 - RNA, 21 nt, Human
gccggugugccugacugccca

SEQ ID NO: 2798554 - RNA, 12 nt, Human
gccggucauuuu

SEQ ID NO: 2798555 - RNA, 14 nt, Human
gccgggccuguaca

SEQ ID NO: 2798556 - RNA, 15 nt, Human
gccgggccuguacag

SEQ ID NO: 2798557 - RNA, 19 nt, Human
gccgggcgugguggcgggc

SEQ ID NO: 2798558 - RNA, 22 nt, Human
gccgggaacagacaacagaagu

SEQ ID NO: 2798559 - RNA, 20 nt, Human
gccgggaacagacaacagaa

SEQ ID NO: 2798560 - RNA, 23 nt, Human
gccggcguggcaaauauaaaacu

SEQ ID NO: 2798561 - RNA, 19 nt, Human
gccggcuucaugccagcua

SEQ ID NO: 2798562 - RNA, 16 nt, Human
gccggcugugcucaga

SEQ ID NO: 2798563 - RNA, 17 nt, Human
gccggcugugcucagag

SEQ ID NO: 2798564 - RNA, 18 nt, Human
gccggcugugcucagaga

SEQ ID NO: 2798565 - RNA, 17 nt, Human
gccggcgagcccugugg

SEQ ID NO: 2798566 - RNA, 15 nt, Human
gccggcgagcccugu

SEQ ID NO: 2798567 - RNA, 18 nt, Human
gccggcgagcccugugga

SEQ ID NO: 2798568 - RNA, 22 nt, Human
gccgaccccuaguucccucugc

SEQ ID NO: 2798569 - RNA, 22 nt, Human
gccgcaaaccacacuggacucc

SEQ ID NO: 2798570 - RNA, 22 nt, Human
gccgcaaauuguaccuuuuuug

SEQ ID NO: 2798571 - RNA, 22 nt, Human
gccgagaucacgccacugcacu

SEQ ID NO: 2798572 - RNA, 21 nt, Human
gccgagaucacgccacugcac

SEQ ID NO: 2798573 - RNA, 20 nt, Human
gccgagaucacgccacugca

SEQ ID NO: 2798574 - RNA, 16 nt, Human
gcccugcuuugggcug

SEQ ID NO: 2798575 - RNA, 18 nt, Human
gcccugcuuugggcugcc

SEQ ID NO: 2798576 - RNA, 19 nt, Human
gccgaccagaggagccuuu

SEQ ID NO: 2798577 - RNA, 12 nt, Human
gccgaccagagg

SEQ ID NO: 2798578 - RNA, 12 nt, Human
gccgacacuguu

SEQ ID NO: 2798579 - RNA, 20 nt, Human
gccgaauccccucccuguca

SEQ ID NO: 2798580 - RNA, 15 nt, Human
gccgaaccaaaagaa

SEQ ID NO: 2798581 - RNA, 14 nt, Human
gcccuugggccacc

SEQ ID NO: 2798582 - RNA, 12 nt, Human
gcccuugggcca

SEQ ID NO: 2798583 - RNA, 15 nt, Human
gcccuuggcuucugu

SEQ ID NO: 2798584 - RNA, 17 nt, Human
gccucccgaguagcugg

SEQ ID NO: 2798585 - RNA, 19 nt, Human
gccucccgaguagcuggga

SEQ ID NO: 2798586 - RNA, 18 nt, Human
gccucccgaguagcuggg

SEQ ID NO: 2798587 - RNA, 20 nt, Human
gccucccgaguagcugggac

SEQ ID NO: 2798588 - RNA, 21 nt, Human
gccuccucacccccagcuuug

SEQ ID NO: 2798589 - RNA, 14 nt, Human
gccuccucaccccc

SEQ ID NO: 2798590 - RNA, 19 nt, Human
gccuccucacccccagcuu

SEQ ID NO: 2798591 - RNA, 18 nt, Human
gccuccucacccccagcu

SEQ ID NO: 2798592 - RNA, 17 nt, Human
gccuccucacccccagc

SEQ ID NO: 2798593 - RNA, 16 nt, Human
gccuccucacccccag

SEQ ID NO: 2798594 - RNA, 14 nt, Human
gccuccggaagcug

SEQ ID NO: 2798595 - RNA, 13 nt, Human
gccucccacuggg

SEQ ID NO: 2798596 - RNA, 14 nt, Human
gccucccacugggg

SEQ ID NO: 2798597 - RNA, 10 nt, Human
gccucccagc

SEQ ID NO: 2798598 - RNA, 14 nt, Human
gccucccagccugg

SEQ ID NO: 2798599 - RNA, 13 nt, Human
gccucccagccug

SEQ ID NO: 2798600 - RNA, 19 nt, Human
gccucccaaagugcuggga

SEQ ID NO: 2798601 - RNA, 18 nt, Human
gccucccaaagugcuggg

SEQ ID NO: 2798602 - RNA, 16 nt, Human
gccucagcauccuggc

SEQ ID NO: 2798603 - RNA, 15 nt, Human
gccucagcauccugg

SEQ ID NO: 2798604 - RNA, 15 nt, Human
gccucagacugcacc

SEQ ID NO: 2798605 - RNA, 17 nt, Human
gccucagacugcaccca

SEQ ID NO: 2798606 - RNA, 18 nt, Human
gccucagacugcacccag

SEQ ID NO: 2798607 - RNA, 19 nt, Human
gccucagacugcacccagg

SEQ ID NO: 2798608 - RNA, 20 nt, Human
gccucagacugcacccagga

SEQ ID NO: 2798609 - RNA, 21 nt, Human
gccucagacugcacccaggag

SEQ ID NO: 2798610 - RNA, 23 nt, Human
gccucagaauugaucauuuuccc

SEQ ID NO: 2798611 - RNA, 13 nt, Human
gccucugauaugg

SEQ ID NO: 2798612 - RNA, 15 nt, Human
gccucugauauggga

SEQ ID NO: 2798613 - RNA, 17 nt, Human
gccucugauaugggacu

SEQ ID NO: 2798614 - RNA, 18 nt, Human
gccucugauaugggacug

SEQ ID NO: 2798615 - RNA, 19 nt, Human
gccucugauaugggacuga

SEQ ID NO: 2798616 - RNA, 23 nt, Human
gccucugauaugggacugagccu

SEQ ID NO: 2798617 - RNA, 19 nt, Human
gccucugaccccuccucac

SEQ ID NO: 2798618 - RNA, 20 nt, Human
gccucugaccccuccucacu

SEQ ID NO: 2798619 - RNA, 21 nt, Human
gccucugaccccuccucacug

SEQ ID NO: 2798620 - RNA, 22 nt, Human
gccucugaccccuccucacugg

SEQ ID NO: 2798621 - RNA, 21 nt, Human
gccucugacacacagcucugu

SEQ ID NO: 2798622 - RNA, 13 nt, Human
gccucugaccccu

SEQ ID NO: 2798623 - RNA, 14 nt, Human
gccucugaccccuc

SEQ ID NO: 2798624 - RNA, 15 nt, Human
gccucugaccccucc

SEQ ID NO: 2798625 - RNA, 16 nt, Human
gccucugaccccuccu

SEQ ID NO: 2798626 - RNA, 17 nt, Human
gccucugaccccuccuc

SEQ ID NO: 2798627 - RNA, 18 nt, Human
gccucugaccccuccuca

SEQ ID NO: 2798628 - RNA, 20 nt, Human
gccucugacacacagcucug

SEQ ID NO: 2798629 - RNA, 19 nt, Human
gccucugacacacagcucu

SEQ ID NO: 2798630 - RNA, 18 nt, Human
gccucugacacacagcuc

SEQ ID NO: 2798631 - RNA, 17 nt, Human
gccucugacacacagcu

SEQ ID NO: 2798632 - RNA, 13 nt, Human
gccucucuagcac

SEQ ID NO: 2798633 - RNA, 20 nt, Human
gccugcaaacgcugccugcc

SEQ ID NO: 2798634 - RNA, 19 nt, Human
gccugcaaacgcugccugc

SEQ ID NO: 2798635 - RNA, 21 nt, Human
gccugcaaacgcugccugccc

SEQ ID NO: 2798636 - RNA, 18 nt, Human
gccugcaaacgcugccug

SEQ ID NO: 2798637 - RNA, 22 nt, Human
gccucucgguugaaaccuguau

SEQ ID NO: 2798638 - RNA, 13 nt, Human
gccucugccucug

SEQ ID NO: 2798639 - RNA, 12 nt, Human
gccucugccucu

SEQ ID NO: 2798640 - RNA, 10 nt, Human
gccucugccu

SEQ ID NO: 2798641 - RNA, 19 nt, Human
gccucugccacacucugac

SEQ ID NO: 2798642 - RNA, 15 nt, Human
gccucugcauucagg

SEQ ID NO: 2798643 - RNA, 19 nt, Human
gccugacuucugcuggcau

SEQ ID NO: 2798644 - RNA, 13 nt, Human
gccugacuugggg

SEQ ID NO: 2798645 - RNA, 12 nt, Human
gccugagaccca

SEQ ID NO: 2798646 - RNA, 13 nt, Human
gccugagacccag

SEQ ID NO: 2798647 - RNA, 14 nt, Human
gccugagacccagg

SEQ ID NO: 2798648 - RNA, 15 nt, Human
gccugagacccagga

SEQ ID NO: 2798649 - RNA, 16 nt, Human
gccugagacccaggac

SEQ ID NO: 2798650 - RNA, 17 nt, Human
gccugagacccaggacu

SEQ ID NO: 2798651 - RNA, 19 nt, Human
gccugagagaauuggcuca

SEQ ID NO: 2798652 - RNA, 20 nt, Human
gccugagagaauuggcucaa

SEQ ID NO: 2798653 - RNA, 19 nt, Human
gccugagagacauggcuuu

SEQ ID NO: 2798654 - RNA, 16 nt, Human
gccugacuucugcugg

SEQ ID NO: 2798655 - RNA, 15 nt, Human
gccugaccuuccuuc

SEQ ID NO: 2798656 - RNA, 16 nt, Human
gccaugggccuccugu

SEQ ID NO: 2798657 - RNA, 15 nt, Human
gccaugggccuccug

SEQ ID NO: 2798658 - RNA, 23 nt, Human
gcccaagacagaugccccagagc

SEQ ID NO: 2798659 - RNA, 21 nt, Human
gcccaagacagaugccccaga

SEQ ID NO: 2798660 - RNA, 20 nt, Human
gcccaagacagaugccccag

SEQ ID NO: 2798661 - RNA, 19 nt, Human
gcccaagacagaugcccca

SEQ ID NO: 2798662 - RNA, 21 nt, Human
gcccaagaauagaugcugacu

SEQ ID NO: 2798663 - RNA, 22 nt, Human
gcccaagaauagaugcugacug

SEQ ID NO: 2798664 - RNA, 24 nt, Human
gcccaaccugcucuccucuugcca

SEQ ID NO: 2798665 - RNA, 14 nt, Human
gcccaaccugcucu

SEQ ID NO: 2798666 - RNA, 14 nt, Human
gcccaagcccaggc

SEQ ID NO: 2798667 - RNA, 15 nt, Human
gcccaagcccaggcc

SEQ ID NO: 2798668 - RNA, 17 nt, Human
gcccaagcccaggccac

SEQ ID NO: 2798669 - RNA, 13 nt, Human
gcccaagaugcuu

SEQ ID NO: 2798670 - RNA, 15 nt, Human
gcccaacuguguagc

SEQ ID NO: 2798671 - RNA, 17 nt, Human
gcccaacuguguagcau

SEQ ID NO: 2798672 - RNA, 15 nt, Human
gcccaaggcggcccc

SEQ ID NO: 2798673 - RNA, 16 nt, Human
gcccaaggcggccccu

SEQ ID NO: 2798674 - RNA, 23 nt, Human
gcccaagggaaagaaaaggaagg

SEQ ID NO: 2798675 - RNA, 17 nt, Human
gcccaaggcggccccuc

SEQ ID NO: 2798676 - RNA, 18 nt, Human
gcccaaggcggccccucc

SEQ ID NO: 2798677 - RNA, 20 nt, Human
gcccacauagugaugguucc

SEQ ID NO: 2798678 - RNA, 16 nt, Human
gcccacauuggaccca

SEQ ID NO: 2798679 - RNA, 15 nt, Human
gcccacauuuagucu

SEQ ID NO: 2798680 - RNA, 17 nt, Human
gcccacauuuagucucu

SEQ ID NO: 2798681 - RNA, 20 nt, Human
gcccacauuuagucucuuua

SEQ ID NO: 2798682 - RNA, 21 nt, Human
gcccacauuuagucucuuuau

SEQ ID NO: 2798683 - RNA, 14 nt, Human
gcccaccugccugg

SEQ ID NO: 2798684 - RNA, 15 nt, Human
gcccaccugccuggc

SEQ ID NO: 2798685 - RNA, 16 nt, Human
gcccaccugccuggcc

SEQ ID NO: 2798686 - RNA, 17 nt, Human
gcccaccugccuggccg

SEQ ID NO: 2798687 - RNA, 21 nt, Human
gcccaccugccuggccggcca

SEQ ID NO: 2798688 - RNA, 22 nt, Human
gcccaccugccuggccggccag

SEQ ID NO: 2798689 - RNA, 17 nt, Human
gcccaccuuggcucaag

SEQ ID NO: 2798690 - RNA, 16 nt, Human
gcccaccuuggcucaa

SEQ ID NO: 2798691 - RNA, 15 nt, Human
gcccaccuuggcuca

SEQ ID NO: 2798692 - RNA, 13 nt, Human
gcccaccuuggcu

SEQ ID NO: 2798693 - RNA, 14 nt, Human
gcccacuucugcca

SEQ ID NO: 2798694 - RNA, 15 nt, Human
gcccagaacuucccu

SEQ ID NO: 2798695 - RNA, 16 nt, Human
gcccagaacuucccug

SEQ ID NO: 2798696 - RNA, 17 nt, Human
gcccagaacuucccuga

SEQ ID NO: 2798697 - RNA, 18 nt, Human
gcccagaagaaaauucuc

SEQ ID NO: 2798698 - RNA, 21 nt, Human
gcccagaagaaaauucuccug

SEQ ID NO: 2798699 - RNA, 23 nt, Human
gcccacuuguauccucugguucu

SEQ ID NO: 2798700 - RNA, 22 nt, Human
gccaucacaugaucuguuuuuc

SEQ ID NO: 2798701 - RNA, 17 nt, Human
gccaguccugccuggcc

SEQ ID NO: 2798702 - RNA, 16 nt, Human
gccaguccugccuggc

SEQ ID NO: 2798703 - RNA, 14 nt, Human
gccaguccugccug

SEQ ID NO: 2798704 - RNA, 21 nt, Human
gccaguaucuauauaugugua

SEQ ID NO: 2798705 - RNA, 22 nt, Human
gccaguaucuauauauguguau

SEQ ID NO: 2798706 - RNA, 23 nt, Human
gccaguaucuauauauguguaug

SEQ ID NO: 2798707 - RNA, 17 nt, Human
gccaguauuagacugga

SEQ ID NO: 2798708 - RNA, 23 nt, Human
gccaguauuagacuggaaguuca

SEQ ID NO: 2798709 - RNA, 15 nt, Human
gccaggcuggucuca

SEQ ID NO: 2798710 - RNA, 17 nt, Human
gccaggcuggucuaaaa

SEQ ID NO: 2798711 - RNA, 13 nt, Human
gccaggcuggucu

SEQ ID NO: 2798712 - RNA, 19 nt, Human
gccaucaucaguggagcca

SEQ ID NO: 2798713 - RNA, 14 nt, Human
gccaucauugcugu

SEQ ID NO: 2798714 - RNA, 18 nt, Human
gccaucauugcugucugc

SEQ ID NO: 2798715 - RNA, 19 nt, Human
gccaucauugcugucugca

SEQ ID NO: 2798716 - RNA, 14 nt, Human
gccaucccucgugg

SEQ ID NO: 2798717 - RNA, 21 nt, Human
gccaucccucgugguccccaa

SEQ ID NO: 2798718 - RNA, 12 nt, Human
gccaucccugug

SEQ ID NO: 2798719 - RNA, 13 nt, Human
gccaucccuguga

SEQ ID NO: 2798720 - RNA, 14 nt, Human
gccaucccugugag

SEQ ID NO: 2798721 - RNA, 15 nt, Human
gccaucccugugagg

SEQ ID NO: 2798722 - RNA, 18 nt, Human
gccaucuggggcuccuuc

SEQ ID NO: 2798723 - RNA, 18 nt, Human
gccaucuguguccugguu

SEQ ID NO: 2798724 - RNA, 19 nt, Human
gccauccuaaaagccaccc

SEQ ID NO: 2798725 - RNA, 18 nt, Human
gccauccucaaacacugc

SEQ ID NO: 2798726 - RNA, 19 nt, Human
gccauccucaaacacugca

SEQ ID NO: 2798727 - RNA, 20 nt, Human
gccauccucaaacacugcag

SEQ ID NO: 2798728 - RNA, 21 nt, Human
gccauccucaaacacugcagg

SEQ ID NO: 2798729 - RNA, 23 nt, Human
gccauccucaaacacugcaggca

SEQ ID NO: 2798730 - RNA, 19 nt, Human
gccauccucuuucucuuuu

SEQ ID NO: 2798731 - RNA, 18 nt, Human
gccaugccaggaaccugu

SEQ ID NO: 2798732 - RNA, 16 nt, Human
gccaugccaggaaccu

SEQ ID NO: 2798733 - RNA, 14 nt, Human
gccaugcaagaacu

SEQ ID NO: 2798734 - RNA, 14 nt, Human
gccaugcaauucau

SEQ ID NO: 2798735 - RNA, 15 nt, Human
gccaugaaaccagag

SEQ ID NO: 2798736 - RNA, 21 nt, Human
gccaaggccagaguggccugg

SEQ ID NO: 2798737 - RNA, 20 nt, Human
gccaaggccagaguggccug

SEQ ID NO: 2798738 - RNA, 18 nt, Human
gccaaggccuucuccucc

SEQ ID NO: 2798739 - RNA, 14 nt, Human
gccaaggccuucuc

SEQ ID NO: 2798740 - RNA, 15 nt, Human
gccaaggccuucucc

SEQ ID NO: 2798741 - RNA, 16 nt, Human
gccaacacucaagaag

SEQ ID NO: 2798742 - RNA, 21 nt, Human
gccacuccagaccccuggcuu

SEQ ID NO: 2798743 - RNA, 20 nt, Human
gccacuccagaccccuggcu

SEQ ID NO: 2798744 - RNA, 20 nt, Human
gccaacacucaagaagcagg

SEQ ID NO: 2798745 - RNA, 15 nt, Human
gccaacacugugggu

SEQ ID NO: 2798746 - RNA, 21 nt, Human
gccaacacuguggguguguga

SEQ ID NO: 2798747 - RNA, 13 nt, Human
gccaaauuuauca

SEQ ID NO: 2798748 - RNA, 19 nt, Human
gccaaauuuaucaaagcau

SEQ ID NO: 2798749 - RNA, 18 nt, Human
gccaaauuauuuguguaa

SEQ ID NO: 2798750 - RNA, 19 nt, Human
gccaaauuauuuguguaau

SEQ ID NO: 2798751 - RNA, 23 nt, Human
gccaaauuauuuguguaauagaa

SEQ ID NO: 2798752 - RNA, 14 nt, Human
gccaacaagaaugc

SEQ ID NO: 2798753 - RNA, 19 nt, Human
gccaacaagaaugcauuga

SEQ ID NO: 2798754 - RNA, 20 nt, Human
gccaacaagaaugcauugau

SEQ ID NO: 2798755 - RNA, 22 nt, Human
gccaacaagaaugcauugauau

SEQ ID NO: 2798756 - RNA, 20 nt, Human
gccaacaccacagaaauggg

SEQ ID NO: 2798757 - RNA, 22 nt, Human
gccacugcaccgggccacagag

SEQ ID NO: 2798758 - RNA, 19 nt, Human
gccacugcaccgggccaca

SEQ ID NO: 2798759 - RNA, 21 nt, Human
gccacugcaccgggccacaga

SEQ ID NO: 2798760 - RNA, 20 nt, Human
gccacugcaccgggccacag

SEQ ID NO: 2798761 - RNA, 12 nt, Human
gccacuccuccc

SEQ ID NO: 2798762 - RNA, 16 nt, Human
gccacuccucccuccg

SEQ ID NO: 2798763 - RNA, 16 nt, Human
gccacuccccuccacu

SEQ ID NO: 2798764 - RNA, 22 nt, Human
gccacuccagaccccuggcuuu

SEQ ID NO: 2798765 - RNA, 14 nt, Human
gccagaugcaccag

SEQ ID NO: 2798766 - RNA, 16 nt, Human
gccagauccucuuggu

SEQ ID NO: 2798767 - RNA, 14 nt, Human
gccagaucuuaggu

SEQ ID NO: 2798768 - RNA, 16 nt, Human
gccagaugaucaacuc

SEQ ID NO: 2798769 - RNA, 15 nt, Human
gccagauccucuugg

SEQ ID NO: 2798770 - RNA, 15 nt, Human
gccagaugcaccagc

SEQ ID NO: 2798771 - RNA, 16 nt, Human
gccagccgcucuccug

SEQ ID NO: 2798772 - RNA, 17 nt, Human
gccagccgcucuccugc

SEQ ID NO: 2798773 - RNA, 18 nt, Human
gccagccgcucuccugcc

SEQ ID NO: 2798774 - RNA, 20 nt, Human
gccagccgcucuccugccac

SEQ ID NO: 2798775 - RNA, 22 nt, Human
gccagccgcucuccugccacau

SEQ ID NO: 2798776 - RNA, 20 nt, Human
gccagcugcagcugggcugu

SEQ ID NO: 2798777 - RNA, 20 nt, Human
gccagcugcaggaaucaaaa

SEQ ID NO: 2798778 - RNA, 13 nt, Human
gccagccugaccu

SEQ ID NO: 2798779 - RNA, 17 nt, Human
gccagccugaccuuccu

SEQ ID NO: 2798780 - RNA, 22 nt, Human
gccagccugaccuuccuuccug

SEQ ID NO: 2798781 - RNA, 13 nt, Human
gccagccugaggc

SEQ ID NO: 2798782 - RNA, 11 nt, Human
gccagccuggc

SEQ ID NO: 2798783 - RNA, 19 nt, Human
gccagccuggcuucuggag

SEQ ID NO: 2798784 - RNA, 18 nt, Human
gccagccuggcuucugga

SEQ ID NO: 2798785 - RNA, 17 nt, Human
gccagccuggcuucugg

SEQ ID NO: 2798786 - RNA, 16 nt, Human
gccagccuggcuucug

SEQ ID NO: 2798787 - RNA, 12 nt, Human
gccagccuggcu

SEQ ID NO: 2798788 - RNA, 19 nt, Human
gccagcugcagcugggcug

SEQ ID NO: 2798789 - RNA, 14 nt, Human
gccagcugcagcug

SEQ ID NO: 2798790 - RNA, 22 nt, Human
gccagccuggcuucuggagccc

SEQ ID NO: 2798791 - RNA, 14 nt, Human
gccagccuggggcc

SEQ ID NO: 2798792 - RNA, 15 nt, Human
gccagccuggggccu

SEQ ID NO: 2798793 - RNA, 16 nt, Human
gccagccuggggccug

SEQ ID NO: 2798794 - RNA, 17 nt, Human
gccagccuggggccugg

SEQ ID NO: 2798795 - RNA, 18 nt, Human
gccagccuggggccuggc

SEQ ID NO: 2798796 - RNA, 19 nt, Human
gccagccuggggccuggca

SEQ ID NO: 2798797 - RNA, 20 nt, Human
gccagccuggggccuggcag

SEQ ID NO: 2798798 - RNA, 14 nt, Human
gccagccuggucca

SEQ ID NO: 2798799 - RNA, 21 nt, Human
gccagccugguccaugcaggg

SEQ ID NO: 2798800 - RNA, 21 nt, Human
gccagccuggcuucuggagcc

SEQ ID NO: 2798801 - RNA, 20 nt, Human
gccagccuggcuucuggagc

SEQ ID NO: 2798802 - RNA, 18 nt, Human
gccaggcucaggccaugg

SEQ ID NO: 2798803 - RNA, 17 nt, Human
gccaggcucaggccaug

SEQ ID NO: 2798804 - RNA, 19 nt, Human
gccaggacugagccccgca

SEQ ID NO: 2798805 - RNA, 17 nt, Human
gccaggaaguacuucca

SEQ ID NO: 2798806 - RNA, 13 nt, Human
gccaggaauauug

SEQ ID NO: 2798807 - RNA, 16 nt, Human
gccaggacagucagcu

SEQ ID NO: 2798808 - RNA, 19 nt, Human
gccaggacagucagcucuc

SEQ ID NO: 2798809 - RNA, 15 nt, Human
gccaggacugagccc

SEQ ID NO: 2798810 - RNA, 16 nt, Human
gccaggacugagcccc

SEQ ID NO: 2798811 - RNA, 17 nt, Human
gccaggacugagccccg

SEQ ID NO: 2798812 - RNA, 13 nt, Human
gcccugcagaggg

SEQ ID NO: 2798813 - RNA, 19 nt, Human
gcccugagaaagcccuguc

SEQ ID NO: 2798814 - RNA, 20 nt, Human
gcccugagaagcugcuccag

SEQ ID NO: 2798815 - RNA, 18 nt, Human
gcccugaagaauggcgcc

SEQ ID NO: 2798816 - RNA, 22 nt, Human
gcccuccgaccacuuccagggg

SEQ ID NO: 2798817 - RNA, 14 nt, Human
gcccucuuccugac

SEQ ID NO: 2798818 - RNA, 16 nt, Human
gcccucuuccugacga

SEQ ID NO: 2798819 - RNA, 17 nt, Human
gcccuccuacccugcgc

SEQ ID NO: 2798820 - RNA, 15 nt, Human
gcccuccgccuucac

SEQ ID NO: 2798821 - RNA, 16 nt, Human
gcccuccgccuucaca

SEQ ID NO: 2798822 - RNA, 18 nt, Human
gcccuccgcgaaaauagu

SEQ ID NO: 2798823 - RNA, 21 nt, Human
gcccucccugccccucccuuc

SEQ ID NO: 2798824 - RNA, 17 nt, Human
gcccuccccaucccaug

SEQ ID NO: 2798825 - RNA, 14 nt, Human
gcccuccccaggaa

SEQ ID NO: 2798826 - RNA, 23 nt, Human
gcccuccacagccgcagccuccc

SEQ ID NO: 2798827 - RNA, 20 nt, Human
gcccuccacagccgcagccu

SEQ ID NO: 2798828 - RNA, 14 nt, Human
gcccuccacagccg

SEQ ID NO: 2798829 - RNA, 19 nt, Human
gcccgggcgcggccagccc

SEQ ID NO: 2798830 - RNA, 21 nt, Human
gcccuccaucuaaacugcccc

SEQ ID NO: 2798831 - RNA, 21 nt, Human
gcccucccaggcucucaacag

SEQ ID NO: 2798832 - RNA, 12 nt, Human
gcccucccaggc

SEQ ID NO: 2798833 - RNA, 20 nt, Human
gcccuccaucuaaacugccc

SEQ ID NO: 2798834 - RNA, 22 nt, Human
gcccucauggccccucugaccu

SEQ ID NO: 2798835 - RNA, 18 nt, Human
gcccucauuacugggccu

SEQ ID NO: 2798836 - RNA, 19 nt, Human
gcccucauuacugggccuu

SEQ ID NO: 2798837 - RNA, 21 nt, Human
gcccucauuacugggccuuag

SEQ ID NO: 2798838 - RNA, 18 nt, Human
gcccucauggccccucug

SEQ ID NO: 2798839 - RNA, 19 nt, Human
gcccucauggccccucuga

SEQ ID NO: 2798840 - RNA, 18 nt, Human
gcccgggcgcggccagcc

SEQ ID NO: 2798841 - RNA, 23 nt, Human
gcccgggaaggucaccagcacca

SEQ ID NO: 2798842 - RNA, 13 nt, Human
gcccgggagccua

SEQ ID NO: 2798843 - RNA, 15 nt, Human
gcccgggagccuagg

SEQ ID NO: 2798844 - RNA, 20 nt, Human
gcccgggagccuaggaccac

SEQ ID NO: 2798845 - RNA, 15 nt, Human
gcccgcagaccucug

SEQ ID NO: 2798846 - RNA, 16 nt, Human
gcccgcagaccucugg

SEQ ID NO: 2798847 - RNA, 17 nt, Human
gcccgcagaccucugga

SEQ ID NO: 2798848 - RNA, 18 nt, Human
gcccgcagaccucuggau

SEQ ID NO: 2798849 - RNA, 13 nt, Human
gcccgcacacccu

SEQ ID NO: 2798850 - RNA, 14 nt, Human
gcccgcacacccuc

SEQ ID NO: 2798851 - RNA, 22 nt, Human
gcccgcacacccucacucugcc

SEQ ID NO: 2798852 - RNA, 23 nt, Human
gcccgcacacccucacucugcca

SEQ ID NO: 2798853 - RNA, 24 nt, Human
gcccgcacacccucacucugccag

SEQ ID NO: 2798854 - RNA, 18 nt, Human
gcccgggaaggucaccag

SEQ ID NO: 2798855 - RNA, 20 nt, Human
gcccgggaaggucaccagca

SEQ ID NO: 2798856 - RNA, 21 nt, Human
gccccucccccaacccccacc

SEQ ID NO: 2798857 - RNA, 15 nt, Human
gccccucccccaacc

SEQ ID NO: 2798858 - RNA, 12 nt, Human
gccccuccccca

SEQ ID NO: 2798859 - RNA, 14 nt, Human
gccccucccccauc

SEQ ID NO: 2798860 - RNA, 16 nt, Human
gccccucccccaucuc

SEQ ID NO: 2798861 - RNA, 13 nt, Human
gccccucccgccc

SEQ ID NO: 2798862 - RNA, 16 nt, Human
gccccucccgccccuu

SEQ ID NO: 2798863 - RNA, 23 nt, Human
gccccucccccaacccccacccc

SEQ ID NO: 2798864 - RNA, 22 nt, Human
gccccucccccaacccccaccc

SEQ ID NO: 2798865 - RNA, 16 nt, Human
gccccgaagggccccc

SEQ ID NO: 2798866 - RNA, 17 nt, Human
gccccgaagggccccca

SEQ ID NO: 2798867 - RNA, 18 nt, Human
gccccgaggccuucucug

SEQ ID NO: 2798868 - RNA, 15 nt, Human
gccccgaggccuucu

SEQ ID NO: 2798869 - RNA, 13 nt, Human
gccccgagcuguc

SEQ ID NO: 2798870 - RNA, 12 nt, Human
gccccuggggcc

SEQ ID NO: 2798871 - RNA, 16 nt, Human
gccccuggggccuaga

SEQ ID NO: 2798872 - RNA, 17 nt, Human
gccccuggggccuagac

SEQ ID NO: 2798873 - RNA, 16 nt, Human
gccccugaacaagaau

SEQ ID NO: 2798874 - RNA, 12 nt, Human
gccccucuuucu

SEQ ID NO: 2798875 - RNA, 14 nt, Human
gccccucuuucucu

SEQ ID NO: 2798876 - RNA, 15 nt, Human
gccccucuuucucuu

SEQ ID NO: 2798877 - RNA, 17 nt, Human
gccccucuuucucuuuc

SEQ ID NO: 2798878 - RNA, 18 nt, Human
gccccuguggagacuggg

SEQ ID NO: 2798879 - RNA, 16 nt, Human
gccccugguccugagg

SEQ ID NO: 2798880 - RNA, 21 nt, Human
gccccugggucagucuggugg

SEQ ID NO: 2798881 - RNA, 15 nt, Human
gccccuuuacggaca

SEQ ID NO: 2798882 - RNA, 20 nt, Human
gccccuuuacggacaccccc

SEQ ID NO: 2798883 - RNA, 22 nt, Human
gccccuuuacggacacccccuc

SEQ ID NO: 2798884 - RNA, 13 nt, Human
gccccuuuccaaa

SEQ ID NO: 2798885 - RNA, 20 nt, Human
gccccuugcucuccccugcc

SEQ ID NO: 2798886 - RNA, 16 nt, Human
gccccuuugggcccug

SEQ ID NO: 2798887 - RNA, 17 nt, Human
gccccuuugggcccugc

SEQ ID NO: 2798888 - RNA, 18 nt, Human
gccccuuugggcccugca

SEQ ID NO: 2798889 - RNA, 19 nt, Human
gccccuuugggcccugcau

SEQ ID NO: 2798890 - RNA, 20 nt, Human
gccccuuugggcccugcaug

SEQ ID NO: 2798891 - RNA, 21 nt, Human
gccccuuugggcccugcaugu

SEQ ID NO: 2798892 - RNA, 12 nt, Human
gcccgacagccu

SEQ ID NO: 2798893 - RNA, 14 nt, Human
gcccgacagccugg

SEQ ID NO: 2798894 - RNA, 15 nt, Human
gcccgacagccuggc

SEQ ID NO: 2798895 - RNA, 18 nt, Human
gcccgagcuguuuauguu

SEQ ID NO: 2798896 - RNA, 22 nt, Human
gcccgagcuguuuauguuuuua

SEQ ID NO: 2798897 - RNA, 13 nt, Human
gcccgcacagcag

SEQ ID NO: 2798898 - RNA, 14 nt, Human
gcccgcacagcagc

SEQ ID NO: 2798899 - RNA, 15 nt, Human
gcccgcacagcagcc

SEQ ID NO: 2798900 - RNA, 16 nt, Human
gcccgcacagcagccu

SEQ ID NO: 2798901 - RNA, 17 nt, Human
gcccgcacagcagccug

SEQ ID NO: 2798902 - RNA, 18 nt, Human
gcccgcacagcagccugc

SEQ ID NO: 2798903 - RNA, 14 nt, Human
gccccaggccucug

SEQ ID NO: 2798904 - RNA, 19 nt, Human
gccccagcacuaacguaaa

SEQ ID NO: 2798905 - RNA, 19 nt, Human
gccccagcaccucagccug

SEQ ID NO: 2798906 - RNA, 21 nt, Human
gccccagcaccucagccugca

SEQ ID NO: 2798907 - RNA, 12 nt, Human
gccccagugccc

SEQ ID NO: 2798908 - RNA, 16 nt, Human
gccccagguagaaacu

SEQ ID NO: 2798909 - RNA, 23 nt, Human
gccccagggucuucccuaccuca

SEQ ID NO: 2798910 - RNA, 16 nt, Human
gccccagggugcccag

SEQ ID NO: 2798911 - RNA, 12 nt, Human
gccccagggcac

SEQ ID NO: 2798912 - RNA, 13 nt, Human
gccccagggcacc

SEQ ID NO: 2798913 - RNA, 15 nt, Human
gccccagggcacccu

SEQ ID NO: 2798914 - RNA, 18 nt, Human
gccccagggcuacccucc

SEQ ID NO: 2798915 - RNA, 16 nt, Human
gccccagggcuacccu

SEQ ID NO: 2798916 - RNA, 21 nt, Human
gccccagggucuucccuaccu

SEQ ID NO: 2798917 - RNA, 20 nt, Human
gccccagggucuucccuacc

SEQ ID NO: 2798918 - RNA, 17 nt, Human
gccccagggucuucccu

SEQ ID NO: 2798919 - RNA, 16 nt, Human
gccccagggucuuccc

SEQ ID NO: 2798920 - RNA, 18 nt, Human
gccccaguucaaucuccc

SEQ ID NO: 2798921 - RNA, 21 nt, Human
gccccauaauuuuuuuuuucc

SEQ ID NO: 2798922 - RNA, 19 nt, Human
gccccaguuguauuuauuu

SEQ ID NO: 2798923 - RNA, 14 nt, Human
gccccagugcccac

SEQ ID NO: 2798924 - RNA, 13 nt, Human
gccccagugccca

SEQ ID NO: 2798925 - RNA, 14 nt, Human
gccccauucugccu

SEQ ID NO: 2798926 - RNA, 15 nt, Human
gccccauucugccug

SEQ ID NO: 2798927 - RNA, 19 nt, Human
gcccccaaagcagcccuuc

SEQ ID NO: 2798928 - RNA, 13 nt, Human
gcccccuggccuc

SEQ ID NO: 2798929 - RNA, 14 nt, Human
gcccccuggccucu

SEQ ID NO: 2798930 - RNA, 15 nt, Human
gcccccuggccucug

SEQ ID NO: 2798931 - RNA, 16 nt, Human
gcccccuggccucugu

SEQ ID NO: 2798932 - RNA, 20 nt, Human
gcccccugcuggcucuucug

SEQ ID NO: 2798933 - RNA, 15 nt, Human
gcccccugcuggcuc

SEQ ID NO: 2798934 - RNA, 13 nt, Human
gcccccugccccc

SEQ ID NO: 2798935 - RNA, 13 nt, Human
gcccccugcuggc

SEQ ID NO: 2798936 - RNA, 17 nt, Human
gcccccuggccucugug

SEQ ID NO: 2798937 - RNA, 19 nt, Human
gcccccuggccucugugcc

SEQ ID NO: 2798938 - RNA, 13 nt, Human
gcccccuggucuc

SEQ ID NO: 2798939 - RNA, 14 nt, Human
gcccccuggucucu

SEQ ID NO: 2798940 - RNA, 16 nt, Human
gcccccuggucucugg

SEQ ID NO: 2798941 - RNA, 17 nt, Human
gcccccuggucucuggu

SEQ ID NO: 2798942 - RNA, 22 nt, Human
gcccccugguggacaguccugg

SEQ ID NO: 2798943 - RNA, 21 nt, Human
gcccccugguggacaguccug

SEQ ID NO: 2798944 - RNA, 23 nt, Human
gcccccugguggacaguccuggg

SEQ ID NO: 2798945 - RNA, 21 nt, Human
gcccccacauuugugccgaca

SEQ ID NO: 2798946 - RNA, 22 nt, Human
gcccccacauuugugccgacac

SEQ ID NO: 2798947 - RNA, 13 nt, Human
gcccccaccacac

SEQ ID NO: 2798948 - RNA, 15 nt, Human
gcccccaccacacau

SEQ ID NO: 2798949 - RNA, 16 nt, Human
gcccccaccacacauc

SEQ ID NO: 2798950 - RNA, 17 nt, Human
gcccccaccacacaucc

SEQ ID NO: 2798951 - RNA, 20 nt, Human
gcccccaccacacaucccag

SEQ ID NO: 2798952 - RNA, 21 nt, Human
gcccccaccacacaucccagc

SEQ ID NO: 2798953 - RNA, 23 nt, Human
gcccccaccacacaucccagccc

SEQ ID NO: 2798954 - RNA, 21 nt, Human
gcccccaccacuaggacucug

SEQ ID NO: 2798955 - RNA, 14 nt, Human
gcccccugcccccc

SEQ ID NO: 2798956 - RNA, 12 nt, Human
gcccccugcccu

SEQ ID NO: 2798957 - RNA, 18 nt, Human
gcccccugccccccagcc

SEQ ID NO: 2798958 - RNA, 19 nt, Human
gcccccugcccguguacau

SEQ ID NO: 2798959 - RNA, 14 nt, Human
gcccccugcccucc

SEQ ID NO: 2798960 - RNA, 19 nt, Human
gcccccugcccuccccucu

SEQ ID NO: 2798961 - RNA, 12 nt, Human
gcccaggcuggc

SEQ ID NO: 2798962 - RNA, 20 nt, Human
gcccaggcuggagugcagug

SEQ ID NO: 2798963 - RNA, 19 nt, Human
gcccaggcuggagugcagu

SEQ ID NO: 2798964 - RNA, 12 nt, Human
gcccaggcugga

SEQ ID NO: 2798965 - RNA, 15 nt, Human
gcccaggcuggagug

SEQ ID NO: 2798966 - RNA, 20 nt, Human
gcccaggcuggagugcaaug

SEQ ID NO: 2798967 - RNA, 18 nt, Human
gcccagagcaggaagcau

SEQ ID NO: 2798968 - RNA, 21 nt, Human
gcccaggccgggguggagcau

SEQ ID NO: 2798969 - RNA, 22 nt, Human
gcccaggccgggguggagcaug

SEQ ID NO: 2798970 - RNA, 23 nt, Human
gcccaggccgggguggagcaugg

SEQ ID NO: 2798971 - RNA, 13 nt, Human
gcccaggccggcc

SEQ ID NO: 2798972 - RNA, 14 nt, Human
gcccaggccggcca

SEQ ID NO: 2798973 - RNA, 15 nt, Human
gcccaggccggccag

SEQ ID NO: 2798974 - RNA, 16 nt, Human
gcccaggccggccagc

SEQ ID NO: 2798975 - RNA, 17 nt, Human
gcccaggccggccagcc

SEQ ID NO: 2798976 - RNA, 18 nt, Human
gcccaggccggccagccu

SEQ ID NO: 2798977 - RNA, 19 nt, Human
gcccaggccggccagccuc

SEQ ID NO: 2798978 - RNA, 20 nt, Human
gcccaggccggccagccuca

SEQ ID NO: 2798979 - RNA, 23 nt, Human
gcccaggccccugccacccuggg

SEQ ID NO: 2798980 - RNA, 14 nt, Human
gcccagagcaggaa

SEQ ID NO: 2798981 - RNA, 15 nt, Human
gcccagagcaggaag

SEQ ID NO: 2798982 - RNA, 16 nt, Human
gcccagagcaggaagc

SEQ ID NO: 2798983 - RNA, 21 nt, Human
gcccagagaggguggugaccu

SEQ ID NO: 2798984 - RNA, 15 nt, Human
gcccagagagggugg

SEQ ID NO: 2798985 - RNA, 22 nt, Human
gcccaguuggguggaugccugg

SEQ ID NO: 2798986 - RNA, 23 nt, Human
gcccaggguggacuuagaaagca

SEQ ID NO: 2798987 - RNA, 14 nt, Human
gcccaggguggacu

SEQ ID NO: 2798988 - RNA, 14 nt, Human
gcccauacucagcc

SEQ ID NO: 2798989 - RNA, 15 nt, Human
gcccauacucagccu

SEQ ID NO: 2798990 - RNA, 16 nt, Human
gcccauacucagccug

SEQ ID NO: 2798991 - RNA, 17 nt, Human
gcccauacucagccugc

SEQ ID NO: 2798992 - RNA, 19 nt, Human
gcccauacucagccugcug

SEQ ID NO: 2798993 - RNA, 20 nt, Human
gcccauacucagccugcugc

SEQ ID NO: 2798994 - RNA, 21 nt, Human
gcccauacucagccugcugcc

SEQ ID NO: 2798995 - RNA, 22 nt, Human
gcccaggggaggcggcacucca

SEQ ID NO: 2798996 - RNA, 20 nt, Human
gcccauccauaguaacugac

SEQ ID NO: 2798997 - RNA, 22 nt, Human
gcccaucacaggguugggccca

SEQ ID NO: 2798998 - RNA, 21 nt, Human
gcccaucacaggguugggccc

SEQ ID NO: 2798999 - RNA, 17 nt, Human
gcccaucacaggguugg

SEQ ID NO: 2799000 - RNA, 13 nt, Human
gcccaucacaggg

SEQ ID NO: 2799001 - RNA, 18 nt, Human
gcccauagaaacaugaca

SEQ ID NO: 2799002 - RNA, 21 nt, Human
gcccauagaaacaugacacug

SEQ ID NO: 2799003 - RNA, 22 nt, Human
gcccauagaaacaugacacuga

SEQ ID NO: 2799004 - RNA, 23 nt, Human
gcccauagaaacaugacacugac

SEQ ID NO: 2799005 - RNA, 12 nt, Human
gccccacugaug

SEQ ID NO: 2799006 - RNA, 13 nt, Human
gccccacugaugc

SEQ ID NO: 2799007 - RNA, 18 nt, Human
gccccacugaugcuguuc

SEQ ID NO: 2799008 - RNA, 23 nt, Human
gccccacugaugcuguucucuuc

SEQ ID NO: 2799009 - RNA, 21 nt, Human
gccccaccggcgcgcucuucg

SEQ ID NO: 2799010 - RNA, 23 nt, Human
gccccacugccagcagcagcagg

SEQ ID NO: 2799011 - RNA, 20 nt, Human
gccccacugccagcagcagc

SEQ ID NO: 2799012 - RNA, 17 nt, Human
gccccacugccagcagc

SEQ ID NO: 2799013 - RNA, 16 nt, Human
gccccacugccagcag

SEQ ID NO: 2799014 - RNA, 15 nt, Human
gccccacugccagca

SEQ ID NO: 2799015 - RNA, 14 nt, Human
gccccacugccagc

SEQ ID NO: 2799016 - RNA, 12 nt, Human
gccccacugcca

SEQ ID NO: 2799017 - RNA, 23 nt, Human
gccccagagcuguuuauggccuc

SEQ ID NO: 2799018 - RNA, 22 nt, Human
gccccagagcuguuuauggccu

SEQ ID NO: 2799019 - RNA, 14 nt, Human
gccccagagcuguu

SEQ ID NO: 2799020 - RNA, 13 nt, Human
gccccagagcugu

SEQ ID NO: 2799021 - RNA, 12 nt, Human
gccccagagcug

SEQ ID NO: 2799022 - RNA, 22 nt, Human
gccccagagcaggguguuggga

SEQ ID NO: 2799023 - RNA, 13 nt, Human
uuuuaaauucuga

SEQ ID NO: 2799024 - RNA, 20 nt, Human
uuuuaaauucugagacaugu

SEQ ID NO: 2799025 - RNA, 24 nt, Human
uuuuaaauucugagacauguguca

SEQ ID NO: 2799026 - RNA, 12 nt, Human
uuuuaaauuguu

SEQ ID NO: 2799027 - RNA, 13 nt, Human
uuuuaacaagaag

SEQ ID NO: 2799028 - RNA, 14 nt, Human
uuuuaacaagaaga

SEQ ID NO: 2799029 - RNA, 16 nt, Human
uuuuaacaagaagaug

SEQ ID NO: 2799030 - RNA, 17 nt, Human
uuuuaacaagaagauga

SEQ ID NO: 2799031 - RNA, 19 nt, Human
uuuuaacaagaagaugaau

SEQ ID NO: 2799032 - RNA, 21 nt, Human
uuuuaacaagaagaugaaugg

SEQ ID NO: 2799033 - RNA, 22 nt, Human
uuuuaaucagacaaaguaauuc

SEQ ID NO: 2799034 - RNA, 22 nt, Human
uuuuaauauuauuacuguugau

SEQ ID NO: 2799035 - RNA, 12 nt, Human
uuuuaaucauga

SEQ ID NO: 2799036 - RNA, 14 nt, Human
uuuuaaucaugaaa

SEQ ID NO: 2799037 - RNA, 21 nt, Human
uuuuaauagucauuccaaaua

SEQ ID NO: 2799038 - RNA, 18 nt, Human
uuuuaauagaauaaaaua

SEQ ID NO: 2799039 - RNA, 14 nt, Human
uuuuaauauaaauu

SEQ ID NO: 2799040 - RNA, 12 nt, Human
uuuuaauagaac

SEQ ID NO: 2799041 - RNA, 16 nt, Human
uuuuaaucaugaaauu

SEQ ID NO: 2799042 - RNA, 20 nt, Human
uuuuaaucaugaaauuacuu

SEQ ID NO: 2799043 - RNA, 17 nt, Human
uuuuaauggauuguuaa

SEQ ID NO: 2799044 - RNA, 18 nt, Human
uuuuaauggauuguuaau

SEQ ID NO: 2799045 - RNA, 17 nt, Human
uuuuaauggcagcagaa

SEQ ID NO: 2799046 - RNA, 21 nt, Human
uuuuaauggcagcagaaaacu

SEQ ID NO: 2799047 - RNA, 22 nt, Human
uuuuaauggcagcagaaaacuu

SEQ ID NO: 2799048 - RNA, 17 nt, Human
uuuuaaucugaaauucu

SEQ ID NO: 2799049 - RNA, 16 nt, Human
uuuuaaugcaguugcu

SEQ ID NO: 2799050 - RNA, 20 nt, Human
uuuuaaugucauuuguuaaa

SEQ ID NO: 2799051 - RNA, 18 nt, Human
uuuuaaugugaugaugua

SEQ ID NO: 2799052 - RNA, 12 nt, Human
uuuuaauguaaa

SEQ ID NO: 2799053 - RNA, 15 nt, Human
uuuuaaauuuuguaa

SEQ ID NO: 2799054 - RNA, 16 nt, Human
uuuuaaauuuuguaau

SEQ ID NO: 2799055 - RNA, 17 nt, Human
uuuuaaauuuuguaaug

SEQ ID NO: 2799056 - RNA, 18 nt, Human
uuuuaaauuuuguaauga

SEQ ID NO: 2799057 - RNA, 16 nt, Human
uuuuaaauguauacua

SEQ ID NO: 2799058 - RNA, 21 nt, Human
uuuuaaaucuaaaucuauuua

SEQ ID NO: 2799059 - RNA, 19 nt, Human
uuuuaaaugcauaaaugca

SEQ ID NO: 2799060 - RNA, 14 nt, Human
uuuuaaauguacag

SEQ ID NO: 2799061 - RNA, 15 nt, Human
uuuuaaauguacaga

SEQ ID NO: 2799062 - RNA, 22 nt, Human
uuuuaaauguacagacauauuu

SEQ ID NO: 2799063 - RNA, 12 nt, Human
uuuuaaauguau

SEQ ID NO: 2799064 - RNA, 18 nt, Human
uuuuaaaucuaaaucuau

SEQ ID NO: 2799065 - RNA, 14 nt, Human
uuuuaaaucuaaau

SEQ ID NO: 2799066 - RNA, 15 nt, Human
uuuuaaagaucugua

SEQ ID NO: 2799067 - RNA, 15 nt, Human
uuuuaaauaaacuuu

SEQ ID NO: 2799068 - RNA, 16 nt, Human
uuuuaaauaaacuuuu

SEQ ID NO: 2799069 - RNA, 21 nt, Human
uuuuaaauaaacuuuuuuuca

SEQ ID NO: 2799070 - RNA, 22 nt, Human
uuuuaaauaaacuuuuuuucaa

SEQ ID NO: 2799071 - RNA, 23 nt, Human
uuuuaaauaaacuuuuuuucaau

SEQ ID NO: 2799072 - RNA, 14 nt, Human
uuuuaaaagagaca

SEQ ID NO: 2799073 - RNA, 22 nt, Human
uuuuaaaagagacaaacuguaa

SEQ ID NO: 2799074 - RNA, 23 nt, Human
uuuuaaaagagacaaacuguaaa

SEQ ID NO: 2799075 - RNA, 19 nt, Human
uuuguugacaaaauuuucu

SEQ ID NO: 2799076 - RNA, 21 nt, Human
uuuuaaaagguauuuugaaua

SEQ ID NO: 2799077 - RNA, 12 nt, Human
uuuuaaaaguuu

SEQ ID NO: 2799078 - RNA, 13 nt, Human
uuuuaaaaguuuc

SEQ ID NO: 2799079 - RNA, 15 nt, Human
uuuuaaaaguuucaa

SEQ ID NO: 2799080 - RNA, 14 nt, Human
uuuguucuuuuuau

SEQ ID NO: 2799081 - RNA, 12 nt, Human
uuuguucucugu

SEQ ID NO: 2799082 - RNA, 13 nt, Human
uuuguucucuguc

SEQ ID NO: 2799083 - RNA, 14 nt, Human
uuuguucuuacaca

SEQ ID NO: 2799084 - RNA, 15 nt, Human
uuuguucuuacacau

SEQ ID NO: 2799085 - RNA, 19 nt, Human
uuuguucuuacacauacag

SEQ ID NO: 2799086 - RNA, 15 nt, Human
uuuguucuucaagaa

SEQ ID NO: 2799087 - RNA, 13 nt, Human
uuuguucuucaga

SEQ ID NO: 2799088 - RNA, 18 nt, Human
uuuguucuucagagauca

SEQ ID NO: 2799089 - RNA, 20 nt, Human
uuuguucgcauggucacaca

SEQ ID NO: 2799090 - RNA, 14 nt, Human
uuuguauauuacac

SEQ ID NO: 2799091 - RNA, 19 nt, Human
uuuguauauuacacauuug

SEQ ID NO: 2799092 - RNA, 21 nt, Human
uuuguauauuacacauuugua

SEQ ID NO: 2799093 - RNA, 17 nt, Human
uuuguaucuuaaauuug

SEQ ID NO: 2799094 - RNA, 22 nt, Human
uuuguaucuuccauauuuggaa

SEQ ID NO: 2799095 - RNA, 20 nt, Human
uuuguaucucugaagcaugu

SEQ ID NO: 2799096 - RNA, 21 nt, Human
uuuguaucucugaagcauguu

SEQ ID NO: 2799097 - RNA, 17 nt, Human
uuuguauaguaaaguga

SEQ ID NO: 2799098 - RNA, 16 nt, Human
uuuguauaguaaagug

SEQ ID NO: 2799099 - RNA, 21 nt, Human
uuuggugguuuaaaaauggua

SEQ ID NO: 2799100 - RNA, 20 nt, Human
uuuggugcucauuuaaauau

SEQ ID NO: 2799101 - RNA, 15 nt, Human
uuuggucucccuggg

SEQ ID NO: 2799102 - RNA, 20 nt, Human
uuugguuugcuuugguuuau

SEQ ID NO: 2799103 - RNA, 17 nt, Human
uuuggaguccccucacc

SEQ ID NO: 2799104 - RNA, 22 nt, Human
uuuggaauuuuugcuugacuuc

SEQ ID NO: 2799105 - RNA, 20 nt, Human
uuuggagucagacagaugug

SEQ ID NO: 2799106 - RNA, 11 nt, Human
uuuggaaugug

SEQ ID NO: 2799107 - RNA, 14 nt, Human
uuuggugauucaaa

SEQ ID NO: 2799108 - RNA, 16 nt, Human
uuuggugcauagaacu

SEQ ID NO: 2799109 - RNA, 17 nt, Human
uuuggugcauagaacug

SEQ ID NO: 2799110 - RNA, 18 nt, Human
uuuggugcauagaacugg

SEQ ID NO: 2799111 - RNA, 22 nt, Human
uuuggugcauagaacuggguaa

SEQ ID NO: 2799112 - RNA, 20 nt, Human
uuuggaguccccucaccucc

SEQ ID NO: 2799113 - RNA, 19 nt, Human
uuuggaguguuauguauuu

SEQ ID NO: 2799114 - RNA, 22 nt, Human
uuuggaguguuauguauuuccu

SEQ ID NO: 2799115 - RNA, 15 nt, Human
uuuggaucuugaaug

SEQ ID NO: 2799116 - RNA, 17 nt, Human
uuuggaucuugaaugug

SEQ ID NO: 2799117 - RNA, 13 nt, Human
uuuggauguaauu

SEQ ID NO: 2799118 - RNA, 15 nt, Human
uuuggauguaauuua

SEQ ID NO: 2799119 - RNA, 16 nt, Human
uuuggucuggacugac

SEQ ID NO: 2799120 - RNA, 19 nt, Human
uuuggucuggacugacagc

SEQ ID NO: 2799121 - RNA, 21 nt, Human
uuuggucuggacugacagcau

SEQ ID NO: 2799122 - RNA, 22 nt, Human
uuuggucuggacugacagcaug

SEQ ID NO: 2799123 - RNA, 20 nt, Human
uuugcaucguccccuccccc

SEQ ID NO: 2799124 - RNA, 14 nt, Human
uuugcuuuuugcua

SEQ ID NO: 2799125 - RNA, 15 nt, Human
uuuggaaaaauguuu

SEQ ID NO: 2799126 - RNA, 15 nt, Human
uuugcuuugcccagc

SEQ ID NO: 2799127 - RNA, 22 nt, Human
uuugcauggcuccagaaauguc

SEQ ID NO: 2799128 - RNA, 21 nt, Human
uuugcaugugaaaaucaaaua

SEQ ID NO: 2799129 - RNA, 22 nt, Human
uuugcaucugaaauaggaaaca

SEQ ID NO: 2799130 - RNA, 14 nt, Human
uuugcaucugaaau

SEQ ID NO: 2799131 - RNA, 23 nt, Human
uuugaauguuaagaauugaccau

SEQ ID NO: 2799132 - RNA, 13 nt, Human
uuugaauguuaau

SEQ ID NO: 2799133 - RNA, 16 nt, Human
uuugaauguuaauuuu

SEQ ID NO: 2799134 - RNA, 19 nt, Human
uuugaauguuaauuuuuug

SEQ ID NO: 2799135 - RNA, 11 nt, Human
uuugaauguua

SEQ ID NO: 2799136 - RNA, 12 nt, Human
uuugaauguuaa

SEQ ID NO: 2799137 - RNA, 15 nt, Human
uuucugaauagaaau

SEQ ID NO: 2799138 - RNA, 13 nt, Human
uuucugacaguuu

SEQ ID NO: 2799139 - RNA, 14 nt, Human
uuucugaaggcuuu

SEQ ID NO: 2799140 - RNA, 17 nt, Human
uuucugaaggcuuugug

SEQ ID NO: 2799141 - RNA, 23 nt, Human
uuucucugccgcuaccucccucc

SEQ ID NO: 2799142 - RNA, 21 nt, Human
uuucuagaauuuaucacacuu

SEQ ID NO: 2799143 - RNA, 19 nt, Human
uuucuagaaguuucccuuc

SEQ ID NO: 2799144 - RNA, 20 nt, Human
uuucuagaaguuucccuucc

SEQ ID NO: 2799145 - RNA, 23 nt, Human
uuucuagaaguuucccuuccucc

SEQ ID NO: 2799146 - RNA, 15 nt, Human
uuucuagacuuucug

SEQ ID NO: 2799147 - RNA, 16 nt, Human
uuucuagacuuucugu

SEQ ID NO: 2799148 - RNA, 15 nt, Human
uuaccacacaucuau

SEQ ID NO: 2799149 - RNA, 18 nt, Human
uuaccacacaucuaugau

SEQ ID NO: 2799150 - RNA, 20 nt, Human
uuaccacacaucuaugauau

SEQ ID NO: 2799151 - RNA, 15 nt, Human
uuuccucaaauguug

SEQ ID NO: 2799152 - RNA, 19 nt, Human
uuuccucagcuuaucucuu

SEQ ID NO: 2799153 - RNA, 13 nt, Human
uuuccucccucag

SEQ ID NO: 2799154 - RNA, 13 nt, Human
uuuccugcccugg

SEQ ID NO: 2799155 - RNA, 12 nt, Human
uuuccugcccug

SEQ ID NO: 2799156 - RNA, 16 nt, Human
uuuccuggacacucag

SEQ ID NO: 2799157 - RNA, 20 nt, Human
uuuccuggacacucagaccu

SEQ ID NO: 2799158 - RNA, 16 nt, Human
uuuccuggaugucuga

SEQ ID NO: 2799159 - RNA, 21 nt, Human
uuuccugauaaagcacagcug

SEQ ID NO: 2799160 - RNA, 12 nt, Human
uuuccugcuuca

SEQ ID NO: 2799161 - RNA, 21 nt, Human
uuacauuuuuugggcagcaau

SEQ ID NO: 2799162 - RNA, 14 nt, Human
uuaccaaacagcaa

SEQ ID NO: 2799163 - RNA, 16 nt, Human
uuaccaaacagcaaac

SEQ ID NO: 2799164 - RNA, 17 nt, Human
uuaccaaacagcaaacc

SEQ ID NO: 2799165 - RNA, 19 nt, Human
uuaccaaacagcaaaccaa

SEQ ID NO: 2799166 - RNA, 20 nt, Human
uuaccaaacagcaaaccaag

SEQ ID NO: 2799167 - RNA, 13 nt, Human
uuacauuuuuauu

SEQ ID NO: 2799168 - RNA, 15 nt, Human
uuacauuuuuauuua

SEQ ID NO: 2799169 - RNA, 17 nt, Human
uuacauuuuuauuuaug

SEQ ID NO: 2799170 - RNA, 18 nt, Human
uuacauuuuuauuuauga

SEQ ID NO: 2799171 - RNA, 19 nt, Human
uuacauuuuuauuuaugaa

SEQ ID NO: 2799172 - RNA, 21 nt, Human
uuacauuuuuauuuaugaagu

SEQ ID NO: 2799173 - RNA, 22 nt, Human
uuacauuuuuauuuaugaaguu

SEQ ID NO: 2799174 - RNA, 13 nt, Human
uuaccaacuuucu

SEQ ID NO: 2799175 - RNA, 14 nt, Human
uuaccaacuuucug

SEQ ID NO: 2799176 - RNA, 15 nt, Human
uuaccaacuuucugu

SEQ ID NO: 2799177 - RNA, 16 nt, Human
uuaccaacuuucugua

SEQ ID NO: 2799178 - RNA, 18 nt, Human
uuaccaacuuucuguaaa

SEQ ID NO: 2799179 - RNA, 16 nt, Human
uuugaauauuacuccu

SEQ ID NO: 2799180 - RNA, 14 nt, Human
uuugaauauggaca

SEQ ID NO: 2799181 - RNA, 16 nt, Human
uuucuugcagaucaaa

SEQ ID NO: 2799182 - RNA, 13 nt, Human
uuucuugcauuga

SEQ ID NO: 2799183 - RNA, 18 nt, Human
uuucuugauuugaguuga

SEQ ID NO: 2799184 - RNA, 22 nt, Human
uuucuugacucuuguuuucagu

SEQ ID NO: 2799185 - RNA, 20 nt, Human
uuucuugacaaaaccuaacu

SEQ ID NO: 2799186 - RNA, 21 nt, Human
uuucuugacaaaaccuaacuu

SEQ ID NO: 2799187 - RNA, 17 nt, Human
uuugaacuggcaauugu

SEQ ID NO: 2799188 - RNA, 19 nt, Human
uuugaacuggcaauugucu

SEQ ID NO: 2799189 - RNA, 22 nt, Human
uuugaacuggcaauugucuauu

SEQ ID NO: 2799190 - RNA, 21 nt, Human
uuugaacucagaucugucuga

SEQ ID NO: 2799191 - RNA, 16 nt, Human
uuugaacucagaucug

SEQ ID NO: 2799192 - RNA, 18 nt, Human
uuugaagaacaugugaga

SEQ ID NO: 2799193 - RNA, 21 nt, Human
uuugaagaagguggaccuuuu

SEQ ID NO: 2799194 - RNA, 17 nt, Human
uuugaagaacaugugag

SEQ ID NO: 2799195 - RNA, 23 nt, Human
uuugaagacccgcuacaaaacgc

SEQ ID NO: 2799196 - RNA, 13 nt, Human
uuucuuauugcgc

SEQ ID NO: 2799197 - RNA, 14 nt, Human
uuucuuauugcgcu

SEQ ID NO: 2799198 - RNA, 17 nt, Human
uuucuuauugcgcugcu

SEQ ID NO: 2799199 - RNA, 16 nt, Human
uuucuuagugccugug

SEQ ID NO: 2799200 - RNA, 19 nt, Human
uuucuuauaauacucuguu

SEQ ID NO: 2799201 - RNA, 21 nt, Human
uuucuuauaauacucuguugu

SEQ ID NO: 2799202 - RNA, 12 nt, Human
uuucugagaaaa

SEQ ID NO: 2799203 - RNA, 15 nt, Human
uuucugagaaaagaa

SEQ ID NO: 2799204 - RNA, 15 nt, Human
uuucuguugguguau

SEQ ID NO: 2799205 - RNA, 14 nt, Human
uuucuguuguaacu

SEQ ID NO: 2799206 - RNA, 15 nt, Human
uuucuguuguaacuu

SEQ ID NO: 2799207 - RNA, 16 nt, Human
uuucuguuguaacuua

SEQ ID NO: 2799208 - RNA, 17 nt, Human
uuucuguuguaacuuau

SEQ ID NO: 2799209 - RNA, 19 nt, Human
uuucuguuguaacuuaugu

SEQ ID NO: 2799210 - RNA, 23 nt, Human
uuucuguuguaacuuauguagau

SEQ ID NO: 2799211 - RNA, 15 nt, Human
uuucuguuggauucc

SEQ ID NO: 2799212 - RNA, 13 nt, Human
uuucuguuucuca

SEQ ID NO: 2799213 - RNA, 16 nt, Human
uuucuguuugauucuu

SEQ ID NO: 2799214 - RNA, 16 nt, Human
uuucuuagcuuuuuaa

SEQ ID NO: 2799215 - RNA, 19 nt, Human
uuucuuagcuuuuuaauug

SEQ ID NO: 2799216 - RNA, 20 nt, Human
uuucuuagcuuuuuaauugu

SEQ ID NO: 2799217 - RNA, 21 nt, Human
uuucuuagcuuuuuaauuguu

SEQ ID NO: 2799218 - RNA, 22 nt, Human
uuucuuagcuuuuuaauuguug

SEQ ID NO: 2799219 - RNA, 14 nt, Human
uuucuuccucugcu

SEQ ID NO: 2799220 - RNA, 16 nt, Human
uuucuuccucugcuga

SEQ ID NO: 2799221 - RNA, 12 nt, Human
uuucuucuauuu

SEQ ID NO: 2799222 - RNA, 12 nt, Human
uuucuuccuggc

SEQ ID NO: 2799223 - RNA, 18 nt, Human
uuucuuccuguuaaugua

SEQ ID NO: 2799224 - RNA, 11 nt, Human
uuucuuccuuu

SEQ ID NO: 2799225 - RNA, 15 nt, Human
uuucuuccuuuacuu

SEQ ID NO: 2799226 - RNA, 13 nt, Human
uuucuucuacuuu

SEQ ID NO: 2799227 - RNA, 12 nt, Human
uuucuucuaugu

SEQ ID NO: 2799228 - RNA, 16 nt, Human
uuucuucagggcugcu

SEQ ID NO: 2799229 - RNA, 13 nt, Human
uuucuucauccaa

SEQ ID NO: 2799230 - RNA, 15 nt, Human
uuucuucauccaacu

SEQ ID NO: 2799231 - RNA, 12 nt, Human
uuucuucaugag

SEQ ID NO: 2799232 - RNA, 15 nt, Human
uuucuucagggcugc

SEQ ID NO: 2799233 - RNA, 21 nt, Human
uuucuucacuguugaaaauua

SEQ ID NO: 2799234 - RNA, 13 nt, Human
uuucuucacuuuu

SEQ ID NO: 2799235 - RNA, 15 nt, Human
uuucuucaaaaugua

SEQ ID NO: 2799236 - RNA, 16 nt, Human
uuucuucaaaauguau

SEQ ID NO: 2799237 - RNA, 21 nt, Human
uuucuucaaaauguauauauu

SEQ ID NO: 2799238 - RNA, 11 nt, Human
uuucuuccucu

SEQ ID NO: 2799239 - RNA, 13 nt, Human
uuucuuccucugc

SEQ ID NO: 2799240 - RNA, 14 nt, Human
uuuuucuaguacac

SEQ ID NO: 2799241 - RNA, 16 nt, Human
uuuuucucaaaguuuu

SEQ ID NO: 2799242 - RNA, 19 nt, Human
uuuuucucaugaaucugca

SEQ ID NO: 2799243 - RNA, 15 nt, Human
uuuuucuccagugcu

SEQ ID NO: 2799244 - RNA, 18 nt, Human
uuuuucucaaaguuuuga

SEQ ID NO: 2799245 - RNA, 11 nt, Human
uuuuuccuuuu

SEQ ID NO: 2799246 - RNA, 11 nt, Human
uuuuuccuuua

SEQ ID NO: 2799247 - RNA, 16 nt, Human
uuuuuccuuuuucuga

SEQ ID NO: 2799248 - RNA, 17 nt, Human
uuuuuccuuuuucugau

SEQ ID NO: 2799249 - RNA, 18 nt, Human
uuuuuccuagcccucuca

SEQ ID NO: 2799250 - RNA, 15 nt, Human
uuuuuccuagccugu

SEQ ID NO: 2799251 - RNA, 19 nt, Human
uuuuuccuagccuguuucu

SEQ ID NO: 2799252 - RNA, 21 nt, Human
uuuuuccuagccuguuucuuc

SEQ ID NO: 2799253 - RNA, 21 nt, Human
uuuuuaaguaauguggaagaa

SEQ ID NO: 2799254 - RNA, 23 nt, Human
uuuuuccuaacaaaagaugaaag

SEQ ID NO: 2799255 - RNA, 11 nt, Human
uuuuuaaauaa

SEQ ID NO: 2799256 - RNA, 16 nt, Human
uuuuuaagauuuuucu

SEQ ID NO: 2799257 - RNA, 13 nt, Human
uuuuuaagauuuu

SEQ ID NO: 2799258 - RNA, 16 nt, Human
uuuuuaaguauuuaua

SEQ ID NO: 2799259 - RNA, 23 nt, Human
uuuuuaaggguuaucuuagaugu

SEQ ID NO: 2799260 - RNA, 13 nt, Human
uuuuucuuuugua

SEQ ID NO: 2799261 - RNA, 10 nt, Human
uuuuugaaaa

SEQ ID NO: 2799262 - RNA, 17 nt, Human
uuuuugaaaaaagcuca

SEQ ID NO: 2799263 - RNA, 23 nt, Human
uuuuugaaaggcauguuccucug

SEQ ID NO: 2799264 - RNA, 11 nt, Human
uuuuugaaaug

SEQ ID NO: 2799265 - RNA, 12 nt, Human
uuuuugaaauga

SEQ ID NO: 2799266 - RNA, 15 nt, Human
uuuuugaaaugaaau

SEQ ID NO: 2799267 - RNA, 16 nt, Human
uuuuugaaaugaaauu

SEQ ID NO: 2799268 - RNA, 17 nt, Human
uuuuugaaaugaaauuu

SEQ ID NO: 2799269 - RNA, 21 nt, Human
uuuuugaaccauccacuuaca

SEQ ID NO: 2799270 - RNA, 19 nt, Human
uuuuugaacuaagaaacuu

SEQ ID NO: 2799271 - RNA, 23 nt, Human
uuuuugaacuaagaaacuuuugu

SEQ ID NO: 2799272 - RNA, 12 nt, Human
uuuuuugauaaa

SEQ ID NO: 2799273 - RNA, 12 nt, Human
uuuuuuguaguu

SEQ ID NO: 2799274 - RNA, 13 nt, Human
uuuuuugguacaa

SEQ ID NO: 2799275 - RNA, 16 nt, Human
uuuuuugguacaaaaa

SEQ ID NO: 2799276 - RNA, 16 nt, Human
uuuuuugggcagcaau

SEQ ID NO: 2799277 - RNA, 12 nt, Human
uuuuuugucaac

SEQ ID NO: 2799278 - RNA, 10 nt, Human
uuuuaauuua

SEQ ID NO: 2799279 - RNA, 15 nt, Human
uuuuaauuuaaagcu

SEQ ID NO: 2799280 - RNA, 16 nt, Human
uuuuaauuuaaagcuu

SEQ ID NO: 2799281 - RNA, 17 nt, Human
uuuuaauuuaaagcuua

SEQ ID NO: 2799282 - RNA, 12 nt, Human
uuuuaauuuaac

SEQ ID NO: 2799283 - RNA, 17 nt, Human
uuuuaauuuaacaugaa

SEQ ID NO: 2799284 - RNA, 12 nt, Human
uuuuccugcuuc

SEQ ID NO: 2799285 - RNA, 14 nt, Human
uuuuccuguucaua

SEQ ID NO: 2799286 - RNA, 16 nt, Human
uuuuccuguuucugaa

SEQ ID NO: 2799287 - RNA, 18 nt, Human
uuuuccuguuucugaaaa

SEQ ID NO: 2799288 - RNA, 12 nt, Human
uuuuaauuguca

SEQ ID NO: 2799289 - RNA, 13 nt, Human
uuuuaauugucau

SEQ ID NO: 2799290 - RNA, 14 nt, Human
uuuuaauugucaug

SEQ ID NO: 2799291 - RNA, 15 nt, Human
uuuuaauugucaugg

SEQ ID NO: 2799292 - RNA, 23 nt, Human
uuuuaauugucaugguuacaaac

SEQ ID NO: 2799293 - RNA, 18 nt, Human
uuuuaauuccaauaugau

SEQ ID NO: 2799294 - RNA, 19 nt, Human
uuuuaauuccaauaugaug

SEQ ID NO: 2799295 - RNA, 22 nt, Human
uuuuaauuccaauaugaugacu

SEQ ID NO: 2799296 - RNA, 16 nt, Human
uuuuaauuaaaaacua

SEQ ID NO: 2799297 - RNA, 16 nt, Human
uuuucuacauuauugc

SEQ ID NO: 2799298 - RNA, 17 nt, Human
uuuucuuugaaugcuuu

SEQ ID NO: 2799299 - RNA, 12 nt, Human
uuuucuuugcaa

SEQ ID NO: 2799300 - RNA, 15 nt, Human
uuuucuuugcaaagu

SEQ ID NO: 2799301 - RNA, 16 nt, Human
uuuucuuuguguagcu

SEQ ID NO: 2799302 - RNA, 21 nt, Human
uuuucuuuuguaagugcuaca

SEQ ID NO: 2799303 - RNA, 14 nt, Human
uuuucuuuuguuac

SEQ ID NO: 2799304 - RNA, 15 nt, Human
uuuucuuuuguuacu

SEQ ID NO: 2799305 - RNA, 16 nt, Human
uuuucuuuuguuacug

SEQ ID NO: 2799306 - RNA, 17 nt, Human
uuuucuuuuguuacugu

SEQ ID NO: 2799307 - RNA, 18 nt, Human
uuuucuuuuguuacuguu

SEQ ID NO: 2799308 - RNA, 19 nt, Human
uuuucuuuuguuacuguuc

SEQ ID NO: 2799309 - RNA, 20 nt, Human
uuuucuuuuguuacuguucu

SEQ ID NO: 2799310 - RNA, 19 nt, Human
uuuucuuuguguagcuuug

SEQ ID NO: 2799311 - RNA, 12 nt, Human
uuuucuuugugu

SEQ ID NO: 2799312 - RNA, 12 nt, Human
uuuucuuuguau

SEQ ID NO: 2799313 - RNA, 15 nt, Human
uuuucuuuguaucau

SEQ ID NO: 2799314 - RNA, 18 nt, Human
uuuucuuuguaucauuca

SEQ ID NO: 2799315 - RNA, 20 nt, Human
uuuucuuuguaucauucauc

SEQ ID NO: 2799316 - RNA, 13 nt, Human
uuuucuaaccuug

SEQ ID NO: 2799317 - RNA, 14 nt, Human
uuuucuaaccuuga

SEQ ID NO: 2799318 - RNA, 19 nt, Human
uuuucuaagcaauuucuug

SEQ ID NO: 2799319 - RNA, 21 nt, Human
uuuucuaagcaauuucuugcu

SEQ ID NO: 2799320 - RNA, 21 nt, Human
uuuucuaaugaggagagaaaa

SEQ ID NO: 2799321 - RNA, 13 nt, Human
uuuucuacaaaua

SEQ ID NO: 2799322 - RNA, 22 nt, Human
uuuucuaaacguaagcacuguu

SEQ ID NO: 2799323 - RNA, 23 nt, Human
uuuucuaaacguaagcacuguuu

SEQ ID NO: 2799324 - RNA, 15 nt, Human
uuuuggucuguguga

SEQ ID NO: 2799325 - RNA, 17 nt, Human
uuuugguauuacacugu

SEQ ID NO: 2799326 - RNA, 14 nt, Human
uuuugguagagaug

SEQ ID NO: 2799327 - RNA, 16 nt, Human
uuuugguagauuaaau

SEQ ID NO: 2799328 - RNA, 17 nt, Human
uuuugguagauuaaaua

SEQ ID NO: 2799329 - RNA, 23 nt, Human
uuuugguauuacacuguauuugu

SEQ ID NO: 2799330 - RNA, 17 nt, Human
uuuugggacaauuguuu

SEQ ID NO: 2799331 - RNA, 17 nt, Human
uuuuggcgcuauuacaa

SEQ ID NO: 2799332 - RNA, 19 nt, Human
uuuuggcgcuauuacaaau

SEQ ID NO: 2799333 - RNA, 15 nt, Human
uuuuggccuggaguu

SEQ ID NO: 2799334 - RNA, 14 nt, Human
uuuugguacaaaaa

SEQ ID NO: 2799335 - RNA, 16 nt, Human
uuuugguacaaaaaua

SEQ ID NO: 2799336 - RNA, 19 nt, Human
uuuugggguuguguuguca

SEQ ID NO: 2799337 - RNA, 13 nt, Human
uuuuggguagcug

SEQ ID NO: 2799338 - RNA, 14 nt, Human
uuuuggguagcugc

SEQ ID NO: 2799339 - RNA, 18 nt, Human
uuuugggggucaggcagc

SEQ ID NO: 2799340 - RNA, 18 nt, Human
uuuugggggugggucugg

SEQ ID NO: 2799341 - RNA, 18 nt, Human
uuuugggggugugagugu

SEQ ID NO: 2799342 - RNA, 13 nt, Human
uuuugaauguuau

SEQ ID NO: 2799343 - RNA, 16 nt, Human
uuuuggauuguauauu

SEQ ID NO: 2799344 - RNA, 14 nt, Human
uuuugaauguuauu

SEQ ID NO: 2799345 - RNA, 14 nt, Human
uuuugaauuguuac

SEQ ID NO: 2799346 - RNA, 15 nt, Human
uuuugaauuguuaca

SEQ ID NO: 2799347 - RNA, 16 nt, Human
uuuugaauuguuacau

SEQ ID NO: 2799348 - RNA, 14 nt, Human
uuuugaauuuagug

SEQ ID NO: 2799349 - RNA, 14 nt, Human
uuuugaaaaaagcu

SEQ ID NO: 2799350 - RNA, 16 nt, Human
uuuugaaaaaagcuca

SEQ ID NO: 2799351 - RNA, 23 nt, Human
uuuugaaaaaagcucauuucaug

SEQ ID NO: 2799352 - RNA, 15 nt, Human
uuuucuuuuuacaua

SEQ ID NO: 2799353 - RNA, 23 nt, Human
uuuucuuuuuacauaacugccuu

SEQ ID NO: 2799354 - RNA, 12 nt, Human
uuuugucuugaa

SEQ ID NO: 2799355 - RNA, 13 nt, Human
uuuugucuugaau

SEQ ID NO: 2799356 - RNA, 18 nt, Human
uuuugugaaaaugucaaa

SEQ ID NO: 2799357 - RNA, 23 nt, Human
uuuuuaaaacacauguuuuuaua

SEQ ID NO: 2799358 - RNA, 15 nt, Human
uuuuuaaaagagaca

SEQ ID NO: 2799359 - RNA, 20 nt, Human
uuuuuaaaagagacaaacug

SEQ ID NO: 2799360 - RNA, 12 nt, Human
uuuuuaaaagau

SEQ ID NO: 2799361 - RNA, 23 nt, Human
uuuuuaaaagaucuucaaaagua

SEQ ID NO: 2799362 - RNA, 14 nt, Human
uuuuuaaaacacau

SEQ ID NO: 2799363 - RNA, 18 nt, Human
uuuuuaaaacacauguuu

SEQ ID NO: 2799364 - RNA, 22 nt, Human
uuuuuaaaaguuucaaugugau

SEQ ID NO: 2799365 - RNA, 19 nt, Human
uuuuuaaaaguuucaaugu

SEQ ID NO: 2799366 - RNA, 15 nt, Human
uuuugucaacauugu

SEQ ID NO: 2799367 - RNA, 16 nt, Human
uuuugucaacauugug

SEQ ID NO: 2799368 - RNA, 15 nt, Human
uuuugucuaauuaaa

SEQ ID NO: 2799369 - RNA, 16 nt, Human
uuuugucccccaacuu

SEQ ID NO: 2799370 - RNA, 20 nt, Human
uuuugucccccaacuugaga

SEQ ID NO: 2799371 - RNA, 17 nt, Human
uuuugucuuuaaauaga

SEQ ID NO: 2799372 - RNA, 14 nt, Human
uuuugucuuuuaug

SEQ ID NO: 2799373 - RNA, 13 nt, Human
uuuugucuuauau

SEQ ID NO: 2799374 - RNA, 16 nt, Human
uuuuuaaaauauuuau

SEQ ID NO: 2799375 - RNA, 17 nt, Human
uuuuuaaaauauuuauu

SEQ ID NO: 2799376 - RNA, 19 nt, Human
uuuuuaaacaaacauugug

SEQ ID NO: 2799377 - RNA, 14 nt, Human
uuuuuaaaauggug

SEQ ID NO: 2799378 - RNA, 17 nt, Human
uuuuuaaaauggugcuu

SEQ ID NO: 2799379 - RNA, 19 nt, Human
uuuuuaaaauggugcuuaa

SEQ ID NO: 2799380 - RNA, 17 nt, Human
uuuuuaaagacagaguc

SEQ ID NO: 2799381 - RNA, 12 nt, Human
uuuuuaaagauc

SEQ ID NO: 2799382 - RNA, 20 nt, Human
uuuuuaaaguguuucuguua

SEQ ID NO: 2799383 - RNA, 12 nt, Human
uuuuuaaagcuu

SEQ ID NO: 2799384 - RNA, 13 nt, Human
uuuuuaaagcuua

SEQ ID NO: 2799385 - RNA, 13 nt, Human
uuuuuaaauaaac

SEQ ID NO: 2799386 - RNA, 14 nt, Human
uuuuuaaauaaacu

SEQ ID NO: 2799387 - RNA, 15 nt, Human
uuuuuaaauaaacuu

SEQ ID NO: 2799388 - RNA, 16 nt, Human
uuuuuaaauaaacuuu

SEQ ID NO: 2799389 - RNA, 17 nt, Human
uuuuuaaauaaacuuuu

SEQ ID NO: 2799390 - RNA, 23 nt, Human
uuuuuaaauaaacuuuuuuucaa

SEQ ID NO: 2799391 - RNA, 11 nt, Human
uuuuguauaca

SEQ ID NO: 2799392 - RNA, 13 nt, Human
uuuuguauacaaa

SEQ ID NO: 2799393 - RNA, 15 nt, Human
uuuuguauacaaaua

SEQ ID NO: 2799394 - RNA, 19 nt, Human
uuuuguauacaaauauauu

SEQ ID NO: 2799395 - RNA, 21 nt, Human
uuuuguauacaaauauauugu

SEQ ID NO: 2799396 - RNA, 13 nt, Human
uuuuguauacauc

SEQ ID NO: 2799397 - RNA, 19 nt, Human
uuuuguauacauccugggu

SEQ ID NO: 2799398 - RNA, 13 nt, Human
uuuuguauauauc

SEQ ID NO: 2799399 - RNA, 19 nt, Human
uuuuguaucuacaucuuuu

SEQ ID NO: 2799400 - RNA, 13 nt, Human
uuuuguaucuuaa

SEQ ID NO: 2799401 - RNA, 14 nt, Human
uuuuguaucuacau

SEQ ID NO: 2799402 - RNA, 17 nt, Human
uuuuguauaguaaagug

SEQ ID NO: 2799403 - RNA, 16 nt, Human
uuuuguauaguaaagu

SEQ ID NO: 2799404 - RNA, 18 nt, Human
uuuuguauaguaaaguga

SEQ ID NO: 2799405 - RNA, 14 nt, Human
uuuuguaauugcuu

SEQ ID NO: 2799406 - RNA, 22 nt, Human
uuuuguaggggucaaagaaaug

SEQ ID NO: 2799407 - RNA, 23 nt, Human
uuuuguaggggucaaagaaaugc

SEQ ID NO: 2799408 - RNA, 19 nt, Human
uuuuguagagccagggucu

SEQ ID NO: 2799409 - RNA, 12 nt, Human
uuuuguacaucu

SEQ ID NO: 2799410 - RNA, 18 nt, Human
uuuuguacaucuggcuua

SEQ ID NO: 2799411 - RNA, 21 nt, Human
uuuuguacaucuggcuuauuu

SEQ ID NO: 2799412 - RNA, 19 nt, Human
uuuuguaaagaaauuuacu

SEQ ID NO: 2799413 - RNA, 13 nt, Human
uuuuguaaugaau

SEQ ID NO: 2799414 - RNA, 19 nt, Human
uuuuguaaacgacaagaau

SEQ ID NO: 2799415 - RNA, 21 nt, Human
uuuuguaaacgacaagaauaa

SEQ ID NO: 2799416 - RNA, 16 nt, Human
uuuugguuguccucaa

SEQ ID NO: 2799417 - RNA, 13 nt, Human
uuuugguguguug

SEQ ID NO: 2799418 - RNA, 14 nt, Human
uuuuggucuuuuug

SEQ ID NO: 2799419 - RNA, 17 nt, Human
uuuuggugauucaaaug

SEQ ID NO: 2799420 - RNA, 21 nt, Human
uuuuguaaaucacauccuuau

SEQ ID NO: 2799421 - RNA, 13 nt, Human
uuuuguaaauuaa

SEQ ID NO: 2799422 - RNA, 14 nt, Human
uuuuguaagacaaa

SEQ ID NO: 2799423 - RNA, 15 nt, Human
uuuuguaaagaugcc

SEQ ID NO: 2799424 - RNA, 21 nt, Human
uuuuguaaagaugccggguuu

SEQ ID NO: 2799425 - RNA, 18 nt, Human
uuuuguaaacucaaaaua

SEQ ID NO: 2799426 - RNA, 21 nt, Human
uuuuguaaacuggaauuaaaa

SEQ ID NO: 2799427 - RNA, 16 nt, Human
gucagcucucaucuga

SEQ ID NO: 2799428 - RNA, 19 nt, Human
gucagcucucaucugaggc

SEQ ID NO: 2799429 - RNA, 15 nt, Human
gucauguuugcaggg

SEQ ID NO: 2799430 - RNA, 16 nt, Human
gucauguuugcagggg

SEQ ID NO: 2799431 - RNA, 23 nt, Human
gucauguuugcaggggugacggc

SEQ ID NO: 2799432 - RNA, 16 nt, Human
gucauguuuuaaaugu

SEQ ID NO: 2799433 - RNA, 17 nt, Human
gucauguuuuaaaugua

SEQ ID NO: 2799434 - RNA, 20 nt, Human
gucauguuuuaaauguacag

SEQ ID NO: 2799435 - RNA, 21 nt, Human
gucauguuuuaaauguacagu

SEQ ID NO: 2799436 - RNA, 11 nt, Human
gucauuaaaug

SEQ ID NO: 2799437 - RNA, 17 nt, Human
gucaggaaacccagucg

SEQ ID NO: 2799438 - RNA, 18 nt, Human
gucauugcaguuuaagag

SEQ ID NO: 2799439 - RNA, 11 nt, Human
gucauugcugu

SEQ ID NO: 2799440 - RNA, 15 nt, Human
gucauugcuguagga

SEQ ID NO: 2799441 - RNA, 21 nt, Human
gucauuauggguuaggcauua

SEQ ID NO: 2799442 - RNA, 16 nt, Human
gucauuagacuccucc

SEQ ID NO: 2799443 - RNA, 13 nt, Human
gucauuaaugugu

SEQ ID NO: 2799444 - RNA, 14 nt, Human
gucauuaauguguu

SEQ ID NO: 2799445 - RNA, 17 nt, Human
gucauuccuucuuuuua

SEQ ID NO: 2799446 - RNA, 20 nt, Human
gucauuguaaacaaacucuu

SEQ ID NO: 2799447 - RNA, 15 nt, Human
gucauuguauguuau

SEQ ID NO: 2799448 - RNA, 13 nt, Human
gucauuuaaaugu

SEQ ID NO: 2799449 - RNA, 13 nt, Human
guccagccugggc

SEQ ID NO: 2799450 - RNA, 11 nt, Human
guccagccugg

SEQ ID NO: 2799451 - RNA, 18 nt, Human
guccaggggaggccuucc

SEQ ID NO: 2799452 - RNA, 14 nt, Human
guccagcagucacu

SEQ ID NO: 2799453 - RNA, 15 nt, Human
guccagcccaucucg

SEQ ID NO: 2799454 - RNA, 19 nt, Human
guccagcccaucucggagc

SEQ ID NO: 2799455 - RNA, 22 nt, Human
guccagccgccauugccaccag

SEQ ID NO: 2799456 - RNA, 20 nt, Human
guccagccgccauugccacc

SEQ ID NO: 2799457 - RNA, 21 nt, Human
gucccaccuuggcugcaggga

SEQ ID NO: 2799458 - RNA, 12 nt, Human
guccacccagga

SEQ ID NO: 2799459 - RNA, 13 nt, Human
guccacaggaagu

SEQ ID NO: 2799460 - RNA, 23 nt, Human
guccacccaggagccccgaggcc

SEQ ID NO: 2799461 - RNA, 13 nt, Human
guccaccuguggg

SEQ ID NO: 2799462 - RNA, 14 nt, Human
guccaccugugggu

SEQ ID NO: 2799463 - RNA, 23 nt, Human
guccaccuguggguguagccagg

SEQ ID NO: 2799464 - RNA, 20 nt, Human
guccacccaccuaugugcca

SEQ ID NO: 2799465 - RNA, 21 nt, Human
guccagagcggaggcugugug

SEQ ID NO: 2799466 - RNA, 21 nt, Human
gucccuaccgagucucuucuc

SEQ ID NO: 2799467 - RNA, 22 nt, Human
gucccuaccgagucucuucucc

SEQ ID NO: 2799468 - RNA, 23 nt, Human
gucccuaccgagucucuucucca

SEQ ID NO: 2799469 - RNA, 22 nt, Human
gucccuauguauuugcaguuca

SEQ ID NO: 2799470 - RNA, 12 nt, Human
gucccucccacc

SEQ ID NO: 2799471 - RNA, 21 nt, Human
gucccucccaccucugugacc

SEQ ID NO: 2799472 - RNA, 12 nt, Human
gucccuccuggu

SEQ ID NO: 2799473 - RNA, 19 nt, Human
gucccuccuggugucaccc

SEQ ID NO: 2799474 - RNA, 21 nt, Human
gucccuccuggugucacccca

SEQ ID NO: 2799475 - RNA, 22 nt, Human
gucccuccuggugucaccccag

SEQ ID NO: 2799476 - RNA, 23 nt, Human
gucccuccuggugucaccccaga

SEQ ID NO: 2799477 - RNA, 16 nt, Human
gucccucccccuuguc

SEQ ID NO: 2799478 - RNA, 17 nt, Human
gucccucccaccucugu

SEQ ID NO: 2799479 - RNA, 18 nt, Human
gucccucccaccucugug

SEQ ID NO: 2799480 - RNA, 13 nt, Human
gucccucccaccu

SEQ ID NO: 2799481 - RNA, 14 nt, Human
gucccucccaccuc

SEQ ID NO: 2799482 - RNA, 15 nt, Human
gucccucccaccucu

SEQ ID NO: 2799483 - RNA, 16 nt, Human
gucccucccaccucug

SEQ ID NO: 2799484 - RNA, 21 nt, Human
gucccugcacuugcagacucu

SEQ ID NO: 2799485 - RNA, 19 nt, Human
gucccugcacuugcagacu

SEQ ID NO: 2799486 - RNA, 16 nt, Human
gucccugcacuugcag

SEQ ID NO: 2799487 - RNA, 20 nt, Human
gucccugacucucugugacc

SEQ ID NO: 2799488 - RNA, 18 nt, Human
gucccugacucucuguga

SEQ ID NO: 2799489 - RNA, 17 nt, Human
gucccugacucucugug

SEQ ID NO: 2799490 - RNA, 21 nt, Human
gucccucucggaaggcuggcu

SEQ ID NO: 2799491 - RNA, 23 nt, Human
gucccaccuuggcugcagggagu

SEQ ID NO: 2799492 - RNA, 20 nt, Human
gucccaccuuggcugcaggg

SEQ ID NO: 2799493 - RNA, 22 nt, Human
gucccacgaauuugcuggggaa

SEQ ID NO: 2799494 - RNA, 13 nt, Human
gucccacgugucu

SEQ ID NO: 2799495 - RNA, 14 nt, Human
gucccacgugucuu

SEQ ID NO: 2799496 - RNA, 16 nt, Human
gucccacgugucuucc

SEQ ID NO: 2799497 - RNA, 18 nt, Human
gucccacgugucuuccac

SEQ ID NO: 2799498 - RNA, 21 nt, Human
gucccacgugucuuccacuuu

SEQ ID NO: 2799499 - RNA, 12 nt, Human
gucccaggcaga

SEQ ID NO: 2799500 - RNA, 20 nt, Human
gucccacgaauuugcugggg

SEQ ID NO: 2799501 - RNA, 15 nt, Human
gucccaggcugagcc

SEQ ID NO: 2799502 - RNA, 17 nt, Human
gucccaggcugagccuc

SEQ ID NO: 2799503 - RNA, 16 nt, Human
gucccaggcugagccu

SEQ ID NO: 2799504 - RNA, 19 nt, Human
gucccaggcugagccucag

SEQ ID NO: 2799505 - RNA, 18 nt, Human
gucccaggcugagccuca

SEQ ID NO: 2799506 - RNA, 21 nt, Human
gucccaucacguguacuggcu

SEQ ID NO: 2799507 - RNA, 22 nt, Human
gucccauugguguugucauugu

SEQ ID NO: 2799508 - RNA, 13 nt, Human
gucccauguggug

SEQ ID NO: 2799509 - RNA, 23 nt, Human
gucccauggacacuccagugcca

SEQ ID NO: 2799510 - RNA, 16 nt, Human
gucccaugcaggcccu

SEQ ID NO: 2799511 - RNA, 21 nt, Human
gucccauggacacuccagugc

SEQ ID NO: 2799512 - RNA, 22 nt, Human
gucccauggacacuccagugcc

SEQ ID NO: 2799513 - RNA, 21 nt, Human
gucaagucucugcuggcccag

SEQ ID NO: 2799514 - RNA, 20 nt, Human
gucaagggcuuacuauuucu

SEQ ID NO: 2799515 - RNA, 17 nt, Human
gucaagucucugcuggc

SEQ ID NO: 2799516 - RNA, 14 nt, Human
gucaagucucugcu

SEQ ID NO: 2799517 - RNA, 22 nt, Human
gucaauccaagagucugaugau

SEQ ID NO: 2799518 - RNA, 22 nt, Human
gucaauccagauggugggaugu

SEQ ID NO: 2799519 - RNA, 17 nt, Human
gucaaucccaaaaguca

SEQ ID NO: 2799520 - RNA, 20 nt, Human
gucaaucccaaaagucacca

SEQ ID NO: 2799521 - RNA, 14 nt, Human
gucaaucauuucuc

SEQ ID NO: 2799522 - RNA, 15 nt, Human
gucaaucauuucuca

SEQ ID NO: 2799523 - RNA, 16 nt, Human
gucaaucauuucucac

SEQ ID NO: 2799524 - RNA, 12 nt, Human
gucaccaguggc

SEQ ID NO: 2799525 - RNA, 18 nt, Human
gucaccacuccauuccca

SEQ ID NO: 2799526 - RNA, 16 nt, Human
guauuaaucuuggaua

SEQ ID NO: 2799527 - RNA, 15 nt, Human
guauuaauaaauaga

SEQ ID NO: 2799528 - RNA, 18 nt, Human
guauuaauaaauagagca

SEQ ID NO: 2799529 - RNA, 19 nt, Human
guauuaauaaauagagcaa

SEQ ID NO: 2799530 - RNA, 21 nt, Human
guauuaauaaauagagcaauu

SEQ ID NO: 2799531 - RNA, 14 nt, Human
guauuaauacuaaa

SEQ ID NO: 2799532 - RNA, 15 nt, Human
guauuaauacuaaaa

SEQ ID NO: 2799533 - RNA, 16 nt, Human
guauuaauacuaaaau

SEQ ID NO: 2799534 - RNA, 19 nt, Human
guauuaauacuaaaauaug

SEQ ID NO: 2799535 - RNA, 21 nt, Human
guauuaauacuaaaauauguc

SEQ ID NO: 2799536 - RNA, 22 nt, Human
guauuaauacuaaaauaugucu

SEQ ID NO: 2799537 - RNA, 15 nt, Human
guauuaagggauuua

SEQ ID NO: 2799538 - RNA, 18 nt, Human
guauuaagucaagaauau

SEQ ID NO: 2799539 - RNA, 21 nt, Human
guauuuuaguaagagauuccu

SEQ ID NO: 2799540 - RNA, 15 nt, Human
guauuuuaaaagcca

SEQ ID NO: 2799541 - RNA, 12 nt, Human
guauuuugaagu

SEQ ID NO: 2799542 - RNA, 13 nt, Human
guauuuugaaguu

SEQ ID NO: 2799543 - RNA, 14 nt, Human
guauuuugaaguuu

SEQ ID NO: 2799544 - RNA, 18 nt, Human
guauuuugaaguuuacau

SEQ ID NO: 2799545 - RNA, 19 nt, Human
guauuuugaaguuuacauu

SEQ ID NO: 2799546 - RNA, 20 nt, Human
guauuuugaaguuuacauuu

SEQ ID NO: 2799547 - RNA, 11 nt, Human
guauuuugaau

SEQ ID NO: 2799548 - RNA, 15 nt, Human
guauuuugaauacca

SEQ ID NO: 2799549 - RNA, 16 nt, Human
guauuuugaauaccau

SEQ ID NO: 2799550 - RNA, 17 nt, Human
guauuuuggagaaauua

SEQ ID NO: 2799551 - RNA, 12 nt, Human
guauuuugugug

SEQ ID NO: 2799552 - RNA, 18 nt, Human
guauuuugugugaccaac

SEQ ID NO: 2799553 - RNA, 23 nt, Human
guauuuugugugaccaacugugu

SEQ ID NO: 2799554 - RNA, 14 nt, Human
guauuuuggagaaa

SEQ ID NO: 2799555 - RNA, 23 nt, Human
gucagcuagaucauuuguucugg

SEQ ID NO: 2799556 - RNA, 22 nt, Human
gucagaugcugugcaaauguua

SEQ ID NO: 2799557 - RNA, 14 nt, Human
gucagaugagaaca

SEQ ID NO: 2799558 - RNA, 15 nt, Human
gucagaugagaacaa

SEQ ID NO: 2799559 - RNA, 16 nt, Human
gucagaugagaacaaa

SEQ ID NO: 2799560 - RNA, 18 nt, Human
gucagaugagaacaaagc

SEQ ID NO: 2799561 - RNA, 21 nt, Human
gucagaugagaacaaagcugu

SEQ ID NO: 2799562 - RNA, 22 nt, Human
gucagaugagaacaaagcuguu

SEQ ID NO: 2799563 - RNA, 15 nt, Human
gucagauacaaugua

SEQ ID NO: 2799564 - RNA, 16 nt, Human
gucagagccugcaguu

SEQ ID NO: 2799565 - RNA, 15 nt, Human
gucagagccugcagu

SEQ ID NO: 2799566 - RNA, 15 nt, Human
gucagaggaccugua

SEQ ID NO: 2799567 - RNA, 16 nt, Human
gucagaggagagauag

SEQ ID NO: 2799568 - RNA, 21 nt, Human
gucagaggagagauagccugu

SEQ ID NO: 2799569 - RNA, 22 nt, Human
gucagaggagagauagccugug

SEQ ID NO: 2799570 - RNA, 23 nt, Human
gucagaggagagauagccugugg

SEQ ID NO: 2799571 - RNA, 14 nt, Human
gucagagccugcag

SEQ ID NO: 2799572 - RNA, 22 nt, Human
gucagacuggcuggcugcagug

SEQ ID NO: 2799573 - RNA, 18 nt, Human
gucagacuggcuggcugc

SEQ ID NO: 2799574 - RNA, 14 nt, Human
gucagacuggcugg

SEQ ID NO: 2799575 - RNA, 24 nt, Human
gucagacugcugggacuggccagg

SEQ ID NO: 2799576 - RNA, 22 nt, Human
gucagacugcugggacuggcca

SEQ ID NO: 2799577 - RNA, 20 nt, Human
gucagacugcugggacuggc

SEQ ID NO: 2799578 - RNA, 16 nt, Human
gucagacugcugggac

SEQ ID NO: 2799579 - RNA, 15 nt, Human
gucagacugcuggga

SEQ ID NO: 2799580 - RNA, 14 nt, Human
gucagacugcuggg

SEQ ID NO: 2799581 - RNA, 15 nt, Human
gucagacuaagaaau

SEQ ID NO: 2799582 - RNA, 14 nt, Human
gucacuaauacaca

SEQ ID NO: 2799583 - RNA, 15 nt, Human
gucaccccuccagga

SEQ ID NO: 2799584 - RNA, 20 nt, Human
gucaccccuccaggaaugau

SEQ ID NO: 2799585 - RNA, 18 nt, Human
gucacucauugcugagcc

SEQ ID NO: 2799586 - RNA, 19 nt, Human
gucacucauugcugagccu

SEQ ID NO: 2799587 - RNA, 20 nt, Human
gucacucauugcugagccuc

SEQ ID NO: 2799588 - RNA, 21 nt, Human
gucacucauugcugagccucu

SEQ ID NO: 2799589 - RNA, 22 nt, Human
gucacucauugcugagccucug

SEQ ID NO: 2799590 - RNA, 23 nt, Human
gucacucauugcugagccucugc

SEQ ID NO: 2799591 - RNA, 24 nt, Human
gucacucauugcugagccucugcu

SEQ ID NO: 2799592 - RNA, 14 nt, Human
gucacucauugcug

SEQ ID NO: 2799593 - RNA, 14 nt, Human
gucacucaggcugg

SEQ ID NO: 2799594 - RNA, 15 nt, Human
gucacucaggcugga

SEQ ID NO: 2799595 - RNA, 12 nt, Human
gucacuagaaug

SEQ ID NO: 2799596 - RNA, 19 nt, Human
guaguguaagcuagaagaa

SEQ ID NO: 2799597 - RNA, 19 nt, Human
guaguguccauuuugugaa

SEQ ID NO: 2799598 - RNA, 20 nt, Human
guaguguccauuuugugaag

SEQ ID NO: 2799599 - RNA, 23 nt, Human
guaguguccauuuugugaagccc

SEQ ID NO: 2799600 - RNA, 14 nt, Human
guaguccuuggcau

SEQ ID NO: 2799601 - RNA, 21 nt, Human
guaguccuuggcauagacaug

SEQ ID NO: 2799602 - RNA, 12 nt, Human
guagucccagcu

SEQ ID NO: 2799603 - RNA, 17 nt, Human
guagucauuuacuaaac

SEQ ID NO: 2799604 - RNA, 12 nt, Human
guagucuugaug

SEQ ID NO: 2799605 - RNA, 13 nt, Human
guagucugcucac

SEQ ID NO: 2799606 - RNA, 13 nt, Human
guagugagcagug

SEQ ID NO: 2799607 - RNA, 16 nt, Human
guagucuugaugacca

SEQ ID NO: 2799608 - RNA, 22 nt, Human
guagugaaauaauagaaugagc

SEQ ID NO: 2799609 - RNA, 22 nt, Human
guagugugggaggcuccuguua

SEQ ID NO: 2799610 - RNA, 15 nt, Human
guauacaaauauauu

SEQ ID NO: 2799611 - RNA, 19 nt, Human
guauacaaauauauuguua

SEQ ID NO: 2799612 - RNA, 19 nt, Human
guauacaacccuggcauua

SEQ ID NO: 2799613 - RNA, 14 nt, Human
guauaauuucgaga

SEQ ID NO: 2799614 - RNA, 17 nt, Human
guauaauuucgagauuu

SEQ ID NO: 2799615 - RNA, 18 nt, Human
guauaauuucgagauuug

SEQ ID NO: 2799616 - RNA, 21 nt, Human
guauaauuucgagauuuguag

SEQ ID NO: 2799617 - RNA, 19 nt, Human
guauaccggaauuacuuuu

SEQ ID NO: 2799618 - RNA, 19 nt, Human
guauacaguucaauaaacu

SEQ ID NO: 2799619 - RNA, 17 nt, Human
guauacauccuggguaa

SEQ ID NO: 2799620 - RNA, 18 nt, Human
guauacauccuggguaau

SEQ ID NO: 2799621 - RNA, 20 nt, Human
guauacauccuggguaauga

SEQ ID NO: 2799622 - RNA, 14 nt, Human
guauacaauauaua

SEQ ID NO: 2799623 - RNA, 15 nt, Human
guauacaauauauaa

SEQ ID NO: 2799624 - RNA, 17 nt, Human
guauacaauauauaaaa

SEQ ID NO: 2799625 - RNA, 18 nt, Human
guauacaauauauaaaaa

SEQ ID NO: 2799626 - RNA, 19 nt, Human
guauacaauauauaaaaau

SEQ ID NO: 2799627 - RNA, 21 nt, Human
guauacaauauauaaaaauau

SEQ ID NO: 2799628 - RNA, 22 nt, Human
guauacaauauauaaaaauaua

SEQ ID NO: 2799629 - RNA, 23 nt, Human
guauacaccauauacuguucuuc

SEQ ID NO: 2799630 - RNA, 15 nt, Human
guauacuauaguacc

SEQ ID NO: 2799631 - RNA, 16 nt, Human
guaguauaaagaaaag

SEQ ID NO: 2799632 - RNA, 22 nt, Human
guaguagcguuuuuuaaaugua

SEQ ID NO: 2799633 - RNA, 15 nt, Human
guaguauucuucccu

SEQ ID NO: 2799634 - RNA, 15 nt, Human
guaguaaaacacaga

SEQ ID NO: 2799635 - RNA, 17 nt, Human
guaguaaaacacagagg

SEQ ID NO: 2799636 - RNA, 17 nt, Human
guaguagcccuuucugu

SEQ ID NO: 2799637 - RNA, 20 nt, Human
guaguagcccuuucugugug

SEQ ID NO: 2799638 - RNA, 21 nt, Human
guaguagcccuuucugugugc

SEQ ID NO: 2799639 - RNA, 15 nt, Human
guaguaauugacaug

SEQ ID NO: 2799640 - RNA, 22 nt, Human
guagggugggccuucagggagu

SEQ ID NO: 2799641 - RNA, 17 nt, Human
guagggugggccuucag

SEQ ID NO: 2799642 - RNA, 20 nt, Human
guagguacuuuuugugaaga

SEQ ID NO: 2799643 - RNA, 22 nt, Human
guagguacuuuuugugaagacg

SEQ ID NO: 2799644 - RNA, 14 nt, Human
guagguaaaaugua

SEQ ID NO: 2799645 - RNA, 18 nt, Human
guagguaaaauguauuuu

SEQ ID NO: 2799646 - RNA, 20 nt, Human
guagguaaaauguauuuuuc

SEQ ID NO: 2799647 - RNA, 22 nt, Human
guagguaaaauguauuuuucua

SEQ ID NO: 2799648 - RNA, 14 nt, Human
guagggugggccuu

SEQ ID NO: 2799649 - RNA, 20 nt, Human
guaggggucaaagaaaugcu

SEQ ID NO: 2799650 - RNA, 22 nt, Human
guaggggcuuauaauaaaggac

SEQ ID NO: 2799651 - RNA, 18 nt, Human
guagaguuaagaagcugu

SEQ ID NO: 2799652 - RNA, 12 nt, Human
guagaguuaaga

SEQ ID NO: 2799653 - RNA, 14 nt, Human
guagaguuaagaag

SEQ ID NO: 2799654 - RNA, 15 nt, Human
guagaguuaagaagc

SEQ ID NO: 2799655 - RNA, 16 nt, Human
guagaguuaagaagcu

SEQ ID NO: 2799656 - RNA, 17 nt, Human
guagaguuaagaagcug

SEQ ID NO: 2799657 - RNA, 13 nt, Human
guagauauuacuu

SEQ ID NO: 2799658 - RNA, 15 nt, Human
guagauauuacuuua

SEQ ID NO: 2799659 - RNA, 17 nt, Human
guagauauuacuuuauc

SEQ ID NO: 2799660 - RNA, 18 nt, Human
guagauauuacuuuauca

SEQ ID NO: 2799661 - RNA, 15 nt, Human
guagauaaauauuug

SEQ ID NO: 2799662 - RNA, 13 nt, Human
guagauauuuggc

SEQ ID NO: 2799663 - RNA, 14 nt, Human
guagauauuuggcu

SEQ ID NO: 2799664 - RNA, 21 nt, Human
guagauauuuggcuuaaauau

SEQ ID NO: 2799665 - RNA, 15 nt, Human
guagaugcgcagccc

SEQ ID NO: 2799666 - RNA, 23 nt, Human
guagcagugugaaguacaauaau

SEQ ID NO: 2799667 - RNA, 19 nt, Human
guagcagggucgggaaagg

SEQ ID NO: 2799668 - RNA, 14 nt, Human
guagcacucaggcu

SEQ ID NO: 2799669 - RNA, 17 nt, Human
guagcacucaggcucuc

SEQ ID NO: 2799670 - RNA, 19 nt, Human
guagauucuguggaacaag

SEQ ID NO: 2799671 - RNA, 13 nt, Human
guagauucugugg

SEQ ID NO: 2799672 - RNA, 16 nt, Human
guagauucuguggaac

SEQ ID NO: 2799673 - RNA, 19 nt, Human
guagccaaggugggcugag

SEQ ID NO: 2799674 - RNA, 18 nt, Human
guagccaaggugggcuga

SEQ ID NO: 2799675 - RNA, 14 nt, Human
guagccaaagguuc

SEQ ID NO: 2799676 - RNA, 16 nt, Human
guagcccccuggccuc

SEQ ID NO: 2799677 - RNA, 17 nt, Human
guagcccccuggccucu

SEQ ID NO: 2799678 - RNA, 20 nt, Human
guagcccacucugcucgccu

SEQ ID NO: 2799679 - RNA, 14 nt, Human
guagcccaggcugg

SEQ ID NO: 2799680 - RNA, 15 nt, Human
guagcccaggcugga

SEQ ID NO: 2799681 - RNA, 17 nt, Human
guagcccauccuucccu

SEQ ID NO: 2799682 - RNA, 16 nt, Human
guagcccacucugcuc

SEQ ID NO: 2799683 - RNA, 20 nt, Human
guagccauguuaacaugaca

SEQ ID NO: 2799684 - RNA, 14 nt, Human
guagccagcaccug

SEQ ID NO: 2799685 - RNA, 19 nt, Human
guagccagggggacuagcc

SEQ ID NO: 2799686 - RNA, 22 nt, Human
guagccagggggacuagccccu

SEQ ID NO: 2799687 - RNA, 18 nt, Human
guagccagguauggcucu

SEQ ID NO: 2799688 - RNA, 20 nt, Human
guagccaggucccccugcag

SEQ ID NO: 2799689 - RNA, 21 nt, Human
guagccaggucccccugcagc

SEQ ID NO: 2799690 - RNA, 22 nt, Human
guagccaggucccccugcagcu

SEQ ID NO: 2799691 - RNA, 23 nt, Human
guagccagggggacuagccccug

SEQ ID NO: 2799692 - RNA, 22 nt, Human
guagggcgggaggauguucugg

SEQ ID NO: 2799693 - RNA, 21 nt, Human
guagggcgggaggauguucug

SEQ ID NO: 2799694 - RNA, 23 nt, Human
guagggcgggaggauguucuggg

SEQ ID NO: 2799695 - RNA, 21 nt, Human
guagggcugccaccaagguga

SEQ ID NO: 2799696 - RNA, 12 nt, Human
guagggcugacu

SEQ ID NO: 2799697 - RNA, 16 nt, Human
guagggcgggaggaug

SEQ ID NO: 2799698 - RNA, 13 nt, Human
guagggaauaaaa

SEQ ID NO: 2799699 - RNA, 16 nt, Human
guagggaggaccacag

SEQ ID NO: 2799700 - RNA, 13 nt, Human
guagggaggcagc

SEQ ID NO: 2799701 - RNA, 14 nt, Human
guagggaggcagcc

SEQ ID NO: 2799702 - RNA, 15 nt, Human
guagggaggcagccu

SEQ ID NO: 2799703 - RNA, 16 nt, Human
guagggaggcagccuc

SEQ ID NO: 2799704 - RNA, 23 nt, Human
guaggcuccugccaguguggaac

SEQ ID NO: 2799705 - RNA, 18 nt, Human
guagcccccuggccucug

SEQ ID NO: 2799706 - RNA, 19 nt, Human
guagcccccuggccucugu

SEQ ID NO: 2799707 - RNA, 23 nt, Human
guagcccccuggccucugugccu

SEQ ID NO: 2799708 - RNA, 13 nt, Human
guauguguguaga

SEQ ID NO: 2799709 - RNA, 21 nt, Human
guaugaucacggcucacugca

SEQ ID NO: 2799710 - RNA, 20 nt, Human
guaugaucacggcucacugc

SEQ ID NO: 2799711 - RNA, 17 nt, Human
guauguugaagccuuug

SEQ ID NO: 2799712 - RNA, 11 nt, Human
guauguugucc

SEQ ID NO: 2799713 - RNA, 18 nt, Human
guauguuguccaauuguu

SEQ ID NO: 2799714 - RNA, 21 nt, Human
guauguuguccaauuguugac

SEQ ID NO: 2799715 - RNA, 19 nt, Human
guauguuuaaucuguuaug

SEQ ID NO: 2799716 - RNA, 15 nt, Human
guauguuuuacacug

SEQ ID NO: 2799717 - RNA, 23 nt, Human
guauuaaaacauuggauuauccu

SEQ ID NO: 2799718 - RNA, 12 nt, Human
guauuaaaacau

SEQ ID NO: 2799719 - RNA, 13 nt, Human
guauuaaaacauu

SEQ ID NO: 2799720 - RNA, 14 nt, Human
guauuaaaacauug

SEQ ID NO: 2799721 - RNA, 15 nt, Human
guauuaaaacauugg

SEQ ID NO: 2799722 - RNA, 17 nt, Human
guauuaaaacauuggau

SEQ ID NO: 2799723 - RNA, 20 nt, Human
guauuaaaacauuggauuau

SEQ ID NO: 2799724 - RNA, 14 nt, Human
guaugaaagauugu

SEQ ID NO: 2799725 - RNA, 18 nt, Human
guaugaauaaagacaccu

SEQ ID NO: 2799726 - RNA, 19 nt, Human
guaugaauaaagacaccua

SEQ ID NO: 2799727 - RNA, 19 nt, Human
guaugaacuuuaucuaaag

SEQ ID NO: 2799728 - RNA, 19 nt, Human
guaugaagagcuugcuuug

SEQ ID NO: 2799729 - RNA, 16 nt, Human
guaugacgcugauaca

SEQ ID NO: 2799730 - RNA, 17 nt, Human
guaugacgcugauacau

SEQ ID NO: 2799731 - RNA, 19 nt, Human
guaugacgcugauacauaa

SEQ ID NO: 2799732 - RNA, 15 nt, Human
guaugaauacagcag

SEQ ID NO: 2799733 - RNA, 20 nt, Human
guaugaauacagcagcaaga

SEQ ID NO: 2799734 - RNA, 13 nt, Human
guaugaaggcuuu

SEQ ID NO: 2799735 - RNA, 14 nt, Human
guaucugaguugcc

SEQ ID NO: 2799736 - RNA, 15 nt, Human
guaucugaguugcca

SEQ ID NO: 2799737 - RNA, 17 nt, Human
guaucugaguugccaag

SEQ ID NO: 2799738 - RNA, 18 nt, Human
guaucugaguugccaaga

SEQ ID NO: 2799739 - RNA, 20 nt, Human
guaucugaguugccaagaca

SEQ ID NO: 2799740 - RNA, 22 nt, Human
guaucugaguugccaagacaaa

SEQ ID NO: 2799741 - RNA, 23 nt, Human
guaucugaguugccaagacaaau

SEQ ID NO: 2799742 - RNA, 14 nt, Human
guaugaaaaugagu

SEQ ID NO: 2799743 - RNA, 20 nt, Human
guaugaaaaugaguugugaa

SEQ ID NO: 2799744 - RNA, 20 nt, Human
guaucugugaaguaguucug

SEQ ID NO: 2799745 - RNA, 16 nt, Human
guaucuuuuuucaaaa

SEQ ID NO: 2799746 - RNA, 22 nt, Human
guaugaaagauggcugugccuc

SEQ ID NO: 2799747 - RNA, 23 nt, Human
guaugaaagauggcugugccucu

SEQ ID NO: 2799748 - RNA, 17 nt, Human
guaucuuucuaugcugc

SEQ ID NO: 2799749 - RNA, 19 nt, Human
guaucuuucuaugcugcuu

SEQ ID NO: 2799750 - RNA, 20 nt, Human
guaucuuucuaugcugcuuu

SEQ ID NO: 2799751 - RNA, 18 nt, Human
guaucuuugcacuccaau

SEQ ID NO: 2799752 - RNA, 13 nt, Human
guaucuuaaauuu

SEQ ID NO: 2799753 - RNA, 17 nt, Human
guaucuuccauauuugg

SEQ ID NO: 2799754 - RNA, 19 nt, Human
guaucuuccauauuuggaa

SEQ ID NO: 2799755 - RNA, 20 nt, Human
guaucuuccauauuuggaag

SEQ ID NO: 2799756 - RNA, 21 nt, Human
guaucuuccauauuuggaaga

SEQ ID NO: 2799757 - RNA, 22 nt, Human
guaucuuccauauuuggaagaa

SEQ ID NO: 2799758 - RNA, 12 nt, Human
guauacuuuaaa

SEQ ID NO: 2799759 - RNA, 13 nt, Human
guauacuuuaaau

SEQ ID NO: 2799760 - RNA, 20 nt, Human
guauacuuuaaauaauuuaa

SEQ ID NO: 2799761 - RNA, 22 nt, Human
guauacuuuaaauaauuuaacu

SEQ ID NO: 2799762 - RNA, 23 nt, Human
guauacuuuaaauaauuuaacua

SEQ ID NO: 2799763 - RNA, 12 nt, Human
guauacuuuagu

SEQ ID NO: 2799764 - RNA, 13 nt, Human
guauacuuuagua

SEQ ID NO: 2799765 - RNA, 14 nt, Human
guauacuuuaguau

SEQ ID NO: 2799766 - RNA, 15 nt, Human
guauagacaguuugu

SEQ ID NO: 2799767 - RNA, 17 nt, Human
guauagacaguuuguaa

SEQ ID NO: 2799768 - RNA, 19 nt, Human
guauagacaguuuguaaau

SEQ ID NO: 2799769 - RNA, 22 nt, Human
guauagacaguuuguaaauguu

SEQ ID NO: 2799770 - RNA, 23 nt, Human
guauagacaguuuguaaauguua

SEQ ID NO: 2799771 - RNA, 21 nt, Human
guauagccuauggcagaaaaa

SEQ ID NO: 2799772 - RNA, 23 nt, Human
guauagccuauggcagaaaaaau

SEQ ID NO: 2799773 - RNA, 19 nt, Human
guauaguacuggcauggua

SEQ ID NO: 2799774 - RNA, 19 nt, Human
guauaguuaggauagcauu

SEQ ID NO: 2799775 - RNA, 13 nt, Human
guauaguguaaaa

SEQ ID NO: 2799776 - RNA, 14 nt, Human
guauaguguaaaau

SEQ ID NO: 2799777 - RNA, 15 nt, Human
guauaguguaaaaua

SEQ ID NO: 2799778 - RNA, 16 nt, Human
guauaguguaaaauaa

SEQ ID NO: 2799779 - RNA, 19 nt, Human
guauaguugauguaacauu

SEQ ID NO: 2799780 - RNA, 13 nt, Human
guauaguugcuuu

SEQ ID NO: 2799781 - RNA, 16 nt, Human
guauauacgcaucuau

SEQ ID NO: 2799782 - RNA, 13 nt, Human
guauauaaauggg

SEQ ID NO: 2799783 - RNA, 20 nt, Human
guauauaaaugggaacauuu

SEQ ID NO: 2799784 - RNA, 21 nt, Human
guauauaaaugggaacauuua

SEQ ID NO: 2799785 - RNA, 12 nt, Human
guauauacacau

SEQ ID NO: 2799786 - RNA, 13 nt, Human
guauauacacaua

SEQ ID NO: 2799787 - RNA, 14 nt, Human
guauauacacauau

SEQ ID NO: 2799788 - RNA, 15 nt, Human
guauauacacauaua

SEQ ID NO: 2799789 - RNA, 16 nt, Human
guauauacacauauac

SEQ ID NO: 2799790 - RNA, 18 nt, Human
guauauacacauauaccu

SEQ ID NO: 2799791 - RNA, 15 nt, Human
guauauauaagaaag

SEQ ID NO: 2799792 - RNA, 17 nt, Human
guauauauaagaaagac

SEQ ID NO: 2799793 - RNA, 19 nt, Human
guauauauaagaaagacau

SEQ ID NO: 2799794 - RNA, 11 nt, Human
guauauauaca

SEQ ID NO: 2799795 - RNA, 13 nt, Human
guauauauacaua

SEQ ID NO: 2799796 - RNA, 12 nt, Human
guauauacuuuu

SEQ ID NO: 2799797 - RNA, 14 nt, Human
guauauauagaauc

SEQ ID NO: 2799798 - RNA, 13 nt, Human
guauauacuuuuu

SEQ ID NO: 2799799 - RNA, 15 nt, Human
guauauauacauaca

SEQ ID NO: 2799800 - RNA, 17 nt, Human
guauauauacauacacu

SEQ ID NO: 2799801 - RNA, 13 nt, Human
guauauaugugua

SEQ ID NO: 2799802 - RNA, 14 nt, Human
guauauauguguau

SEQ ID NO: 2799803 - RNA, 16 nt, Human
guauauauguguauau

SEQ ID NO: 2799804 - RNA, 20 nt, Human
guauauauguguauauauac

SEQ ID NO: 2799805 - RNA, 23 nt, Human
guauauauguguauauauacaua

SEQ ID NO: 2799806 - RNA, 22 nt, Human
guauauaucugcuucaguggag

SEQ ID NO: 2799807 - RNA, 13 nt, Human
guauauauuccca

SEQ ID NO: 2799808 - RNA, 14 nt, Human
guauauauucccaa

SEQ ID NO: 2799809 - RNA, 11 nt, Human
guauauauuua

SEQ ID NO: 2799810 - RNA, 21 nt, Human
guauaucugggcuggccaguu

SEQ ID NO: 2799811 - RNA, 14 nt, Human
guauaucugggcug

SEQ ID NO: 2799812 - RNA, 14 nt, Human
guauaucagaaaag

SEQ ID NO: 2799813 - RNA, 19 nt, Human
guauaucagaaaagggaag

SEQ ID NO: 2799814 - RNA, 12 nt, Human
guauaucaugua

SEQ ID NO: 2799815 - RNA, 24 nt, Human
guauaucauguaaagaaaugucuu

SEQ ID NO: 2799816 - RNA, 13 nt, Human
guauaugucucag

SEQ ID NO: 2799817 - RNA, 15 nt, Human
guauaugucucaggu

SEQ ID NO: 2799818 - RNA, 21 nt, Human
guauaugucucaggucccugc

SEQ ID NO: 2799819 - RNA, 16 nt, Human
guauauguugggugca

SEQ ID NO: 2799820 - RNA, 20 nt, Human
guaucuauauauguguaugu

SEQ ID NO: 2799821 - RNA, 17 nt, Human
guaucucugaagcaugu

SEQ ID NO: 2799822 - RNA, 19 nt, Human
guaucucugaagcauguuu

SEQ ID NO: 2799823 - RNA, 20 nt, Human
guaucucugaagcauguuuc

SEQ ID NO: 2799824 - RNA, 20 nt, Human
guaucucuuucacauuguuu

SEQ ID NO: 2799825 - RNA, 22 nt, Human
guaucucuuucacauuguuugc

SEQ ID NO: 2799826 - RNA, 18 nt, Human
guauccugggggacccaa

SEQ ID NO: 2799827 - RNA, 14 nt, Human
guaucgauguuuua

SEQ ID NO: 2799828 - RNA, 15 nt, Human
guaucgauguuuuau

SEQ ID NO: 2799829 - RNA, 15 nt, Human
guaucguaaccagcc

SEQ ID NO: 2799830 - RNA, 16 nt, Human
guaucuaaaaguguca

SEQ ID NO: 2799831 - RNA, 16 nt, Human
guaucguaaccagcca

SEQ ID NO: 2799832 - RNA, 17 nt, Human
guaucguaaccagccag

SEQ ID NO: 2799833 - RNA, 21 nt, Human
gucugugaauuggaccauccu

SEQ ID NO: 2799834 - RNA, 20 nt, Human
gucugugaccugcaucuaag

SEQ ID NO: 2799835 - RNA, 19 nt, Human
gucugagagcaaagugacc

SEQ ID NO: 2799836 - RNA, 20 nt, Human
gucugagagcaaagugaccu

SEQ ID NO: 2799837 - RNA, 14 nt, Human
gucugccaggcccc

SEQ ID NO: 2799838 - RNA, 21 nt, Human
gucugccaggcccccaccaca

SEQ ID NO: 2799839 - RNA, 23 nt, Human
gucugccaggcccccaccacaca

SEQ ID NO: 2799840 - RNA, 22 nt, Human
gucugccuguugcgugacacuc

SEQ ID NO: 2799841 - RNA, 14 nt, Human
gucugcgaaguccu

SEQ ID NO: 2799842 - RNA, 15 nt, Human
gucugcgaaguccua

SEQ ID NO: 2799843 - RNA, 21 nt, Human
gucugcgaaguccuauggaaa

SEQ ID NO: 2799844 - RNA, 15 nt, Human
gucugcgugggucag

SEQ ID NO: 2799845 - RNA, 16 nt, Human
gucugcgugggucaga

SEQ ID NO: 2799846 - RNA, 17 nt, Human
gucugcccuucacccca

SEQ ID NO: 2799847 - RNA, 10 nt, Human
gucugcccuu

SEQ ID NO: 2799848 - RNA, 15 nt, Human
gucugucuucacagc

SEQ ID NO: 2799849 - RNA, 12 nt, Human
gucugucuucug

SEQ ID NO: 2799850 - RNA, 14 nt, Human
gucugucuucugua

SEQ ID NO: 2799851 - RNA, 15 nt, Human
gucugucuucuguau

SEQ ID NO: 2799852 - RNA, 16 nt, Human
gucugucuucuguaua

SEQ ID NO: 2799853 - RNA, 23 nt, Human
gucugucuucuguauauaaaugg

SEQ ID NO: 2799854 - RNA, 22 nt, Human
gucugucuucacagcucugugu

SEQ ID NO: 2799855 - RNA, 16 nt, Human
gucugucuucacagcu

SEQ ID NO: 2799856 - RNA, 22 nt, Human
gucuguugugugucaugccagu

SEQ ID NO: 2799857 - RNA, 13 nt, Human
gucuguuuaaagu

SEQ ID NO: 2799858 - RNA, 14 nt, Human
gucuguuuaaagug

SEQ ID NO: 2799859 - RNA, 17 nt, Human
gucuguuuaaaguggca

SEQ ID NO: 2799860 - RNA, 14 nt, Human
gucuguuuaagaaa

SEQ ID NO: 2799861 - RNA, 15 nt, Human
gucuguuuaagaaaa

SEQ ID NO: 2799862 - RNA, 16 nt, Human
gucuguuuaagaaaag

SEQ ID NO: 2799863 - RNA, 18 nt, Human
gucuguuuaagaaaagua

SEQ ID NO: 2799864 - RNA, 20 nt, Human
gucuguuuaagaaaaguauu

SEQ ID NO: 2799865 - RNA, 21 nt, Human
gucuguuugcugauggucugg

SEQ ID NO: 2799866 - RNA, 13 nt, Human
gucuguuuggacu

SEQ ID NO: 2799867 - RNA, 21 nt, Human
gucuguuuggacugcagaagc

SEQ ID NO: 2799868 - RNA, 14 nt, Human
gucuguuuguuuca

SEQ ID NO: 2799869 - RNA, 17 nt, Human
gucuguuuguuucaaga

SEQ ID NO: 2799870 - RNA, 18 nt, Human
gucuguuuguuucaagaa

SEQ ID NO: 2799871 - RNA, 23 nt, Human
gucuguuuguuucaagaaccugg

SEQ ID NO: 2799872 - RNA, 20 nt, Human
gucuguugugugucaugcca

SEQ ID NO: 2799873 - RNA, 18 nt, Human
gucuguugugugucaugc

SEQ ID NO: 2799874 - RNA, 20 nt, Human
gucugugugcgcucugugga

SEQ ID NO: 2799875 - RNA, 20 nt, Human
gucugugugaugaacuuucu

SEQ ID NO: 2799876 - RNA, 13 nt, Human
gucugugugaaug

SEQ ID NO: 2799877 - RNA, 14 nt, Human
gucugugugaaugu

SEQ ID NO: 2799878 - RNA, 15 nt, Human
gucugugugaaugug

SEQ ID NO: 2799879 - RNA, 16 nt, Human
gucugugugaaugugg

SEQ ID NO: 2799880 - RNA, 22 nt, Human
gucuguguugcgugucgugggu

SEQ ID NO: 2799881 - RNA, 17 nt, Human
gucuguucacuuuuccu

SEQ ID NO: 2799882 - RNA, 18 nt, Human
gucuguucuguuucaagg

SEQ ID NO: 2799883 - RNA, 20 nt, Human
gucugugugugaccccuccu

SEQ ID NO: 2799884 - RNA, 21 nt, Human
gucugugugugaccccuccug

SEQ ID NO: 2799885 - RNA, 22 nt, Human
gucugugugugaccccuccugg

SEQ ID NO: 2799886 - RNA, 23 nt, Human
gucugugugugaccccuccuggg

SEQ ID NO: 2799887 - RNA, 15 nt, Human
gucuugcuguugaca

SEQ ID NO: 2799888 - RNA, 19 nt, Human
gucuugcuguugacauauu

SEQ ID NO: 2799889 - RNA, 21 nt, Human
gucuugcuauauugcccaggc

SEQ ID NO: 2799890 - RNA, 23 nt, Human
gucuugcuauauugcccaggcug

SEQ ID NO: 2799891 - RNA, 14 nt, Human
gucuuggacacugu

SEQ ID NO: 2799892 - RNA, 15 nt, Human
gucuuggacacugua

SEQ ID NO: 2799893 - RNA, 21 nt, Human
gucuugcaauggcagccuugg

SEQ ID NO: 2799894 - RNA, 20 nt, Human
gucuugcaauggcagccuug

SEQ ID NO: 2799895 - RNA, 23 nt, Human
gucuugcaauggcagccuuggca

SEQ ID NO: 2799896 - RNA, 18 nt, Human
gucuugaugaccaaaguc

SEQ ID NO: 2799897 - RNA, 16 nt, Human
gucuuuuuucacuaca

SEQ ID NO: 2799898 - RNA, 15 nt, Human
gucuugguauucuua

SEQ ID NO: 2799899 - RNA, 16 nt, Human
gucuuguaauauuuug

SEQ ID NO: 2799900 - RNA, 19 nt, Human
gucuuguaauauuuuguau

SEQ ID NO: 2799901 - RNA, 20 nt, Human
gucuuguaauauuuuguauu

SEQ ID NO: 2799902 - RNA, 20 nt, Human
gucuuggcagcaccugucuc

SEQ ID NO: 2799903 - RNA, 22 nt, Human
gucuuggaauuccauuugagga

SEQ ID NO: 2799904 - RNA, 18 nt, Human
gucuuggacacuguacaa

SEQ ID NO: 2799905 - RNA, 22 nt, Human
gucuuggcagcaccugucuccu

SEQ ID NO: 2799906 - RNA, 19 nt, Human
gucuugcaauggcagccuu

SEQ ID NO: 2799907 - RNA, 18 nt, Human
gucuugcaauggcagccu

SEQ ID NO: 2799908 - RNA, 17 nt, Human
gucuugcaauggcagcc

SEQ ID NO: 2799909 - RNA, 16 nt, Human
gucuugcaauggcagc

SEQ ID NO: 2799910 - RNA, 20 nt, Human
gucuugaacuccuggccuca

SEQ ID NO: 2799911 - RNA, 18 nt, Human
gucuugaacuccuggccu

SEQ ID NO: 2799912 - RNA, 21 nt, Human
gucuugaacuccuggccucaa

SEQ ID NO: 2799913 - RNA, 12 nt, Human
gucuugaaagau

SEQ ID NO: 2799914 - RNA, 15 nt, Human
gucuugaaugucuuu

SEQ ID NO: 2799915 - RNA, 13 nt, Human
gucuugaaguccu

SEQ ID NO: 2799916 - RNA, 15 nt, Human
gucuugaaguccugg

SEQ ID NO: 2799917 - RNA, 16 nt, Human
gucuugaaguccuggc

SEQ ID NO: 2799918 - RNA, 17 nt, Human
gucuugaaugucuuuug

SEQ ID NO: 2799919 - RNA, 19 nt, Human
gucuugaaugucuuuugaa

SEQ ID NO: 2799920 - RNA, 17 nt, Human
gucuugaacuccuggcc

SEQ ID NO: 2799921 - RNA, 16 nt, Human
gucuugaacuccuggc

SEQ ID NO: 2799922 - RNA, 18 nt, Human
gucuucuggacaggcucu

SEQ ID NO: 2799923 - RNA, 23 nt, Human
gucuucuggacaggcucugcuuc

SEQ ID NO: 2799924 - RNA, 12 nt, Human
gucuucuguaua

SEQ ID NO: 2799925 - RNA, 18 nt, Human
gucuucuguauauaaaug

SEQ ID NO: 2799926 - RNA, 20 nt, Human
gucuucuguauauaaauggg

SEQ ID NO: 2799927 - RNA, 20 nt, Human
gucuucuccaccacgcuggg

SEQ ID NO: 2799928 - RNA, 17 nt, Human
gucuucuccaccacgcu

SEQ ID NO: 2799929 - RNA, 13 nt, Human
gucuucucugucu

SEQ ID NO: 2799930 - RNA, 16 nt, Human
gucuucucugucucag

SEQ ID NO: 2799931 - RNA, 18 nt, Human
gucuucugacaaacugug

SEQ ID NO: 2799932 - RNA, 20 nt, Human
gucguagccaaggugggcug

SEQ ID NO: 2799933 - RNA, 19 nt, Human
gucgucacuaauacacagu

SEQ ID NO: 2799934 - RNA, 22 nt, Human
gucguggcagauaaucagccuc

SEQ ID NO: 2799935 - RNA, 15 nt, Human
gucguggcagauaau

SEQ ID NO: 2799936 - RNA, 23 nt, Human
gucguggcagauaaucagccucu

SEQ ID NO: 2799937 - RNA, 22 nt, Human
gucuaaagauggaguuucuaag

SEQ ID NO: 2799938 - RNA, 21 nt, Human
gucuaagauaguaacaaugaa

SEQ ID NO: 2799939 - RNA, 16 nt, Human
gucuaacucagaauua

SEQ ID NO: 2799940 - RNA, 22 nt, Human
gucuaacuuuagaagugcauuu

SEQ ID NO: 2799941 - RNA, 23 nt, Human
gucuaacuuuagaagugcauuuc

SEQ ID NO: 2799942 - RNA, 14 nt, Human
gucuaacuuuugug

SEQ ID NO: 2799943 - RNA, 15 nt, Human
gucggaggaaagaca

SEQ ID NO: 2799944 - RNA, 13 nt, Human
gucuaaauuugaa

SEQ ID NO: 2799945 - RNA, 15 nt, Human
gucuaaaugcugaaa

SEQ ID NO: 2799946 - RNA, 23 nt, Human
gucuaaagauggaguuucuaagg

SEQ ID NO: 2799947 - RNA, 19 nt, Human
gucucacuauguugcccag

SEQ ID NO: 2799948 - RNA, 11 nt, Human
gucucacucug

SEQ ID NO: 2799949 - RNA, 18 nt, Human
gucucacuauguugccca

SEQ ID NO: 2799950 - RNA, 16 nt, Human
gucgggcuuuguguga

SEQ ID NO: 2799951 - RNA, 14 nt, Human
gucgggcaccagcc

SEQ ID NO: 2799952 - RNA, 18 nt, Human
gucgggcaccagccagcg

SEQ ID NO: 2799953 - RNA, 14 nt, Human
gucggaacagcaga

SEQ ID NO: 2799954 - RNA, 15 nt, Human
gucggaacagcagau

SEQ ID NO: 2799955 - RNA, 16 nt, Human
gucccugcccuucuuc

SEQ ID NO: 2799956 - RNA, 21 nt, Human
gucugagacucacaggaagga

SEQ ID NO: 2799957 - RNA, 22 nt, Human
gucugagacucacaggaaggag

SEQ ID NO: 2799958 - RNA, 20 nt, Human
gucucugcuggcccagccaa

SEQ ID NO: 2799959 - RNA, 16 nt, Human
gucucuggcaguucug

SEQ ID NO: 2799960 - RNA, 21 nt, Human
gucucuggcaguucuggaaug

SEQ ID NO: 2799961 - RNA, 12 nt, Human
gucucuggccug

SEQ ID NO: 2799962 - RNA, 13 nt, Human
gucucuggccugu

SEQ ID NO: 2799963 - RNA, 19 nt, Human
gucucuggggcaggcugcu

SEQ ID NO: 2799964 - RNA, 21 nt, Human
gucucuggggcaggcugcuuc

SEQ ID NO: 2799965 - RNA, 18 nt, Human
gucucuucuccacuggau

SEQ ID NO: 2799966 - RNA, 14 nt, Human
gucucuucucccag

SEQ ID NO: 2799967 - RNA, 15 nt, Human
gucucuucucccaga

SEQ ID NO: 2799968 - RNA, 16 nt, Human
gucucuucucccagaa

SEQ ID NO: 2799969 - RNA, 17 nt, Human
gucucuucucccagaau

SEQ ID NO: 2799970 - RNA, 22 nt, Human
gucucuucucccagaaucccag

SEQ ID NO: 2799971 - RNA, 23 nt, Human
gucucuucucccagaaucccagc

SEQ ID NO: 2799972 - RNA, 17 nt, Human
gucucugguuccucccc

SEQ ID NO: 2799973 - RNA, 16 nt, Human
gucucugguuccuccc

SEQ ID NO: 2799974 - RNA, 19 nt, Human
gucucucucucucuacaaa

SEQ ID NO: 2799975 - RNA, 16 nt, Human
gucucucuuaaaguug

SEQ ID NO: 2799976 - RNA, 20 nt, Human
gucucucuucagacucucag

SEQ ID NO: 2799977 - RNA, 21 nt, Human
gucucucuucagacucucagc

SEQ ID NO: 2799978 - RNA, 22 nt, Human
gucucucuucagacucucagcc

SEQ ID NO: 2799979 - RNA, 15 nt, Human
gucucugaagcguga

SEQ ID NO: 2799980 - RNA, 17 nt, Human
gucucugaaguacuaac

SEQ ID NO: 2799981 - RNA, 19 nt, Human
gucucugaaguacuaacac

SEQ ID NO: 2799982 - RNA, 13 nt, Human
gucucugagcauu

SEQ ID NO: 2799983 - RNA, 14 nt, Human
gucucugcugcauu

SEQ ID NO: 2799984 - RNA, 22 nt, Human
gucucugcugcauuugugucau

SEQ ID NO: 2799985 - RNA, 21 nt, Human
gucucugcauuuuucugcaga

SEQ ID NO: 2799986 - RNA, 12 nt, Human
gucucugcugcc

SEQ ID NO: 2799987 - RNA, 13 nt, Human
gucucugcugccg

SEQ ID NO: 2799988 - RNA, 14 nt, Human
gucucugcugccgc

SEQ ID NO: 2799989 - RNA, 15 nt, Human
gucucugccuugccu

SEQ ID NO: 2799990 - RNA, 16 nt, Human
gucucugccuugccuu

SEQ ID NO: 2799991 - RNA, 12 nt, Human
gucucugcucca

SEQ ID NO: 2799992 - RNA, 21 nt, Human
gucucugcuccaccuuucagc

SEQ ID NO: 2799993 - RNA, 15 nt, Human
gucucugcucgcccu

SEQ ID NO: 2799994 - RNA, 22 nt, Human
gucucugcucgcccuccuuucu

SEQ ID NO: 2799995 - RNA, 23 nt, Human
gucucugcucgcccuccuuucug

SEQ ID NO: 2799996 - RNA, 17 nt, Human
gucucugcuggcccagc

SEQ ID NO: 2799997 - RNA, 16 nt, Human
gucucugcuggcccag

SEQ ID NO: 2799998 - RNA, 15 nt, Human
gucucugcuggccca

SEQ ID NO: 2799999 - RNA, 13 nt, Human
gucucugcuggcc

SEQ ID NO: 2800000 - RNA, 21 nt, Human
gucucacugaaacauuuaaau

SEQ ID NO: 2800001 - RNA, 23 nt, Human
gucucacgggcaugggcacuccc

SEQ ID NO: 2800002 - RNA, 15 nt, Human
gucucacugaaacau

SEQ ID NO: 2800003 - RNA, 22 nt, Human
gucucacucugucgcccagucu

SEQ ID NO: 2800004 - RNA, 19 nt, Human
gucucacucugucgcccag

SEQ ID NO: 2800005 - RNA, 18 nt, Human
gucucacucugucgccca

SEQ ID NO: 2800006 - RNA, 16 nt, Human
gucucacucugucgcc

SEQ ID NO: 2800007 - RNA, 15 nt, Human
gucucacucugucgc

SEQ ID NO: 2800008 - RNA, 13 nt, Human
gucucagccuccc

SEQ ID NO: 2800009 - RNA, 16 nt, Human
gucucguuugugauuc

SEQ ID NO: 2800010 - RNA, 13 nt, Human
gucucuaaagcac

SEQ ID NO: 2800011 - RNA, 14 nt, Human
gucucuaaagcacu

SEQ ID NO: 2800012 - RNA, 21 nt, Human
gucucuaauucuauuaaagug

SEQ ID NO: 2800013 - RNA, 22 nt, Human
gucucuacuuuucccuguacuu

SEQ ID NO: 2800014 - RNA, 16 nt, Human
gucucaggagcauggg

SEQ ID NO: 2800015 - RNA, 12 nt, Human
gucucaggagca

SEQ ID NO: 2800016 - RNA, 13 nt, Human
gucucuaggcugg

SEQ ID NO: 2800017 - RNA, 14 nt, Human
gucucuaggcuggg

SEQ ID NO: 2800018 - RNA, 15 nt, Human
gucucuaggcugggg

SEQ ID NO: 2800019 - RNA, 15 nt, Human
gucucucucucucua

SEQ ID NO: 2800020 - RNA, 17 nt, Human
gucucuaggcuggggaa

SEQ ID NO: 2800021 - RNA, 22 nt, Human
gugcgcucuguggaugccaggg

SEQ ID NO: 2800022 - RNA, 15 nt, Human
gugcgcucuguggau

SEQ ID NO: 2800023 - RNA, 19 nt, Human
gugcgcugggcacuucccu

SEQ ID NO: 2800024 - RNA, 21 nt, Human
gugcgcugggcacuucccugc

SEQ ID NO: 2800025 - RNA, 22 nt, Human
gugcgcugggcacuucccugcu

SEQ ID NO: 2800026 - RNA, 23 nt, Human
gugcgcugggcacuucccugcug

SEQ ID NO: 2800027 - RNA, 14 nt, Human
gugcgccuacagga

SEQ ID NO: 2800028 - RNA, 18 nt, Human
gugcgaucucggcucagu

SEQ ID NO: 2800029 - RNA, 13 nt, Human
gugcgugaaugua

SEQ ID NO: 2800030 - RNA, 16 nt, Human
gugcgugccgugugag

SEQ ID NO: 2800031 - RNA, 22 nt, Human
gugcgugccgugugagugugac

SEQ ID NO: 2800032 - RNA, 23 nt, Human
gugcuaaccacgucugucuucac

SEQ ID NO: 2800033 - RNA, 22 nt, Human
gugcuaaauggucgcccaggag

SEQ ID NO: 2800034 - RNA, 12 nt, Human
gugcgugcucag

SEQ ID NO: 2800035 - RNA, 13 nt, Human
gugcguguguaga

SEQ ID NO: 2800036 - RNA, 15 nt, Human
gugcguguguagagu

SEQ ID NO: 2800037 - RNA, 17 nt, Human
gugcguguguagaguua

SEQ ID NO: 2800038 - RNA, 13 nt, Human
gugcuaagguucu

SEQ ID NO: 2800039 - RNA, 14 nt, Human
gugcuaagguucua

SEQ ID NO: 2800040 - RNA, 15 nt, Human
gugcuaagguucuaa

SEQ ID NO: 2800041 - RNA, 16 nt, Human
gugcuaagguucuaag

SEQ ID NO: 2800042 - RNA, 17 nt, Human
gugcuaagguucuaagg

SEQ ID NO: 2800043 - RNA, 20 nt, Human
gugcccaagaauagaugcug

SEQ ID NO: 2800044 - RNA, 16 nt, Human
gugccaucauugcugu

SEQ ID NO: 2800045 - RNA, 22 nt, Human
gugccaucauugcugucugcag

SEQ ID NO: 2800046 - RNA, 21 nt, Human
gugccccucuccuucuuagcu

SEQ ID NO: 2800047 - RNA, 12 nt, Human
gugccccugcug

SEQ ID NO: 2800048 - RNA, 21 nt, Human
gugcccccuucaagccugugc

SEQ ID NO: 2800049 - RNA, 16 nt, Human
gugccaugugccaggu

SEQ ID NO: 2800050 - RNA, 14 nt, Human
gugccaugugccag

SEQ ID NO: 2800051 - RNA, 21 nt, Human
gugcgaucuggguucacugca

SEQ ID NO: 2800052 - RNA, 18 nt, Human
gugccuuuugcagaagag

SEQ ID NO: 2800053 - RNA, 21 nt, Human
gugccuuuugcagaagagggu

SEQ ID NO: 2800054 - RNA, 23 nt, Human
gugccuuuugcagaagagggugu

SEQ ID NO: 2800055 - RNA, 14 nt, Human
gugcgaauggacuu

SEQ ID NO: 2800056 - RNA, 19 nt, Human
gugccuucuucagggccug

SEQ ID NO: 2800057 - RNA, 20 nt, Human
gugccuucuucagggccugg

SEQ ID NO: 2800058 - RNA, 21 nt, Human
gugccuucuucagggccuggu

SEQ ID NO: 2800059 - RNA, 20 nt, Human
gugcccuacucauugggguu

SEQ ID NO: 2800060 - RNA, 20 nt, Human
gugcccuccacagccgcagc

SEQ ID NO: 2800061 - RNA, 21 nt, Human
gugcccuccugagggaggacc

SEQ ID NO: 2800062 - RNA, 23 nt, Human
gugcccuccugagggaggaccug

SEQ ID NO: 2800063 - RNA, 15 nt, Human
gugccuucagcucua

SEQ ID NO: 2800064 - RNA, 23 nt, Human
gugcaguggugcgaucuggguuc

SEQ ID NO: 2800065 - RNA, 20 nt, Human
gugcaguggugcgaucuggg

SEQ ID NO: 2800066 - RNA, 16 nt, Human
gugcagacagaagucu

SEQ ID NO: 2800067 - RNA, 14 nt, Human
gugcagcagauugg

SEQ ID NO: 2800068 - RNA, 21 nt, Human
gugcagcagauuggaaggaga

SEQ ID NO: 2800069 - RNA, 17 nt, Human
gugcagaugagguugcu

SEQ ID NO: 2800070 - RNA, 19 nt, Human
gugcagaugcaauuguuug

SEQ ID NO: 2800071 - RNA, 23 nt, Human
gugcagcucaaggaaaggccuga

SEQ ID NO: 2800072 - RNA, 22 nt, Human
gugcagcucaaggaaaggccug

SEQ ID NO: 2800073 - RNA, 19 nt, Human
gugcauagaacuggguaaa

SEQ ID NO: 2800074 - RNA, 14 nt, Human
gugcauagugcugg

SEQ ID NO: 2800075 - RNA, 16 nt, Human
gugcauagugcuggga

SEQ ID NO: 2800076 - RNA, 13 nt, Human
gugcaggcuggcc

SEQ ID NO: 2800077 - RNA, 14 nt, Human
gugcaggcuggcca

SEQ ID NO: 2800078 - RNA, 15 nt, Human
gugcaggcuggccag

SEQ ID NO: 2800079 - RNA, 19 nt, Human
gugcaguucuaguuugcau

SEQ ID NO: 2800080 - RNA, 20 nt, Human
gugcaguucuaguuugcauu

SEQ ID NO: 2800081 - RNA, 13 nt, Human
gugcaucucagcc

SEQ ID NO: 2800082 - RNA, 15 nt, Human
gugccagccugaggc

SEQ ID NO: 2800083 - RNA, 18 nt, Human
gugccaggaaacucuugc

SEQ ID NO: 2800084 - RNA, 19 nt, Human
gugccaggaaacucuugcu

SEQ ID NO: 2800085 - RNA, 24 nt, Human
gugauccacccaccucagccuccc

SEQ ID NO: 2800086 - RNA, 23 nt, Human
gugauccacccaccucagccucc

SEQ ID NO: 2800087 - RNA, 21 nt, Human
gugauuuagaacuguauguca

SEQ ID NO: 2800088 - RNA, 23 nt, Human
gugauuuagaacuguaugucaga

SEQ ID NO: 2800089 - RNA, 18 nt, Human
gugauuuagaacuguaug

SEQ ID NO: 2800090 - RNA, 19 nt, Human
gugcaaaauauuugacuau

SEQ ID NO: 2800091 - RNA, 21 nt, Human
gugauuuuaugaucaguguug

SEQ ID NO: 2800092 - RNA, 17 nt, Human
gugauuuucaagcagca

SEQ ID NO: 2800093 - RNA, 19 nt, Human
gugcaaaagcuucaaauua

SEQ ID NO: 2800094 - RNA, 19 nt, Human
gugauauagaauuagcuuu

SEQ ID NO: 2800095 - RNA, 12 nt, Human
gugcagaggaag

SEQ ID NO: 2800096 - RNA, 22 nt, Human
gugcagaggucagacuaagaaa

SEQ ID NO: 2800097 - RNA, 23 nt, Human
gugcagaggaaguggaaggcauc

SEQ ID NO: 2800098 - RNA, 17 nt, Human
gugcacuuucuaauguu

SEQ ID NO: 2800099 - RNA, 19 nt, Human
gugcacuuucuaauguuuc

SEQ ID NO: 2800100 - RNA, 13 nt, Human
gugcacuuuguaa

SEQ ID NO: 2800101 - RNA, 14 nt, Human
gugcacuuuguaaa

SEQ ID NO: 2800102 - RNA, 15 nt, Human
gugcacuuuguaaau

SEQ ID NO: 2800103 - RNA, 18 nt, Human
gugaacaaaagaugcucu

SEQ ID NO: 2800104 - RNA, 19 nt, Human
gugaacaaaagaugcucuu

SEQ ID NO: 2800105 - RNA, 13 nt, Human
gugaaugaacacu

SEQ ID NO: 2800106 - RNA, 11 nt, Human
gugaaugaaag

SEQ ID NO: 2800107 - RNA, 12 nt, Human
gugaaugaaaga

SEQ ID NO: 2800108 - RNA, 17 nt, Human
gugaaugaaagauuaaa

SEQ ID NO: 2800109 - RNA, 18 nt, Human
gugaaugaaagauuaaac

SEQ ID NO: 2800110 - RNA, 19 nt, Human
gugaaugaaagauuaaaca

SEQ ID NO: 2800111 - RNA, 18 nt, Human
gucuugguuucucucuac

SEQ ID NO: 2800112 - RNA, 23 nt, Human
gucuuuuuuuggugauucaaaug

SEQ ID NO: 2800113 - RNA, 15 nt, Human
gucuuguacaugugu

SEQ ID NO: 2800114 - RNA, 20 nt, Human
gugacaaggauugcuacugu

SEQ ID NO: 2800115 - RNA, 22 nt, Human
gugaauucuugaaggaaaauga

SEQ ID NO: 2800116 - RNA, 19 nt, Human
gugaauuucuucacuguug

SEQ ID NO: 2800117 - RNA, 20 nt, Human
gugaauuuauaccuaccugu

SEQ ID NO: 2800118 - RNA, 18 nt, Human
gugaauucuugaaggaaa

SEQ ID NO: 2800119 - RNA, 14 nt, Human
gugaaugcuucuca

SEQ ID NO: 2800120 - RNA, 14 nt, Human
gugaauggauugga

SEQ ID NO: 2800121 - RNA, 15 nt, Human
gugaauggauuggau

SEQ ID NO: 2800122 - RNA, 20 nt, Human
gugaauggauuggauuauuu

SEQ ID NO: 2800123 - RNA, 18 nt, Human
gugaaugauucauguuau

SEQ ID NO: 2800124 - RNA, 19 nt, Human
gugaaugauucauguuaua

SEQ ID NO: 2800125 - RNA, 23 nt, Human
gugaaugauucauguuauauuua

SEQ ID NO: 2800126 - RNA, 15 nt, Human
gugaaugccagugug

SEQ ID NO: 2800127 - RNA, 18 nt, Human
gugaaugccagugugcug

SEQ ID NO: 2800128 - RNA, 19 nt, Human
gugaaugccagugugcuga

SEQ ID NO: 2800129 - RNA, 14 nt, Human
gugaccucugccug

SEQ ID NO: 2800130 - RNA, 13 nt, Human
gugaccucugccu

SEQ ID NO: 2800131 - RNA, 15 nt, Human
gugacagaggcagcc

SEQ ID NO: 2800132 - RNA, 12 nt, Human
gugaccucugcc

SEQ ID NO: 2800133 - RNA, 15 nt, Human
gugaccucugccuga

SEQ ID NO: 2800134 - RNA, 14 nt, Human
gugacggcccucau

SEQ ID NO: 2800135 - RNA, 16 nt, Human
gugacggcccucaucu

SEQ ID NO: 2800136 - RNA, 14 nt, Human
gugacagaggcagc

SEQ ID NO: 2800137 - RNA, 13 nt, Human
gugacagaggcag

SEQ ID NO: 2800138 - RNA, 12 nt, Human
gugacagaggca

SEQ ID NO: 2800139 - RNA, 23 nt, Human
gugacagaccacaucuuuaucug

SEQ ID NO: 2800140 - RNA, 21 nt, Human
gugacaauaauauuguuguau

SEQ ID NO: 2800141 - RNA, 22 nt, Human
gugacacagcagcuucaccaga

SEQ ID NO: 2800142 - RNA, 16 nt, Human
gugacacucuccuugc

SEQ ID NO: 2800143 - RNA, 17 nt, Human
gugacacucuccuugca

SEQ ID NO: 2800144 - RNA, 19 nt, Human
gugacacucuccuugcagu

SEQ ID NO: 2800145 - RNA, 20 nt, Human
gugacacucuccuugcaguu

SEQ ID NO: 2800146 - RNA, 12 nt, Human
gugacacagcag

SEQ ID NO: 2800147 - RNA, 19 nt, Human
gugacacagcagcuucacc

SEQ ID NO: 2800148 - RNA, 18 nt, Human
gugacacacuacaccaca

SEQ ID NO: 2800149 - RNA, 20 nt, Human
gugacacacuacaccacaca

SEQ ID NO: 2800150 - RNA, 21 nt, Human
gugacacacuacaccacacac

SEQ ID NO: 2800151 - RNA, 22 nt, Human
gugacacacuacaccacacaca

SEQ ID NO: 2800152 - RNA, 23 nt, Human
gugacacacuacaccacacacaa

SEQ ID NO: 2800153 - RNA, 12 nt, Human
gugacacagacu

SEQ ID NO: 2800154 - RNA, 14 nt, Human
gugacacagacuca

SEQ ID NO: 2800155 - RNA, 19 nt, Human
gugacacagacucauccug

SEQ ID NO: 2800156 - RNA, 22 nt, Human
gugauccacccaccucagccuc

SEQ ID NO: 2800157 - RNA, 17 nt, Human
gugaucacagcagcuuc

SEQ ID NO: 2800158 - RNA, 13 nt, Human
gugauauuucucu

SEQ ID NO: 2800159 - RNA, 15 nt, Human
gugauauuucucuag

SEQ ID NO: 2800160 - RNA, 16 nt, Human
gugauauuucucuagu

SEQ ID NO: 2800161 - RNA, 13 nt, Human
gugaucaaagcca

SEQ ID NO: 2800162 - RNA, 17 nt, Human
gugauaguucacccccu

SEQ ID NO: 2800163 - RNA, 18 nt, Human
gugauagcuaacauuuua

SEQ ID NO: 2800164 - RNA, 12 nt, Human
gugauagcauug

SEQ ID NO: 2800165 - RNA, 19 nt, Human
gugauagcauugcuuucgu

SEQ ID NO: 2800166 - RNA, 16 nt, Human
gugauauggcagaaga

SEQ ID NO: 2800167 - RNA, 19 nt, Human
gugauauggcagaagacac

SEQ ID NO: 2800168 - RNA, 13 nt, Human
gugauauucuaag

SEQ ID NO: 2800169 - RNA, 16 nt, Human
gugauauccugaaaaa

SEQ ID NO: 2800170 - RNA, 13 nt, Human
gugauauggagca

SEQ ID NO: 2800171 - RNA, 17 nt, Human
gugauauggagcaagag

SEQ ID NO: 2800172 - RNA, 15 nt, Human
gugauauauguauua

SEQ ID NO: 2800173 - RNA, 16 nt, Human
gugauauauguauuaa

SEQ ID NO: 2800174 - RNA, 20 nt, Human
gugauauauuccuaaacuau

SEQ ID NO: 2800175 - RNA, 16 nt, Human
gugaguuuggucugga

SEQ ID NO: 2800176 - RNA, 18 nt, Human
gugaguuuggucuggacu

SEQ ID NO: 2800177 - RNA, 19 nt, Human
gugaguuuggucuggacug

SEQ ID NO: 2800178 - RNA, 21 nt, Human
gugaguuuggucuggacugac

SEQ ID NO: 2800179 - RNA, 20 nt, Human
gugaguguguguuugugcug

SEQ ID NO: 2800180 - RNA, 15 nt, Human
gugaguguuucuaug

SEQ ID NO: 2800181 - RNA, 16 nt, Human
gugaguguuucuauga

SEQ ID NO: 2800182 - RNA, 23 nt, Human
gugaguguuucuaugaguggaaa

SEQ ID NO: 2800183 - RNA, 21 nt, Human
gugauacagaacucuuaaaaa

SEQ ID NO: 2800184 - RNA, 14 nt, Human
gugauaaacuuugc

SEQ ID NO: 2800185 - RNA, 15 nt, Human
gugauaauuuaagag

SEQ ID NO: 2800186 - RNA, 13 nt, Human
gugauaaacuuug

SEQ ID NO: 2800187 - RNA, 21 nt, Human
gugauaacuccuaagaggagc

SEQ ID NO: 2800188 - RNA, 12 nt, Human
gugauaaggaca

SEQ ID NO: 2800189 - RNA, 21 nt, Human
gugauaaggacaugaugcuuu

SEQ ID NO: 2800190 - RNA, 20 nt, Human
gugagccacugcaccgggcc

SEQ ID NO: 2800191 - RNA, 15 nt, Human
gugagccacugcacc

SEQ ID NO: 2800192 - RNA, 14 nt, Human
gugagccacugcac

SEQ ID NO: 2800193 - RNA, 18 nt, Human
gugagcccauggcccucc

SEQ ID NO: 2800194 - RNA, 12 nt, Human
gugagccccauc

SEQ ID NO: 2800195 - RNA, 16 nt, Human
gugagccccaucuuca

SEQ ID NO: 2800196 - RNA, 17 nt, Human
gugagcccauggcccuc

SEQ ID NO: 2800197 - RNA, 14 nt, Human
gugagccccugguc

SEQ ID NO: 2800198 - RNA, 15 nt, Human
gugacuauauagaga

SEQ ID NO: 2800199 - RNA, 17 nt, Human
gugacuauauagagaug

SEQ ID NO: 2800200 - RNA, 20 nt, Human
gugacuauauagagauguuu

SEQ ID NO: 2800201 - RNA, 14 nt, Human
gugacuaugaacuu

SEQ ID NO: 2800202 - RNA, 13 nt, Human
gugaauugacuac

SEQ ID NO: 2800203 - RNA, 19 nt, Human
gugacuaguacaaauuaua

SEQ ID NO: 2800204 - RNA, 23 nt, Human
gugacuaacuagacaccaaaguu

SEQ ID NO: 2800205 - RNA, 19 nt, Human
gugagccgagaucacgcca

SEQ ID NO: 2800206 - RNA, 17 nt, Human
gugagccccugguccug

SEQ ID NO: 2800207 - RNA, 13 nt, Human
gugagccuggcuc

SEQ ID NO: 2800208 - RNA, 14 nt, Human
gugagccuggcucu

SEQ ID NO: 2800209 - RNA, 16 nt, Human
gugagccuggcucuug

SEQ ID NO: 2800210 - RNA, 23 nt, Human
gugagccuggcucuugugcugga

SEQ ID NO: 2800211 - RNA, 15 nt, Human
gugaggagcugcugg

SEQ ID NO: 2800212 - RNA, 17 nt, Human
gugaggagcugcuggcu

SEQ ID NO: 2800213 - RNA, 14 nt, Human
gugagccuuggcug

SEQ ID NO: 2800214 - RNA, 19 nt, Human
gugagcgccugugcacaca

SEQ ID NO: 2800215 - RNA, 20 nt, Human
gugagcgccugugcacacac

SEQ ID NO: 2800216 - RNA, 18 nt, Human
gugaggagcugcuggcuu

SEQ ID NO: 2800217 - RNA, 13 nt, Human
gugagugugacag

SEQ ID NO: 2800218 - RNA, 14 nt, Human
gugagugugacagg

SEQ ID NO: 2800219 - RNA, 15 nt, Human
gugagugugacaggg

SEQ ID NO: 2800220 - RNA, 16 nt, Human
gugagugugacagggc

SEQ ID NO: 2800221 - RNA, 17 nt, Human
gugagugugacagggcc

SEQ ID NO: 2800222 - RNA, 18 nt, Human
gugagugugacagggcca

SEQ ID NO: 2800223 - RNA, 19 nt, Human
gugagugugacagggccag

SEQ ID NO: 2800224 - RNA, 20 nt, Human
gugagugugacagggccagu

SEQ ID NO: 2800225 - RNA, 15 nt, Human
guucugaaauaaacu

SEQ ID NO: 2800226 - RNA, 16 nt, Human
guucucuguccagcag

SEQ ID NO: 2800227 - RNA, 17 nt, Human
guucuaauaauuucuaa

SEQ ID NO: 2800228 - RNA, 19 nt, Human
guucuaauaauuucuaaug

SEQ ID NO: 2800229 - RNA, 18 nt, Human
guucuaaguuucuaagau

SEQ ID NO: 2800230 - RNA, 19 nt, Human
guucuaaguuucuaagauu

SEQ ID NO: 2800231 - RNA, 21 nt, Human
guucuaaguuucuaagauucu

SEQ ID NO: 2800232 - RNA, 22 nt, Human
guucuaaguuucuaagauucua

SEQ ID NO: 2800233 - RNA, 14 nt, Human
guucuaaguuucua

SEQ ID NO: 2800234 - RNA, 15 nt, Human
guucuaaguuucuaa

SEQ ID NO: 2800235 - RNA, 16 nt, Human
guucuaaguuucuaag

SEQ ID NO: 2800236 - RNA, 17 nt, Human
guucuaaguuucuaaga

SEQ ID NO: 2800237 - RNA, 17 nt, Human
guucugaugaugugccu

SEQ ID NO: 2800238 - RNA, 18 nt, Human
guucugaugaugugccug

SEQ ID NO: 2800239 - RNA, 16 nt, Human
guucugcacacagcac

SEQ ID NO: 2800240 - RNA, 15 nt, Human
guucugcacacagca

SEQ ID NO: 2800241 - RNA, 15 nt, Human
guucugcccccagcc

SEQ ID NO: 2800242 - RNA, 16 nt, Human
guucugcccccagccc

SEQ ID NO: 2800243 - RNA, 17 nt, Human
guucugcccccagccca

SEQ ID NO: 2800244 - RNA, 19 nt, Human
guucugcccccagcccaaa

SEQ ID NO: 2800245 - RNA, 20 nt, Human
guucugcccccagcccaaag

SEQ ID NO: 2800246 - RNA, 12 nt, Human
guucugcacuga

SEQ ID NO: 2800247 - RNA, 13 nt, Human
guucugcacugaa

SEQ ID NO: 2800248 - RNA, 14 nt, Human
guucugcacugaaa

SEQ ID NO: 2800249 - RNA, 15 nt, Human
guucugcacugaaaa

SEQ ID NO: 2800250 - RNA, 16 nt, Human
guucugcacugaaaag

SEQ ID NO: 2800251 - RNA, 20 nt, Human
guucugcagacacgccuucc

SEQ ID NO: 2800252 - RNA, 21 nt, Human
guucugcagacacgccuuccc

SEQ ID NO: 2800253 - RNA, 14 nt, Human
guucguugguuaua

SEQ ID NO: 2800254 - RNA, 14 nt, Human
guucuaaagaugga

SEQ ID NO: 2800255 - RNA, 17 nt, Human
guucuaaagauggaaaa

SEQ ID NO: 2800256 - RNA, 20 nt, Human
guucuaaagauggaaaaacc

SEQ ID NO: 2800257 - RNA, 23 nt, Human
guucuaaagauggaaaaaccacc

SEQ ID NO: 2800258 - RNA, 10 nt, Human
guucuaaagc

SEQ ID NO: 2800259 - RNA, 12 nt, Human
guucuaaagcuc

SEQ ID NO: 2800260 - RNA, 14 nt, Human
guucuaaagcucug

SEQ ID NO: 2800261 - RNA, 16 nt, Human
guucuaaagcucugac

SEQ ID NO: 2800262 - RNA, 12 nt, Human
guucuaaaguuc

SEQ ID NO: 2800263 - RNA, 13 nt, Human
guucuaaaguucu

SEQ ID NO: 2800264 - RNA, 14 nt, Human
guucuaaaguucua

SEQ ID NO: 2800265 - RNA, 15 nt, Human
guucuaaaguucuaa

SEQ ID NO: 2800266 - RNA, 16 nt, Human
guucuaaaguucuaag

SEQ ID NO: 2800267 - RNA, 17 nt, Human
guucuaaaguucuaaga

SEQ ID NO: 2800268 - RNA, 18 nt, Human
guucuaaaguucuaagau

SEQ ID NO: 2800269 - RNA, 19 nt, Human
guucuaaaguucuaagauu

SEQ ID NO: 2800270 - RNA, 17 nt, Human
guucuaaggcucugaga

SEQ ID NO: 2800271 - RNA, 14 nt, Human
guucuaagggggag

SEQ ID NO: 2800272 - RNA, 12 nt, Human
guucuaaggcuc

SEQ ID NO: 2800273 - RNA, 13 nt, Human
guucuaaggcucu

SEQ ID NO: 2800274 - RNA, 14 nt, Human
guucuaaggcucug

SEQ ID NO: 2800275 - RNA, 16 nt, Human
guucuaaggcucugag

SEQ ID NO: 2800276 - RNA, 15 nt, Human
guucuaagauucuga

SEQ ID NO: 2800277 - RNA, 11 nt, Human
guucuaaggcc

SEQ ID NO: 2800278 - RNA, 13 nt, Human
guucuaaggccua

SEQ ID NO: 2800279 - RNA, 20 nt, Human
guucuaaggccuaggauucu

SEQ ID NO: 2800280 - RNA, 21 nt, Human
guucuaaggccuaggauucua

SEQ ID NO: 2800281 - RNA, 22 nt, Human
guucuaaggccuaggauucuaa

SEQ ID NO: 2800282 - RNA, 23 nt, Human
guucuaaggccuaggauucuaaa

SEQ ID NO: 2800283 - RNA, 11 nt, Human
guucuaaggcu

SEQ ID NO: 2800284 - RNA, 21 nt, Human
guucuaaaguucuaagauucu

SEQ ID NO: 2800285 - RNA, 14 nt, Human
guucuaagaaaccc

SEQ ID NO: 2800286 - RNA, 15 nt, Human
guucuaagacucaaa

SEQ ID NO: 2800287 - RNA, 17 nt, Human
guucuaagacucaaaug

SEQ ID NO: 2800288 - RNA, 20 nt, Human
guucuaagacucaaauguuc

SEQ ID NO: 2800289 - RNA, 21 nt, Human
guucuaagacucaaauguucu

SEQ ID NO: 2800290 - RNA, 13 nt, Human
guucuaagaugug

SEQ ID NO: 2800291 - RNA, 21 nt, Human
guucuaagaugugauauucua

SEQ ID NO: 2800292 - RNA, 22 nt, Human
guucuaagaugugauauucuaa

SEQ ID NO: 2800293 - RNA, 13 nt, Human
guucuaagauucu

SEQ ID NO: 2800294 - RNA, 14 nt, Human
guucuaagauucua

SEQ ID NO: 2800295 - RNA, 15 nt, Human
guucuaagauucuaa

SEQ ID NO: 2800296 - RNA, 17 nt, Human
guucuaagauucuaaug

SEQ ID NO: 2800297 - RNA, 20 nt, Human
guucuaagauucuaaugaug

SEQ ID NO: 2800298 - RNA, 14 nt, Human
guucuaagauucug

SEQ ID NO: 2800299 - RNA, 21 nt, Human
guuccuuuccaacguuuggaa

SEQ ID NO: 2800300 - RNA, 23 nt, Human
guuccuuuccuuuucuuuaaaga

SEQ ID NO: 2800301 - RNA, 23 nt, Human
guuccuugaucuguauauacaau

SEQ ID NO: 2800302 - RNA, 18 nt, Human
guuccuuuguguguacuc

SEQ ID NO: 2800303 - RNA, 19 nt, Human
guuccuuuguguguacuca

SEQ ID NO: 2800304 - RNA, 14 nt, Human
guuccuuuuuauga

SEQ ID NO: 2800305 - RNA, 15 nt, Human
guucgagaccagccu

SEQ ID NO: 2800306 - RNA, 17 nt, Human
guuccuuccucugagcc

SEQ ID NO: 2800307 - RNA, 19 nt, Human
guuccuuccucugagccuu

SEQ ID NO: 2800308 - RNA, 18 nt, Human
guuccuuccucugagccu

SEQ ID NO: 2800309 - RNA, 16 nt, Human
guucgagaccagccug

SEQ ID NO: 2800310 - RNA, 17 nt, Human
guucgagaccagccugg

SEQ ID NO: 2800311 - RNA, 19 nt, Human
guucgagaccagccuggcc

SEQ ID NO: 2800312 - RNA, 18 nt, Human
guucgagaccagccuggc

SEQ ID NO: 2800313 - RNA, 20 nt, Human
guucgagaccagccuggcca

SEQ ID NO: 2800314 - RNA, 22 nt, Human
guucgaggacuacaaccaauuu

SEQ ID NO: 2800315 - RNA, 13 nt, Human
guucguagcuuuc

SEQ ID NO: 2800316 - RNA, 17 nt, Human
guucgguuuuuuuccug

SEQ ID NO: 2800317 - RNA, 19 nt, Human
guucgguuuuuuuccuguu

SEQ ID NO: 2800318 - RNA, 14 nt, Human
guucggcucugggu

SEQ ID NO: 2800319 - RNA, 20 nt, Human
guucgcauggucacacacug

SEQ ID NO: 2800320 - RNA, 15 nt, Human
guucgccuggagccc

SEQ ID NO: 2800321 - RNA, 16 nt, Human
guucgccuggagcccu

SEQ ID NO: 2800322 - RNA, 12 nt, Human
guucgcuuggcu

SEQ ID NO: 2800323 - RNA, 19 nt, Human
guucgcuuggcuccaugcu

SEQ ID NO: 2800324 - RNA, 14 nt, Human
guucgcauggucac

SEQ ID NO: 2800325 - RNA, 19 nt, Human
guugaaaauuauuuuaaac

SEQ ID NO: 2800326 - RNA, 18 nt, Human
guugaaaauucaaaaagu

SEQ ID NO: 2800327 - RNA, 17 nt, Human
guugaaaaccaaaauga

SEQ ID NO: 2800328 - RNA, 15 nt, Human
guucuuuuuaaguua

SEQ ID NO: 2800329 - RNA, 17 nt, Human
guucuuuuuaaguuaau

SEQ ID NO: 2800330 - RNA, 23 nt, Human
guucuuugcugcauucugccucu

SEQ ID NO: 2800331 - RNA, 21 nt, Human
guucuuugagggacugccucu

SEQ ID NO: 2800332 - RNA, 22 nt, Human
guucuuugagggacugccucug

SEQ ID NO: 2800333 - RNA, 23 nt, Human
guucuuugagggacugccucugc

SEQ ID NO: 2800334 - RNA, 15 nt, Human
guucugccagaucuu

SEQ ID NO: 2800335 - RNA, 15 nt, Human
guucuuucuggaguc

SEQ ID NO: 2800336 - RNA, 14 nt, Human
guucuuucuuccuc

SEQ ID NO: 2800337 - RNA, 15 nt, Human
guucuuucuuccucu

SEQ ID NO: 2800338 - RNA, 16 nt, Human
guucuuucuuccucug

SEQ ID NO: 2800339 - RNA, 17 nt, Human
guucuuucuuccucugc

SEQ ID NO: 2800340 - RNA, 18 nt, Human
guucuuucuuccucugcu

SEQ ID NO: 2800341 - RNA, 19 nt, Human
guucuuucuuccucugcug

SEQ ID NO: 2800342 - RNA, 11 nt, Human
guucuuuauau

SEQ ID NO: 2800343 - RNA, 13 nt, Human
guucuuuauauac

SEQ ID NO: 2800344 - RNA, 16 nt, Human
guucuuuauauacaau

SEQ ID NO: 2800345 - RNA, 19 nt, Human
guucuuuauauacaauaau

SEQ ID NO: 2800346 - RNA, 20 nt, Human
guucuuuauauacaauaaug

SEQ ID NO: 2800347 - RNA, 21 nt, Human
guucuuuauauacaauaaugg

SEQ ID NO: 2800348 - RNA, 22 nt, Human
guucuuuauauacaauaaugga

SEQ ID NO: 2800349 - RNA, 16 nt, Human
guucugggacacaguu

SEQ ID NO: 2800350 - RNA, 15 nt, Human
guucugggacacagu

SEQ ID NO: 2800351 - RNA, 14 nt, Human
guucugggacacag

SEQ ID NO: 2800352 - RNA, 12 nt, Human
guucugggacac

SEQ ID NO: 2800353 - RNA, 11 nt, Human
guucugggaca

SEQ ID NO: 2800354 - RNA, 16 nt, Human
guucuggccagaaugc

SEQ ID NO: 2800355 - RNA, 20 nt, Human
guucuggcugccccaaccug

SEQ ID NO: 2800356 - RNA, 22 nt, Human
guucuggcugccccaaccugcu

SEQ ID NO: 2800357 - RNA, 12 nt, Human
guucuggccaga

SEQ ID NO: 2800358 - RNA, 13 nt, Human
guucuggccagaa

SEQ ID NO: 2800359 - RNA, 23 nt, Human
guucugcuucaaggcuuccacug

SEQ ID NO: 2800360 - RNA, 21 nt, Human
guucugcuucaauaaaucuuu

SEQ ID NO: 2800361 - RNA, 14 nt, Human
guucugcuuucucc

SEQ ID NO: 2800362 - RNA, 20 nt, Human
guucuggaaaagaacuguuu

SEQ ID NO: 2800363 - RNA, 17 nt, Human
guugauguuggcuggga

SEQ ID NO: 2800364 - RNA, 13 nt, Human
guugauuaaacuc

SEQ ID NO: 2800365 - RNA, 16 nt, Human
guugauguuggcuggg

SEQ ID NO: 2800366 - RNA, 17 nt, Human
guugauguacugauuga

SEQ ID NO: 2800367 - RNA, 13 nt, Human
guugauguaucug

SEQ ID NO: 2800368 - RNA, 14 nt, Human
guugauguaucuga

SEQ ID NO: 2800369 - RNA, 21 nt, Human
guugauguaucugaguugcca

SEQ ID NO: 2800370 - RNA, 19 nt, Human
guugaaugacaacagaagc

SEQ ID NO: 2800371 - RNA, 16 nt, Human
guugaauggccugccu

SEQ ID NO: 2800372 - RNA, 15 nt, Human
guugaaugacaacag

SEQ ID NO: 2800373 - RNA, 17 nt, Human
guugaauacuuuuuaca

SEQ ID NO: 2800374 - RNA, 13 nt, Human
guugaauacuuuu

SEQ ID NO: 2800375 - RNA, 13 nt, Human
guugaauaaaagu

SEQ ID NO: 2800376 - RNA, 18 nt, Human
guugaauaaaagugcaca

SEQ ID NO: 2800377 - RNA, 22 nt, Human
guugaagggagguggcaagagu

SEQ ID NO: 2800378 - RNA, 12 nt, Human
guugaagucacc

SEQ ID NO: 2800379 - RNA, 14 nt, Human
guugaagccuuugu

SEQ ID NO: 2800380 - RNA, 13 nt, Human
guugaagccuuug

SEQ ID NO: 2800381 - RNA, 15 nt, Human
guugaaagaguccua

SEQ ID NO: 2800382 - RNA, 12 nt, Human
guugaaagcaaa

SEQ ID NO: 2800383 - RNA, 15 nt, Human
guugaaagcaaaaau

SEQ ID NO: 2800384 - RNA, 16 nt, Human
guugaaagcaaaaaug

SEQ ID NO: 2800385 - RNA, 21 nt, Human
guugaaagcaaaaaugcuaau

SEQ ID NO: 2800386 - RNA, 22 nt, Human
guugaaaauucaaaaaguguuu

SEQ ID NO: 2800387 - RNA, 15 nt, Human
guugaagaggaaggg

SEQ ID NO: 2800388 - RNA, 16 nt, Human
guugaagacuuuguuu

SEQ ID NO: 2800389 - RNA, 24 nt, Human
guugaaauuuugcaaauauaaaca

SEQ ID NO: 2800390 - RNA, 18 nt, Human
guugaaccaaaccucccu

SEQ ID NO: 2800391 - RNA, 14 nt, Human
guugcacuuuguag

SEQ ID NO: 2800392 - RNA, 14 nt, Human
guugcacugauauu

SEQ ID NO: 2800393 - RNA, 19 nt, Human
guugcauacugagccaagu

SEQ ID NO: 2800394 - RNA, 18 nt, Human
guugcauuccuuugucuu

SEQ ID NO: 2800395 - RNA, 18 nt, Human
guugccaaacagccacac

SEQ ID NO: 2800396 - RNA, 17 nt, Human
guugccaaacagccaca

SEQ ID NO: 2800397 - RNA, 13 nt, Human
guugccaagacaa

SEQ ID NO: 2800398 - RNA, 14 nt, Human
guugccaagacaaa

SEQ ID NO: 2800399 - RNA, 15 nt, Human
guugccaagacaaau

SEQ ID NO: 2800400 - RNA, 16 nt, Human
guugccaagacaaauc

SEQ ID NO: 2800401 - RNA, 17 nt, Human
guugccaagacaaauca

SEQ ID NO: 2800402 - RNA, 20 nt, Human
guugccaagacaaaucaaca

SEQ ID NO: 2800403 - RNA, 20 nt, Human
guugcacacccacucagcuc

SEQ ID NO: 2800404 - RNA, 22 nt, Human
guugcaauagaacagagaaaga

SEQ ID NO: 2800405 - RNA, 17 nt, Human
guugauuuuuacugugu

SEQ ID NO: 2800406 - RNA, 12 nt, Human
guugauuaaggc

SEQ ID NO: 2800407 - RNA, 13 nt, Human
guugauuaaggca

SEQ ID NO: 2800408 - RNA, 16 nt, Human
guuggcagugagugag

SEQ ID NO: 2800409 - RNA, 22 nt, Human
guuggcagugagugagccuggc

SEQ ID NO: 2800410 - RNA, 23 nt, Human
guuggcagugagugagccuggcu

SEQ ID NO: 2800411 - RNA, 23 nt, Human
guuggccaaagccaaagcuaggc

SEQ ID NO: 2800412 - RNA, 14 nt, Human
guuggauguagcau

SEQ ID NO: 2800413 - RNA, 15 nt, Human
guuggauuccaugcu

SEQ ID NO: 2800414 - RNA, 16 nt, Human
guuggauuccaugcua

SEQ ID NO: 2800415 - RNA, 17 nt, Human
guuggauuccaugcuaa

SEQ ID NO: 2800416 - RNA, 12 nt, Human
guuggauuuguu

SEQ ID NO: 2800417 - RNA, 14 nt, Human
guuggccaggcugc

SEQ ID NO: 2800418 - RNA, 13 nt, Human
guuggccaggcug

SEQ ID NO: 2800419 - RNA, 14 nt, Human
guuggccaggcugg

SEQ ID NO: 2800420 - RNA, 15 nt, Human
guuggccaggcuggu

SEQ ID NO: 2800421 - RNA, 14 nt, Human
guuggccaguguga

SEQ ID NO: 2800422 - RNA, 19 nt, Human
guuggccaggcuggucuca

SEQ ID NO: 2800423 - RNA, 17 nt, Human
guuggccaggcuggucu

SEQ ID NO: 2800424 - RNA, 18 nt, Human
guuggccaggcuggucuc

SEQ ID NO: 2800425 - RNA, 19 nt, Human
guuggccaggcugcucuug

SEQ ID NO: 2800426 - RNA, 14 nt, Human
guugcccaggcagg

SEQ ID NO: 2800427 - RNA, 12 nt, Human
guugcccaggca

SEQ ID NO: 2800428 - RNA, 17 nt, Human
guugccaccaccucugu

SEQ ID NO: 2800429 - RNA, 19 nt, Human
guugccaccaccucugugg

SEQ ID NO: 2800430 - RNA, 20 nt, Human
guugccaccaccucuguggc

SEQ ID NO: 2800431 - RNA, 21 nt, Human
guugccaccaccucuguggca

SEQ ID NO: 2800432 - RNA, 15 nt, Human
guuggacaaauguga

SEQ ID NO: 2800433 - RNA, 21 nt, Human
guuggacaaaugugaagaugc

SEQ ID NO: 2800434 - RNA, 14 nt, Human
guuggaccccagag

SEQ ID NO: 2800435 - RNA, 17 nt, Human
guuggaccccagagauu

SEQ ID NO: 2800436 - RNA, 21 nt, Human
guuggacaccuuuagguucuu

SEQ ID NO: 2800437 - RNA, 13 nt, Human
guuggacuaaaug

SEQ ID NO: 2800438 - RNA, 14 nt, Human
guuggacuaaaugc

SEQ ID NO: 2800439 - RNA, 15 nt, Human
guuggacuaaaugcc

SEQ ID NO: 2800440 - RNA, 18 nt, Human
guuggacuaaaugccuag

SEQ ID NO: 2800441 - RNA, 23 nt, Human
guuggacuaaaugccuaguuuuu

SEQ ID NO: 2800442 - RNA, 20 nt, Human
guugccaaaucuggcuccuu

SEQ ID NO: 2800443 - RNA, 22 nt, Human
guuaccuccaacagaacuaaau

SEQ ID NO: 2800444 - RNA, 23 nt, Human
guuaccuccaacagaacuaaaug

SEQ ID NO: 2800445 - RNA, 20 nt, Human
guuacccaggguggagugca

SEQ ID NO: 2800446 - RNA, 14 nt, Human
guuacccaugaaaa

SEQ ID NO: 2800447 - RNA, 16 nt, Human
guuaccgccugucucu

SEQ ID NO: 2800448 - RNA, 16 nt, Human
guuaccuaaaguauuu

SEQ ID NO: 2800449 - RNA, 20 nt, Human
guuaccuaaaguauuuuuau

SEQ ID NO: 2800450 - RNA, 13 nt, Human
guuaccauucaca

SEQ ID NO: 2800451 - RNA, 23 nt, Human
guuaccauuuugggguacccacu

SEQ ID NO: 2800452 - RNA, 23 nt, Human
guuaccacacaucuaugauauaa

SEQ ID NO: 2800453 - RNA, 21 nt, Human
guuaccauauuuauccauuug

SEQ ID NO: 2800454 - RNA, 16 nt, Human
guuacaguaugcuugc

SEQ ID NO: 2800455 - RNA, 17 nt, Human
guuacaguaugcuugcu

SEQ ID NO: 2800456 - RNA, 18 nt, Human
guuacaguaugcuugcuc

SEQ ID NO: 2800457 - RNA, 13 nt, Human
guuacagcucccc

SEQ ID NO: 2800458 - RNA, 13 nt, Human
guuacagagaccu

SEQ ID NO: 2800459 - RNA, 17 nt, Human
guuacagagaccuaugu

SEQ ID NO: 2800460 - RNA, 22 nt, Human
guuacagagaccuauguaagaa

SEQ ID NO: 2800461 - RNA, 15 nt, Human
guuacagcacaaaau

SEQ ID NO: 2800462 - RNA, 21 nt, Human
guuacagcacaaaaugauggc

SEQ ID NO: 2800463 - RNA, 16 nt, Human
guuacagccaagugcc

SEQ ID NO: 2800464 - RNA, 23 nt, Human
guuacagccaagugccaaaugcu

SEQ ID NO: 2800465 - RNA, 23 nt, Human
guuacuaauuggccucuuuaaga

SEQ ID NO: 2800466 - RNA, 12 nt, Human
guuacuauuuuc

SEQ ID NO: 2800467 - RNA, 14 nt, Human
guuacucagggcuc

SEQ ID NO: 2800468 - RNA, 20 nt, Human
guuacucagggcuccuccca

SEQ ID NO: 2800469 - RNA, 22 nt, Human
guuacucagggcuccucccagc

SEQ ID NO: 2800470 - RNA, 19 nt, Human
guuaacauaguaaguucag

SEQ ID NO: 2800471 - RNA, 19 nt, Human
guuaguuauagaugucuag

SEQ ID NO: 2800472 - RNA, 16 nt, Human
guuaguuucuuuggga

SEQ ID NO: 2800473 - RNA, 13 nt, Human
guuaguuucuugg

SEQ ID NO: 2800474 - RNA, 17 nt, Human
guuauaaagugugccac

SEQ ID NO: 2800475 - RNA, 13 nt, Human
guuaucucugugu

SEQ ID NO: 2800476 - RNA, 14 nt, Human
guuaucucuguguu

SEQ ID NO: 2800477 - RNA, 12 nt, Human
guuaucucugug

SEQ ID NO: 2800478 - RNA, 14 nt, Human
guuaucgaaauaac

SEQ ID NO: 2800479 - RNA, 15 nt, Human
guuaucgaaauaaca

SEQ ID NO: 2800480 - RNA, 17 nt, Human
guuaucgaaauaacaau

SEQ ID NO: 2800481 - RNA, 23 nt, Human
guuaucgaaauaacaauguuaag

SEQ ID NO: 2800482 - RNA, 18 nt, Human
guuaucgaaauaacaaug

SEQ ID NO: 2800483 - RNA, 21 nt, Human
guuaucgaaauaacaauguua

SEQ ID NO: 2800484 - RNA, 18 nt, Human
guuaucccaaucauuguu

SEQ ID NO: 2800485 - RNA, 17 nt, Human
guuaugacuauguaaac

SEQ ID NO: 2800486 - RNA, 17 nt, Human
guuaucuguucuuuuga

SEQ ID NO: 2800487 - RNA, 18 nt, Human
guuaucuucucaaguucu

SEQ ID NO: 2800488 - RNA, 19 nt, Human
guuaucuuauacuguacaa

SEQ ID NO: 2800489 - RNA, 20 nt, Human
guuaucuuauacuguacaau

SEQ ID NO: 2800490 - RNA, 22 nt, Human
guuaucuuauacuguacaauaa

SEQ ID NO: 2800491 - RNA, 23 nt, Human
guuaucuuauacuguacaauaaa

SEQ ID NO: 2800492 - RNA, 19 nt, Human
guuaucuucucaaguucua

SEQ ID NO: 2800493 - RNA, 21 nt, Human
guuaucuucucaaguucuaag

SEQ ID NO: 2800494 - RNA, 23 nt, Human
guuaucuucucaaguucuaagau

SEQ ID NO: 2800495 - RNA, 13 nt, Human
guuaugaaagaau

SEQ ID NO: 2800496 - RNA, 17 nt, Human
guuaugaaagaauauau

SEQ ID NO: 2800497 - RNA, 18 nt, Human
guuaugaaagaauauauu

SEQ ID NO: 2800498 - RNA, 20 nt, Human
guuaugaaagaauauauuua

SEQ ID NO: 2800499 - RNA, 13 nt, Human
guuaugaaucagu

SEQ ID NO: 2800500 - RNA, 15 nt, Human
guuaugacuauguaa

SEQ ID NO: 2800501 - RNA, 15 nt, Human
guuaugaaauaaaga

SEQ ID NO: 2800502 - RNA, 22 nt, Human
guuaucuucucaaguucuaaga

SEQ ID NO: 2800503 - RNA, 20 nt, Human
guuaugaaauucacccccuu

SEQ ID NO: 2800504 - RNA, 13 nt, Human
guuauaagacucu

SEQ ID NO: 2800505 - RNA, 14 nt, Human
guuauaagacucuc

SEQ ID NO: 2800506 - RNA, 16 nt, Human
guuauauaauucacuc

SEQ ID NO: 2800507 - RNA, 17 nt, Human
guuauaguaacucccau

SEQ ID NO: 2800508 - RNA, 17 nt, Human
guuauauuuaaugcauu

SEQ ID NO: 2800509 - RNA, 10 nt, Human
guuauauuuc

SEQ ID NO: 2800510 - RNA, 12 nt, Human
guuauauuucag

SEQ ID NO: 2800511 - RNA, 15 nt, Human
guuauauuucagaug

SEQ ID NO: 2800512 - RNA, 21 nt, Human
guuauauuucagauguaaugu

SEQ ID NO: 2800513 - RNA, 23 nt, Human
guuauauuucagauguaauguuu

SEQ ID NO: 2800514 - RNA, 17 nt, Human
guuauauauuuuuugua

SEQ ID NO: 2800515 - RNA, 14 nt, Human
guuauaucaacaga

SEQ ID NO: 2800516 - RNA, 16 nt, Human
guuauaucauauguau

SEQ ID NO: 2800517 - RNA, 16 nt, Human
guuauauccccugcua

SEQ ID NO: 2800518 - RNA, 17 nt, Human
guuauauccccugcuac

SEQ ID NO: 2800519 - RNA, 23 nt, Human
guuaucaaacuucagcuguacuu

SEQ ID NO: 2800520 - RNA, 16 nt, Human
guucaauucucauuug

SEQ ID NO: 2800521 - RNA, 23 nt, Human
guucaauucucauuugucacaca

SEQ ID NO: 2800522 - RNA, 14 nt, Human
guucacacccugca

SEQ ID NO: 2800523 - RNA, 15 nt, Human
guucacacccugcaa

SEQ ID NO: 2800524 - RNA, 16 nt, Human
guucacacccugcaag

SEQ ID NO: 2800525 - RNA, 17 nt, Human
guucacacccugcaagg

SEQ ID NO: 2800526 - RNA, 19 nt, Human
guucacacccugcaaggcc

SEQ ID NO: 2800527 - RNA, 17 nt, Human
guucaaugguucugaaa

SEQ ID NO: 2800528 - RNA, 20 nt, Human
guucaagcgauucuucugcu

SEQ ID NO: 2800529 - RNA, 18 nt, Human
guucaauaauaaauauuu

SEQ ID NO: 2800530 - RNA, 18 nt, Human
guucaaucucccgcugcu

SEQ ID NO: 2800531 - RNA, 22 nt, Human
guucaaggaacuugaaaaauac

SEQ ID NO: 2800532 - RNA, 12 nt, Human
guucaaguuuug

SEQ ID NO: 2800533 - RNA, 20 nt, Human
guucaauaaacuuaacuuua

SEQ ID NO: 2800534 - RNA, 23 nt, Human
guucaagugauucucaugccuca

SEQ ID NO: 2800535 - RNA, 12 nt, Human
guuauguauuuc

SEQ ID NO: 2800536 - RNA, 13 nt, Human
guuauguauuucc

SEQ ID NO: 2800537 - RNA, 23 nt, Human
guuauguauuuccuggauguuug

SEQ ID NO: 2800538 - RNA, 15 nt, Human
guuaugucuguuuaa

SEQ ID NO: 2800539 - RNA, 16 nt, Human
guuaugucuguuuaag

SEQ ID NO: 2800540 - RNA, 18 nt, Human
guuaugucuguuuaagaa

SEQ ID NO: 2800541 - RNA, 19 nt, Human
guuauguguaugugccauu

SEQ ID NO: 2800542 - RNA, 18 nt, Human
guuauguguaugugccau

SEQ ID NO: 2800543 - RNA, 22 nt, Human
guuauguaccauaugaucuguu

SEQ ID NO: 2800544 - RNA, 17 nt, Human
guuauguacuaguguuc

SEQ ID NO: 2800545 - RNA, 22 nt, Human
guuauguacuaguguucuguuu

SEQ ID NO: 2800546 - RNA, 13 nt, Human
guuauguacugua

SEQ ID NO: 2800547 - RNA, 14 nt, Human
guuauguacuguac

SEQ ID NO: 2800548 - RNA, 15 nt, Human
guuauguacuguacu

SEQ ID NO: 2800549 - RNA, 17 nt, Human
guuauguacuguacuaa

SEQ ID NO: 2800550 - RNA, 19 nt, Human
guuauguacuguacuaauu

SEQ ID NO: 2800551 - RNA, 23 nt, Human
guuauggcagaugacaagauggu

SEQ ID NO: 2800552 - RNA, 19 nt, Human
guucaagcgauucuucugc

SEQ ID NO: 2800553 - RNA, 20 nt, Human
guuauguguaugugccauuu

SEQ ID NO: 2800554 - RNA, 13 nt, Human
guucagaacaacu

SEQ ID NO: 2800555 - RNA, 14 nt, Human
guucacugaagacg

SEQ ID NO: 2800556 - RNA, 20 nt, Human
guucacugaaggugauucac

SEQ ID NO: 2800557 - RNA, 19 nt, Human
guucagaguccuuaaaaug

SEQ ID NO: 2800558 - RNA, 13 nt, Human
guucagaguuuuc

SEQ ID NO: 2800559 - RNA, 19 nt, Human
guucagauaauugaauaag

SEQ ID NO: 2800560 - RNA, 19 nt, Human
guucacugcaaccuccgcc

SEQ ID NO: 2800561 - RNA, 14 nt, Human
guucaccuuuguag

SEQ ID NO: 2800562 - RNA, 15 nt, Human
guucaccuuuguagc

SEQ ID NO: 2800563 - RNA, 17 nt, Human
guucaccuuuguagcac

SEQ ID NO: 2800564 - RNA, 23 nt, Human
guucaccuuuguagcacucaggc

SEQ ID NO: 2800565 - RNA, 15 nt, Human
guucacgcaacuuga

SEQ ID NO: 2800566 - RNA, 16 nt, Human
guucacgcaacuugaa

SEQ ID NO: 2800567 - RNA, 19 nt, Human
guucacgugcagcucaagg

SEQ ID NO: 2800568 - RNA, 24 nt, Human
guucacucuacuuagcaugucccu

SEQ ID NO: 2800569 - RNA, 15 nt, Human
guucacuaaagcagu

SEQ ID NO: 2800570 - RNA, 22 nt, Human
guucaauuuguuaguuccugua

SEQ ID NO: 2800571 - RNA, 16 nt, Human
guucacauuagaauua

SEQ ID NO: 2800572 - RNA, 17 nt, Human
guucacauuagaauuag

SEQ ID NO: 2800573 - RNA, 19 nt, Human
guucacccaucuuaucaag

SEQ ID NO: 2800574 - RNA, 15 nt, Human
guucaauucccugaa

SEQ ID NO: 2800575 - RNA, 17 nt, Human
guucaauucccugaagg

SEQ ID NO: 2800576 - RNA, 16 nt, Human
guucaucccagcccca

SEQ ID NO: 2800577 - RNA, 19 nt, Human
guucauauuccauauuuau

SEQ ID NO: 2800578 - RNA, 17 nt, Human
guucagcaccacccuag

SEQ ID NO: 2800579 - RNA, 16 nt, Human
guucagcaccacccua

SEQ ID NO: 2800580 - RNA, 13 nt, Human
guucagcacuugu

SEQ ID NO: 2800581 - RNA, 15 nt, Human
guucagcacuugucu

SEQ ID NO: 2800582 - RNA, 20 nt, Human
guucagcacuugucucauuu

SEQ ID NO: 2800583 - RNA, 22 nt, Human
guucagcacuugucucauuuua

SEQ ID NO: 2800584 - RNA, 23 nt, Human
guucagcacuugucucauuuuaa

SEQ ID NO: 2800585 - RNA, 12 nt, Human
guucauguagag

SEQ ID NO: 2800586 - RNA, 15 nt, Human
guucauguagagaaa

SEQ ID NO: 2800587 - RNA, 16 nt, Human
guucauguagagaaaa

SEQ ID NO: 2800588 - RNA, 19 nt, Human
guucauguagagaaaagca

SEQ ID NO: 2800589 - RNA, 10 nt, Human
guucauguuu

SEQ ID NO: 2800590 - RNA, 14 nt, Human
guucauguuugcuu

SEQ ID NO: 2800591 - RNA, 24 nt, Human
guucauguuugcuucauaaaugaa

SEQ ID NO: 2800592 - RNA, 16 nt, Human
guucauguuuggugca

SEQ ID NO: 2800593 - RNA, 20 nt, Human
guucauguuuggugcauaga

SEQ ID NO: 2800594 - RNA, 14 nt, Human
guucaugagaaucu

SEQ ID NO: 2800595 - RNA, 16 nt, Human
guucaugccaccaugg

SEQ ID NO: 2800596 - RNA, 12 nt, Human
guucaugagaau

SEQ ID NO: 2800597 - RNA, 19 nt, Human
guucaugagaaucuauauu

SEQ ID NO: 2800598 - RNA, 17 nt, Human
guucaugaugcagucuc

SEQ ID NO: 2800599 - RNA, 23 nt, Human
guucaugaugcagucuccucuuu

SEQ ID NO: 2800600 - RNA, 17 nt, Human
guucauccuauuguuga

SEQ ID NO: 2800601 - RNA, 18 nt, Human
guucauccuauuguugau

SEQ ID NO: 2800602 - RNA, 19 nt, Human
guuccuaagagugcugggc

SEQ ID NO: 2800603 - RNA, 21 nt, Human
guuccagcagaugccacauaa

SEQ ID NO: 2800604 - RNA, 17 nt, Human
guuccuaagaagcuucu

SEQ ID NO: 2800605 - RNA, 18 nt, Human
guuccuaagaagcuucua

SEQ ID NO: 2800606 - RNA, 19 nt, Human
guuccuaagaagcuucuaa

SEQ ID NO: 2800607 - RNA, 21 nt, Human
guuccuaagaagcuucuaaua

SEQ ID NO: 2800608 - RNA, 21 nt, Human
guuccaucuccuauaaucugu

SEQ ID NO: 2800609 - RNA, 22 nt, Human
guuccaucuccuauaaucuguc

SEQ ID NO: 2800610 - RNA, 16 nt, Human
guuccagcucuuugaa

SEQ ID NO: 2800611 - RNA, 14 nt, Human
guuccagcucuuug

SEQ ID NO: 2800612 - RNA, 12 nt, Human
guuccagcucuu

SEQ ID NO: 2800613 - RNA, 13 nt, Human
guuccuuagaccu

SEQ ID NO: 2800614 - RNA, 22 nt, Human
guuccucuuugguguacagacu

SEQ ID NO: 2800615 - RNA, 17 nt, Human
guuccugacaucacagc

SEQ ID NO: 2800616 - RNA, 20 nt, Human
guuccugacaucacagcagc

SEQ ID NO: 2800617 - RNA, 21 nt, Human
guuccugacaucacagcagcc

SEQ ID NO: 2800618 - RNA, 23 nt, Human
guuccugacaucacagcagccuc

SEQ ID NO: 2800619 - RNA, 17 nt, Human
guuccuccccgccuucc

SEQ ID NO: 2800620 - RNA, 23 nt, Human
guuccuccccuccuccuggacuc

SEQ ID NO: 2800621 - RNA, 12 nt, Human
guuccucucugg

SEQ ID NO: 2800622 - RNA, 22 nt, Human
guuccucucugguggcucuuug

SEQ ID NO: 2800623 - RNA, 12 nt, Human
guuccacagagu

SEQ ID NO: 2800624 - RNA, 20 nt, Human
guuccacagaguaagacauu

SEQ ID NO: 2800625 - RNA, 14 nt, Human
guuccacaguugcc

SEQ ID NO: 2800626 - RNA, 16 nt, Human
guuccacaguugccac

SEQ ID NO: 2800627 - RNA, 18 nt, Human
guuccacaguugccacca

SEQ ID NO: 2800628 - RNA, 23 nt, Human
guuccaauccuggcucuguggcu

SEQ ID NO: 2800629 - RNA, 16 nt, Human
guuccacguguuuuau

SEQ ID NO: 2800630 - RNA, 21 nt, Human
guuccagcaauucuccugccu

SEQ ID NO: 2800631 - RNA, 20 nt, Human
guuccagcaauucuccugcc

SEQ ID NO: 2800632 - RNA, 23 nt, Human
guuccagcaauucuccugccuca

SEQ ID NO: 2800633 - RNA, 16 nt, Human
guucauugcacuuuga

SEQ ID NO: 2800634 - RNA, 20 nt, Human
guucauuaaagcaugaaugg

SEQ ID NO: 2800635 - RNA, 16 nt, Human
guucauuaaagcauga

SEQ ID NO: 2800636 - RNA, 15 nt, Human
guucauguuugcuuc

SEQ ID NO: 2800637 - RNA, 16 nt, Human
guucauuugugugcuc

SEQ ID NO: 2800638 - RNA, 18 nt, Human
guucauuugugugcucau

SEQ ID NO: 2800639 - RNA, 17 nt, Human
guucauuugugugcuca

SEQ ID NO: 2800640 - RNA, 19 nt, Human
guuccaaaagccaauggcu

SEQ ID NO: 2800641 - RNA, 15 nt, Human
guucauuuguuuguu

SEQ ID NO: 2800642 - RNA, 14 nt, Human
guuccaagagucua

SEQ ID NO: 2800643 - RNA, 16 nt, Human
guuccaagagucuaaa

SEQ ID NO: 2800644 - RNA, 18 nt, Human
guuccaagagucuaaaga

SEQ ID NO: 2800645 - RNA, 16 nt, Human
guuccaauccuggcuc

SEQ ID NO: 2800646 - RNA, 15 nt, Human
guuccaauccuggcu

SEQ ID NO: 2800647 - RNA, 16 nt, Human
guuccaaguuuccaaa

SEQ ID NO: 2800648 - RNA, 17 nt, Human
guuccaaguuuccaaac

SEQ ID NO: 2800649 - RNA, 20 nt, Human
guuccaagagucuaaagaug

SEQ ID NO: 2800650 - RNA, 13 nt, Human
guuccaaggccag

SEQ ID NO: 2800651 - RNA, 14 nt, Human
guuccaaggccagg

SEQ ID NO: 2800652 - RNA, 17 nt, Human
guuccaaguccaauaag

SEQ ID NO: 2800653 - RNA, 19 nt, Human
guuccaaguccaauaagac

SEQ ID NO: 2800654 - RNA, 18 nt, Human
guuaaaacuguacauuua

SEQ ID NO: 2800655 - RNA, 19 nt, Human
guuaaaacuguacauuuaa

SEQ ID NO: 2800656 - RNA, 20 nt, Human
guuaaaacuguacauuuaaa

SEQ ID NO: 2800657 - RNA, 22 nt, Human
guuaaaacuguacauuuaaaau

SEQ ID NO: 2800658 - RNA, 23 nt, Human
guuaaaacuguacauuuaaaauu

SEQ ID NO: 2800659 - RNA, 20 nt, Human
guuaaaaaaaggcauuguuu

SEQ ID NO: 2800660 - RNA, 15 nt, Human
guuaaaaaaauggca

SEQ ID NO: 2800661 - RNA, 19 nt, Human
guuaaaaaaauggcaguga

SEQ ID NO: 2800662 - RNA, 13 nt, Human
guuaaaaaaaaaa

SEQ ID NO: 2800663 - RNA, 19 nt, Human
guuaaaaaaaaaaaaagga

SEQ ID NO: 2800664 - RNA, 21 nt, Human
guuaaaaaaaaaaaaaggaaa

SEQ ID NO: 2800665 - RNA, 23 nt, Human
guuaaaaaaaaaaaaaggaaaaa

SEQ ID NO: 2800666 - RNA, 11 nt, Human
guuaaaaauaa

SEQ ID NO: 2800667 - RNA, 21 nt, Human
guuaaaauaacuaguguugcu

SEQ ID NO: 2800668 - RNA, 22 nt, Human
guuaaaauacaguucugucaua

SEQ ID NO: 2800669 - RNA, 12 nt, Human
guuaaagaugca

SEQ ID NO: 2800670 - RNA, 12 nt, Human
guuaaacuguua

SEQ ID NO: 2800671 - RNA, 13 nt, Human
guuaaacuguuag

SEQ ID NO: 2800672 - RNA, 21 nt, Human
guuaaacuguuagcacuguug

SEQ ID NO: 2800673 - RNA, 22 nt, Human
guuaaacuguuagcacuguuga

SEQ ID NO: 2800674 - RNA, 19 nt, Human
guuaaaaugugaggaagaa

SEQ ID NO: 2800675 - RNA, 20 nt, Human
guuaaauacuguguggaacu

SEQ ID NO: 2800676 - RNA, 21 nt, Human
guuaaauagaguauaugcacu

SEQ ID NO: 2800677 - RNA, 19 nt, Human
guuaaauagaguauaugca

SEQ ID NO: 2800678 - RNA, 20 nt, Human
guuaaauagaguauaugcac

SEQ ID NO: 2800679 - RNA, 12 nt, Human
guuacacccuuu

SEQ ID NO: 2800680 - RNA, 22 nt, Human
guuacacccuuucuugacaaaa

SEQ ID NO: 2800681 - RNA, 17 nt, Human
guuaacugauuugcaau

SEQ ID NO: 2800682 - RNA, 18 nt, Human
guuaacugagugccuuuu

SEQ ID NO: 2800683 - RNA, 20 nt, Human
guuaagaaaucuguuuuugu

SEQ ID NO: 2800684 - RNA, 18 nt, Human
guuaacaucaugaauuua

SEQ ID NO: 2800685 - RNA, 20 nt, Human
guuaacaucaugaauuuauu

SEQ ID NO: 2800686 - RNA, 23 nt, Human
guuaacauuccaagacucuagag

SEQ ID NO: 2800687 - RNA, 13 nt, Human
guuaacauuguug

SEQ ID NO: 2800688 - RNA, 22 nt, Human
guuaacauuguugcucccugug

SEQ ID NO: 2800689 - RNA, 12 nt, Human
guuaacagauuu

SEQ ID NO: 2800690 - RNA, 24 nt, Human
guuaacauuccaagacucuagagu

SEQ ID NO: 2800691 - RNA, 15 nt, Human
guuaaccauuuaagu

SEQ ID NO: 2800692 - RNA, 17 nt, Human
guuaacuauugcauuua

SEQ ID NO: 2800693 - RNA, 15 nt, Human
guuaaaugaaauugu

SEQ ID NO: 2800694 - RNA, 17 nt, Human
guuaaaugaaauuguaa

SEQ ID NO: 2800695 - RNA, 18 nt, Human
guuaaaugaaauuguaaa

SEQ ID NO: 2800696 - RNA, 20 nt, Human
guuaaaugaaauuguaaaac

SEQ ID NO: 2800697 - RNA, 19 nt, Human
guuaaauuuguaaguuuca

SEQ ID NO: 2800698 - RNA, 23 nt, Human
guuaaauuuguaaguuucaggug

SEQ ID NO: 2800699 - RNA, 13 nt, Human
guuaaauuuguaa

SEQ ID NO: 2800700 - RNA, 14 nt, Human
guuaaauuuguaag

SEQ ID NO: 2800701 - RNA, 15 nt, Human
guuaaauuuguaagu

SEQ ID NO: 2800702 - RNA, 16 nt, Human
guuaaauuuguaaguu

SEQ ID NO: 2800703 - RNA, 17 nt, Human
guuaaauuuguaaguuu

SEQ ID NO: 2800704 - RNA, 18 nt, Human
guuaaauuuguaaguuuc

SEQ ID NO: 2800705 - RNA, 13 nt, Human
guguuauguauuu

SEQ ID NO: 2800706 - RNA, 14 nt, Human
guguuauguauuuc

SEQ ID NO: 2800707 - RNA, 16 nt, Human
guguuauucuuugcgu

SEQ ID NO: 2800708 - RNA, 17 nt, Human
guguucauacauuugag

SEQ ID NO: 2800709 - RNA, 12 nt, Human
guguucauacau

SEQ ID NO: 2800710 - RNA, 16 nt, Human
guguucacugaagacg

SEQ ID NO: 2800711 - RNA, 13 nt, Human
guguuauuuuuca

SEQ ID NO: 2800712 - RNA, 17 nt, Human
guguuccaaguuuccaa

SEQ ID NO: 2800713 - RNA, 19 nt, Human
guguuccccaucugggucc

SEQ ID NO: 2800714 - RNA, 15 nt, Human
guguucccuuugucu

SEQ ID NO: 2800715 - RNA, 20 nt, Human
guguucccuuugucuuucaa

SEQ ID NO: 2800716 - RNA, 21 nt, Human
guguucccuuugucuuucaaa

SEQ ID NO: 2800717 - RNA, 14 nt, Human
guguucgcuuggcu

SEQ ID NO: 2800718 - RNA, 13 nt, Human
guguucuaagaug

SEQ ID NO: 2800719 - RNA, 22 nt, Human
guguucuaagaugugauauucu

SEQ ID NO: 2800720 - RNA, 23 nt, Human
guguucuauccaaacauguauuu

SEQ ID NO: 2800721 - RNA, 11 nt, Human
guguucuccuu

SEQ ID NO: 2800722 - RNA, 16 nt, Human
guguucuccuuuuccu

SEQ ID NO: 2800723 - RNA, 21 nt, Human
guguuuuucuuguaaaugugu

SEQ ID NO: 2800724 - RNA, 13 nt, Human
guguuuuucucca

SEQ ID NO: 2800725 - RNA, 14 nt, Human
guguuuuucuccag

SEQ ID NO: 2800726 - RNA, 15 nt, Human
guguuuuucuccagu

SEQ ID NO: 2800727 - RNA, 18 nt, Human
guguuuuucuccagugcu

SEQ ID NO: 2800728 - RNA, 16 nt, Human
guguuuuagaugguuu

SEQ ID NO: 2800729 - RNA, 15 nt, Human
guguuuuaauuuaaa

SEQ ID NO: 2800730 - RNA, 14 nt, Human
guguucucucuuau

SEQ ID NO: 2800731 - RNA, 14 nt, Human
guguuuuaauuuaa

SEQ ID NO: 2800732 - RNA, 15 nt, Human
guguuuuauaaaaua

SEQ ID NO: 2800733 - RNA, 14 nt, Human
guguuuucugugua

SEQ ID NO: 2800734 - RNA, 16 nt, Human
guguuuucuguguaac

SEQ ID NO: 2800735 - RNA, 13 nt, Human
guguguuggacag

SEQ ID NO: 2800736 - RNA, 12 nt, Human
guguuaauuuau

SEQ ID NO: 2800737 - RNA, 16 nt, Human
guguuacugcaguuga

SEQ ID NO: 2800738 - RNA, 21 nt, Human
guguuacugcaguugaaaggg

SEQ ID NO: 2800739 - RNA, 15 nt, Human
guguuacuguaauuc

SEQ ID NO: 2800740 - RNA, 19 nt, Human
guguuacuguaauuccuca

SEQ ID NO: 2800741 - RNA, 16 nt, Human
guguuacuuauggaag

SEQ ID NO: 2800742 - RNA, 14 nt, Human
guguuacuuuuugu

SEQ ID NO: 2800743 - RNA, 17 nt, Human
guguuaacauuccaaga

SEQ ID NO: 2800744 - RNA, 14 nt, Human
guguuaacauucca

SEQ ID NO: 2800745 - RNA, 19 nt, Human
guguuaaaugaaauuguaa

SEQ ID NO: 2800746 - RNA, 18 nt, Human
gugugccugcagccccgc

SEQ ID NO: 2800747 - RNA, 16 nt, Human
gugugccugggggagu

SEQ ID NO: 2800748 - RNA, 23 nt, Human
gugugccugggggaguuuuccuc

SEQ ID NO: 2800749 - RNA, 16 nt, Human
gugugccugcagcccc

SEQ ID NO: 2800750 - RNA, 15 nt, Human
gugugccugcagccc

SEQ ID NO: 2800751 - RNA, 14 nt, Human
gugugccugcagcc

SEQ ID NO: 2800752 - RNA, 13 nt, Human
gugugccugcagc

SEQ ID NO: 2800753 - RNA, 18 nt, Human
gugugccugacugcccag

SEQ ID NO: 2800754 - RNA, 19 nt, Human
gugugccugacugcccagc

SEQ ID NO: 2800755 - RNA, 20 nt, Human
gugugccugacugcccagca

SEQ ID NO: 2800756 - RNA, 16 nt, Human
gugugcccccuucaag

SEQ ID NO: 2800757 - RNA, 19 nt, Human
gugugccucaguauauuua

SEQ ID NO: 2800758 - RNA, 22 nt, Human
gugugccucaguauauuuaaac

SEQ ID NO: 2800759 - RNA, 22 nt, Human
gugugcucugaucauccacugu

SEQ ID NO: 2800760 - RNA, 15 nt, Human
gugugcucugaucau

SEQ ID NO: 2800761 - RNA, 16 nt, Human
gugugcugagguguua

SEQ ID NO: 2800762 - RNA, 17 nt, Human
gugugcugaugggcgua

SEQ ID NO: 2800763 - RNA, 12 nt, Human
gugugcucugau

SEQ ID NO: 2800764 - RNA, 16 nt, Human
gugugcgcucugugga

SEQ ID NO: 2800765 - RNA, 21 nt, Human
guguggacuguggcacuugcc

SEQ ID NO: 2800766 - RNA, 15 nt, Human
guguggcagagagag

SEQ ID NO: 2800767 - RNA, 13 nt, Human
guguggcagcagg

SEQ ID NO: 2800768 - RNA, 14 nt, Human
guguggcagcaggc

SEQ ID NO: 2800769 - RNA, 16 nt, Human
guguggcagcaggcag

SEQ ID NO: 2800770 - RNA, 15 nt, Human
guguggccacuucug

SEQ ID NO: 2800771 - RNA, 19 nt, Human
guguggccacuucugucca

SEQ ID NO: 2800772 - RNA, 18 nt, Human
guguggauccaauguuag

SEQ ID NO: 2800773 - RNA, 13 nt, Human
guguggcugagga

SEQ ID NO: 2800774 - RNA, 14 nt, Human
guguggcuccuucc

SEQ ID NO: 2800775 - RNA, 14 nt, Human
gugugggcuguguc

SEQ ID NO: 2800776 - RNA, 15 nt, Human
guguggcugaggagg

SEQ ID NO: 2800777 - RNA, 20 nt, Human
guguggcugaggaggccucc

SEQ ID NO: 2800778 - RNA, 13 nt, Human
guguguugucuug

SEQ ID NO: 2800779 - RNA, 16 nt, Human
guguguugucuugaaa

SEQ ID NO: 2800780 - RNA, 18 nt, Human
guguguugucuugaaaga

SEQ ID NO: 2800781 - RNA, 14 nt, Human
guguguuugugauu

SEQ ID NO: 2800782 - RNA, 15 nt, Human
guguguuucugaucu

SEQ ID NO: 2800783 - RNA, 12 nt, Human
guguccuucccu

SEQ ID NO: 2800784 - RNA, 15 nt, Human
guguccuucccugca

SEQ ID NO: 2800785 - RNA, 21 nt, Human
guguccuguaguugcguggac

SEQ ID NO: 2800786 - RNA, 23 nt, Human
gugucccugcacuugcagacucu

SEQ ID NO: 2800787 - RNA, 20 nt, Human
guguccccuccacugucaca

SEQ ID NO: 2800788 - RNA, 23 nt, Human
gugucucagggugcagaggucag

SEQ ID NO: 2800789 - RNA, 20 nt, Human
gugucuaagauucuagauca

SEQ ID NO: 2800790 - RNA, 23 nt, Human
gugucucaaucugaucugaguga

SEQ ID NO: 2800791 - RNA, 16 nt, Human
gugucuaagauucuag

SEQ ID NO: 2800792 - RNA, 17 nt, Human
gugucuaagauucuaga

SEQ ID NO: 2800793 - RNA, 18 nt, Human
gugucuaagauucuagau

SEQ ID NO: 2800794 - RNA, 19 nt, Human
gugucuaagauucuagauc

SEQ ID NO: 2800795 - RNA, 15 nt, Human
gugucguagccaagg

SEQ ID NO: 2800796 - RNA, 17 nt, Human
gugucuaaaaacaccaa

SEQ ID NO: 2800797 - RNA, 14 nt, Human
gugucuaaaaacac

SEQ ID NO: 2800798 - RNA, 14 nt, Human
gugucuaagauucu

SEQ ID NO: 2800799 - RNA, 15 nt, Human
gugucuaagauucua

SEQ ID NO: 2800800 - RNA, 15 nt, Human
gugucugcucaguaa

SEQ ID NO: 2800801 - RNA, 21 nt, Human
gugucugcuuuaaagggccug

SEQ ID NO: 2800802 - RNA, 17 nt, Human
gugucugcgaaguccua

SEQ ID NO: 2800803 - RNA, 20 nt, Human
gugugagucaccaagcccag

SEQ ID NO: 2800804 - RNA, 14 nt, Human
gugugagugugaca

SEQ ID NO: 2800805 - RNA, 15 nt, Human
gugugagugugacag

SEQ ID NO: 2800806 - RNA, 18 nt, Human
gugugagugugacagggc

SEQ ID NO: 2800807 - RNA, 19 nt, Human
gugugagugugacagggcc

SEQ ID NO: 2800808 - RNA, 17 nt, Human
gugucuggauucccagg

SEQ ID NO: 2800809 - RNA, 21 nt, Human
gugucuggauucccaggauga

SEQ ID NO: 2800810 - RNA, 19 nt, Human
gugugaucccaagugccag

SEQ ID NO: 2800811 - RNA, 17 nt, Human
gugugaucccaagugcc

SEQ ID NO: 2800812 - RNA, 18 nt, Human
gugugaucucuucagggu

SEQ ID NO: 2800813 - RNA, 21 nt, Human
gugugaucuuaauauauuuga

SEQ ID NO: 2800814 - RNA, 22 nt, Human
gugugaucuuaauauauuugaa

SEQ ID NO: 2800815 - RNA, 17 nt, Human
gugugaugaacuuucuc

SEQ ID NO: 2800816 - RNA, 22 nt, Human
gugugaugaacuuucucuucau

SEQ ID NO: 2800817 - RNA, 20 nt, Human
gugugcacaaauauuuauuu

SEQ ID NO: 2800818 - RNA, 15 nt, Human
gugugcaacagacaa

SEQ ID NO: 2800819 - RNA, 16 nt, Human
gugugcaacagacaag

SEQ ID NO: 2800820 - RNA, 21 nt, Human
gugugccauagaguuuaacac

SEQ ID NO: 2800821 - RNA, 16 nt, Human
gugugcauguguguau

SEQ ID NO: 2800822 - RNA, 17 nt, Human
gugugcauguguguaua

SEQ ID NO: 2800823 - RNA, 22 nt, Human
gugugcauggaggcccuccugu

SEQ ID NO: 2800824 - RNA, 22 nt, Human
gugugcaccuuaccaacuuucu

SEQ ID NO: 2800825 - RNA, 13 nt, Human
gugugcagugaag

SEQ ID NO: 2800826 - RNA, 14 nt, Human
guguaauaagacau

SEQ ID NO: 2800827 - RNA, 13 nt, Human
guguaauaagaca

SEQ ID NO: 2800828 - RNA, 15 nt, Human
guguaauaagacaua

SEQ ID NO: 2800829 - RNA, 22 nt, Human
guguaauaagacuuagauugug

SEQ ID NO: 2800830 - RNA, 12 nt, Human
guguaauaagac

SEQ ID NO: 2800831 - RNA, 17 nt, Human
guggugccauccccagg

SEQ ID NO: 2800832 - RNA, 16 nt, Human
guggugccauccccag

SEQ ID NO: 2800833 - RNA, 23 nt, Human
guggugagcagaaguggagcugg

SEQ ID NO: 2800834 - RNA, 14 nt, Human
guggugcagacaga

SEQ ID NO: 2800835 - RNA, 18 nt, Human
guggugccaucauugcug

SEQ ID NO: 2800836 - RNA, 23 nt, Human
guggugccaucauugcugucugc

SEQ ID NO: 2800837 - RNA, 19 nt, Human
guggugcgaucuggguuca

SEQ ID NO: 2800838 - RNA, 22 nt, Human
guggugccauccccagggggca

SEQ ID NO: 2800839 - RNA, 17 nt, Human
guggugaccucugccug

SEQ ID NO: 2800840 - RNA, 14 nt, Human
guggugaccucugc

SEQ ID NO: 2800841 - RNA, 19 nt, Human
guggucuucaaauugucuu

SEQ ID NO: 2800842 - RNA, 23 nt, Human
guggucuucaaauugucuuuugu

SEQ ID NO: 2800843 - RNA, 15 nt, Human
guggucuuuguaaga

SEQ ID NO: 2800844 - RNA, 19 nt, Human
guggucuuuguaagagugu

SEQ ID NO: 2800845 - RNA, 19 nt, Human
gugguaugaucacggcuca

SEQ ID NO: 2800846 - RNA, 14 nt, Human
guggguggggcugc

SEQ ID NO: 2800847 - RNA, 13 nt, Human
gugguaugugaca

SEQ ID NO: 2800848 - RNA, 14 nt, Human
gugguacccucugg

SEQ ID NO: 2800849 - RNA, 12 nt, Human
gugguacucuga

SEQ ID NO: 2800850 - RNA, 19 nt, Human
gugguaggccuuuuaacau

SEQ ID NO: 2800851 - RNA, 22 nt, Human
gugguaggccuuuuaacauuuu

SEQ ID NO: 2800852 - RNA, 23 nt, Human
gugguaggccuuuuaacauuuug

SEQ ID NO: 2800853 - RNA, 21 nt, Human
gugguagguacuuuuugugaa

SEQ ID NO: 2800854 - RNA, 23 nt, Human
gugguagguacuuuuugugaaga

SEQ ID NO: 2800855 - RNA, 18 nt, Human
gugguaguaaaacacaga

SEQ ID NO: 2800856 - RNA, 19 nt, Human
gugguaguaaaacacagag

SEQ ID NO: 2800857 - RNA, 20 nt, Human
gugguaguaaaacacagagg

SEQ ID NO: 2800858 - RNA, 11 nt, Human
guggucucagg

SEQ ID NO: 2800859 - RNA, 12 nt, Human
guggucucagga

SEQ ID NO: 2800860 - RNA, 13 nt, Human
guggucucaggau

SEQ ID NO: 2800861 - RNA, 13 nt, Human
gugguccccaaca

SEQ ID NO: 2800862 - RNA, 12 nt, Human
guguacagguac

SEQ ID NO: 2800863 - RNA, 17 nt, Human
guguaauuuauaaaauu

SEQ ID NO: 2800864 - RNA, 12 nt, Human
guguaauuuaug

SEQ ID NO: 2800865 - RNA, 14 nt, Human
guguacaauguaca

SEQ ID NO: 2800866 - RNA, 16 nt, Human
guguacaauguacaca

SEQ ID NO: 2800867 - RNA, 20 nt, Human
guguacaauguacacacugg

SEQ ID NO: 2800868 - RNA, 22 nt, Human
guguaauguagcguguuuacau

SEQ ID NO: 2800869 - RNA, 18 nt, Human
guguacauaguguaaugu

SEQ ID NO: 2800870 - RNA, 17 nt, Human
guguaccauuugccucc

SEQ ID NO: 2800871 - RNA, 21 nt, Human
guguaccuccucucaguguuu

SEQ ID NO: 2800872 - RNA, 20 nt, Human
guguaccuguguacauaacu

SEQ ID NO: 2800873 - RNA, 15 nt, Human
guguacuuaacuauu

SEQ ID NO: 2800874 - RNA, 18 nt, Human
guguacucacugaagccu

SEQ ID NO: 2800875 - RNA, 12 nt, Human
guguacuguaua

SEQ ID NO: 2800876 - RNA, 19 nt, Human
guguacuguauagacaguu

SEQ ID NO: 2800877 - RNA, 11 nt, Human
guguacugugu

SEQ ID NO: 2800878 - RNA, 13 nt, Human
guguacuguguca

SEQ ID NO: 2800879 - RNA, 16 nt, Human
guguacuggcuccucu

SEQ ID NO: 2800880 - RNA, 15 nt, Human
guguagaguuaagaa

SEQ ID NO: 2800881 - RNA, 19 nt, Human
guguagaagcauuccuucu

SEQ ID NO: 2800882 - RNA, 23 nt, Human
guguagaagcauuccuucuuuga

SEQ ID NO: 2800883 - RNA, 13 nt, Human
guguagaagcauu

SEQ ID NO: 2800884 - RNA, 14 nt, Human
guguagaagcauuc

SEQ ID NO: 2800885 - RNA, 17 nt, Human
guguagaagcauuccuu

SEQ ID NO: 2800886 - RNA, 20 nt, Human
guguagaguuaagaagcugu

SEQ ID NO: 2800887 - RNA, 17 nt, Human
guguagaguuaagaagc

SEQ ID NO: 2800888 - RNA, 18 nt, Human
guguagaguuaagaagcu

SEQ ID NO: 2800889 - RNA, 14 nt, Human
guguagccaagguc

SEQ ID NO: 2800890 - RNA, 21 nt, Human
guguagccagguauggcucug

SEQ ID NO: 2800891 - RNA, 23 nt, Human
guguagccagguauggcucugca

SEQ ID NO: 2800892 - RNA, 22 nt, Human
guguagccaggucccccugcag

SEQ ID NO: 2800893 - RNA, 17 nt, Human
guguagccuugcccgga

SEQ ID NO: 2800894 - RNA, 16 nt, Human
guguagccuugcccgg

SEQ ID NO: 2800895 - RNA, 14 nt, Human
guguagccugugca

SEQ ID NO: 2800896 - RNA, 18 nt, Human
gugucccugcacuugcag

SEQ ID NO: 2800897 - RNA, 16 nt, Human
gugucccugcacuugc

SEQ ID NO: 2800898 - RNA, 13 nt, Human
gugucccugcacu

SEQ ID NO: 2800899 - RNA, 17 nt, Human
guguccccggggcccag

SEQ ID NO: 2800900 - RNA, 18 nt, Human
guguccccggggcccagg

SEQ ID NO: 2800901 - RNA, 19 nt, Human
guguccccggggcccaggg

SEQ ID NO: 2800902 - RNA, 13 nt, Human
guguccccuccac

SEQ ID NO: 2800903 - RNA, 21 nt, Human
guguauggaaaaaccauuuga

SEQ ID NO: 2800904 - RNA, 19 nt, Human
guguauggaaauaaaugua

SEQ ID NO: 2800905 - RNA, 19 nt, Human
gugucccauugguguuguc

SEQ ID NO: 2800906 - RNA, 14 nt, Human
guguauauuauuug

SEQ ID NO: 2800907 - RNA, 15 nt, Human
guguauauuauuugg

SEQ ID NO: 2800908 - RNA, 16 nt, Human
guguauauuauuuggc

SEQ ID NO: 2800909 - RNA, 17 nt, Human
guguauauuauuuggca

SEQ ID NO: 2800910 - RNA, 19 nt, Human
guguauauuauuuggcagu

SEQ ID NO: 2800911 - RNA, 13 nt, Human
guguauaucagaa

SEQ ID NO: 2800912 - RNA, 13 nt, Human
guguauauaugug

SEQ ID NO: 2800913 - RNA, 18 nt, Human
guguauauauguguauau

SEQ ID NO: 2800914 - RNA, 22 nt, Human
guguauauauguguauauauac

SEQ ID NO: 2800915 - RNA, 17 nt, Human
guguauaagugcacaca

SEQ ID NO: 2800916 - RNA, 18 nt, Human
guguaucguaaccagcca

SEQ ID NO: 2800917 - RNA, 21 nt, Human
guguauccccccccuguauag

SEQ ID NO: 2800918 - RNA, 22 nt, Human
guguauccccccccuguauagu

SEQ ID NO: 2800919 - RNA, 14 nt, Human
guguaguuaauuua

SEQ ID NO: 2800920 - RNA, 18 nt, Human
guguauagaaguagauua

SEQ ID NO: 2800921 - RNA, 13 nt, Human
guguauauauaca

SEQ ID NO: 2800922 - RNA, 14 nt, Human
guguauauauacau

SEQ ID NO: 2800923 - RNA, 15 nt, Human
guguauauauacaua

SEQ ID NO: 2800924 - RNA, 16 nt, Human
guguauauauacauac

SEQ ID NO: 2800925 - RNA, 14 nt, Human
guguagcuuugcuc

SEQ ID NO: 2800926 - RNA, 12 nt, Human
guggcugcugcc

SEQ ID NO: 2800927 - RNA, 19 nt, Human
guggcugcgugccccugcu

SEQ ID NO: 2800928 - RNA, 20 nt, Human
guggcugcgugccccugcug

SEQ ID NO: 2800929 - RNA, 16 nt, Human
guggcugcugcccagg

SEQ ID NO: 2800930 - RNA, 13 nt, Human
guggcugcugccc

SEQ ID NO: 2800931 - RNA, 15 nt, Human
guggcugcugcccag

SEQ ID NO: 2800932 - RNA, 13 nt, Human
guggcuccuuccc

SEQ ID NO: 2800933 - RNA, 13 nt, Human
guggcuccucccg

SEQ ID NO: 2800934 - RNA, 20 nt, Human
guggcuccucccggugccca

SEQ ID NO: 2800935 - RNA, 22 nt, Human
guggcuuaaaacaacacucaca

SEQ ID NO: 2800936 - RNA, 12 nt, Human
guggcugucugg

SEQ ID NO: 2800937 - RNA, 13 nt, Human
guggcugucugga

SEQ ID NO: 2800938 - RNA, 15 nt, Human
guggcugucuggaaa

SEQ ID NO: 2800939 - RNA, 23 nt, Human
guggcuguggagacaaugucugc

SEQ ID NO: 2800940 - RNA, 22 nt, Human
guggcugggggcaggagggccc

SEQ ID NO: 2800941 - RNA, 17 nt, Human
guggcugggggcaggag

SEQ ID NO: 2800942 - RNA, 21 nt, Human
guggcuucauuagagcaggcg

SEQ ID NO: 2800943 - RNA, 18 nt, Human
guggcuucccaugucuuu

SEQ ID NO: 2800944 - RNA, 16 nt, Human
gugggcacccacccug

SEQ ID NO: 2800945 - RNA, 20 nt, Human
gugggcacccacccugggac

SEQ ID NO: 2800946 - RNA, 16 nt, Human
gugggcacuggcccag

SEQ ID NO: 2800947 - RNA, 21 nt, Human
gugggcagagcccccaggaag

SEQ ID NO: 2800948 - RNA, 19 nt, Human
guggcuucauuagagcagg

SEQ ID NO: 2800949 - RNA, 20 nt, Human
guggcuucauuagagcaggc

SEQ ID NO: 2800950 - RNA, 15 nt, Human
guggcuucagcucca

SEQ ID NO: 2800951 - RNA, 19 nt, Human
guggcuucagcuccagccc

SEQ ID NO: 2800952 - RNA, 18 nt, Human
guggcuucccgcucagcc

SEQ ID NO: 2800953 - RNA, 19 nt, Human
guggcuucccgcucagccc

SEQ ID NO: 2800954 - RNA, 20 nt, Human
guggcuucccgcucagcccu

SEQ ID NO: 2800955 - RNA, 19 nt, Human
guggcuggguuggagggug

SEQ ID NO: 2800956 - RNA, 16 nt, Human
guggcugggggcagga

SEQ ID NO: 2800957 - RNA, 11 nt, Human
guggcuggggg

SEQ ID NO: 2800958 - RNA, 20 nt, Human
gugggcauuucuugcgagcc

SEQ ID NO: 2800959 - RNA, 13 nt, Human
gugggccagggcu

SEQ ID NO: 2800960 - RNA, 14 nt, Human
gugggccagggcug

SEQ ID NO: 2800961 - RNA, 19 nt, Human
gugggccagggcugcccug

SEQ ID NO: 2800962 - RNA, 21 nt, Human
gugggccagggcugcccugag

SEQ ID NO: 2800963 - RNA, 15 nt, Human
gugggcuaguugggc

SEQ ID NO: 2800964 - RNA, 14 nt, Human
gugggcuaauuaaa

SEQ ID NO: 2800965 - RNA, 13 nt, Human
gugggcuccuggc

SEQ ID NO: 2800966 - RNA, 16 nt, Human
gugggcugagcccugg

SEQ ID NO: 2800967 - RNA, 15 nt, Human
gugggcugagcccug

SEQ ID NO: 2800968 - RNA, 14 nt, Human
gugggcugagcccu

SEQ ID NO: 2800969 - RNA, 13 nt, Human
gugggcugagccc

SEQ ID NO: 2800970 - RNA, 18 nt, Human
gugggcgugagaccugcc

SEQ ID NO: 2800971 - RNA, 22 nt, Human
gugggcgugagaccugccccuc

SEQ ID NO: 2800972 - RNA, 21 nt, Human
gugggcgugagaccugccccu

SEQ ID NO: 2800973 - RNA, 19 nt, Human
gugggccuucagggaguga

SEQ ID NO: 2800974 - RNA, 17 nt, Human
guggggcagcuugaggg

SEQ ID NO: 2800975 - RNA, 13 nt, Human
guggggcagcuug

SEQ ID NO: 2800976 - RNA, 21 nt, Human
guggguuuucaucaagacugg

SEQ ID NO: 2800977 - RNA, 22 nt, Human
gugguaaaugccacacaccuuu

SEQ ID NO: 2800978 - RNA, 14 nt, Human
guggguguagccag

SEQ ID NO: 2800979 - RNA, 12 nt, Human
guggguguguga

SEQ ID NO: 2800980 - RNA, 15 nt, Human
gugggugugugacuc

SEQ ID NO: 2800981 - RNA, 16 nt, Human
guggguuauucuggag

SEQ ID NO: 2800982 - RNA, 13 nt, Human
guggguucuaugu

SEQ ID NO: 2800983 - RNA, 13 nt, Human
guggguugcuaac

SEQ ID NO: 2800984 - RNA, 18 nt, Human
gugggcugagcccuggca

SEQ ID NO: 2800985 - RNA, 16 nt, Human
gugggcuucccagugg

SEQ ID NO: 2800986 - RNA, 22 nt, Human
gugggcuucccaguggcugcug

SEQ ID NO: 2800987 - RNA, 23 nt, Human
gugggcuucccaguggcugcugc

SEQ ID NO: 2800988 - RNA, 15 nt, Human
gugggcuucagggca

SEQ ID NO: 2800989 - RNA, 16 nt, Human
gugggcuucagggcag

SEQ ID NO: 2800990 - RNA, 13 nt, Human
guggggagguguc

SEQ ID NO: 2800991 - RNA, 13 nt, Human
guggggaggggcu

SEQ ID NO: 2800992 - RNA, 15 nt, Human
guggggcagagccuc

SEQ ID NO: 2800993 - RNA, 14 nt, Human
gugggcuugauucu

SEQ ID NO: 2800994 - RNA, 13 nt, Human
guggggacccagg

SEQ ID NO: 2800995 - RNA, 16 nt, Human
guggggacccaggcuc

SEQ ID NO: 2800996 - RNA, 18 nt, Human
guggggacccaggcuccg

SEQ ID NO: 2800997 - RNA, 21 nt, Human
guggggacccaggcuccgccc

SEQ ID NO: 2800998 - RNA, 16 nt, Human
guuguggauuucaguu

SEQ ID NO: 2800999 - RNA, 12 nt, Human
guuuagaccaag

SEQ ID NO: 2801000 - RNA, 15 nt, Human
guuuagaccaaggaa

SEQ ID NO: 2801001 - RNA, 20 nt, Human
guuuagaccaaggaacaaaa

SEQ ID NO: 2801002 - RNA, 22 nt, Human
guuuagaccaaggaacaaaaaa

SEQ ID NO: 2801003 - RNA, 19 nt, Human
guuuauaaaauauaaacaa

SEQ ID NO: 2801004 - RNA, 20 nt, Human
guuuauagagggccaagacu

SEQ ID NO: 2801005 - RNA, 21 nt, Human
guuuauagagggccaagacuu

SEQ ID NO: 2801006 - RNA, 18 nt, Human
guuuauaaaauauaaaca

SEQ ID NO: 2801007 - RNA, 13 nt, Human
guuuauaaaauau

SEQ ID NO: 2801008 - RNA, 17 nt, Human
guuuauaauuuucugaa

SEQ ID NO: 2801009 - RNA, 17 nt, Human
guuuauaacuauucagu

SEQ ID NO: 2801010 - RNA, 19 nt, Human
guuuauaacuauucaguug

SEQ ID NO: 2801011 - RNA, 15 nt, Human
guuuauaccuuugcc

SEQ ID NO: 2801012 - RNA, 20 nt, Human
guuuauacuccaguguacau

SEQ ID NO: 2801013 - RNA, 23 nt, Human
guuuauagagaaugaugauaaca

SEQ ID NO: 2801014 - RNA, 18 nt, Human
guuucauguuuugugacu

SEQ ID NO: 2801015 - RNA, 16 nt, Human
guuucauucuccugcc

SEQ ID NO: 2801016 - RNA, 19 nt, Human
guuucauguuuugugacua

SEQ ID NO: 2801017 - RNA, 15 nt, Human
guuucauucuccugc

SEQ ID NO: 2801018 - RNA, 18 nt, Human
guuucauaauuguguacu

SEQ ID NO: 2801019 - RNA, 14 nt, Human
guuucaggugacau

SEQ ID NO: 2801020 - RNA, 15 nt, Human
guuucaggugacaug

SEQ ID NO: 2801021 - RNA, 16 nt, Human
guuucaggugacaugu

SEQ ID NO: 2801022 - RNA, 20 nt, Human
guuucaggugacaugugaaa

SEQ ID NO: 2801023 - RNA, 22 nt, Human
guuuagugcaucuuugccucuc

SEQ ID NO: 2801024 - RNA, 12 nt, Human
guuuaugaaaau

SEQ ID NO: 2801025 - RNA, 14 nt, Human
guuuaucaugaagc

SEQ ID NO: 2801026 - RNA, 15 nt, Human
guuuaucaugaagcc

SEQ ID NO: 2801027 - RNA, 16 nt, Human
guuuaucaugaagccu

SEQ ID NO: 2801028 - RNA, 17 nt, Human
guuuaucaugaagccug

SEQ ID NO: 2801029 - RNA, 21 nt, Human
guuuauauuuuuucaguuguu

SEQ ID NO: 2801030 - RNA, 18 nt, Human
guuuaucaacucaagaau

SEQ ID NO: 2801031 - RNA, 14 nt, Human
guuuauauguguug

SEQ ID NO: 2801032 - RNA, 18 nt, Human
guuuauauguguugaaaa

SEQ ID NO: 2801033 - RNA, 15 nt, Human
guuuaucagauacau

SEQ ID NO: 2801034 - RNA, 16 nt, Human
guuuaucagauacauc

SEQ ID NO: 2801035 - RNA, 18 nt, Human
guuuaucagauacaucac

SEQ ID NO: 2801036 - RNA, 19 nt, Human
guuuaucagauacaucacu

SEQ ID NO: 2801037 - RNA, 21 nt, Human
guuuaucagauacaucacugc

SEQ ID NO: 2801038 - RNA, 23 nt, Human
guuuaucagauacaucacugcuu

SEQ ID NO: 2801039 - RNA, 15 nt, Human
guuuaucagcaaaaa

SEQ ID NO: 2801040 - RNA, 14 nt, Human
guuuagaagcugag

SEQ ID NO: 2801041 - RNA, 15 nt, Human
guuuagaagcugaga

SEQ ID NO: 2801042 - RNA, 22 nt, Human
guuuagaagcugagacacaaag

SEQ ID NO: 2801043 - RNA, 11 nt, Human
guuuacauuuu

SEQ ID NO: 2801044 - RNA, 16 nt, Human
guuuaccauuuuucau

SEQ ID NO: 2801045 - RNA, 17 nt, Human
guuuaccauuuuucauu

SEQ ID NO: 2801046 - RNA, 16 nt, Human
guuuacccaugaagau

SEQ ID NO: 2801047 - RNA, 16 nt, Human
guuuacccgguuucuu

SEQ ID NO: 2801048 - RNA, 13 nt, Human
guuuaccuagaag

SEQ ID NO: 2801049 - RNA, 23 nt, Human
guuuaccuagaagaagcuauguc

SEQ ID NO: 2801050 - RNA, 12 nt, Human
guuuacauuuuu

SEQ ID NO: 2801051 - RNA, 20 nt, Human
guuuacauuuuuauuuauga

SEQ ID NO: 2801052 - RNA, 21 nt, Human
guuuacauuuuuauuuaugaa

SEQ ID NO: 2801053 - RNA, 22 nt, Human
guuuacauuuuuauuuaugaag

SEQ ID NO: 2801054 - RNA, 23 nt, Human
guuuacauuuuuauuuaugaagu

SEQ ID NO: 2801055 - RNA, 16 nt, Human
guuuaccugaauaaau

SEQ ID NO: 2801056 - RNA, 22 nt, Human
guuuaccugaauaaaugguagu

SEQ ID NO: 2801057 - RNA, 20 nt, Human
guuuacuaugccugugucuu

SEQ ID NO: 2801058 - RNA, 17 nt, Human
guuuacuaugccugugu

SEQ ID NO: 2801059 - RNA, 16 nt, Human
guuuacuaugccugug

SEQ ID NO: 2801060 - RNA, 13 nt, Human
guuguuaugcuau

SEQ ID NO: 2801061 - RNA, 13 nt, Human
guuguucaacuau

SEQ ID NO: 2801062 - RNA, 15 nt, Human
guuguucaacuauuu

SEQ ID NO: 2801063 - RNA, 16 nt, Human
guuguucaacuauuuu

SEQ ID NO: 2801064 - RNA, 11 nt, Human
guuguuagaga

SEQ ID NO: 2801065 - RNA, 14 nt, Human
guuguuagagaaaa

SEQ ID NO: 2801066 - RNA, 12 nt, Human
guuguuucagug

SEQ ID NO: 2801067 - RNA, 23 nt, Human
guuguuucagugaauaugccugu

SEQ ID NO: 2801068 - RNA, 20 nt, Human
guuguuuacuuaaagauuua

SEQ ID NO: 2801069 - RNA, 14 nt, Human
guuguugcauguuu

SEQ ID NO: 2801070 - RNA, 17 nt, Human
guuguugcauguuugaa

SEQ ID NO: 2801071 - RNA, 18 nt, Human
guuguugcuucuugugaa

SEQ ID NO: 2801072 - RNA, 20 nt, Human
guuguugcuucuugugaagg

SEQ ID NO: 2801073 - RNA, 11 nt, Human
guuguuucuuu

SEQ ID NO: 2801074 - RNA, 13 nt, Human
guuguuucuuucu

SEQ ID NO: 2801075 - RNA, 14 nt, Human
guuguuucuuucua

SEQ ID NO: 2801076 - RNA, 15 nt, Human
guuguuucuuucuag

SEQ ID NO: 2801077 - RNA, 12 nt, Human
guuuacauuuaa

SEQ ID NO: 2801078 - RNA, 14 nt, Human
guuuacauuuaaag

SEQ ID NO: 2801079 - RNA, 15 nt, Human
guuuacauuuaaagc

SEQ ID NO: 2801080 - RNA, 17 nt, Human
guuuacauuuaaagcau

SEQ ID NO: 2801081 - RNA, 18 nt, Human
guuuacauuuaaagcauu

SEQ ID NO: 2801082 - RNA, 21 nt, Human
guuuacauuuaaagcauugcu

SEQ ID NO: 2801083 - RNA, 23 nt, Human
guuuacauuuaaagcauugcugu

SEQ ID NO: 2801084 - RNA, 12 nt, Human
guuggcuggggg

SEQ ID NO: 2801085 - RNA, 17 nt, Human
guuggcugggaacucac

SEQ ID NO: 2801086 - RNA, 14 nt, Human
guuggcuggaugaa

SEQ ID NO: 2801087 - RNA, 12 nt, Human
guuggcuggccu

SEQ ID NO: 2801088 - RNA, 13 nt, Human
guuggcuggccuu

SEQ ID NO: 2801089 - RNA, 20 nt, Human
guuggcugacuuccacaccu

SEQ ID NO: 2801090 - RNA, 14 nt, Human
guuggccccugccc

SEQ ID NO: 2801091 - RNA, 13 nt, Human
guuggccccugcc

SEQ ID NO: 2801092 - RNA, 20 nt, Human
guuggccccugcccggcugc

SEQ ID NO: 2801093 - RNA, 13 nt, Human
guuggccugcacu

SEQ ID NO: 2801094 - RNA, 18 nt, Human
guuggccaggcuggucua

SEQ ID NO: 2801095 - RNA, 19 nt, Human
guuggcugggggccucagu

SEQ ID NO: 2801096 - RNA, 16 nt, Human
guugucacugcuuuug

SEQ ID NO: 2801097 - RNA, 21 nt, Human
guugucacugcuuuuggccug

SEQ ID NO: 2801098 - RNA, 22 nt, Human
guugucacugcuuuuggccugg

SEQ ID NO: 2801099 - RNA, 22 nt, Human
guugucaagucucugcuggccc

SEQ ID NO: 2801100 - RNA, 17 nt, Human
guugucaagucucugcu

SEQ ID NO: 2801101 - RNA, 20 nt, Human
guugucauuguaaacaaacu

SEQ ID NO: 2801102 - RNA, 22 nt, Human
guugucaguauuauucuacuau

SEQ ID NO: 2801103 - RNA, 22 nt, Human
guuguccaauuguugacaguuc

SEQ ID NO: 2801104 - RNA, 18 nt, Human
guuguccauauuuucaca

SEQ ID NO: 2801105 - RNA, 22 nt, Human
guugucugaagucacugcacag

SEQ ID NO: 2801106 - RNA, 19 nt, Human
guugucugaagucacugca

SEQ ID NO: 2801107 - RNA, 14 nt, Human
guugugaauguugu

SEQ ID NO: 2801108 - RNA, 19 nt, Human
guugugaaaguuuugagua

SEQ ID NO: 2801109 - RNA, 17 nt, Human
guugugcaaauuaacag

SEQ ID NO: 2801110 - RNA, 10 nt, Human
guugugcagc

SEQ ID NO: 2801111 - RNA, 18 nt, Human
guugugcagcuuuugguc

SEQ ID NO: 2801112 - RNA, 21 nt, Human
guugugccacagaguguagcc

SEQ ID NO: 2801113 - RNA, 22 nt, Human
guugugccacagaguguagcca

SEQ ID NO: 2801114 - RNA, 21 nt, Human
guugugauagcuaacauuuua

SEQ ID NO: 2801115 - RNA, 21 nt, Human
guugugaucaucccaucuaag

SEQ ID NO: 2801116 - RNA, 21 nt, Human
guugugaugucuuuucuuggc

SEQ ID NO: 2801117 - RNA, 19 nt, Human
guuguggaaagccucugcu

SEQ ID NO: 2801118 - RNA, 18 nt, Human
guuguggguucuauguuu

SEQ ID NO: 2801119 - RNA, 12 nt, Human
guugugucuuuu

SEQ ID NO: 2801120 - RNA, 23 nt, Human
guuguuaaaauuaugaaucugau

SEQ ID NO: 2801121 - RNA, 12 nt, Human
guuguguuguca

SEQ ID NO: 2801122 - RNA, 14 nt, Human
guuguguugucacc

SEQ ID NO: 2801123 - RNA, 20 nt, Human
guuguguuuguugcuggcuu

SEQ ID NO: 2801124 - RNA, 20 nt, Human
guuuuccucuauacaucucu

SEQ ID NO: 2801125 - RNA, 22 nt, Human
guuuuccucuauacaucucucc

SEQ ID NO: 2801126 - RNA, 24 nt, Human
guuuuccucuauacaucucucccc

SEQ ID NO: 2801127 - RNA, 20 nt, Human
guuuucccuugaggaaacaa

SEQ ID NO: 2801128 - RNA, 19 nt, Human
guuuuguacauguaacauu

SEQ ID NO: 2801129 - RNA, 14 nt, Human
guuuugguuuuuuu

SEQ ID NO: 2801130 - RNA, 16 nt, Human
guuuugguguaacauc

SEQ ID NO: 2801131 - RNA, 15 nt, Human
guuuugggggucagg

SEQ ID NO: 2801132 - RNA, 22 nt, Human
guuuugggggucaggcagccag

SEQ ID NO: 2801133 - RNA, 21 nt, Human
guuuugggggugugaguguuu

SEQ ID NO: 2801134 - RNA, 18 nt, Human
guuuuggguagcugccac

SEQ ID NO: 2801135 - RNA, 15 nt, Human
guuuuggguauguuu

SEQ ID NO: 2801136 - RNA, 17 nt, Human
guuuugguagauuaaau

SEQ ID NO: 2801137 - RNA, 14 nt, Human
guuuuguacauaga

SEQ ID NO: 2801138 - RNA, 17 nt, Human
guuuuguacauagauuu

SEQ ID NO: 2801139 - RNA, 18 nt, Human
guuuuguacauagauuua

SEQ ID NO: 2801140 - RNA, 12 nt, Human
guuuuguacaug

SEQ ID NO: 2801141 - RNA, 14 nt, Human
guuuguuauauccu

SEQ ID NO: 2801142 - RNA, 21 nt, Human
guuuguguguugucuugaaag

SEQ ID NO: 2801143 - RNA, 11 nt, Human
guuuguuuguc

SEQ ID NO: 2801144 - RNA, 14 nt, Human
guuuguuugucugu

SEQ ID NO: 2801145 - RNA, 15 nt, Human
guuuguuugucuguu

SEQ ID NO: 2801146 - RNA, 17 nt, Human
guuuguuuguuugucug

SEQ ID NO: 2801147 - RNA, 13 nt, Human
guuuguuuuugcu

SEQ ID NO: 2801148 - RNA, 16 nt, Human
guuuguuuuugcuugu

SEQ ID NO: 2801149 - RNA, 12 nt, Human
guuuguuuuuuu

SEQ ID NO: 2801150 - RNA, 15 nt, Human
guuuguuuuuuugcc

SEQ ID NO: 2801151 - RNA, 17 nt, Human
guuuguuuuuuugccac

SEQ ID NO: 2801152 - RNA, 12 nt, Human
guuuguuucuuu

SEQ ID NO: 2801153 - RNA, 14 nt, Human
guuuguuucuuugu

SEQ ID NO: 2801154 - RNA, 15 nt, Human
guuuguuucuuugug

SEQ ID NO: 2801155 - RNA, 20 nt, Human
guuuuaaaaaggaacugcag

SEQ ID NO: 2801156 - RNA, 21 nt, Human
guuuuaaaaaggaacugcagc

SEQ ID NO: 2801157 - RNA, 22 nt, Human
guuuuaaaaaggaacugcagca

SEQ ID NO: 2801158 - RNA, 21 nt, Human
guuuuauuuuuuauuguuuuc

SEQ ID NO: 2801159 - RNA, 17 nt, Human
guuuucaaauuggacuu

SEQ ID NO: 2801160 - RNA, 23 nt, Human
guuuucaaauuggacuuucaaaa

SEQ ID NO: 2801161 - RNA, 12 nt, Human
guuuucacucuu

SEQ ID NO: 2801162 - RNA, 11 nt, Human
guuuucacucu

SEQ ID NO: 2801163 - RNA, 21 nt, Human
guuuucagaaccucuucccca

SEQ ID NO: 2801164 - RNA, 20 nt, Human
guuuucagaaccucuucccc

SEQ ID NO: 2801165 - RNA, 19 nt, Human
guuuucagaaccucuuccc

SEQ ID NO: 2801166 - RNA, 20 nt, Human
guuuucacauaaaugcagcc

SEQ ID NO: 2801167 - RNA, 22 nt, Human
guuuucacauaaaugcagccca

SEQ ID NO: 2801168 - RNA, 23 nt, Human
guuuucacauaaaugcagcccau

SEQ ID NO: 2801169 - RNA, 15 nt, Human
guuuguguguugucu

SEQ ID NO: 2801170 - RNA, 16 nt, Human
guuuguuaaaaauaaa

SEQ ID NO: 2801171 - RNA, 19 nt, Human
guuuguuaaaaauaaaucc

SEQ ID NO: 2801172 - RNA, 13 nt, Human
guuuguggcuggg

SEQ ID NO: 2801173 - RNA, 22 nt, Human
guuuguggcugggggcaggagg

SEQ ID NO: 2801174 - RNA, 20 nt, Human
guuuguggcugggggcagga

SEQ ID NO: 2801175 - RNA, 22 nt, Human
guuuguguauuuacgcuuugau

SEQ ID NO: 2801176 - RNA, 13 nt, Human
guuugugugucuu

SEQ ID NO: 2801177 - RNA, 14 nt, Human
guuugugugucuua

SEQ ID NO: 2801178 - RNA, 15 nt, Human
guuugugugucuuaa

SEQ ID NO: 2801179 - RNA, 13 nt, Human
guuugucuauuuu

SEQ ID NO: 2801180 - RNA, 14 nt, Human
guuugucuauuuua

SEQ ID NO: 2801181 - RNA, 15 nt, Human
guuugucuauuuuaa

SEQ ID NO: 2801182 - RNA, 16 nt, Human
guuugucuauuuuaaa

SEQ ID NO: 2801183 - RNA, 19 nt, Human
guuugucuauuuuaaaaua

SEQ ID NO: 2801184 - RNA, 18 nt, Human
guuugucucaguuggaaa

SEQ ID NO: 2801185 - RNA, 19 nt, Human
guuugucucaguuggaaau

SEQ ID NO: 2801186 - RNA, 15 nt, Human
guuugucucuccuuu

SEQ ID NO: 2801187 - RNA, 16 nt, Human
guuugucucuccuuuu

SEQ ID NO: 2801188 - RNA, 16 nt, Human
guuuguggccucagaa

SEQ ID NO: 2801189 - RNA, 13 nt, Human
guuuguaugugug

SEQ ID NO: 2801190 - RNA, 15 nt, Human
guuuguggccucaga

SEQ ID NO: 2801191 - RNA, 17 nt, Human
guuugucacaugaaaca

SEQ ID NO: 2801192 - RNA, 20 nt, Human
guuugucaucagauggaaau

SEQ ID NO: 2801193 - RNA, 22 nt, Human
guuuguccugaugcuuuugucu

SEQ ID NO: 2801194 - RNA, 17 nt, Human
guuuguaguuguuuuaa

SEQ ID NO: 2801195 - RNA, 15 nt, Human
guuuguauaacuucu

SEQ ID NO: 2801196 - RNA, 13 nt, Human
guuuguaagaaaa

SEQ ID NO: 2801197 - RNA, 14 nt, Human
guuuguagguaaaa

SEQ ID NO: 2801198 - RNA, 16 nt, Human
guuuguauaacuucuu

SEQ ID NO: 2801199 - RNA, 20 nt, Human
guuuguauguguguagacaa

SEQ ID NO: 2801200 - RNA, 12 nt, Human
guuuguauuugg

SEQ ID NO: 2801201 - RNA, 18 nt, Human
guuuggggcaagucaugu

SEQ ID NO: 2801202 - RNA, 21 nt, Human
guuuggggcaagucauguaaa

SEQ ID NO: 2801203 - RNA, 15 nt, Human
guuugguguguccca

SEQ ID NO: 2801204 - RNA, 17 nt, Human
guuugggugauuccuaa

SEQ ID NO: 2801205 - RNA, 15 nt, Human
guuuggucuggacug

SEQ ID NO: 2801206 - RNA, 17 nt, Human
guuuggucuggacugac

SEQ ID NO: 2801207 - RNA, 20 nt, Human
guuugggggacguuucucau

SEQ ID NO: 2801208 - RNA, 19 nt, Human
guuugacuagaugauggau

SEQ ID NO: 2801209 - RNA, 18 nt, Human
guuugacuagaugaugga

SEQ ID NO: 2801210 - RNA, 16 nt, Human
guuugacuagaugaug

SEQ ID NO: 2801211 - RNA, 15 nt, Human
guuugacauuguaug

SEQ ID NO: 2801212 - RNA, 13 nt, Human
guuugaccucaca

SEQ ID NO: 2801213 - RNA, 21 nt, Human
guuugaccucacagugacccu

SEQ ID NO: 2801214 - RNA, 18 nt, Human
guuugaaagugaauaaac

SEQ ID NO: 2801215 - RNA, 19 nt, Human
guuugaaagugaauaaacu

SEQ ID NO: 2801216 - RNA, 14 nt, Human
guuugaaaucuuuu

SEQ ID NO: 2801217 - RNA, 20 nt, Human
guuugaaaugaggucuguuu

SEQ ID NO: 2801218 - RNA, 22 nt, Human
guuugaaaugaggucuguuuaa

SEQ ID NO: 2801219 - RNA, 19 nt, Human
guuucuuuuuaaguaaugu

SEQ ID NO: 2801220 - RNA, 14 nt, Human
guuucuuuguguug

SEQ ID NO: 2801221 - RNA, 22 nt, Human
guuucuuaacccuuuccagagu

SEQ ID NO: 2801222 - RNA, 13 nt, Human
guuucuuagcuuu

SEQ ID NO: 2801223 - RNA, 16 nt, Human
guuucuuagcuuuuua

SEQ ID NO: 2801224 - RNA, 17 nt, Human
guuucuugcaagcaugc

SEQ ID NO: 2801225 - RNA, 14 nt, Human
guuucuucacuuuu

SEQ ID NO: 2801226 - RNA, 11 nt, Human
guuucuuccug

SEQ ID NO: 2801227 - RNA, 14 nt, Human
guuucuuccuguua

SEQ ID NO: 2801228 - RNA, 20 nt, Human
guuucuuccuguuaauguau

SEQ ID NO: 2801229 - RNA, 20 nt, Human
guuucuucuaacugccccuc

SEQ ID NO: 2801230 - RNA, 20 nt, Human
guuucuucugcgccucaggc

SEQ ID NO: 2801231 - RNA, 13 nt, Human
guuucuugcuugu

SEQ ID NO: 2801232 - RNA, 14 nt, Human
guuucuugcuugua

SEQ ID NO: 2801233 - RNA, 17 nt, Human
guuucuugcuuguaccu

SEQ ID NO: 2801234 - RNA, 18 nt, Human
guuucuugcuuguaccuc

SEQ ID NO: 2801235 - RNA, 19 nt, Human
guuucuugcuuguaccucu

SEQ ID NO: 2801236 - RNA, 13 nt, Human
guuucuugguaaa

SEQ ID NO: 2801237 - RNA, 13 nt, Human
guuucuuguuuau

SEQ ID NO: 2801238 - RNA, 21 nt, Human
guuucccccaacauauaaaau

SEQ ID NO: 2801239 - RNA, 17 nt, Human
guuucuguuugauucuu

SEQ ID NO: 2801240 - RNA, 18 nt, Human
guuucuguuugauucuuu

SEQ ID NO: 2801241 - RNA, 22 nt, Human
uaaaagguauuaaauugauguu

SEQ ID NO: 2801242 - RNA, 12 nt, Human
uaaaaggagcca

SEQ ID NO: 2801243 - RNA, 19 nt, Human
uaaaaggcaaauguguaca

SEQ ID NO: 2801244 - RNA, 18 nt, Human
uaaaaggcaaauguguac

SEQ ID NO: 2801245 - RNA, 15 nt, Human
uaaaaggauaguauu

SEQ ID NO: 2801246 - RNA, 18 nt, Human
uaaaaggauaguauuuuu

SEQ ID NO: 2801247 - RNA, 23 nt, Human
uaaaaggauaguauuuuuaucca

SEQ ID NO: 2801248 - RNA, 17 nt, Human
uaaaagggcaaaucugc

SEQ ID NO: 2801249 - RNA, 19 nt, Human
uaaaaggggguccguggaa

SEQ ID NO: 2801250 - RNA, 21 nt, Human
uaaaaggggguccguggaaga

SEQ ID NO: 2801251 - RNA, 22 nt, Human
uaaaagcagaaaauaaaggaag

SEQ ID NO: 2801252 - RNA, 21 nt, Human
uaaaaggaaaucucaccccau

SEQ ID NO: 2801253 - RNA, 11 nt, Human
uaaaagcacac

SEQ ID NO: 2801254 - RNA, 13 nt, Human
uaaaagcaaaaua

SEQ ID NO: 2801255 - RNA, 15 nt, Human
uaaaagcaaaauaaa

SEQ ID NO: 2801256 - RNA, 21 nt, Human
uaaaagcaaaauaaaaacuau

SEQ ID NO: 2801257 - RNA, 12 nt, Human
uaaaagauucau

SEQ ID NO: 2801258 - RNA, 14 nt, Human
uaaaagauucauuu

SEQ ID NO: 2801259 - RNA, 19 nt, Human
uaaaagauucauuuuuaau

SEQ ID NO: 2801260 - RNA, 20 nt, Human
uaaaagauucauuuuuaauc

SEQ ID NO: 2801261 - RNA, 13 nt, Human
uaaaagauucacc

SEQ ID NO: 2801262 - RNA, 16 nt, Human
uaaaagagagagagag

SEQ ID NO: 2801263 - RNA, 19 nt, Human
uaaaagagagagagagaaa

SEQ ID NO: 2801264 - RNA, 22 nt, Human
uaaaacauuggauuauccugag

SEQ ID NO: 2801265 - RNA, 17 nt, Human
uaaaacauuggauuauc

SEQ ID NO: 2801266 - RNA, 19 nt, Human
uaaaacauuggauuauccu

SEQ ID NO: 2801267 - RNA, 20 nt, Human
uaaaacauuggauuauccug

SEQ ID NO: 2801268 - RNA, 21 nt, Human
uaaaacauuggauuauccuga

SEQ ID NO: 2801269 - RNA, 12 nt, Human
uaaaacauguaa

SEQ ID NO: 2801270 - RNA, 13 nt, Human
uaaaacaguauuu

SEQ ID NO: 2801271 - RNA, 14 nt, Human
uaaaacaguauuua

SEQ ID NO: 2801272 - RNA, 17 nt, Human
uaaaacaguauuuauuu

SEQ ID NO: 2801273 - RNA, 20 nt, Human
uaaaacaguauuuauuuugu

SEQ ID NO: 2801274 - RNA, 21 nt, Human
uaaaacaguauuuauuuugua

SEQ ID NO: 2801275 - RNA, 22 nt, Human
uaaaacaguauuuauuuuguaa

SEQ ID NO: 2801276 - RNA, 14 nt, Human
uaaaacauguaaua

SEQ ID NO: 2801277 - RNA, 20 nt, Human
uaaaacauuauagauuuuca

SEQ ID NO: 2801278 - RNA, 12 nt, Human
uaaaacauuaug

SEQ ID NO: 2801279 - RNA, 15 nt, Human
uaaaacauuggauua

SEQ ID NO: 2801280 - RNA, 16 nt, Human
uaaaacauuggauuau

SEQ ID NO: 2801281 - RNA, 15 nt, Human
uaaaacaacacucac

SEQ ID NO: 2801282 - RNA, 16 nt, Human
uaaaacaacagcucga

SEQ ID NO: 2801283 - RNA, 17 nt, Human
uaaaacaacagcucgau

SEQ ID NO: 2801284 - RNA, 22 nt, Human
uaaaacaacagcucgauccaaa

SEQ ID NO: 2801285 - RNA, 14 nt, Human
uaaaacaaagggca

SEQ ID NO: 2801286 - RNA, 16 nt, Human
uaaaacaaaagcucau

SEQ ID NO: 2801287 - RNA, 17 nt, Human
uaaaacaaaauuuguuu

SEQ ID NO: 2801288 - RNA, 11 nt, Human
uaaaacaaaac

SEQ ID NO: 2801289 - RNA, 12 nt, Human
uaaaacaaaaca

SEQ ID NO: 2801290 - RNA, 17 nt, Human
uaaaacaaaacaaaaca

SEQ ID NO: 2801291 - RNA, 20 nt, Human
uaaaacaaaacaaaacaaca

SEQ ID NO: 2801292 - RNA, 21 nt, Human
uaaaacaaaacaaaacaacau

SEQ ID NO: 2801293 - RNA, 21 nt, Human
uaaaaauguaaauauucuaua

SEQ ID NO: 2801294 - RNA, 22 nt, Human
uaaaaaugucuugcuguugaca

SEQ ID NO: 2801295 - RNA, 23 nt, Human
uaaaaaugucuugcuguugacau

SEQ ID NO: 2801296 - RNA, 19 nt, Human
uaaaaauguaaauauucua

SEQ ID NO: 2801297 - RNA, 20 nt, Human
uaaaaauguaaauauucuau

SEQ ID NO: 2801298 - RNA, 23 nt, Human
uaaaaauguuuuuucauguguuu

SEQ ID NO: 2801299 - RNA, 22 nt, Human
uaaaaauugccauuggacaguu

SEQ ID NO: 2801300 - RNA, 18 nt, Human
uaaaaauugucuucaugu

SEQ ID NO: 2801301 - RNA, 19 nt, Human
uaaaaauugucuucaugua

SEQ ID NO: 2801302 - RNA, 23 nt, Human
uaaaaauugucuucauguacauu

SEQ ID NO: 2801303 - RNA, 18 nt, Human
uaaaacagcugucucuaa

SEQ ID NO: 2801304 - RNA, 23 nt, Human
uaaaacagcugucucuaacuuau

SEQ ID NO: 2801305 - RNA, 12 nt, Human
uaaaacacagag

SEQ ID NO: 2801306 - RNA, 13 nt, Human
uaaaacacagagg

SEQ ID NO: 2801307 - RNA, 19 nt, Human
uaaaacacuuccauaaucu

SEQ ID NO: 2801308 - RNA, 17 nt, Human
uaaaacacuuucaaaac

SEQ ID NO: 2801309 - RNA, 16 nt, Human
uaaaacaccucugcuu

SEQ ID NO: 2801310 - RNA, 19 nt, Human
uaaaacaccucugcuuucu

SEQ ID NO: 2801311 - RNA, 22 nt, Human
uaaaacaccucugcuuucugau

SEQ ID NO: 2801312 - RNA, 13 nt, Human
uaaaacacuucug

SEQ ID NO: 2801313 - RNA, 14 nt, Human
uaaaacacuucugu

SEQ ID NO: 2801314 - RNA, 18 nt, Human
uaaaacacuucuguccug

SEQ ID NO: 2801315 - RNA, 20 nt, Human
uaaaaagccacuagacucuu

SEQ ID NO: 2801316 - RNA, 23 nt, Human
uaaaaagccacuagacucuucac

SEQ ID NO: 2801317 - RNA, 13 nt, Human
uaaaaauguaaau

SEQ ID NO: 2801318 - RNA, 18 nt, Human
uaaaaauguaaauauucu

SEQ ID NO: 2801319 - RNA, 21 nt, Human
uaaaaagacauucuuccaaaa

SEQ ID NO: 2801320 - RNA, 16 nt, Human
uaaaaagaaacaagau

SEQ ID NO: 2801321 - RNA, 18 nt, Human
uaaaaagaaacaagaugc

SEQ ID NO: 2801322 - RNA, 19 nt, Human
uaaaaagaaacaagaugcu

SEQ ID NO: 2801323 - RNA, 16 nt, Human
uaaaaagaaaucuggu

SEQ ID NO: 2801324 - RNA, 15 nt, Human
uaaaaagauuagcaa

SEQ ID NO: 2801325 - RNA, 16 nt, Human
uaaaaagauuagcaag

SEQ ID NO: 2801326 - RNA, 13 nt, Human
uaaaaagauucuu

SEQ ID NO: 2801327 - RNA, 19 nt, Human
uaaaaagauucuuuuucug

SEQ ID NO: 2801328 - RNA, 11 nt, Human
guuuuuacagc

SEQ ID NO: 2801329 - RNA, 17 nt, Human
guuuuuacagcuguguu

SEQ ID NO: 2801330 - RNA, 18 nt, Human
guuuuuaauauaaagccu

SEQ ID NO: 2801331 - RNA, 17 nt, Human
guuuuuaauaaagacag

SEQ ID NO: 2801332 - RNA, 13 nt, Human
guuuuuaauagaa

SEQ ID NO: 2801333 - RNA, 20 nt, Human
guuuuuaauagcuauggaau

SEQ ID NO: 2801334 - RNA, 21 nt, Human
guuuuuaaggguuuguggaaa

SEQ ID NO: 2801335 - RNA, 20 nt, Human
guuuuguuuggcaaggaaag

SEQ ID NO: 2801336 - RNA, 14 nt, Human
guuuuuaacucuac

SEQ ID NO: 2801337 - RNA, 21 nt, Human
guuuuuaacucuacuguguaa

SEQ ID NO: 2801338 - RNA, 16 nt, Human
uaaaggcuaacuauga

SEQ ID NO: 2801339 - RNA, 13 nt, Human
uaaaguguuacuu

SEQ ID NO: 2801340 - RNA, 17 nt, Human
uaaaguguuacuuuuug

SEQ ID NO: 2801341 - RNA, 20 nt, Human
uaaaguguucugccagaucu

SEQ ID NO: 2801342 - RNA, 11 nt, Human
uaaaguguuuc

SEQ ID NO: 2801343 - RNA, 12 nt, Human
uaaaguguuuca

SEQ ID NO: 2801344 - RNA, 15 nt, Human
uaaaguguuucagcu

SEQ ID NO: 2801345 - RNA, 18 nt, Human
uaaaguguuucagcuaag

SEQ ID NO: 2801346 - RNA, 21 nt, Human
uaaaguguuucagcuaaggga

SEQ ID NO: 2801347 - RNA, 17 nt, Human
uaaaguguuucuguuau

SEQ ID NO: 2801348 - RNA, 14 nt, Human
uaaaguuagaaucu

SEQ ID NO: 2801349 - RNA, 16 nt, Human
uaaaguuagaaucuau

SEQ ID NO: 2801350 - RNA, 19 nt, Human
uaaaguuagaaucuauuuu

SEQ ID NO: 2801351 - RNA, 20 nt, Human
uaaaguuagaaucuauuuuc

SEQ ID NO: 2801352 - RNA, 22 nt, Human
uaaaguuagaaucuauuuucua

SEQ ID NO: 2801353 - RNA, 18 nt, Human
uaaaguguuucuguuauu

SEQ ID NO: 2801354 - RNA, 13 nt, Human
uaaaguuauauuu

SEQ ID NO: 2801355 - RNA, 16 nt, Human
uaaaguuauauuucag

SEQ ID NO: 2801356 - RNA, 12 nt, Human
uaaaguucuaag

SEQ ID NO: 2801357 - RNA, 19 nt, Human
uaaaggcaccaucuaauag

SEQ ID NO: 2801358 - RNA, 15 nt, Human
uaaaggcccagcccc

SEQ ID NO: 2801359 - RNA, 16 nt, Human
uaaaggcccagccccu

SEQ ID NO: 2801360 - RNA, 17 nt, Human
uaaaggcccagccccua

SEQ ID NO: 2801361 - RNA, 22 nt, Human
uaaagcuuacucuguccauuua

SEQ ID NO: 2801362 - RNA, 16 nt, Human
uaaagcuuauccauaa

SEQ ID NO: 2801363 - RNA, 21 nt, Human
uaaagcugccuguaguuagga

SEQ ID NO: 2801364 - RNA, 18 nt, Human
uaaagcugccuguaguua

SEQ ID NO: 2801365 - RNA, 23 nt, Human
uaaagcugccuguaguuaggaaa

SEQ ID NO: 2801366 - RNA, 21 nt, Human
uaaagccucaagguuuuaggu

SEQ ID NO: 2801367 - RNA, 17 nt, Human
uaaagcugccuguaguu

SEQ ID NO: 2801368 - RNA, 16 nt, Human
uaaagcugccuguagu

SEQ ID NO: 2801369 - RNA, 14 nt, Human
uaaagcugaaaacu

SEQ ID NO: 2801370 - RNA, 14 nt, Human
uaaagccagccuga

SEQ ID NO: 2801371 - RNA, 17 nt, Human
uaaagccagccugaccu

SEQ ID NO: 2801372 - RNA, 16 nt, Human
uaaagcaauaaaauuu

SEQ ID NO: 2801373 - RNA, 23 nt, Human
uaaagcccgccugacagaaacca

SEQ ID NO: 2801374 - RNA, 12 nt, Human
uaaagccuccuc

SEQ ID NO: 2801375 - RNA, 12 nt, Human
uaaagaaaacug

SEQ ID NO: 2801376 - RNA, 13 nt, Human
uaaagaaaacuuc

SEQ ID NO: 2801377 - RNA, 13 nt, Human
uaaagaaacagcu

SEQ ID NO: 2801378 - RNA, 14 nt, Human
uaaagaaacagcuu

SEQ ID NO: 2801379 - RNA, 15 nt, Human
uaaagaaacagcuuu

SEQ ID NO: 2801380 - RNA, 19 nt, Human
uaaagaaacagcuuucaag

SEQ ID NO: 2801381 - RNA, 20 nt, Human
uaaagaaacagcuuucaagu

SEQ ID NO: 2801382 - RNA, 23 nt, Human
uaaagaaacagcuuucaagugcc

SEQ ID NO: 2801383 - RNA, 20 nt, Human
uaaagcaacuguuaugaaau

SEQ ID NO: 2801384 - RNA, 22 nt, Human
uaaagcaacuguuaugaaauaa

SEQ ID NO: 2801385 - RNA, 19 nt, Human
uaaagaaaauaucugaaau

SEQ ID NO: 2801386 - RNA, 15 nt, Human
uaaacuugucuuuuc

SEQ ID NO: 2801387 - RNA, 13 nt, Human
uaaacuugugaau

SEQ ID NO: 2801388 - RNA, 17 nt, Human
uaaacuuguuugcugug

SEQ ID NO: 2801389 - RNA, 20 nt, Human
uaaacuuguuugcugugaac

SEQ ID NO: 2801390 - RNA, 22 nt, Human
uaaacuuguuugcugugaacaa

SEQ ID NO: 2801391 - RNA, 18 nt, Human
uaaacuuccccaucuucu

SEQ ID NO: 2801392 - RNA, 15 nt, Human
uaaacuuauaaauca

SEQ ID NO: 2801393 - RNA, 16 nt, Human
uaaacuuauaaaucau

SEQ ID NO: 2801394 - RNA, 18 nt, Human
uaaacuuauaaaucauau

SEQ ID NO: 2801395 - RNA, 12 nt, Human
uaaacuuaugaa

SEQ ID NO: 2801396 - RNA, 13 nt, Human
uaaacuuaugaau

SEQ ID NO: 2801397 - RNA, 14 nt, Human
uaaacuuaugaaug

SEQ ID NO: 2801398 - RNA, 15 nt, Human
uaaacuuaugaaugu

SEQ ID NO: 2801399 - RNA, 16 nt, Human
uaaacuuaugaauguu

SEQ ID NO: 2801400 - RNA, 17 nt, Human
uaaacuuaugaauguuu

SEQ ID NO: 2801401 - RNA, 18 nt, Human
uaaacuuaugaauguuuc

SEQ ID NO: 2801402 - RNA, 19 nt, Human
uaaacuuaugaauguuucc

SEQ ID NO: 2801403 - RNA, 12 nt, Human
uaaacuucagca

SEQ ID NO: 2801404 - RNA, 13 nt, Human
uaaacuucagcac

SEQ ID NO: 2801405 - RNA, 14 nt, Human
uaaacuucagcacc

SEQ ID NO: 2801406 - RNA, 16 nt, Human
uaaacuucagcaccau

SEQ ID NO: 2801407 - RNA, 13 nt, Human
uaaacuguguuua

SEQ ID NO: 2801408 - RNA, 14 nt, Human
uaaacuuaacuuua

SEQ ID NO: 2801409 - RNA, 20 nt, Human
uaaacuuaacuuuaacugaa

SEQ ID NO: 2801410 - RNA, 12 nt, Human
uaaacuguguuu

SEQ ID NO: 2801411 - RNA, 16 nt, Human
uaaacuguuagcacug

SEQ ID NO: 2801412 - RNA, 17 nt, Human
uaaacuguuagcacugu

SEQ ID NO: 2801413 - RNA, 18 nt, Human
uaaacuguuagcacuguu

SEQ ID NO: 2801414 - RNA, 19 nt, Human
uaaacuguuagcacuguug

SEQ ID NO: 2801415 - RNA, 20 nt, Human
uaaacuguuagcacuguuga

SEQ ID NO: 2801416 - RNA, 22 nt, Human
uaaacuguuagcacuguugaug

SEQ ID NO: 2801417 - RNA, 23 nt, Human
uaaacuguuagcacuguugaugu

SEQ ID NO: 2801418 - RNA, 13 nt, Human
uaaacuguugcuc

SEQ ID NO: 2801419 - RNA, 18 nt, Human
uaaacuguuucagauuuu

SEQ ID NO: 2801420 - RNA, 20 nt, Human
uaaacauugacgauuccuuc

SEQ ID NO: 2801421 - RNA, 14 nt, Human
uaaacauucuuuua

SEQ ID NO: 2801422 - RNA, 18 nt, Human
uaaacauucuuuuaacuu

SEQ ID NO: 2801423 - RNA, 22 nt, Human
uaaacauuaaucaaucaucugu

SEQ ID NO: 2801424 - RNA, 16 nt, Human
uaaaccaaaaacugaa

SEQ ID NO: 2801425 - RNA, 14 nt, Human
uaaaccaaaggaca

SEQ ID NO: 2801426 - RNA, 15 nt, Human
uaaaccaaaggacau

SEQ ID NO: 2801427 - RNA, 19 nt, Human
uaaaccaaaggacauuaug

SEQ ID NO: 2801428 - RNA, 20 nt, Human
uaaaccaaaggacauuaugu

SEQ ID NO: 2801429 - RNA, 21 nt, Human
uaaaccaaaggacauuaugug

SEQ ID NO: 2801430 - RNA, 23 nt, Human
uaaaccaaaggacauuaugugug

SEQ ID NO: 2801431 - RNA, 13 nt, Human
uaaacauguguuu

SEQ ID NO: 2801432 - RNA, 12 nt, Human
uaaacauguguu

SEQ ID NO: 2801433 - RNA, 15 nt, Human
uaaacauguguuuua

SEQ ID NO: 2801434 - RNA, 17 nt, Human
uaaacauuaaaaaugga

SEQ ID NO: 2801435 - RNA, 15 nt, Human
uaaacauuaaauguc

SEQ ID NO: 2801436 - RNA, 16 nt, Human
uaaacauuaaaugucu

SEQ ID NO: 2801437 - RNA, 17 nt, Human
uaaacauuaaaugucuu

SEQ ID NO: 2801438 - RNA, 18 nt, Human
uaaacauuaaaugucuua

SEQ ID NO: 2801439 - RNA, 21 nt, Human
uaaacauuaaaugucuuauau

SEQ ID NO: 2801440 - RNA, 13 nt, Human
uaaaaucuuauag

SEQ ID NO: 2801441 - RNA, 17 nt, Human
uaaaaucuuauaguucu

SEQ ID NO: 2801442 - RNA, 18 nt, Human
uaaaaucuuauaguucua

SEQ ID NO: 2801443 - RNA, 16 nt, Human
uaaaaucuugaaaaug

SEQ ID NO: 2801444 - RNA, 13 nt, Human
uaaaaucuuggaa

SEQ ID NO: 2801445 - RNA, 17 nt, Human
uaaaaucuuggaaguac

SEQ ID NO: 2801446 - RNA, 22 nt, Human
uaaaaucuuggaaguacaugaa

SEQ ID NO: 2801447 - RNA, 24 nt, Human
uaaaaucuuggaaguacaugaaua

SEQ ID NO: 2801448 - RNA, 19 nt, Human
uaaaaucuuauaguucuag

SEQ ID NO: 2801449 - RNA, 13 nt, Human
uaaacacauuuug

SEQ ID NO: 2801450 - RNA, 18 nt, Human
uaaacacgccugcaaacg

SEQ ID NO: 2801451 - RNA, 22 nt, Human
uaaacauaugauuucacuagaa

SEQ ID NO: 2801452 - RNA, 17 nt, Human
uaaacauccuucaagaa

SEQ ID NO: 2801453 - RNA, 15 nt, Human
uaaacaucacacaca

SEQ ID NO: 2801454 - RNA, 16 nt, Human
uaaacaucacacacac

SEQ ID NO: 2801455 - RNA, 11 nt, Human
uaaucugucaa

SEQ ID NO: 2801456 - RNA, 15 nt, Human
uaaucugucaaaaca

SEQ ID NO: 2801457 - RNA, 16 nt, Human
uaaucugucaaaacac

SEQ ID NO: 2801458 - RNA, 17 nt, Human
uaaucugucaaaacacu

SEQ ID NO: 2801459 - RNA, 18 nt, Human
uaaucugucaaaacacug

SEQ ID NO: 2801460 - RNA, 19 nt, Human
uaaucugucaaaacacugu

SEQ ID NO: 2801461 - RNA, 20 nt, Human
uaaucugucaaaacacugug

SEQ ID NO: 2801462 - RNA, 21 nt, Human
uaaucugucaaaacacugugg

SEQ ID NO: 2801463 - RNA, 22 nt, Human
uaaucugucaaaacacugugga

SEQ ID NO: 2801464 - RNA, 15 nt, Human
uaauggggcggugag

SEQ ID NO: 2801465 - RNA, 16 nt, Human
uaauggcaugucagac

SEQ ID NO: 2801466 - RNA, 13 nt, Human
uaauggcacugau

SEQ ID NO: 2801467 - RNA, 17 nt, Human
uaauggcacuuaucauu

SEQ ID NO: 2801468 - RNA, 12 nt, Human
uaauggcagcag

SEQ ID NO: 2801469 - RNA, 14 nt, Human
uaauggcagcagaa

SEQ ID NO: 2801470 - RNA, 20 nt, Human
uaauggcagcagaaaacuug

SEQ ID NO: 2801471 - RNA, 14 nt, Human
uaauggauuaaauu

SEQ ID NO: 2801472 - RNA, 22 nt, Human
uaauggauuaaauuuaauucuu

SEQ ID NO: 2801473 - RNA, 15 nt, Human
uaauggauuguuaau

SEQ ID NO: 2801474 - RNA, 16 nt, Human
uaauggauuguuaauu

SEQ ID NO: 2801475 - RNA, 20 nt, Human
uaauggauuguuaauuucag

SEQ ID NO: 2801476 - RNA, 13 nt, Human
uaauggacacuuu

SEQ ID NO: 2801477 - RNA, 19 nt, Human
uaauggacacuuuucaccu

SEQ ID NO: 2801478 - RNA, 12 nt, Human
uaauggauccuu

SEQ ID NO: 2801479 - RNA, 19 nt, Human
uaaugcuaauuuaaagaga

SEQ ID NO: 2801480 - RNA, 13 nt, Human
uaaugcuacuguc

SEQ ID NO: 2801481 - RNA, 15 nt, Human
uaaugcuacugucuc

SEQ ID NO: 2801482 - RNA, 24 nt, Human
uaaugcugcaaacuuaauguucuu

SEQ ID NO: 2801483 - RNA, 16 nt, Human
uaaugcugcacuuccu

SEQ ID NO: 2801484 - RNA, 12 nt, Human
uaaugcugccuu

SEQ ID NO: 2801485 - RNA, 16 nt, Human
uaaugcuuaagaggga

SEQ ID NO: 2801486 - RNA, 20 nt, Human
uaaugcuuaagggaguuuaa

SEQ ID NO: 2801487 - RNA, 16 nt, Human
uaaugcuuaauuucua

SEQ ID NO: 2801488 - RNA, 19 nt, Human
uaaugcuuagagaauguuc

SEQ ID NO: 2801489 - RNA, 20 nt, Human
uaaugcuuagagaauguucu

SEQ ID NO: 2801490 - RNA, 14 nt, Human
uaaugcuucagaua

SEQ ID NO: 2801491 - RNA, 14 nt, Human
uaaugcuucauuca

SEQ ID NO: 2801492 - RNA, 20 nt, Human
uaaugcuucauucaauauug

SEQ ID NO: 2801493 - RNA, 21 nt, Human
uaauggaaaaaaaaaaaagag

SEQ ID NO: 2801494 - RNA, 22 nt, Human
uaauggaaaaaaaaaaaagagg

SEQ ID NO: 2801495 - RNA, 13 nt, Human
uaauggaagagaa

SEQ ID NO: 2801496 - RNA, 14 nt, Human
uaauggaagagaaa

SEQ ID NO: 2801497 - RNA, 17 nt, Human
uaauggaagagaaaucu

SEQ ID NO: 2801498 - RNA, 17 nt, Human
uaaugcuuucacaacau

SEQ ID NO: 2801499 - RNA, 19 nt, Human
uaaugcuuucacaacauuu

SEQ ID NO: 2801500 - RNA, 21 nt, Human
uaauguuggacaccuuuaggu

SEQ ID NO: 2801501 - RNA, 18 nt, Human
uaauguuauaucauaugu

SEQ ID NO: 2801502 - RNA, 15 nt, Human
uaauguucugugaua

SEQ ID NO: 2801503 - RNA, 18 nt, Human
uaauguucugugauacag

SEQ ID NO: 2801504 - RNA, 22 nt, Human
uaauguucuuaugcaaaaugga

SEQ ID NO: 2801505 - RNA, 23 nt, Human
uaauguucuuaugcaaaauggaa

SEQ ID NO: 2801506 - RNA, 18 nt, Human
uaaugggcuuagagcagu

SEQ ID NO: 2801507 - RNA, 18 nt, Human
uaauuaaaaacuaguagu

SEQ ID NO: 2801508 - RNA, 18 nt, Human
uaauuaagacugaaaaua

SEQ ID NO: 2801509 - RNA, 13 nt, Human
uaauguuuucuuu

SEQ ID NO: 2801510 - RNA, 18 nt, Human
uaauguuuucuuugcaaa

SEQ ID NO: 2801511 - RNA, 19 nt, Human
uaauguuuucuuugcaaag

SEQ ID NO: 2801512 - RNA, 20 nt, Human
uaauguuuucuuugcaaagu

SEQ ID NO: 2801513 - RNA, 21 nt, Human
uaauguuuucuuugcaaagua

SEQ ID NO: 2801514 - RNA, 22 nt, Human
uaauguuuucuuugcaaaguau

SEQ ID NO: 2801515 - RNA, 18 nt, Human
uaauguuuguuaccucca

SEQ ID NO: 2801516 - RNA, 15 nt, Human
uaauguuuuaaaugu

SEQ ID NO: 2801517 - RNA, 16 nt, Human
uaauguuuuaaaugua

SEQ ID NO: 2801518 - RNA, 17 nt, Human
uaauguuuuaaauguac

SEQ ID NO: 2801519 - RNA, 20 nt, Human
uaauguuuuaaauguacaga

SEQ ID NO: 2801520 - RNA, 11 nt, Human
uaauguuuccu

SEQ ID NO: 2801521 - RNA, 17 nt, Human
uaauguuucuaucugau

SEQ ID NO: 2801522 - RNA, 17 nt, Human
uaauuaggcaaggcuau

SEQ ID NO: 2801523 - RNA, 14 nt, Human
uaauuaggaaaaaa

SEQ ID NO: 2801524 - RNA, 16 nt, Human
uaauuaggaaaaaaac

SEQ ID NO: 2801525 - RNA, 13 nt, Human
uaauuagcauucu

SEQ ID NO: 2801526 - RNA, 14 nt, Human
uaauuagcauucug

SEQ ID NO: 2801527 - RNA, 22 nt, Human
uaauauggccacaguagucuug

SEQ ID NO: 2801528 - RNA, 18 nt, Human
uaauauggcuaugcuuaa

SEQ ID NO: 2801529 - RNA, 20 nt, Human
uaauauggcuaugcuuaaaa

SEQ ID NO: 2801530 - RNA, 21 nt, Human
uaauauggcuaugcuuaaaag

SEQ ID NO: 2801531 - RNA, 15 nt, Human
uaauauggcaaaaau

SEQ ID NO: 2801532 - RNA, 16 nt, Human
uaauauggcaaaaaug

SEQ ID NO: 2801533 - RNA, 18 nt, Human
uaauauggcaaaaauggc

SEQ ID NO: 2801534 - RNA, 10 nt, Human
uaauaugcau

SEQ ID NO: 2801535 - RNA, 22 nt, Human
uaauauauuuuuauauuuaguu

SEQ ID NO: 2801536 - RNA, 21 nt, Human
uaauaucaaaugcaguauauu

SEQ ID NO: 2801537 - RNA, 18 nt, Human
uaauaauguuaaccaagg

SEQ ID NO: 2801538 - RNA, 22 nt, Human
uaauaauguuaaccaaggaaau

SEQ ID NO: 2801539 - RNA, 21 nt, Human
uaauaaugagcuauuaaaacu

SEQ ID NO: 2801540 - RNA, 22 nt, Human
uaauaaugagcuauuaaaacuc

SEQ ID NO: 2801541 - RNA, 23 nt, Human
uaauaaugagcuauuaaaacuca

SEQ ID NO: 2801542 - RNA, 14 nt, Human
uaauaauauuguuu

SEQ ID NO: 2801543 - RNA, 19 nt, Human
uaauaauauuguuuuucuu

SEQ ID NO: 2801544 - RNA, 13 nt, Human
uaauaugaaguau

SEQ ID NO: 2801545 - RNA, 23 nt, Human
uaauaugauuuuuuaaaagaaau

SEQ ID NO: 2801546 - RNA, 14 nt, Human
uaauaucuuuguga

SEQ ID NO: 2801547 - RNA, 19 nt, Human
uaauaucuuugugauaauu

SEQ ID NO: 2801548 - RNA, 20 nt, Human
uaauaucuuugugauaauuu

SEQ ID NO: 2801549 - RNA, 21 nt, Human
uaauaucuuugugauaauuua

SEQ ID NO: 2801550 - RNA, 13 nt, Human
uaauaauggguuu

SEQ ID NO: 2801551 - RNA, 14 nt, Human
uaauaucauucacu

SEQ ID NO: 2801552 - RNA, 19 nt, Human
uaauauccaggucaacaga

SEQ ID NO: 2801553 - RNA, 20 nt, Human
uaauauccaggucaacagaa

SEQ ID NO: 2801554 - RNA, 22 nt, Human
uaauauccaggucaacagaaug

SEQ ID NO: 2801555 - RNA, 24 nt, Human
uaauauccaggucaacagaaugaa

SEQ ID NO: 2801556 - RNA, 15 nt, Human
uaauaucuaaaguua

SEQ ID NO: 2801557 - RNA, 16 nt, Human
uaauaucuaaaguuau

SEQ ID NO: 2801558 - RNA, 21 nt, Human
uaauaucuaaaguuauauuuc

SEQ ID NO: 2801559 - RNA, 12 nt, Human
uaauauggauuu

SEQ ID NO: 2801560 - RNA, 19 nt, Human
uaauccccaguucgccugg

SEQ ID NO: 2801561 - RNA, 14 nt, Human
uaaucccccaggag

SEQ ID NO: 2801562 - RNA, 15 nt, Human
uaaucccccaggaga

SEQ ID NO: 2801563 - RNA, 22 nt, Human
uaauauuaauuuucuacaaaua

SEQ ID NO: 2801564 - RNA, 19 nt, Human
uaauauuaccuaaugaaag

SEQ ID NO: 2801565 - RNA, 22 nt, Human
uaauauuaccuaaugaaaguga

SEQ ID NO: 2801566 - RNA, 22 nt, Human
uaauauuacuguuuauuucugu

SEQ ID NO: 2801567 - RNA, 11 nt, Human
uaauauuauua

SEQ ID NO: 2801568 - RNA, 15 nt, Human
uaaucuaguuuacag

SEQ ID NO: 2801569 - RNA, 17 nt, Human
uaaucuaguuuacagaa

SEQ ID NO: 2801570 - RNA, 18 nt, Human
uaaucuaguuuacagaaa

SEQ ID NO: 2801571 - RNA, 20 nt, Human
uaaucuaguuuacagaaaaa

SEQ ID NO: 2801572 - RNA, 22 nt, Human
uaaucuagaacacaggcaaaau

SEQ ID NO: 2801573 - RNA, 14 nt, Human
uaaucuagacaaua

SEQ ID NO: 2801574 - RNA, 14 nt, Human
uaaucuagaacaca

SEQ ID NO: 2801575 - RNA, 17 nt, Human
uaaucuggacuccucug

SEQ ID NO: 2801576 - RNA, 18 nt, Human
uaaucuggacuccucugu

SEQ ID NO: 2801577 - RNA, 21 nt, Human
uaaucugauggcuucuccagg

SEQ ID NO: 2801578 - RNA, 21 nt, Human
uaaucugcaaagaaugagaag

SEQ ID NO: 2801579 - RNA, 15 nt, Human
uaaucuggacuccuc

SEQ ID NO: 2801580 - RNA, 19 nt, Human
uaaucuggacuccucuguc

SEQ ID NO: 2801581 - RNA, 20 nt, Human
uaaucuggacuccucugucc

SEQ ID NO: 2801582 - RNA, 21 nt, Human
uaaucuggacuccucugucca

SEQ ID NO: 2801583 - RNA, 22 nt, Human
uaaucuggacuccucuguccag

SEQ ID NO: 2801584 - RNA, 17 nt, Human
uaaucugggaagggaag

SEQ ID NO: 2801585 - RNA, 13 nt, Human
uaaucuguacauu

SEQ ID NO: 2801586 - RNA, 18 nt, Human
uaaucuguacauuuuguu

SEQ ID NO: 2801587 - RNA, 22 nt, Human
uaaucuguacauuuuguuguaa

SEQ ID NO: 2801588 - RNA, 23 nt, Human
uaaucuguacauuuuguuguaaa

SEQ ID NO: 2801589 - RNA, 23 nt, Human
uaaucugggccagaauuucaaac

SEQ ID NO: 2801590 - RNA, 18 nt, Human
uaaucugggccagaauuu

SEQ ID NO: 2801591 - RNA, 15 nt, Human
uaagugaaaaucuua

SEQ ID NO: 2801592 - RNA, 19 nt, Human
uaagugaaagugaggaaau

SEQ ID NO: 2801593 - RNA, 22 nt, Human
uaagucuuaucaagcagccaag

SEQ ID NO: 2801594 - RNA, 20 nt, Human
uaagucuuaucaagcagcca

SEQ ID NO: 2801595 - RNA, 13 nt, Human
uaagucucaacug

SEQ ID NO: 2801596 - RNA, 15 nt, Human
uaaguccuuuaugug

SEQ ID NO: 2801597 - RNA, 17 nt, Human
uaaguccuuuaugugga

SEQ ID NO: 2801598 - RNA, 20 nt, Human
uaaguccuuuauguggaaaa

SEQ ID NO: 2801599 - RNA, 12 nt, Human
uaagucucugug

SEQ ID NO: 2801600 - RNA, 11 nt, Human
uaagucucugu

SEQ ID NO: 2801601 - RNA, 16 nt, Human
uaagugcguguguaga

SEQ ID NO: 2801602 - RNA, 17 nt, Human
uaagugcguguguagag

SEQ ID NO: 2801603 - RNA, 18 nt, Human
uaagugcguguguagagu

SEQ ID NO: 2801604 - RNA, 19 nt, Human
uaagugcguguguagaguu

SEQ ID NO: 2801605 - RNA, 14 nt, Human
uaagugcacaacau

SEQ ID NO: 2801606 - RNA, 22 nt, Human
uaagugcacaacauuacaggga

SEQ ID NO: 2801607 - RNA, 15 nt, Human
uaagugcacacagaa

SEQ ID NO: 2801608 - RNA, 17 nt, Human
uaagugcacacagaaau

SEQ ID NO: 2801609 - RNA, 18 nt, Human
uaagugcacacagaaaua

SEQ ID NO: 2801610 - RNA, 19 nt, Human
uaagugcacacagaaauau

SEQ ID NO: 2801611 - RNA, 22 nt, Human
uaagugcacacagaaauauaua

SEQ ID NO: 2801612 - RNA, 15 nt, Human
uaagugagugugcug

SEQ ID NO: 2801613 - RNA, 20 nt, Human
uaagugagugugcugcugua

SEQ ID NO: 2801614 - RNA, 14 nt, Human
uaagugaauaauaa

SEQ ID NO: 2801615 - RNA, 13 nt, Human
uaagugaauuuau

SEQ ID NO: 2801616 - RNA, 14 nt, Human
uaagugaauuuaua

SEQ ID NO: 2801617 - RNA, 15 nt, Human
uaagugacauuugua

SEQ ID NO: 2801618 - RNA, 21 nt, Human
uaauaacugugaaguuuacau

SEQ ID NO: 2801619 - RNA, 19 nt, Human
uaauaaauauuuuugccau

SEQ ID NO: 2801620 - RNA, 11 nt, Human
uaauaagaaaa

SEQ ID NO: 2801621 - RNA, 19 nt, Human
uaauaagaaugguugccuu

SEQ ID NO: 2801622 - RNA, 12 nt, Human
uaauaagacaua

SEQ ID NO: 2801623 - RNA, 14 nt, Human
uaauaagacauaac

SEQ ID NO: 2801624 - RNA, 17 nt, Human
uaauaagacauaacguu

SEQ ID NO: 2801625 - RNA, 19 nt, Human
uaauaagacauaacguuuu

SEQ ID NO: 2801626 - RNA, 20 nt, Human
uaauaagacauaacguuuuu

SEQ ID NO: 2801627 - RNA, 22 nt, Human
uaauaagacauaacguuuuucc

SEQ ID NO: 2801628 - RNA, 18 nt, Human
uaauaaaguuuuuuucca

SEQ ID NO: 2801629 - RNA, 16 nt, Human
uaauaaauacauacgg

SEQ ID NO: 2801630 - RNA, 15 nt, Human
uaauaaauagagcaa

SEQ ID NO: 2801631 - RNA, 20 nt, Human
uaauaaaggacuguaaucuu

SEQ ID NO: 2801632 - RNA, 16 nt, Human
uaauaaaggacuguaa

SEQ ID NO: 2801633 - RNA, 13 nt, Human
uaauaaaggacug

SEQ ID NO: 2801634 - RNA, 12 nt, Human
uaauaaaggacu

SEQ ID NO: 2801635 - RNA, 21 nt, Human
uaagugcguguguagaguuaa

SEQ ID NO: 2801636 - RNA, 15 nt, Human
uaaguggugugugua

SEQ ID NO: 2801637 - RNA, 23 nt, Human
uaagugcguguguagaguuaaga

SEQ ID NO: 2801638 - RNA, 16 nt, Human
uaagugcuacauaaau

SEQ ID NO: 2801639 - RNA, 19 nt, Human
uaagugcuacauaaauugg

SEQ ID NO: 2801640 - RNA, 16 nt, Human
uaagugguguguguau

SEQ ID NO: 2801641 - RNA, 17 nt, Human
uaagugguuugaucauu

SEQ ID NO: 2801642 - RNA, 20 nt, Human
uaaggguuaguuuacaauca

SEQ ID NO: 2801643 - RNA, 22 nt, Human
uaaggguuucccccaacauaua

SEQ ID NO: 2801644 - RNA, 17 nt, Human
uaagggucgaaagcucu

SEQ ID NO: 2801645 - RNA, 23 nt, Human
uaagggguuugccauuugauacc

SEQ ID NO: 2801646 - RNA, 13 nt, Human
uaagggugggugc

SEQ ID NO: 2801647 - RNA, 18 nt, Human
uaagggugggugcucaga

SEQ ID NO: 2801648 - RNA, 19 nt, Human
uaagggugggugcucagaa

SEQ ID NO: 2801649 - RNA, 20 nt, Human
uaagggugggugcucagaau

SEQ ID NO: 2801650 - RNA, 16 nt, Human
uaagguccugaaagua

SEQ ID NO: 2801651 - RNA, 20 nt, Human
uaagguccgguguucuaaga

SEQ ID NO: 2801652 - RNA, 21 nt, Human
uaagguccgguguucuaagau

SEQ ID NO: 2801653 - RNA, 17 nt, Human
uaagguccgguguucua

SEQ ID NO: 2801654 - RNA, 18 nt, Human
uaagguccgguguucuaa

SEQ ID NO: 2801655 - RNA, 18 nt, Human
uaagguagaaccucaccu

SEQ ID NO: 2801656 - RNA, 13 nt, Human
uaagggcagaguc

SEQ ID NO: 2801657 - RNA, 14 nt, Human
uaagggcagaguca

SEQ ID NO: 2801658 - RNA, 15 nt, Human
uaagggcaugccuug

SEQ ID NO: 2801659 - RNA, 18 nt, Human
uaagggcaugccuugugc

SEQ ID NO: 2801660 - RNA, 16 nt, Human
uaagggaggaggagcu

SEQ ID NO: 2801661 - RNA, 21 nt, Human
uaagggaggaggagcuucugg

SEQ ID NO: 2801662 - RNA, 22 nt, Human
uaagggaggaggagcuucuggg

SEQ ID NO: 2801663 - RNA, 14 nt, Human
uaagggauuucuua

SEQ ID NO: 2801664 - RNA, 16 nt, Human
uaagggauuucuuagg

SEQ ID NO: 2801665 - RNA, 17 nt, Human
uaagggauuucuuaggg

SEQ ID NO: 2801666 - RNA, 15 nt, Human
uaagggaagacauuu

SEQ ID NO: 2801667 - RNA, 16 nt, Human
uaagggaagacauuuc

SEQ ID NO: 2801668 - RNA, 17 nt, Human
uaagggaagacauuucu

SEQ ID NO: 2801669 - RNA, 18 nt, Human
uaagggaagacauuucuu

SEQ ID NO: 2801670 - RNA, 19 nt, Human
uaagggaagacauuucuuu

SEQ ID NO: 2801671 - RNA, 15 nt, Human
uaaggugugcucuga

SEQ ID NO: 2801672 - RNA, 15 nt, Human
uaaggugcuaaaucu

SEQ ID NO: 2801673 - RNA, 15 nt, Human
uaaggugaggccugu

SEQ ID NO: 2801674 - RNA, 17 nt, Human
uaaggugaggccugucu

SEQ ID NO: 2801675 - RNA, 22 nt, Human
uaaggugaggccugucugugac

SEQ ID NO: 2801676 - RNA, 16 nt, Human
uaagguguuuucugug

SEQ ID NO: 2801677 - RNA, 17 nt, Human
uaagguguuuucugugu

SEQ ID NO: 2801678 - RNA, 18 nt, Human
uaagguguuuucugugua

SEQ ID NO: 2801679 - RNA, 19 nt, Human
uaagguguuuucuguguaa

SEQ ID NO: 2801680 - RNA, 20 nt, Human
uaagguguuuucuguguaac

SEQ ID NO: 2801681 - RNA, 17 nt, Human
uaaguauuugaaacuga

SEQ ID NO: 2801682 - RNA, 22 nt, Human
uaagucacccuagcccucuccc

SEQ ID NO: 2801683 - RNA, 19 nt, Human
uaagucaguauggucuaac

SEQ ID NO: 2801684 - RNA, 12 nt, Human
uaagucaguguu

SEQ ID NO: 2801685 - RNA, 13 nt, Human
uaagucaguguug

SEQ ID NO: 2801686 - RNA, 14 nt, Human
uaagucaguguuga

SEQ ID NO: 2801687 - RNA, 15 nt, Human
uaagucaguguugag

SEQ ID NO: 2801688 - RNA, 16 nt, Human
uaagucaguguugaga

SEQ ID NO: 2801689 - RNA, 17 nt, Human
uaagucaguguugagau

SEQ ID NO: 2801690 - RNA, 15 nt, Human
uaagaggcagggucu

SEQ ID NO: 2801691 - RNA, 12 nt, Human
uaagaggcaggg

SEQ ID NO: 2801692 - RNA, 16 nt, Human
uaagcuaacccccuuc

SEQ ID NO: 2801693 - RNA, 22 nt, Human
uaagcuaacccccuucuacuga

SEQ ID NO: 2801694 - RNA, 17 nt, Human
uaagcuagaagaaguga

SEQ ID NO: 2801695 - RNA, 18 nt, Human
uaagcuagaagaagugag

SEQ ID NO: 2801696 - RNA, 13 nt, Human
uaagcccuggccc

SEQ ID NO: 2801697 - RNA, 15 nt, Human
uaagcccuggccccc

SEQ ID NO: 2801698 - RNA, 15 nt, Human
uaagccuaccugcuc

SEQ ID NO: 2801699 - RNA, 16 nt, Human
uaagccuaaaaguggg

SEQ ID NO: 2801700 - RNA, 16 nt, Human
uaagccucauauuuaa

SEQ ID NO: 2801701 - RNA, 17 nt, Human
uaagccuaccugcucuc

SEQ ID NO: 2801702 - RNA, 17 nt, Human
uaagccucauauuuaaa

SEQ ID NO: 2801703 - RNA, 14 nt, Human
uaaggcucuagauc

SEQ ID NO: 2801704 - RNA, 19 nt, Human
uaaggcucuaugagucuag

SEQ ID NO: 2801705 - RNA, 22 nt, Human
uaaggcucuaugagucuagaug

SEQ ID NO: 2801706 - RNA, 14 nt, Human
uaaggcucugagag

SEQ ID NO: 2801707 - RNA, 15 nt, Human
uaaggcucugagagu

SEQ ID NO: 2801708 - RNA, 22 nt, Human
uaaggcuuugauuaguuuucuu

SEQ ID NO: 2801709 - RNA, 24 nt, Human
uaaggcucugagagucuagauucu

SEQ ID NO: 2801710 - RNA, 19 nt, Human
uaaggcucugagagucuag

SEQ ID NO: 2801711 - RNA, 22 nt, Human
uaaggcucugagagucuagauu

SEQ ID NO: 2801712 - RNA, 12 nt, Human
uaaaugucuguu

SEQ ID NO: 2801713 - RNA, 13 nt, Human
uaaaugucuuaua

SEQ ID NO: 2801714 - RNA, 14 nt, Human
uaaaugucuuauau

SEQ ID NO: 2801715 - RNA, 13 nt, Human
uaaaugucuuugu

SEQ ID NO: 2801716 - RNA, 14 nt, Human
uaaaugucuuugua

SEQ ID NO: 2801717 - RNA, 15 nt, Human
uaaaugucuuuguaa

SEQ ID NO: 2801718 - RNA, 16 nt, Human
uaaaugucuuuguaag

SEQ ID NO: 2801719 - RNA, 17 nt, Human
uaaaugucuuuguaagu

SEQ ID NO: 2801720 - RNA, 21 nt, Human
uaaaugucuuuguaagucagu

SEQ ID NO: 2801721 - RNA, 22 nt, Human
uaaaugucuuuguaagucagug

SEQ ID NO: 2801722 - RNA, 16 nt, Human
uaaauucacaaacuuu

SEQ ID NO: 2801723 - RNA, 23 nt, Human
uaaaugugauaugauuggcaaua

SEQ ID NO: 2801724 - RNA, 18 nt, Human
uaaauucacaaacuuuua

SEQ ID NO: 2801725 - RNA, 16 nt, Human
uaaauuccacuggacu

SEQ ID NO: 2801726 - RNA, 17 nt, Human
uaaauucccaacuucuc

SEQ ID NO: 2801727 - RNA, 18 nt, Human
uaaauucccaacuucucu

SEQ ID NO: 2801728 - RNA, 14 nt, Human
uaaauuccacugga

SEQ ID NO: 2801729 - RNA, 13 nt, Human
uaaauuccacugg

SEQ ID NO: 2801730 - RNA, 19 nt, Human
uaaauucgugauuuucaag

SEQ ID NO: 2801731 - RNA, 15 nt, Human
uaaauucugagacau

SEQ ID NO: 2801732 - RNA, 19 nt, Human
uaaauucugagacaugugu

SEQ ID NO: 2801733 - RNA, 22 nt, Human
uaaauucugagacaugugucaa

SEQ ID NO: 2801734 - RNA, 13 nt, Human
uaaauucuuuauu

SEQ ID NO: 2801735 - RNA, 21 nt, Human
uaaauucuuuauuucugucau

SEQ ID NO: 2801736 - RNA, 13 nt, Human
uaaauugaaauug

SEQ ID NO: 2801737 - RNA, 14 nt, Human
uaaauuugaauguu

SEQ ID NO: 2801738 - RNA, 22 nt, Human
uaaauuugaauguuaagcagau

SEQ ID NO: 2801739 - RNA, 12 nt, Human
uaaauuuguaag

SEQ ID NO: 2801740 - RNA, 20 nt, Human
uaaauuuggggacagauuca

SEQ ID NO: 2801741 - RNA, 13 nt, Human
uaaauuugauacu

SEQ ID NO: 2801742 - RNA, 14 nt, Human
uaaauuugauacuu

SEQ ID NO: 2801743 - RNA, 15 nt, Human
uaaauuugauacuua

SEQ ID NO: 2801744 - RNA, 16 nt, Human
uaaauuugauacuuau

SEQ ID NO: 2801745 - RNA, 17 nt, Human
uaaauuugauacuuaua

SEQ ID NO: 2801746 - RNA, 18 nt, Human
uaaauuugauacuuauau

SEQ ID NO: 2801747 - RNA, 21 nt, Human
uaaauuugauacuuauauuuu

SEQ ID NO: 2801748 - RNA, 13 nt, Human
uaaauuugauuua

SEQ ID NO: 2801749 - RNA, 20 nt, Human
uaaauuugauuuacauauau

SEQ ID NO: 2801750 - RNA, 22 nt, Human
uaaauuugauuuacauauauua

SEQ ID NO: 2801751 - RNA, 13 nt, Human
uaaauuugcuagc

SEQ ID NO: 2801752 - RNA, 14 nt, Human
uaaauuugcuagca

SEQ ID NO: 2801753 - RNA, 13 nt, Human
uaaauuuguaagu

SEQ ID NO: 2801754 - RNA, 15 nt, Human
uaaauuuguaaguuu

SEQ ID NO: 2801755 - RNA, 16 nt, Human
uaaauuuguaaguuuc

SEQ ID NO: 2801756 - RNA, 17 nt, Human
uaaauuuguaaguuuca

SEQ ID NO: 2801757 - RNA, 18 nt, Human
uaaauuuguaaguuucag

SEQ ID NO: 2801758 - RNA, 19 nt, Human
uaaauuuguaaguuucagg

SEQ ID NO: 2801759 - RNA, 20 nt, Human
uaaauuuguaaguuucaggu

SEQ ID NO: 2801760 - RNA, 23 nt, Human
uaaauuuguaaguuucaggugac

SEQ ID NO: 2801761 - RNA, 19 nt, Human
uaacacuauguuuauuuac

SEQ ID NO: 2801762 - RNA, 13 nt, Human
uaacacccuuccu

SEQ ID NO: 2801763 - RNA, 15 nt, Human
uaacacccuuccuuc

SEQ ID NO: 2801764 - RNA, 23 nt, Human
uaacacccuuccuucuguaaaua

SEQ ID NO: 2801765 - RNA, 24 nt, Human
uaacacccuuccuucuguaaauac

SEQ ID NO: 2801766 - RNA, 16 nt, Human
uaacacgugaugugau

SEQ ID NO: 2801767 - RNA, 18 nt, Human
uaacacuaaaauuuuagg

SEQ ID NO: 2801768 - RNA, 11 nt, Human
uaaauggaaau

SEQ ID NO: 2801769 - RNA, 15 nt, Human
uaaaugggaacauuu

SEQ ID NO: 2801770 - RNA, 16 nt, Human
uaaaugggaacauuua

SEQ ID NO: 2801771 - RNA, 17 nt, Human
uaaaugggaacauuuau

SEQ ID NO: 2801772 - RNA, 23 nt, Human
uaaaugggaacauuuauuuuaug

SEQ ID NO: 2801773 - RNA, 17 nt, Human
uaaauggggcucacaaa

SEQ ID NO: 2801774 - RNA, 17 nt, Human
uaaauggucgcccagga

SEQ ID NO: 2801775 - RNA, 22 nt, Human
uaaaugucucuuuaaugucaca

SEQ ID NO: 2801776 - RNA, 20 nt, Human
uaaauguauacuauaguacc

SEQ ID NO: 2801777 - RNA, 12 nt, Human
uaaauguauaua

SEQ ID NO: 2801778 - RNA, 13 nt, Human
uaaauguauauac

SEQ ID NO: 2801779 - RNA, 14 nt, Human
uaaauguauauaca

SEQ ID NO: 2801780 - RNA, 15 nt, Human
uaaauguauauacac

SEQ ID NO: 2801781 - RNA, 17 nt, Human
uaaauguauauacacau

SEQ ID NO: 2801782 - RNA, 18 nt, Human
uaaauguauauacacaua

SEQ ID NO: 2801783 - RNA, 17 nt, Human
uaaauguauacuauagu

SEQ ID NO: 2801784 - RNA, 15 nt, Human
uaaauguauacuaua

SEQ ID NO: 2801785 - RNA, 18 nt, Human
uaaauguacagacauauu

SEQ ID NO: 2801786 - RNA, 21 nt, Human
uaaauguacagacauauuuaa

SEQ ID NO: 2801787 - RNA, 13 nt, Human
uaaauguauacua

SEQ ID NO: 2801788 - RNA, 12 nt, Human
uaaauguauacu

SEQ ID NO: 2801789 - RNA, 14 nt, Human
uaaaguuggaauuu

SEQ ID NO: 2801790 - RNA, 18 nt, Human
uaaaguuggaauuuacca

SEQ ID NO: 2801791 - RNA, 13 nt, Human
uaaaguucuaaga

SEQ ID NO: 2801792 - RNA, 14 nt, Human
uaaaguucuaagau

SEQ ID NO: 2801793 - RNA, 15 nt, Human
uaaaguucuaagauu

SEQ ID NO: 2801794 - RNA, 16 nt, Human
uaaaguucuaagauuc

SEQ ID NO: 2801795 - RNA, 17 nt, Human
uaaaguucuaagauucu

SEQ ID NO: 2801796 - RNA, 18 nt, Human
uaaaguucuaagauucug

SEQ ID NO: 2801797 - RNA, 19 nt, Human
uaaaguucuaagauucuga

SEQ ID NO: 2801798 - RNA, 22 nt, Human
uaaaguucuaagauucugauuu

SEQ ID NO: 2801799 - RNA, 14 nt, Human
uaaaugccuaauaa

SEQ ID NO: 2801800 - RNA, 14 nt, Human
uaaaugccuaguuu

SEQ ID NO: 2801801 - RNA, 17 nt, Human
uaaaugccuaguuuuua

SEQ ID NO: 2801802 - RNA, 20 nt, Human
uaaaugccuaguuuuuagua

SEQ ID NO: 2801803 - RNA, 17 nt, Human
uaaauggaaaaaaugau

SEQ ID NO: 2801804 - RNA, 17 nt, Human
uaacugugaaguuuaca

SEQ ID NO: 2801805 - RNA, 13 nt, Human
uaacugugaaguu

SEQ ID NO: 2801806 - RNA, 18 nt, Human
uaacuuuuguaagacaaa

SEQ ID NO: 2801807 - RNA, 13 nt, Human
uaacuuuuguaag

SEQ ID NO: 2801808 - RNA, 18 nt, Human
uaacugugaaguuuacau

SEQ ID NO: 2801809 - RNA, 15 nt, Human
uaacugugcugaaug

SEQ ID NO: 2801810 - RNA, 16 nt, Human
uaacugugcugaaugc

SEQ ID NO: 2801811 - RNA, 17 nt, Human
uaacugugcugaaugcu

SEQ ID NO: 2801812 - RNA, 20 nt, Human
uaagaaaaaauaacacacau

SEQ ID NO: 2801813 - RNA, 16 nt, Human
uaagaaaacaucacug

SEQ ID NO: 2801814 - RNA, 21 nt, Human
uaagaaaaccaccccuuagau

SEQ ID NO: 2801815 - RNA, 16 nt, Human
uaagaaaacaaucaca

SEQ ID NO: 2801816 - RNA, 20 nt, Human
uaagaaaacaaucacacuca

SEQ ID NO: 2801817 - RNA, 21 nt, Human
uaagagacagucaccccagga

SEQ ID NO: 2801818 - RNA, 14 nt, Human
uaagagacucagcc

SEQ ID NO: 2801819 - RNA, 15 nt, Human
uaagagacucagccu

SEQ ID NO: 2801820 - RNA, 18 nt, Human
uaagagacucagccugca

SEQ ID NO: 2801821 - RNA, 12 nt, Human
uaagagagaaau

SEQ ID NO: 2801822 - RNA, 14 nt, Human
uaagagagaaaucu

SEQ ID NO: 2801823 - RNA, 18 nt, Human
uaagagagaaaucugaaa

SEQ ID NO: 2801824 - RNA, 18 nt, Human
uaagaacaaaagcgaccc

SEQ ID NO: 2801825 - RNA, 23 nt, Human
uaagaggcagaaaauugcacaau

SEQ ID NO: 2801826 - RNA, 20 nt, Human
uaagaggcagaaaauugcac

SEQ ID NO: 2801827 - RNA, 17 nt, Human
uaagaggcagaaaauug

SEQ ID NO: 2801828 - RNA, 16 nt, Human
uaagaggaucuccugu

SEQ ID NO: 2801829 - RNA, 21 nt, Human
uaacuuuuuuucuucuacuuu

SEQ ID NO: 2801830 - RNA, 13 nt, Human
uaagagacaguca

SEQ ID NO: 2801831 - RNA, 14 nt, Human
uaagaaaaguauuu

SEQ ID NO: 2801832 - RNA, 15 nt, Human
uaagaaaaguauuuu

SEQ ID NO: 2801833 - RNA, 19 nt, Human
uaagaaaaguauuuugaag

SEQ ID NO: 2801834 - RNA, 20 nt, Human
uaagaaaaguauuuugaagu

SEQ ID NO: 2801835 - RNA, 21 nt, Human
uaagaaaaguauuuugaaguu

SEQ ID NO: 2801836 - RNA, 22 nt, Human
uaagaaaaguauuuugaaguuu

SEQ ID NO: 2801837 - RNA, 18 nt, Human
uaagaaaaugcuagaaga

SEQ ID NO: 2801838 - RNA, 23 nt, Human
uaagaaaaugcuagaagaaaaca

SEQ ID NO: 2801839 - RNA, 19 nt, Human
uaagaaaucaaagagagaa

SEQ ID NO: 2801840 - RNA, 24 nt, Human
uaagaaaucuaguauuucaugcug

SEQ ID NO: 2801841 - RNA, 19 nt, Human
uaagaaaucucccaugugc

SEQ ID NO: 2801842 - RNA, 21 nt, Human
uaagaaaucucccaugugcau

SEQ ID NO: 2801843 - RNA, 22 nt, Human
uaagaaaucucccaugugcaua

SEQ ID NO: 2801844 - RNA, 15 nt, Human
uaagaaaucuguuuu

SEQ ID NO: 2801845 - RNA, 14 nt, Human
uaagaaacuuuugu

SEQ ID NO: 2801846 - RNA, 15 nt, Human
uaagaaacuuuugua

SEQ ID NO: 2801847 - RNA, 18 nt, Human
uaagaaacuuuuguaaag

SEQ ID NO: 2801848 - RNA, 19 nt, Human
uaagaaacuuuuguaaaga

SEQ ID NO: 2801849 - RNA, 12 nt, Human
uaagaaagacau

SEQ ID NO: 2801850 - RNA, 14 nt, Human
uaagaaagacaucu

SEQ ID NO: 2801851 - RNA, 16 nt, Human
uaagaaagacaucuuu

SEQ ID NO: 2801852 - RNA, 21 nt, Human
uaagaaagacaucuuucucuu

SEQ ID NO: 2801853 - RNA, 12 nt, Human
uaagaaacagag

SEQ ID NO: 2801854 - RNA, 16 nt, Human
uaagaaacagagcagu

SEQ ID NO: 2801855 - RNA, 21 nt, Human
uaagaaacccucugucauucg

SEQ ID NO: 2801856 - RNA, 20 nt, Human
uaaccauggaguagagguac

SEQ ID NO: 2801857 - RNA, 22 nt, Human
uaaccaguuaccacacaucuau

SEQ ID NO: 2801858 - RNA, 22 nt, Human
uaaccaguuguggugugaguau

SEQ ID NO: 2801859 - RNA, 19 nt, Human
uaaccccagcucccuagga

SEQ ID NO: 2801860 - RNA, 13 nt, Human
uaaccccagcucc

SEQ ID NO: 2801861 - RNA, 19 nt, Human
uaacccaggccugucugac

SEQ ID NO: 2801862 - RNA, 14 nt, Human
uaacccacuuguca

SEQ ID NO: 2801863 - RNA, 24 nt, Human
uaacccacuugucacugacacaaa

SEQ ID NO: 2801864 - RNA, 14 nt, Human
uaaccauuugcacu

SEQ ID NO: 2801865 - RNA, 10 nt, Human
uaaccauuuu

SEQ ID NO: 2801866 - RNA, 18 nt, Human
uaaccauuuuauaaagug

SEQ ID NO: 2801867 - RNA, 20 nt, Human
uaaccauuuuauaaagugcu

SEQ ID NO: 2801868 - RNA, 12 nt, Human
uaacccaaggag

SEQ ID NO: 2801869 - RNA, 18 nt, Human
uaacccaaggagcacagg

SEQ ID NO: 2801870 - RNA, 20 nt, Human
uaaccacgucugucuucaca

SEQ ID NO: 2801871 - RNA, 15 nt, Human
uaaccacugaaggga

SEQ ID NO: 2801872 - RNA, 17 nt, Human
uaaccacugcaaguccu

SEQ ID NO: 2801873 - RNA, 18 nt, Human
uaaccacugcaaguccuu

SEQ ID NO: 2801874 - RNA, 20 nt, Human
uaaccacugcaaguccuuuu

SEQ ID NO: 2801875 - RNA, 19 nt, Human
uaaccacgucugucuucac

SEQ ID NO: 2801876 - RNA, 15 nt, Human
uaaccacggaaaaga

SEQ ID NO: 2801877 - RNA, 16 nt, Human
uaaccaaacaauuauu

SEQ ID NO: 2801878 - RNA, 13 nt, Human
uaaccacggaaaa

SEQ ID NO: 2801879 - RNA, 11 nt, Human
uaacauuugcc

SEQ ID NO: 2801880 - RNA, 12 nt, Human
uaacauuugccu

SEQ ID NO: 2801881 - RNA, 13 nt, Human
uaacauuugccuu

SEQ ID NO: 2801882 - RNA, 15 nt, Human
uaacauuugccuugc

SEQ ID NO: 2801883 - RNA, 16 nt, Human
uaacauuugccuugca

SEQ ID NO: 2801884 - RNA, 21 nt, Human
uaacauuugccuugcagaacu

SEQ ID NO: 2801885 - RNA, 23 nt, Human
uaacauuugccuugcagaacugc

SEQ ID NO: 2801886 - RNA, 13 nt, Human
uaacauuuuaaau

SEQ ID NO: 2801887 - RNA, 21 nt, Human
uaacauuuuaaauaaaagaaa

SEQ ID NO: 2801888 - RNA, 10 nt, Human
uaacauuuug

SEQ ID NO: 2801889 - RNA, 11 nt, Human
uaacauuuugu

SEQ ID NO: 2801890 - RNA, 12 nt, Human
uaacauuuuguu

SEQ ID NO: 2801891 - RNA, 14 nt, Human
uaacauuuuguucu

SEQ ID NO: 2801892 - RNA, 15 nt, Human
uaacauuuuguucuu

SEQ ID NO: 2801893 - RNA, 16 nt, Human
uaacauuuuguucuua

SEQ ID NO: 2801894 - RNA, 21 nt, Human
uaacauuuuguucuuacacau

SEQ ID NO: 2801895 - RNA, 22 nt, Human
uaacauuuuguucuuacacaua

SEQ ID NO: 2801896 - RNA, 15 nt, Human
uaacucaccagcccc

SEQ ID NO: 2801897 - RNA, 23 nt, Human
uaacuauugcauuuauauguacc

SEQ ID NO: 2801898 - RNA, 21 nt, Human
uaacuauugcauuuauaugua

SEQ ID NO: 2801899 - RNA, 16 nt, Human
uaacuauugcauuuau

SEQ ID NO: 2801900 - RNA, 14 nt, Human
uaacuccagugaag

SEQ ID NO: 2801901 - RNA, 21 nt, Human
uaacucaccagccccacugcc

SEQ ID NO: 2801902 - RNA, 16 nt, Human
uaacucaccagcccca

SEQ ID NO: 2801903 - RNA, 17 nt, Human
uaacuauugcccagguu

SEQ ID NO: 2801904 - RNA, 16 nt, Human
uaacuccccuguuuca

SEQ ID NO: 2801905 - RNA, 19 nt, Human
uaacuccccuguuucaauc

SEQ ID NO: 2801906 - RNA, 23 nt, Human
uaacuccccuguuucaaucacug

SEQ ID NO: 2801907 - RNA, 17 nt, Human
uaacuccuaagaggagc

SEQ ID NO: 2801908 - RNA, 14 nt, Human
uaacccuacaccca

SEQ ID NO: 2801909 - RNA, 17 nt, Human
uaacccuguuacaaagc

SEQ ID NO: 2801910 - RNA, 16 nt, Human
uaacuauguugauaaa

SEQ ID NO: 2801911 - RNA, 12 nt, Human
uaacuauucagu

SEQ ID NO: 2801912 - RNA, 14 nt, Human
uaacuauucaguug

SEQ ID NO: 2801913 - RNA, 22 nt, Human
uaacuauucaguuguguuuguu

SEQ ID NO: 2801914 - RNA, 15 nt, Human
uaacuauugcauuua

SEQ ID NO: 2801915 - RNA, 18 nt, Human
uaacucuguaaaaacacu

SEQ ID NO: 2801916 - RNA, 17 nt, Human
uaacuccugagaaaugu

SEQ ID NO: 2801917 - RNA, 19 nt, Human
uaacuccugagaaauguua

SEQ ID NO: 2801918 - RNA, 15 nt, Human
uaacugaacuuugaa

SEQ ID NO: 2801919 - RNA, 14 nt, Human
uaacugaagagaca

SEQ ID NO: 2801920 - RNA, 17 nt, Human
uaacugaagauguugag

SEQ ID NO: 2801921 - RNA, 19 nt, Human
uaacugaagauguugagaa

SEQ ID NO: 2801922 - RNA, 14 nt, Human
uaacucuugucuau

SEQ ID NO: 2801923 - RNA, 16 nt, Human
uaacucuugucuauuu

SEQ ID NO: 2801924 - RNA, 12 nt, Human
uaacugccuuga

SEQ ID NO: 2801925 - RNA, 21 nt, Human
uaacugccuugaaccugugag

SEQ ID NO: 2801926 - RNA, 22 nt, Human
uaacugccuugaaccugugagu

SEQ ID NO: 2801927 - RNA, 14 nt, Human
uauaugaaaaccug

SEQ ID NO: 2801928 - RNA, 12 nt, Human
uauaugaaaacu

SEQ ID NO: 2801929 - RNA, 19 nt, Human
uauaugaaaacuauacaac

SEQ ID NO: 2801930 - RNA, 15 nt, Human
uauauggacauggca

SEQ ID NO: 2801931 - RNA, 19 nt, Human
uauauggaugauucagaaa

SEQ ID NO: 2801932 - RNA, 16 nt, Human
uauauggaugauucag

SEQ ID NO: 2801933 - RNA, 18 nt, Human
uauauggaugauucagaa

SEQ ID NO: 2801934 - RNA, 14 nt, Human
uauauuugcuuuuu

SEQ ID NO: 2801935 - RNA, 13 nt, Human
uauauuuguagga

SEQ ID NO: 2801936 - RNA, 17 nt, Human
uauauuuguaggagaaa

SEQ ID NO: 2801937 - RNA, 13 nt, Human
uauauuuguaucg

SEQ ID NO: 2801938 - RNA, 21 nt, Human
uauauuuuuauaauaaacaua

SEQ ID NO: 2801939 - RNA, 13 nt, Human
uauauuuuuauau

SEQ ID NO: 2801940 - RNA, 18 nt, Human
uauauuuuuuuaauuuaa

SEQ ID NO: 2801941 - RNA, 12 nt, Human
uauauuuucgua

SEQ ID NO: 2801942 - RNA, 16 nt, Human
uauauuuucguaugaa

SEQ ID NO: 2801943 - RNA, 18 nt, Human
uauauuuucguaugaaaa

SEQ ID NO: 2801944 - RNA, 20 nt, Human
uauauuuucguaugaaaaug

SEQ ID NO: 2801945 - RNA, 11 nt, Human
uauauuuugac

SEQ ID NO: 2801946 - RNA, 18 nt, Human
uauauuuuuaaaaaauga

SEQ ID NO: 2801947 - RNA, 21 nt, Human
uauauuuuuaaaaaaugaaau

SEQ ID NO: 2801948 - RNA, 20 nt, Human
uaucaaacagaauuuuaaag

SEQ ID NO: 2801949 - RNA, 19 nt, Human
uaucaggugcugccaucca

SEQ ID NO: 2801950 - RNA, 20 nt, Human
uaucaggugcugccauccag

SEQ ID NO: 2801951 - RNA, 21 nt, Human
uaucagucaauauuuuuagau

SEQ ID NO: 2801952 - RNA, 20 nt, Human
uaucagucaauauuuuuaga

SEQ ID NO: 2801953 - RNA, 20 nt, Human
uaucaguuuguccuguagag

SEQ ID NO: 2801954 - RNA, 16 nt, Human
uaucauacaaaucagu

SEQ ID NO: 2801955 - RNA, 22 nt, Human
uaucauacaaaucaguuaguuu

SEQ ID NO: 2801956 - RNA, 15 nt, Human
uaucauacuguucaa

SEQ ID NO: 2801957 - RNA, 15 nt, Human
uaucauagaaaugua

SEQ ID NO: 2801958 - RNA, 14 nt, Human
uaucauagaaaugu

SEQ ID NO: 2801959 - RNA, 13 nt, Human
uaucaugacaugu

SEQ ID NO: 2801960 - RNA, 14 nt, Human
uaucaugacauguu

SEQ ID NO: 2801961 - RNA, 18 nt, Human
uaucauagaaauguaacu

SEQ ID NO: 2801962 - RNA, 23 nt, Human
uaucauagaaauguaacuuuugu

SEQ ID NO: 2801963 - RNA, 13 nt, Human
uaucauaguuaac

SEQ ID NO: 2801964 - RNA, 15 nt, Human
uaucauaguuaacau

SEQ ID NO: 2801965 - RNA, 16 nt, Human
uaucauaguuaacaua

SEQ ID NO: 2801966 - RNA, 15 nt, Human
uaucauauugguauu

SEQ ID NO: 2801967 - RNA, 18 nt, Human
uaucauuaaaagaacaua

SEQ ID NO: 2801968 - RNA, 16 nt, Human
uaucauguaaagaaau

SEQ ID NO: 2801969 - RNA, 21 nt, Human
uaucauguaaagaaaugucuu

SEQ ID NO: 2801970 - RNA, 21 nt, Human
uaucaugcuuuaaaguguaau

SEQ ID NO: 2801971 - RNA, 22 nt, Human
uaucaugcuuuaaaguguaaua

SEQ ID NO: 2801972 - RNA, 23 nt, Human
uaucaugcuuuaaaguguaauaa

SEQ ID NO: 2801973 - RNA, 17 nt, Human
uaucaugcuuugaaaaa

SEQ ID NO: 2801974 - RNA, 15 nt, Human
uauauaaagaauaua

SEQ ID NO: 2801975 - RNA, 18 nt, Human
uauauaaagaauauauau

SEQ ID NO: 2801976 - RNA, 19 nt, Human
uauauaaagaauauauaua

SEQ ID NO: 2801977 - RNA, 12 nt, Human
uauauaaaguau

SEQ ID NO: 2801978 - RNA, 13 nt, Human
uauauaagaaaga

SEQ ID NO: 2801979 - RNA, 14 nt, Human
uauauaagaaagac

SEQ ID NO: 2801980 - RNA, 15 nt, Human
uauauaagaaagaca

SEQ ID NO: 2801981 - RNA, 16 nt, Human
uauauaagaaagacau

SEQ ID NO: 2801982 - RNA, 17 nt, Human
uauauaagaaagacauc

SEQ ID NO: 2801983 - RNA, 20 nt, Human
uauauaagagcaugaaauuu

SEQ ID NO: 2801984 - RNA, 23 nt, Human
uauauaagagcaugaaauuuuua

SEQ ID NO: 2801985 - RNA, 13 nt, Human
uauauaacagaua

SEQ ID NO: 2801986 - RNA, 17 nt, Human
uauauaacagauacauu

SEQ ID NO: 2801987 - RNA, 18 nt, Human
uauauaacagauacauuu

SEQ ID NO: 2801988 - RNA, 20 nt, Human
uauaucugggcuggccaguu

SEQ ID NO: 2801989 - RNA, 11 nt, Human
uauaucuguau

SEQ ID NO: 2801990 - RNA, 14 nt, Human
uauaucuguaugua

SEQ ID NO: 2801991 - RNA, 15 nt, Human
uauaucuguauguau

SEQ ID NO: 2801992 - RNA, 20 nt, Human
uauaucuguauguauuagug

SEQ ID NO: 2801993 - RNA, 14 nt, Human
uauaucuguggucu

SEQ ID NO: 2801994 - RNA, 18 nt, Human
uauaucuguggucuucaa

SEQ ID NO: 2801995 - RNA, 16 nt, Human
uauaucugcuucagug

SEQ ID NO: 2801996 - RNA, 17 nt, Human
uauaucugcuucagugg

SEQ ID NO: 2801997 - RNA, 14 nt, Human
uauaucuggaauga

SEQ ID NO: 2801998 - RNA, 22 nt, Human
uauagagauguuuuuaaaaguu

SEQ ID NO: 2801999 - RNA, 16 nt, Human
uauagaguucauccca

SEQ ID NO: 2802000 - RNA, 17 nt, Human
uauagaguucaucccag

SEQ ID NO: 2802001 - RNA, 21 nt, Human
uauagaggacccuaacacagu

SEQ ID NO: 2802002 - RNA, 12 nt, Human
uauaguacauga

SEQ ID NO: 2802003 - RNA, 16 nt, Human
uauaguacaugauaaa

SEQ ID NO: 2802004 - RNA, 14 nt, Human
uauaguacaugaua

SEQ ID NO: 2802005 - RNA, 13 nt, Human
uauaguacaugau

SEQ ID NO: 2802006 - RNA, 13 nt, Human
uauagucauuuau

SEQ ID NO: 2802007 - RNA, 21 nt, Human
uauagucauuuauuuuaaaaa

SEQ ID NO: 2802008 - RNA, 22 nt, Human
uauagucauuuauuuuaaaaaa

SEQ ID NO: 2802009 - RNA, 18 nt, Human
uauaguauuugauucaaa

SEQ ID NO: 2802010 - RNA, 19 nt, Human
uauaguauuugauucaaaa

SEQ ID NO: 2802011 - RNA, 20 nt, Human
uauagucccagcuacucaga

SEQ ID NO: 2802012 - RNA, 22 nt, Human
uauaguuuugaauccuuugccu

SEQ ID NO: 2802013 - RNA, 23 nt, Human
uauaguuuugaauccuuugccug

SEQ ID NO: 2802014 - RNA, 14 nt, Human
uauauaaaaauaua

SEQ ID NO: 2802015 - RNA, 15 nt, Human
uauauaaaaauauau

SEQ ID NO: 2802016 - RNA, 18 nt, Human
uauauaaaaauauauaua

SEQ ID NO: 2802017 - RNA, 21 nt, Human
uauauaaaaauauauauagug

SEQ ID NO: 2802018 - RNA, 15 nt, Human
uauacuuuaguauga

SEQ ID NO: 2802019 - RNA, 19 nt, Human
uauagaaauauauacgaac

SEQ ID NO: 2802020 - RNA, 21 nt, Human
uauagaaauauauacgaacaa

SEQ ID NO: 2802021 - RNA, 19 nt, Human
uauagacugccgugcauua

SEQ ID NO: 2802022 - RNA, 22 nt, Human
uauagagaaaggucuaugcaga

SEQ ID NO: 2802023 - RNA, 23 nt, Human
uauagacaguccuuaaaaaucac

SEQ ID NO: 2802024 - RNA, 14 nt, Human
uauagacaguuugu

SEQ ID NO: 2802025 - RNA, 15 nt, Human
uauagacaguuugua

SEQ ID NO: 2802026 - RNA, 16 nt, Human
uauagacaguuuguaa

SEQ ID NO: 2802027 - RNA, 17 nt, Human
uauagacaguuuguaaa

SEQ ID NO: 2802028 - RNA, 21 nt, Human
uauagacaguuuguaaauguu

SEQ ID NO: 2802029 - RNA, 19 nt, Human
uauagacauugaggaccuc

SEQ ID NO: 2802030 - RNA, 16 nt, Human
uauagacaaauaauaa

SEQ ID NO: 2802031 - RNA, 16 nt, Human
uauagacacccuggca

SEQ ID NO: 2802032 - RNA, 14 nt, Human
uauagacagcuuug

SEQ ID NO: 2802033 - RNA, 17 nt, Human
uauagacagcuuugacu

SEQ ID NO: 2802034 - RNA, 15 nt, Human
uauagaauuagcuuu

SEQ ID NO: 2802035 - RNA, 16 nt, Human
uauagaauuagcuuuu

SEQ ID NO: 2802036 - RNA, 20 nt, Human
uauagaauuagcuuuuucau

SEQ ID NO: 2802037 - RNA, 22 nt, Human
uauagaauuagcuuuuucaucc

SEQ ID NO: 2802038 - RNA, 16 nt, Human
uauagaaguuugucca

SEQ ID NO: 2802039 - RNA, 14 nt, Human
uauacuuuaaauaa

SEQ ID NO: 2802040 - RNA, 11 nt, Human
uauacuuuuuu

SEQ ID NO: 2802041 - RNA, 23 nt, Human
uauacuuugguuggcagcauucc

SEQ ID NO: 2802042 - RNA, 14 nt, Human
uauacuuuguggac

SEQ ID NO: 2802043 - RNA, 20 nt, Human
uauacuuuguggaccaauua

SEQ ID NO: 2802044 - RNA, 13 nt, Human
uauaaauaggaga

SEQ ID NO: 2802045 - RNA, 19 nt, Human
uauacuugugguuuucaaa

SEQ ID NO: 2802046 - RNA, 22 nt, Human
uauacuugugguuuucaaauug

SEQ ID NO: 2802047 - RNA, 16 nt, Human
uauacuuuaaauaauu

SEQ ID NO: 2802048 - RNA, 21 nt, Human
uauacuuuaaauaauuuaacu

SEQ ID NO: 2802049 - RNA, 12 nt, Human
uauacuuuagua

SEQ ID NO: 2802050 - RNA, 12 nt, Human
uauagaaagaua

SEQ ID NO: 2802051 - RNA, 13 nt, Human
uauaaagugcuug

SEQ ID NO: 2802052 - RNA, 17 nt, Human
uauaaagugcuugugua

SEQ ID NO: 2802053 - RNA, 18 nt, Human
uauaaagugcuuguguaa

SEQ ID NO: 2802054 - RNA, 19 nt, Human
uauaaagugcuuguguaau

SEQ ID NO: 2802055 - RNA, 15 nt, Human
uauaaaguauagaga

SEQ ID NO: 2802056 - RNA, 18 nt, Human
uauaaaguauagagagaa

SEQ ID NO: 2802057 - RNA, 19 nt, Human
uauaaaguauagagagaag

SEQ ID NO: 2802058 - RNA, 20 nt, Human
uauaaaguauagagagaagu

SEQ ID NO: 2802059 - RNA, 19 nt, Human
uauaaacuaucaguuuguc

SEQ ID NO: 2802060 - RNA, 20 nt, Human
uauaaacagacaauauguga

SEQ ID NO: 2802061 - RNA, 19 nt, Human
uauaaaguacccaucuagu

SEQ ID NO: 2802062 - RNA, 23 nt, Human
uauaaaguacccaucuaguacuu

SEQ ID NO: 2802063 - RNA, 17 nt, Human
uaguauucauucugcau

SEQ ID NO: 2802064 - RNA, 22 nt, Human
uaguauugaauacuuacauucu

SEQ ID NO: 2802065 - RNA, 16 nt, Human
uaguaugguggcuggg

SEQ ID NO: 2802066 - RNA, 20 nt, Human
uaguggcuuaaaacaacacu

SEQ ID NO: 2802067 - RNA, 20 nt, Human
uaguggcuucauuagagcag

SEQ ID NO: 2802068 - RNA, 16 nt, Human
uaguggcuuguccuca

SEQ ID NO: 2802069 - RNA, 18 nt, Human
uagugggcaccccacugc

SEQ ID NO: 2802070 - RNA, 14 nt, Human
uagugggccagggc

SEQ ID NO: 2802071 - RNA, 15 nt, Human
uagugggccagggcu

SEQ ID NO: 2802072 - RNA, 18 nt, Human
uaguauuuauuuauguac

SEQ ID NO: 2802073 - RNA, 16 nt, Human
uaguauuuauuuaugu

SEQ ID NO: 2802074 - RNA, 16 nt, Human
uaguggucuuuguaag

SEQ ID NO: 2802075 - RNA, 13 nt, Human
uaguggucuuugu

SEQ ID NO: 2802076 - RNA, 14 nt, Human
uaguggucuuugua

SEQ ID NO: 2802077 - RNA, 15 nt, Human
uaguggucuuuguaa

SEQ ID NO: 2802078 - RNA, 22 nt, Human
uaguucuguuugguguguccca

SEQ ID NO: 2802079 - RNA, 15 nt, Human
uauaaaauuagaaag

SEQ ID NO: 2802080 - RNA, 18 nt, Human
uauaaaauuagaaagcaa

SEQ ID NO: 2802081 - RNA, 13 nt, Human
uaguuuacagaaa

SEQ ID NO: 2802082 - RNA, 19 nt, Human
uaguuuacagaaaaaucuu

SEQ ID NO: 2802083 - RNA, 20 nt, Human
uaguuuacagaaaaaucuug

SEQ ID NO: 2802084 - RNA, 16 nt, Human
uaguuguuuuaaguac

SEQ ID NO: 2802085 - RNA, 16 nt, Human
uaguuuaaaacacauu

SEQ ID NO: 2802086 - RNA, 22 nt, Human
uaguuuaaccauaugcccacau

SEQ ID NO: 2802087 - RNA, 12 nt, Human
uaguuucuugug

SEQ ID NO: 2802088 - RNA, 17 nt, Human
uaguuuaccucuuuaaa

SEQ ID NO: 2802089 - RNA, 14 nt, Human
uauaaacaucacac

SEQ ID NO: 2802090 - RNA, 17 nt, Human
uauaaacaucacacaca

SEQ ID NO: 2802091 - RNA, 18 nt, Human
uauaaacaucacacacac

SEQ ID NO: 2802092 - RNA, 18 nt, Human
uauaaacaaagauucaug

SEQ ID NO: 2802093 - RNA, 14 nt, Human
uaguuucuuuggga

SEQ ID NO: 2802094 - RNA, 20 nt, Human
uaguuugaccucacagugac

SEQ ID NO: 2802095 - RNA, 21 nt, Human
uaguuugaccucacagugacc

SEQ ID NO: 2802096 - RNA, 17 nt, Human
uaguuugacucaguaua

SEQ ID NO: 2802097 - RNA, 16 nt, Human
uauaaacauuaaaugu

SEQ ID NO: 2802098 - RNA, 18 nt, Human
uauaaacauuaaaugucu

SEQ ID NO: 2802099 - RNA, 19 nt, Human
uauaaacauuaaaugucuu

SEQ ID NO: 2802100 - RNA, 19 nt, Human
uauaaagggggagggaaau

SEQ ID NO: 2802101 - RNA, 21 nt, Human
uauaaagggggagggaaauag

SEQ ID NO: 2802102 - RNA, 14 nt, Human
uaggucuuuguaag

SEQ ID NO: 2802103 - RNA, 16 nt, Human
uaggugacagagugag

SEQ ID NO: 2802104 - RNA, 11 nt, Human
uaggugacaga

SEQ ID NO: 2802105 - RNA, 14 nt, Human
uaggcuuucagcuu

SEQ ID NO: 2802106 - RNA, 19 nt, Human
uaggucucggacuaagccu

SEQ ID NO: 2802107 - RNA, 17 nt, Human
uaggucucuucucccag

SEQ ID NO: 2802108 - RNA, 18 nt, Human
uaggucucuucucccaga

SEQ ID NO: 2802109 - RNA, 19 nt, Human
uaggucucuucucccagaa

SEQ ID NO: 2802110 - RNA, 20 nt, Human
uaggucucuucucccagaau

SEQ ID NO: 2802111 - RNA, 21 nt, Human
uagcugucugcucagacagaa

SEQ ID NO: 2802112 - RNA, 17 nt, Human
uagcugucuagaguagc

SEQ ID NO: 2802113 - RNA, 13 nt, Human
uaggcucugccuu

SEQ ID NO: 2802114 - RNA, 15 nt, Human
uaggcucugccuucg

SEQ ID NO: 2802115 - RNA, 12 nt, Human
uagcuguaaaac

SEQ ID NO: 2802116 - RNA, 15 nt, Human
uagcugucuagagua

SEQ ID NO: 2802117 - RNA, 16 nt, Human
uaguagcccuuucugu

SEQ ID NO: 2802118 - RNA, 17 nt, Human
uaguagcccuuucugug

SEQ ID NO: 2802119 - RNA, 18 nt, Human
uaguagcccuuucugugu

SEQ ID NO: 2802120 - RNA, 19 nt, Human
uaguagcguuuuuuaaaug

SEQ ID NO: 2802121 - RNA, 19 nt, Human
uaguagcccuuucugugug

SEQ ID NO: 2802122 - RNA, 23 nt, Human
uaguagcguuuuuuaaauguaua

SEQ ID NO: 2802123 - RNA, 21 nt, Human
uaguagcguuuuuuaaaugua

SEQ ID NO: 2802124 - RNA, 17 nt, Human
uagguucccuguucuuc

SEQ ID NO: 2802125 - RNA, 20 nt, Human
uagguucccuguucuuccuc

SEQ ID NO: 2802126 - RNA, 21 nt, Human
uagguucccuguucuuccucc

SEQ ID NO: 2802127 - RNA, 22 nt, Human
uagguucccuguucuuccucca

SEQ ID NO: 2802128 - RNA, 13 nt, Human
uagguucuaaagu

SEQ ID NO: 2802129 - RNA, 14 nt, Human
uagguucaauuccc

SEQ ID NO: 2802130 - RNA, 22 nt, Human
uagguucuaaaguucuaagauu

SEQ ID NO: 2802131 - RNA, 20 nt, Human
uagguucuaaaguucuaaga

SEQ ID NO: 2802132 - RNA, 21 nt, Human
uagguucuaaaguucuaagau

SEQ ID NO: 2802133 - RNA, 15 nt, Human
uagguucuaaaguuc

SEQ ID NO: 2802134 - RNA, 16 nt, Human
uagguucuaaaguucu

SEQ ID NO: 2802135 - RNA, 17 nt, Human
uagguucuaaaguucua

SEQ ID NO: 2802136 - RNA, 18 nt, Human
uagguucuaaaguucuaa

SEQ ID NO: 2802137 - RNA, 18 nt, Human
uagguucuuugcugcauu

SEQ ID NO: 2802138 - RNA, 16 nt, Human
uagguggcaaggcugu

SEQ ID NO: 2802139 - RNA, 15 nt, Human
uagguggcaaggcug

SEQ ID NO: 2802140 - RNA, 22 nt, Human
uagguuaauuccaauuauauga

SEQ ID NO: 2802141 - RNA, 13 nt, Human
uagguuaaaaaaa

SEQ ID NO: 2802142 - RNA, 17 nt, Human
uagguuaaaaaaaggca

SEQ ID NO: 2802143 - RNA, 14 nt, Human
uagaguucauccca

SEQ ID NO: 2802144 - RNA, 16 nt, Human
uagauuagaaaaauuc

SEQ ID NO: 2802145 - RNA, 15 nt, Human
uagauuaauggcacu

SEQ ID NO: 2802146 - RNA, 16 nt, Human
uagauuaauggcacug

SEQ ID NO: 2802147 - RNA, 17 nt, Human
uagauuaauggcacuga

SEQ ID NO: 2802148 - RNA, 18 nt, Human
uagauuaauggcacugau

SEQ ID NO: 2802149 - RNA, 22 nt, Human
uagauagcugcauguggcuuuu

SEQ ID NO: 2802150 - RNA, 14 nt, Human
uagauuauaucaaa

SEQ ID NO: 2802151 - RNA, 15 nt, Human
uagauuauaucaaag

SEQ ID NO: 2802152 - RNA, 17 nt, Human
uagauuauaucaaagua

SEQ ID NO: 2802153 - RNA, 19 nt, Human
uagauuauaucaaaguauu

SEQ ID NO: 2802154 - RNA, 13 nt, Human
uagauucaaaggu

SEQ ID NO: 2802155 - RNA, 15 nt, Human
uagauucaaagguuc

SEQ ID NO: 2802156 - RNA, 16 nt, Human
uagauucaaagguucu

SEQ ID NO: 2802157 - RNA, 20 nt, Human
uagauuccauugguccaaga

SEQ ID NO: 2802158 - RNA, 21 nt, Human
uagauuccauugguccaagau

SEQ ID NO: 2802159 - RNA, 17 nt, Human
uagauucaaagguucua

SEQ ID NO: 2802160 - RNA, 18 nt, Human
uagauucaaagguucuag

SEQ ID NO: 2802161 - RNA, 14 nt, Human
uagauuugaccucc

SEQ ID NO: 2802162 - RNA, 21 nt, Human
uagauuuauuuuucaguucca

SEQ ID NO: 2802163 - RNA, 22 nt, Human
uagauuuauuuuucaguuccaa

SEQ ID NO: 2802164 - RNA, 14 nt, Human
uagauucuaaagau

SEQ ID NO: 2802165 - RNA, 14 nt, Human
uagauuuaguguaa

SEQ ID NO: 2802166 - RNA, 11 nt, Human
uagauucuaaa

SEQ ID NO: 2802167 - RNA, 12 nt, Human
uagauucuaaag

SEQ ID NO: 2802168 - RNA, 13 nt, Human
uagauucuaaaga

SEQ ID NO: 2802169 - RNA, 11 nt, Human
uagcagggaaa

SEQ ID NO: 2802170 - RNA, 22 nt, Human
uagcagcggaacaaggagucag

SEQ ID NO: 2802171 - RNA, 15 nt, Human
uagcaucauccugca

SEQ ID NO: 2802172 - RNA, 15 nt, Human
uagcauccuaagaaa

SEQ ID NO: 2802173 - RNA, 16 nt, Human
uagcauccuaagaaau

SEQ ID NO: 2802174 - RNA, 17 nt, Human
uagcauccuaagaaaua

SEQ ID NO: 2802175 - RNA, 18 nt, Human
uagcauccuaagaaauau

SEQ ID NO: 2802176 - RNA, 19 nt, Human
uagcauccuaagaaauaug

SEQ ID NO: 2802177 - RNA, 20 nt, Human
uagcauccuaagaaauaugu

SEQ ID NO: 2802178 - RNA, 22 nt, Human
uagcauccuaagaaauauguga

SEQ ID NO: 2802179 - RNA, 23 nt, Human
uagcauccuaagaaauaugugag

SEQ ID NO: 2802180 - RNA, 22 nt, Human
uagcaucucaggagauuucaug

SEQ ID NO: 2802181 - RNA, 18 nt, Human
uagcaucugcauugccca

SEQ ID NO: 2802182 - RNA, 14 nt, Human
uagcaucuguacaa

SEQ ID NO: 2802183 - RNA, 15 nt, Human
uagcaucuguacaaa

SEQ ID NO: 2802184 - RNA, 17 nt, Human
uagcaucuguacaaagg

SEQ ID NO: 2802185 - RNA, 22 nt, Human
uagcauauucuuuucugcaaaa

SEQ ID NO: 2802186 - RNA, 19 nt, Human
uagcauagcuuauuauuga

SEQ ID NO: 2802187 - RNA, 18 nt, Human
uagcaggccaaggucuga

SEQ ID NO: 2802188 - RNA, 22 nt, Human
uagcaggccaaggucugagcca

SEQ ID NO: 2802189 - RNA, 19 nt, Human
uagccgcccaugcacuggg

SEQ ID NO: 2802190 - RNA, 16 nt, Human
uagcccccuggccucu

SEQ ID NO: 2802191 - RNA, 17 nt, Human
uagcccccuggccucug

SEQ ID NO: 2802192 - RNA, 18 nt, Human
uagcccccuggccucugu

SEQ ID NO: 2802193 - RNA, 15 nt, Human
uagcccccuggccuc

SEQ ID NO: 2802194 - RNA, 14 nt, Human
uagccccucccaag

SEQ ID NO: 2802195 - RNA, 20 nt, Human
uagccccucccaagcuggcu

SEQ ID NO: 2802196 - RNA, 22 nt, Human
uagccccucccaagcuggcugg

SEQ ID NO: 2802197 - RNA, 13 nt, Human
uagcaugccaaca

SEQ ID NO: 2802198 - RNA, 14 nt, Human
uagcaugccaacaa

SEQ ID NO: 2802199 - RNA, 19 nt, Human
uagcaugccaacaagaaug

SEQ ID NO: 2802200 - RNA, 20 nt, Human
uagcaugccaacaagaaugc

SEQ ID NO: 2802201 - RNA, 21 nt, Human
uagcaugccaacaagaaugca

SEQ ID NO: 2802202 - RNA, 17 nt, Human
uagcauggauagaguau

SEQ ID NO: 2802203 - RNA, 13 nt, Human
uagauuuggaaua

SEQ ID NO: 2802204 - RNA, 19 nt, Human
uagccagcacuuguauaua

SEQ ID NO: 2802205 - RNA, 13 nt, Human
uagccaggaucau

SEQ ID NO: 2802206 - RNA, 15 nt, Human
uagccaggaucaugg

SEQ ID NO: 2802207 - RNA, 18 nt, Human
uagccaggaucauggugu

SEQ ID NO: 2802208 - RNA, 20 nt, Human
uagccaggaucaugguguaa

SEQ ID NO: 2802209 - RNA, 22 nt, Human
uagccaggaucaugguguaaua

SEQ ID NO: 2802210 - RNA, 23 nt, Human
uagccaggaucaugguguaauaa

SEQ ID NO: 2802211 - RNA, 22 nt, Human
uagccagggggacuagccccug

SEQ ID NO: 2802212 - RNA, 18 nt, Human
uagccaggucccccugca

SEQ ID NO: 2802213 - RNA, 19 nt, Human
uagccaggucccccugcag

SEQ ID NO: 2802214 - RNA, 21 nt, Human
uagccaggucccccugcagcu

SEQ ID NO: 2802215 - RNA, 16 nt, Human
uagccagugcuccagg

SEQ ID NO: 2802216 - RNA, 23 nt, Human
uagccagugcuccaggcacccag

SEQ ID NO: 2802217 - RNA, 13 nt, Human
uagccccauaauu

SEQ ID NO: 2802218 - RNA, 21 nt, Human
uagcucaggugucccugcacu

SEQ ID NO: 2802219 - RNA, 20 nt, Human
uagcucaggugucccugcac

SEQ ID NO: 2802220 - RNA, 20 nt, Human
uagccuggagcaccuuuccu

SEQ ID NO: 2802221 - RNA, 20 nt, Human
uagccuggauacaguauaaa

SEQ ID NO: 2802222 - RNA, 22 nt, Human
uagccuggauauuauucuugua

SEQ ID NO: 2802223 - RNA, 20 nt, Human
uagccuaauacaacauguag

SEQ ID NO: 2802224 - RNA, 18 nt, Human
uagccuagauaugaauau

SEQ ID NO: 2802225 - RNA, 22 nt, Human
uagccuagauaugaauauaugg

SEQ ID NO: 2802226 - RNA, 19 nt, Human
uagcugggacuacaggcac

SEQ ID NO: 2802227 - RNA, 17 nt, Human
uagcugggacuacaggc

SEQ ID NO: 2802228 - RNA, 15 nt, Human
uagcugggacuacag

SEQ ID NO: 2802229 - RNA, 12 nt, Human
uagcugggacua

SEQ ID NO: 2802230 - RNA, 19 nt, Human
uagcucuuuuuuguuuguu

SEQ ID NO: 2802231 - RNA, 22 nt, Human
uagcucuuuuuuguuuguuucu

SEQ ID NO: 2802232 - RNA, 23 nt, Human
uagcucuuuuuuguuuguuucuu

SEQ ID NO: 2802233 - RNA, 21 nt, Human
uagcugaugaacuuauucugu

SEQ ID NO: 2802234 - RNA, 23 nt, Human
uagcugaugaacuuauucuguag

SEQ ID NO: 2802235 - RNA, 16 nt, Human
uagaauuauuuaaaca

SEQ ID NO: 2802236 - RNA, 20 nt, Human
uagaauuauuucacaaauaa

SEQ ID NO: 2802237 - RNA, 23 nt, Human
uagaauuauuucacaaauaauag

SEQ ID NO: 2802238 - RNA, 12 nt, Human
uagaauuauuua

SEQ ID NO: 2802239 - RNA, 15 nt, Human
uagaauuauuuaaac

SEQ ID NO: 2802240 - RNA, 14 nt, Human
uagaauuagcuuuu

SEQ ID NO: 2802241 - RNA, 19 nt, Human
uagaauuagcuuuuucauc

SEQ ID NO: 2802242 - RNA, 17 nt, Human
uagaauuauaagucaca

SEQ ID NO: 2802243 - RNA, 18 nt, Human
uagaaucugcaauucaaa

SEQ ID NO: 2802244 - RNA, 22 nt, Human
uagaaucugcaauucaaaaguu

SEQ ID NO: 2802245 - RNA, 13 nt, Human
uagaaucuauuuu

SEQ ID NO: 2802246 - RNA, 15 nt, Human
uagaaucuauuuucu

SEQ ID NO: 2802247 - RNA, 16 nt, Human
uagaaucuauuuucua

SEQ ID NO: 2802248 - RNA, 17 nt, Human
uagaaucuauuuucuau

SEQ ID NO: 2802249 - RNA, 18 nt, Human
uagaaucuauuuucuaug

SEQ ID NO: 2802250 - RNA, 19 nt, Human
uagaaucuauuuucuaugu

SEQ ID NO: 2802251 - RNA, 20 nt, Human
uagaaucuauuuucuaugua

SEQ ID NO: 2802252 - RNA, 22 nt, Human
uagaaucuauuuucuauguacu

SEQ ID NO: 2802253 - RNA, 20 nt, Human
uagaauccacguauuccccu

SEQ ID NO: 2802254 - RNA, 17 nt, Human
uagaaugaaaacucauu

SEQ ID NO: 2802255 - RNA, 18 nt, Human
uagaaugaaccacugccc

SEQ ID NO: 2802256 - RNA, 21 nt, Human
uagaaugauuucaugcuaucu

SEQ ID NO: 2802257 - RNA, 21 nt, Human
uagaauggauaaaauaaugcu

SEQ ID NO: 2802258 - RNA, 22 nt, Human
uagaauggauaaaauaaugcug

SEQ ID NO: 2802259 - RNA, 16 nt, Human
uagaaugauuucaugc

SEQ ID NO: 2802260 - RNA, 14 nt, Human
uagaaugagaucug

SEQ ID NO: 2802261 - RNA, 17 nt, Human
uagaaugagaucugaau

SEQ ID NO: 2802262 - RNA, 14 nt, Human
uagaaguuugucca

SEQ ID NO: 2802263 - RNA, 21 nt, Human
uagaaguuuguccauuuguaa

SEQ ID NO: 2802264 - RNA, 23 nt, Human
uagaaguuuguccauuuguaaaa

SEQ ID NO: 2802265 - RNA, 18 nt, Human
uagaaguuguuugucauc

SEQ ID NO: 2802266 - RNA, 16 nt, Human
uagaaguuucccuucc

SEQ ID NO: 2802267 - RNA, 18 nt, Human
uagaauacuuuuuaaaag

SEQ ID NO: 2802268 - RNA, 17 nt, Human
uagaauaaucuugcuca

SEQ ID NO: 2802269 - RNA, 15 nt, Human
uagaauauaggucuc

SEQ ID NO: 2802270 - RNA, 16 nt, Human
uagaauauaggucucu

SEQ ID NO: 2802271 - RNA, 19 nt, Human
uagaauauaggucucuucu

SEQ ID NO: 2802272 - RNA, 21 nt, Human
uagaauauaggucucuucucc

SEQ ID NO: 2802273 - RNA, 22 nt, Human
uagaauauaggucucuucuccc

SEQ ID NO: 2802274 - RNA, 21 nt, Human
uagaauagccuguggccuuug

SEQ ID NO: 2802275 - RNA, 15 nt, Human
uagaaucaaucagua

SEQ ID NO: 2802276 - RNA, 14 nt, Human
uacuuuaaacuugu

SEQ ID NO: 2802277 - RNA, 17 nt, Human
uacuuuaaacuugucuu

SEQ ID NO: 2802278 - RNA, 21 nt, Human
uacuguuuaccauuuuucauu

SEQ ID NO: 2802279 - RNA, 16 nt, Human
uacuuguuucucuguu

SEQ ID NO: 2802280 - RNA, 20 nt, Human
uacuuguuucucuguuguaa

SEQ ID NO: 2802281 - RNA, 15 nt, Human
uagaagugcauuucu

SEQ ID NO: 2802282 - RNA, 16 nt, Human
uagaagugcauuucug

SEQ ID NO: 2802283 - RNA, 17 nt, Human
uagaagugcauuucuga

SEQ ID NO: 2802284 - RNA, 18 nt, Human
uagaagugcauuucugaa

SEQ ID NO: 2802285 - RNA, 23 nt, Human
uagaagugcauuucugaauagaa

SEQ ID NO: 2802286 - RNA, 16 nt, Human
uagaagugcuccccuc

SEQ ID NO: 2802287 - RNA, 16 nt, Human
uacuuuaaauaauuua

SEQ ID NO: 2802288 - RNA, 15 nt, Human
uagaagugucauguu

SEQ ID NO: 2802289 - RNA, 16 nt, Human
uagaagugucauguuu

SEQ ID NO: 2802290 - RNA, 17 nt, Human
uacuugugguuuucaaa

SEQ ID NO: 2802291 - RNA, 18 nt, Human
uacuugugguuuucaaau

SEQ ID NO: 2802292 - RNA, 18 nt, Human
uacuugugaaacacagcu

SEQ ID NO: 2802293 - RNA, 19 nt, Human
uacuugugaaacacagcug

SEQ ID NO: 2802294 - RNA, 20 nt, Human
uacuugugaaacacagcugu

SEQ ID NO: 2802295 - RNA, 21 nt, Human
uacuugugaaacacagcuguu

SEQ ID NO: 2802296 - RNA, 16 nt, Human
uacuugugauuucgau

SEQ ID NO: 2802297 - RNA, 18 nt, Human
uagaccccauacaaguuu

SEQ ID NO: 2802298 - RNA, 20 nt, Human
uagacccacuggacucaccu

SEQ ID NO: 2802299 - RNA, 15 nt, Human
uagaauaaaguugaa

SEQ ID NO: 2802300 - RNA, 21 nt, Human
uagaauucuguauuggauaua

SEQ ID NO: 2802301 - RNA, 13 nt, Human
uagaccaaggaac

SEQ ID NO: 2802302 - RNA, 14 nt, Human
uagaccaaggaaca

SEQ ID NO: 2802303 - RNA, 15 nt, Human
uagaccaaggaacaa

SEQ ID NO: 2802304 - RNA, 18 nt, Human
uagaccaaggaacaaaaa

SEQ ID NO: 2802305 - RNA, 16 nt, Human
uagaccaggauuucua

SEQ ID NO: 2802306 - RNA, 17 nt, Human
uagaccaggauuucuaa

SEQ ID NO: 2802307 - RNA, 18 nt, Human
uagacuuaauagaaacau

SEQ ID NO: 2802308 - RNA, 19 nt, Human
uagacucuguaacaucacu

SEQ ID NO: 2802309 - RNA, 19 nt, Human
uagacucaucuuacuguac

SEQ ID NO: 2802310 - RNA, 17 nt, Human
uagacucaucuuacugu

SEQ ID NO: 2802311 - RNA, 18 nt, Human
uagacucaucuuacugua

SEQ ID NO: 2802312 - RNA, 21 nt, Human
uagacucaucuuacuguaccu

SEQ ID NO: 2802313 - RNA, 21 nt, Human
uagacucaugguguguuacac

SEQ ID NO: 2802314 - RNA, 13 nt, Human
uagacuauauaca

SEQ ID NO: 2802315 - RNA, 14 nt, Human
uagacuauauacau

SEQ ID NO: 2802316 - RNA, 19 nt, Human
uagacuauauacaugugug

SEQ ID NO: 2802317 - RNA, 20 nt, Human
uagacuauauacaugugugu

SEQ ID NO: 2802318 - RNA, 22 nt, Human
uagacuauauacauguguguau

SEQ ID NO: 2802319 - RNA, 23 nt, Human
uagacuauauacauguguguaua

SEQ ID NO: 2802320 - RNA, 19 nt, Human
uagagguccucuggagccc

SEQ ID NO: 2802321 - RNA, 18 nt, Human
uagagguccucuggagcc

SEQ ID NO: 2802322 - RNA, 17 nt, Human
uagagguccucuggagc

SEQ ID NO: 2802323 - RNA, 17 nt, Human
uagagguauauuggaag

SEQ ID NO: 2802324 - RNA, 23 nt, Human
uagagguaccagcaauauguaaa

SEQ ID NO: 2802325 - RNA, 15 nt, Human
uagagguacuagaau

SEQ ID NO: 2802326 - RNA, 18 nt, Human
uagagguacuagaaugcu

SEQ ID NO: 2802327 - RNA, 14 nt, Human
uagagaagauaauu

SEQ ID NO: 2802328 - RNA, 17 nt, Human
uagagaaggaaagcuuu

SEQ ID NO: 2802329 - RNA, 13 nt, Human
uagagaaggaccc

SEQ ID NO: 2802330 - RNA, 22 nt, Human
uagagaaggacccggaggggcc

SEQ ID NO: 2802331 - RNA, 13 nt, Human
uagagaaugcaca

SEQ ID NO: 2802332 - RNA, 14 nt, Human
uagagaaugcacag

SEQ ID NO: 2802333 - RNA, 22 nt, Human
uagagaaugcacagauauacuu

SEQ ID NO: 2802334 - RNA, 16 nt, Human
uagaguuaagaagcug

SEQ ID NO: 2802335 - RNA, 17 nt, Human
uagaguuaagaagcugu

SEQ ID NO: 2802336 - RNA, 19 nt, Human
uagaguuaagaagcuguug

SEQ ID NO: 2802337 - RNA, 23 nt, Human
uagaguuaagaagcuguuguaca

SEQ ID NO: 2802338 - RNA, 12 nt, Human
uagaguuaagaa

SEQ ID NO: 2802339 - RNA, 13 nt, Human
uagaguuaagaag

SEQ ID NO: 2802340 - RNA, 15 nt, Human
uagaguuaagaagcu

SEQ ID NO: 2802341 - RNA, 20 nt, Human
uagaguguaguuuacagaaa

SEQ ID NO: 2802342 - RNA, 20 nt, Human
uagagguccucuggagcccu

SEQ ID NO: 2802343 - RNA, 13 nt, Human
uagaguccucacu

SEQ ID NO: 2802344 - RNA, 20 nt, Human
uagaguccucacucccaguc

SEQ ID NO: 2802345 - RNA, 14 nt, Human
uagaguccucacuc

SEQ ID NO: 2802346 - RNA, 23 nt, Human
uaauucuauuaaagugcuaaggu

SEQ ID NO: 2802347 - RNA, 12 nt, Human
uaauucucaggc

SEQ ID NO: 2802348 - RNA, 11 nt, Human
uaauucuaaag

SEQ ID NO: 2802349 - RNA, 12 nt, Human
uaauucuaaagg

SEQ ID NO: 2802350 - RNA, 21 nt, Human
uaauuaggcaaggcuauguga

SEQ ID NO: 2802351 - RNA, 22 nt, Human
uaauuaggcaaggcuaugugau

SEQ ID NO: 2802352 - RNA, 16 nt, Human
uaauuagguuaacauu

SEQ ID NO: 2802353 - RNA, 15 nt, Human
uaauuaggguacauu

SEQ ID NO: 2802354 - RNA, 18 nt, Human
uaauuaggguacauuuau

SEQ ID NO: 2802355 - RNA, 19 nt, Human
uaauuaggguacauuuaua

SEQ ID NO: 2802356 - RNA, 20 nt, Human
uaauuaggguacauuuauaa

SEQ ID NO: 2802357 - RNA, 21 nt, Human
uaauuaggguacauuuauaau

SEQ ID NO: 2802358 - RNA, 22 nt, Human
uaauuaggguacauuuauaauu

SEQ ID NO: 2802359 - RNA, 22 nt, Human
uaauuccucucacuaaacuuua

SEQ ID NO: 2802360 - RNA, 19 nt, Human
uaauuccucaacguauugu

SEQ ID NO: 2802361 - RNA, 14 nt, Human
uaauuuuuacccua

SEQ ID NO: 2802362 - RNA, 18 nt, Human
uaauuuuuacccuaaugu

SEQ ID NO: 2802363 - RNA, 20 nt, Human
uaauuuuuacccuaaugucu

SEQ ID NO: 2802364 - RNA, 21 nt, Human
uaauuuuuacccuaaugucuu

SEQ ID NO: 2802365 - RNA, 14 nt, Human
uacaaacaaucucu

SEQ ID NO: 2802366 - RNA, 15 nt, Human
uacaaacaaucucuu

SEQ ID NO: 2802367 - RNA, 20 nt, Human
uacaaacaaucucuuaaauu

SEQ ID NO: 2802368 - RNA, 15 nt, Human
uaauucucaggccau

SEQ ID NO: 2802369 - RNA, 16 nt, Human
uacaaauauaaaucuu

SEQ ID NO: 2802370 - RNA, 17 nt, Human
uacaaauauaaaucuua

SEQ ID NO: 2802371 - RNA, 16 nt, Human
uacaaaucaaguauuu

SEQ ID NO: 2802372 - RNA, 17 nt, Human
uacaaauauaagauuuu

SEQ ID NO: 2802373 - RNA, 13 nt, Human
uacaaauauauug

SEQ ID NO: 2802374 - RNA, 14 nt, Human
uacaaauauauugu

SEQ ID NO: 2802375 - RNA, 15 nt, Human
uacaaauauauuguu

SEQ ID NO: 2802376 - RNA, 17 nt, Human
uacaaauauauuguuaa

SEQ ID NO: 2802377 - RNA, 13 nt, Human
uacaaaccuacca

SEQ ID NO: 2802378 - RNA, 16 nt, Human
uacaaacuaaggugcu

SEQ ID NO: 2802379 - RNA, 19 nt, Human
uacaaacucccacuuguca

SEQ ID NO: 2802380 - RNA, 18 nt, Human
uacaaagcacuagagaau

SEQ ID NO: 2802381 - RNA, 23 nt, Human
uacaaagcacuagagaaugcaca

SEQ ID NO: 2802382 - RNA, 16 nt, Human
uaauuuuuauauuuaa

SEQ ID NO: 2802383 - RNA, 21 nt, Human
uacaaagagguguacagguac

SEQ ID NO: 2802384 - RNA, 18 nt, Human
uacaaaggggaaagaaca

SEQ ID NO: 2802385 - RNA, 19 nt, Human
uacaaaggggaaagaacau

SEQ ID NO: 2802386 - RNA, 23 nt, Human
uacaaaggggaaagaacauaaag

SEQ ID NO: 2802387 - RNA, 16 nt, Human
uacaaagcgugcacaa

SEQ ID NO: 2802388 - RNA, 17 nt, Human
uacaaagcgugcacaag

SEQ ID NO: 2802389 - RNA, 15 nt, Human
uacacacacacacac

SEQ ID NO: 2802390 - RNA, 18 nt, Human
uacacacacacacacaca

SEQ ID NO: 2802391 - RNA, 13 nt, Human
uacacacacacac

SEQ ID NO: 2802392 - RNA, 12 nt, Human
uacacacacaca

SEQ ID NO: 2802393 - RNA, 13 nt, Human
uacacaauucuua

SEQ ID NO: 2802394 - RNA, 9 nt, Human
uacacacac

SEQ ID NO: 2802395 - RNA, 10 nt, Human
uacacacaca

SEQ ID NO: 2802396 - RNA, 22 nt, Human
uacacagugggaacucugacaa

SEQ ID NO: 2802397 - RNA, 23 nt, Human
uacacagugggaacucugacaag

SEQ ID NO: 2802398 - RNA, 15 nt, Human
uacacagcucuagac

SEQ ID NO: 2802399 - RNA, 13 nt, Human
uacacauuuguac

SEQ ID NO: 2802400 - RNA, 15 nt, Human
uacacauuuguacag

SEQ ID NO: 2802401 - RNA, 16 nt, Human
uacacauuuguacaga

SEQ ID NO: 2802402 - RNA, 18 nt, Human
uacacauuuguacagaau

SEQ ID NO: 2802403 - RNA, 18 nt, Human
uacacauuaaguaaucaa

SEQ ID NO: 2802404 - RNA, 13 nt, Human
uacacauuagauu

SEQ ID NO: 2802405 - RNA, 14 nt, Human
uacacauuagauuu

SEQ ID NO: 2802406 - RNA, 15 nt, Human
uacacauuagauuuu

SEQ ID NO: 2802407 - RNA, 23 nt, Human
uacacauuagauuuuauuuuacu

SEQ ID NO: 2802408 - RNA, 13 nt, Human
uacacauauaccu

SEQ ID NO: 2802409 - RNA, 14 nt, Human
uacacauauaccua

SEQ ID NO: 2802410 - RNA, 18 nt, Human
uacacauauaccuauaau

SEQ ID NO: 2802411 - RNA, 21 nt, Human
uacacauauaccuauaaugug

SEQ ID NO: 2802412 - RNA, 16 nt, Human
uacacauacaguuuua

SEQ ID NO: 2802413 - RNA, 23 nt, Human
uacacauacaguuuuaugcucuu

SEQ ID NO: 2802414 - RNA, 20 nt, Human
uacacagggauguacaaggc

SEQ ID NO: 2802415 - RNA, 15 nt, Human
uacacugacuugaga

SEQ ID NO: 2802416 - RNA, 13 nt, Human
uacacucuuauag

SEQ ID NO: 2802417 - RNA, 12 nt, Human
uacacucuuaua

SEQ ID NO: 2802418 - RNA, 17 nt, Human
uacacaaugguuuuuaa

SEQ ID NO: 2802419 - RNA, 20 nt, Human
uacacaaugguuuuuaaauu

SEQ ID NO: 2802420 - RNA, 21 nt, Human
uacacaaugguuuuuaaauuu

SEQ ID NO: 2802421 - RNA, 11 nt, Human
uacacacacac

SEQ ID NO: 2802422 - RNA, 23 nt, Human
uacaacaaaggcaaguuaagaga

SEQ ID NO: 2802423 - RNA, 23 nt, Human
uacaacugccucgaaacacagaa

SEQ ID NO: 2802424 - RNA, 13 nt, Human
uacaauugugggc

SEQ ID NO: 2802425 - RNA, 22 nt, Human
uacaauugugggcauaaacugu

SEQ ID NO: 2802426 - RNA, 13 nt, Human
uacaaaugccuua

SEQ ID NO: 2802427 - RNA, 19 nt, Human
uacaaaugccuuaaaaugg

SEQ ID NO: 2802428 - RNA, 20 nt, Human
uacaaaugccuuaaaaugga

SEQ ID NO: 2802429 - RNA, 21 nt, Human
uacaaaugccuuaaaauggaa

SEQ ID NO: 2802430 - RNA, 22 nt, Human
uacaaaugccuuaaaauggaau

SEQ ID NO: 2802431 - RNA, 14 nt, Human
uacaaauuaaaaag

SEQ ID NO: 2802432 - RNA, 15 nt, Human
uacaaauuaaaaaga

SEQ ID NO: 2802433 - RNA, 16 nt, Human
uacaaauuaaaaagau

SEQ ID NO: 2802434 - RNA, 19 nt, Human
uacaaauuaaaaagauucu

SEQ ID NO: 2802435 - RNA, 19 nt, Human
uacaacaagaguuuauuuc

SEQ ID NO: 2802436 - RNA, 13 nt, Human
uacaaauuauaaa

SEQ ID NO: 2802437 - RNA, 15 nt, Human
uacaaauuauaaaaa

SEQ ID NO: 2802438 - RNA, 19 nt, Human
uacaaauuauaaaaagcca

SEQ ID NO: 2802439 - RNA, 21 nt, Human
uacaaauuauaaaaagccacu

SEQ ID NO: 2802440 - RNA, 15 nt, Human
uacaaccucccucuu

SEQ ID NO: 2802441 - RNA, 16 nt, Human
uacaaccucccucuug

SEQ ID NO: 2802442 - RNA, 17 nt, Human
uacaaccucccucuugu

SEQ ID NO: 2802443 - RNA, 21 nt, Human
uacaaccucccucuuguuuug

SEQ ID NO: 2802444 - RNA, 22 nt, Human
uacaaccucccucuuguuuugu

SEQ ID NO: 2802445 - RNA, 13 nt, Human
uacaacagccuca

SEQ ID NO: 2802446 - RNA, 15 nt, Human
uacaacagccucacu

SEQ ID NO: 2802447 - RNA, 21 nt, Human
uacaacauaaucuaguuuaca

SEQ ID NO: 2802448 - RNA, 22 nt, Human
uacaacauaaucuaguuuacag

SEQ ID NO: 2802449 - RNA, 23 nt, Human
uacaacauaaucuaguuuacaga

SEQ ID NO: 2802450 - RNA, 22 nt, Human
uacaacaagaguuuauuuccaa

SEQ ID NO: 2802451 - RNA, 15 nt, Human
uacaggagugagcac

SEQ ID NO: 2802452 - RNA, 16 nt, Human
uacagcuguuuaagau

SEQ ID NO: 2802453 - RNA, 13 nt, Human
uacaggaaguccc

SEQ ID NO: 2802454 - RNA, 23 nt, Human
uacaguuuauuuuuaaagauaga

SEQ ID NO: 2802455 - RNA, 22 nt, Human
uacaguuuggggcaagucaugu

SEQ ID NO: 2802456 - RNA, 23 nt, Human
uacaguuuggggcaagucaugua

SEQ ID NO: 2802457 - RNA, 21 nt, Human
uacagcuggguggcacugcca

SEQ ID NO: 2802458 - RNA, 24 nt, Human
uacagcuggguggcacugccaugc

SEQ ID NO: 2802459 - RNA, 14 nt, Human
uacagcuguuuaag

SEQ ID NO: 2802460 - RNA, 12 nt, Human
uacagcuguguu

SEQ ID NO: 2802461 - RNA, 17 nt, Human
uacagcuguguuauucu

SEQ ID NO: 2802462 - RNA, 11 nt, Human
uacagcucccc

SEQ ID NO: 2802463 - RNA, 15 nt, Human
uacagcuccccaagu

SEQ ID NO: 2802464 - RNA, 13 nt, Human
uacagcucugacu

SEQ ID NO: 2802465 - RNA, 20 nt, Human
uacagcucuggccacaacag

SEQ ID NO: 2802466 - RNA, 14 nt, Human
uacagcugccugca

SEQ ID NO: 2802467 - RNA, 20 nt, Human
uacagcuggguggcacugcc

SEQ ID NO: 2802468 - RNA, 10 nt, Human
uacagcuggg

SEQ ID NO: 2802469 - RNA, 20 nt, Human
uacagcugggcuggggagga

SEQ ID NO: 2802470 - RNA, 13 nt, Human
uacagcugccugc

SEQ ID NO: 2802471 - RNA, 16 nt, Human
uacagcuaaucagcau

SEQ ID NO: 2802472 - RNA, 18 nt, Human
uacagcuaaucagcauuc

SEQ ID NO: 2802473 - RNA, 13 nt, Human
uacacuugcccug

SEQ ID NO: 2802474 - RNA, 14 nt, Human
uacacuugcccugc

SEQ ID NO: 2802475 - RNA, 16 nt, Human
uacacugaggagagau

SEQ ID NO: 2802476 - RNA, 16 nt, Human
uacacugcaaucauau

SEQ ID NO: 2802477 - RNA, 19 nt, Human
uacacugcaaucauaugug

SEQ ID NO: 2802478 - RNA, 20 nt, Human
uacacugcaaucauauguga

SEQ ID NO: 2802479 - RNA, 21 nt, Human
uacacugcaaucauaugugau

SEQ ID NO: 2802480 - RNA, 16 nt, Human
uacagcuaugaagaaa

SEQ ID NO: 2802481 - RNA, 13 nt, Human
uacaguuuuaugc

SEQ ID NO: 2802482 - RNA, 17 nt, Human
uacaguuuuaugcucuu

SEQ ID NO: 2802483 - RNA, 18 nt, Human
uacaguuuuaugcucuuu

SEQ ID NO: 2802484 - RNA, 19 nt, Human
uacaguuuuaugcucuuuu

SEQ ID NO: 2802485 - RNA, 17 nt, Human
uacaguuugucacauga

SEQ ID NO: 2802486 - RNA, 15 nt, Human
uacauaaaagaauuu

SEQ ID NO: 2802487 - RNA, 16 nt, Human
uacauaaaagaauuuu

SEQ ID NO: 2802488 - RNA, 21 nt, Human
uacauaaauugcauaaagcau

SEQ ID NO: 2802489 - RNA, 22 nt, Human
uacauaaauugcauaaagcaua

SEQ ID NO: 2802490 - RNA, 12 nt, Human
uacauaaauugg

SEQ ID NO: 2802491 - RNA, 16 nt, Human
uacauaaauuggccug

SEQ ID NO: 2802492 - RNA, 13 nt, Human
uacauaacaagaa

SEQ ID NO: 2802493 - RNA, 18 nt, Human
uacauaacaagaaaauca

SEQ ID NO: 2802494 - RNA, 19 nt, Human
uacauaacaagaaaaucaa

SEQ ID NO: 2802495 - RNA, 13 nt, Human
uacauaacuaaau

SEQ ID NO: 2802496 - RNA, 18 nt, Human
uacauaacuaaauuugau

SEQ ID NO: 2802497 - RNA, 19 nt, Human
uacauaacuaaauuugaua

SEQ ID NO: 2802498 - RNA, 20 nt, Human
uacauaacucuguaaaaaca

SEQ ID NO: 2802499 - RNA, 23 nt, Human
uacauaacucuguaaaaacacug

SEQ ID NO: 2802500 - RNA, 13 nt, Human
uacauaacugccu

SEQ ID NO: 2802501 - RNA, 14 nt, Human
uacauaacugccuu

SEQ ID NO: 2802502 - RNA, 16 nt, Human
uacauaacugccuuga

SEQ ID NO: 2802503 - RNA, 22 nt, Human
uacauaacugccuugaaccugu

SEQ ID NO: 2802504 - RNA, 17 nt, Human
uacaucuuuuuucacaa

SEQ ID NO: 2802505 - RNA, 18 nt, Human
uacaucuuuuuucacaaa

SEQ ID NO: 2802506 - RNA, 20 nt, Human
uacaucuuuuuucacaaauu

SEQ ID NO: 2802507 - RNA, 16 nt, Human
uacauggacagaauuu

SEQ ID NO: 2802508 - RNA, 17 nt, Human
uacauggacagaauuuu

SEQ ID NO: 2802509 - RNA, 16 nt, Human
uacauggcagaguuug

SEQ ID NO: 2802510 - RNA, 19 nt, Human
uacauggcagaguuugugu

SEQ ID NO: 2802511 - RNA, 17 nt, Human
uacaugcagcccaugcc

SEQ ID NO: 2802512 - RNA, 14 nt, Human
uacaugcagcccau

SEQ ID NO: 2802513 - RNA, 22 nt, Human
uacaugcagcccaugcccaccu

SEQ ID NO: 2802514 - RNA, 17 nt, Human
uacaugcauacaaagag

SEQ ID NO: 2802515 - RNA, 21 nt, Human
uacaugaaacagaaacaaaaa

SEQ ID NO: 2802516 - RNA, 14 nt, Human
uacauaaacaauga

SEQ ID NO: 2802517 - RNA, 21 nt, Human
uacaugaaaauuuuaaaaaua

SEQ ID NO: 2802518 - RNA, 22 nt, Human
uacaugcaauuuauuaaaauga

SEQ ID NO: 2802519 - RNA, 18 nt, Human
uacaugaaauuuuuguaa

SEQ ID NO: 2802520 - RNA, 19 nt, Human
uacaugaaauuuuuguaaa

SEQ ID NO: 2802521 - RNA, 15 nt, Human
uacaugaaacagaaa

SEQ ID NO: 2802522 - RNA, 14 nt, Human
uacaugaaacagaa

SEQ ID NO: 2802523 - RNA, 13 nt, Human
uacaugaaacaga

SEQ ID NO: 2802524 - RNA, 12 nt, Human
uacaugaaacag

SEQ ID NO: 2802525 - RNA, 16 nt, Human
uacuguccuacccacc

SEQ ID NO: 2802526 - RNA, 14 nt, Human
uacugcucaggcug

SEQ ID NO: 2802527 - RNA, 15 nt, Human
uacugcucaggcugc

SEQ ID NO: 2802528 - RNA, 22 nt, Human
uacugcucaggcugcagcugga

SEQ ID NO: 2802529 - RNA, 14 nt, Human
uacugucucacuga

SEQ ID NO: 2802530 - RNA, 22 nt, Human
uacugucucacugaaacauuua

SEQ ID NO: 2802531 - RNA, 15 nt, Human
uacugucugauuggc

SEQ ID NO: 2802532 - RNA, 17 nt, Human
uacugucugauuggcuu

SEQ ID NO: 2802533 - RNA, 22 nt, Human
uacugucugguuuuaacaauuu

SEQ ID NO: 2802534 - RNA, 15 nt, Human
uacugugaaacuggc

SEQ ID NO: 2802535 - RNA, 16 nt, Human
uacugucugguuuuaa

SEQ ID NO: 2802536 - RNA, 19 nt, Human
uacugucugguuuuaacaa

SEQ ID NO: 2802537 - RNA, 20 nt, Human
uacugucugguuuuaacaau

SEQ ID NO: 2802538 - RNA, 21 nt, Human
uacugucugguuuuaacaauu

SEQ ID NO: 2802539 - RNA, 15 nt, Human
uacuguuaaccauuu

SEQ ID NO: 2802540 - RNA, 18 nt, Human
uacuguuaaccauuuaag

SEQ ID NO: 2802541 - RNA, 19 nt, Human
uacuguuaaccauuuaagu

SEQ ID NO: 2802542 - RNA, 18 nt, Human
uacuguguuuuauaaaau

SEQ ID NO: 2802543 - RNA, 18 nt, Human
uacuguggaaaagaaaca

SEQ ID NO: 2802544 - RNA, 12 nt, Human
uacuguggagga

SEQ ID NO: 2802545 - RNA, 14 nt, Human
uacuguggaggaag

SEQ ID NO: 2802546 - RNA, 16 nt, Human
uacuguggaggaagga

SEQ ID NO: 2802547 - RNA, 18 nt, Human
uacuguggaggaaggauu

SEQ ID NO: 2802548 - RNA, 21 nt, Human
uacugugugugugaaugaaca

SEQ ID NO: 2802549 - RNA, 23 nt, Human
uacugugugugugaaugaacacu

SEQ ID NO: 2802550 - RNA, 22 nt, Human
uacugugugugugaaugaacac

SEQ ID NO: 2802551 - RNA, 22 nt, Human
uacuguggaggaaggauuguaa

SEQ ID NO: 2802552 - RNA, 13 nt, Human
uacuuguggacac

SEQ ID NO: 2802553 - RNA, 13 nt, Human
uacuuaacuauuc

SEQ ID NO: 2802554 - RNA, 20 nt, Human
uacuuaaauggaaaaaauga

SEQ ID NO: 2802555 - RNA, 12 nt, Human
uacuuaaagauu

SEQ ID NO: 2802556 - RNA, 14 nt, Human
uacuuaaagauuua

SEQ ID NO: 2802557 - RNA, 19 nt, Human
uacuuaaagauuuaucaaa

SEQ ID NO: 2802558 - RNA, 15 nt, Human
uacuguuuauuucug

SEQ ID NO: 2802559 - RNA, 23 nt, Human
uacuguuuauuucuguuucucau

SEQ ID NO: 2802560 - RNA, 23 nt, Human
uacuguucaaugguucugaaaua

SEQ ID NO: 2802561 - RNA, 19 nt, Human
uacuguuuuaucuggcccc

SEQ ID NO: 2802562 - RNA, 21 nt, Human
uacuuaaaaaaaaaaaaaagc

SEQ ID NO: 2802563 - RNA, 23 nt, Human
uacuuaaaaaaaaaaaaaagcuu

SEQ ID NO: 2802564 - RNA, 21 nt, Human
uacuugaacaaaagggucaga

SEQ ID NO: 2802565 - RNA, 16 nt, Human
uacuuaagaauaugcu

SEQ ID NO: 2802566 - RNA, 12 nt, Human
uacuuaagagaa

SEQ ID NO: 2802567 - RNA, 13 nt, Human
uacuuaagagaaa

SEQ ID NO: 2802568 - RNA, 14 nt, Human
uacuuaagagaaau

SEQ ID NO: 2802569 - RNA, 15 nt, Human
uacuuaagagaaaug

SEQ ID NO: 2802570 - RNA, 16 nt, Human
uacuuaagagaaaugg

SEQ ID NO: 2802571 - RNA, 18 nt, Human
uacuuaagagaaauggca

SEQ ID NO: 2802572 - RNA, 19 nt, Human
uacuuaagagaaauggcaa

SEQ ID NO: 2802573 - RNA, 16 nt, Human
uacuaauuuucuagau

SEQ ID NO: 2802574 - RNA, 16 nt, Human
uacuaauuccacaccu

SEQ ID NO: 2802575 - RNA, 15 nt, Human
uacuaauuuuacaca

SEQ ID NO: 2802576 - RNA, 17 nt, Human
uacuaauuuuacacauu

SEQ ID NO: 2802577 - RNA, 18 nt, Human
uacuaauuuuacacauua

SEQ ID NO: 2802578 - RNA, 16 nt, Human
uacuaauguaaaauga

SEQ ID NO: 2802579 - RNA, 20 nt, Human
uacuaauguaaaaugauuug

SEQ ID NO: 2802580 - RNA, 13 nt, Human
uacuaauuccaca

SEQ ID NO: 2802581 - RNA, 15 nt, Human
uacuaaggcuuuccu

SEQ ID NO: 2802582 - RNA, 14 nt, Human
uacuaaguucacau

SEQ ID NO: 2802583 - RNA, 22 nt, Human
uacuaaguucacauuagaauua

SEQ ID NO: 2802584 - RNA, 13 nt, Human
uacucauugaaau

SEQ ID NO: 2802585 - RNA, 14 nt, Human
uacucauugaaaug

SEQ ID NO: 2802586 - RNA, 15 nt, Human
uacucauugaaaugu

SEQ ID NO: 2802587 - RNA, 16 nt, Human
uacucauugaaauguc

SEQ ID NO: 2802588 - RNA, 17 nt, Human
uacucauugaaauguca

SEQ ID NO: 2802589 - RNA, 11 nt, Human
uacucauuucu

SEQ ID NO: 2802590 - RNA, 15 nt, Human
uacucauuucuaaaa

SEQ ID NO: 2802591 - RNA, 18 nt, Human
uacucauuucuaaaagaa

SEQ ID NO: 2802592 - RNA, 22 nt, Human
uacucauuucuaaaagaauauu

SEQ ID NO: 2802593 - RNA, 17 nt, Human
uacuccuaccucagccu

SEQ ID NO: 2802594 - RNA, 16 nt, Human
uacuccuaccucagcc

SEQ ID NO: 2802595 - RNA, 15 nt, Human
uacuccuaccucagc

SEQ ID NO: 2802596 - RNA, 14 nt, Human
uacuccuaccucag

SEQ ID NO: 2802597 - RNA, 12 nt, Human
uacuccucccag

SEQ ID NO: 2802598 - RNA, 13 nt, Human
uacuccuauuuuu

SEQ ID NO: 2802599 - RNA, 14 nt, Human
uacuccuauuuuug

SEQ ID NO: 2802600 - RNA, 18 nt, Human
uacuccuauuuuuguaaa

SEQ ID NO: 2802601 - RNA, 20 nt, Human
uacuccuauuuuuguaaacu

SEQ ID NO: 2802602 - RNA, 21 nt, Human
uacuccuauuuuuguaaacug

SEQ ID NO: 2802603 - RNA, 14 nt, Human
uacuccucacacuu

SEQ ID NO: 2802604 - RNA, 15 nt, Human
uacuccucacacuua

SEQ ID NO: 2802605 - RNA, 21 nt, Human
uacuccucacacuuacuguaa

SEQ ID NO: 2802606 - RNA, 19 nt, Human
uacucccugcagaugccac

SEQ ID NO: 2802607 - RNA, 15 nt, Human
uacucccuugcccua

SEQ ID NO: 2802608 - RNA, 18 nt, Human
uacucccugcagaugcca

SEQ ID NO: 2802609 - RNA, 16 nt, Human
uacucccugcagaugc

SEQ ID NO: 2802610 - RNA, 13 nt, Human
uacucccugcaga

SEQ ID NO: 2802611 - RNA, 14 nt, Human
uacucccucucagg

SEQ ID NO: 2802612 - RNA, 15 nt, Human
uacuccauaaacaga

SEQ ID NO: 2802613 - RNA, 19 nt, Human
uacugcccaggccugccug

SEQ ID NO: 2802614 - RNA, 20 nt, Human
uacugcccaggccugccugu

SEQ ID NO: 2802615 - RNA, 21 nt, Human
uacugcccaggccugccuguu

SEQ ID NO: 2802616 - RNA, 22 nt, Human
uacugcccaggccugccuguuc

SEQ ID NO: 2802617 - RNA, 19 nt, Human
uacugccauguacuaguuu

SEQ ID NO: 2802618 - RNA, 21 nt, Human
uacugccauguacuaguuuua

SEQ ID NO: 2802619 - RNA, 11 nt, Human
uacugccaaag

SEQ ID NO: 2802620 - RNA, 22 nt, Human
uacugcagccuuugccuccccg

SEQ ID NO: 2802621 - RNA, 20 nt, Human
uacugcagccuuugccuccc

SEQ ID NO: 2802622 - RNA, 15 nt, Human
uacugauuuuuguga

SEQ ID NO: 2802623 - RNA, 17 nt, Human
uacugauuuuugugauu

SEQ ID NO: 2802624 - RNA, 13 nt, Human
uacugauuuuugu

SEQ ID NO: 2802625 - RNA, 21 nt, Human
uacucuaagaucuuagauucu

SEQ ID NO: 2802626 - RNA, 22 nt, Human
uacucuaagaucuuagauucuc

SEQ ID NO: 2802627 - RNA, 15 nt, Human
uacgaaacacaaacc

SEQ ID NO: 2802628 - RNA, 11 nt, Human
uacuccuccuc

SEQ ID NO: 2802629 - RNA, 19 nt, Human
uacucggaaauuaaaguuu

SEQ ID NO: 2802630 - RNA, 22 nt, Human
uacucgggaggcugaggcacaa

SEQ ID NO: 2802631 - RNA, 13 nt, Human
uacucuaagaucu

SEQ ID NO: 2802632 - RNA, 15 nt, Human
uacucuaagaucuua

SEQ ID NO: 2802633 - RNA, 18 nt, Human
uacucuaagaucuuagau

SEQ ID NO: 2802634 - RNA, 20 nt, Human
uacucuaagaucuuagauuc

SEQ ID NO: 2802635 - RNA, 18 nt, Human
uaccuuaucacugcauua

SEQ ID NO: 2802636 - RNA, 21 nt, Human
uaccuuuugaggagccccagc

SEQ ID NO: 2802637 - RNA, 17 nt, Human
uaccuuuuaccagcuuu

SEQ ID NO: 2802638 - RNA, 18 nt, Human
uaccuuuuaccagcuuuu

SEQ ID NO: 2802639 - RNA, 16 nt, Human
uaccuuuuauguagca

SEQ ID NO: 2802640 - RNA, 13 nt, Human
uaccuuuuauuuu

SEQ ID NO: 2802641 - RNA, 17 nt, Human
uaccucuuauugcaaaa

SEQ ID NO: 2802642 - RNA, 22 nt, Human
uaccuuacuguggaggaaggau

SEQ ID NO: 2802643 - RNA, 12 nt, Human
uaccucugugug

SEQ ID NO: 2802644 - RNA, 14 nt, Human
uaccucugugugcu

SEQ ID NO: 2802645 - RNA, 14 nt, Human
uaccucuuauugca

SEQ ID NO: 2802646 - RNA, 14 nt, Human
uaccucucuguccc

SEQ ID NO: 2802647 - RNA, 15 nt, Human
uaccucucugucccu

SEQ ID NO: 2802648 - RNA, 18 nt, Human
uaccucucugucccuugc

SEQ ID NO: 2802649 - RNA, 20 nt, Human
uaccucucugucccuugcug

SEQ ID NO: 2802650 - RNA, 21 nt, Human
uaccucucugucccuugcugu

SEQ ID NO: 2802651 - RNA, 17 nt, Human
uaccucugaccaacagg

SEQ ID NO: 2802652 - RNA, 17 nt, Human
uaccucuggcugacuaa

SEQ ID NO: 2802653 - RNA, 21 nt, Human
uaccucuggcugacuaaauuu

SEQ ID NO: 2802654 - RNA, 12 nt, Human
uaccucucuguc

SEQ ID NO: 2802655 - RNA, 11 nt, Human
uaccuccuccu

SEQ ID NO: 2802656 - RNA, 13 nt, Human
uaccuccucucag

SEQ ID NO: 2802657 - RNA, 14 nt, Human
uaccuccucucagu

SEQ ID NO: 2802658 - RNA, 15 nt, Human
uaccuccucucagug

SEQ ID NO: 2802659 - RNA, 17 nt, Human
uaccuccucucaguguu

SEQ ID NO: 2802660 - RNA, 19 nt, Human
uaccuccucucaguguuuu

SEQ ID NO: 2802661 - RNA, 14 nt, Human
uaccuccugucucu

SEQ ID NO: 2802662 - RNA, 15 nt, Human
uaccuccugucucug

SEQ ID NO: 2802663 - RNA, 12 nt, Human
uacuaaacauau

SEQ ID NO: 2802664 - RNA, 18 nt, Human
uacuaaacauaugauuuc

SEQ ID NO: 2802665 - RNA, 14 nt, Human
uacuaacacaagga

SEQ ID NO: 2802666 - RNA, 13 nt, Human
uacuaaauuuaaa

SEQ ID NO: 2802667 - RNA, 14 nt, Human
uacuaaauuuaaau

SEQ ID NO: 2802668 - RNA, 15 nt, Human
uacuaaauuuaaauu

SEQ ID NO: 2802669 - RNA, 17 nt, Human
uacuaaauuuaaauuua

SEQ ID NO: 2802670 - RNA, 21 nt, Human
uacuaaauuuaaauuuaaaga

SEQ ID NO: 2802671 - RNA, 22 nt, Human
uacuaaauuuaaauuuaaagau

SEQ ID NO: 2802672 - RNA, 23 nt, Human
uacuaaauuuaaauuuaaagaua

SEQ ID NO: 2802673 - RNA, 20 nt, Human
uacuaagcauagcaaacaga

SEQ ID NO: 2802674 - RNA, 12 nt, Human
uacgaacaaaac

SEQ ID NO: 2802675 - RNA, 16 nt, Human
uacgaacaaaacacac

SEQ ID NO: 2802676 - RNA, 21 nt, Human
uaccuuuuuugauaaaguuuc

SEQ ID NO: 2802677 - RNA, 21 nt, Human
uaccuuuuuuguuuuuucaaa

SEQ ID NO: 2802678 - RNA, 22 nt, Human
uaccuuuuuuguuuuuucaaaa

SEQ ID NO: 2802679 - RNA, 23 nt, Human
uaccuuuuuuguuuuuucaaaau

SEQ ID NO: 2802680 - RNA, 23 nt, Human
uaccuaaaaggaaaucucacccc

SEQ ID NO: 2802681 - RNA, 22 nt, Human
uaccuaaaaggaaaucucaccc

SEQ ID NO: 2802682 - RNA, 19 nt, Human
uaccuaaaaggaaaucuca

SEQ ID NO: 2802683 - RNA, 22 nt, Human
uaccgagucucuucuccacugg

SEQ ID NO: 2802684 - RNA, 20 nt, Human
uaccgaguucaagugauuuu

SEQ ID NO: 2802685 - RNA, 15 nt, Human
uaccgccugucucuu

SEQ ID NO: 2802686 - RNA, 17 nt, Human
uaccgccugucucuuua

SEQ ID NO: 2802687 - RNA, 20 nt, Human
uaccguaggcuuuguauuca

SEQ ID NO: 2802688 - RNA, 17 nt, Human
uaccgagucucuucucc

SEQ ID NO: 2802689 - RNA, 18 nt, Human
uaccgagucucuucucca

SEQ ID NO: 2802690 - RNA, 21 nt, Human
uaccgagucucuucuccacug

SEQ ID NO: 2802691 - RNA, 15 nt, Human
uacccacugcucugg

SEQ ID NO: 2802692 - RNA, 21 nt, Human
uacccacuucuaaauagcaau

SEQ ID NO: 2802693 - RNA, 16 nt, Human
uacccagagaguccug

SEQ ID NO: 2802694 - RNA, 20 nt, Human
uacauuuuuugggcagcaau

SEQ ID NO: 2802695 - RNA, 14 nt, Human
uacauuuuuauuua

SEQ ID NO: 2802696 - RNA, 16 nt, Human
uacauuuuuauuuaug

SEQ ID NO: 2802697 - RNA, 17 nt, Human
uacauuuuuauuuauga

SEQ ID NO: 2802698 - RNA, 19 nt, Human
uacauuuuuauuuaugaag

SEQ ID NO: 2802699 - RNA, 22 nt, Human
uacauuuuuauuuaugaaguuu

SEQ ID NO: 2802700 - RNA, 16 nt, Human
uacauggccaguguga

SEQ ID NO: 2802701 - RNA, 20 nt, Human
uacauuuuguuguaaaaaga

SEQ ID NO: 2802702 - RNA, 21 nt, Human
uacauuuuguuguaaaaagaa

SEQ ID NO: 2802703 - RNA, 22 nt, Human
uacauuuuguuguaaaaagaaa

SEQ ID NO: 2802704 - RNA, 23 nt, Human
uacauuuuguuguaaaaagaaaa

SEQ ID NO: 2802705 - RNA, 22 nt, Human
uacauggcagaguuuguguguu

SEQ ID NO: 2802706 - RNA, 14 nt, Human
uaccuauaaugugu

SEQ ID NO: 2802707 - RNA, 16 nt, Human
uaccuauaaugugugu

SEQ ID NO: 2802708 - RNA, 17 nt, Human
uaccuauaaugugugua

SEQ ID NO: 2802709 - RNA, 18 nt, Human
uaccuauaauguguguau

SEQ ID NO: 2802710 - RNA, 19 nt, Human
uaccuauaauguguguaug

SEQ ID NO: 2802711 - RNA, 23 nt, Human
uaccuauaauguguguaugugua

SEQ ID NO: 2802712 - RNA, 13 nt, Human
uaccuagaagaag

SEQ ID NO: 2802713 - RNA, 14 nt, Human
uaccuaccugugug

SEQ ID NO: 2802714 - RNA, 20 nt, Human
uaccuaaaguauuuuuauaa

SEQ ID NO: 2802715 - RNA, 15 nt, Human
uaccuaacauuauuu

SEQ ID NO: 2802716 - RNA, 13 nt, Human
uaccuaaguacug

SEQ ID NO: 2802717 - RNA, 15 nt, Human
uaccuaaguacugua

SEQ ID NO: 2802718 - RNA, 16 nt, Human
uaccuaaguacuguaa

SEQ ID NO: 2802719 - RNA, 17 nt, Human
uaccuaaguacuguaau

SEQ ID NO: 2802720 - RNA, 19 nt, Human
uaccuaagugacauuugua

SEQ ID NO: 2802721 - RNA, 20 nt, Human
uaccuaagugacauuuguag

SEQ ID NO: 2802722 - RNA, 11 nt, Human
uaccucagccu

SEQ ID NO: 2802723 - RNA, 15 nt, Human
uaccucacccugcua

SEQ ID NO: 2802724 - RNA, 14 nt, Human
uaccucagccuaga

SEQ ID NO: 2802725 - RNA, 12 nt, Human
uaccucagccua

SEQ ID NO: 2802726 - RNA, 16 nt, Human
uaccucagccuagacc

SEQ ID NO: 2802727 - RNA, 18 nt, Human
uaccucacccugcuacac

SEQ ID NO: 2802728 - RNA, 19 nt, Human
uaccucaaccauccuggcu

SEQ ID NO: 2802729 - RNA, 14 nt, Human
uaccucaaacuauc

SEQ ID NO: 2802730 - RNA, 15 nt, Human
uaccucaaacuaucu

SEQ ID NO: 2802731 - RNA, 12 nt, Human
uaccuauuugac

SEQ ID NO: 2802732 - RNA, 21 nt, Human
uaccuaucccaccuccauccc

SEQ ID NO: 2802733 - RNA, 17 nt, Human
uaccucaaccuauggua

SEQ ID NO: 2802734 - RNA, 13 nt, Human
uaccucaauguuu

SEQ ID NO: 2802735 - RNA, 14 nt, Human
uaccucaauguuug

SEQ ID NO: 2802736 - RNA, 15 nt, Human
uaccucaauguuuga

SEQ ID NO: 2802737 - RNA, 16 nt, Human
uaccucaauguuugag

SEQ ID NO: 2802738 - RNA, 13 nt, Human
uaccuccccugcc

SEQ ID NO: 2802739 - RNA, 14 nt, Human
uaccuccccugccu

SEQ ID NO: 2802740 - RNA, 15 nt, Human
uaccuccccugccuu

SEQ ID NO: 2802741 - RNA, 17 nt, Human
uaccuccccugccuugc

SEQ ID NO: 2802742 - RNA, 11 nt, Human
uaccucccucc

SEQ ID NO: 2802743 - RNA, 12 nt, Human
uaccucccuccc

SEQ ID NO: 2802744 - RNA, 21 nt, Human
uaccucccuccccgucucauu

SEQ ID NO: 2802745 - RNA, 12 nt, Human
uaccucauguuu

SEQ ID NO: 2802746 - RNA, 13 nt, Human
uaccucauguuua

SEQ ID NO: 2802747 - RNA, 14 nt, Human
uaccucauguuuau

SEQ ID NO: 2802748 - RNA, 15 nt, Human
uaccucauguuuaug

SEQ ID NO: 2802749 - RNA, 17 nt, Human
uaccucauguuuaugaa

SEQ ID NO: 2802750 - RNA, 18 nt, Human
uaccucauguuuaugaaa

SEQ ID NO: 2802751 - RNA, 19 nt, Human
uaccucauguuuaugaaaa

SEQ ID NO: 2802752 - RNA, 20 nt, Human
uaccucauguuuaugaaaau

SEQ ID NO: 2802753 - RNA, 20 nt, Human
uaccuccaacagaacuaaau

SEQ ID NO: 2802754 - RNA, 22 nt, Human
uaccuccaacagaacuaaaugu

SEQ ID NO: 2802755 - RNA, 23 nt, Human
uaccuccaacagaacuaaauguu

SEQ ID NO: 2802756 - RNA, 15 nt, Human
uaccucaggcaggaa

SEQ ID NO: 2802757 - RNA, 14 nt, Human
uaccucaggcagga

SEQ ID NO: 2802758 - RNA, 17 nt, Human
uaccucaggcagcucaa

SEQ ID NO: 2802759 - RNA, 18 nt, Human
uaccucaggcagcucaag

SEQ ID NO: 2802760 - RNA, 14 nt, Human
uaccucaggcagcu

SEQ ID NO: 2802761 - RNA, 16 nt, Human
uaccucaggcagcuca

SEQ ID NO: 2802762 - RNA, 12 nt, Human
uaccucaggaaa

SEQ ID NO: 2802763 - RNA, 14 nt, Human
uaccucaggaaaga

SEQ ID NO: 2802764 - RNA, 16 nt, Human
uaccucaggaaagaau

SEQ ID NO: 2802765 - RNA, 18 nt, Human
uaccucaggaaagaauag

SEQ ID NO: 2802766 - RNA, 17 nt, Human
ugaauuaaauaaacccu

SEQ ID NO: 2802767 - RNA, 23 nt, Human
ugaauuaaucaucuauaaagaag

SEQ ID NO: 2802768 - RNA, 23 nt, Human
ugacaaauguguaucggaugcuu

SEQ ID NO: 2802769 - RNA, 15 nt, Human
ugacaaaucugugua

SEQ ID NO: 2802770 - RNA, 16 nt, Human
ugacaaaucuguguau

SEQ ID NO: 2802771 - RNA, 23 nt, Human
ugacaaaucuguguauauuauuu

SEQ ID NO: 2802772 - RNA, 17 nt, Human
ugacaaauguaaacauu

SEQ ID NO: 2802773 - RNA, 13 nt, Human
ugaauuguuacau

SEQ ID NO: 2802774 - RNA, 17 nt, Human
ugaauuguuuucuuuaa

SEQ ID NO: 2802775 - RNA, 19 nt, Human
ugaauuguuuuuauuguuu

SEQ ID NO: 2802776 - RNA, 12 nt, Human
ugaauuuaaaua

SEQ ID NO: 2802777 - RNA, 14 nt, Human
ugacaaaguuacug

SEQ ID NO: 2802778 - RNA, 12 nt, Human
ugacaacacagc

SEQ ID NO: 2802779 - RNA, 15 nt, Human
ugacaacagacuucu

SEQ ID NO: 2802780 - RNA, 22 nt, Human
ugacaacagaagcuucagaagu

SEQ ID NO: 2802781 - RNA, 13 nt, Human
ugacaacagaagc

SEQ ID NO: 2802782 - RNA, 14 nt, Human
ugacaacagaagcu

SEQ ID NO: 2802783 - RNA, 19 nt, Human
ugacaacagacuucugaaa

SEQ ID NO: 2802784 - RNA, 18 nt, Human
ugacaacagacuucugaa

SEQ ID NO: 2802785 - RNA, 23 nt, Human
ugacaaggauugcuacuguccua

SEQ ID NO: 2802786 - RNA, 15 nt, Human
ugacaacugugacug

SEQ ID NO: 2802787 - RNA, 16 nt, Human
ugacaacugugacugu

SEQ ID NO: 2802788 - RNA, 16 nt, Human
ugacaagggcugaccu

SEQ ID NO: 2802789 - RNA, 21 nt, Human
ugacaagggcugaccugccuc

SEQ ID NO: 2802790 - RNA, 22 nt, Human
ugacaagggcugaccugccucu

SEQ ID NO: 2802791 - RNA, 22 nt, Human
ugacaacuucccagugaauucu

SEQ ID NO: 2802792 - RNA, 12 nt, Human
ugacaacuguga

SEQ ID NO: 2802793 - RNA, 13 nt, Human
ugacaacugugac

SEQ ID NO: 2802794 - RNA, 14 nt, Human
ugacaacugugacu

SEQ ID NO: 2802795 - RNA, 13 nt, Human
ugacaacugucua

SEQ ID NO: 2802796 - RNA, 21 nt, Human
ugacaacugucuaacuuuaga

SEQ ID NO: 2802797 - RNA, 22 nt, Human
ugacaacugucuaacuuuagaa

SEQ ID NO: 2802798 - RNA, 13 nt, Human
ugacaaccuccau

SEQ ID NO: 2802799 - RNA, 20 nt, Human
ugacaaccuccauucuauuu

SEQ ID NO: 2802800 - RNA, 21 nt, Human
ugacaaccuccauucuauuuu

SEQ ID NO: 2802801 - RNA, 13 nt, Human
ugacagacacagg

SEQ ID NO: 2802802 - RNA, 16 nt, Human
ugacagacacaggccc

SEQ ID NO: 2802803 - RNA, 14 nt, Human
ugacagacacaggc

SEQ ID NO: 2802804 - RNA, 14 nt, Human
ugacacacagcucu

SEQ ID NO: 2802805 - RNA, 16 nt, Human
ugacacaaguggaccu

SEQ ID NO: 2802806 - RNA, 17 nt, Human
ugacacaaaccugccug

SEQ ID NO: 2802807 - RNA, 18 nt, Human
ugacacaaaccugccugg

SEQ ID NO: 2802808 - RNA, 19 nt, Human
ugacacaaaccugccuggg

SEQ ID NO: 2802809 - RNA, 13 nt, Human
ugacacaaaggaa

SEQ ID NO: 2802810 - RNA, 14 nt, Human
ugacacaaaggaag

SEQ ID NO: 2802811 - RNA, 15 nt, Human
ugacacaaaggaagu

SEQ ID NO: 2802812 - RNA, 15 nt, Human
ugacacacagcucug

SEQ ID NO: 2802813 - RNA, 17 nt, Human
ugacacaaguggaccuu

SEQ ID NO: 2802814 - RNA, 19 nt, Human
ugacacaaguggaccuuag

SEQ ID NO: 2802815 - RNA, 17 nt, Human
ugacacaauuggaauug

SEQ ID NO: 2802816 - RNA, 19 nt, Human
ugacauguuauauauuuuu

SEQ ID NO: 2802817 - RNA, 18 nt, Human
ugacauguuauauauuuu

SEQ ID NO: 2802818 - RNA, 20 nt, Human
ugacacaagaggaauaagaa

SEQ ID NO: 2802819 - RNA, 21 nt, Human
ugaccagccuccaugcugccu

SEQ ID NO: 2802820 - RNA, 23 nt, Human
ugaccauccacucuacccuccca

SEQ ID NO: 2802821 - RNA, 14 nt, Human
ugaccaucugcuuu

SEQ ID NO: 2802822 - RNA, 15 nt, Human
ugaccaucugcuuuu

SEQ ID NO: 2802823 - RNA, 22 nt, Human
ugaccauccacucuacccuccc

SEQ ID NO: 2802824 - RNA, 19 nt, Human
ugaccauccacucuacccu

SEQ ID NO: 2802825 - RNA, 22 nt, Human
ugaccagccuccaugcugccuc

SEQ ID NO: 2802826 - RNA, 14 nt, Human
ugacaucuggaauc

SEQ ID NO: 2802827 - RNA, 17 nt, Human
ugacaucuuuuuaaagc

SEQ ID NO: 2802828 - RNA, 19 nt, Human
ugacaucuuuuuaaagcuu

SEQ ID NO: 2802829 - RNA, 20 nt, Human
ugacaucuuuuuaaagcuua

SEQ ID NO: 2802830 - RNA, 21 nt, Human
ugacaugauuagcagaagaaa

SEQ ID NO: 2802831 - RNA, 23 nt, Human
ugacaugaggaaaauaauguaau

SEQ ID NO: 2802832 - RNA, 18 nt, Human
ugacaugcacucagcucu

SEQ ID NO: 2802833 - RNA, 13 nt, Human
ugacaugcacuga

SEQ ID NO: 2802834 - RNA, 14 nt, Human
ugacaugcacugac

SEQ ID NO: 2802835 - RNA, 15 nt, Human
ugacaugcacugacc

SEQ ID NO: 2802836 - RNA, 17 nt, Human
ugacaugcacugacccu

SEQ ID NO: 2802837 - RNA, 19 nt, Human
ugacaugcacugacccuuc

SEQ ID NO: 2802838 - RNA, 21 nt, Human
ugacaugcacugacccuucca

SEQ ID NO: 2802839 - RNA, 11 nt, Human
ugacaugcacu

SEQ ID NO: 2802840 - RNA, 17 nt, Human
ugacaugccuauaugag

SEQ ID NO: 2802841 - RNA, 23 nt, Human
ugacaugccuauaugagaagaau

SEQ ID NO: 2802842 - RNA, 15 nt, Human
ugacaugugaaaccu

SEQ ID NO: 2802843 - RNA, 16 nt, Human
ugacaugugaaaccuu

SEQ ID NO: 2802844 - RNA, 13 nt, Human
ugacaugugaaac

SEQ ID NO: 2802845 - RNA, 17 nt, Human
ugacaugugaaaccuuu

SEQ ID NO: 2802846 - RNA, 19 nt, Human
ugacaugugaaaccuuuuu

SEQ ID NO: 2802847 - RNA, 21 nt, Human
ugacaugugaaaccuuuuuua

SEQ ID NO: 2802848 - RNA, 19 nt, Human
ugacauguguuggcagccu

SEQ ID NO: 2802849 - RNA, 18 nt, Human
ugacagacacaggcccgg

SEQ ID NO: 2802850 - RNA, 17 nt, Human
ugacagacacaggcccg

SEQ ID NO: 2802851 - RNA, 22 nt, Human
ugacagaccacaucuuuaucug

SEQ ID NO: 2802852 - RNA, 19 nt, Human
ugacagagcgagacuccau

SEQ ID NO: 2802853 - RNA, 11 nt, Human
ugacauauuua

SEQ ID NO: 2802854 - RNA, 12 nt, Human
ugacauauuuaa

SEQ ID NO: 2802855 - RNA, 13 nt, Human
ugacauauuuaau

SEQ ID NO: 2802856 - RNA, 14 nt, Human
ugacauauuuaaug

SEQ ID NO: 2802857 - RNA, 15 nt, Human
ugacauauuuaaugu

SEQ ID NO: 2802858 - RNA, 16 nt, Human
ugacauauuuaauguu

SEQ ID NO: 2802859 - RNA, 17 nt, Human
ugacauauuuaauguuu

SEQ ID NO: 2802860 - RNA, 18 nt, Human
ugacauauuuaauguuuu

SEQ ID NO: 2802861 - RNA, 19 nt, Human
ugacauauuuaauguuuua

SEQ ID NO: 2802862 - RNA, 20 nt, Human
ugacauauuuaauguuuuaa

SEQ ID NO: 2802863 - RNA, 21 nt, Human
ugacauauuuaauguuuuaaa

SEQ ID NO: 2802864 - RNA, 22 nt, Human
ugacauauuuaauguuuuaaau

SEQ ID NO: 2802865 - RNA, 23 nt, Human
ugacauauuuaauguuuuaaaug

SEQ ID NO: 2802866 - RNA, 14 nt, Human
ugacaucucagggg

SEQ ID NO: 2802867 - RNA, 15 nt, Human
ugacaucucaggggc

SEQ ID NO: 2802868 - RNA, 23 nt, Human
ugacaucaguuccuuugugugua

SEQ ID NO: 2802869 - RNA, 13 nt, Human
ugacaucagccag

SEQ ID NO: 2802870 - RNA, 14 nt, Human
ugacaucagccagc

SEQ ID NO: 2802871 - RNA, 17 nt, Human
ugacaucagccagcugc

SEQ ID NO: 2802872 - RNA, 18 nt, Human
ugacaucagccagcugcc

SEQ ID NO: 2802873 - RNA, 14 nt, Human
ugacaucucuuuga

SEQ ID NO: 2802874 - RNA, 13 nt, Human
ugacaucucuuug

SEQ ID NO: 2802875 - RNA, 12 nt, Human
ugacaucucuuu

SEQ ID NO: 2802876 - RNA, 18 nt, Human
ugacaucucaggggccag

SEQ ID NO: 2802877 - RNA, 19 nt, Human
ugacaucucaggggccaga

SEQ ID NO: 2802878 - RNA, 21 nt, Human
ugacaucucaggggccagagg

SEQ ID NO: 2802879 - RNA, 22 nt, Human
ugacaucucaggggccagagga

SEQ ID NO: 2802880 - RNA, 15 nt, Human
ugacauauuuuugcu

SEQ ID NO: 2802881 - RNA, 14 nt, Human
ugacaucacagcag

SEQ ID NO: 2802882 - RNA, 15 nt, Human
ugacaucacagcagc

SEQ ID NO: 2802883 - RNA, 16 nt, Human
ugacaucacagcagcc

SEQ ID NO: 2802884 - RNA, 18 nt, Human
ugacaucacagcagccuc

SEQ ID NO: 2802885 - RNA, 13 nt, Human
ugacaucacuugu

SEQ ID NO: 2802886 - RNA, 23 nt, Human
ugacaucacuuguacaaaauaaa

SEQ ID NO: 2802887 - RNA, 22 nt, Human
ugacaucacuuguacaaaauaa

SEQ ID NO: 2802888 - RNA, 21 nt, Human
ugacaucacuuguacaaaaua

SEQ ID NO: 2802889 - RNA, 20 nt, Human
ugacaucacuuguacaaaau

SEQ ID NO: 2802890 - RNA, 19 nt, Human
ugacaucacuuguacaaaa

SEQ ID NO: 2802891 - RNA, 18 nt, Human
ugacaucacuuguacaaa

SEQ ID NO: 2802892 - RNA, 17 nt, Human
ugacaucacuuguacaa

SEQ ID NO: 2802893 - RNA, 16 nt, Human
ugacaucacuuguaca

SEQ ID NO: 2802894 - RNA, 17 nt, Human
ugaaugauucauguuau

SEQ ID NO: 2802895 - RNA, 18 nt, Human
ugaaugauucauguuaua

SEQ ID NO: 2802896 - RNA, 19 nt, Human
ugaauguuuauuccuugau

SEQ ID NO: 2802897 - RNA, 11 nt, Human
ugaauguuucc

SEQ ID NO: 2802898 - RNA, 22 nt, Human
ugaauguuuccaaccuggagua

SEQ ID NO: 2802899 - RNA, 21 nt, Human
ugaauguuuccaaccuggagu

SEQ ID NO: 2802900 - RNA, 14 nt, Human
ugaauuaaaacuuc

SEQ ID NO: 2802901 - RNA, 16 nt, Human
ugaauuaaaacuucuu

SEQ ID NO: 2802902 - RNA, 18 nt, Human
ugaauuaaaacuucuuaa

SEQ ID NO: 2802903 - RNA, 22 nt, Human
ugaauuaaaacuucuuaaauau

SEQ ID NO: 2802904 - RNA, 23 nt, Human
ugaauuaaaauugucccauuugc

SEQ ID NO: 2802905 - RNA, 15 nt, Human
ugaaucugauuuuua

SEQ ID NO: 2802906 - RNA, 16 nt, Human
ugaaucugcucacuuu

SEQ ID NO: 2802907 - RNA, 14 nt, Human
ugaaucuauuuaag

SEQ ID NO: 2802908 - RNA, 16 nt, Human
ugaaucuauuuaagua

SEQ ID NO: 2802909 - RNA, 16 nt, Human
ugaaugaaccuucugg

SEQ ID NO: 2802910 - RNA, 15 nt, Human
ugaaugaaccuucug

SEQ ID NO: 2802911 - RNA, 15 nt, Human
ugaaugaacacucuu

SEQ ID NO: 2802912 - RNA, 12 nt, Human
ugaaugaacacu

SEQ ID NO: 2802913 - RNA, 11 nt, Human
ugaaugaacac

SEQ ID NO: 2802914 - RNA, 16 nt, Human
ugaaucuuggugucua

SEQ ID NO: 2802915 - RNA, 14 nt, Human
ugaaguuuacauug

SEQ ID NO: 2802916 - RNA, 20 nt, Human
ugaaggcuucucuguucuac

SEQ ID NO: 2802917 - RNA, 19 nt, Human
ugaaguuuaaaacaguauu

SEQ ID NO: 2802918 - RNA, 20 nt, Human
ugaaguuuaaaacaguauuu

SEQ ID NO: 2802919 - RNA, 21 nt, Human
ugaaguuuaaaacaguauuua

SEQ ID NO: 2802920 - RNA, 20 nt, Human
ugaaguuuacauuguaaaua

SEQ ID NO: 2802921 - RNA, 16 nt, Human
ugaaguuuacauugua

SEQ ID NO: 2802922 - RNA, 12 nt, Human
ugaaguuuacau

SEQ ID NO: 2802923 - RNA, 13 nt, Human
ugaaguuuacauu

SEQ ID NO: 2802924 - RNA, 14 nt, Human
ugaaguuuacauuu

SEQ ID NO: 2802925 - RNA, 15 nt, Human
ugaaguuuacauuuu

SEQ ID NO: 2802926 - RNA, 16 nt, Human
ugaaguuuacauuuuu

SEQ ID NO: 2802927 - RNA, 17 nt, Human
ugaaguuuacauuuuua

SEQ ID NO: 2802928 - RNA, 19 nt, Human
ugaaguuuacauuuuuauu

SEQ ID NO: 2802929 - RNA, 16 nt, Human
ugaaguuuccuuggcu

SEQ ID NO: 2802930 - RNA, 19 nt, Human
ugaaguuuccuuggcuggu

SEQ ID NO: 2802931 - RNA, 21 nt, Human
ugaaguuuccuuggcuggugc

SEQ ID NO: 2802932 - RNA, 17 nt, Human
ugaaguuuuacauuguu

SEQ ID NO: 2802933 - RNA, 16 nt, Human
ugaaguuuuacauugu

SEQ ID NO: 2802934 - RNA, 15 nt, Human
ugaaguuuuacauug

SEQ ID NO: 2802935 - RNA, 14 nt, Human
ugaaguuuuacauu

SEQ ID NO: 2802936 - RNA, 18 nt, Human
ugaaguuugaacuucaua

SEQ ID NO: 2802937 - RNA, 20 nt, Human
ugaaguuuguaguuguuuua

SEQ ID NO: 2802938 - RNA, 15 nt, Human
ugaauccuuugccug

SEQ ID NO: 2802939 - RNA, 17 nt, Human
ugaauccucuucuuuau

SEQ ID NO: 2802940 - RNA, 21 nt, Human
ugaaucccccuugccacccca

SEQ ID NO: 2802941 - RNA, 14 nt, Human
ugaaucacuguuuu

SEQ ID NO: 2802942 - RNA, 16 nt, Human
ugaaucacuguuuuua

SEQ ID NO: 2802943 - RNA, 19 nt, Human
ugaaucacuguuuuuagac

SEQ ID NO: 2802944 - RNA, 21 nt, Human
ugaaucacuguuuuuagacac

SEQ ID NO: 2802945 - RNA, 22 nt, Human
ugaaucacuguuuuuagacacc

SEQ ID NO: 2802946 - RNA, 20 nt, Human
ugaaucaguuuccaauuauu

SEQ ID NO: 2802947 - RNA, 22 nt, Human
ugaaucaguuuccaauuauuug

SEQ ID NO: 2802948 - RNA, 23 nt, Human
ugaaucaguuuccaauuauuuga

SEQ ID NO: 2802949 - RNA, 18 nt, Human
ugaacuucucucagacuu

SEQ ID NO: 2802950 - RNA, 16 nt, Human
ugaacuuauucuguag

SEQ ID NO: 2802951 - RNA, 15 nt, Human
ugaacuucucucaga

SEQ ID NO: 2802952 - RNA, 22 nt, Human
ugaacuucucucagacuuacuu

SEQ ID NO: 2802953 - RNA, 17 nt, Human
ugaacuucuuugaauuu

SEQ ID NO: 2802954 - RNA, 20 nt, Human
ugaagacucauucuucugua

SEQ ID NO: 2802955 - RNA, 19 nt, Human
ugaagacucauucuucugu

SEQ ID NO: 2802956 - RNA, 23 nt, Human
ugaacuggguacuuguggacaca

SEQ ID NO: 2802957 - RNA, 13 nt, Human
ugaacugguucau

SEQ ID NO: 2802958 - RNA, 22 nt, Human
ugaacuguguguaauuguuccu

SEQ ID NO: 2802959 - RNA, 16 nt, Human
ugaacuguuaagaaau

SEQ ID NO: 2802960 - RNA, 14 nt, Human
ugaaacagauuuca

SEQ ID NO: 2802961 - RNA, 16 nt, Human
ugaaacagaaacaaaa

SEQ ID NO: 2802962 - RNA, 14 nt, Human
ugaaacagaaacaa

SEQ ID NO: 2802963 - RNA, 13 nt, Human
ugaaacagaaaca

SEQ ID NO: 2802964 - RNA, 15 nt, Human
ugaaacacuuugccu

SEQ ID NO: 2802965 - RNA, 20 nt, Human
ugaaacacuuugccuccugu

SEQ ID NO: 2802966 - RNA, 23 nt, Human
ugaaacacuuugccuccugugua

SEQ ID NO: 2802967 - RNA, 13 nt, Human
ugaaacacuuuuu

SEQ ID NO: 2802968 - RNA, 15 nt, Human
ugaaacacuuuuuug

SEQ ID NO: 2802969 - RNA, 14 nt, Human
ugaagagcuugcuu

SEQ ID NO: 2802970 - RNA, 15 nt, Human
ugaagagcuugcuuu

SEQ ID NO: 2802971 - RNA, 16 nt, Human
ugaagagcuugcuuug

SEQ ID NO: 2802972 - RNA, 17 nt, Human
ugaagagcuugcuuuga

SEQ ID NO: 2802973 - RNA, 18 nt, Human
ugaagagcuugcuuugau

SEQ ID NO: 2802974 - RNA, 19 nt, Human
ugaagagcuugcuuugauu

SEQ ID NO: 2802975 - RNA, 23 nt, Human
ugaagaguccucugaaugaaccu

SEQ ID NO: 2802976 - RNA, 18 nt, Human
ugaagagucgauuauuuc

SEQ ID NO: 2802977 - RNA, 22 nt, Human
ugaagagugacuaguacaaauu

SEQ ID NO: 2802978 - RNA, 14 nt, Human
ugaagacugaggac

SEQ ID NO: 2802979 - RNA, 17 nt, Human
ugaagaguccucugaau

SEQ ID NO: 2802980 - RNA, 13 nt, Human
ugaagaguaguuu

SEQ ID NO: 2802981 - RNA, 15 nt, Human
ugaagagagauauau

SEQ ID NO: 2802982 - RNA, 21 nt, Human
ugaagagagauauaucugaaa

SEQ ID NO: 2802983 - RNA, 22 nt, Human
ugaagagagauauaucugaaaa

SEQ ID NO: 2802984 - RNA, 17 nt, Human
ugaagagacaguuauuu

SEQ ID NO: 2802985 - RNA, 23 nt, Human
ugaagagacaguuauuuauaguc

SEQ ID NO: 2802986 - RNA, 16 nt, Human
ugaagagcaaaaauau

SEQ ID NO: 2802987 - RNA, 22 nt, Human
ugaagagccagaagugaagagu

SEQ ID NO: 2802988 - RNA, 24 nt, Human
ugaagagaaccgagcaaagaucaa

SEQ ID NO: 2802989 - RNA, 19 nt, Human
ugaagagaagcaauuuugg

SEQ ID NO: 2802990 - RNA, 15 nt, Human
ugaagacuggaagcu

SEQ ID NO: 2802991 - RNA, 11 nt, Human
ugaaggccugg

SEQ ID NO: 2802992 - RNA, 19 nt, Human
ugaaggaacauuccuuagu

SEQ ID NO: 2802993 - RNA, 15 nt, Human
ugaaggaaaaugaua

SEQ ID NO: 2802994 - RNA, 12 nt, Human
ugaaggaaacag

SEQ ID NO: 2802995 - RNA, 14 nt, Human
ugaaggaaacaguu

SEQ ID NO: 2802996 - RNA, 16 nt, Human
ugaaggaaacaguuaa

SEQ ID NO: 2802997 - RNA, 22 nt, Human
ugaagaguugccccgucucugu

SEQ ID NO: 2802998 - RNA, 14 nt, Human
ugacuaaaauauuu

SEQ ID NO: 2802999 - RNA, 23 nt, Human
ugacuaacuagacaccaaaguuc

SEQ ID NO: 2803000 - RNA, 11 nt, Human
ugacuaauuag

SEQ ID NO: 2803001 - RNA, 14 nt, Human
ugacuaauuagggu

SEQ ID NO: 2803002 - RNA, 21 nt, Human
ugacuaauuaggguacauuua

SEQ ID NO: 2803003 - RNA, 22 nt, Human
ugacuaauuaggguacauuuau

SEQ ID NO: 2803004 - RNA, 23 nt, Human
ugacuaauuaggguacauuuaua

SEQ ID NO: 2803005 - RNA, 20 nt, Human
ugacuaacuagacaccaaag

SEQ ID NO: 2803006 - RNA, 15 nt, Human
ugacuaaauucguga

SEQ ID NO: 2803007 - RNA, 18 nt, Human
ugacuaaauucgugauuu

SEQ ID NO: 2803008 - RNA, 19 nt, Human
ugacuaaauucgugauuuu

SEQ ID NO: 2803009 - RNA, 13 nt, Human
ugacuaaauuugg

SEQ ID NO: 2803010 - RNA, 16 nt, Human
ugacuaaauuugggga

SEQ ID NO: 2803011 - RNA, 15 nt, Human
ugaccaugucuauga

SEQ ID NO: 2803012 - RNA, 23 nt, Human
ugacguggagcgggguaugaaga

SEQ ID NO: 2803013 - RNA, 16 nt, Human
ugacuuugcucuuucu

SEQ ID NO: 2803014 - RNA, 13 nt, Human
ugacuuucaggua

SEQ ID NO: 2803015 - RNA, 14 nt, Human
ugacuuucaguaaa

SEQ ID NO: 2803016 - RNA, 17 nt, Human
ugacuggggugggaggu

SEQ ID NO: 2803017 - RNA, 20 nt, Human
ugacuggggugggaggucuu

SEQ ID NO: 2803018 - RNA, 20 nt, Human
ugacucuuguuuucaguuuc

SEQ ID NO: 2803019 - RNA, 23 nt, Human
ugacucuuuuuagggccaggcag

SEQ ID NO: 2803020 - RNA, 22 nt, Human
ugacucuuuuuagggccaggca

SEQ ID NO: 2803021 - RNA, 21 nt, Human
ugacugcccagcauuugggua

SEQ ID NO: 2803022 - RNA, 18 nt, Human
ugacugcccauucaccaa

SEQ ID NO: 2803023 - RNA, 14 nt, Human
ugacuggcauuuua

SEQ ID NO: 2803024 - RNA, 17 nt, Human
ugacuggcauuuuauag

SEQ ID NO: 2803025 - RNA, 18 nt, Human
ugacuggcauuuuauaga

SEQ ID NO: 2803026 - RNA, 21 nt, Human
ugacuggcauuuuauagacac

SEQ ID NO: 2803027 - RNA, 23 nt, Human
ugacuggaggguccauuuuucuu

SEQ ID NO: 2803028 - RNA, 15 nt, Human
ugacugcugauucuc

SEQ ID NO: 2803029 - RNA, 23 nt, Human
ugacugcuccccagcccuggcuc

SEQ ID NO: 2803030 - RNA, 20 nt, Human
ugacugcuccccagcccugg

SEQ ID NO: 2803031 - RNA, 21 nt, Human
ugacugcuccccagcccuggc

SEQ ID NO: 2803032 - RNA, 22 nt, Human
ugacugcuccccagcccuggcu

SEQ ID NO: 2803033 - RNA, 13 nt, Human
ugagaaagcccug

SEQ ID NO: 2803034 - RNA, 21 nt, Human
ugagaaagcccugucgggcuu

SEQ ID NO: 2803035 - RNA, 21 nt, Human
ugagaaauauggacacuuaau

SEQ ID NO: 2803036 - RNA, 17 nt, Human
ugagacagugcacauga

SEQ ID NO: 2803037 - RNA, 18 nt, Human
ugagacagugcacaugaa

SEQ ID NO: 2803038 - RNA, 19 nt, Human
ugagacagugcacaugaac

SEQ ID NO: 2803039 - RNA, 17 nt, Human
ugagaaauauggacacu

SEQ ID NO: 2803040 - RNA, 15 nt, Human
ugagaaauauggaca

SEQ ID NO: 2803041 - RNA, 23 nt, Human
ugagacaguuucuuagcuuuuua

SEQ ID NO: 2803042 - RNA, 20 nt, Human
ugagacaguuucuuagcuuu

SEQ ID NO: 2803043 - RNA, 21 nt, Human
ugagacaguuucuuagcuuuu

SEQ ID NO: 2803044 - RNA, 14 nt, Human
ugagacaguuucuu

SEQ ID NO: 2803045 - RNA, 15 nt, Human
ugagacaguuucuua

SEQ ID NO: 2803046 - RNA, 16 nt, Human
ugagacaguuucuuag

SEQ ID NO: 2803047 - RNA, 18 nt, Human
ugagacaguuucuuagcu

SEQ ID NO: 2803048 - RNA, 19 nt, Human
ugagacaguuucuuagcuu

SEQ ID NO: 2803049 - RNA, 16 nt, Human
ugagaaaccuguaucu

SEQ ID NO: 2803050 - RNA, 17 nt, Human
ugagaaaccuguaucuu

SEQ ID NO: 2803051 - RNA, 18 nt, Human
ugagaaaccuguaucuuu

SEQ ID NO: 2803052 - RNA, 20 nt, Human
ugagaaaccuguaucuuucu

SEQ ID NO: 2803053 - RNA, 21 nt, Human
ugagaaaccuguaucuuucua

SEQ ID NO: 2803054 - RNA, 22 nt, Human
ugagaaaccuguaucuuucuau

SEQ ID NO: 2803055 - RNA, 24 nt, Human
ugagaaaccuguaucuuucuaugc

SEQ ID NO: 2803056 - RNA, 23 nt, Human
ugagaaaacaagcaaguucugag

SEQ ID NO: 2803057 - RNA, 14 nt, Human
ugagaaaacaagca

SEQ ID NO: 2803058 - RNA, 13 nt, Human
ugagaaaacaagc

SEQ ID NO: 2803059 - RNA, 18 nt, Human
ugagaaaaauauauacua

SEQ ID NO: 2803060 - RNA, 16 nt, Human
ugagaaaaagcuccug

SEQ ID NO: 2803061 - RNA, 17 nt, Human
ugagaaaaagcuccugu

SEQ ID NO: 2803062 - RNA, 18 nt, Human
ugagaaaaagcuccuguc

SEQ ID NO: 2803063 - RNA, 16 nt, Human
ugagcaggaaggccug

SEQ ID NO: 2803064 - RNA, 17 nt, Human
ugagcaggaaggccugg

SEQ ID NO: 2803065 - RNA, 18 nt, Human
ugagcaggaaggccuggg

SEQ ID NO: 2803066 - RNA, 19 nt, Human
ugagcaggaaggccugggu

SEQ ID NO: 2803067 - RNA, 18 nt, Human
ugagaguuuugucuugaa

SEQ ID NO: 2803068 - RNA, 21 nt, Human
ugagaguuuugucuugaaugu

SEQ ID NO: 2803069 - RNA, 22 nt, Human
ugagauagcugguguuagggcu

SEQ ID NO: 2803070 - RNA, 15 nt, Human
ugagauacuuuuucu

SEQ ID NO: 2803071 - RNA, 21 nt, Human
ugagauacuuuuucuuuugua

SEQ ID NO: 2803072 - RNA, 23 nt, Human
ugagauacuuuuucuuuuguaag

SEQ ID NO: 2803073 - RNA, 14 nt, Human
ugagaggggaacag

SEQ ID NO: 2803074 - RNA, 18 nt, Human
ugagaggggaacagacug

SEQ ID NO: 2803075 - RNA, 12 nt, Human
ugagaccugccc

SEQ ID NO: 2803076 - RNA, 22 nt, Human
ugagaccugccccuccucucug

SEQ ID NO: 2803077 - RNA, 15 nt, Human
ugagaccugccccuc

SEQ ID NO: 2803078 - RNA, 14 nt, Human
ugagaccugccccu

SEQ ID NO: 2803079 - RNA, 13 nt, Human
ugagaccugcccc

SEQ ID NO: 2803080 - RNA, 21 nt, Human
ugaggcaaugucaggaacaga

SEQ ID NO: 2803081 - RNA, 22 nt, Human
ugaggcacaagaaucacuugaa

SEQ ID NO: 2803082 - RNA, 20 nt, Human
ugaggcaaugucaggaacag

SEQ ID NO: 2803083 - RNA, 17 nt, Human
ugaggcaaugucaggaa

SEQ ID NO: 2803084 - RNA, 16 nt, Human
ugaggcaaugucagga

SEQ ID NO: 2803085 - RNA, 13 nt, Human
ugaggcagggcaa

SEQ ID NO: 2803086 - RNA, 18 nt, Human
ugaggcagggcaaaugac

SEQ ID NO: 2803087 - RNA, 18 nt, Human
ugaggcucuuucugggcc

SEQ ID NO: 2803088 - RNA, 17 nt, Human
ugaggcucuuucugggc

SEQ ID NO: 2803089 - RNA, 16 nt, Human
ugaggcucuuucuggg

SEQ ID NO: 2803090 - RNA, 23 nt, Human
ugaggcggguggaucaccugagg

SEQ ID NO: 2803091 - RNA, 14 nt, Human
ugaggccugucugu

SEQ ID NO: 2803092 - RNA, 16 nt, Human
ugaggccugucuguga

SEQ ID NO: 2803093 - RNA, 19 nt, Human
ugaggccugucugugaccu

SEQ ID NO: 2803094 - RNA, 19 nt, Human
ugaggucagagccugcagu

SEQ ID NO: 2803095 - RNA, 18 nt, Human
ugaggucagagccugcag

SEQ ID NO: 2803096 - RNA, 13 nt, Human
ugaggcugagacu

SEQ ID NO: 2803097 - RNA, 19 nt, Human
ugaggcucuuucugggcca

SEQ ID NO: 2803098 - RNA, 15 nt, Human
ugaggucccaggaag

SEQ ID NO: 2803099 - RNA, 16 nt, Human
ugaggucccaggaagu

SEQ ID NO: 2803100 - RNA, 12 nt, Human
ugaggucaggga

SEQ ID NO: 2803101 - RNA, 14 nt, Human
ugaggucagggagu

SEQ ID NO: 2803102 - RNA, 15 nt, Human
ugaggucagggagug

SEQ ID NO: 2803103 - RNA, 16 nt, Human
ugaggucagggagugc

SEQ ID NO: 2803104 - RNA, 18 nt, Human
ugaggucagggagugcug

SEQ ID NO: 2803105 - RNA, 16 nt, Human
ugaggugaaagggagc

SEQ ID NO: 2803106 - RNA, 15 nt, Human
ugaggugaaagggag

SEQ ID NO: 2803107 - RNA, 18 nt, Human
ugaggugaaagggagcua

SEQ ID NO: 2803108 - RNA, 17 nt, Human
ugaggugaaagggagcu

SEQ ID NO: 2803109 - RNA, 16 nt, Human
ugaggugccuguccca

SEQ ID NO: 2803110 - RNA, 14 nt, Human
ugaggugccugucc

SEQ ID NO: 2803111 - RNA, 15 nt, Human
ugaggugccuguccc

SEQ ID NO: 2803112 - RNA, 12 nt, Human
ugaggugguagg

SEQ ID NO: 2803113 - RNA, 21 nt, Human
ugaggugguaguaaaacacag

SEQ ID NO: 2803114 - RNA, 23 nt, Human
ugaggugguaguaaaacacagag

SEQ ID NO: 2803115 - RNA, 19 nt, Human
ugagucccaggcugagccu

SEQ ID NO: 2803116 - RNA, 12 nt, Human
ugagguguacca

SEQ ID NO: 2803117 - RNA, 21 nt, Human
ugagucccaggcugagccuca

SEQ ID NO: 2803118 - RNA, 20 nt, Human
ugagucccaggcugagccuc

SEQ ID NO: 2803119 - RNA, 18 nt, Human
ugagucccccagagaugu

SEQ ID NO: 2803120 - RNA, 20 nt, Human
ugagucccccagagauguca

SEQ ID NO: 2803121 - RNA, 20 nt, Human
ugaggauuauuauaaaaggg

SEQ ID NO: 2803122 - RNA, 20 nt, Human
ugaggauuauugauaguacu

SEQ ID NO: 2803123 - RNA, 16 nt, Human
ugaggauuuagaagug

SEQ ID NO: 2803124 - RNA, 19 nt, Human
ugaggauuuagaaguguca

SEQ ID NO: 2803125 - RNA, 15 nt, Human
ugaggcaaguguggg

SEQ ID NO: 2803126 - RNA, 16 nt, Human
ugaggcaagugugggc

SEQ ID NO: 2803127 - RNA, 20 nt, Human
ugaggcaaccugauuguaaa

SEQ ID NO: 2803128 - RNA, 22 nt, Human
ugaggaggggccccccugcccu

SEQ ID NO: 2803129 - RNA, 19 nt, Human
ugagcuuggcagcugaacu

SEQ ID NO: 2803130 - RNA, 20 nt, Human
ugagcuuggcagcugaacua

SEQ ID NO: 2803131 - RNA, 17 nt, Human
ugaggaggccuccaucu

SEQ ID NO: 2803132 - RNA, 23 nt, Human
ugagcuuaagaauuuugagcagg

SEQ ID NO: 2803133 - RNA, 16 nt, Human
ugagcugaucugcgga

SEQ ID NO: 2803134 - RNA, 13 nt, Human
ugagcugagccag

SEQ ID NO: 2803135 - RNA, 14 nt, Human
ugagcugagccagg

SEQ ID NO: 2803136 - RNA, 15 nt, Human
ugagcugagccaggc

SEQ ID NO: 2803137 - RNA, 16 nt, Human
ugagcugagccaggcu

SEQ ID NO: 2803138 - RNA, 22 nt, Human
ugagccgagaucacgccacugc

SEQ ID NO: 2803139 - RNA, 23 nt, Human
ugagcagggcucagcggggacag

SEQ ID NO: 2803140 - RNA, 22 nt, Human
ugagcagggcucagcggggaca

SEQ ID NO: 2803141 - RNA, 20 nt, Human
ugagcagggcucagcgggga

SEQ ID NO: 2803142 - RNA, 23 nt, Human
ugagccgagaucacgccacugca

SEQ ID NO: 2803143 - RNA, 16 nt, Human
ugagcuauugcuguuc

SEQ ID NO: 2803144 - RNA, 15 nt, Human
ugagcuauuaaaacu

SEQ ID NO: 2803145 - RNA, 18 nt, Human
ugagcuauuaaaacucag

SEQ ID NO: 2803146 - RNA, 21 nt, Human
ugagcuauuaaaacucagccu

SEQ ID NO: 2803147 - RNA, 12 nt, Human
ugagcucagccc

SEQ ID NO: 2803148 - RNA, 11 nt, Human
ugagcucagcc

SEQ ID NO: 2803149 - RNA, 20 nt, Human
ugagcucagcccuggugggc

SEQ ID NO: 2803150 - RNA, 15 nt, Human
ugagcugauauaaau

SEQ ID NO: 2803151 - RNA, 16 nt, Human
ugagcugauauaaauu

SEQ ID NO: 2803152 - RNA, 17 nt, Human
ugagcugauauaaauuc

SEQ ID NO: 2803153 - RNA, 21 nt, Human
ugagcugauauaaauucugug

SEQ ID NO: 2803154 - RNA, 12 nt, Human
ucugucucaucc

SEQ ID NO: 2803155 - RNA, 17 nt, Human
ucugucucauccuccug

SEQ ID NO: 2803156 - RNA, 18 nt, Human
ucugucucauccuccugg

SEQ ID NO: 2803157 - RNA, 19 nt, Human
ucugucucauccuccugga

SEQ ID NO: 2803158 - RNA, 20 nt, Human
ucugucucauccuccuggaa

SEQ ID NO: 2803159 - RNA, 14 nt, Human
ucugucuccuuaac

SEQ ID NO: 2803160 - RNA, 19 nt, Human
ucugucuccuuaacacuga

SEQ ID NO: 2803161 - RNA, 22 nt, Human
ucugucucccaguuaugaauca

SEQ ID NO: 2803162 - RNA, 14 nt, Human
ucuguguauauuau

SEQ ID NO: 2803163 - RNA, 18 nt, Human
ucuguguauauuauuugg

SEQ ID NO: 2803164 - RNA, 19 nt, Human
ucuguguauauuauuuggc

SEQ ID NO: 2803165 - RNA, 15 nt, Human
ucugucucagacuuu

SEQ ID NO: 2803166 - RNA, 19 nt, Human
ucugucucagacuuuugua

SEQ ID NO: 2803167 - RNA, 22 nt, Human
ucugucucagacuuuuguacau

SEQ ID NO: 2803168 - RNA, 19 nt, Human
ucugucuagcaugccaaca

SEQ ID NO: 2803169 - RNA, 23 nt, Human
ucugucuagcaugccaacaagaa

SEQ ID NO: 2803170 - RNA, 16 nt, Human
ucugucuaaaaaccag

SEQ ID NO: 2803171 - RNA, 17 nt, Human
ucugucuaaaaaccaga

SEQ ID NO: 2803172 - RNA, 15 nt, Human
ucugucuaaagauag

SEQ ID NO: 2803173 - RNA, 14 nt, Human
ucugucuacaaaua

SEQ ID NO: 2803174 - RNA, 22 nt, Human
ucugucuacaaauauaagauuu

SEQ ID NO: 2803175 - RNA, 16 nt, Human
ucuguccugagaagca

SEQ ID NO: 2803176 - RNA, 12 nt, Human
ucuguccugcug

SEQ ID NO: 2803177 - RNA, 15 nt, Human
ucuguccugcuucug

SEQ ID NO: 2803178 - RNA, 16 nt, Human
ucuguccugcuucuga

SEQ ID NO: 2803179 - RNA, 16 nt, Human
ucugucgcccagucug

SEQ ID NO: 2803180 - RNA, 17 nt, Human
ucugucgcccagucugg

SEQ ID NO: 2803181 - RNA, 12 nt, Human
ucuguccuggga

SEQ ID NO: 2803182 - RNA, 17 nt, Human
ucuguacacguguccug

SEQ ID NO: 2803183 - RNA, 14 nt, Human
ucuguaauuuuuca

SEQ ID NO: 2803184 - RNA, 15 nt, Human
ucuguaauuuuucag

SEQ ID NO: 2803185 - RNA, 12 nt, Human
ucuguacaaagg

SEQ ID NO: 2803186 - RNA, 23 nt, Human
ucuguacaaaggggaaagaacau

SEQ ID NO: 2803187 - RNA, 20 nt, Human
ucuguccuacucugugucag

SEQ ID NO: 2803188 - RNA, 13 nt, Human
ucuguacacgugu

SEQ ID NO: 2803189 - RNA, 19 nt, Human
ucuggucucuaggcugggg

SEQ ID NO: 2803190 - RNA, 21 nt, Human
ucuggucucuaggcuggggaa

SEQ ID NO: 2803191 - RNA, 16 nt, Human
ucuggucucuaggcug

SEQ ID NO: 2803192 - RNA, 17 nt, Human
ucuggucucuaggcugg

SEQ ID NO: 2803193 - RNA, 18 nt, Human
ucuggucucuaggcuggg

SEQ ID NO: 2803194 - RNA, 12 nt, Human
ucuguaaauaug

SEQ ID NO: 2803195 - RNA, 13 nt, Human
ucuguaaauacca

SEQ ID NO: 2803196 - RNA, 21 nt, Human
ucuguaaauaccauugacaca

SEQ ID NO: 2803197 - RNA, 22 nt, Human
ucuguaaauaccauugacacau

SEQ ID NO: 2803198 - RNA, 16 nt, Human
ucuguaaauauguuuu

SEQ ID NO: 2803199 - RNA, 23 nt, Human
ucuguaacagguauuuuguuucu

SEQ ID NO: 2803200 - RNA, 23 nt, Human
ucuguaacaucacuauccaugca

SEQ ID NO: 2803201 - RNA, 15 nt, Human
ucuguaaacucaaaa

SEQ ID NO: 2803202 - RNA, 18 nt, Human
ucuguaaacucaaaacuu

SEQ ID NO: 2803203 - RNA, 23 nt, Human
ucuggcuuccagaaaaccccagc

SEQ ID NO: 2803204 - RNA, 16 nt, Human
ucuggcuguaaggcuc

SEQ ID NO: 2803205 - RNA, 18 nt, Human
ucuggcuguaaggcucua

SEQ ID NO: 2803206 - RNA, 22 nt, Human
ucuggcuguaaggcucuagauc

SEQ ID NO: 2803207 - RNA, 16 nt, Human
ucuggcuuauuuuaau

SEQ ID NO: 2803208 - RNA, 17 nt, Human
ucuggcuuauuuuaaug

SEQ ID NO: 2803209 - RNA, 18 nt, Human
ucuggcuuauuuuaaugu

SEQ ID NO: 2803210 - RNA, 20 nt, Human
ucuggcuuauuuuaauguga

SEQ ID NO: 2803211 - RNA, 21 nt, Human
ucuggcuuauuuuaaugugau

SEQ ID NO: 2803212 - RNA, 21 nt, Human
ucuggcuguaaggcucuagau

SEQ ID NO: 2803213 - RNA, 21 nt, Human
ucuggcugccccaaccugcug

SEQ ID NO: 2803214 - RNA, 22 nt, Human
ucuggcugccccaaccugcuga

SEQ ID NO: 2803215 - RNA, 21 nt, Human
ucugcugccgccccacccaga

SEQ ID NO: 2803216 - RNA, 17 nt, Human
ucugcugccugcccgca

SEQ ID NO: 2803217 - RNA, 22 nt, Human
ucugcugccugcccgcacagca

SEQ ID NO: 2803218 - RNA, 23 nt, Human
ucugcugccugcccgcacagcag

SEQ ID NO: 2803219 - RNA, 13 nt, Human
ucugcuggaguuu

SEQ ID NO: 2803220 - RNA, 18 nt, Human
ucugcugcugucccuccc

SEQ ID NO: 2803221 - RNA, 19 nt, Human
ucugcuggaguuucaugua

SEQ ID NO: 2803222 - RNA, 22 nt, Human
ucugcugccgccccacccagau

SEQ ID NO: 2803223 - RNA, 16 nt, Human
ucugcugaagacuugc

SEQ ID NO: 2803224 - RNA, 23 nt, Human
ucuggaaugguacaugucuucca

SEQ ID NO: 2803225 - RNA, 14 nt, Human
ucuggacucuaaag

SEQ ID NO: 2803226 - RNA, 15 nt, Human
ucuggacucuaaaga

SEQ ID NO: 2803227 - RNA, 18 nt, Human
ucuggacucuaaagacca

SEQ ID NO: 2803228 - RNA, 20 nt, Human
ucuggacucuaaagaccaaa

SEQ ID NO: 2803229 - RNA, 22 nt, Human
ucuggacuccucuguccaggca

SEQ ID NO: 2803230 - RNA, 14 nt, Human
ucuggacugacagc

SEQ ID NO: 2803231 - RNA, 17 nt, Human
ucuggacugacagcaug

SEQ ID NO: 2803232 - RNA, 19 nt, Human
ucuggacugccccagaaaa

SEQ ID NO: 2803233 - RNA, 15 nt, Human
ucuggacuggcuaga

SEQ ID NO: 2803234 - RNA, 14 nt, Human
ucuggacuggcuag

SEQ ID NO: 2803235 - RNA, 15 nt, Human
ucuggacuccucugu

SEQ ID NO: 2803236 - RNA, 16 nt, Human
ucuggacuccucuguc

SEQ ID NO: 2803237 - RNA, 18 nt, Human
ucuggacuccucugucca

SEQ ID NO: 2803238 - RNA, 20 nt, Human
ucugccugcccaggccccug

SEQ ID NO: 2803239 - RNA, 18 nt, Human
ucugccugcccaggcccc

SEQ ID NO: 2803240 - RNA, 17 nt, Human
ucugccugcccaggccc

SEQ ID NO: 2803241 - RNA, 16 nt, Human
ucugcucgccuuagca

SEQ ID NO: 2803242 - RNA, 16 nt, Human
ucugcuccuuuccccu

SEQ ID NO: 2803243 - RNA, 21 nt, Human
ucugcuccuuuccccuuccuu

SEQ ID NO: 2803244 - RNA, 17 nt, Human
ucugcucgcccuccuuu

SEQ ID NO: 2803245 - RNA, 19 nt, Human
ucugcucgcccuccuuucu

SEQ ID NO: 2803246 - RNA, 21 nt, Human
ucugcucgcccuccuuucugu

SEQ ID NO: 2803247 - RNA, 21 nt, Human
ucugcuccucuccccagcaag

SEQ ID NO: 2803248 - RNA, 22 nt, Human
ucugcugauccucccaggcuuc

SEQ ID NO: 2803249 - RNA, 13 nt, Human
ucugcugaaggaa

SEQ ID NO: 2803250 - RNA, 22 nt, Human
ucugcccaccucagccucccaa

SEQ ID NO: 2803251 - RNA, 18 nt, Human
ucugcccacauuggaccc

SEQ ID NO: 2803252 - RNA, 19 nt, Human
ucugcccaaaaauaugguu

SEQ ID NO: 2803253 - RNA, 18 nt, Human
ucugcccaauuggaggaa

SEQ ID NO: 2803254 - RNA, 23 nt, Human
ucugccauauucuguuggccagu

SEQ ID NO: 2803255 - RNA, 22 nt, Human
ucugccauauucuguuggccag

SEQ ID NO: 2803256 - RNA, 13 nt, Human
ucugccaucaacu

SEQ ID NO: 2803257 - RNA, 21 nt, Human
ucugcauauguugaauacuuu

SEQ ID NO: 2803258 - RNA, 19 nt, Human
ucugcauauguugaauacu

SEQ ID NO: 2803259 - RNA, 18 nt, Human
ucugccauauucuguugg

SEQ ID NO: 2803260 - RNA, 18 nt, Human
ucugcauauguugaauac

SEQ ID NO: 2803261 - RNA, 16 nt, Human
ucugcauauguugaau

SEQ ID NO: 2803262 - RNA, 15 nt, Human
ucugcauauguugaa

SEQ ID NO: 2803263 - RNA, 15 nt, Human
ucugcaguaaaucuu

SEQ ID NO: 2803264 - RNA, 20 nt, Human
ucugccugaagucacacagu

SEQ ID NO: 2803265 - RNA, 19 nt, Human
ucugccugaagucacacag

SEQ ID NO: 2803266 - RNA, 22 nt, Human
ucugccucugacacacagcucu

SEQ ID NO: 2803267 - RNA, 21 nt, Human
ucugccucugacacacagcuc

SEQ ID NO: 2803268 - RNA, 23 nt, Human
ucugccucugacacacagcucug

SEQ ID NO: 2803269 - RNA, 18 nt, Human
ucugccucugacacacag

SEQ ID NO: 2803270 - RNA, 15 nt, Human
ucugccucugacaca

SEQ ID NO: 2803271 - RNA, 20 nt, Human
ucugccucacauagcuuaca

SEQ ID NO: 2803272 - RNA, 21 nt, Human
ucugccucaccgcuucccucc

SEQ ID NO: 2803273 - RNA, 20 nt, Human
ucugccuccaugcugcagug

SEQ ID NO: 2803274 - RNA, 15 nt, Human
ucugccuauccuggc

SEQ ID NO: 2803275 - RNA, 15 nt, Human
ucugccuccucuuca

SEQ ID NO: 2803276 - RNA, 15 nt, Human
ucugccucucuagga

SEQ ID NO: 2803277 - RNA, 16 nt, Human
ucugcaguaaaucuuu

SEQ ID NO: 2803278 - RNA, 18 nt, Human
ucugcaccguacugugga

SEQ ID NO: 2803279 - RNA, 21 nt, Human
ucugcaccuauguagcucugc

SEQ ID NO: 2803280 - RNA, 22 nt, Human
ucugcaccuauguagcucugca

SEQ ID NO: 2803281 - RNA, 23 nt, Human
ucugcacccuggggccuggaccu

SEQ ID NO: 2803282 - RNA, 20 nt, Human
ucugcaagcacaucugcauu

SEQ ID NO: 2803283 - RNA, 17 nt, Human
ucugcaaggucuuuggu

SEQ ID NO: 2803284 - RNA, 16 nt, Human
ucugcaaugggcacug

SEQ ID NO: 2803285 - RNA, 19 nt, Human
ucugcaaugggcacuggga

SEQ ID NO: 2803286 - RNA, 21 nt, Human
ucugcaaugggcacugggaug

SEQ ID NO: 2803287 - RNA, 24 nt, Human
ucugcacccuggggccuggaccug

SEQ ID NO: 2803288 - RNA, 13 nt, Human
ucugcacccuucu

SEQ ID NO: 2803289 - RNA, 15 nt, Human
ucugcacccuucuuu

SEQ ID NO: 2803290 - RNA, 16 nt, Human
ucugcacccuucuuuu

SEQ ID NO: 2803291 - RNA, 19 nt, Human
ucugcacccuucuuuucuc

SEQ ID NO: 2803292 - RNA, 20 nt, Human
ucugcacccuucuuuucuca

SEQ ID NO: 2803293 - RNA, 21 nt, Human
ucugcacccuucuuuucucau

SEQ ID NO: 2803294 - RNA, 14 nt, Human
ucugcaauucaaaa

SEQ ID NO: 2803295 - RNA, 16 nt, Human
ucugcaauucaaaagu

SEQ ID NO: 2803296 - RNA, 19 nt, Human
ucugcaauucaaaaguucc

SEQ ID NO: 2803297 - RNA, 21 nt, Human
ucugcaauucaaaaguuccaa

SEQ ID NO: 2803298 - RNA, 21 nt, Human
ucugaggaauccagacccggc

SEQ ID NO: 2803299 - RNA, 18 nt, Human
ucugaggaauccagaccc

SEQ ID NO: 2803300 - RNA, 22 nt, Human
ucugaggaauccagacccggcu

SEQ ID NO: 2803301 - RNA, 16 nt, Human
ucugcaaacaaacacc

SEQ ID NO: 2803302 - RNA, 22 nt, Human
ucugcaaacaaacaccuucuua

SEQ ID NO: 2803303 - RNA, 18 nt, Human
ucugcaaagaaugagaag

SEQ ID NO: 2803304 - RNA, 13 nt, Human
ucucaaugugaaa

SEQ ID NO: 2803305 - RNA, 17 nt, Human
ucugauuugcauauuca

SEQ ID NO: 2803306 - RNA, 15 nt, Human
ucugcaaaaggagag

SEQ ID NO: 2803307 - RNA, 16 nt, Human
ucugcaaaaggagaga

SEQ ID NO: 2803308 - RNA, 21 nt, Human
ucugauuuugugcaaaagcuu

SEQ ID NO: 2803309 - RNA, 14 nt, Human
ucugauuuuuauga

SEQ ID NO: 2803310 - RNA, 13 nt, Human
ucugauuuuagga

SEQ ID NO: 2803311 - RNA, 22 nt, Human
ucugauuuuaggagcuaaggcu

SEQ ID NO: 2803312 - RNA, 21 nt, Human
ucucauauauagacagcuuug

SEQ ID NO: 2803313 - RNA, 22 nt, Human
ucucauauauagacagcuuuga

SEQ ID NO: 2803314 - RNA, 12 nt, Human
ucucaucacaca

SEQ ID NO: 2803315 - RNA, 14 nt, Human
ucucaucacacaca

SEQ ID NO: 2803316 - RNA, 15 nt, Human
ucucaucacacacau

SEQ ID NO: 2803317 - RNA, 16 nt, Human
ucucaucacacacaug

SEQ ID NO: 2803318 - RNA, 18 nt, Human
ucucaucacacacaugga

SEQ ID NO: 2803319 - RNA, 22 nt, Human
ucucauccccaggggucccagc

SEQ ID NO: 2803320 - RNA, 16 nt, Human
ucucauccccaguccc

SEQ ID NO: 2803321 - RNA, 23 nt, Human
ucucauccccagucccaaugcac

SEQ ID NO: 2803322 - RNA, 14 nt, Human
ucucauccuccagu

SEQ ID NO: 2803323 - RNA, 21 nt, Human
ucucauccuccaguaccuugc

SEQ ID NO: 2803324 - RNA, 13 nt, Human
ucucauccuccug

SEQ ID NO: 2803325 - RNA, 14 nt, Human
ucucauccuccugg

SEQ ID NO: 2803326 - RNA, 15 nt, Human
ucucauccuccugga

SEQ ID NO: 2803327 - RNA, 16 nt, Human
ucucauccuccuggaa

SEQ ID NO: 2803328 - RNA, 17 nt, Human
ucucauccuccuggaac

SEQ ID NO: 2803329 - RNA, 18 nt, Human
ucucauccuccuggaacc

SEQ ID NO: 2803330 - RNA, 14 nt, Human
ucucauccccaggg

SEQ ID NO: 2803331 - RNA, 18 nt, Human
ucugagaggacuuuucuu

SEQ ID NO: 2803332 - RNA, 15 nt, Human
ucucauccccagggg

SEQ ID NO: 2803333 - RNA, 14 nt, Human
ucugagagucuaga

SEQ ID NO: 2803334 - RNA, 15 nt, Human
ucugagagucuagau

SEQ ID NO: 2803335 - RNA, 16 nt, Human
ucugagagucuagauu

SEQ ID NO: 2803336 - RNA, 17 nt, Human
ucugagagucuagauuc

SEQ ID NO: 2803337 - RNA, 18 nt, Human
ucugagagucuagauucu

SEQ ID NO: 2803338 - RNA, 19 nt, Human
ucugagagucuagauucuc

SEQ ID NO: 2803339 - RNA, 21 nt, Human
ucugagagucuagauucucug

SEQ ID NO: 2803340 - RNA, 16 nt, Human
ucugagcgggaggcag

SEQ ID NO: 2803341 - RNA, 17 nt, Human
ucugagcgggaggcaga

SEQ ID NO: 2803342 - RNA, 22 nt, Human
ucugagcgggaggcagaguuug

SEQ ID NO: 2803343 - RNA, 20 nt, Human
ucugagccagugcuuuaaug

SEQ ID NO: 2803344 - RNA, 22 nt, Human
ucugagagucuagauucucugg

SEQ ID NO: 2803345 - RNA, 12 nt, Human
ucugagcccaug

SEQ ID NO: 2803346 - RNA, 23 nt, Human
ucugagcccauguucugccccca

SEQ ID NO: 2803347 - RNA, 22 nt, Human
ucuuucccacccuguucccagu

SEQ ID NO: 2803348 - RNA, 14 nt, Human
ucuuugaaugcuuu

SEQ ID NO: 2803349 - RNA, 14 nt, Human
ucuugugcuagaau

SEQ ID NO: 2803350 - RNA, 17 nt, Human
ucuugugcuagaauacu

SEQ ID NO: 2803351 - RNA, 18 nt, Human
ucuugugcuagaauacuu

SEQ ID NO: 2803352 - RNA, 19 nt, Human
ucuugugcuagaauacuuu

SEQ ID NO: 2803353 - RNA, 21 nt, Human
ucuugugcuagaauacuuuuu

SEQ ID NO: 2803354 - RNA, 23 nt, Human
ucuugugcuagaauacuuuuuaa

SEQ ID NO: 2803355 - RNA, 18 nt, Human
ucuugugugauuaacuua

SEQ ID NO: 2803356 - RNA, 19 nt, Human
ucuugugugauuaacuuau

SEQ ID NO: 2803357 - RNA, 22 nt, Human
ucuugugcuggauggagcccag

SEQ ID NO: 2803358 - RNA, 23 nt, Human
ucuugugcuggauggagcccagg

SEQ ID NO: 2803359 - RNA, 21 nt, Human
ucuugugcuuuuccuauuugu

SEQ ID NO: 2803360 - RNA, 18 nt, Human
ucuugugcuuuuccugau

SEQ ID NO: 2803361 - RNA, 14 nt, Human
ucuuugcuguaaga

SEQ ID NO: 2803362 - RNA, 19 nt, Human
ucuuugcuguaagaugucu

SEQ ID NO: 2803363 - RNA, 21 nt, Human
ucuuugccuugggcugcuccu

SEQ ID NO: 2803364 - RNA, 20 nt, Human
ucuuugccuugggcugcucc

SEQ ID NO: 2803365 - RNA, 14 nt, Human
ucuuugccuugggc

SEQ ID NO: 2803366 - RNA, 12 nt, Human
ucuuugccuggu

SEQ ID NO: 2803367 - RNA, 12 nt, Human
ucuuugccucuc

SEQ ID NO: 2803368 - RNA, 17 nt, Human
ucuuugcagacaggcaa

SEQ ID NO: 2803369 - RNA, 14 nt, Human
ucuuugcagacagg

SEQ ID NO: 2803370 - RNA, 16 nt, Human
ucuuugacacucugca

SEQ ID NO: 2803371 - RNA, 17 nt, Human
ucuuugacacucugcag

SEQ ID NO: 2803372 - RNA, 13 nt, Human
ucuuugcagacag

SEQ ID NO: 2803373 - RNA, 19 nt, Human
ucuuugagggacugccucu

SEQ ID NO: 2803374 - RNA, 21 nt, Human
ucuuugagggacugccucugc

SEQ ID NO: 2803375 - RNA, 22 nt, Human
ucuuugagggacugccucugcc

SEQ ID NO: 2803376 - RNA, 23 nt, Human
ucuuugagggacugccucugcca

SEQ ID NO: 2803377 - RNA, 12 nt, Human
ucuuugcaaagu

SEQ ID NO: 2803378 - RNA, 15 nt, Human
ucuuugcaaaguauu

SEQ ID NO: 2803379 - RNA, 21 nt, Human
ucuuugcaaaguauuguaaau

SEQ ID NO: 2803380 - RNA, 22 nt, Human
ucuuugcaaaguauuguaaauu

SEQ ID NO: 2803381 - RNA, 23 nt, Human
ucuuugcaaaguauuguaaauua

SEQ ID NO: 2803382 - RNA, 15 nt, Human
ucuuuuuaaguaaug

SEQ ID NO: 2803383 - RNA, 16 nt, Human
ucuuuuuaaguaaugu

SEQ ID NO: 2803384 - RNA, 19 nt, Human
ucuuuuuaaguaaugugga

SEQ ID NO: 2803385 - RNA, 15 nt, Human
ucuuuuuaaguuaau

SEQ ID NO: 2803386 - RNA, 12 nt, Human
ucuuuuuacaua

SEQ ID NO: 2803387 - RNA, 20 nt, Human
ucuuuuuacauaacugccuu

SEQ ID NO: 2803388 - RNA, 12 nt, Human
ucuuuuuaguuu

SEQ ID NO: 2803389 - RNA, 15 nt, Human
ucuuuuuaaaauggu

SEQ ID NO: 2803390 - RNA, 23 nt, Human
ucuuuuuaaaguguuucuguuau

SEQ ID NO: 2803391 - RNA, 16 nt, Human
ucuuuucuaaaagacu

SEQ ID NO: 2803392 - RNA, 14 nt, Human
ucuuuuuaaagcuu

SEQ ID NO: 2803393 - RNA, 20 nt, Human
ucuuuuguucgcauggucac

SEQ ID NO: 2803394 - RNA, 13 nt, Human
ucuuuuguuacug

SEQ ID NO: 2803395 - RNA, 14 nt, Human
ucuuuuguuacugu

SEQ ID NO: 2803396 - RNA, 15 nt, Human
ucuuuuguuacuguu

SEQ ID NO: 2803397 - RNA, 16 nt, Human
ucuuuuguuacuguuc

SEQ ID NO: 2803398 - RNA, 17 nt, Human
ucuuuuguuacuguucu

SEQ ID NO: 2803399 - RNA, 18 nt, Human
ucuuuuguuacuguucuu

SEQ ID NO: 2803400 - RNA, 19 nt, Human
ucuuuuguuacuguucuug

SEQ ID NO: 2803401 - RNA, 21 nt, Human
ucuuuuguuacuguucuugcu

SEQ ID NO: 2803402 - RNA, 22 nt, Human
ucuuuuguuacuguucuugcug

SEQ ID NO: 2803403 - RNA, 23 nt, Human
ucuuuuguuacuguucuugcugc

SEQ ID NO: 2803404 - RNA, 16 nt, Human
ucuuuucauucucauu

SEQ ID NO: 2803405 - RNA, 22 nt, Human
ucuuuuccaaaauaaaacaaag

SEQ ID NO: 2803406 - RNA, 15 nt, Human
ucuuuuccuguugua

SEQ ID NO: 2803407 - RNA, 14 nt, Human
ucuuuucuaguuug

SEQ ID NO: 2803408 - RNA, 15 nt, Human
ucuuuuguuaaauaa

SEQ ID NO: 2803409 - RNA, 22 nt, Human
ucuuuuguuaaauaauauggcu

SEQ ID NO: 2803410 - RNA, 11 nt, Human
ucuuuuguuac

SEQ ID NO: 2803411 - RNA, 12 nt, Human
ucuuuuguuacu

SEQ ID NO: 2803412 - RNA, 15 nt, Human
ugaaaaccaaaauga

SEQ ID NO: 2803413 - RNA, 17 nt, Human
ugaaaaccaaaaugaca

SEQ ID NO: 2803414 - RNA, 21 nt, Human
ugaaaaccaaaaugacaucuu

SEQ ID NO: 2803415 - RNA, 23 nt, Human
ugaaaauucaaaaaguguuuauu

SEQ ID NO: 2803416 - RNA, 18 nt, Human
ugaaaauucaaaaagugu

SEQ ID NO: 2803417 - RNA, 19 nt, Human
ugaaaauucaaaaaguguu

SEQ ID NO: 2803418 - RNA, 18 nt, Human
ugaaaauuauuuuaaaca

SEQ ID NO: 2803419 - RNA, 19 nt, Human
ugaaaauuauuuuaaacaa

SEQ ID NO: 2803420 - RNA, 21 nt, Human
ugaaaauuauuuuaaacaaaa

SEQ ID NO: 2803421 - RNA, 17 nt, Human
ugaaaauucaaaaagug

SEQ ID NO: 2803422 - RNA, 20 nt, Human
ugaaaauucgcccgagcugu

SEQ ID NO: 2803423 - RNA, 21 nt, Human
ugaaaauucgcccgagcuguu

SEQ ID NO: 2803424 - RNA, 22 nt, Human
ugaaaauucgcccgagcuguuu

SEQ ID NO: 2803425 - RNA, 23 nt, Human
ugaaacacucaguuguucaauaa

SEQ ID NO: 2803426 - RNA, 15 nt, Human
ugaaacacgaaacuu

SEQ ID NO: 2803427 - RNA, 17 nt, Human
ugaaacacgaaacuugu

SEQ ID NO: 2803428 - RNA, 19 nt, Human
ugaaacacgaaacuuguua

SEQ ID NO: 2803429 - RNA, 20 nt, Human
ugaaacacgaaacuuguuau

SEQ ID NO: 2803430 - RNA, 21 nt, Human
ugaaacacgaaacuuguuauu

SEQ ID NO: 2803431 - RNA, 13 nt, Human
ugaaaauuugaga

SEQ ID NO: 2803432 - RNA, 22 nt, Human
ugaaaauuugagacuauuuaaa

SEQ ID NO: 2803433 - RNA, 19 nt, Human
ugaaaauuuuaaaaauaca

SEQ ID NO: 2803434 - RNA, 20 nt, Human
ugaaaauuuuaaaaauacau

SEQ ID NO: 2803435 - RNA, 21 nt, Human
ugaaaauuuuaaaaauacaua

SEQ ID NO: 2803436 - RNA, 22 nt, Human
ugaaaauuuuaaaaauacauau

SEQ ID NO: 2803437 - RNA, 14 nt, Human
ugaaaauuuuacca

SEQ ID NO: 2803438 - RNA, 15 nt, Human
ugaaaauuauuuuaa

SEQ ID NO: 2803439 - RNA, 16 nt, Human
ugaaaauuauuuuaaa

SEQ ID NO: 2803440 - RNA, 20 nt, Human
ugaaaauuaggauuucauga

SEQ ID NO: 2803441 - RNA, 20 nt, Human
ugaaaacggagcugaacaau

SEQ ID NO: 2803442 - RNA, 18 nt, Human
ugaaaaccuaaaagacag

SEQ ID NO: 2803443 - RNA, 15 nt, Human
ugaaaaccuacauau

SEQ ID NO: 2803444 - RNA, 16 nt, Human
ugaaaaccuacauauu

SEQ ID NO: 2803445 - RNA, 18 nt, Human
ugaaaaccaucuggccug

SEQ ID NO: 2803446 - RNA, 20 nt, Human
ugaaaaccaucuggccuggc

SEQ ID NO: 2803447 - RNA, 21 nt, Human
ugaaaaccaucuggccuggcc

SEQ ID NO: 2803448 - RNA, 22 nt, Human
ugaaaaccaucuggccuggccu

SEQ ID NO: 2803449 - RNA, 20 nt, Human
ucuuagcuaucauugcuucc

SEQ ID NO: 2803450 - RNA, 21 nt, Human
ucuuagcuaucauugcuuccu

SEQ ID NO: 2803451 - RNA, 20 nt, Human
ucugugucagguggggcagc

SEQ ID NO: 2803452 - RNA, 17 nt, Human
ucugugucagguggggc

SEQ ID NO: 2803453 - RNA, 20 nt, Human
ucugugugaugaacuuucuc

SEQ ID NO: 2803454 - RNA, 18 nt, Human
ucugugugaugaacuuuc

SEQ ID NO: 2803455 - RNA, 21 nt, Human
ucugugugcacaaauauuuau

SEQ ID NO: 2803456 - RNA, 14 nt, Human
ucugugugcacaaa

SEQ ID NO: 2803457 - RNA, 13 nt, Human
ucugugugaaaau

SEQ ID NO: 2803458 - RNA, 13 nt, Human
ucugugugaaugu

SEQ ID NO: 2803459 - RNA, 14 nt, Human
ucugugugaaugug

SEQ ID NO: 2803460 - RNA, 15 nt, Human
ucugugugaaugugg

SEQ ID NO: 2803461 - RNA, 22 nt, Human
ucugugugaaugugggcacugg

SEQ ID NO: 2803462 - RNA, 21 nt, Human
ucugugucuuucacagcuccu

SEQ ID NO: 2803463 - RNA, 18 nt, Human
ucugugugcaccuuacca

SEQ ID NO: 2803464 - RNA, 19 nt, Human
ucugugugcaccuuaccaa

SEQ ID NO: 2803465 - RNA, 18 nt, Human
ucugugugugaccccucc

SEQ ID NO: 2803466 - RNA, 19 nt, Human
ucugugugugaccccuccu

SEQ ID NO: 2803467 - RNA, 20 nt, Human
ucugugugugaccccuccug

SEQ ID NO: 2803468 - RNA, 21 nt, Human
ucugugugugaccccuccugg

SEQ ID NO: 2803469 - RNA, 22 nt, Human
ucugugugugaccccuccuggg

SEQ ID NO: 2803470 - RNA, 23 nt, Human
ucugugugugaccccuccugggg

SEQ ID NO: 2803471 - RNA, 21 nt, Human
ucuuagauucucugugucuaa

SEQ ID NO: 2803472 - RNA, 22 nt, Human
ucugugugcaccuuaccaacuu

SEQ ID NO: 2803473 - RNA, 12 nt, Human
ucuuagauucuc

SEQ ID NO: 2803474 - RNA, 22 nt, Human
ucuuagcauagcuuauuauuga

SEQ ID NO: 2803475 - RNA, 13 nt, Human
ucuuaucaagcag

SEQ ID NO: 2803476 - RNA, 16 nt, Human
ucuuaucaagcagcca

SEQ ID NO: 2803477 - RNA, 23 nt, Human
ucuuaucaaggacucugguuucu

SEQ ID NO: 2803478 - RNA, 20 nt, Human
ucuuauauauauuucuuugu

SEQ ID NO: 2803479 - RNA, 14 nt, Human
ucuuauacacauug

SEQ ID NO: 2803480 - RNA, 12 nt, Human
ucuuaucucagu

SEQ ID NO: 2803481 - RNA, 14 nt, Human
ucuuaucucaguca

SEQ ID NO: 2803482 - RNA, 20 nt, Human
ucuuaucucagucaugcaua

SEQ ID NO: 2803483 - RNA, 22 nt, Human
ucuuaucucagucaugcauaaa

SEQ ID NO: 2803484 - RNA, 18 nt, Human
ucuuaucugagcugagcc

SEQ ID NO: 2803485 - RNA, 15 nt, Human
ucuuaugcaaaaugg

SEQ ID NO: 2803486 - RNA, 16 nt, Human
ucuuaugcaaaaugga

SEQ ID NO: 2803487 - RNA, 17 nt, Human
ucuuaugcaaaauggaa

SEQ ID NO: 2803488 - RNA, 13 nt, Human
ucuucagagauca

SEQ ID NO: 2803489 - RNA, 18 nt, Human
ucuucagagaucauggaa

SEQ ID NO: 2803490 - RNA, 12 nt, Human
ucuucagagcug

SEQ ID NO: 2803491 - RNA, 13 nt, Human
ucuucagagcuga

SEQ ID NO: 2803492 - RNA, 20 nt, Human
ucuucauucuaucaagccca

SEQ ID NO: 2803493 - RNA, 14 nt, Human
ucuucauuucauug

SEQ ID NO: 2803494 - RNA, 15 nt, Human
ucuucauuucauugu

SEQ ID NO: 2803495 - RNA, 24 nt, Human
ucuucauuucauuguaugaugugu

SEQ ID NO: 2803496 - RNA, 16 nt, Human
ucuucauuucauugua

SEQ ID NO: 2803497 - RNA, 17 nt, Human
ucuucauuucauuguau

SEQ ID NO: 2803498 - RNA, 21 nt, Human
ucuucauuucauuguaugaug

SEQ ID NO: 2803499 - RNA, 22 nt, Human
ucuucauuucauuguaugaugu

SEQ ID NO: 2803500 - RNA, 20 nt, Human
ucuucauaaaguacuugagu

SEQ ID NO: 2803501 - RNA, 21 nt, Human
ucuucauguacauuuggaacu

SEQ ID NO: 2803502 - RNA, 19 nt, Human
ucuucagauacaaacugca

SEQ ID NO: 2803503 - RNA, 21 nt, Human
ucuucaguugguugugucuuu

SEQ ID NO: 2803504 - RNA, 22 nt, Human
ucuucaguugguugugucuuuu

SEQ ID NO: 2803505 - RNA, 22 nt, Human
ucuucaguuaagccuuuggaaa

SEQ ID NO: 2803506 - RNA, 20 nt, Human
ucuucaguuaagccuuugga

SEQ ID NO: 2803507 - RNA, 19 nt, Human
ucuucaguuaagccuuugg

SEQ ID NO: 2803508 - RNA, 23 nt, Human
ucuugcauggcaaggacugcagg

SEQ ID NO: 2803509 - RNA, 17 nt, Human
ucuugcauugacauuau

SEQ ID NO: 2803510 - RNA, 14 nt, Human
ucuugcucugcuga

SEQ ID NO: 2803511 - RNA, 14 nt, Human
ucuugcccugggga

SEQ ID NO: 2803512 - RNA, 16 nt, Human
ucuugccacugccucu

SEQ ID NO: 2803513 - RNA, 17 nt, Human
ucuugccacugccucuu

SEQ ID NO: 2803514 - RNA, 23 nt, Human
ucuugcucugcugacagacacag

SEQ ID NO: 2803515 - RNA, 15 nt, Human
ucuugcucugcugac

SEQ ID NO: 2803516 - RNA, 14 nt, Human
ucuuguacaugugu

SEQ ID NO: 2803517 - RNA, 17 nt, Human
ucuuguacauguguagc

SEQ ID NO: 2803518 - RNA, 14 nt, Human
ucuuguaauuucca

SEQ ID NO: 2803519 - RNA, 21 nt, Human
ucuuguaauuuccagcuuucu

SEQ ID NO: 2803520 - RNA, 17 nt, Human
ucuugccgaggagccag

SEQ ID NO: 2803521 - RNA, 19 nt, Human
ucuugccgaggagccaggc

SEQ ID NO: 2803522 - RNA, 19 nt, Human
ucuuguacauguguagccu

SEQ ID NO: 2803523 - RNA, 24 nt, Human
ucuuguacauguguagccugugca

SEQ ID NO: 2803524 - RNA, 17 nt, Human
ucuuguagcccaggcug

SEQ ID NO: 2803525 - RNA, 23 nt, Human
ucuuguagcggaugauucuucaa

SEQ ID NO: 2803526 - RNA, 20 nt, Human
ucuuguauaagauccuagau

SEQ ID NO: 2803527 - RNA, 21 nt, Human
ucuuguauaagauccuagauc

SEQ ID NO: 2803528 - RNA, 20 nt, Human
ucuuguccucauucuugccu

SEQ ID NO: 2803529 - RNA, 13 nt, Human
ucuuguccuagcu

SEQ ID NO: 2803530 - RNA, 17 nt, Human
ucuuguccucaguccau

SEQ ID NO: 2803531 - RNA, 19 nt, Human
ucuuguccucaguccauuu

SEQ ID NO: 2803532 - RNA, 14 nt, Human
ucuucuuguuucuc

SEQ ID NO: 2803533 - RNA, 15 nt, Human
ucuucuuguuucucc

SEQ ID NO: 2803534 - RNA, 17 nt, Human
ucuucuuucagacuugc

SEQ ID NO: 2803535 - RNA, 19 nt, Human
ucuucuuucagacuugcca

SEQ ID NO: 2803536 - RNA, 18 nt, Human
ucuucuuuuggcuuccau

SEQ ID NO: 2803537 - RNA, 16 nt, Human
ucuucuuuuggcuucc

SEQ ID NO: 2803538 - RNA, 17 nt, Human
ucuucgaagccuugccu

SEQ ID NO: 2803539 - RNA, 18 nt, Human
ucuucgaagccuugccua

SEQ ID NO: 2803540 - RNA, 20 nt, Human
ucuuccaaaguaaaauugcu

SEQ ID NO: 2803541 - RNA, 13 nt, Human
ucuuccuuuacuu

SEQ ID NO: 2803542 - RNA, 16 nt, Human
ucuuccuuuacuuucc

SEQ ID NO: 2803543 - RNA, 17 nt, Human
ucuuccuuuacuuuccc

SEQ ID NO: 2803544 - RNA, 18 nt, Human
ucuuccuuuacuuucccu

SEQ ID NO: 2803545 - RNA, 19 nt, Human
ucuuccuuuacuuucccuu

SEQ ID NO: 2803546 - RNA, 20 nt, Human
ucuuccuuuacuuucccuug

SEQ ID NO: 2803547 - RNA, 22 nt, Human
ucuuccuuuacuuucccuugcu

SEQ ID NO: 2803548 - RNA, 16 nt, Human
ucuuccuuucucuuuc

SEQ ID NO: 2803549 - RNA, 17 nt, Human
ucuuccuuucucuuucu

SEQ ID NO: 2803550 - RNA, 18 nt, Human
ucuuccuuucucuuucuc

SEQ ID NO: 2803551 - RNA, 15 nt, Human
ucuucgcgcccgccc

SEQ ID NO: 2803552 - RNA, 20 nt, Human
ucuucgcgcccgccccugca

SEQ ID NO: 2803553 - RNA, 23 nt, Human
ucuucgcgcccgccccugcagca

SEQ ID NO: 2803554 - RNA, 17 nt, Human
ucuucgggaccaggauu

SEQ ID NO: 2803555 - RNA, 14 nt, Human
ucuucgggaccagg

SEQ ID NO: 2803556 - RNA, 22 nt, Human
ucuucggcccucagaugucccu

SEQ ID NO: 2803557 - RNA, 23 nt, Human
ucuucggcccucagaugucccuu

SEQ ID NO: 2803558 - RNA, 21 nt, Human
ucuugaaauuaagaaggcaaa

SEQ ID NO: 2803559 - RNA, 20 nt, Human
ucuugaaauuaagaaggcaa

SEQ ID NO: 2803560 - RNA, 14 nt, Human
ucuugaaauuaaga

SEQ ID NO: 2803561 - RNA, 24 nt, Human
ucagcugccucacuuccuacaaga

SEQ ID NO: 2803562 - RNA, 22 nt, Human
ucagcugcucagcaaccuuuca

SEQ ID NO: 2803563 - RNA, 15 nt, Human
ucagcugccucacuu

SEQ ID NO: 2803564 - RNA, 14 nt, Human
ucagcugccucacu

SEQ ID NO: 2803565 - RNA, 12 nt, Human
ucagcugccuca

SEQ ID NO: 2803566 - RNA, 15 nt, Human
ucagcucucaucuga

SEQ ID NO: 2803567 - RNA, 13 nt, Human
ucaggaccaggca

SEQ ID NO: 2803568 - RNA, 14 nt, Human
ucaggaccaggcaa

SEQ ID NO: 2803569 - RNA, 14 nt, Human
ucaggaccuuuuga

SEQ ID NO: 2803570 - RNA, 21 nt, Human
ucaggacucagaagccucugg

SEQ ID NO: 2803571 - RNA, 14 nt, Human
ucaggacucagaag

SEQ ID NO: 2803572 - RNA, 22 nt, Human
ucaggagaguagaacagauaau

SEQ ID NO: 2803573 - RNA, 12 nt, Human
ucaggagaaaaa

SEQ ID NO: 2803574 - RNA, 14 nt, Human
ucaggaggcgcccu

SEQ ID NO: 2803575 - RNA, 12 nt, Human
ucaggaggcgcc

SEQ ID NO: 2803576 - RNA, 12 nt, Human
ucaggaggcuga

SEQ ID NO: 2803577 - RNA, 18 nt, Human
ucaggaguccaagaccag

SEQ ID NO: 2803578 - RNA, 18 nt, Human
ucaggaggcugaggggag

SEQ ID NO: 2803579 - RNA, 15 nt, Human
ucaggaggcugaggg

SEQ ID NO: 2803580 - RNA, 16 nt, Human
ucaggaggaaggcuua

SEQ ID NO: 2803581 - RNA, 23 nt, Human
ucaggaggaaggcuuacacccac

SEQ ID NO: 2803582 - RNA, 17 nt, Human
ucagcucggggagccuu

SEQ ID NO: 2803583 - RNA, 18 nt, Human
ucagcucggggagccuua

SEQ ID NO: 2803584 - RNA, 22 nt, Human
ucagcuccagcucaccagcccc

SEQ ID NO: 2803585 - RNA, 21 nt, Human
ucagcuccagcucaccagccc

SEQ ID NO: 2803586 - RNA, 18 nt, Human
ucagcuccagcucaccag

SEQ ID NO: 2803587 - RNA, 15 nt, Human
ucagcuccagcucac

SEQ ID NO: 2803588 - RNA, 12 nt, Human
ucagccugcaca

SEQ ID NO: 2803589 - RNA, 20 nt, Human
ucagccugcaguuaauuagc

SEQ ID NO: 2803590 - RNA, 20 nt, Human
ucagccucccgaauagcugg

SEQ ID NO: 2803591 - RNA, 12 nt, Human
ucagccucccga

SEQ ID NO: 2803592 - RNA, 22 nt, Human
ucagccucccaaagugcuggga

SEQ ID NO: 2803593 - RNA, 20 nt, Human
ucagccucccaaguagcugg

SEQ ID NO: 2803594 - RNA, 18 nt, Human
ucagccugaggcugagac

SEQ ID NO: 2803595 - RNA, 13 nt, Human
ucagccugaggcu

SEQ ID NO: 2803596 - RNA, 20 nt, Human
ucagccugaggcugagacug

SEQ ID NO: 2803597 - RNA, 21 nt, Human
ucagccucuuaaagcugccug

SEQ ID NO: 2803598 - RNA, 12 nt, Human
ucagccucuuaa

SEQ ID NO: 2803599 - RNA, 22 nt, Human
ucagccucuuaaagcugccugu

SEQ ID NO: 2803600 - RNA, 14 nt, Human
ucagauacaaugua

SEQ ID NO: 2803601 - RNA, 12 nt, Human
ucagauacauca

SEQ ID NO: 2803602 - RNA, 14 nt, Human
ucagauacaucacu

SEQ ID NO: 2803603 - RNA, 15 nt, Human
ucagauacaucacug

SEQ ID NO: 2803604 - RNA, 16 nt, Human
ucagauacaucacugc

SEQ ID NO: 2803605 - RNA, 17 nt, Human
ucagauacaucacugcu

SEQ ID NO: 2803606 - RNA, 19 nt, Human
ucagauacaucacugcuug

SEQ ID NO: 2803607 - RNA, 21 nt, Human
ucagauacaucacugcuugau

SEQ ID NO: 2803608 - RNA, 13 nt, Human
uaucauucaucuu

SEQ ID NO: 2803609 - RNA, 19 nt, Human
uaucauucaucuucuucuu

SEQ ID NO: 2803610 - RNA, 19 nt, Human
uaucauugcuuccuccucc

SEQ ID NO: 2803611 - RNA, 19 nt, Human
ucagaucacugaauuuaua

SEQ ID NO: 2803612 - RNA, 21 nt, Human
ucagaucacugaauuuauaaa

SEQ ID NO: 2803613 - RNA, 23 nt, Human
ucagaucaguguaccauuugccu

SEQ ID NO: 2803614 - RNA, 16 nt, Human
ucagauccuuguuuca

SEQ ID NO: 2803615 - RNA, 17 nt, Human
ucagauccuuguuucaa

SEQ ID NO: 2803616 - RNA, 18 nt, Human
ucagauccuuguuucaaa

SEQ ID NO: 2803617 - RNA, 20 nt, Human
ucagauccugaucuuaagag

SEQ ID NO: 2803618 - RNA, 19 nt, Human
ucagauccuuguuucaaac

SEQ ID NO: 2803619 - RNA, 16 nt, Human
uaucauaaaaucaaaa

SEQ ID NO: 2803620 - RNA, 18 nt, Human
ucagcacauauuuucugu

SEQ ID NO: 2803621 - RNA, 18 nt, Human
ucagcacagauaaaaagu

SEQ ID NO: 2803622 - RNA, 20 nt, Human
ucagcacagauaaaaagugg

SEQ ID NO: 2803623 - RNA, 22 nt, Human
ucagcacagauaaaaaguggaa

SEQ ID NO: 2803624 - RNA, 14 nt, Human
ucagcaccacccua

SEQ ID NO: 2803625 - RNA, 13 nt, Human
ucagcaccacccu

SEQ ID NO: 2803626 - RNA, 12 nt, Human
ucagcaccaccc

SEQ ID NO: 2803627 - RNA, 23 nt, Human
ucagcaccacccuagucccuucc

SEQ ID NO: 2803628 - RNA, 15 nt, Human
ucagcaccacccuag

SEQ ID NO: 2803629 - RNA, 19 nt, Human
ucagccuaguggcuugucc

SEQ ID NO: 2803630 - RNA, 20 nt, Human
ucagccuaguggcuuguccu

SEQ ID NO: 2803631 - RNA, 14 nt, Human
ucagcaucugugau

SEQ ID NO: 2803632 - RNA, 15 nt, Human
ucagcaucugugaug

SEQ ID NO: 2803633 - RNA, 17 nt, Human
ucagcaucugugauggg

SEQ ID NO: 2803634 - RNA, 13 nt, Human
ucagccucccaaa

SEQ ID NO: 2803635 - RNA, 12 nt, Human
ucagccucccaa

SEQ ID NO: 2803636 - RNA, 18 nt, Human
ucagcauccuggcacccg

SEQ ID NO: 2803637 - RNA, 17 nt, Human
ucagcauccuggcaccc

SEQ ID NO: 2803638 - RNA, 16 nt, Human
ucagcauccuggcacc

SEQ ID NO: 2803639 - RNA, 15 nt, Human
ucagcauccuggcac

SEQ ID NO: 2803640 - RNA, 15 nt, Human
ucaguccauagcaga

SEQ ID NO: 2803641 - RNA, 21 nt, Human
ucagucauuagacuccuccuc

SEQ ID NO: 2803642 - RNA, 17 nt, Human
ucagucaugcauaaaua

SEQ ID NO: 2803643 - RNA, 20 nt, Human
ucagucaugcauaaauaugc

SEQ ID NO: 2803644 - RNA, 14 nt, Human
ucaguccauuuaua

SEQ ID NO: 2803645 - RNA, 15 nt, Human
ucaguccauuuauau

SEQ ID NO: 2803646 - RNA, 16 nt, Human
ucaguccauuuauaua

SEQ ID NO: 2803647 - RNA, 23 nt, Human
ucaguccauuuauauaugaaaac

SEQ ID NO: 2803648 - RNA, 18 nt, Human
ucaguccccgugaaggag

SEQ ID NO: 2803649 - RNA, 17 nt, Human
ucagucccaucagagag

SEQ ID NO: 2803650 - RNA, 15 nt, Human
ucagucagaaaacuu

SEQ ID NO: 2803651 - RNA, 17 nt, Human
ucagucagaaaacuuua

SEQ ID NO: 2803652 - RNA, 20 nt, Human
ucagucagaaaacuuuaaaa

SEQ ID NO: 2803653 - RNA, 23 nt, Human
ucagucagaaaacuuuaaaaaau

SEQ ID NO: 2803654 - RNA, 19 nt, Human
ucagucagugcaaauguca

SEQ ID NO: 2803655 - RNA, 14 nt, Human
ucagucaugcauaa

SEQ ID NO: 2803656 - RNA, 15 nt, Human
ucagucaugcauaaa

SEQ ID NO: 2803657 - RNA, 16 nt, Human
ucagucaugcauaaau

SEQ ID NO: 2803658 - RNA, 17 nt, Human
ucagguggggcagcuug

SEQ ID NO: 2803659 - RNA, 21 nt, Human
ucagguggggcagcuugaggg

SEQ ID NO: 2803660 - RNA, 16 nt, Human
ucagguggggcagcuu

SEQ ID NO: 2803661 - RNA, 15 nt, Human
ucagguggggcagcu

SEQ ID NO: 2803662 - RNA, 20 nt, Human
ucaggugcugccauccaggu

SEQ ID NO: 2803663 - RNA, 18 nt, Human
ucaggugcugccauccag

SEQ ID NO: 2803664 - RNA, 14 nt, Human
ucagguggggcagc

SEQ ID NO: 2803665 - RNA, 20 nt, Human
ucaggagucccaaggaaagc

SEQ ID NO: 2803666 - RNA, 19 nt, Human
ucaggagucccaaggaaag

SEQ ID NO: 2803667 - RNA, 19 nt, Human
ucaguccuccccucacagc

SEQ ID NO: 2803668 - RNA, 13 nt, Human
ucaguccuccccu

SEQ ID NO: 2803669 - RNA, 17 nt, Human
ucaguccuccccucaca

SEQ ID NO: 2803670 - RNA, 18 nt, Human
ucaguccuccccucacag

SEQ ID NO: 2803671 - RNA, 16 nt, Human
ucagucccuauguauu

SEQ ID NO: 2803672 - RNA, 17 nt, Human
ucagucccuauguauuu

SEQ ID NO: 2803673 - RNA, 18 nt, Human
ucagucccuauguauuug

SEQ ID NO: 2803674 - RNA, 23 nt, Human
ucagucccuauguauuugcaguu

SEQ ID NO: 2803675 - RNA, 13 nt, Human
ucagucccuaugu

SEQ ID NO: 2803676 - RNA, 19 nt, Human
ucagucugauucccaagcu

SEQ ID NO: 2803677 - RNA, 17 nt, Human
ucagucugauucccaag

SEQ ID NO: 2803678 - RNA, 19 nt, Human
ucagugugucuaaauuuga

SEQ ID NO: 2803679 - RNA, 18 nt, Human
ucaguguuguugcucuag

SEQ ID NO: 2803680 - RNA, 15 nt, Human
ucaguguugagaugg

SEQ ID NO: 2803681 - RNA, 22 nt, Human
ucaguguuugggucaccccucc

SEQ ID NO: 2803682 - RNA, 15 nt, Human
ucaguguuuuaaauu

SEQ ID NO: 2803683 - RNA, 17 nt, Human
ucaguguuuuaaauucu

SEQ ID NO: 2803684 - RNA, 18 nt, Human
ucaguguuuuaaauucug

SEQ ID NO: 2803685 - RNA, 15 nt, Human
ucaguguuuuggacu

SEQ ID NO: 2803686 - RNA, 16 nt, Human
ucaguguuuuggacuc

SEQ ID NO: 2803687 - RNA, 20 nt, Human
ucaguguuuuggacuccauc

SEQ ID NO: 2803688 - RNA, 23 nt, Human
ucaguguuuuggacuccaucucu

SEQ ID NO: 2803689 - RNA, 14 nt, Human
ucaguguuuuuccu

SEQ ID NO: 2803690 - RNA, 20 nt, Human
ucaguuaacuauugcauuua

SEQ ID NO: 2803691 - RNA, 16 nt, Human
ucaguuaacuauugca

SEQ ID NO: 2803692 - RNA, 17 nt, Human
ucaguuaagccuuugga

SEQ ID NO: 2803693 - RNA, 16 nt, Human
ucaguuaagccuuugg

SEQ ID NO: 2803694 - RNA, 22 nt, Human
ucaguucccuuggccucagaau

SEQ ID NO: 2803695 - RNA, 19 nt, Human
ucaguuccgucagaaagug

SEQ ID NO: 2803696 - RNA, 20 nt, Human
ucaguucccuuggccucaga

SEQ ID NO: 2803697 - RNA, 19 nt, Human
ucaguucccuuggccucag

SEQ ID NO: 2803698 - RNA, 18 nt, Human
ucaguucccuuggccuca

SEQ ID NO: 2803699 - RNA, 17 nt, Human
ucaguucccuuggccuc

SEQ ID NO: 2803700 - RNA, 16 nt, Human
ucaguucccuuggccu

SEQ ID NO: 2803701 - RNA, 15 nt, Human
ucaguucccuuggcc

SEQ ID NO: 2803702 - RNA, 16 nt, Human
ucauggaccacuguuu

SEQ ID NO: 2803703 - RNA, 18 nt, Human
ucauggaccacuguuucu

SEQ ID NO: 2803704 - RNA, 19 nt, Human
ucauggaccacuguuucuu

SEQ ID NO: 2803705 - RNA, 21 nt, Human
ucauggaccacuguuucuugc

SEQ ID NO: 2803706 - RNA, 22 nt, Human
ucauggaccacuguuucuugcu

SEQ ID NO: 2803707 - RNA, 23 nt, Human
ucauggaccacuguuucuugcuu

SEQ ID NO: 2803708 - RNA, 12 nt, Human
ucauggccacac

SEQ ID NO: 2803709 - RNA, 14 nt, Human
ucauggccacacug

SEQ ID NO: 2803710 - RNA, 15 nt, Human
ucauggccacacugu

SEQ ID NO: 2803711 - RNA, 17 nt, Human
ucauggccacacuguga

SEQ ID NO: 2803712 - RNA, 18 nt, Human
ucauggccacacugugac

SEQ ID NO: 2803713 - RNA, 19 nt, Human
ucauggccacacugugaca

SEQ ID NO: 2803714 - RNA, 21 nt, Human
ucauggccacacugugacaca

SEQ ID NO: 2803715 - RNA, 13 nt, Human
ucauggccccucu

SEQ ID NO: 2803716 - RNA, 14 nt, Human
ucauggccccucug

SEQ ID NO: 2803717 - RNA, 18 nt, Human
ucauggccccucugaccu

SEQ ID NO: 2803718 - RNA, 15 nt, Human
ucauggccuugucua

SEQ ID NO: 2803719 - RNA, 14 nt, Human
ucauccaccccauc

SEQ ID NO: 2803720 - RNA, 14 nt, Human
ucauccacauuguu

SEQ ID NO: 2803721 - RNA, 12 nt, Human
ucauccacccca

SEQ ID NO: 2803722 - RNA, 19 nt, Human
ucauccacauuguuuuaaa

SEQ ID NO: 2803723 - RNA, 22 nt, Human
ucauccacauuguuuuaaaaag

SEQ ID NO: 2803724 - RNA, 15 nt, Human
ucauccacauuguuu

SEQ ID NO: 2803725 - RNA, 16 nt, Human
ucauccacauuguuuu

SEQ ID NO: 2803726 - RNA, 17 nt, Human
ucauccacauuguuuua

SEQ ID NO: 2803727 - RNA, 21 nt, Human
ucaucuggauaggagccugcu

SEQ ID NO: 2803728 - RNA, 22 nt, Human
ucaucuggauaggagccugcug

SEQ ID NO: 2803729 - RNA, 12 nt, Human
ucaucuggcugc

SEQ ID NO: 2803730 - RNA, 23 nt, Human
ucaucuggauaggagccugcugg

SEQ ID NO: 2803731 - RNA, 16 nt, Human
ucaucuuuuaaagaaa

SEQ ID NO: 2803732 - RNA, 16 nt, Human
ucaguuccuuugugug

SEQ ID NO: 2803733 - RNA, 20 nt, Human
ucaguuccuuuguguguacu

SEQ ID NO: 2803734 - RNA, 22 nt, Human
ucaguuccuuuguguguacuca

SEQ ID NO: 2803735 - RNA, 19 nt, Human
ucaguucuacggaucauca

SEQ ID NO: 2803736 - RNA, 15 nt, Human
ucauauuuuguauau

SEQ ID NO: 2803737 - RNA, 13 nt, Human
ucauagaaaugua

SEQ ID NO: 2803738 - RNA, 22 nt, Human
ucauagaaauaguuugagaaau

SEQ ID NO: 2803739 - RNA, 22 nt, Human
ucauagaaauguaacuuuugua

SEQ ID NO: 2803740 - RNA, 15 nt, Human
ucaucaguggagcca

SEQ ID NO: 2803741 - RNA, 16 nt, Human
ucaucaaggcacugcc

SEQ ID NO: 2803742 - RNA, 19 nt, Human
ucaucaagacuggaaggug

SEQ ID NO: 2803743 - RNA, 15 nt, Human
ucaucaaggcacugc

SEQ ID NO: 2803744 - RNA, 23 nt, Human
ucauauuuuguauauaucugcuu

SEQ ID NO: 2803745 - RNA, 19 nt, Human
ucaucaaauggaagacaca

SEQ ID NO: 2803746 - RNA, 23 nt, Human
ucaucaaauggaagacacauuga

SEQ ID NO: 2803747 - RNA, 16 nt, Human
ucaucaacaaagaaau

SEQ ID NO: 2803748 - RNA, 18 nt, Human
ucaucaacaaagaaauau

SEQ ID NO: 2803749 - RNA, 13 nt, Human
ucaucaacaagau

SEQ ID NO: 2803750 - RNA, 19 nt, Human
ucaucaacaagauuuccuu

SEQ ID NO: 2803751 - RNA, 11 nt, Human
ucaucaagacu

SEQ ID NO: 2803752 - RNA, 19 nt, Human
ucauccaaacaauuuaaaa

SEQ ID NO: 2803753 - RNA, 17 nt, Human
ucauccaacuuauguuu

SEQ ID NO: 2803754 - RNA, 12 nt, Human
ucaucauuguuu

SEQ ID NO: 2803755 - RNA, 22 nt, Human
ucaucauuguuucugcaugaau

SEQ ID NO: 2803756 - RNA, 19 nt, Human
ucaucauaaaauaaaguau

SEQ ID NO: 2803757 - RNA, 15 nt, Human
ucaucauaaaauaaa

SEQ ID NO: 2803758 - RNA, 14 nt, Human
ucaucauaaaauaa

SEQ ID NO: 2803759 - RNA, 13 nt, Human
ucaucauaaaaua

SEQ ID NO: 2803760 - RNA, 19 nt, Human
ucaucauaguaaaagaaau

SEQ ID NO: 2803761 - RNA, 11 nt, Human
ucaucaucagg

SEQ ID NO: 2803762 - RNA, 13 nt, Human
ucaucaucagggc

SEQ ID NO: 2803763 - RNA, 14 nt, Human
ucaucaucagggcc

SEQ ID NO: 2803764 - RNA, 15 nt, Human
ucaucaucagggccu

SEQ ID NO: 2803765 - RNA, 16 nt, Human
ucaucaucagggccug

SEQ ID NO: 2803766 - RNA, 22 nt, Human
uccauaaucuggacuccucugu

SEQ ID NO: 2803767 - RNA, 23 nt, Human
uccauaaucuggacuccucuguc

SEQ ID NO: 2803768 - RNA, 13 nt, Human
uccagggcucuga

SEQ ID NO: 2803769 - RNA, 14 nt, Human
uccaggggaaccug

SEQ ID NO: 2803770 - RNA, 18 nt, Human
uccauaaugcuacugucu

SEQ ID NO: 2803771 - RNA, 16 nt, Human
uccauaaugcuacugu

SEQ ID NO: 2803772 - RNA, 15 nt, Human
uccauagcaacagga

SEQ ID NO: 2803773 - RNA, 16 nt, Human
uccauagcaacaggaa

SEQ ID NO: 2803774 - RNA, 15 nt, Human
uccauaguaacugac

SEQ ID NO: 2803775 - RNA, 16 nt, Human
uccauaguaacugaca

SEQ ID NO: 2803776 - RNA, 13 nt, Human
uccauaguuuuga

SEQ ID NO: 2803777 - RNA, 15 nt, Human
uccauaguuuugaug

SEQ ID NO: 2803778 - RNA, 19 nt, Human
uccauaguuuugaugacug

SEQ ID NO: 2803779 - RNA, 22 nt, Human
uccauaguuuugaugacuggca

SEQ ID NO: 2803780 - RNA, 23 nt, Human
uccauaguuuugaugacuggcau

SEQ ID NO: 2803781 - RNA, 18 nt, Human
uccauaguaguaugauga

SEQ ID NO: 2803782 - RNA, 23 nt, Human
uccauaucuuaaagaaacagcuu

SEQ ID NO: 2803783 - RNA, 14 nt, Human
uccauaucuugcga

SEQ ID NO: 2803784 - RNA, 21 nt, Human
uccauaucuugcgaauccaag

SEQ ID NO: 2803785 - RNA, 22 nt, Human
uccauaucuugcgaauccaagc

SEQ ID NO: 2803786 - RNA, 14 nt, Human
uccaugaugcuggg

SEQ ID NO: 2803787 - RNA, 20 nt, Human
uccauauauccuuuucuucu

SEQ ID NO: 2803788 - RNA, 19 nt, Human
uccaugaguuugcccuggu

SEQ ID NO: 2803789 - RNA, 19 nt, Human
uccauauuuauagguaccc

SEQ ID NO: 2803790 - RNA, 14 nt, Human
ucccaacuuguaaa

SEQ ID NO: 2803791 - RNA, 16 nt, Human
ucccaacagucauguu

SEQ ID NO: 2803792 - RNA, 21 nt, Human
ucccaacuucucuugcuuucu

SEQ ID NO: 2803793 - RNA, 14 nt, Human
ucccaaccagugcc

SEQ ID NO: 2803794 - RNA, 17 nt, Human
ucccaaccagugccaag

SEQ ID NO: 2803795 - RNA, 18 nt, Human
ucccaaccagugccaagg

SEQ ID NO: 2803796 - RNA, 19 nt, Human
ucccaaccagugccaagga

SEQ ID NO: 2803797 - RNA, 20 nt, Human
ucccaaccagugccaaggac

SEQ ID NO: 2803798 - RNA, 23 nt, Human
ucccaaccagugccaaggaccuc

SEQ ID NO: 2803799 - RNA, 21 nt, Human
ucccaaccccuuaagcccugg

SEQ ID NO: 2803800 - RNA, 22 nt, Human
ucccaaccccuuaagcccuggc

SEQ ID NO: 2803801 - RNA, 15 nt, Human
ucccaacagccaugc

SEQ ID NO: 2803802 - RNA, 16 nt, Human
ucccaacagccaugcc

SEQ ID NO: 2803803 - RNA, 17 nt, Human
ucccaacagccaugccc

SEQ ID NO: 2803804 - RNA, 16 nt, Human
uccaugucgccucugc

SEQ ID NO: 2803805 - RNA, 16 nt, Human
uccauguccccuccca

SEQ ID NO: 2803806 - RNA, 21 nt, Human
uccaugcagggggcuccuggg

SEQ ID NO: 2803807 - RNA, 17 nt, Human
uccaugcaugacagccu

SEQ ID NO: 2803808 - RNA, 19 nt, Human
uccaugcaugacagccucu

SEQ ID NO: 2803809 - RNA, 15 nt, Human
uccaugaugcuggga

SEQ ID NO: 2803810 - RNA, 12 nt, Human
uccaugauucua

SEQ ID NO: 2803811 - RNA, 13 nt, Human
uccaugcaccaaa

SEQ ID NO: 2803812 - RNA, 14 nt, Human
uccaugcaccaaac

SEQ ID NO: 2803813 - RNA, 15 nt, Human
ucccaacaagcagcu

SEQ ID NO: 2803814 - RNA, 19 nt, Human
uccaugucgccucugcauu

SEQ ID NO: 2803815 - RNA, 17 nt, Human
uccauguccccucccag

SEQ ID NO: 2803816 - RNA, 18 nt, Human
uccauguccccucccaga

SEQ ID NO: 2803817 - RNA, 17 nt, Human
uccauguccuaugugug

SEQ ID NO: 2803818 - RNA, 18 nt, Human
uccauguccuauguguga

SEQ ID NO: 2803819 - RNA, 17 nt, Human
uccaugucgccucugca

SEQ ID NO: 2803820 - RNA, 18 nt, Human
uccaugucgccucugcau

SEQ ID NO: 2803821 - RNA, 16 nt, Human
ucccaugagccucagc

SEQ ID NO: 2803822 - RNA, 15 nt, Human
ucccaugagccucag

SEQ ID NO: 2803823 - RNA, 14 nt, Human
ucccaugacccagg

SEQ ID NO: 2803824 - RNA, 15 nt, Human
ucccaugacccaggc

SEQ ID NO: 2803825 - RNA, 16 nt, Human
ucccaugacccaggcu

SEQ ID NO: 2803826 - RNA, 20 nt, Human
ucccaugacccaggcugggc

SEQ ID NO: 2803827 - RNA, 21 nt, Human
ucccaugagacccuggugccu

SEQ ID NO: 2803828 - RNA, 22 nt, Human
ucccaugagacccuggugccug

SEQ ID NO: 2803829 - RNA, 22 nt, Human
ucccagggccagggcccugcag

SEQ ID NO: 2803830 - RNA, 21 nt, Human
ucccagggccagggcccugca

SEQ ID NO: 2803831 - RNA, 23 nt, Human
ucccagggccagggcccugcaga

SEQ ID NO: 2803832 - RNA, 18 nt, Human
ucccaggcugagccucag

SEQ ID NO: 2803833 - RNA, 19 nt, Human
ucccaggcugagccucagu

SEQ ID NO: 2803834 - RNA, 20 nt, Human
ucccagggccagggcccugc

SEQ ID NO: 2803835 - RNA, 17 nt, Human
ucccagggccagggccc

SEQ ID NO: 2803836 - RNA, 16 nt, Human
ucccagggccagggcc

SEQ ID NO: 2803837 - RNA, 13 nt, Human
ucccaagaaaugc

SEQ ID NO: 2803838 - RNA, 16 nt, Human
ucccaggauguacaag

SEQ ID NO: 2803839 - RNA, 22 nt, Human
ucccacugggguccagggagca

SEQ ID NO: 2803840 - RNA, 13 nt, Human
ucccacuguauga

SEQ ID NO: 2803841 - RNA, 18 nt, Human
ucccacuguaugauuuau

SEQ ID NO: 2803842 - RNA, 15 nt, Human
ucccacucaccccgg

SEQ ID NO: 2803843 - RNA, 23 nt, Human
ucccacucaccccggcagacgcc

SEQ ID NO: 2803844 - RNA, 14 nt, Human
ucccacucagucca

SEQ ID NO: 2803845 - RNA, 13 nt, Human
ucccacucacccc

SEQ ID NO: 2803846 - RNA, 21 nt, Human
ucccacgaauuugcuggggaa

SEQ ID NO: 2803847 - RNA, 14 nt, Human
ucccacgugggaga

SEQ ID NO: 2803848 - RNA, 14 nt, Human
ucccacgugucuuc

SEQ ID NO: 2803849 - RNA, 15 nt, Human
ucccacgugucuucc

SEQ ID NO: 2803850 - RNA, 17 nt, Human
ucccacgugucuuccac

SEQ ID NO: 2803851 - RNA, 18 nt, Human
ucccacgugucuuccacu

SEQ ID NO: 2803852 - RNA, 18 nt, Human
ucccacgggaccuggggc

SEQ ID NO: 2803853 - RNA, 15 nt, Human
ucccacgaauuugcu

SEQ ID NO: 2803854 - RNA, 20 nt, Human
ucccaccuuucgggccaugu

SEQ ID NO: 2803855 - RNA, 18 nt, Human
ucccacgaauuugcuggg

SEQ ID NO: 2803856 - RNA, 20 nt, Human
ucccacgaauuugcugggga

SEQ ID NO: 2803857 - RNA, 14 nt, Human
ucccaccucccugc

SEQ ID NO: 2803858 - RNA, 15 nt, Human
ucccaccucccugcc

SEQ ID NO: 2803859 - RNA, 16 nt, Human
ucccaccucccugccc

SEQ ID NO: 2803860 - RNA, 17 nt, Human
ucccaccucccugccca

SEQ ID NO: 2803861 - RNA, 18 nt, Human
ucccaccucccugcccag

SEQ ID NO: 2803862 - RNA, 19 nt, Human
ucccaccucccugcccagg

SEQ ID NO: 2803863 - RNA, 20 nt, Human
ucccaccucccugcccaggc

SEQ ID NO: 2803864 - RNA, 21 nt, Human
ucccaccuuggcugcagggag

SEQ ID NO: 2803865 - RNA, 19 nt, Human
ucccaccuuggcugcaggg

SEQ ID NO: 2803866 - RNA, 17 nt, Human
ucccaccuccaucccag

SEQ ID NO: 2803867 - RNA, 15 nt, Human
ucccaccuccauccc

SEQ ID NO: 2803868 - RNA, 16 nt, Human
ucccaccucagccucc

SEQ ID NO: 2803869 - RNA, 23 nt, Human
ucccaagauguugauuuuuacug

SEQ ID NO: 2803870 - RNA, 14 nt, Human
ucccaagauuuuuu

SEQ ID NO: 2803871 - RNA, 19 nt, Human
ucccaagauuuuuucauuu

SEQ ID NO: 2803872 - RNA, 14 nt, Human
ucccaagauguuga

SEQ ID NO: 2803873 - RNA, 22 nt, Human
ucccaagagaaggggaagcacu

SEQ ID NO: 2803874 - RNA, 18 nt, Human
ucccaccucagccucccg

SEQ ID NO: 2803875 - RNA, 14 nt, Human
ucccaagccuucgg

SEQ ID NO: 2803876 - RNA, 13 nt, Human
ucccaccuccagc

SEQ ID NO: 2803877 - RNA, 15 nt, Human
ucccaccuccagccc

SEQ ID NO: 2803878 - RNA, 16 nt, Human
ucccaccuccagcccg

SEQ ID NO: 2803879 - RNA, 17 nt, Human
ucccaccuccagcccgg

SEQ ID NO: 2803880 - RNA, 22 nt, Human
ucccaccuccagcccgggagcc

SEQ ID NO: 2803881 - RNA, 13 nt, Human
ucccaccuccagu

SEQ ID NO: 2803882 - RNA, 14 nt, Human
ucccaccuccaguc

SEQ ID NO: 2803883 - RNA, 17 nt, Human
ucccaccuccagucccc

SEQ ID NO: 2803884 - RNA, 13 nt, Human
uccaggaccccug

SEQ ID NO: 2803885 - RNA, 13 nt, Human
uccagcuggccug

SEQ ID NO: 2803886 - RNA, 12 nt, Human
uccagcuggccu

SEQ ID NO: 2803887 - RNA, 11 nt, Human
uccagcuggcc

SEQ ID NO: 2803888 - RNA, 22 nt, Human
uccagcuggccgggagccugau

SEQ ID NO: 2803889 - RNA, 21 nt, Human
uccagcuggccgggagccuga

SEQ ID NO: 2803890 - RNA, 15 nt, Human
uccagcuggccggga

SEQ ID NO: 2803891 - RNA, 18 nt, Human
uccagcuggccuggacag

SEQ ID NO: 2803892 - RNA, 17 nt, Human
uccagcuggccuggaca

SEQ ID NO: 2803893 - RNA, 19 nt, Human
uccagcugggcucugcaau

SEQ ID NO: 2803894 - RNA, 19 nt, Human
uccagcuggguuggaaaac

SEQ ID NO: 2803895 - RNA, 16 nt, Human
uccagcaacacagccu

SEQ ID NO: 2803896 - RNA, 21 nt, Human
uccagcaacacagccugggcc

SEQ ID NO: 2803897 - RNA, 20 nt, Human
uccagcaacacagccugggc

SEQ ID NO: 2803898 - RNA, 17 nt, Human
uccagcaacacagccug

SEQ ID NO: 2803899 - RNA, 20 nt, Human
uccagcaacuucuucuccau

SEQ ID NO: 2803900 - RNA, 19 nt, Human
uccagcaacuucuucucca

SEQ ID NO: 2803901 - RNA, 18 nt, Human
uccagcaacuucuucucc

SEQ ID NO: 2803902 - RNA, 22 nt, Human
uccagcaacacagccugggccc

SEQ ID NO: 2803903 - RNA, 18 nt, Human
uccagcaauucuccugcc

SEQ ID NO: 2803904 - RNA, 20 nt, Human
uccagcaauucuccugccuc

SEQ ID NO: 2803905 - RNA, 19 nt, Human
uccagcaauucuccugccu

SEQ ID NO: 2803906 - RNA, 12 nt, Human
uccagcugcugu

SEQ ID NO: 2803907 - RNA, 14 nt, Human
uccagcugcugucu

SEQ ID NO: 2803908 - RNA, 15 nt, Human
uccagcugcugucuu

SEQ ID NO: 2803909 - RNA, 17 nt, Human
uccagcugcugucuucu

SEQ ID NO: 2803910 - RNA, 18 nt, Human
uccagauguuuccagacu

SEQ ID NO: 2803911 - RNA, 19 nt, Human
uccagauguuuccagacuu

SEQ ID NO: 2803912 - RNA, 19 nt, Human
uccagauuaucuauuugug

SEQ ID NO: 2803913 - RNA, 23 nt, Human
uccagauuaucuauuugugugug

SEQ ID NO: 2803914 - RNA, 22 nt, Human
uccagauuuuuuacagcugccu

SEQ ID NO: 2803915 - RNA, 12 nt, Human
uccagauuuuua

SEQ ID NO: 2803916 - RNA, 19 nt, Human
uccagauuuuucggaggcc

SEQ ID NO: 2803917 - RNA, 14 nt, Human
uccagaugguggga

SEQ ID NO: 2803918 - RNA, 13 nt, Human
uccagaugugaug

SEQ ID NO: 2803919 - RNA, 14 nt, Human
uccagaugugaugc

SEQ ID NO: 2803920 - RNA, 17 nt, Human
uccagaugugaugcuug

SEQ ID NO: 2803921 - RNA, 19 nt, Human
uccagaugugaugcuugau

SEQ ID NO: 2803922 - RNA, 14 nt, Human
uccacuucaaugca

SEQ ID NO: 2803923 - RNA, 22 nt, Human
uccagagaguggcuccucccgg

SEQ ID NO: 2803924 - RNA, 19 nt, Human
uccagagaguggcuccucc

SEQ ID NO: 2803925 - RNA, 20 nt, Human
uccagaggcuauuauuuuca

SEQ ID NO: 2803926 - RNA, 20 nt, Human
uccagagcggaggcugugug

SEQ ID NO: 2803927 - RNA, 21 nt, Human
uccagagcggaggcugugugc

SEQ ID NO: 2803928 - RNA, 23 nt, Human
uccagagcggaggcugugugccu

SEQ ID NO: 2803929 - RNA, 20 nt, Human
uccagaggguugugauuuug

SEQ ID NO: 2803930 - RNA, 22 nt, Human
uccacugugccaugugccaggu

SEQ ID NO: 2803931 - RNA, 17 nt, Human
uccacugugccuuugca

SEQ ID NO: 2803932 - RNA, 12 nt, Human
uccacuguguau

SEQ ID NO: 2803933 - RNA, 20 nt, Human
uccacuguguauagaaguag

SEQ ID NO: 2803934 - RNA, 21 nt, Human
uccacuuagaaauugcauuuc

SEQ ID NO: 2803935 - RNA, 23 nt, Human
uccacuuagaaauugcauuuccu

SEQ ID NO: 2803936 - RNA, 14 nt, Human
uccacccugcucuc

SEQ ID NO: 2803937 - RNA, 13 nt, Human
uccacccugcucu

SEQ ID NO: 2803938 - RNA, 21 nt, Human
uccacccugcucuccgaccag

SEQ ID NO: 2803939 - RNA, 22 nt, Human
uccacagcgagggcagcugcua

SEQ ID NO: 2803940 - RNA, 13 nt, Human
uccacaggaagug

SEQ ID NO: 2803941 - RNA, 12 nt, Human
uccacccuggaa

SEQ ID NO: 2803942 - RNA, 22 nt, Human
uccaagcuaagcacugccacug

SEQ ID NO: 2803943 - RNA, 14 nt, Human
uccaagcuaagcac

SEQ ID NO: 2803944 - RNA, 20 nt, Human
uccaagccuccacagcgagg

SEQ ID NO: 2803945 - RNA, 17 nt, Human
uccaagccuccacagcg

SEQ ID NO: 2803946 - RNA, 21 nt, Human
uccaagccuccacagcgaggg

SEQ ID NO: 2803947 - RNA, 16 nt, Human
uccaagccuccacagc

SEQ ID NO: 2803948 - RNA, 15 nt, Human
uccaagccuccacag

SEQ ID NO: 2803949 - RNA, 14 nt, Human
uccaagccuccaca

SEQ ID NO: 2803950 - RNA, 15 nt, Human
uccaagccagcggga

SEQ ID NO: 2803951 - RNA, 23 nt, Human
uccaagcagccugagcaacucuu

SEQ ID NO: 2803952 - RNA, 18 nt, Human
uccacacccaauuccacu

SEQ ID NO: 2803953 - RNA, 22 nt, Human
uccacacccaggcauagccugg

SEQ ID NO: 2803954 - RNA, 21 nt, Human
uccacaccuuuuauugacaca

SEQ ID NO: 2803955 - RNA, 15 nt, Human
uccacaccuuuuauu

SEQ ID NO: 2803956 - RNA, 21 nt, Human
uccacagcgagggcagcugcu

SEQ ID NO: 2803957 - RNA, 20 nt, Human
uccacagcgagggcagcugc

SEQ ID NO: 2803958 - RNA, 14 nt, Human
uccacagcuaccuc

SEQ ID NO: 2803959 - RNA, 13 nt, Human
uccacagcuuccu

SEQ ID NO: 2803960 - RNA, 14 nt, Human
uccacagcuuccug

SEQ ID NO: 2803961 - RNA, 15 nt, Human
uccacagcuuccugu

SEQ ID NO: 2803962 - RNA, 23 nt, Human
uccacagcuuccuguccccaucu

SEQ ID NO: 2803963 - RNA, 12 nt, Human
uccacagcuucc

SEQ ID NO: 2803964 - RNA, 19 nt, Human
uccacagcgagggcagcug

SEQ ID NO: 2803965 - RNA, 18 nt, Human
uccacagcgagggcagcu

SEQ ID NO: 2803966 - RNA, 17 nt, Human
uccacagcgagggcagc

SEQ ID NO: 2803967 - RNA, 18 nt, Human
uccacagccgcagccucc

SEQ ID NO: 2803968 - RNA, 17 nt, Human
uccacagccgcagccuc

SEQ ID NO: 2803969 - RNA, 16 nt, Human
uccacagccgcagccu

SEQ ID NO: 2803970 - RNA, 14 nt, Human
uccacagccgcagc

SEQ ID NO: 2803971 - RNA, 19 nt, Human
uccaagaggguccuuuagu

SEQ ID NO: 2803972 - RNA, 15 nt, Human
uccaagagucuaaag

SEQ ID NO: 2803973 - RNA, 20 nt, Human
uccaagacucuagaguccaa

SEQ ID NO: 2803974 - RNA, 23 nt, Human
uccaagacucuagaguccaaggu

SEQ ID NO: 2803975 - RNA, 13 nt, Human
uccaagacucuag

SEQ ID NO: 2803976 - RNA, 14 nt, Human
uccaagacucuaga

SEQ ID NO: 2803977 - RNA, 15 nt, Human
uccaagacucuagag

SEQ ID NO: 2803978 - RNA, 16 nt, Human
uccaagacucuagagu

SEQ ID NO: 2803979 - RNA, 20 nt, Human
ucauguaucaucuggauagg

SEQ ID NO: 2803980 - RNA, 18 nt, Human
ucaugggcaccaaccugc

SEQ ID NO: 2803981 - RNA, 19 nt, Human
ucauguacauuuggaacua

SEQ ID NO: 2803982 - RNA, 18 nt, Human
ucauguacaagaugaagg

SEQ ID NO: 2803983 - RNA, 17 nt, Human
ucauguacaagaugaag

SEQ ID NO: 2803984 - RNA, 16 nt, Human
ucauguacaagaugaa

SEQ ID NO: 2803985 - RNA, 16 nt, Human
ucauguagagaaaagc

SEQ ID NO: 2803986 - RNA, 17 nt, Human
ucauguagagaaaagca

SEQ ID NO: 2803987 - RNA, 19 nt, Human
ucauguagagaaaagcaca

SEQ ID NO: 2803988 - RNA, 20 nt, Human
ucauguagagaaaagcacac

SEQ ID NO: 2803989 - RNA, 15 nt, Human
ucauguaucaucugg

SEQ ID NO: 2803990 - RNA, 18 nt, Human
ucauguaucaucuggaua

SEQ ID NO: 2803991 - RNA, 19 nt, Human
ucauguaucaucuggauag

SEQ ID NO: 2803992 - RNA, 19 nt, Human
ucuaauuucaaaaauauaa

SEQ ID NO: 2803993 - RNA, 22 nt, Human
ucuaauuucaaaaauauaacuu

SEQ ID NO: 2803994 - RNA, 20 nt, Human
ucuaauuucaaaaauauaac

SEQ ID NO: 2803995 - RNA, 14 nt, Human
ucuacuauuuaugu

SEQ ID NO: 2803996 - RNA, 15 nt, Human
ucuacuaauuccaca

SEQ ID NO: 2803997 - RNA, 15 nt, Human
ucuaauucucugugg

SEQ ID NO: 2803998 - RNA, 21 nt, Human
ucuaauucuauuaaagugcua

SEQ ID NO: 2803999 - RNA, 17 nt, Human
ucuaauugcaucucaaa

SEQ ID NO: 2804000 - RNA, 19 nt, Human
ucuaauugcaucucaaaau

SEQ ID NO: 2804001 - RNA, 17 nt, Human
ucuaaugucuucauuuc

SEQ ID NO: 2804002 - RNA, 20 nt, Human
ucuaauggguauuuaaacaa

SEQ ID NO: 2804003 - RNA, 14 nt, Human
ucuaaugucuucau

SEQ ID NO: 2804004 - RNA, 15 nt, Human
ucuaaugucuucauu

SEQ ID NO: 2804005 - RNA, 18 nt, Human
ucuaauauuaaaaauaug

SEQ ID NO: 2804006 - RNA, 17 nt, Human
ucuaaucgaaagaaaau

SEQ ID NO: 2804007 - RNA, 20 nt, Human
ucuaaucgaaagaaaauggg

SEQ ID NO: 2804008 - RNA, 12 nt, Human
ucuaaucaaaag

SEQ ID NO: 2804009 - RNA, 22 nt, Human
ucuaaugaggagagaaaauaua

SEQ ID NO: 2804010 - RNA, 24 nt, Human
ucuaaugaggagagaaaauauaug

SEQ ID NO: 2804011 - RNA, 21 nt, Human
ucuaaugacaugccuauauga

SEQ ID NO: 2804012 - RNA, 17 nt, Human
ucuaauauuaaaaauau

SEQ ID NO: 2804013 - RNA, 16 nt, Human
ucgucuuaacucacca

SEQ ID NO: 2804014 - RNA, 12 nt, Human
ucgucuucacuc

SEQ ID NO: 2804015 - RNA, 14 nt, Human
ucgucuucacucuu

SEQ ID NO: 2804016 - RNA, 17 nt, Human
ucuagguggcaaggcug

SEQ ID NO: 2804017 - RNA, 18 nt, Human
ucuagguggcaaggcugu

SEQ ID NO: 2804018 - RNA, 20 nt, Human
ucuagguggcaaggcugugc

SEQ ID NO: 2804019 - RNA, 21 nt, Human
ucuauaugaauuuaaauauaa

SEQ ID NO: 2804020 - RNA, 12 nt, Human
ucuaggcucugc

SEQ ID NO: 2804021 - RNA, 14 nt, Human
ucuaggcucugccu

SEQ ID NO: 2804022 - RNA, 15 nt, Human
ucuaggcucugccuu

SEQ ID NO: 2804023 - RNA, 17 nt, Human
ucuaggcucugccuucg

SEQ ID NO: 2804024 - RNA, 18 nt, Human
ucuaggguugcuggagcc

SEQ ID NO: 2804025 - RNA, 21 nt, Human
ucuaggguugcuggagccuga

SEQ ID NO: 2804026 - RNA, 22 nt, Human
ucuaggguugcuggagccugag

SEQ ID NO: 2804027 - RNA, 12 nt, Human
ucuaggcugggg

SEQ ID NO: 2804028 - RNA, 20 nt, Human
ucuagguaggggcccacuuc

SEQ ID NO: 2804029 - RNA, 20 nt, Human
ucuaauggcacuuaucauua

SEQ ID NO: 2804030 - RNA, 18 nt, Human
ucuacuaauuccacaccu

SEQ ID NO: 2804031 - RNA, 19 nt, Human
ucuacuccuaccucagccu

SEQ ID NO: 2804032 - RNA, 17 nt, Human
ucuacuccuaccucagc

SEQ ID NO: 2804033 - RNA, 22 nt, Human
ucuacuccuaccucagccuaga

SEQ ID NO: 2804034 - RNA, 15 nt, Human
ucuaggcacuguagu

SEQ ID NO: 2804035 - RNA, 21 nt, Human
ucuaggcacuguaguucuaag

SEQ ID NO: 2804036 - RNA, 22 nt, Human
ucuaggcacuguaguucuaaga

SEQ ID NO: 2804037 - RNA, 24 nt, Human
ucuaggcacuguaguucuaagacu

SEQ ID NO: 2804038 - RNA, 15 nt, Human
ucuauccaaacaugu

SEQ ID NO: 2804039 - RNA, 22 nt, Human
ucuauccaaacauguauuuaug

SEQ ID NO: 2804040 - RNA, 18 nt, Human
ucuauccaaaucugaaga

SEQ ID NO: 2804041 - RNA, 13 nt, Human
ucuaucuaaauga

SEQ ID NO: 2804042 - RNA, 14 nt, Human
ucuaucuaaaugau

SEQ ID NO: 2804043 - RNA, 12 nt, Human
ucuaucuaauga

SEQ ID NO: 2804044 - RNA, 14 nt, Human
ucuaucuaaugaca

SEQ ID NO: 2804045 - RNA, 16 nt, Human
ucuaucuaaugacaug

SEQ ID NO: 2804046 - RNA, 12 nt, Human
ucuaucucucaa

SEQ ID NO: 2804047 - RNA, 12 nt, Human
ucuaucugggcc

SEQ ID NO: 2804048 - RNA, 15 nt, Human
ucuaucugggccugg

SEQ ID NO: 2804049 - RNA, 16 nt, Human
ucuaucugggccuggg

SEQ ID NO: 2804050 - RNA, 17 nt, Human
ucuaucugggccugggc

SEQ ID NO: 2804051 - RNA, 18 nt, Human
ucuaucugggccugggcu

SEQ ID NO: 2804052 - RNA, 16 nt, Human
ucuauccuacaacaag

SEQ ID NO: 2804053 - RNA, 14 nt, Human
ucuaucuuccaaau

SEQ ID NO: 2804054 - RNA, 17 nt, Human
ucuaucuuccaaaugca

SEQ ID NO: 2804055 - RNA, 23 nt, Human
ucuaucuuccaaaugcaauuuga

SEQ ID NO: 2804056 - RNA, 22 nt, Human
ucuaucuuugagcgcccacuag

SEQ ID NO: 2804057 - RNA, 14 nt, Human
ucuaucuuguucca

SEQ ID NO: 2804058 - RNA, 19 nt, Human
ucuaucuuguuccaaggcc

SEQ ID NO: 2804059 - RNA, 22 nt, Human
ucuaucuuguuccaaggccagg

SEQ ID NO: 2804060 - RNA, 13 nt, Human
ucuagguaauuuu

SEQ ID NO: 2804061 - RNA, 12 nt, Human
ucucacacacau

SEQ ID NO: 2804062 - RNA, 14 nt, Human
ucucacacacauag

SEQ ID NO: 2804063 - RNA, 15 nt, Human
ucucacacacauaga

SEQ ID NO: 2804064 - RNA, 23 nt, Human
ucucacucugucgcccagucugg

SEQ ID NO: 2804065 - RNA, 20 nt, Human
ucucagauccuuguuucaaa

SEQ ID NO: 2804066 - RNA, 13 nt, Human
ucucauaaauuua

SEQ ID NO: 2804067 - RNA, 18 nt, Human
ucucauaauuccuacagc

SEQ ID NO: 2804068 - RNA, 20 nt, Human
ucucauaauuccuacagcac

SEQ ID NO: 2804069 - RNA, 16 nt, Human
ucucaguuuguauaga

SEQ ID NO: 2804070 - RNA, 15 nt, Human
ucucaguuggaaaua

SEQ ID NO: 2804071 - RNA, 16 nt, Human
ucucaguuuguguguc

SEQ ID NO: 2804072 - RNA, 17 nt, Human
ucucaguuugugugucu

SEQ ID NO: 2804073 - RNA, 18 nt, Human
ucucaguuugugugucuu

SEQ ID NO: 2804074 - RNA, 19 nt, Human
ucucaguuugugugucuua

SEQ ID NO: 2804075 - RNA, 15 nt, Human
ucucacuguugccca

SEQ ID NO: 2804076 - RNA, 14 nt, Human
ucucacuguugccc

SEQ ID NO: 2804077 - RNA, 17 nt, Human
ucucacuguguacauaa

SEQ ID NO: 2804078 - RNA, 17 nt, Human
ucucacuggaugcaaag

SEQ ID NO: 2804079 - RNA, 20 nt, Human
ucucacugccaucaaacugu

SEQ ID NO: 2804080 - RNA, 18 nt, Human
ucucagauccuuguuuca

SEQ ID NO: 2804081 - RNA, 19 nt, Human
ucucagauccuuguuucaa

SEQ ID NO: 2804082 - RNA, 22 nt, Human
ucucagauccuuguuucaaaca

SEQ ID NO: 2804083 - RNA, 15 nt, Human
ucucagaugcaguuu

SEQ ID NO: 2804084 - RNA, 14 nt, Human
ucucagauccuugu

SEQ ID NO: 2804085 - RNA, 14 nt, Human
ucucagaucacugc

SEQ ID NO: 2804086 - RNA, 17 nt, Human
ucucagaucacugcaac

SEQ ID NO: 2804087 - RNA, 16 nt, Human
ucucagauccuuguuu

SEQ ID NO: 2804088 - RNA, 17 nt, Human
ucucagauccuuguuuc

SEQ ID NO: 2804089 - RNA, 17 nt, Human
ucucagacuuuuguaca

SEQ ID NO: 2804090 - RNA, 18 nt, Human
ucucagacuuuuguacau

SEQ ID NO: 2804091 - RNA, 20 nt, Human
ucucagacuuuuguacaucu

SEQ ID NO: 2804092 - RNA, 16 nt, Human
ucucagacugcaugua

SEQ ID NO: 2804093 - RNA, 15 nt, Human
ucguccacagcuucc

SEQ ID NO: 2804094 - RNA, 16 nt, Human
ucguccacagcuuccu

SEQ ID NO: 2804095 - RNA, 17 nt, Human
ucguccacagcuuccug

SEQ ID NO: 2804096 - RNA, 16 nt, Human
ucggagcaucccggag

SEQ ID NO: 2804097 - RNA, 21 nt, Human
ucggagcaucccggaggaaau

SEQ ID NO: 2804098 - RNA, 23 nt, Human
ucggagcaucccggaggaaaucu

SEQ ID NO: 2804099 - RNA, 13 nt, Human
ucggaggccccac

SEQ ID NO: 2804100 - RNA, 17 nt, Human
ucggaggccccacugau

SEQ ID NO: 2804101 - RNA, 18 nt, Human
ucggaggccccacugaug

SEQ ID NO: 2804102 - RNA, 19 nt, Human
ucggaggccccacugaugc

SEQ ID NO: 2804103 - RNA, 14 nt, Human
ucggaggcugcccc

SEQ ID NO: 2804104 - RNA, 23 nt, Human
ucggaggcugcccccggcccccu

SEQ ID NO: 2804105 - RNA, 16 nt, Human
ucgcuuggcuccaugc

SEQ ID NO: 2804106 - RNA, 22 nt, Human
ucgcuuggcuccaugcuccuca

SEQ ID NO: 2804107 - RNA, 12 nt, Human
ucgcuuguaaau

SEQ ID NO: 2804108 - RNA, 16 nt, Human
ucgcuuguaaauacca

SEQ ID NO: 2804109 - RNA, 17 nt, Human
ucgcuuguaaauaccag

SEQ ID NO: 2804110 - RNA, 23 nt, Human
ucgcccagucuggaaugcagugg

SEQ ID NO: 2804111 - RNA, 19 nt, Human
ucgcccagucuggaaugca

SEQ ID NO: 2804112 - RNA, 14 nt, Human
ucgcccagucugga

SEQ ID NO: 2804113 - RNA, 16 nt, Human
ucgccaacauggugaa

SEQ ID NO: 2804114 - RNA, 14 nt, Human
ucgauccaaauugu

SEQ ID NO: 2804115 - RNA, 15 nt, Human
ucgauccaaauugug

SEQ ID NO: 2804116 - RNA, 21 nt, Human
ucgauccaaauugugcuucuc

SEQ ID NO: 2804117 - RNA, 15 nt, Human
ucgaugaaggcugcc

SEQ ID NO: 2804118 - RNA, 15 nt, Human
ucgaugauucaggug

SEQ ID NO: 2804119 - RNA, 18 nt, Human
ucgaugcguucacuccaa

SEQ ID NO: 2804120 - RNA, 23 nt, Human
ucgaugguacgugacccucugcu

SEQ ID NO: 2804121 - RNA, 20 nt, Human
ucgauguguacucuaacuua

SEQ ID NO: 2804122 - RNA, 15 nt, Human
uccuuuguguuucua

SEQ ID NO: 2804123 - RNA, 20 nt, Human
uccuuuguguuucuauugac

SEQ ID NO: 2804124 - RNA, 12 nt, Human
uccuuugucuuc

SEQ ID NO: 2804125 - RNA, 21 nt, Human
uccuuugucuucaaacuguga

SEQ ID NO: 2804126 - RNA, 17 nt, Human
uccuuugugguuuuaug

SEQ ID NO: 2804127 - RNA, 20 nt, Human
uccuuuguguguacucacug

SEQ ID NO: 2804128 - RNA, 13 nt, Human
uccuuuucuuuaa

SEQ ID NO: 2804129 - RNA, 15 nt, Human
uccuuuucuuuuguu

SEQ ID NO: 2804130 - RNA, 16 nt, Human
uccuuuucuuuuguua

SEQ ID NO: 2804131 - RNA, 17 nt, Human
uccuuuucuuuuguuac

SEQ ID NO: 2804132 - RNA, 18 nt, Human
uccuuuucuuuuguuacu

SEQ ID NO: 2804133 - RNA, 19 nt, Human
uccuuuucuuuuguuacug

SEQ ID NO: 2804134 - RNA, 20 nt, Human
uccuuuucuuuuguuacugu

SEQ ID NO: 2804135 - RNA, 21 nt, Human
uccuuuucuuuuguuacuguu

SEQ ID NO: 2804136 - RNA, 22 nt, Human
uccuuuucuuuuguuacuguuc

SEQ ID NO: 2804137 - RNA, 23 nt, Human
uccuuuucuuuuguuacuguucu

SEQ ID NO: 2804138 - RNA, 10 nt, Human
uccuuuucuu

SEQ ID NO: 2804139 - RNA, 15 nt, Human
uccuuuucuucuaug

SEQ ID NO: 2804140 - RNA, 16 nt, Human
uccuuuucuucuaugu

SEQ ID NO: 2804141 - RNA, 14 nt, Human
uccuuuucuugcuu

SEQ ID NO: 2804142 - RNA, 20 nt, Human
ucgcauggucacacacugau

SEQ ID NO: 2804143 - RNA, 19 nt, Human
ucgcauggucacacacuga

SEQ ID NO: 2804144 - RNA, 13 nt, Human
ucgcaucauugca

SEQ ID NO: 2804145 - RNA, 15 nt, Human
ucgcaucauugcaga

SEQ ID NO: 2804146 - RNA, 14 nt, Human
ucgcaucuucccaa

SEQ ID NO: 2804147 - RNA, 11 nt, Human
ucgcagccuga

SEQ ID NO: 2804148 - RNA, 13 nt, Human
ucgcagccugagu

SEQ ID NO: 2804149 - RNA, 14 nt, Human
ucgcagccugaguc

SEQ ID NO: 2804150 - RNA, 15 nt, Human
ucgauucauauugaa

SEQ ID NO: 2804151 - RNA, 22 nt, Human
ucgauguuuuauuauuucuauu

SEQ ID NO: 2804152 - RNA, 15 nt, Human
uccuucuuuuuaaaa

SEQ ID NO: 2804153 - RNA, 22 nt, Human
uccuucuuugauaauguuaaau

SEQ ID NO: 2804154 - RNA, 19 nt, Human
uccuucuuugauaauguua

SEQ ID NO: 2804155 - RNA, 20 nt, Human
uccuucuuugauaauguuaa

SEQ ID NO: 2804156 - RNA, 17 nt, Human
uccuugcuccuggccuu

SEQ ID NO: 2804157 - RNA, 21 nt, Human
uccuugcuccuggccuugcug

SEQ ID NO: 2804158 - RNA, 16 nt, Human
uccuuggucuuuguau

SEQ ID NO: 2804159 - RNA, 17 nt, Human
uccuuggucuuuguauc

SEQ ID NO: 2804160 - RNA, 23 nt, Human
uccuuggucuuuguaucuuccau

SEQ ID NO: 2804161 - RNA, 14 nt, Human
uccuuggugccugg

SEQ ID NO: 2804162 - RNA, 21 nt, Human
uccuugcuguccuaggccaca

SEQ ID NO: 2804163 - RNA, 19 nt, Human
uccuugcuguccuaggcca

SEQ ID NO: 2804164 - RNA, 17 nt, Human
uccuugcuguccuaggc

SEQ ID NO: 2804165 - RNA, 18 nt, Human
uccuuggugccuggccug

SEQ ID NO: 2804166 - RNA, 12 nt, Human
uccuuugaagau

SEQ ID NO: 2804167 - RNA, 22 nt, Human
uccuuugaagauaguaacugua

SEQ ID NO: 2804168 - RNA, 14 nt, Human
uccuuugcagggca

SEQ ID NO: 2804169 - RNA, 15 nt, Human
uccuuugcagggcag

SEQ ID NO: 2804170 - RNA, 16 nt, Human
uccuuugcagggcagc

SEQ ID NO: 2804171 - RNA, 17 nt, Human
uccuuugcagggcagcc

SEQ ID NO: 2804172 - RNA, 18 nt, Human
uccuuugcagggcagccc

SEQ ID NO: 2804173 - RNA, 17 nt, Human
uccuuugcgccugugac

SEQ ID NO: 2804174 - RNA, 18 nt, Human
uccuuugguccugucccc

SEQ ID NO: 2804175 - RNA, 15 nt, Human
uccuuaucaaaggac

SEQ ID NO: 2804176 - RNA, 14 nt, Human
uccuuaucaaagga

SEQ ID NO: 2804177 - RNA, 21 nt, Human
uccuuaccuuuaccccauccc

SEQ ID NO: 2804178 - RNA, 20 nt, Human
uccuuacgcuuugucacaca

SEQ ID NO: 2804179 - RNA, 17 nt, Human
uccuuaucaaaggacac

SEQ ID NO: 2804180 - RNA, 13 nt, Human
uccuucuuugaua

SEQ ID NO: 2804181 - RNA, 16 nt, Human
uccuucuuugauaaug

SEQ ID NO: 2804182 - RNA, 14 nt, Human
uccuuaucagagcu

SEQ ID NO: 2804183 - RNA, 15 nt, Human
uccuuaucagagcua

SEQ ID NO: 2804184 - RNA, 22 nt, Human
uccuuaucagagcuaagggugg

SEQ ID NO: 2804185 - RNA, 16 nt, Human
uccuguccccaucugu

SEQ ID NO: 2804186 - RNA, 17 nt, Human
uccuguccccaucuguc

SEQ ID NO: 2804187 - RNA, 20 nt, Human
uccuguccccaucugucggc

SEQ ID NO: 2804188 - RNA, 19 nt, Human
uccugaggggcaucugccc

SEQ ID NO: 2804189 - RNA, 16 nt, Human
uccugaggggcaucug

SEQ ID NO: 2804190 - RNA, 15 nt, Human
uccugaggggcaucu

SEQ ID NO: 2804191 - RNA, 18 nt, Human
uccugaggcuuuggauuu

SEQ ID NO: 2804192 - RNA, 17 nt, Human
uccugagggaggaccug

SEQ ID NO: 2804193 - RNA, 21 nt, Human
uccugagggaggaccuggggc

SEQ ID NO: 2804194 - RNA, 23 nt, Human
uccugagggaggaccuggggcac

SEQ ID NO: 2804195 - RNA, 17 nt, Human
uccugaggcuuuggauu

SEQ ID NO: 2804196 - RNA, 16 nt, Human
uccugaggcuuuggau

SEQ ID NO: 2804197 - RNA, 17 nt, Human
uccucuguccaggcacu

SEQ ID NO: 2804198 - RNA, 13 nt, Human
uccucuggggcuc

SEQ ID NO: 2804199 - RNA, 17 nt, Human
uccucuggggcucuagg

SEQ ID NO: 2804200 - RNA, 18 nt, Human
uccucucacuaaacuuua

SEQ ID NO: 2804201 - RNA, 14 nt, Human
uccucucagccccu

SEQ ID NO: 2804202 - RNA, 12 nt, Human
uccucuggagcc

SEQ ID NO: 2804203 - RNA, 16 nt, Human
uccucuauacaucucu

SEQ ID NO: 2804204 - RNA, 17 nt, Human
uccucuauacaucucuc

SEQ ID NO: 2804205 - RNA, 20 nt, Human
uccucuauacaucucucccc

SEQ ID NO: 2804206 - RNA, 21 nt, Human
uccucuauacaucucucccca

SEQ ID NO: 2804207 - RNA, 20 nt, Human
uccucgaugggagggauggc

SEQ ID NO: 2804208 - RNA, 17 nt, Human
uccucgacaucacuguu

SEQ ID NO: 2804209 - RNA, 21 nt, Human
uccucgacaucacuguucaug

SEQ ID NO: 2804210 - RNA, 18 nt, Human
uccuccuggaaccuugcu

SEQ ID NO: 2804211 - RNA, 19 nt, Human
uccuccuggaaccuugcug

SEQ ID NO: 2804212 - RNA, 20 nt, Human
uccuccuggaaccuugcugu

SEQ ID NO: 2804213 - RNA, 21 nt, Human
uccuccuggaaccuugcuguc

SEQ ID NO: 2804214 - RNA, 22 nt, Human
uccuccuggaaccuugcugucc

SEQ ID NO: 2804215 - RNA, 13 nt, Human
uccuccuggacuc

SEQ ID NO: 2804216 - RNA, 14 nt, Human
uccuaagccuaaaa

SEQ ID NO: 2804217 - RNA, 13 nt, Human
uccuaagccugug

SEQ ID NO: 2804218 - RNA, 14 nt, Human
uccuaagccugugg

SEQ ID NO: 2804219 - RNA, 16 nt, Human
uccuaagccuguggcu

SEQ ID NO: 2804220 - RNA, 17 nt, Human
uccuaagccuguggcug

SEQ ID NO: 2804221 - RNA, 20 nt, Human
uccuaagccuguggcugugg

SEQ ID NO: 2804222 - RNA, 17 nt, Human
uccuaagagugcugggc

SEQ ID NO: 2804223 - RNA, 19 nt, Human
uccuaagagugcugggcau

SEQ ID NO: 2804224 - RNA, 16 nt, Human
uccuaagagugcuggg

SEQ ID NO: 2804225 - RNA, 13 nt, Human
uccuaagcaucua

SEQ ID NO: 2804226 - RNA, 14 nt, Human
uccuaagcaucuaa

SEQ ID NO: 2804227 - RNA, 16 nt, Human
uccggaaugccaccca

SEQ ID NO: 2804228 - RNA, 18 nt, Human
uccggaaugccacccaca

SEQ ID NO: 2804229 - RNA, 17 nt, Human
uccggaaugccacccac

SEQ ID NO: 2804230 - RNA, 15 nt, Human
uccggaguagcuggg

SEQ ID NO: 2804231 - RNA, 16 nt, Human
uccggauccuaagcau

SEQ ID NO: 2804232 - RNA, 15 nt, Human
uccggacacuccuag

SEQ ID NO: 2804233 - RNA, 18 nt, Human
uccggacacuccuagaga

SEQ ID NO: 2804234 - RNA, 15 nt, Human
uccuauccacugggc

SEQ ID NO: 2804235 - RNA, 17 nt, Human
uccuauccacugggcac

SEQ ID NO: 2804236 - RNA, 21 nt, Human
uccuauccacugggcacaacu

SEQ ID NO: 2804237 - RNA, 15 nt, Human
uccuaagcaucuaag

SEQ ID NO: 2804238 - RNA, 16 nt, Human
uccuaagcaucuaagu

SEQ ID NO: 2804239 - RNA, 17 nt, Human
uccuaucuaucuuccaa

SEQ ID NO: 2804240 - RNA, 17 nt, Human
uccuaagcaucuaaguu

SEQ ID NO: 2804241 - RNA, 15 nt, Human
uccuaugaaugcuuu

SEQ ID NO: 2804242 - RNA, 17 nt, Human
uccuaugaaugcuuugc

SEQ ID NO: 2804243 - RNA, 18 nt, Human
uccuaugaaugcuuugca

SEQ ID NO: 2804244 - RNA, 12 nt, Human
uccuaugcaaua

SEQ ID NO: 2804245 - RNA, 13 nt, Human
uccuaugcaauaa

SEQ ID NO: 2804246 - RNA, 16 nt, Human
uccuaugcaauaaaau

SEQ ID NO: 2804247 - RNA, 13 nt, Human
uccuauggaaacc

SEQ ID NO: 2804248 - RNA, 16 nt, Human
uccuauuugcacugua

SEQ ID NO: 2804249 - RNA, 18 nt, Human
uccuauuugccaugggcu

SEQ ID NO: 2804250 - RNA, 15 nt, Human
uccuauuucuuauag

SEQ ID NO: 2804251 - RNA, 13 nt, Human
uccuauuucagua

SEQ ID NO: 2804252 - RNA, 16 nt, Human
uccuauuucaguacuu

SEQ ID NO: 2804253 - RNA, 21 nt, Human
uccuauuucaguacuucagca

SEQ ID NO: 2804254 - RNA, 18 nt, Human
uccuauuucuagggcugg

SEQ ID NO: 2804255 - RNA, 16 nt, Human
uccuccguccagccgc

SEQ ID NO: 2804256 - RNA, 14 nt, Human
uccuccguccagcc

SEQ ID NO: 2804257 - RNA, 18 nt, Human
uccuccguccagccgcca

SEQ ID NO: 2804258 - RNA, 17 nt, Human
uccuauuuguuuucaug

SEQ ID NO: 2804259 - RNA, 14 nt, Human
uccuauuuguuuuc

SEQ ID NO: 2804260 - RNA, 16 nt, Human
uccuauuuguuuucau

SEQ ID NO: 2804261 - RNA, 13 nt, Human
uccuauuuuugua

SEQ ID NO: 2804262 - RNA, 14 nt, Human
uccuauuuuuguaa

SEQ ID NO: 2804263 - RNA, 17 nt, Human
uccuauuuuuguaaacu

SEQ ID NO: 2804264 - RNA, 17 nt, Human
uccuccgguugcauacu

SEQ ID NO: 2804265 - RNA, 20 nt, Human
uccuccgguugcauacugga

SEQ ID NO: 2804266 - RNA, 23 nt, Human
uccuccgguugcauacuggacuc

SEQ ID NO: 2804267 - RNA, 17 nt, Human
uccuccaguaccuugcu

SEQ ID NO: 2804268 - RNA, 18 nt, Human
uccuccaguaccuugcuu

SEQ ID NO: 2804269 - RNA, 18 nt, Human
uccucccuuuccuuccua

SEQ ID NO: 2804270 - RNA, 19 nt, Human
uccucccuuuccuuccuaa

SEQ ID NO: 2804271 - RNA, 21 nt, Human
uccgcccacaggaagccugca

SEQ ID NO: 2804272 - RNA, 11 nt, Human
uccgcccccag

SEQ ID NO: 2804273 - RNA, 12 nt, Human
uccgcccccagc

SEQ ID NO: 2804274 - RNA, 13 nt, Human
uccgcccccagcc

SEQ ID NO: 2804275 - RNA, 14 nt, Human
uccgcccccagccu

SEQ ID NO: 2804276 - RNA, 15 nt, Human
uccgcccccagccua

SEQ ID NO: 2804277 - RNA, 16 nt, Human
uccgcccccagccuau

SEQ ID NO: 2804278 - RNA, 21 nt, Human
uccgcuuucuacccagcgagc

SEQ ID NO: 2804279 - RNA, 13 nt, Human
uccgccccugccu

SEQ ID NO: 2804280 - RNA, 14 nt, Human
uccgccccugccug

SEQ ID NO: 2804281 - RNA, 15 nt, Human
uccgccccugccugc

SEQ ID NO: 2804282 - RNA, 16 nt, Human
uccgccccugccugcc

SEQ ID NO: 2804283 - RNA, 19 nt, Human
uccgccccugccugccaug

SEQ ID NO: 2804284 - RNA, 15 nt, Human
uccgccccuucccuu

SEQ ID NO: 2804285 - RNA, 17 nt, Human
uccgccccuucccuucc

SEQ ID NO: 2804286 - RNA, 22 nt, Human
uccgaaagggacuuggaagcuc

SEQ ID NO: 2804287 - RNA, 19 nt, Human
uccgaacacccucgaagcg

SEQ ID NO: 2804288 - RNA, 15 nt, Human
uccgacccucuggga

SEQ ID NO: 2804289 - RNA, 17 nt, Human
uccgacccucugggaac

SEQ ID NO: 2804290 - RNA, 18 nt, Human
uccgacccucugggaacc

SEQ ID NO: 2804291 - RNA, 21 nt, Human
uccgacccucugggaaccucc

SEQ ID NO: 2804292 - RNA, 21 nt, Human
uccgaaagggacuuggaagcu

SEQ ID NO: 2804293 - RNA, 17 nt, Human
ucccuugaaauuuuaaa

SEQ ID NO: 2804294 - RNA, 17 nt, Human
ucccuugaccaggccug

SEQ ID NO: 2804295 - RNA, 21 nt, Human
ucccuugaccaggccugggcc

SEQ ID NO: 2804296 - RNA, 17 nt, Human
ucccuucuuuuucuucu

SEQ ID NO: 2804297 - RNA, 13 nt, Human
ucccuucuugcau

SEQ ID NO: 2804298 - RNA, 16 nt, Human
ucccuucuugcauccu

SEQ ID NO: 2804299 - RNA, 23 nt, Human
ucccuucuugcauccuuccuaua

SEQ ID NO: 2804300 - RNA, 22 nt, Human
ucccuucugucccucacagcac

SEQ ID NO: 2804301 - RNA, 17 nt, Human
ucccuucugucccucac

SEQ ID NO: 2804302 - RNA, 20 nt, Human
ucccuggggaaaacuugcag

SEQ ID NO: 2804303 - RNA, 16 nt, Human
ucccuucugucccuca

SEQ ID NO: 2804304 - RNA, 16 nt, Human
ucccugggccaggguc

SEQ ID NO: 2804305 - RNA, 17 nt, Human
ucccugggccagggucu

SEQ ID NO: 2804306 - RNA, 18 nt, Human
ucccugggccagggucug

SEQ ID NO: 2804307 - RNA, 24 nt, Human
ucccugggccagggucugugugaa

SEQ ID NO: 2804308 - RNA, 14 nt, Human
ucccugggaggccc

SEQ ID NO: 2804309 - RNA, 14 nt, Human
ucccuggcucccau

SEQ ID NO: 2804310 - RNA, 12 nt, Human
ucccugcccagg

SEQ ID NO: 2804311 - RNA, 13 nt, Human
ucccugcccaggc

SEQ ID NO: 2804312 - RNA, 16 nt, Human
ucccugcccaggccgg

SEQ ID NO: 2804313 - RNA, 19 nt, Human
ucccugcccaggccggcca

SEQ ID NO: 2804314 - RNA, 16 nt, Human
ucccugcccauuucau

SEQ ID NO: 2804315 - RNA, 13 nt, Human
ucccugccccaaa

SEQ ID NO: 2804316 - RNA, 18 nt, Human
ucccugccccucccuuca

SEQ ID NO: 2804317 - RNA, 18 nt, Human
ucccucuguccaccagcc

SEQ ID NO: 2804318 - RNA, 12 nt, Human
ucccugccagag

SEQ ID NO: 2804319 - RNA, 14 nt, Human
ucccugcauuucug

SEQ ID NO: 2804320 - RNA, 17 nt, Human
ucccugcauuucugagu

SEQ ID NO: 2804321 - RNA, 15 nt, Human
ucccugccaaacuga

SEQ ID NO: 2804322 - RNA, 14 nt, Human
ucccugccccuccc

SEQ ID NO: 2804323 - RNA, 16 nt, Human
ucccugccccccagcc

SEQ ID NO: 2804324 - RNA, 20 nt, Human
ucccugcacuugcagacucu

SEQ ID NO: 2804325 - RNA, 23 nt, Human
ucccugcagaugccacccuagcc

SEQ ID NO: 2804326 - RNA, 22 nt, Human
ucccugcagaugccacccuagc

SEQ ID NO: 2804327 - RNA, 16 nt, Human
ucccugcagaugccac

SEQ ID NO: 2804328 - RNA, 12 nt, Human
ucccucuucacu

SEQ ID NO: 2804329 - RNA, 15 nt, Human
ucccucuucacuccc

SEQ ID NO: 2804330 - RNA, 16 nt, Human
ucccucuucacucccc

SEQ ID NO: 2804331 - RNA, 15 nt, Human
ucccucuucccucag

SEQ ID NO: 2804332 - RNA, 12 nt, Human
ucccucugcuca

SEQ ID NO: 2804333 - RNA, 13 nt, Human
ucccucugcucag

SEQ ID NO: 2804334 - RNA, 14 nt, Human
ucccucugcucagc

SEQ ID NO: 2804335 - RNA, 15 nt, Human
ucccucugcucagcc

SEQ ID NO: 2804336 - RNA, 16 nt, Human
ucccucugcucagcca

SEQ ID NO: 2804337 - RNA, 18 nt, Human
ucccucugcucagccaag

SEQ ID NO: 2804338 - RNA, 21 nt, Human
ucccucugcucagccaagcuu

SEQ ID NO: 2804339 - RNA, 19 nt, Human
ucccucugaccugcaggcc

SEQ ID NO: 2804340 - RNA, 18 nt, Human
ucccucugaccugcaggc

SEQ ID NO: 2804341 - RNA, 17 nt, Human
ucccucugaccugcagg

SEQ ID NO: 2804342 - RNA, 13 nt, Human
ucccucugaccug

SEQ ID NO: 2804343 - RNA, 23 nt, Human
ucccucucucuucugcuccaccc

SEQ ID NO: 2804344 - RNA, 13 nt, Human
ucccucuauuuau

SEQ ID NO: 2804345 - RNA, 19 nt, Human
ucccucuauuuauguuugc

SEQ ID NO: 2804346 - RNA, 16 nt, Human
ucccucucaggaucca

SEQ ID NO: 2804347 - RNA, 13 nt, Human
ucccuccucaccu

SEQ ID NO: 2804348 - RNA, 18 nt, Human
ucccucuaggcucugccu

SEQ ID NO: 2804349 - RNA, 20 nt, Human
ucccucuaggcucugccuuc

SEQ ID NO: 2804350 - RNA, 20 nt, Human
ucccucucucuucugcucca

SEQ ID NO: 2804351 - RNA, 21 nt, Human
ucccucucucuucugcuccac

SEQ ID NO: 2804352 - RNA, 14 nt, Human
ucccucucaucuca

SEQ ID NO: 2804353 - RNA, 17 nt, Human
ucccucucaucucaggu

SEQ ID NO: 2804354 - RNA, 13 nt, Human
ucccuagcaguga

SEQ ID NO: 2804355 - RNA, 15 nt, Human
ucccuagcagugaac

SEQ ID NO: 2804356 - RNA, 16 nt, Human
ucccuagcagugaacu

SEQ ID NO: 2804357 - RNA, 16 nt, Human
ucccuagccagcacuu

SEQ ID NO: 2804358 - RNA, 17 nt, Human
ucccuagccagcacuug

SEQ ID NO: 2804359 - RNA, 20 nt, Human
ucccuagccagcacuuguau

SEQ ID NO: 2804360 - RNA, 22 nt, Human
ucccuagccagcacuuguauau

SEQ ID NO: 2804361 - RNA, 16 nt, Human
ucccuagaucuuucua

SEQ ID NO: 2804362 - RNA, 23 nt, Human
ucccuagaucuuucuauuccaaa

SEQ ID NO: 2804363 - RNA, 17 nt, Human
ucccuacuuccugugac

SEQ ID NO: 2804364 - RNA, 12 nt, Human
ucccuagacuuu

SEQ ID NO: 2804365 - RNA, 13 nt, Human
ucccuagacuuua

SEQ ID NO: 2804366 - RNA, 14 nt, Human
ucccuagacuuuag

SEQ ID NO: 2804367 - RNA, 20 nt, Human
ucccuagacuuuaggcuuuc

SEQ ID NO: 2804368 - RNA, 22 nt, Human
ucccuagacuuuaggcuuucag

SEQ ID NO: 2804369 - RNA, 14 nt, Human
ucccucccuugggg

SEQ ID NO: 2804370 - RNA, 13 nt, Human
ucccucccuuggg

SEQ ID NO: 2804371 - RNA, 12 nt, Human
ucccuccucacc

SEQ ID NO: 2804372 - RNA, 22 nt, Human
ucccuagaaaacaaugcaaaac

SEQ ID NO: 2804373 - RNA, 19 nt, Human
ucccuccggcuugaccugu

SEQ ID NO: 2804374 - RNA, 22 nt, Human
ucccaugagccucagcauccug

SEQ ID NO: 2804375 - RNA, 17 nt, Human
ucccaugagccucagca

SEQ ID NO: 2804376 - RNA, 19 nt, Human
ucccaugacccaggcuggg

SEQ ID NO: 2804377 - RNA, 20 nt, Human
ucccuacccccuaagagcca

SEQ ID NO: 2804378 - RNA, 19 nt, Human
ucccuacccccuaagagcc

SEQ ID NO: 2804379 - RNA, 15 nt, Human
ucccaugcaggcccu

SEQ ID NO: 2804380 - RNA, 16 nt, Human
ucccaugcaggcccuu

SEQ ID NO: 2804381 - RNA, 19 nt, Human
ucccuaccgagucucuucu

SEQ ID NO: 2804382 - RNA, 21 nt, Human
ucccuaccgagucucuucucc

SEQ ID NO: 2804383 - RNA, 22 nt, Human
ucccuaccgagucucuucucca

SEQ ID NO: 2804384 - RNA, 23 nt, Human
ucccuaccgagucucuucuccac

SEQ ID NO: 2804385 - RNA, 16 nt, Human
ugccugguggcagcug

SEQ ID NO: 2804386 - RNA, 15 nt, Human
ugccugguggcagcu

SEQ ID NO: 2804387 - RNA, 14 nt, Human
ugccugguggcagc

SEQ ID NO: 2804388 - RNA, 18 nt, Human
ugccuguaauucagugua

SEQ ID NO: 2804389 - RNA, 20 nt, Human
ugccuggugcuuccaaauau

SEQ ID NO: 2804390 - RNA, 13 nt, Human
ugccuguaaacau

SEQ ID NO: 2804391 - RNA, 15 nt, Human
ugccuguaaacauag

SEQ ID NO: 2804392 - RNA, 23 nt, Human
ugccuguagcccacucugcucgc

SEQ ID NO: 2804393 - RNA, 20 nt, Human
ugccuguagcccacucugcu

SEQ ID NO: 2804394 - RNA, 18 nt, Human
ugccuguagcccacucug

SEQ ID NO: 2804395 - RNA, 13 nt, Human
ugccuguaguuag

SEQ ID NO: 2804396 - RNA, 15 nt, Human
ugccuguagcaguga

SEQ ID NO: 2804397 - RNA, 14 nt, Human
ugccugugaacuga

SEQ ID NO: 2804398 - RNA, 22 nt, Human
ugccuggcuucgcaaaauguuu

SEQ ID NO: 2804399 - RNA, 19 nt, Human
ugccuggugcacugugucu

SEQ ID NO: 2804400 - RNA, 17 nt, Human
ugccuggugaauggccu

SEQ ID NO: 2804401 - RNA, 18 nt, Human
ugccuggugaauggccuu

SEQ ID NO: 2804402 - RNA, 21 nt, Human
ugccugacugcccagcauuug

SEQ ID NO: 2804403 - RNA, 23 nt, Human
ugccugacccuacuucuuuugcu

SEQ ID NO: 2804404 - RNA, 19 nt, Human
ugccucgaacuggcugcaa

SEQ ID NO: 2804405 - RNA, 18 nt, Human
ugccucgaacuggcugca

SEQ ID NO: 2804406 - RNA, 20 nt, Human
ugccucgaacuggcugcaaa

SEQ ID NO: 2804407 - RNA, 12 nt, Human
ugccucucacac

SEQ ID NO: 2804408 - RNA, 13 nt, Human
ugccucucacaca

SEQ ID NO: 2804409 - RNA, 15 nt, Human
ugccucucacacaca

SEQ ID NO: 2804410 - RNA, 19 nt, Human
ugccucucacacacauaga

SEQ ID NO: 2804411 - RNA, 21 nt, Human
ugccucgaaacacagaaaccu

SEQ ID NO: 2804412 - RNA, 22 nt, Human
ugccccuucauugauuuccugu

SEQ ID NO: 2804413 - RNA, 23 nt, Human
ugccucgaaacacagaaaccuuu

SEQ ID NO: 2804414 - RNA, 13 nt, Human
ugccugaagaaca

SEQ ID NO: 2804415 - RNA, 13 nt, Human
ugccuucuucagg

SEQ ID NO: 2804416 - RNA, 14 nt, Human
ugccuucuucaggg

SEQ ID NO: 2804417 - RNA, 15 nt, Human
ugccuucuucagggc

SEQ ID NO: 2804418 - RNA, 17 nt, Human
ugccuucuucagggccu

SEQ ID NO: 2804419 - RNA, 18 nt, Human
ugccuucuucagggccug

SEQ ID NO: 2804420 - RNA, 19 nt, Human
ugccuucuucagggccugg

SEQ ID NO: 2804421 - RNA, 20 nt, Human
ugccuucuucagggccuggu

SEQ ID NO: 2804422 - RNA, 16 nt, Human
ugccuucuuuugauua

SEQ ID NO: 2804423 - RNA, 13 nt, Human
ugccuucuuuugu

SEQ ID NO: 2804424 - RNA, 14 nt, Human
ugccuucuuuugua

SEQ ID NO: 2804425 - RNA, 12 nt, Human
ugccuucuuuga

SEQ ID NO: 2804426 - RNA, 13 nt, Human
ugccuucuuugaa

SEQ ID NO: 2804427 - RNA, 14 nt, Human
ugccuucuuugaag

SEQ ID NO: 2804428 - RNA, 15 nt, Human
ugccuucuuugaaga

SEQ ID NO: 2804429 - RNA, 16 nt, Human
ugccuucuuugaagaa

SEQ ID NO: 2804430 - RNA, 17 nt, Human
ugccuucuuugaagaag

SEQ ID NO: 2804431 - RNA, 20 nt, Human
ugccuucuuugaagaaggug

SEQ ID NO: 2804432 - RNA, 21 nt, Human
ugccugugaacugaacucuga

SEQ ID NO: 2804433 - RNA, 18 nt, Human
ugccugugaacugaacuc

SEQ ID NO: 2804434 - RNA, 17 nt, Human
ugccugugaacugaacu

SEQ ID NO: 2804435 - RNA, 21 nt, Human
ugcgaucuggguucacugcaa

SEQ ID NO: 2804436 - RNA, 20 nt, Human
ugcgaucuggguucacugca

SEQ ID NO: 2804437 - RNA, 19 nt, Human
ugcgaucuggguucacugc

SEQ ID NO: 2804438 - RNA, 15 nt, Human
ugcgaucuggguuca

SEQ ID NO: 2804439 - RNA, 14 nt, Human
ugcgaucuggguuc

SEQ ID NO: 2804440 - RNA, 13 nt, Human
ugcgauagagucu

SEQ ID NO: 2804441 - RNA, 19 nt, Human
ugcgaucucggcucagugc

SEQ ID NO: 2804442 - RNA, 14 nt, Human
ugcgauagagucuc

SEQ ID NO: 2804443 - RNA, 16 nt, Human
ugcgauagagucucac

SEQ ID NO: 2804444 - RNA, 14 nt, Human
ugccuugaagccac

SEQ ID NO: 2804445 - RNA, 17 nt, Human
ugccuugaaccugugag

SEQ ID NO: 2804446 - RNA, 18 nt, Human
ugccuugaaccugugagu

SEQ ID NO: 2804447 - RNA, 19 nt, Human
ugccuugaaccugugagua

SEQ ID NO: 2804448 - RNA, 23 nt, Human
ugccuugaaccugugaguaaaua

SEQ ID NO: 2804449 - RNA, 15 nt, Human
ugccuugaagccacu

SEQ ID NO: 2804450 - RNA, 12 nt, Human
ugccuugaauaa

SEQ ID NO: 2804451 - RNA, 15 nt, Human
ugccuugaauaauaa

SEQ ID NO: 2804452 - RNA, 22 nt, Human
ugcuaaauggucgcccaggaga

SEQ ID NO: 2804453 - RNA, 21 nt, Human
ugcuaaauggucgcccaggag

SEQ ID NO: 2804454 - RNA, 20 nt, Human
ugcuaaauggucgcccagga

SEQ ID NO: 2804455 - RNA, 22 nt, Human
ugcuaagacucaguggggaggg

SEQ ID NO: 2804456 - RNA, 16 nt, Human
ugcgccuacaggagug

SEQ ID NO: 2804457 - RNA, 14 nt, Human
ugcgccuacaggag

SEQ ID NO: 2804458 - RNA, 22 nt, Human
ugcgccuacaggagugagcacu

SEQ ID NO: 2804459 - RNA, 17 nt, Human
ugcgccucaggcugcug

SEQ ID NO: 2804460 - RNA, 12 nt, Human
ugcgucccaaga

SEQ ID NO: 2804461 - RNA, 14 nt, Human
ugcgucuuccgccc

SEQ ID NO: 2804462 - RNA, 19 nt, Human
ugcgucuuccgccccugcc

SEQ ID NO: 2804463 - RNA, 20 nt, Human
ugcgucuuccgccccugccu

SEQ ID NO: 2804464 - RNA, 21 nt, Human
ugcgucuuccgccccugccug

SEQ ID NO: 2804465 - RNA, 12 nt, Human
ugcgugaaugua

SEQ ID NO: 2804466 - RNA, 20 nt, Human
ugcgugaauguauguaaugu

SEQ ID NO: 2804467 - RNA, 15 nt, Human
ugcgugacacucucc

SEQ ID NO: 2804468 - RNA, 19 nt, Human
ugcgugacacucuccuugc

SEQ ID NO: 2804469 - RNA, 20 nt, Human
ugcgugacacucuccuugca

SEQ ID NO: 2804470 - RNA, 21 nt, Human
ugcgugacacucuccuugcag

SEQ ID NO: 2804471 - RNA, 22 nt, Human
ugcgugacacucuccuugcagu

SEQ ID NO: 2804472 - RNA, 17 nt, Human
ugcucacaacuuagugu

SEQ ID NO: 2804473 - RNA, 15 nt, Human
ugcucacaguaaccc

SEQ ID NO: 2804474 - RNA, 21 nt, Human
ugcucaauaaaugauucuuag

SEQ ID NO: 2804475 - RNA, 20 nt, Human
ugcuaagcaagcuaaccuua

SEQ ID NO: 2804476 - RNA, 16 nt, Human
ugcucacauaucuguc

SEQ ID NO: 2804477 - RNA, 15 nt, Human
ugcucacauaucugu

SEQ ID NO: 2804478 - RNA, 17 nt, Human
ugcucagaccagcucuu

SEQ ID NO: 2804479 - RNA, 20 nt, Human
ugcucagagaccugaagugu

SEQ ID NO: 2804480 - RNA, 16 nt, Human
ugcucagaccagcucu

SEQ ID NO: 2804481 - RNA, 17 nt, Human
ugcucaguaauuugagg

SEQ ID NO: 2804482 - RNA, 21 nt, Human
ugcucaguggguaaaauuaga

SEQ ID NO: 2804483 - RNA, 23 nt, Human
ugcucaguggguaaaauuagaug

SEQ ID NO: 2804484 - RNA, 20 nt, Human
ugcucagggucaauuucuuu

SEQ ID NO: 2804485 - RNA, 16 nt, Human
ugcucagggucaauuu

SEQ ID NO: 2804486 - RNA, 14 nt, Human
ugcuccucucccca

SEQ ID NO: 2804487 - RNA, 19 nt, Human
ugcuccuccuuggugccug

SEQ ID NO: 2804488 - RNA, 23 nt, Human
ugcuccuccuuggugccuggccu

SEQ ID NO: 2804489 - RNA, 22 nt, Human
ugcucagggaaaagcagcucuc

SEQ ID NO: 2804490 - RNA, 21 nt, Human
ugcucagggaaaagcagcucu

SEQ ID NO: 2804491 - RNA, 19 nt, Human
ugcucagggaaaagcagcu

SEQ ID NO: 2804492 - RNA, 12 nt, Human
ugcucagccaag

SEQ ID NO: 2804493 - RNA, 14 nt, Human
ugcucagccaagcu

SEQ ID NO: 2804494 - RNA, 22 nt, Human
ugcucuccucuugccacugccu

SEQ ID NO: 2804495 - RNA, 18 nt, Human
ugcugaacaaaaaauaaa

SEQ ID NO: 2804496 - RNA, 15 nt, Human
ugcugaacaaaaaau

SEQ ID NO: 2804497 - RNA, 18 nt, Human
ugcucuccaagucucagu

SEQ ID NO: 2804498 - RNA, 19 nt, Human
ugcucuccaagucucagug

SEQ ID NO: 2804499 - RNA, 13 nt, Human
ugcucuccccugc

SEQ ID NO: 2804500 - RNA, 12 nt, Human
ugcucuccccug

SEQ ID NO: 2804501 - RNA, 20 nt, Human
ugcucuccaagucucagugg

SEQ ID NO: 2804502 - RNA, 20 nt, Human
ugcucuccagccugggaggc

SEQ ID NO: 2804503 - RNA, 16 nt, Human
ugcucuccucuugcca

SEQ ID NO: 2804504 - RNA, 14 nt, Human
ugcucuccccugcc

SEQ ID NO: 2804505 - RNA, 14 nt, Human
ugcucuccucuugc

SEQ ID NO: 2804506 - RNA, 18 nt, Human
ugcucuccucuugccacu

SEQ ID NO: 2804507 - RNA, 21 nt, Human
ugcucuccucuugccacugcc

SEQ ID NO: 2804508 - RNA, 17 nt, Human
ugcuccucuccccagca

SEQ ID NO: 2804509 - RNA, 14 nt, Human
ugcuccuuuccccu

SEQ ID NO: 2804510 - RNA, 23 nt, Human
ugcucgcccuccuuucugugccc

SEQ ID NO: 2804511 - RNA, 17 nt, Human
ugcucuaucucucaaaa

SEQ ID NO: 2804512 - RNA, 22 nt, Human
ugcucucaccagcugcugcucu

SEQ ID NO: 2804513 - RNA, 16 nt, Human
ugcugcaaacuuaaug

SEQ ID NO: 2804514 - RNA, 16 nt, Human
ugcugauuuccccucu

SEQ ID NO: 2804515 - RNA, 19 nt, Human
ugcugauuuccccucuucc

SEQ ID NO: 2804516 - RNA, 14 nt, Human
ugcugauggucugg

SEQ ID NO: 2804517 - RNA, 19 nt, Human
ugcugauggucuggucuau

SEQ ID NO: 2804518 - RNA, 18 nt, Human
ugcugauuuggugaccaa

SEQ ID NO: 2804519 - RNA, 12 nt, Human
ugcugauuuuaa

SEQ ID NO: 2804520 - RNA, 13 nt, Human
ugcugauuuuaau

SEQ ID NO: 2804521 - RNA, 14 nt, Human
ugcugauuuuaaug

SEQ ID NO: 2804522 - RNA, 16 nt, Human
ugcugauuuuaaugga

SEQ ID NO: 2804523 - RNA, 15 nt, Human
ugcugacagcugacc

SEQ ID NO: 2804524 - RNA, 20 nt, Human
ugcugacauggcucuggacu

SEQ ID NO: 2804525 - RNA, 23 nt, Human
ugcugaaggaauaaauugcuccu

SEQ ID NO: 2804526 - RNA, 20 nt, Human
ugcugaacaaaaaauaaaaa

SEQ ID NO: 2804527 - RNA, 23 nt, Human
ugcugacagacacaggcccggcu

SEQ ID NO: 2804528 - RNA, 22 nt, Human
ugcugacagacacaggcccggc

SEQ ID NO: 2804529 - RNA, 15 nt, Human
ugcugcaugccuggu

SEQ ID NO: 2804530 - RNA, 23 nt, Human
ugcugcaucuuauagcacuuuga

SEQ ID NO: 2804531 - RNA, 20 nt, Human
ugcugcgcccuuaccuuccc

SEQ ID NO: 2804532 - RNA, 16 nt, Human
ugcugcgcccuuaccu

SEQ ID NO: 2804533 - RNA, 21 nt, Human
ugcugccuuuucuuuaacuuu

SEQ ID NO: 2804534 - RNA, 17 nt, Human
ugcugcugcugcgcccu

SEQ ID NO: 2804535 - RNA, 12 nt, Human
ugcugcuagaac

SEQ ID NO: 2804536 - RNA, 13 nt, Human
ugcugcuagaacu

SEQ ID NO: 2804537 - RNA, 14 nt, Human
ugcugcuagaacuu

SEQ ID NO: 2804538 - RNA, 15 nt, Human
ugcugcuagaacuuu

SEQ ID NO: 2804539 - RNA, 16 nt, Human
ugcugcuagaacuuuu

SEQ ID NO: 2804540 - RNA, 17 nt, Human
ugcugcuagaacuuuuu

SEQ ID NO: 2804541 - RNA, 19 nt, Human
ugcugcuagaacuuuuuua

SEQ ID NO: 2804542 - RNA, 20 nt, Human
ugcugcuagaacuuuuuuaa

SEQ ID NO: 2804543 - RNA, 13 nt, Human
ugcugcugucacc

SEQ ID NO: 2804544 - RNA, 21 nt, Human
ugcugcaaggacauucuugua

SEQ ID NO: 2804545 - RNA, 19 nt, Human
ugcugcuuuuauaucugua

SEQ ID NO: 2804546 - RNA, 17 nt, Human
ugcuggaaccugcaaaa

SEQ ID NO: 2804547 - RNA, 19 nt, Human
ugcuggaaccugcaaaaaa

SEQ ID NO: 2804548 - RNA, 13 nt, Human
ugcugcugucccu

SEQ ID NO: 2804549 - RNA, 20 nt, Human
ugcugcuuagacauaacaaa

SEQ ID NO: 2804550 - RNA, 14 nt, Human
ugcacggcugcuga

SEQ ID NO: 2804551 - RNA, 15 nt, Human
ugcacggcugcugag

SEQ ID NO: 2804552 - RNA, 16 nt, Human
ugcacugacccuucca

SEQ ID NO: 2804553 - RNA, 17 nt, Human
ugcacugacccuuccag

SEQ ID NO: 2804554 - RNA, 20 nt, Human
ugcacugacccuuccagaca

SEQ ID NO: 2804555 - RNA, 23 nt, Human
ugcacugacccuuccagacauac

SEQ ID NO: 2804556 - RNA, 13 nt, Human
ugcacgcagauua

SEQ ID NO: 2804557 - RNA, 21 nt, Human
ugcacgcagauuagcaggcca

SEQ ID NO: 2804558 - RNA, 19 nt, Human
ugcacgcgcccuuucuacc

SEQ ID NO: 2804559 - RNA, 20 nt, Human
ugcacgcgcccuuucuacca

SEQ ID NO: 2804560 - RNA, 13 nt, Human
ugcacggcugcug

SEQ ID NO: 2804561 - RNA, 15 nt, Human
ugcaccgggccacag

SEQ ID NO: 2804562 - RNA, 14 nt, Human
ugcaccgggccaca

SEQ ID NO: 2804563 - RNA, 22 nt, Human
ugcaccgggccacagagaaagu

SEQ ID NO: 2804564 - RNA, 17 nt, Human
ugcaccgggccacagag

SEQ ID NO: 2804565 - RNA, 13 nt, Human
ugcagcagauugg

SEQ ID NO: 2804566 - RNA, 16 nt, Human
ugcagcagauuggaag

SEQ ID NO: 2804567 - RNA, 22 nt, Human
ugcagcagauuggaaggagaca

SEQ ID NO: 2804568 - RNA, 23 nt, Human
ugcagcagauuggaaggagacac

SEQ ID NO: 2804569 - RNA, 16 nt, Human
ugcagcacggacaaua

SEQ ID NO: 2804570 - RNA, 17 nt, Human
ugcagcacggacaauaa

SEQ ID NO: 2804571 - RNA, 18 nt, Human
ugcagcacggacaauaaa

SEQ ID NO: 2804572 - RNA, 19 nt, Human
ugcagcacggacaauaaac

SEQ ID NO: 2804573 - RNA, 20 nt, Human
ugcagcacggacaauaaacc

SEQ ID NO: 2804574 - RNA, 22 nt, Human
ugcagcacggacaauaaaccuc

SEQ ID NO: 2804575 - RNA, 16 nt, Human
ugcagcaaucuuugaa

SEQ ID NO: 2804576 - RNA, 17 nt, Human
ugcagcaaucuuugaaa

SEQ ID NO: 2804577 - RNA, 18 nt, Human
ugcagcaauuaaaaauug

SEQ ID NO: 2804578 - RNA, 22 nt, Human
ugcagcaauuaaaaauugucuu

SEQ ID NO: 2804579 - RNA, 23 nt, Human
ugcagagcaccuuugcacaggau

SEQ ID NO: 2804580 - RNA, 21 nt, Human
ugcagagcaggaaacaugacu

SEQ ID NO: 2804581 - RNA, 13 nt, Human
ugcagaggggaaa

SEQ ID NO: 2804582 - RNA, 17 nt, Human
ugcacuuugaugucaug

SEQ ID NO: 2804583 - RNA, 19 nt, Human
ugcacuuugaugucaugug

SEQ ID NO: 2804584 - RNA, 20 nt, Human
ugcacuuugaugucaugugu

SEQ ID NO: 2804585 - RNA, 19 nt, Human
ugcacuuucuaauguuucu

SEQ ID NO: 2804586 - RNA, 12 nt, Human
ugcacuuuguaa

SEQ ID NO: 2804587 - RNA, 13 nt, Human
ugcacuuuguaaa

SEQ ID NO: 2804588 - RNA, 14 nt, Human
ugcacuuuguaaau

SEQ ID NO: 2804589 - RNA, 15 nt, Human
ugcacuuuguaaauu

SEQ ID NO: 2804590 - RNA, 16 nt, Human
ugcacuuuguaaauuc

SEQ ID NO: 2804591 - RNA, 17 nt, Human
ugcacuuuguaaauucc

SEQ ID NO: 2804592 - RNA, 12 nt, Human
ugcacuuuguag

SEQ ID NO: 2804593 - RNA, 13 nt, Human
ugcacuuuguagu

SEQ ID NO: 2804594 - RNA, 15 nt, Human
ugcacuuuguagugu

SEQ ID NO: 2804595 - RNA, 18 nt, Human
ugcacuuuguaguguuug

SEQ ID NO: 2804596 - RNA, 21 nt, Human
ugcacuugugauuauuuauua

SEQ ID NO: 2804597 - RNA, 16 nt, Human
ugcacuguaugcugga

SEQ ID NO: 2804598 - RNA, 15 nt, Human
ugcacuguaugcugg

SEQ ID NO: 2804599 - RNA, 16 nt, Human
ugcacuggggagcccg

SEQ ID NO: 2804600 - RNA, 20 nt, Human
ugcacuggggagcccgucuc

SEQ ID NO: 2804601 - RNA, 15 nt, Human
ugcaggccaggccag

SEQ ID NO: 2804602 - RNA, 21 nt, Human
ugcaggccaagagcagaggca

SEQ ID NO: 2804603 - RNA, 20 nt, Human
ugcaggccaagagcagaggc

SEQ ID NO: 2804604 - RNA, 16 nt, Human
ugcaggcaucacagcu

SEQ ID NO: 2804605 - RNA, 17 nt, Human
ugcagugauauggcaga

SEQ ID NO: 2804606 - RNA, 20 nt, Human
ugcagugauauggcagaaga

SEQ ID NO: 2804607 - RNA, 23 nt, Human
ugcagugauauggcagaagacac

SEQ ID NO: 2804608 - RNA, 21 nt, Human
ugcagugauauggcagaagac

SEQ ID NO: 2804609 - RNA, 22 nt, Human
ugcagugauauggcagaagaca

SEQ ID NO: 2804610 - RNA, 20 nt, Human
ugcaggcacuuauuguaaau

SEQ ID NO: 2804611 - RNA, 21 nt, Human
ugcagcaggaucuagaggggg

SEQ ID NO: 2804612 - RNA, 13 nt, Human
ugcagcaggagug

SEQ ID NO: 2804613 - RNA, 14 nt, Human
ugcagcaggagugg

SEQ ID NO: 2804614 - RNA, 20 nt, Human
ugcagcaggaguggugcaga

SEQ ID NO: 2804615 - RNA, 22 nt, Human
ugcagcaggaguggugcagaca

SEQ ID NO: 2804616 - RNA, 23 nt, Human
ugcagcaggaguggugcagacag

SEQ ID NO: 2804617 - RNA, 16 nt, Human
ugcagcauggucccug

SEQ ID NO: 2804618 - RNA, 18 nt, Human
ugcagcauggucccugcc

SEQ ID NO: 2804619 - RNA, 19 nt, Human
ugcagcauggucccugccu

SEQ ID NO: 2804620 - RNA, 21 nt, Human
ugcagaggaaguacaaacuaa

SEQ ID NO: 2804621 - RNA, 19 nt, Human
ugcaggauuuguucucugu

SEQ ID NO: 2804622 - RNA, 22 nt, Human
ugcagugguaugaucacggcuc

SEQ ID NO: 2804623 - RNA, 17 nt, Human
ugcaguggcucacgccu

SEQ ID NO: 2804624 - RNA, 13 nt, Human
ugcagugggguuu

SEQ ID NO: 2804625 - RNA, 21 nt, Human
ugcagugggguuucgcagccu

SEQ ID NO: 2804626 - RNA, 23 nt, Human
ugcagugggguuucgcagccuga

SEQ ID NO: 2804627 - RNA, 22 nt, Human
ugcaguggccccuuaggccagu

SEQ ID NO: 2804628 - RNA, 13 nt, Human
ugcaguucuugag

SEQ ID NO: 2804629 - RNA, 16 nt, Human
ugcaguucuugaguug

SEQ ID NO: 2804630 - RNA, 17 nt, Human
ugcaguucuugaguugc

SEQ ID NO: 2804631 - RNA, 23 nt, Human
ugcaguggugcgaucucggcuca

SEQ ID NO: 2804632 - RNA, 20 nt, Human
ugccauccagguucagcuug

SEQ ID NO: 2804633 - RNA, 21 nt, Human
ugccauccagguucagcuugu

SEQ ID NO: 2804634 - RNA, 13 nt, Human
ugcccaccugccu

SEQ ID NO: 2804635 - RNA, 15 nt, Human
ugcccaccugccugg

SEQ ID NO: 2804636 - RNA, 16 nt, Human
ugcccaccugccuggc

SEQ ID NO: 2804637 - RNA, 17 nt, Human
ugcccaccugccuggcc

SEQ ID NO: 2804638 - RNA, 19 nt, Human
ugcccaccugccuggccgg

SEQ ID NO: 2804639 - RNA, 20 nt, Human
ugcccaccugccuggccggc

SEQ ID NO: 2804640 - RNA, 21 nt, Human
ugcccaccugccuggccggcc

SEQ ID NO: 2804641 - RNA, 22 nt, Human
ugcccaccugccuggccggcca

SEQ ID NO: 2804642 - RNA, 23 nt, Human
ugcccaccugccuggccggccag

SEQ ID NO: 2804643 - RNA, 19 nt, Human
ugcccaccugcccaucaca

SEQ ID NO: 2804644 - RNA, 17 nt, Human
ugcccaccugcccauca

SEQ ID NO: 2804645 - RNA, 15 nt, Human
ugcccaccugcccau

SEQ ID NO: 2804646 - RNA, 14 nt, Human
ugcccaccugccca

SEQ ID NO: 2804647 - RNA, 18 nt, Human
ugcccacccugggagaca

SEQ ID NO: 2804648 - RNA, 22 nt, Human
ugcccacccugggagacagacc

SEQ ID NO: 2804649 - RNA, 22 nt, Human
ugcccaccucagccucccaaag

SEQ ID NO: 2804650 - RNA, 11 nt, Human
ugcccaccugc

SEQ ID NO: 2804651 - RNA, 12 nt, Human
ugcccaccugcc

SEQ ID NO: 2804652 - RNA, 14 nt, Human
ugcccaggcuccau

SEQ ID NO: 2804653 - RNA, 13 nt, Human
ugcccaggcuggc

SEQ ID NO: 2804654 - RNA, 18 nt, Human
ugcccaggcuggagugca

SEQ ID NO: 2804655 - RNA, 20 nt, Human
ugcccaggcuggagugcaau

SEQ ID NO: 2804656 - RNA, 13 nt, Human
ugcccaggcugga

SEQ ID NO: 2804657 - RNA, 11 nt, Human
ugcccaggcug

SEQ ID NO: 2804658 - RNA, 14 nt, Human
ugcccagucuuuca

SEQ ID NO: 2804659 - RNA, 17 nt, Human
ugcccagucuuucaugu

SEQ ID NO: 2804660 - RNA, 20 nt, Human
ugcccagguuucuggucucu

SEQ ID NO: 2804661 - RNA, 22 nt, Human
ugcccaugauggucacuuaaaa

SEQ ID NO: 2804662 - RNA, 23 nt, Human
ugcccaucacaggguugggccca

SEQ ID NO: 2804663 - RNA, 20 nt, Human
ugcccaucacaggguugggc

SEQ ID NO: 2804664 - RNA, 16 nt, Human
ugcccaugggagcugg

SEQ ID NO: 2804665 - RNA, 19 nt, Human
ugccccagcucuggcuucc

SEQ ID NO: 2804666 - RNA, 15 nt, Human
ugccccagggcuccc

SEQ ID NO: 2804667 - RNA, 20 nt, Human
ugccccagucguuagaauau

SEQ ID NO: 2804668 - RNA, 23 nt, Human
ugccccucccccaacccccaccc

SEQ ID NO: 2804669 - RNA, 22 nt, Human
ugccccucccccaacccccacc

SEQ ID NO: 2804670 - RNA, 21 nt, Human
ugccccucccccaacccccac

SEQ ID NO: 2804671 - RNA, 17 nt, Human
ugccccucccccaaccc

SEQ ID NO: 2804672 - RNA, 12 nt, Human
ugccccuccccc

SEQ ID NO: 2804673 - RNA, 19 nt, Human
ugccacccuggggagaaag

SEQ ID NO: 2804674 - RNA, 22 nt, Human
ugccacuacggaauaguuggcu

SEQ ID NO: 2804675 - RNA, 18 nt, Human
ugccacuaauuuuaguau

SEQ ID NO: 2804676 - RNA, 14 nt, Human
ugccacccuagcca

SEQ ID NO: 2804677 - RNA, 23 nt, Human
ugccaccagagaccguccucacc

SEQ ID NO: 2804678 - RNA, 18 nt, Human
ugccaccauggccagcca

SEQ ID NO: 2804679 - RNA, 22 nt, Human
ugccagguuuuuggucugaccc

SEQ ID NO: 2804680 - RNA, 19 nt, Human
ugccagguuuuuggucuga

SEQ ID NO: 2804681 - RNA, 18 nt, Human
ugccagguuuuuggucug

SEQ ID NO: 2804682 - RNA, 20 nt, Human
ugccaggaucaagcaugaaa

SEQ ID NO: 2804683 - RNA, 15 nt, Human
ugcauaugaaauccu

SEQ ID NO: 2804684 - RNA, 17 nt, Human
ugcauauguugaauacu

SEQ ID NO: 2804685 - RNA, 15 nt, Human
ugcauauguugaaua

SEQ ID NO: 2804686 - RNA, 19 nt, Human
ugcauaugucacuagaaug

SEQ ID NO: 2804687 - RNA, 21 nt, Human
ugcauaugucacuagaaugga

SEQ ID NO: 2804688 - RNA, 13 nt, Human
ugcauauguugaa

SEQ ID NO: 2804689 - RNA, 15 nt, Human
ugcauauuuauccaa

SEQ ID NO: 2804690 - RNA, 22 nt, Human
ugcauauuuauccaaaaugugu

SEQ ID NO: 2804691 - RNA, 22 nt, Human
ugccaccaggagaaccacuaca

SEQ ID NO: 2804692 - RNA, 17 nt, Human
ugccaccaggagaacca

SEQ ID NO: 2804693 - RNA, 14 nt, Human
ugccaccaggagaa

SEQ ID NO: 2804694 - RNA, 13 nt, Human
ugccaccaggaga

SEQ ID NO: 2804695 - RNA, 12 nt, Human
ugccaccaggag

SEQ ID NO: 2804696 - RNA, 18 nt, Human
ugccaccagagaccgucc

SEQ ID NO: 2804697 - RNA, 19 nt, Human
ugccaccagagaccguccu

SEQ ID NO: 2804698 - RNA, 21 nt, Human
ugccaccagagaccguccuca

SEQ ID NO: 2804699 - RNA, 22 nt, Human
ugccaccagagaccguccucac

SEQ ID NO: 2804700 - RNA, 22 nt, Human
ugggagcugccuguucagcucc

SEQ ID NO: 2804701 - RNA, 21 nt, Human
ugggagcugccuguucagcuc

SEQ ID NO: 2804702 - RNA, 17 nt, Human
ugggagcugccuguuca

SEQ ID NO: 2804703 - RNA, 15 nt, Human
ugggagugagcuggu

SEQ ID NO: 2804704 - RNA, 12 nt, Human
ugggaguccagg

SEQ ID NO: 2804705 - RNA, 14 nt, Human
ugggaguccaggca

SEQ ID NO: 2804706 - RNA, 17 nt, Human
ugggaguccaggcacag

SEQ ID NO: 2804707 - RNA, 18 nt, Human
ugggaguccaggcacagg

SEQ ID NO: 2804708 - RNA, 19 nt, Human
ugggaguccaggcacagga

SEQ ID NO: 2804709 - RNA, 16 nt, Human
ugggauuacaggugug

SEQ ID NO: 2804710 - RNA, 18 nt, Human
ugggauuacaggcuccug

SEQ ID NO: 2804711 - RNA, 21 nt, Human
ugggauuacagggaugagcca

SEQ ID NO: 2804712 - RNA, 17 nt, Human
ugggauuacagguguga

SEQ ID NO: 2804713 - RNA, 14 nt, Human
ugggauucagagaa

SEQ ID NO: 2804714 - RNA, 18 nt, Human
ugggagagugucaaccag

SEQ ID NO: 2804715 - RNA, 21 nt, Human
ugggagagugucaaccagaca

SEQ ID NO: 2804716 - RNA, 22 nt, Human
ugggagagugucaaccagacag

SEQ ID NO: 2804717 - RNA, 23 nt, Human
ugggagagugucaaccagacaga

SEQ ID NO: 2804718 - RNA, 14 nt, Human
ugggagcugccugu

SEQ ID NO: 2804719 - RNA, 13 nt, Human
ugggagcugccug

SEQ ID NO: 2804720 - RNA, 12 nt, Human
ugggagcugccu

SEQ ID NO: 2804721 - RNA, 14 nt, Human
ugggagauguuaga

SEQ ID NO: 2804722 - RNA, 16 nt, Human
ugggacaauuguuuua

SEQ ID NO: 2804723 - RNA, 17 nt, Human
ugggacaauuguuuuaa

SEQ ID NO: 2804724 - RNA, 20 nt, Human
ugggacacaaaacuccgccc

SEQ ID NO: 2804725 - RNA, 14 nt, Human
uggcuuuucuguuu

SEQ ID NO: 2804726 - RNA, 16 nt, Human
uggcuuuucuguuucc

SEQ ID NO: 2804727 - RNA, 18 nt, Human
uggcuuuucuguuuccug

SEQ ID NO: 2804728 - RNA, 19 nt, Human
uggcuuuucuguuuccugu

SEQ ID NO: 2804729 - RNA, 24 nt, Human
ugggaccuccaccguugguguuca

SEQ ID NO: 2804730 - RNA, 19 nt, Human
ugggaccuaggggcgccgc

SEQ ID NO: 2804731 - RNA, 17 nt, Human
uggcuuucauuauuagu

SEQ ID NO: 2804732 - RNA, 17 nt, Human
uggcuuuccuuguggca

SEQ ID NO: 2804733 - RNA, 19 nt, Human
uggcuuuccuuguggcaga

SEQ ID NO: 2804734 - RNA, 20 nt, Human
uggcuuuccuuguggcagag

SEQ ID NO: 2804735 - RNA, 21 nt, Human
uggcuuuccuuguggcagagg

SEQ ID NO: 2804736 - RNA, 20 nt, Human
uggcuuucucccacugaguu

SEQ ID NO: 2804737 - RNA, 17 nt, Human
uggcuuuauuuguuuuu

SEQ ID NO: 2804738 - RNA, 15 nt, Human
uggcuuucagaaaac

SEQ ID NO: 2804739 - RNA, 13 nt, Human
uggcuuccuccug

SEQ ID NO: 2804740 - RNA, 14 nt, Human
uggcuuccuccuga

SEQ ID NO: 2804741 - RNA, 11 nt, Human
uggcuuccucc

SEQ ID NO: 2804742 - RNA, 22 nt, Human
uggcuuccuaaaauucagugga

SEQ ID NO: 2804743 - RNA, 22 nt, Human
uggcuucugugaugagcugauc

SEQ ID NO: 2804744 - RNA, 21 nt, Human
uggcuucugugaugagcugau

SEQ ID NO: 2804745 - RNA, 17 nt, Human
uggcuucugugaugagc

SEQ ID NO: 2804746 - RNA, 14 nt, Human
uggcuucugugaug

SEQ ID NO: 2804747 - RNA, 13 nt, Human
uggcuucugugau

SEQ ID NO: 2804748 - RNA, 19 nt, Human
uggcuucuuuucuuuguau

SEQ ID NO: 2804749 - RNA, 22 nt, Human
uggcuucuuuucuuuguaucau

SEQ ID NO: 2804750 - RNA, 19 nt, Human
uggcuugacucaggauuua

SEQ ID NO: 2804751 - RNA, 15 nt, Human
uggcuugagaaauau

SEQ ID NO: 2804752 - RNA, 14 nt, Human
uggcuucuccaggg

SEQ ID NO: 2804753 - RNA, 14 nt, Human
uggcuucuggagcc

SEQ ID NO: 2804754 - RNA, 21 nt, Human
uggcugggggccucagugcca

SEQ ID NO: 2804755 - RNA, 13 nt, Human
uggcuggaagggg

SEQ ID NO: 2804756 - RNA, 18 nt, Human
uggcuggaagggguccag

SEQ ID NO: 2804757 - RNA, 22 nt, Human
uggcugguaacaguucauguuu

SEQ ID NO: 2804758 - RNA, 19 nt, Human
uggcuggaugaaauuuucu

SEQ ID NO: 2804759 - RNA, 16 nt, Human
uggcugggguggccug

SEQ ID NO: 2804760 - RNA, 18 nt, Human
uggcugggguggccugug

SEQ ID NO: 2804761 - RNA, 19 nt, Human
uggcugggguggccugugu

SEQ ID NO: 2804762 - RNA, 20 nt, Human
uggcugggguggccugugug

SEQ ID NO: 2804763 - RNA, 21 nt, Human
uggcugggguggccugugugg

SEQ ID NO: 2804764 - RNA, 22 nt, Human
uggcugggguggccuguguggc

SEQ ID NO: 2804765 - RNA, 19 nt, Human
uggcucugcuguccccuug

SEQ ID NO: 2804766 - RNA, 15 nt, Human
uggcucuggacucua

SEQ ID NO: 2804767 - RNA, 14 nt, Human
uggcucugcaaugg

SEQ ID NO: 2804768 - RNA, 22 nt, Human
uggcucugaggugccuguccca

SEQ ID NO: 2804769 - RNA, 23 nt, Human
uggcucugcaaugggcacuggga

SEQ ID NO: 2804770 - RNA, 13 nt, Human
uggcucuggagac

SEQ ID NO: 2804771 - RNA, 17 nt, Human
uggccagauggcccgga

SEQ ID NO: 2804772 - RNA, 20 nt, Human
uggcucugaggugccugucc

SEQ ID NO: 2804773 - RNA, 21 nt, Human
uggcucugaggugccuguccc

SEQ ID NO: 2804774 - RNA, 17 nt, Human
uggcucucccauuuccu

SEQ ID NO: 2804775 - RNA, 16 nt, Human
ugguauuccugccucc

SEQ ID NO: 2804776 - RNA, 19 nt, Human
ugguauucaggauuacaug

SEQ ID NO: 2804777 - RNA, 18 nt, Human
ugguauuacacuguauuu

SEQ ID NO: 2804778 - RNA, 20 nt, Human
ugguauuacacuguauuugu

SEQ ID NO: 2804779 - RNA, 18 nt, Human
ugguaugaucacggcuca

SEQ ID NO: 2804780 - RNA, 16 nt, Human
uggguuuuaugagaug

SEQ ID NO: 2804781 - RNA, 15 nt, Human
ugguauaaguaacuu

SEQ ID NO: 2804782 - RNA, 19 nt, Human
ugguauaaguaacuuuauu

SEQ ID NO: 2804783 - RNA, 14 nt, Human
uggguuaguggaug

SEQ ID NO: 2804784 - RNA, 14 nt, Human
ugggugugugacuc

SEQ ID NO: 2804785 - RNA, 22 nt, Human
uggguuaggcauuaauguuucu

SEQ ID NO: 2804786 - RNA, 16 nt, Human
uggguucuauguuuac

SEQ ID NO: 2804787 - RNA, 17 nt, Human
uggguucuauguuuacu

SEQ ID NO: 2804788 - RNA, 18 nt, Human
uggguguguguagccaag

SEQ ID NO: 2804789 - RNA, 14 nt, Human
uggguguagccagg

SEQ ID NO: 2804790 - RNA, 23 nt, Human
uggguuacaguaugcuugcucua

SEQ ID NO: 2804791 - RNA, 15 nt, Human
ugggggugagggucc

SEQ ID NO: 2804792 - RNA, 14 nt, Human
ugggguuguguugu

SEQ ID NO: 2804793 - RNA, 15 nt, Human
ugggguuucgcagcc

SEQ ID NO: 2804794 - RNA, 18 nt, Human
ugggguuucgcagccuga

SEQ ID NO: 2804795 - RNA, 14 nt, Human
uggguaaaauuaga

SEQ ID NO: 2804796 - RNA, 15 nt, Human
uggguaaaauuagau

SEQ ID NO: 2804797 - RNA, 19 nt, Human
uggguaaaauuagaugcau

SEQ ID NO: 2804798 - RNA, 24 nt, Human
uggguaaaauuagaugcauguuga

SEQ ID NO: 2804799 - RNA, 15 nt, Human
uggguaaaugcaaag

SEQ ID NO: 2804800 - RNA, 18 nt, Human
uggguaaaugcaaaguuc

SEQ ID NO: 2804801 - RNA, 20 nt, Human
uggguaaaugcaaaguucug

SEQ ID NO: 2804802 - RNA, 15 nt, Human
uggguaaaugcagcg

SEQ ID NO: 2804803 - RNA, 16 nt, Human
ugggugggguauuuuu

SEQ ID NO: 2804804 - RNA, 13 nt, Human
ugggugguacccu

SEQ ID NO: 2804805 - RNA, 14 nt, Human
ugggugguacccuc

SEQ ID NO: 2804806 - RNA, 18 nt, Human
ugggugguacccucugga

SEQ ID NO: 2804807 - RNA, 22 nt, Human
ugggugguacccucuggagggg

SEQ ID NO: 2804808 - RNA, 20 nt, Human
uggggaaagggguuggggug

SEQ ID NO: 2804809 - RNA, 11 nt, Human
uggggaaaggg

SEQ ID NO: 2804810 - RNA, 18 nt, Human
uggggaacauuucuguaa

SEQ ID NO: 2804811 - RNA, 23 nt, Human
uggggaacauuucuguaaauacc

SEQ ID NO: 2804812 - RNA, 14 nt, Human
uggggaugugggag

SEQ ID NO: 2804813 - RNA, 15 nt, Human
uggggaugugggagg

SEQ ID NO: 2804814 - RNA, 16 nt, Human
uggggaugugggaggg

SEQ ID NO: 2804815 - RNA, 14 nt, Human
ugggggcuggccuc

SEQ ID NO: 2804816 - RNA, 22 nt, Human
ugggcuaagugauccucccacc

SEQ ID NO: 2804817 - RNA, 20 nt, Human
ugggcgugagaccugccccu

SEQ ID NO: 2804818 - RNA, 17 nt, Human
ugggcuggugucaccug

SEQ ID NO: 2804819 - RNA, 16 nt, Human
ugggcuaguugggcuu

SEQ ID NO: 2804820 - RNA, 17 nt, Human
ugggcuaauuaaauaaa

SEQ ID NO: 2804821 - RNA, 20 nt, Human
ugggcguuaggggcaggcag

SEQ ID NO: 2804822 - RNA, 15 nt, Human
ugggcuucaguggca

SEQ ID NO: 2804823 - RNA, 16 nt, Human
ugggcuucacuguaua

SEQ ID NO: 2804824 - RNA, 17 nt, Human
ugggcuucacuguauaa

SEQ ID NO: 2804825 - RNA, 23 nt, Human
ugggcuucacuguauaaauagga

SEQ ID NO: 2804826 - RNA, 11 nt, Human
ugggcuucagc

SEQ ID NO: 2804827 - RNA, 13 nt, Human
ugggcuucagccu

SEQ ID NO: 2804828 - RNA, 19 nt, Human
ugggcuucagccuaguggc

SEQ ID NO: 2804829 - RNA, 22 nt, Human
ugggcuucagccuaguggcuug

SEQ ID NO: 2804830 - RNA, 14 nt, Human
ugggcuuaagaaau

SEQ ID NO: 2804831 - RNA, 14 nt, Human
ugggcuuagagcag

SEQ ID NO: 2804832 - RNA, 22 nt, Human
ugggcugguauugguggcuuuc

SEQ ID NO: 2804833 - RNA, 23 nt, Human
ugggcuagguagaaaaaggguca

SEQ ID NO: 2804834 - RNA, 13 nt, Human
ugggcuauggaca

SEQ ID NO: 2804835 - RNA, 17 nt, Human
ugggcuucaguggcagc

SEQ ID NO: 2804836 - RNA, 18 nt, Human
ugggcuucacuguauaaa

SEQ ID NO: 2804837 - RNA, 13 nt, Human
ugggcuucagggc

SEQ ID NO: 2804838 - RNA, 15 nt, Human
ugggcuucagggcag

SEQ ID NO: 2804839 - RNA, 18 nt, Human
ugggcuucagggcaggug

SEQ ID NO: 2804840 - RNA, 22 nt, Human
uggggaaagacacugccugggc

SEQ ID NO: 2804841 - RNA, 21 nt, Human
uggggaaagacacugccuggg

SEQ ID NO: 2804842 - RNA, 20 nt, Human
uggggaaagacacugccugg

SEQ ID NO: 2804843 - RNA, 19 nt, Human
uggggaaagacacugccug

SEQ ID NO: 2804844 - RNA, 18 nt, Human
uggggaaagacacugccu

SEQ ID NO: 2804845 - RNA, 14 nt, Human
uggggaaaccuaga

SEQ ID NO: 2804846 - RNA, 17 nt, Human
uggggaaaaaaaucauc

SEQ ID NO: 2804847 - RNA, 16 nt, Human
ugggcuuugauuucca

SEQ ID NO: 2804848 - RNA, 22 nt, Human
uggaggagcagugcaggcacag

SEQ ID NO: 2804849 - RNA, 20 nt, Human
uggaggagcagugcaggcac

SEQ ID NO: 2804850 - RNA, 21 nt, Human
uggaggagcagugcaggcaca

SEQ ID NO: 2804851 - RNA, 18 nt, Human
uggaggagcaaaggcuga

SEQ ID NO: 2804852 - RNA, 20 nt, Human
uggaggagcaaaggcugaga

SEQ ID NO: 2804853 - RNA, 21 nt, Human
uggaggagcaaaggcugagaa

SEQ ID NO: 2804854 - RNA, 13 nt, Human
uggaggagcagug

SEQ ID NO: 2804855 - RNA, 11 nt, Human
uggaggagcaa

SEQ ID NO: 2804856 - RNA, 14 nt, Human
uggaggagcaaagg

SEQ ID NO: 2804857 - RNA, 16 nt, Human
uggaggagcaaaggcu

SEQ ID NO: 2804858 - RNA, 19 nt, Human
uggaggaacaacucuccag

SEQ ID NO: 2804859 - RNA, 13 nt, Human
uggacucugcaca

SEQ ID NO: 2804860 - RNA, 14 nt, Human
uggaggaaagcaac

SEQ ID NO: 2804861 - RNA, 15 nt, Human
uggacuccucugucc

SEQ ID NO: 2804862 - RNA, 14 nt, Human
uggacuccucuguc

SEQ ID NO: 2804863 - RNA, 15 nt, Human
uggacuccugcacac

SEQ ID NO: 2804864 - RNA, 16 nt, Human
uggacucuaaagacca

SEQ ID NO: 2804865 - RNA, 17 nt, Human
uggacucuaaagaccaa

SEQ ID NO: 2804866 - RNA, 18 nt, Human
uggacucuaaagaccaaa

SEQ ID NO: 2804867 - RNA, 21 nt, Human
uggacucuaaagaccaaacuu

SEQ ID NO: 2804868 - RNA, 14 nt, Human
uggauuucuuuugu

SEQ ID NO: 2804869 - RNA, 14 nt, Human
uggauccaauguua

SEQ ID NO: 2804870 - RNA, 18 nt, Human
uggauccaauguuagaga

SEQ ID NO: 2804871 - RNA, 22 nt, Human
uggauccaauguuagagacuuu

SEQ ID NO: 2804872 - RNA, 23 nt, Human
uggauccaauguuagagacuuuu

SEQ ID NO: 2804873 - RNA, 17 nt, Human
uggauccccucugucua

SEQ ID NO: 2804874 - RNA, 20 nt, Human
uggauccccucugucuacaa

SEQ ID NO: 2804875 - RNA, 23 nt, Human
uggauccccucugucuacaaaua

SEQ ID NO: 2804876 - RNA, 18 nt, Human
uggaucccgaagaaugga

SEQ ID NO: 2804877 - RNA, 16 nt, Human
uggaucagaugaacuc

SEQ ID NO: 2804878 - RNA, 19 nt, Human
uggaucacgacgcugcaga

SEQ ID NO: 2804879 - RNA, 20 nt, Human
uggaucacgacgcugcagag

SEQ ID NO: 2804880 - RNA, 15 nt, Human
uggauuuguuuaaaa

SEQ ID NO: 2804881 - RNA, 16 nt, Human
uggauuuguuuaaaag

SEQ ID NO: 2804882 - RNA, 17 nt, Human
uggauuuguuuaaaagg

SEQ ID NO: 2804883 - RNA, 15 nt, Human
uggauuuuuaauuaa

SEQ ID NO: 2804884 - RNA, 16 nt, Human
uggauuuuuaauuaaa

SEQ ID NO: 2804885 - RNA, 17 nt, Human
uggauuuuuaauuaaaa

SEQ ID NO: 2804886 - RNA, 19 nt, Human
uggauuuuuaauuaaaaac

SEQ ID NO: 2804887 - RNA, 14 nt, Human
uggauuugacauug

SEQ ID NO: 2804888 - RNA, 13 nt, Human
uggauuugaugcu

SEQ ID NO: 2804889 - RNA, 13 nt, Human
uggauuugacauu

SEQ ID NO: 2804890 - RNA, 16 nt, Human
uggauuucuuuuguaa

SEQ ID NO: 2804891 - RNA, 12 nt, Human
uggcaaauauaa

SEQ ID NO: 2804892 - RNA, 14 nt, Human
uggcaaauauaaaa

SEQ ID NO: 2804893 - RNA, 12 nt, Human
uggcaacagaag

SEQ ID NO: 2804894 - RNA, 13 nt, Human
uggcaacagaagc

SEQ ID NO: 2804895 - RNA, 15 nt, Human
uggcaacagaagcag

SEQ ID NO: 2804896 - RNA, 23 nt, Human
uggccaggcagaucugugcccca

SEQ ID NO: 2804897 - RNA, 14 nt, Human
uggccaggagcucu

SEQ ID NO: 2804898 - RNA, 16 nt, Human
uggccaggagcucuuc

SEQ ID NO: 2804899 - RNA, 15 nt, Human
uggccaggagcucuu

SEQ ID NO: 2804900 - RNA, 22 nt, Human
uggccaggagcucuucaggccu

SEQ ID NO: 2804901 - RNA, 20 nt, Human
uggccaggagcucuucaggc

SEQ ID NO: 2804902 - RNA, 23 nt, Human
uggccaggagcucuucaggccuc

SEQ ID NO: 2804903 - RNA, 20 nt, Human
uggccaggcagaucugugcc

SEQ ID NO: 2804904 - RNA, 19 nt, Human
uggccaggcagaucugugc

SEQ ID NO: 2804905 - RNA, 17 nt, Human
uggccaggcagaucugu

SEQ ID NO: 2804906 - RNA, 16 nt, Human
uggccaggcagaucug

SEQ ID NO: 2804907 - RNA, 12 nt, Human
uggccaggcaga

SEQ ID NO: 2804908 - RNA, 21 nt, Human
uggccagaugcaccagcccuu

SEQ ID NO: 2804909 - RNA, 20 nt, Human
uggccagaugcaccagcccu

SEQ ID NO: 2804910 - RNA, 21 nt, Human
uggccagccaacuuuugcaug

SEQ ID NO: 2804911 - RNA, 15 nt, Human
uggccacucagcuuc

SEQ ID NO: 2804912 - RNA, 22 nt, Human
uggccacucagcuuccuaccca

SEQ ID NO: 2804913 - RNA, 21 nt, Human
uggcagugagugagccuggcu

SEQ ID NO: 2804914 - RNA, 12 nt, Human
uggcaguggagg

SEQ ID NO: 2804915 - RNA, 17 nt, Human
uggccacuccagacccc

SEQ ID NO: 2804916 - RNA, 12 nt, Human
uggccacucagc

SEQ ID NO: 2804917 - RNA, 13 nt, Human
uggccacucagcu

SEQ ID NO: 2804918 - RNA, 13 nt, Human
uggcagcugcuuu

SEQ ID NO: 2804919 - RNA, 20 nt, Human
uggcacgguggcucaggccu

SEQ ID NO: 2804920 - RNA, 19 nt, Human
uggcacgguggcucaggcc

SEQ ID NO: 2804921 - RNA, 19 nt, Human
uggcaggaguuggaagugu

SEQ ID NO: 2804922 - RNA, 21 nt, Human
uggcacccggccccugcuggu

SEQ ID NO: 2804923 - RNA, 21 nt, Human
uggcaacaguuagcuggagcu

SEQ ID NO: 2804924 - RNA, 12 nt, Human
uggcaccuccua

SEQ ID NO: 2804925 - RNA, 19 nt, Human
uggauuucugguucugaug

SEQ ID NO: 2804926 - RNA, 19 nt, Human
uggcagguuggguaacccu

SEQ ID NO: 2804927 - RNA, 20 nt, Human
uggccaccucucuccuuugc

SEQ ID NO: 2804928 - RNA, 14 nt, Human
uggcagugagugag

SEQ ID NO: 2804929 - RNA, 17 nt, Human
uggcagugagugagccu

SEQ ID NO: 2804930 - RNA, 18 nt, Human
uggcagugagugagccug

SEQ ID NO: 2804931 - RNA, 19 nt, Human
uggcagugagugagccugg

SEQ ID NO: 2804932 - RNA, 23 nt, Human
uggcagugagugagccuggcucu

SEQ ID NO: 2804933 - RNA, 14 nt, Human
uggcagugaugaau

SEQ ID NO: 2804934 - RNA, 21 nt, Human
uggcagggcuggccccagggc

SEQ ID NO: 2804935 - RNA, 23 nt, Human
uggcagggcuggccccagggcac

SEQ ID NO: 2804936 - RNA, 22 nt, Human
uggcaggaugacccugcgaagg

SEQ ID NO: 2804937 - RNA, 18 nt, Human
uggcaggauggccuggcc

SEQ ID NO: 2804938 - RNA, 21 nt, Human
uggaaccacggagaucuccuu

SEQ ID NO: 2804939 - RNA, 22 nt, Human
uggaacauccuuugcagggcag

SEQ ID NO: 2804940 - RNA, 23 nt, Human
uggaacauccuuugcagggcagc

SEQ ID NO: 2804941 - RNA, 20 nt, Human
uggaacauaaaaaggacauc

SEQ ID NO: 2804942 - RNA, 21 nt, Human
uggaacaucaucaaggcacug

SEQ ID NO: 2804943 - RNA, 23 nt, Human
uggaacaucaucaaggcacugcc

SEQ ID NO: 2804944 - RNA, 21 nt, Human
uggaaagcaucaccucaggcc

SEQ ID NO: 2804945 - RNA, 20 nt, Human
uggaaagcaucaccucaggc

SEQ ID NO: 2804946 - RNA, 19 nt, Human
uggaaagcaucaccucagg

SEQ ID NO: 2804947 - RNA, 16 nt, Human
uggaaagcaucaccuc

SEQ ID NO: 2804948 - RNA, 23 nt, Human
uggaaagacagcuucucauccug

SEQ ID NO: 2804949 - RNA, 16 nt, Human
uggaaagaaucuaaua

SEQ ID NO: 2804950 - RNA, 22 nt, Human
uggaaacagcucgacuuuaaaa

SEQ ID NO: 2804951 - RNA, 19 nt, Human
uggaaagacagcuucucau

SEQ ID NO: 2804952 - RNA, 14 nt, Human
uggaaaaauguuug

SEQ ID NO: 2804953 - RNA, 15 nt, Human
uggaaaaauguuugu

SEQ ID NO: 2804954 - RNA, 16 nt, Human
uggaaaaauuccagaa

SEQ ID NO: 2804955 - RNA, 17 nt, Human
uggaaacagcucgacuu

SEQ ID NO: 2804956 - RNA, 19 nt, Human
ugcuuugaagcaguugugu

SEQ ID NO: 2804957 - RNA, 22 nt, Human
ugcuuugaagcaguugugucag

SEQ ID NO: 2804958 - RNA, 15 nt, Human
ugcuuugaagcaguu

SEQ ID NO: 2804959 - RNA, 14 nt, Human
ugcuuugaagcagu

SEQ ID NO: 2804960 - RNA, 13 nt, Human
uggaaaaaucaca

SEQ ID NO: 2804961 - RNA, 23 nt, Human
uggaaaaaucacaauuuuuaaug

SEQ ID NO: 2804962 - RNA, 19 nt, Human
ugcuuucugauguugccuu

SEQ ID NO: 2804963 - RNA, 17 nt, Human
ugcuuuaccaaacagca

SEQ ID NO: 2804964 - RNA, 18 nt, Human
ugcuuuaccaaacagcaa

SEQ ID NO: 2804965 - RNA, 19 nt, Human
ugcuuuaccaaacagcaaa

SEQ ID NO: 2804966 - RNA, 22 nt, Human
ugcuuuaccaaacagcaaacca

SEQ ID NO: 2804967 - RNA, 20 nt, Human
ugcuuucuuuuuuaaaauca

SEQ ID NO: 2804968 - RNA, 22 nt, Human
ugcuuugaaaaaguuaaugcuu

SEQ ID NO: 2804969 - RNA, 13 nt, Human
ugcuggagacucc

SEQ ID NO: 2804970 - RNA, 20 nt, Human
ugcuggacggggacugggga

SEQ ID NO: 2804971 - RNA, 13 nt, Human
ugcuggagaagag

SEQ ID NO: 2804972 - RNA, 18 nt, Human
ugcuggagaagagaggag

SEQ ID NO: 2804973 - RNA, 22 nt, Human
ugcuggagaagagaggagagga

SEQ ID NO: 2804974 - RNA, 20 nt, Human
ugcuggacggcauuccugcu

SEQ ID NO: 2804975 - RNA, 19 nt, Human
ugcuggacggcauuccugc

SEQ ID NO: 2804976 - RNA, 19 nt, Human
ugcuggacugucauagaaa

SEQ ID NO: 2804977 - RNA, 15 nt, Human
ugcuggacugucaua

SEQ ID NO: 2804978 - RNA, 14 nt, Human
ugcuggacugucau

SEQ ID NO: 2804979 - RNA, 21 nt, Human
ugcuggacggggacuggggau

SEQ ID NO: 2804980 - RNA, 16 nt, Human
ugcuggacgucuuucu

SEQ ID NO: 2804981 - RNA, 15 nt, Human
ugcuuuaaaguguaa

SEQ ID NO: 2804982 - RNA, 17 nt, Human
ugcuuuaaaguguaaua

SEQ ID NO: 2804983 - RNA, 23 nt, Human
ugcuuuaaaguguaauaauauga

SEQ ID NO: 2804984 - RNA, 12 nt, Human
ugcuggagccug

SEQ ID NO: 2804985 - RNA, 13 nt, Human
uggaauauaaaga

SEQ ID NO: 2804986 - RNA, 14 nt, Human
uggaacuaauaaau

SEQ ID NO: 2804987 - RNA, 17 nt, Human
uggaacuaauaaauaca

SEQ ID NO: 2804988 - RNA, 15 nt, Human
uggaacucuaucugg

SEQ ID NO: 2804989 - RNA, 20 nt, Human
uggaacucuaucugggccug

SEQ ID NO: 2804990 - RNA, 23 nt, Human
uggaacucagcugucuguggcuu

SEQ ID NO: 2804991 - RNA, 17 nt, Human
uggaacgcuaaugaaac

SEQ ID NO: 2804992 - RNA, 18 nt, Human
uggaacgcuaaugaaaca

SEQ ID NO: 2804993 - RNA, 20 nt, Human
uggaacggugaaggugacag

SEQ ID NO: 2804994 - RNA, 18 nt, Human
uggaauaaaaggcuugaa

SEQ ID NO: 2804995 - RNA, 15 nt, Human
uggaauaaaaggcuu

SEQ ID NO: 2804996 - RNA, 22 nt, Human
uggaauaaaaggcuugaagcug

SEQ ID NO: 2804997 - RNA, 16 nt, Human
uggaaugcuguguuaa

SEQ ID NO: 2804998 - RNA, 17 nt, Human
uggaaugaauuaaauaa

SEQ ID NO: 2804999 - RNA, 18 nt, Human
uggaaugaauuaaauaaa

SEQ ID NO: 2805000 - RNA, 17 nt, Human
uggaaugagugugcaug

SEQ ID NO: 2805001 - RNA, 18 nt, Human
uggaaugagugugcaugg

SEQ ID NO: 2805002 - RNA, 19 nt, Human
uggaaugagugugcaugga

SEQ ID NO: 2805003 - RNA, 21 nt, Human
uggaaugagugugcauggagg

SEQ ID NO: 2805004 - RNA, 15 nt, Human
uggaauggacauccu

SEQ ID NO: 2805005 - RNA, 17 nt, Human
uggaaugggcagcucau

SEQ ID NO: 2805006 - RNA, 22 nt, Human
uggaaugguacaugucuuccau

SEQ ID NO: 2805007 - RNA, 14 nt, Human
uggacacuuuucac

SEQ ID NO: 2805008 - RNA, 16 nt, Human
uggacacuuuucaccu

SEQ ID NO: 2805009 - RNA, 23 nt, Human
uggacacuuuucaccuccuucaa

SEQ ID NO: 2805010 - RNA, 16 nt, Human
uggacagacagaggau

SEQ ID NO: 2805011 - RNA, 22 nt, Human
uggacagacagaggaugagcuc

SEQ ID NO: 2805012 - RNA, 15 nt, Human
uggacagagaagggc

SEQ ID NO: 2805013 - RNA, 12 nt, Human
uggacagagggg

SEQ ID NO: 2805014 - RNA, 13 nt, Human
uggacagagggga

SEQ ID NO: 2805015 - RNA, 14 nt, Human
uggacagaggggac

SEQ ID NO: 2805016 - RNA, 18 nt, Human
uggacagaggggacucug

SEQ ID NO: 2805017 - RNA, 19 nt, Human
uggacagaggggacucugg

SEQ ID NO: 2805018 - RNA, 20 nt, Human
uggacagaggggacucuggg

SEQ ID NO: 2805019 - RNA, 18 nt, Human
uggacuauuauaauuuaa

SEQ ID NO: 2805020 - RNA, 17 nt, Human
uggacucaaucccuagg

SEQ ID NO: 2805021 - RNA, 19 nt, Human
uggacucaaucccuagggc

SEQ ID NO: 2805022 - RNA, 20 nt, Human
uggacucaccucccccaucu

SEQ ID NO: 2805023 - RNA, 18 nt, Human
uggacucaccucccccau

SEQ ID NO: 2805024 - RNA, 21 nt, Human
uggacuagagggaccucuccc

SEQ ID NO: 2805025 - RNA, 22 nt, Human
uggacauggcaggccgauuugg

SEQ ID NO: 2805026 - RNA, 19 nt, Human
ugugcgccuacaggaguga

SEQ ID NO: 2805027 - RNA, 14 nt, Human
ugugcgccuacagg

SEQ ID NO: 2805028 - RNA, 16 nt, Human
ugugccuuuuauagcu

SEQ ID NO: 2805029 - RNA, 18 nt, Human
ugugccuuuuauagcuau

SEQ ID NO: 2805030 - RNA, 14 nt, Human
ugugcuagaauacu

SEQ ID NO: 2805031 - RNA, 16 nt, Human
ugugcuagaauacuuu

SEQ ID NO: 2805032 - RNA, 18 nt, Human
ugugcuagaauacuuuuu

SEQ ID NO: 2805033 - RNA, 13 nt, Human
ugugcuauaguau

SEQ ID NO: 2805034 - RNA, 17 nt, Human
ugugcuauaguauuuga

SEQ ID NO: 2805035 - RNA, 18 nt, Human
ugugcuauaguauuugau

SEQ ID NO: 2805036 - RNA, 22 nt, Human
ugugcucagagaccugaagugu

SEQ ID NO: 2805037 - RNA, 18 nt, Human
ugugcucaggacucagaa

SEQ ID NO: 2805038 - RNA, 15 nt, Human
ugugcuauaaauccu

SEQ ID NO: 2805039 - RNA, 12 nt, Human
ugugcucagaga

SEQ ID NO: 2805040 - RNA, 13 nt, Human
ugugcuuugcucu

SEQ ID NO: 2805041 - RNA, 16 nt, Human
ugugcuuugcucuugu

SEQ ID NO: 2805042 - RNA, 17 nt, Human
ugugcuuugcucuuguc

SEQ ID NO: 2805043 - RNA, 18 nt, Human
ugugcuuugcucuugucc

SEQ ID NO: 2805044 - RNA, 16 nt, Human
uguggaacauaaaaag

SEQ ID NO: 2805045 - RNA, 14 nt, Human
ugugcuuguuuuau

SEQ ID NO: 2805046 - RNA, 19 nt, Human
ugugcuuguuuuauaaaau

SEQ ID NO: 2805047 - RNA, 14 nt, Human
ugugcuuguuaacu

SEQ ID NO: 2805048 - RNA, 14 nt, Human
ugugcacguacaca

SEQ ID NO: 2805049 - RNA, 15 nt, Human
ugugcaugugugugu

SEQ ID NO: 2805050 - RNA, 16 nt, Human
ugugccuucuuuugau

SEQ ID NO: 2805051 - RNA, 15 nt, Human
ugugccuuuuauagc

SEQ ID NO: 2805052 - RNA, 16 nt, Human
ugugccuuugcaaauc

SEQ ID NO: 2805053 - RNA, 18 nt, Human
ugugccuuugcaaaucag

SEQ ID NO: 2805054 - RNA, 20 nt, Human
ugugccuuugcaaaucagug

SEQ ID NO: 2805055 - RNA, 17 nt, Human
uguguacaauguacaca

SEQ ID NO: 2805056 - RNA, 17 nt, Human
uguguacaccucuggau

SEQ ID NO: 2805057 - RNA, 18 nt, Human
uguguacauaacucugua

SEQ ID NO: 2805058 - RNA, 20 nt, Human
uguguacauaacucuguaaa

SEQ ID NO: 2805059 - RNA, 17 nt, Human
uguguaauuguuccuuu

SEQ ID NO: 2805060 - RNA, 12 nt, Human
uguguagggcgg

SEQ ID NO: 2805061 - RNA, 17 nt, Human
uguguagcuuugcucuu

SEQ ID NO: 2805062 - RNA, 14 nt, Human
uguguagcuuugcu

SEQ ID NO: 2805063 - RNA, 15 nt, Human
uguguagccugugca

SEQ ID NO: 2805064 - RNA, 16 nt, Human
uguguagccugugcau

SEQ ID NO: 2805065 - RNA, 14 nt, Human
uguguagccugugc

SEQ ID NO: 2805066 - RNA, 23 nt, Human
uguguagccugugcauguauguc

SEQ ID NO: 2805067 - RNA, 13 nt, Human
uguguaaugaaaa

SEQ ID NO: 2805068 - RNA, 22 nt, Human
ugugggcuaguugggcuuccuc

SEQ ID NO: 2805069 - RNA, 22 nt, Human
ugugggcgugagaccugccccu

SEQ ID NO: 2805070 - RNA, 17 nt, Human
ugugggcgggcccagca

SEQ ID NO: 2805071 - RNA, 21 nt, Human
uguguaauagaaaacugaaaa

SEQ ID NO: 2805072 - RNA, 21 nt, Human
ugugggcgugagaccugcccc

SEQ ID NO: 2805073 - RNA, 20 nt, Human
ugugggcgugagaccugccc

SEQ ID NO: 2805074 - RNA, 21 nt, Human
ugugggcauuucuugcgagcc

SEQ ID NO: 2805075 - RNA, 14 nt, Human
ugugggcacuggcc

SEQ ID NO: 2805076 - RNA, 16 nt, Human
ugugggcacuggccca

SEQ ID NO: 2805077 - RNA, 17 nt, Human
ugugggcacuggcccag

SEQ ID NO: 2805078 - RNA, 18 nt, Human
ugugggcacuggcccagg

SEQ ID NO: 2805079 - RNA, 23 nt, Human
ugugggcacuggcccagguucau

SEQ ID NO: 2805080 - RNA, 21 nt, Human
ugugggagggagcagacagga

SEQ ID NO: 2805081 - RNA, 13 nt, Human
ugugggagggagc

SEQ ID NO: 2805082 - RNA, 16 nt, Human
ugugggaggcuccugu

SEQ ID NO: 2805083 - RNA, 20 nt, Human
uguggccuuccauuuauaug

SEQ ID NO: 2805084 - RNA, 17 nt, Human
uguggccugcacaguga

SEQ ID NO: 2805085 - RNA, 15 nt, Human
uguggccugggccuc

SEQ ID NO: 2805086 - RNA, 16 nt, Human
uguggccugggccucc

SEQ ID NO: 2805087 - RNA, 11 nt, Human
uguggccugca

SEQ ID NO: 2805088 - RNA, 13 nt, Human
uguggccucagaa

SEQ ID NO: 2805089 - RNA, 21 nt, Human
uguggcuaaaugccuaauaaa

SEQ ID NO: 2805090 - RNA, 16 nt, Human
uguggcgggcaguggg

SEQ ID NO: 2805091 - RNA, 10 nt, Human
uguggcucac

SEQ ID NO: 2805092 - RNA, 19 nt, Human
uguggacacagcucuucuc

SEQ ID NO: 2805093 - RNA, 17 nt, Human
uguggaccacugcauga

SEQ ID NO: 2805094 - RNA, 19 nt, Human
uguggaccacugcaugagc

SEQ ID NO: 2805095 - RNA, 15 nt, Human
uguggaccaauuauu

SEQ ID NO: 2805096 - RNA, 17 nt, Human
uguggaccaauuauuga

SEQ ID NO: 2805097 - RNA, 11 nt, Human
uguggccucag

SEQ ID NO: 2805098 - RNA, 10 nt, Human
uguggccuca

SEQ ID NO: 2805099 - RNA, 18 nt, Human
uguggccguuaucuggaa

SEQ ID NO: 2805100 - RNA, 18 nt, Human
uguggacacagcucuucu

SEQ ID NO: 2805101 - RNA, 20 nt, Human
uguggaaguguguguggcag

SEQ ID NO: 2805102 - RNA, 13 nt, Human
uguggaaugagug

SEQ ID NO: 2805103 - RNA, 16 nt, Human
uguggaaugagugugc

SEQ ID NO: 2805104 - RNA, 18 nt, Human
uguggaaugagugugcau

SEQ ID NO: 2805105 - RNA, 19 nt, Human
uguggaagaaaaugguuua

SEQ ID NO: 2805106 - RNA, 20 nt, Human
uguggaagaaaaugguuuau

SEQ ID NO: 2805107 - RNA, 22 nt, Human
uguggaagaaaaugguuuauuu

SEQ ID NO: 2805108 - RNA, 19 nt, Human
uguggaacauaaaaaggac

SEQ ID NO: 2805109 - RNA, 21 nt, Human
uguggaacauaaaaaggacau

SEQ ID NO: 2805110 - RNA, 15 nt, Human
uguggaacccagcag

SEQ ID NO: 2805111 - RNA, 21 nt, Human
uguggaacccagcaguucugu

SEQ ID NO: 2805112 - RNA, 20 nt, Human
uguggaacuaauaaauacau

SEQ ID NO: 2805113 - RNA, 22 nt, Human
uguggaacuaauaaauacauac

SEQ ID NO: 2805114 - RNA, 23 nt, Human
uguggaacuaauaaauacauacg

SEQ ID NO: 2805115 - RNA, 19 nt, Human
ugugaauugaaauguucgu

SEQ ID NO: 2805116 - RNA, 15 nt, Human
ugugaauugacuacc

SEQ ID NO: 2805117 - RNA, 18 nt, Human
ugugaauugcaugacuug

SEQ ID NO: 2805118 - RNA, 18 nt, Human
ugugaagugaaugaaaca

SEQ ID NO: 2805119 - RNA, 18 nt, Human
ugugaaaauaucugcuca

SEQ ID NO: 2805120 - RNA, 14 nt, Human
ugugaaggccauga

SEQ ID NO: 2805121 - RNA, 15 nt, Human
ugugaaggcagagaa

SEQ ID NO: 2805122 - RNA, 19 nt, Human
ugugaaggcagagaaaggg

SEQ ID NO: 2805123 - RNA, 23 nt, Human
ugugaaggcagagaaagggacaa

SEQ ID NO: 2805124 - RNA, 21 nt, Human
ugugaauguugugauguauuc

SEQ ID NO: 2805125 - RNA, 21 nt, Human
ugugaaguuagguucuuaaaa

SEQ ID NO: 2805126 - RNA, 19 nt, Human
ugugaauggauuggauuau

SEQ ID NO: 2805127 - RNA, 16 nt, Human
ugugaauggauuggau

SEQ ID NO: 2805128 - RNA, 22 nt, Human
ugugaauggauuggauuauuua

SEQ ID NO: 2805129 - RNA, 12 nt, Human
ugugaauguggg

SEQ ID NO: 2805130 - RNA, 15 nt, Human
ugugaaugugggcac

SEQ ID NO: 2805131 - RNA, 18 nt, Human
ugugaaugugggcacugg

SEQ ID NO: 2805132 - RNA, 13 nt, Human
ugugaccaacugu

SEQ ID NO: 2805133 - RNA, 14 nt, Human
ugugaccaacugug

SEQ ID NO: 2805134 - RNA, 15 nt, Human
ugugaccaacugugu

SEQ ID NO: 2805135 - RNA, 16 nt, Human
ugugaccaacuguguu

SEQ ID NO: 2805136 - RNA, 17 nt, Human
ugugaccaacuguguug

SEQ ID NO: 2805137 - RNA, 19 nt, Human
ugugaccaacuguguugua

SEQ ID NO: 2805138 - RNA, 21 nt, Human
ugugaccaacuguguuguauu

SEQ ID NO: 2805139 - RNA, 22 nt, Human
ugugaccaacuguguuguauua

SEQ ID NO: 2805140 - RNA, 15 nt, Human
ugugacauuuuacau

SEQ ID NO: 2805141 - RNA, 18 nt, Human
ugugacauuuuacauuaa

SEQ ID NO: 2805142 - RNA, 17 nt, Human
ugugacauuuuacauua

SEQ ID NO: 2805143 - RNA, 13 nt, Human
ugugaggagcugc

SEQ ID NO: 2805144 - RNA, 20 nt, Human
ugugaggagcugcuggcuug

SEQ ID NO: 2805145 - RNA, 18 nt, Human
ugugaggagcugcuggcu

SEQ ID NO: 2805146 - RNA, 17 nt, Human
ugugaggagcugcuggc

SEQ ID NO: 2805147 - RNA, 14 nt, Human
ugugaggagcugcu

SEQ ID NO: 2805148 - RNA, 17 nt, Human
ugugagucaccaagccc

SEQ ID NO: 2805149 - RNA, 15 nt, Human
ugugagucaccaagc

SEQ ID NO: 2805150 - RNA, 13 nt, Human
ugugaggccccug

SEQ ID NO: 2805151 - RNA, 14 nt, Human
ugugaggccccugg

SEQ ID NO: 2805152 - RNA, 22 nt, Human
ugugaggccccuggacaagcag

SEQ ID NO: 2805153 - RNA, 21 nt, Human
ugugagucaccaagcccaguu

SEQ ID NO: 2805154 - RNA, 19 nt, Human
ugugagucaccaagcccag

SEQ ID NO: 2805155 - RNA, 22 nt, Human
ugugagucuuugguucuaagga

SEQ ID NO: 2805156 - RNA, 16 nt, Human
ugugagugccuuuugc

SEQ ID NO: 2805157 - RNA, 17 nt, Human
ugugagugccuuuugca

SEQ ID NO: 2805158 - RNA, 19 nt, Human
ugugagugccuuuugcaga

SEQ ID NO: 2805159 - RNA, 21 nt, Human
ugugagugccuuuugcagaag

SEQ ID NO: 2805160 - RNA, 18 nt, Human
ugugagucuuugguucua

SEQ ID NO: 2805161 - RNA, 20 nt, Human
ugugagucuuugguucuaag

SEQ ID NO: 2805162 - RNA, 21 nt, Human
ugugagucuuugguucuaagg

SEQ ID NO: 2805163 - RNA, 19 nt, Human
ugugaguguguguuugugc

SEQ ID NO: 2805164 - RNA, 11 nt, Human
ugugaguguga

SEQ ID NO: 2805165 - RNA, 12 nt, Human
ugugagugugac

SEQ ID NO: 2805166 - RNA, 13 nt, Human
ugugagugugaca

SEQ ID NO: 2805167 - RNA, 14 nt, Human
ugugagugugacag

SEQ ID NO: 2805168 - RNA, 15 nt, Human
ugugagugugacagg

SEQ ID NO: 2805169 - RNA, 16 nt, Human
ugugagugugacaggg

SEQ ID NO: 2805170 - RNA, 17 nt, Human
ugugagugugacagggc

SEQ ID NO: 2805171 - RNA, 18 nt, Human
ugugagugugacagggcc

SEQ ID NO: 2805172 - RNA, 20 nt, Human
ugugcacaauucuguuuuag

SEQ ID NO: 2805173 - RNA, 20 nt, Human
ugugcacacacacacacaug

SEQ ID NO: 2805174 - RNA, 15 nt, Human
ugugcacaauucugu

SEQ ID NO: 2805175 - RNA, 17 nt, Human
ugugaucacgccuggcu

SEQ ID NO: 2805176 - RNA, 18 nt, Human
ugugaucacgccuggcua

SEQ ID NO: 2805177 - RNA, 22 nt, Human
ugugaucagcuuucaaagcauu

SEQ ID NO: 2805178 - RNA, 23 nt, Human
ugugaucagcuuucaaagcauuu

SEQ ID NO: 2805179 - RNA, 19 nt, Human
ugugauauucuaagacuua

SEQ ID NO: 2805180 - RNA, 14 nt, Human
ugugauauucuaag

SEQ ID NO: 2805181 - RNA, 15 nt, Human
ugugauauucuaaga

SEQ ID NO: 2805182 - RNA, 16 nt, Human
ugugaguuuaaagcaa

SEQ ID NO: 2805183 - RNA, 22 nt, Human
ugugaguguguguuugugcuga

SEQ ID NO: 2805184 - RNA, 17 nt, Human
ugugaguguuuggggga

SEQ ID NO: 2805185 - RNA, 14 nt, Human
ugugauauuaacag

SEQ ID NO: 2805186 - RNA, 16 nt, Human
ugugauauauguauua

SEQ ID NO: 2805187 - RNA, 17 nt, Human
ugugauauauguauuaa

SEQ ID NO: 2805188 - RNA, 13 nt, Human
ugucuuuugaaua

SEQ ID NO: 2805189 - RNA, 14 nt, Human
ugucuuuucuuggc

SEQ ID NO: 2805190 - RNA, 15 nt, Human
ugucuuuucuuggca

SEQ ID NO: 2805191 - RNA, 22 nt, Human
ugucuuuucuuggcaaaagccu

SEQ ID NO: 2805192 - RNA, 23 nt, Human
ugucuuuucuuggcaaaagccuu

SEQ ID NO: 2805193 - RNA, 22 nt, Human
ugucuuuccuaagaccuggggu

SEQ ID NO: 2805194 - RNA, 13 nt, Human
ugucuuuugucau

SEQ ID NO: 2805195 - RNA, 14 nt, Human
ugucuuuugaauau

SEQ ID NO: 2805196 - RNA, 17 nt, Human
ugugaaaaucaaauaca

SEQ ID NO: 2805197 - RNA, 13 nt, Human
ugugaaaaugggu

SEQ ID NO: 2805198 - RNA, 14 nt, Human
ugugaaaauggguu

SEQ ID NO: 2805199 - RNA, 16 nt, Human
ugugaaaaugugugug

SEQ ID NO: 2805200 - RNA, 17 nt, Human
ugugaaaaugugugugu

SEQ ID NO: 2805201 - RNA, 17 nt, Human
ugugaagcccuguugug

SEQ ID NO: 2805202 - RNA, 15 nt, Human
ugucuuucugagcac

SEQ ID NO: 2805203 - RNA, 13 nt, Human
ugucuuuggaaaa

SEQ ID NO: 2805204 - RNA, 21 nt, Human
ugucuuuggaaaaauguuugu

SEQ ID NO: 2805205 - RNA, 12 nt, Human
ugucuuucugag

SEQ ID NO: 2805206 - RNA, 17 nt, Human
ugucuuucuccaaaguu

SEQ ID NO: 2805207 - RNA, 19 nt, Human
ugucuuucuccaaaguuau

SEQ ID NO: 2805208 - RNA, 12 nt, Human
ugucuguaaaua

SEQ ID NO: 2805209 - RNA, 21 nt, Human
ugucuguacacguguccugua

SEQ ID NO: 2805210 - RNA, 15 nt, Human
ugucuguacuaaaaa

SEQ ID NO: 2805211 - RNA, 19 nt, Human
ugucuguacacguguccug

SEQ ID NO: 2805212 - RNA, 20 nt, Human
ugucuguacacguguccugu

SEQ ID NO: 2805213 - RNA, 17 nt, Human
ugucuguaaauauguuu

SEQ ID NO: 2805214 - RNA, 22 nt, Human
ugucugguuuuaacaauuuccu

SEQ ID NO: 2805215 - RNA, 18 nt, Human
ugucuguaaaagagccua

SEQ ID NO: 2805216 - RNA, 13 nt, Human
ugucuguacacgu

SEQ ID NO: 2805217 - RNA, 15 nt, Human
ugucuguacacgugu

SEQ ID NO: 2805218 - RNA, 14 nt, Human
ugucuguauuucau

SEQ ID NO: 2805219 - RNA, 20 nt, Human
ugucuguauuucauguggcu

SEQ ID NO: 2805220 - RNA, 22 nt, Human
ugucuguauuucauguggcugu

SEQ ID NO: 2805221 - RNA, 13 nt, Human
ugucugucauugu

SEQ ID NO: 2805222 - RNA, 15 nt, Human
ugucugguuuuaaca

SEQ ID NO: 2805223 - RNA, 16 nt, Human
ugucugguuuuaacaa

SEQ ID NO: 2805224 - RNA, 15 nt, Human
ugucuggauucccag

SEQ ID NO: 2805225 - RNA, 19 nt, Human
ugucuggauucccaggaug

SEQ ID NO: 2805226 - RNA, 18 nt, Human
ugucuggcaaaagaaaaa

SEQ ID NO: 2805227 - RNA, 19 nt, Human
ugucugaagucacugcaca

SEQ ID NO: 2805228 - RNA, 23 nt, Human
ugucugcuuaguaucucaucaac

SEQ ID NO: 2805229 - RNA, 20 nt, Human
ugucugcuuuaaagggccug

SEQ ID NO: 2805230 - RNA, 21 nt, Human
ugucugcuuuaaagggccugc

SEQ ID NO: 2805231 - RNA, 22 nt, Human
ugucugcuuuaaagggccugcc

SEQ ID NO: 2805232 - RNA, 17 nt, Human
ugucugaagucacugca

SEQ ID NO: 2805233 - RNA, 18 nt, Human
ugucugaagucacugcac

SEQ ID NO: 2805234 - RNA, 16 nt, Human
ugucugaagucacugc

SEQ ID NO: 2805235 - RNA, 13 nt, Human
uguccucccucca

SEQ ID NO: 2805236 - RNA, 19 nt, Human
uguccucccuccaccuacc

SEQ ID NO: 2805237 - RNA, 20 nt, Human
uguccucaguccauuuauau

SEQ ID NO: 2805238 - RNA, 16 nt, Human
uguccucauuucucca

SEQ ID NO: 2805239 - RNA, 17 nt, Human
uguccucauuucuccag

SEQ ID NO: 2805240 - RNA, 18 nt, Human
uguccucauuucuccaga

SEQ ID NO: 2805241 - RNA, 23 nt, Human
uguccucagggagcagggaaggc

SEQ ID NO: 2805242 - RNA, 19 nt, Human
uguccucagggagcaggga

SEQ ID NO: 2805243 - RNA, 14 nt, Human
uguccucagggagc

SEQ ID NO: 2805244 - RNA, 12 nt, Human
uguccucaggga

SEQ ID NO: 2805245 - RNA, 13 nt, Human
ugucaugcaugaa

SEQ ID NO: 2805246 - RNA, 13 nt, Human
uguccucuccccu

SEQ ID NO: 2805247 - RNA, 20 nt, Human
uguccucuccccuccagccu

SEQ ID NO: 2805248 - RNA, 22 nt, Human
uguccucuccccuccagccuuu

SEQ ID NO: 2805249 - RNA, 12 nt, Human
ugucugaacuuu

SEQ ID NO: 2805250 - RNA, 17 nt, Human
ugucugaacuuugggaa

SEQ ID NO: 2805251 - RNA, 23 nt, Human
uguccugaaaauuguuucaagaa

SEQ ID NO: 2805252 - RNA, 13 nt, Human
uguaugauguguu

SEQ ID NO: 2805253 - RNA, 13 nt, Human
uguaguucuaaga

SEQ ID NO: 2805254 - RNA, 15 nt, Human
uguaguucuaagacu

SEQ ID NO: 2805255 - RNA, 15 nt, Human
uguaguugcguggac

SEQ ID NO: 2805256 - RNA, 20 nt, Human
uguaguugcguggacucugc

SEQ ID NO: 2805257 - RNA, 22 nt, Human
uguaguugcaauagaacagaga

SEQ ID NO: 2805258 - RNA, 16 nt, Human
uguaguugauguaucc

SEQ ID NO: 2805259 - RNA, 17 nt, Human
uguaguugauguaucca

SEQ ID NO: 2805260 - RNA, 16 nt, Human
uguaguuuacagaaaa

SEQ ID NO: 2805261 - RNA, 21 nt, Human
uguaguuguucguugguuaua

SEQ ID NO: 2805262 - RNA, 21 nt, Human
uguaguugcguggacucugca

SEQ ID NO: 2805263 - RNA, 19 nt, Human
uguaguuuaccucuuuaaa

SEQ ID NO: 2805264 - RNA, 17 nt, Human
uguaguuuuauuuuaug

SEQ ID NO: 2805265 - RNA, 23 nt, Human
uguaguuuuauuuuauguuuaga

SEQ ID NO: 2805266 - RNA, 13 nt, Human
uguauugugguau

SEQ ID NO: 2805267 - RNA, 14 nt, Human
uguauugugguauu

SEQ ID NO: 2805268 - RNA, 14 nt, Human
uguauucuuaaaau

SEQ ID NO: 2805269 - RNA, 20 nt, Human
uguauucuuaaaaugcaaua

SEQ ID NO: 2805270 - RNA, 22 nt, Human
uguauucuuaaaaugcaauauu

SEQ ID NO: 2805271 - RNA, 18 nt, Human
uguaugauguguugugau

SEQ ID NO: 2805272 - RNA, 17 nt, Human
uguauuuaugugugagg

SEQ ID NO: 2805273 - RNA, 15 nt, Human
uguauuuauuuaaaa

SEQ ID NO: 2805274 - RNA, 20 nt, Human
uguauuuauuuaguauuuau

SEQ ID NO: 2805275 - RNA, 16 nt, Human
uguauuuauuuaaaag

SEQ ID NO: 2805276 - RNA, 19 nt, Human
uguauuguuuucugacagu

SEQ ID NO: 2805277 - RNA, 23 nt, Human
uguauuuauugaagaaacagaua

SEQ ID NO: 2805278 - RNA, 18 nt, Human
uguauuuauuuaaaagau

SEQ ID NO: 2805279 - RNA, 20 nt, Human
uguauuuauuuaaaagauuc

SEQ ID NO: 2805280 - RNA, 13 nt, Human
uguauuucuuaua

SEQ ID NO: 2805281 - RNA, 18 nt, Human
uguauuucuuauacgcuu

SEQ ID NO: 2805282 - RNA, 12 nt, Human
ugucacaggcag

SEQ ID NO: 2805283 - RNA, 14 nt, Human
ugucacaccagcca

SEQ ID NO: 2805284 - RNA, 15 nt, Human
ugucacaccagccau

SEQ ID NO: 2805285 - RNA, 14 nt, Human
ugucacacuggcua

SEQ ID NO: 2805286 - RNA, 15 nt, Human
ugucacacuggcuau

SEQ ID NO: 2805287 - RNA, 13 nt, Human
ugucacaccagcc

SEQ ID NO: 2805288 - RNA, 17 nt, Human
ugucacacacuuuggcu

SEQ ID NO: 2805289 - RNA, 19 nt, Human
uguauuuuguaaauaauaa

SEQ ID NO: 2805290 - RNA, 22 nt, Human
uguauuuuguaaauaauaaaau

SEQ ID NO: 2805291 - RNA, 13 nt, Human
ugucacacacuuu

SEQ ID NO: 2805292 - RNA, 14 nt, Human
ugucaccccagagc

SEQ ID NO: 2805293 - RNA, 15 nt, Human
ugucaccccagagcc

SEQ ID NO: 2805294 - RNA, 16 nt, Human
ugucaccccagagcca

SEQ ID NO: 2805295 - RNA, 17 nt, Human
ugucaccccagagccac

SEQ ID NO: 2805296 - RNA, 18 nt, Human
ugucaccccagagccaca

SEQ ID NO: 2805297 - RNA, 19 nt, Human
ugucaccccagagccacac

SEQ ID NO: 2805298 - RNA, 20 nt, Human
ugucaccccagagccacaca

SEQ ID NO: 2805299 - RNA, 21 nt, Human
ugucaccccagagccacacau

SEQ ID NO: 2805300 - RNA, 22 nt, Human
ugucaccccagagccacacaug

SEQ ID NO: 2805301 - RNA, 18 nt, Human
ugucacccuccaccucuu

SEQ ID NO: 2805302 - RNA, 22 nt, Human
ugucacccuccaccucuucacc

SEQ ID NO: 2805303 - RNA, 14 nt, Human
ugucaccaaggaaa

SEQ ID NO: 2805304 - RNA, 15 nt, Human
ugucaccaaggaaac

SEQ ID NO: 2805305 - RNA, 23 nt, Human
ugucaccaaggaaacgcuaccuc

SEQ ID NO: 2805306 - RNA, 17 nt, Human
ugucacauggugccccu

SEQ ID NO: 2805307 - RNA, 18 nt, Human
ugucacauggugccccua

SEQ ID NO: 2805308 - RNA, 20 nt, Human
ugucacauggugccccuagc

SEQ ID NO: 2805309 - RNA, 21 nt, Human
ugucacauggugccccuagcu

SEQ ID NO: 2805310 - RNA, 14 nt, Human
ugucacauugcauu

SEQ ID NO: 2805311 - RNA, 16 nt, Human
ugucacauugcauucu

SEQ ID NO: 2805312 - RNA, 17 nt, Human
ugucacauugcauucua

SEQ ID NO: 2805313 - RNA, 19 nt, Human
ugucacauugcauucuauu

SEQ ID NO: 2805314 - RNA, 21 nt, Human
ugucacauugcauucuauugc

SEQ ID NO: 2805315 - RNA, 22 nt, Human
ugucacauugcauucuauugcc

SEQ ID NO: 2805316 - RNA, 16 nt, Human
uguccauauuuucaca

SEQ ID NO: 2805317 - RNA, 16 nt, Human
ugucccaacuuguaaa

SEQ ID NO: 2805318 - RNA, 23 nt, Human
ugucccaaaaagaaaggagggga

SEQ ID NO: 2805319 - RNA, 12 nt, Human
uguccaucugcc

SEQ ID NO: 2805320 - RNA, 13 nt, Human
uguccaucugccc

SEQ ID NO: 2805321 - RNA, 14 nt, Human
uguccaucugcccg

SEQ ID NO: 2805322 - RNA, 16 nt, Human
uguccaucugcccgcc

SEQ ID NO: 2805323 - RNA, 17 nt, Human
uguccaucugcccgccu

SEQ ID NO: 2805324 - RNA, 19 nt, Human
uguccaucugcccgccugc

SEQ ID NO: 2805325 - RNA, 22 nt, Human
uguccaucugcccgccugccca

SEQ ID NO: 2805326 - RNA, 23 nt, Human
uguccaucugcccgccugcccac

SEQ ID NO: 2805327 - RNA, 19 nt, Human
ugucauuugagcagggcuc

SEQ ID NO: 2805328 - RNA, 16 nt, Human
ugucauuugagcaggg

SEQ ID NO: 2805329 - RNA, 15 nt, Human
ugucauuucauucca

SEQ ID NO: 2805330 - RNA, 16 nt, Human
ugucauuucauuccau

SEQ ID NO: 2805331 - RNA, 20 nt, Human
ugucauuucauuccauugcc

SEQ ID NO: 2805332 - RNA, 13 nt, Human
ugucaccugaaga

SEQ ID NO: 2805333 - RNA, 16 nt, Human
ugucacgauugucauc

SEQ ID NO: 2805334 - RNA, 13 nt, Human
ugucaccuuuucu

SEQ ID NO: 2805335 - RNA, 16 nt, Human
ugucaccuuuucuugc

SEQ ID NO: 2805336 - RNA, 20 nt, Human
ugucaccuuuucuugccuga

SEQ ID NO: 2805337 - RNA, 17 nt, Human
ugucauuuaugugucag

SEQ ID NO: 2805338 - RNA, 16 nt, Human
ugucauguguucccuu

SEQ ID NO: 2805339 - RNA, 17 nt, Human
ugucauguguucccuuu

SEQ ID NO: 2805340 - RNA, 18 nt, Human
ugucauguguucccuuug

SEQ ID NO: 2805341 - RNA, 19 nt, Human
ugucauguguucccuuugu

SEQ ID NO: 2805342 - RNA, 22 nt, Human
ugucauguguucccuuugucuu

SEQ ID NO: 2805343 - RNA, 17 nt, Human
ugucaugcuucaucauu

SEQ ID NO: 2805344 - RNA, 22 nt, Human
ugucaugcuucaucauucccuc

SEQ ID NO: 2805345 - RNA, 17 nt, Human
ugucaugguuacaaacu

SEQ ID NO: 2805346 - RNA, 23 nt, Human
ugucaucuuucuucuauuuuauu

SEQ ID NO: 2805347 - RNA, 16 nt, Human
ugucaugaauucuuau

SEQ ID NO: 2805348 - RNA, 19 nt, Human
ugucaugaauucuuaugcu

SEQ ID NO: 2805349 - RNA, 21 nt, Human
ugucaugaauucuuaugcuua

SEQ ID NO: 2805350 - RNA, 20 nt, Human
uguccuacccacccuccuuu

SEQ ID NO: 2805351 - RNA, 17 nt, Human
uguccuacucuguguca

SEQ ID NO: 2805352 - RNA, 12 nt, Human
uguccuacucug

SEQ ID NO: 2805353 - RNA, 23 nt, Human
ugucccacccccacccccagcuc

SEQ ID NO: 2805354 - RNA, 17 nt, Human
ugucccacccccacccc

SEQ ID NO: 2805355 - RNA, 18 nt, Human
ugucccacccccaccccc

SEQ ID NO: 2805356 - RNA, 22 nt, Human
ugucccacccccacccccagcu

SEQ ID NO: 2805357 - RNA, 13 nt, Human
uguccccaucugu

SEQ ID NO: 2805358 - RNA, 9 nt, Human
uguccccca

SEQ ID NO: 2805359 - RNA, 13 nt, Human
ugucccccaacuu

SEQ ID NO: 2805360 - RNA, 20 nt, Human
ugucccccagguuccgaaga

SEQ ID NO: 2805361 - RNA, 17 nt, Human
ugucccacgugucuucc

SEQ ID NO: 2805362 - RNA, 21 nt, Human
ugucccacgugucuuccacuu

SEQ ID NO: 2805363 - RNA, 14 nt, Human
ugucccccaacuug

SEQ ID NO: 2805364 - RNA, 16 nt, Human
ugucccccaacuugag

SEQ ID NO: 2805365 - RNA, 14 nt, Human
uguaguuaggaaau

SEQ ID NO: 2805366 - RNA, 13 nt, Human
uguaguuaggaaa

SEQ ID NO: 2805367 - RNA, 12 nt, Human
uguaguuaggaa

SEQ ID NO: 2805368 - RNA, 14 nt, Human
uguaguuaauuuau

SEQ ID NO: 2805369 - RNA, 17 nt, Human
uguaguuaauuuaucua

SEQ ID NO: 2805370 - RNA, 18 nt, Human
uguaguuaauuuaucuaa

SEQ ID NO: 2805371 - RNA, 23 nt, Human
uguaguuaggaaauaaaaccuuu

SEQ ID NO: 2805372 - RNA, 15 nt, Human
uguaguuaggaaaua

SEQ ID NO: 2805373 - RNA, 20 nt, Human
uguagcucugcaucuccugu

SEQ ID NO: 2805374 - RNA, 12 nt, Human
uguagcuguaaa

SEQ ID NO: 2805375 - RNA, 13 nt, Human
uguagcuguaaaa

SEQ ID NO: 2805376 - RNA, 14 nt, Human
uguagcuguaaaac

SEQ ID NO: 2805377 - RNA, 17 nt, Human
uguagcuguaaaacgcu

SEQ ID NO: 2805378 - RNA, 18 nt, Human
uguagcuguaaaacgcug

SEQ ID NO: 2805379 - RNA, 17 nt, Human
uguagccuugcccggau

SEQ ID NO: 2805380 - RNA, 16 nt, Human
uguagccuugcccgga

SEQ ID NO: 2805381 - RNA, 16 nt, Human
uguagcguguuuacau

SEQ ID NO: 2805382 - RNA, 17 nt, Human
uguagcguguuuacaug

SEQ ID NO: 2805383 - RNA, 20 nt, Human
uguagcguguuuacaugugu

SEQ ID NO: 2805384 - RNA, 21 nt, Human
uguagcguguuuacaugugua

SEQ ID NO: 2805385 - RNA, 19 nt, Human
uguagcccccuggccucug

SEQ ID NO: 2805386 - RNA, 20 nt, Human
uguagcccccuggccucugu

SEQ ID NO: 2805387 - RNA, 22 nt, Human
uguagccucgccgucugugaau

SEQ ID NO: 2805388 - RNA, 13 nt, Human
uguagccugugca

SEQ ID NO: 2805389 - RNA, 14 nt, Human
uguagccugugcau

SEQ ID NO: 2805390 - RNA, 15 nt, Human
uguagccugugcaug

SEQ ID NO: 2805391 - RNA, 22 nt, Human
uguagccugugcauguaugucu

SEQ ID NO: 2805392 - RNA, 23 nt, Human
uguagccuggauauuauucuugu

SEQ ID NO: 2805393 - RNA, 16 nt, Human
uguagccugugcaugu

SEQ ID NO: 2805394 - RNA, 20 nt, Human
uguagccugugcauguaugu

SEQ ID NO: 2805395 - RNA, 16 nt, Human
uguagcccccuggccu

SEQ ID NO: 2805396 - RNA, 17 nt, Human
uguagcccccuggccuc

SEQ ID NO: 2805397 - RNA, 18 nt, Human
uguagcccccuggccucu

SEQ ID NO: 2805398 - RNA, 22 nt, Human
uguagcccacucugcucgccuu

SEQ ID NO: 2805399 - RNA, 16 nt, Human
uguagcccaggcugga

SEQ ID NO: 2805400 - RNA, 23 nt, Human
uguagcccauccuucccuuugga

SEQ ID NO: 2805401 - RNA, 17 nt, Human
uguagcccacucugcuc

SEQ ID NO: 2805402 - RNA, 16 nt, Human
uguagcccacucugcu

SEQ ID NO: 2805403 - RNA, 20 nt, Human
uguagccacuaguaaguaau

SEQ ID NO: 2805404 - RNA, 17 nt, Human
uguagccagguauggcu

SEQ ID NO: 2805405 - RNA, 20 nt, Human
uguagccagguauggcucug

SEQ ID NO: 2805406 - RNA, 21 nt, Human
uguagccagguauggcucugc

SEQ ID NO: 2805407 - RNA, 22 nt, Human
uguagccagguauggcucugca

SEQ ID NO: 2805408 - RNA, 14 nt, Human
uguagccagguccc

SEQ ID NO: 2805409 - RNA, 18 nt, Human
uguagccaggucccccug

SEQ ID NO: 2805410 - RNA, 20 nt, Human
uguagccaggucccccugca

SEQ ID NO: 2805411 - RNA, 21 nt, Human
uguagccaggucccccugcag

SEQ ID NO: 2805412 - RNA, 18 nt, Human
uguacugcauguuaccau

SEQ ID NO: 2805413 - RNA, 15 nt, Human
uguacugcucaggcu

SEQ ID NO: 2805414 - RNA, 16 nt, Human
uguacugcucaggcug

SEQ ID NO: 2805415 - RNA, 17 nt, Human
uguacugcucaggcugc

SEQ ID NO: 2805416 - RNA, 20 nt, Human
uguacugcucaggcugcagc

SEQ ID NO: 2805417 - RNA, 15 nt, Human
uguacuguucugugu

SEQ ID NO: 2805418 - RNA, 17 nt, Human
uguacuguauagacagu

SEQ ID NO: 2805419 - RNA, 19 nt, Human
uguacuguauagacaguuu

SEQ ID NO: 2805420 - RNA, 21 nt, Human
uguacuguauagacaguuugu

SEQ ID NO: 2805421 - RNA, 23 nt, Human
uguacuguauagacaguuuguaa

SEQ ID NO: 2805422 - RNA, 17 nt, Human
uguacuguaugugauga

SEQ ID NO: 2805423 - RNA, 19 nt, Human
uguacugugucauaaacag

SEQ ID NO: 2805424 - RNA, 20 nt, Human
uguacuggcuccucuguggu

SEQ ID NO: 2805425 - RNA, 15 nt, Human
uguacuguacuaauu

SEQ ID NO: 2805426 - RNA, 16 nt, Human
uguacuguacuaauuc

SEQ ID NO: 2805427 - RNA, 21 nt, Human
uguaccuuuugaggagcccca

SEQ ID NO: 2805428 - RNA, 17 nt, Human
uguaccucuggcugacu

SEQ ID NO: 2805429 - RNA, 20 nt, Human
uguaccucuggcugacuaaa

SEQ ID NO: 2805430 - RNA, 15 nt, Human
uguacgucugacagg

SEQ ID NO: 2805431 - RNA, 22 nt, Human
uguaccuuuugaggagccccag

SEQ ID NO: 2805432 - RNA, 21 nt, Human
uguaccuuuuuuguuuuuuca

SEQ ID NO: 2805433 - RNA, 11 nt, Human
uguagcaguga

SEQ ID NO: 2805434 - RNA, 22 nt, Human
uguagauuuaguguaauaagac

SEQ ID NO: 2805435 - RNA, 15 nt, Human
uguagcauauaggug

SEQ ID NO: 2805436 - RNA, 23 nt, Human
uguagcagugagaaaaagcuccu

SEQ ID NO: 2805437 - RNA, 10 nt, Human
uguagccaag

SEQ ID NO: 2805438 - RNA, 15 nt, Human
uguagaugauguauu

SEQ ID NO: 2805439 - RNA, 16 nt, Human
uguagauggaaaaacu

SEQ ID NO: 2805440 - RNA, 19 nt, Human
uguagauggaaaaacuugu

SEQ ID NO: 2805441 - RNA, 23 nt, Human
uguagauggaaaaacuugugcua

SEQ ID NO: 2805442 - RNA, 21 nt, Human
uguagauuaaggugaugugau

SEQ ID NO: 2805443 - RNA, 15 nt, Human
uguagauucugugga

SEQ ID NO: 2805444 - RNA, 12 nt, Human
uguagaugaugu

SEQ ID NO: 2805445 - RNA, 16 nt, Human
uguacuguucuguguc

SEQ ID NO: 2805446 - RNA, 19 nt, Human
uguacuguucugugucuuu

SEQ ID NO: 2805447 - RNA, 19 nt, Human
uguacuguuuaauguucug

SEQ ID NO: 2805448 - RNA, 24 nt, Human
uguacuguuuaauguucugugaua

SEQ ID NO: 2805449 - RNA, 13 nt, Human
uguagaucccaag

SEQ ID NO: 2805450 - RNA, 22 nt, Human
uguagaucccaagaugacuggg

SEQ ID NO: 2805451 - RNA, 14 nt, Human
uguagauauuuggc

SEQ ID NO: 2805452 - RNA, 15 nt, Human
uguagauauuuggcu

SEQ ID NO: 2805453 - RNA, 16 nt, Human
uguagauauuuggcuu

SEQ ID NO: 2805454 - RNA, 17 nt, Human
uguagauauuuggcuua

SEQ ID NO: 2805455 - RNA, 19 nt, Human
uguagauauuuggcuuaaa

SEQ ID NO: 2805456 - RNA, 22 nt, Human
uguagauauuuggcuuaaauau

SEQ ID NO: 2805457 - RNA, 22 nt, Human
uguaccguaggcuuuguauuca

SEQ ID NO: 2805458 - RNA, 13 nt, Human
uguaccuccccug

SEQ ID NO: 2805459 - RNA, 15 nt, Human
uguaccuccccugcc

SEQ ID NO: 2805460 - RNA, 17 nt, Human
uguaccuccccugccuu

SEQ ID NO: 2805461 - RNA, 18 nt, Human
uguaccuccccugccuug

SEQ ID NO: 2805462 - RNA, 22 nt, Human
uguaccuccccugccuugcugu

SEQ ID NO: 2805463 - RNA, 15 nt, Human
uguaccuccucucag

SEQ ID NO: 2805464 - RNA, 19 nt, Human
uguaccuccucucaguguu

SEQ ID NO: 2805465 - RNA, 20 nt, Human
uguaccuccucucaguguuu

SEQ ID NO: 2805466 - RNA, 15 nt, Human
uguacaguuuggggc

SEQ ID NO: 2805467 - RNA, 22 nt, Human
uguacacacugguacuuagagu

SEQ ID NO: 2805468 - RNA, 18 nt, Human
uguacaauguacacacug

SEQ ID NO: 2805469 - RNA, 16 nt, Human
uguacaauuaaaaacc

SEQ ID NO: 2805470 - RNA, 17 nt, Human
uguaauuaaauuauggu

SEQ ID NO: 2805471 - RNA, 18 nt, Human
uguaauuaaauuauggua

SEQ ID NO: 2805472 - RNA, 16 nt, Human
uguaauguuuguuacc

SEQ ID NO: 2805473 - RNA, 13 nt, Human
uguaauguuuucu

SEQ ID NO: 2805474 - RNA, 18 nt, Human
uguaauguuuucuuugca

SEQ ID NO: 2805475 - RNA, 19 nt, Human
uguaauguuuucuuugcaa

SEQ ID NO: 2805476 - RNA, 21 nt, Human
uguaauguuuucuuugcaaag

SEQ ID NO: 2805477 - RNA, 16 nt, Human
uguacaagaugaagga

SEQ ID NO: 2805478 - RNA, 12 nt, Human
uguacaauaaaa

SEQ ID NO: 2805479 - RNA, 16 nt, Human
uguacaauaaaaacau

SEQ ID NO: 2805480 - RNA, 20 nt, Human
uguacaauaaaaacauugcc

SEQ ID NO: 2805481 - RNA, 23 nt, Human
uguacaaggacagccccuccucc

SEQ ID NO: 2805482 - RNA, 20 nt, Human
uguacaaggacagccccucc

SEQ ID NO: 2805483 - RNA, 16 nt, Human
uguacaaggacagccc

SEQ ID NO: 2805484 - RNA, 23 nt, Human
uguaaguuucaggugacauguga

SEQ ID NO: 2805485 - RNA, 15 nt, Human
uguaaguuucaggug

SEQ ID NO: 2805486 - RNA, 16 nt, Human
uguaaguuucagguga

SEQ ID NO: 2805487 - RNA, 18 nt, Human
uguaaguuucaggugaca

SEQ ID NO: 2805488 - RNA, 19 nt, Human
uguaaguuucaggugacau

SEQ ID NO: 2805489 - RNA, 20 nt, Human
uguaaguuucaggugacaug

SEQ ID NO: 2805490 - RNA, 21 nt, Human
uguaaguuucaggugacaugu

SEQ ID NO: 2805491 - RNA, 16 nt, Human
uguaauagaaaacuga

SEQ ID NO: 2805492 - RNA, 18 nt, Human
uguaauagaaaacugaaa

SEQ ID NO: 2805493 - RNA, 20 nt, Human
uguaauagaaaacugaaaau

SEQ ID NO: 2805494 - RNA, 14 nt, Human
uguaaguuucaggu

SEQ ID NO: 2805495 - RNA, 13 nt, Human
uggucacagccuc

SEQ ID NO: 2805496 - RNA, 14 nt, Human
uggucacagccucc

SEQ ID NO: 2805497 - RNA, 15 nt, Human
uggucacagccuccu

SEQ ID NO: 2805498 - RNA, 16 nt, Human
uggucacagccuccuc

SEQ ID NO: 2805499 - RNA, 17 nt, Human
uggucacagccuccucu

SEQ ID NO: 2805500 - RNA, 18 nt, Human
uggucacagccuccucug

SEQ ID NO: 2805501 - RNA, 15 nt, Human
uggucaaucaacacu

SEQ ID NO: 2805502 - RNA, 22 nt, Human
uggucaauccgaaguaugaggg

SEQ ID NO: 2805503 - RNA, 16 nt, Human
uggucacacacugaug

SEQ ID NO: 2805504 - RNA, 15 nt, Human
uggucacacacugau

SEQ ID NO: 2805505 - RNA, 14 nt, Human
uggucacacacuga

SEQ ID NO: 2805506 - RNA, 20 nt, Human
uguaaucccagcuacucggg

SEQ ID NO: 2805507 - RNA, 13 nt, Human
uguaaucccccag

SEQ ID NO: 2805508 - RNA, 17 nt, Human
uguaauauaaagauguu

SEQ ID NO: 2805509 - RNA, 19 nt, Human
uguaauauaccagcuugua

SEQ ID NO: 2805510 - RNA, 14 nt, Human
uguaauauuuugua

SEQ ID NO: 2805511 - RNA, 17 nt, Human
uguaauauuuuguauua

SEQ ID NO: 2805512 - RNA, 22 nt, Human
uguaauauuuuguauuauugcu

SEQ ID NO: 2805513 - RNA, 23 nt, Human
uguaauauuuuguauuauugcug

SEQ ID NO: 2805514 - RNA, 22 nt, Human
uguaauauuuuuauauacagag

SEQ ID NO: 2805515 - RNA, 20 nt, Human
uguaaucuuauuuaggaagu

SEQ ID NO: 2805516 - RNA, 14 nt, Human
uguaaucucucugc

SEQ ID NO: 2805517 - RNA, 17 nt, Human
uguaaucucucugcagc

SEQ ID NO: 2805518 - RNA, 18 nt, Human
uguaaucucucugcagcu

SEQ ID NO: 2805519 - RNA, 19 nt, Human
uguaaucucucugcagcug

SEQ ID NO: 2805520 - RNA, 20 nt, Human
uguaaucucucugcagcugc

SEQ ID NO: 2805521 - RNA, 21 nt, Human
uguaaucucucugcagcugcc

SEQ ID NO: 2805522 - RNA, 22 nt, Human
uguaaucucucugcagcugccg

SEQ ID NO: 2805523 - RNA, 22 nt, Human
uguaaugucccuuucagagaca

SEQ ID NO: 2805524 - RNA, 19 nt, Human
uguaaugugugaaaaagau

SEQ ID NO: 2805525 - RNA, 23 nt, Human
uguaaugugugaaaaagaugcca

SEQ ID NO: 2805526 - RNA, 18 nt, Human
uguaaugugugguggccu

SEQ ID NO: 2805527 - RNA, 20 nt, Human
uguaaugugugguggccuca

SEQ ID NO: 2805528 - RNA, 21 nt, Human
uguaaugugugguggccucag

SEQ ID NO: 2805529 - RNA, 22 nt, Human
uguaaugugugguggccucagc

SEQ ID NO: 2805530 - RNA, 15 nt, Human
uuaaacuacagguag

SEQ ID NO: 2805531 - RNA, 14 nt, Human
uuaaacuagaugac

SEQ ID NO: 2805532 - RNA, 16 nt, Human
uuaaacuagaugaccu

SEQ ID NO: 2805533 - RNA, 18 nt, Human
uuaaacuagaugaccuca

SEQ ID NO: 2805534 - RNA, 20 nt, Human
uuaaacuagaugaccucauu

SEQ ID NO: 2805535 - RNA, 23 nt, Human
uuaaacuagaugaccucauuaac

SEQ ID NO: 2805536 - RNA, 13 nt, Human
uuaaacucaggga

SEQ ID NO: 2805537 - RNA, 14 nt, Human
uuaaacucagggac

SEQ ID NO: 2805538 - RNA, 14 nt, Human
uuaaacuaucuugu

SEQ ID NO: 2805539 - RNA, 16 nt, Human
uuaaacuaucuugugu

SEQ ID NO: 2805540 - RNA, 14 nt, Human
uuaaacucaagaca

SEQ ID NO: 2805541 - RNA, 16 nt, Human
uuaaacucaagacaau

SEQ ID NO: 2805542 - RNA, 15 nt, Human
uuaaacuugucuuuu

SEQ ID NO: 2805543 - RNA, 14 nt, Human
uuaaacuugugaau

SEQ ID NO: 2805544 - RNA, 15 nt, Human
uuaaacuugugaaug

SEQ ID NO: 2805545 - RNA, 17 nt, Human
uuaaacuugugaaugcu

SEQ ID NO: 2805546 - RNA, 16 nt, Human
uuaaacuuauaaauca

SEQ ID NO: 2805547 - RNA, 23 nt, Human
uuaaacuuauaaaucauauugau

SEQ ID NO: 2805548 - RNA, 14 nt, Human
uuaaacuuaugaau

SEQ ID NO: 2805549 - RNA, 16 nt, Human
uuaaacuuaugaaugu

SEQ ID NO: 2805550 - RNA, 18 nt, Human
uuaaaaaaaaagaucugu

SEQ ID NO: 2805551 - RNA, 14 nt, Human
uuaaaacucagccu

SEQ ID NO: 2805552 - RNA, 19 nt, Human
uuaaaacucagccugggac

SEQ ID NO: 2805553 - RNA, 19 nt, Human
uuaaaauaaacaguuguga

SEQ ID NO: 2805554 - RNA, 20 nt, Human
uuaaaauaaacaguugugaa

SEQ ID NO: 2805555 - RNA, 19 nt, Human
uuaaaaguuucaaugugau

SEQ ID NO: 2805556 - RNA, 22 nt, Human
uuaaaaguuucaaugugauucu

SEQ ID NO: 2805557 - RNA, 15 nt, Human
uuaaaauaacuagug

SEQ ID NO: 2805558 - RNA, 12 nt, Human
uuaaaacugcuu

SEQ ID NO: 2805559 - RNA, 13 nt, Human
uuaaaacugcuuu

SEQ ID NO: 2805560 - RNA, 22 nt, Human
uuaaaacugcuuuuuuuuuucc

SEQ ID NO: 2805561 - RNA, 9 nt, Human
uuaaaagaa

SEQ ID NO: 2805562 - RNA, 14 nt, Human
uuaaaacuucuuaa

SEQ ID NO: 2805563 - RNA, 15 nt, Human
uuaaaacuucuuaaa

SEQ ID NO: 2805564 - RNA, 19 nt, Human
uuaaaacuucuuaaauauc

SEQ ID NO: 2805565 - RNA, 16 nt, Human
uuaaaaguuucaaugu

SEQ ID NO: 2805566 - RNA, 17 nt, Human
uuaaaaguuucaaugug

SEQ ID NO: 2805567 - RNA, 17 nt, Human
uuaaauaucugaacauu

SEQ ID NO: 2805568 - RNA, 21 nt, Human
uuaaauaucugaacauuuacu

SEQ ID NO: 2805569 - RNA, 22 nt, Human
uuaaauaucugaacauuuacua

SEQ ID NO: 2805570 - RNA, 14 nt, Human
uuaaauaucuuuua

SEQ ID NO: 2805571 - RNA, 16 nt, Human
uuaaauaucuuuuaug

SEQ ID NO: 2805572 - RNA, 17 nt, Human
uuaaauaucuuuuaugu

SEQ ID NO: 2805573 - RNA, 18 nt, Human
uuaaauaucuuuuauguu

SEQ ID NO: 2805574 - RNA, 19 nt, Human
uuaaauaucuuuuauguuu

SEQ ID NO: 2805575 - RNA, 20 nt, Human
uuaaauaucuuuuauguuug

SEQ ID NO: 2805576 - RNA, 21 nt, Human
uuaaauaucuuuuauguuuga

SEQ ID NO: 2805577 - RNA, 22 nt, Human
uuaaauaucuuuuauguuugaa

SEQ ID NO: 2805578 - RNA, 13 nt, Human
uuaaagccuccuc

SEQ ID NO: 2805579 - RNA, 19 nt, Human
uuaaagcauauagagauga

SEQ ID NO: 2805580 - RNA, 14 nt, Human
uuaaagcauugcug

SEQ ID NO: 2805581 - RNA, 20 nt, Human
uuaaagcauugcuguuaugu

SEQ ID NO: 2805582 - RNA, 21 nt, Human
uuaaagcauugcuguuauguc

SEQ ID NO: 2805583 - RNA, 22 nt, Human
uuaaagcauugcuguuaugucu

SEQ ID NO: 2805584 - RNA, 16 nt, Human
uuaaagcauugcuuuu

SEQ ID NO: 2805585 - RNA, 22 nt, Human
uuaaagcauugcuuuuauuuug

SEQ ID NO: 2805586 - RNA, 14 nt, Human
uuaaagaaacagcu

SEQ ID NO: 2805587 - RNA, 16 nt, Human
uuaaagaaacagcuuu

SEQ ID NO: 2805588 - RNA, 21 nt, Human
uuaaagaaacagcuuucaagu

SEQ ID NO: 2805589 - RNA, 22 nt, Human
uuaaagcaagcaacacagagga

SEQ ID NO: 2805590 - RNA, 16 nt, Human
uuaaaugaggauuauu

SEQ ID NO: 2805591 - RNA, 14 nt, Human
uuaaaugaaauugu

SEQ ID NO: 2805592 - RNA, 23 nt, Human
uuaaaugaaauuguaaaaccugu

SEQ ID NO: 2805593 - RNA, 21 nt, Human
uuaaaugaauauuuugauaau

SEQ ID NO: 2805594 - RNA, 20 nt, Human
uuaaauauuaguuaauggau

SEQ ID NO: 2805595 - RNA, 14 nt, Human
uuaaaucaaagaua

SEQ ID NO: 2805596 - RNA, 13 nt, Human
uuaaaucauuuua

SEQ ID NO: 2805597 - RNA, 18 nt, Human
uuaaaucauuuuaggaaa

SEQ ID NO: 2805598 - RNA, 20 nt, Human
uuaaaucauuuuaggaaagg

SEQ ID NO: 2805599 - RNA, 21 nt, Human
uuaaaucauuuuaggaaagga

SEQ ID NO: 2805600 - RNA, 20 nt, Human
uuaaaucuaaaucuauuuau

SEQ ID NO: 2805601 - RNA, 16 nt, Human
uuaaaucugucccuga

SEQ ID NO: 2805602 - RNA, 13 nt, Human
uuaaaaaaaaaga

SEQ ID NO: 2805603 - RNA, 20 nt, Human
uuaaaaaaaaaaaaaagcuu

SEQ ID NO: 2805604 - RNA, 22 nt, Human
uuaaaaaaaaaaaaaagcuuua

SEQ ID NO: 2805605 - RNA, 23 nt, Human
uuaaaaaaaaaaaaaagcuuuau

SEQ ID NO: 2805606 - RNA, 20 nt, Human
uuaaaaaaaaaaaaaggaaa

SEQ ID NO: 2805607 - RNA, 21 nt, Human
uuaaaaaaaaaaaaaggaaaa

SEQ ID NO: 2805608 - RNA, 20 nt, Human
uguuuuugcuuguuauauua

SEQ ID NO: 2805609 - RNA, 16 nt, Human
uguuuuucuuucuaca

SEQ ID NO: 2805610 - RNA, 12 nt, Human
uguuuuucuggg

SEQ ID NO: 2805611 - RNA, 17 nt, Human
uguuuuuagacaccuuc

SEQ ID NO: 2805612 - RNA, 15 nt, Human
uguuuuuauaaaaau

SEQ ID NO: 2805613 - RNA, 21 nt, Human
uguuuuucucacuccuuuugg

SEQ ID NO: 2805614 - RNA, 12 nt, Human
uguuuuucucca

SEQ ID NO: 2805615 - RNA, 14 nt, Human
uguuuuucuccagu

SEQ ID NO: 2805616 - RNA, 15 nt, Human
uguuuuaagaaaugu

SEQ ID NO: 2805617 - RNA, 16 nt, Human
uguuuuaagaaaugua

SEQ ID NO: 2805618 - RNA, 23 nt, Human
uguuuuaagaaauguaguugaug

SEQ ID NO: 2805619 - RNA, 17 nt, Human
uguuuuaagaggcaggg

SEQ ID NO: 2805620 - RNA, 22 nt, Human
uguuuuaauuuaaacaccuccu

SEQ ID NO: 2805621 - RNA, 15 nt, Human
uguuuuaaucugaaa

SEQ ID NO: 2805622 - RNA, 18 nt, Human
uguuuuaaucugaaauuc

SEQ ID NO: 2805623 - RNA, 20 nt, Human
uguuuuaaucugaaauucua

SEQ ID NO: 2805624 - RNA, 20 nt, Human
uguuucuggguccugaagaa

SEQ ID NO: 2805625 - RNA, 18 nt, Human
uguuuuaaguacuacaca

SEQ ID NO: 2805626 - RNA, 19 nt, Human
uguuuuuaaaaguuucaau

SEQ ID NO: 2805627 - RNA, 23 nt, Human
uguuuuaauuuaaacaccuccuc

SEQ ID NO: 2805628 - RNA, 12 nt, Human
uguuuguggccu

SEQ ID NO: 2805629 - RNA, 14 nt, Human
uguuuguggccuca

SEQ ID NO: 2805630 - RNA, 13 nt, Human
uguuuguggccuc

SEQ ID NO: 2805631 - RNA, 15 nt, Human
uguuuguggccucag

SEQ ID NO: 2805632 - RNA, 12 nt, Human
uguuuguguauu

SEQ ID NO: 2805633 - RNA, 16 nt, Human
uguuuuaagaggcagg

SEQ ID NO: 2805634 - RNA, 22 nt, Human
uguuuuaaauacgcacuacaug

SEQ ID NO: 2805635 - RNA, 14 nt, Human
uguuuuaaauguac

SEQ ID NO: 2805636 - RNA, 15 nt, Human
uguuuuaaauguaca

SEQ ID NO: 2805637 - RNA, 23 nt, Human
uguuuuaaauguacagacauauu

SEQ ID NO: 2805638 - RNA, 12 nt, Human
uguuuuaaauuc

SEQ ID NO: 2805639 - RNA, 13 nt, Human
uguuuuaaauucu

SEQ ID NO: 2805640 - RNA, 14 nt, Human
uguuuuaaauucug

SEQ ID NO: 2805641 - RNA, 15 nt, Human
uguuuuaaauucuga

SEQ ID NO: 2805642 - RNA, 17 nt, Human
uguuuuaaauucugaga

SEQ ID NO: 2805643 - RNA, 22 nt, Human
uguuuuaaauucugagacaugu

SEQ ID NO: 2805644 - RNA, 11 nt, Human
uguuugugugu

SEQ ID NO: 2805645 - RNA, 14 nt, Human
uguuuguguauuua

SEQ ID NO: 2805646 - RNA, 16 nt, Human
uguuuguugcuggcuu

SEQ ID NO: 2805647 - RNA, 17 nt, Human
uguuuguugcuggcuug

SEQ ID NO: 2805648 - RNA, 13 nt, Human
uguuuaaaguggc

SEQ ID NO: 2805649 - RNA, 15 nt, Human
uguuuccucuuccaa

SEQ ID NO: 2805650 - RNA, 16 nt, Human
uguuuccucuuccaaa

SEQ ID NO: 2805651 - RNA, 18 nt, Human
uguuucccuucccuucca

SEQ ID NO: 2805652 - RNA, 17 nt, Human
uguuuccuaauaucaaa

SEQ ID NO: 2805653 - RNA, 21 nt, Human
uguuuccuaauaucaaaugca

SEQ ID NO: 2805654 - RNA, 16 nt, Human
uguuuccugcaggcca

SEQ ID NO: 2805655 - RNA, 16 nt, Human
uguuucugaaaagaaa

SEQ ID NO: 2805656 - RNA, 19 nt, Human
uguuucugaaaagaaauaa

SEQ ID NO: 2805657 - RNA, 22 nt, Human
uguuucugaaaagaaauaauaa

SEQ ID NO: 2805658 - RNA, 23 nt, Human
uguuucugaaaagaaauaauaau

SEQ ID NO: 2805659 - RNA, 17 nt, Human
uguuucugagaaaagaa

SEQ ID NO: 2805660 - RNA, 19 nt, Human
uguuuccauauuuuauagg

SEQ ID NO: 2805661 - RNA, 23 nt, Human
uguuuacuuaaagauuuaucaaa

SEQ ID NO: 2805662 - RNA, 17 nt, Human
uguuuacuuuaaacuug

SEQ ID NO: 2805663 - RNA, 18 nt, Human
uguuuacuuuaaacuugu

SEQ ID NO: 2805664 - RNA, 14 nt, Human
uguuuaccauuuuu

SEQ ID NO: 2805665 - RNA, 15 nt, Human
uguuuacuuaaagau

SEQ ID NO: 2805666 - RNA, 16 nt, Human
uguuuacuuaaagauu

SEQ ID NO: 2805667 - RNA, 17 nt, Human
uguuuacuuaaagauuu

SEQ ID NO: 2805668 - RNA, 18 nt, Human
uguuuacuuaaagauuua

SEQ ID NO: 2805669 - RNA, 19 nt, Human
uguuuacuuaaagauuuau

SEQ ID NO: 2805670 - RNA, 13 nt, Human
uuacauuguaaau

SEQ ID NO: 2805671 - RNA, 12 nt, Human
uuacauuguaaa

SEQ ID NO: 2805672 - RNA, 15 nt, Human
uuacauuuaaagcau

SEQ ID NO: 2805673 - RNA, 16 nt, Human
uuacauuuaaagcauu

SEQ ID NO: 2805674 - RNA, 21 nt, Human
uuacauuuaaagcauugcugu

SEQ ID NO: 2805675 - RNA, 22 nt, Human
uuacauuuaaagcauugcuguu

SEQ ID NO: 2805676 - RNA, 16 nt, Human
uuacauucucuaauaa

SEQ ID NO: 2805677 - RNA, 15 nt, Human
uuacagaaauacuau

SEQ ID NO: 2805678 - RNA, 16 nt, Human
uuacagaaauacuaua

SEQ ID NO: 2805679 - RNA, 17 nt, Human
uuacagaaauacuauaa

SEQ ID NO: 2805680 - RNA, 18 nt, Human
uuacagaaaaagacuuua

SEQ ID NO: 2805681 - RNA, 15 nt, Human
uuacagaaaaaucuu

SEQ ID NO: 2805682 - RNA, 13 nt, Human
uuacagaaaaaga

SEQ ID NO: 2805683 - RNA, 14 nt, Human
uuacacugccaucu

SEQ ID NO: 2805684 - RNA, 17 nt, Human
uuacacugccuguauac

SEQ ID NO: 2805685 - RNA, 18 nt, Human
uuacacugccuguauacu

SEQ ID NO: 2805686 - RNA, 19 nt, Human
uuacacugccuguauacuu

SEQ ID NO: 2805687 - RNA, 21 nt, Human
uuacacugccuguauacuuua

SEQ ID NO: 2805688 - RNA, 22 nt, Human
uuacacugccuguauacuuuag

SEQ ID NO: 2805689 - RNA, 20 nt, Human
uuacacuguaccauauagca

SEQ ID NO: 2805690 - RNA, 21 nt, Human
uuacacuguaccauauagcaa

SEQ ID NO: 2805691 - RNA, 14 nt, Human
uuacacuguauuug

SEQ ID NO: 2805692 - RNA, 17 nt, Human
uuacacuguauuuguau

SEQ ID NO: 2805693 - RNA, 20 nt, Human
uuacacccuuucuugacaaa

SEQ ID NO: 2805694 - RNA, 18 nt, Human
uuacaccgacuagccagg

SEQ ID NO: 2805695 - RNA, 22 nt, Human
uuaaugaaucguaaugaaguug

SEQ ID NO: 2805696 - RNA, 16 nt, Human
uuaaugauaaguaaau

SEQ ID NO: 2805697 - RNA, 13 nt, Human
uuaauuaauuuga

SEQ ID NO: 2805698 - RNA, 16 nt, Human
uuaauuaauuugauua

SEQ ID NO: 2805699 - RNA, 20 nt, Human
uuaauuaauuugauuaacaa

SEQ ID NO: 2805700 - RNA, 21 nt, Human
uuaauuaauuugauuaacaaa

SEQ ID NO: 2805701 - RNA, 13 nt, Human
uuaauuacaccau

SEQ ID NO: 2805702 - RNA, 16 nt, Human
uuaauuaagacugaaa

SEQ ID NO: 2805703 - RNA, 15 nt, Human
uuaauuaaacauugu

SEQ ID NO: 2805704 - RNA, 16 nt, Human
uuaauuaaacauugug

SEQ ID NO: 2805705 - RNA, 18 nt, Human
uuacacagaaacacugcc

SEQ ID NO: 2805706 - RNA, 16 nt, Human
uuacacagaaacacug

SEQ ID NO: 2805707 - RNA, 14 nt, Human
uuacacagaaacac

SEQ ID NO: 2805708 - RNA, 13 nt, Human
uuacacagaaaca

SEQ ID NO: 2805709 - RNA, 20 nt, Human
uuacacagaaacacugccuu

SEQ ID NO: 2805710 - RNA, 19 nt, Human
uuacacagaaacacugccu

SEQ ID NO: 2805711 - RNA, 14 nt, Human
uuacacauacaguu

SEQ ID NO: 2805712 - RNA, 14 nt, Human
uuacacauuaagua

SEQ ID NO: 2805713 - RNA, 16 nt, Human
uuacacauuagauuuu

SEQ ID NO: 2805714 - RNA, 16 nt, Human
uuacacauuuguacag

SEQ ID NO: 2805715 - RNA, 17 nt, Human
uuacacauuuguacaga

SEQ ID NO: 2805716 - RNA, 13 nt, Human
uuacaagaaguuu

SEQ ID NO: 2805717 - RNA, 18 nt, Human
uuacaagaaguuuauucu

SEQ ID NO: 2805718 - RNA, 20 nt, Human
uuacaagaaguuuauucuca

SEQ ID NO: 2805719 - RNA, 16 nt, Human
uuacacaauucuuacc

SEQ ID NO: 2805720 - RNA, 20 nt, Human
uuacacaauucuuacccugu

SEQ ID NO: 2805721 - RNA, 16 nt, Human
uuacacacacagaugu

SEQ ID NO: 2805722 - RNA, 23 nt, Human
uuacaacugccucgaaacacaga

SEQ ID NO: 2805723 - RNA, 22 nt, Human
uuacaacugccucgaaacacag

SEQ ID NO: 2805724 - RNA, 19 nt, Human
uuacaacauaaucuaguuu

SEQ ID NO: 2805725 - RNA, 14 nt, Human
uuaauuaggaaaaa

SEQ ID NO: 2805726 - RNA, 21 nt, Human
uuaauuacucagcagaauggu

SEQ ID NO: 2805727 - RNA, 14 nt, Human
uuaauuacuuaaaa

SEQ ID NO: 2805728 - RNA, 15 nt, Human
uuaauuagcauucug

SEQ ID NO: 2805729 - RNA, 18 nt, Human
uuaauuagcauucuggca

SEQ ID NO: 2805730 - RNA, 15 nt, Human
uuaagcacucuuaaa

SEQ ID NO: 2805731 - RNA, 14 nt, Human
uuaagcaacaucuu

SEQ ID NO: 2805732 - RNA, 19 nt, Human
uuaagcaacaucuuuuuaa

SEQ ID NO: 2805733 - RNA, 21 nt, Human
uuaagauuuuucucaaaguuu

SEQ ID NO: 2805734 - RNA, 14 nt, Human
uuaagcaaauacuu

SEQ ID NO: 2805735 - RNA, 15 nt, Human
uuaagcaaauacuua

SEQ ID NO: 2805736 - RNA, 18 nt, Human
uuaagcauuaccacucag

SEQ ID NO: 2805737 - RNA, 13 nt, Human
uuaagcauuacca

SEQ ID NO: 2805738 - RNA, 13 nt, Human
uuaauaauaaucu

SEQ ID NO: 2805739 - RNA, 16 nt, Human
uuaauaauaaucuagg

SEQ ID NO: 2805740 - RNA, 15 nt, Human
uuaauaacauuaccu

SEQ ID NO: 2805741 - RNA, 13 nt, Human
uuaauaacauuac

SEQ ID NO: 2805742 - RNA, 16 nt, Human
uuaauaacauuaccuu

SEQ ID NO: 2805743 - RNA, 17 nt, Human
uuaauaacauuaccuua

SEQ ID NO: 2805744 - RNA, 20 nt, Human
uuaauaacauuaccuuacug

SEQ ID NO: 2805745 - RNA, 21 nt, Human
uuaauaacauuaccuuacugu

SEQ ID NO: 2805746 - RNA, 19 nt, Human
uuaagccucauauuuaaag

SEQ ID NO: 2805747 - RNA, 20 nt, Human
uuaauagagaaggaaagcuu

SEQ ID NO: 2805748 - RNA, 23 nt, Human
uuaauagagaaggaaagcuuugg

SEQ ID NO: 2805749 - RNA, 17 nt, Human
uuaauagaucuuagggu

SEQ ID NO: 2805750 - RNA, 21 nt, Human
uuaauacgcaggcaucugauu

SEQ ID NO: 2805751 - RNA, 15 nt, Human
uuaauacuaaaauau

SEQ ID NO: 2805752 - RNA, 15 nt, Human
uuaauacuaccuuga

SEQ ID NO: 2805753 - RNA, 22 nt, Human
uuaauacaguuuauuuuuaaag

SEQ ID NO: 2805754 - RNA, 17 nt, Human
uuaauacuaccuugaaa

SEQ ID NO: 2805755 - RNA, 13 nt, Human
uuaagaguccaag

SEQ ID NO: 2805756 - RNA, 14 nt, Human
uuaagaguccaaga

SEQ ID NO: 2805757 - RNA, 19 nt, Human
uuaagaguccaagaaucca

SEQ ID NO: 2805758 - RNA, 15 nt, Human
uuaagauuuuacaaa

SEQ ID NO: 2805759 - RNA, 16 nt, Human
uuaagauuuuacaaaa

SEQ ID NO: 2805760 - RNA, 18 nt, Human
uuaagauuuuacaaaaga

SEQ ID NO: 2805761 - RNA, 14 nt, Human
uuaagauuuuucuc

SEQ ID NO: 2805762 - RNA, 15 nt, Human
uuaagauuuuucuca

SEQ ID NO: 2805763 - RNA, 16 nt, Human
uuaagauuuuucucaa

SEQ ID NO: 2805764 - RNA, 17 nt, Human
uuaagauuuuucucaaa

SEQ ID NO: 2805765 - RNA, 20 nt, Human
uuaagauuuuucucaaaguu

SEQ ID NO: 2805766 - RNA, 22 nt, Human
uuaagauuuuucucaaaguuuu

SEQ ID NO: 2805767 - RNA, 19 nt, Human
uuaagcaaaagaaaaagau

SEQ ID NO: 2805768 - RNA, 14 nt, Human
uuaagauacaaauu

SEQ ID NO: 2805769 - RNA, 15 nt, Human
uuaagauacaaauua

SEQ ID NO: 2805770 - RNA, 20 nt, Human
uuaagauacaaauuaauuuu

SEQ ID NO: 2805771 - RNA, 12 nt, Human
uuaaauguauac

SEQ ID NO: 2805772 - RNA, 19 nt, Human
uuaaaugucuuauauagca

SEQ ID NO: 2805773 - RNA, 19 nt, Human
uuaaauguauacuauagua

SEQ ID NO: 2805774 - RNA, 14 nt, Human
uuaaauguauacua

SEQ ID NO: 2805775 - RNA, 17 nt, Human
uuaaauguguacaaugu

SEQ ID NO: 2805776 - RNA, 18 nt, Human
uuaaauguguacaaugua

SEQ ID NO: 2805777 - RNA, 20 nt, Human
uuaaauguuaugacuaugua

SEQ ID NO: 2805778 - RNA, 16 nt, Human
uuaaauguuaugacua

SEQ ID NO: 2805779 - RNA, 16 nt, Human
uguugacaguucugaa

SEQ ID NO: 2805780 - RNA, 18 nt, Human
uguugacauaccuuuuau

SEQ ID NO: 2805781 - RNA, 15 nt, Human
uguugacauauuuaa

SEQ ID NO: 2805782 - RNA, 16 nt, Human
uguugacauauuuaau

SEQ ID NO: 2805783 - RNA, 18 nt, Human
uguugacauauuuaaugu

SEQ ID NO: 2805784 - RNA, 19 nt, Human
uguugacauauuuaauguu

SEQ ID NO: 2805785 - RNA, 20 nt, Human
uguugacauauuuaauguuu

SEQ ID NO: 2805786 - RNA, 21 nt, Human
uguugacauauuuaauguuuu

SEQ ID NO: 2805787 - RNA, 23 nt, Human
uguugacauauuuaauguuuuaa

SEQ ID NO: 2805788 - RNA, 15 nt, Human
uguugacaacuguga

SEQ ID NO: 2805789 - RNA, 18 nt, Human
uguugacaacugugacug

SEQ ID NO: 2805790 - RNA, 15 nt, Human
uguugaauucuuuug

SEQ ID NO: 2805791 - RNA, 18 nt, Human
uguugaauucuuuugcca

SEQ ID NO: 2805792 - RNA, 22 nt, Human
uguugacaaaauuuucucauuu

SEQ ID NO: 2805793 - RNA, 18 nt, Human
uguugaauacuuuuuaca

SEQ ID NO: 2805794 - RNA, 13 nt, Human
uguugaauacuuu

SEQ ID NO: 2805795 - RNA, 15 nt, Human
uguugaagccuuugu

SEQ ID NO: 2805796 - RNA, 17 nt, Human
uguugaagggagguggc

SEQ ID NO: 2805797 - RNA, 13 nt, Human
uguugaagucacc

SEQ ID NO: 2805798 - RNA, 18 nt, Human
uguugaccaugucuauga

SEQ ID NO: 2805799 - RNA, 22 nt, Human
uguugagaaucccaaauuugau

SEQ ID NO: 2805800 - RNA, 18 nt, Human
uguugacauuaagaaugu

SEQ ID NO: 2805801 - RNA, 22 nt, Human
uguugacauuaagaauguuggu

SEQ ID NO: 2805802 - RNA, 15 nt, Human
uguucugcuuuccuc

SEQ ID NO: 2805803 - RNA, 14 nt, Human
uguucuuuuuauug

SEQ ID NO: 2805804 - RNA, 17 nt, Human
uguucuuuuuauugaau

SEQ ID NO: 2805805 - RNA, 15 nt, Human
uguugaaaaccaaaa

SEQ ID NO: 2805806 - RNA, 18 nt, Human
uguugaaaaccaaaauga

SEQ ID NO: 2805807 - RNA, 18 nt, Human
uguucugcccccagccca

SEQ ID NO: 2805808 - RNA, 22 nt, Human
uguucugcccccagcccaaagg

SEQ ID NO: 2805809 - RNA, 18 nt, Human
uguucucggaguguguau

SEQ ID NO: 2805810 - RNA, 17 nt, Human
uguucucggagugugua

SEQ ID NO: 2805811 - RNA, 21 nt, Human
uguucuccuuuuccucucucc

SEQ ID NO: 2805812 - RNA, 21 nt, Human
uguuggaagcuuguuuuccag

SEQ ID NO: 2805813 - RNA, 12 nt, Human
uguuggaaugaa

SEQ ID NO: 2805814 - RNA, 14 nt, Human
uguuggacaaaugu

SEQ ID NO: 2805815 - RNA, 16 nt, Human
uguuggacaaauguga

SEQ ID NO: 2805816 - RNA, 19 nt, Human
uguuggacaaaugugaaga

SEQ ID NO: 2805817 - RNA, 20 nt, Human
uguuggacaaaugugaagau

SEQ ID NO: 2805818 - RNA, 22 nt, Human
uguuggacaaaugugaagaugc

SEQ ID NO: 2805819 - RNA, 23 nt, Human
uguuggacaaaugugaagaugca

SEQ ID NO: 2805820 - RNA, 16 nt, Human
uguugauccauccagc

SEQ ID NO: 2805821 - RNA, 19 nt, Human
uguugauccauccagcuug

SEQ ID NO: 2805822 - RNA, 20 nt, Human
uguugauccauccagcuugc

SEQ ID NO: 2805823 - RNA, 16 nt, Human
uguugaucccaagaca

SEQ ID NO: 2805824 - RNA, 12 nt, Human
uguugaucccaa

SEQ ID NO: 2805825 - RNA, 22 nt, Human
uguugaugggcacuugagaacu

SEQ ID NO: 2805826 - RNA, 13 nt, Human
uguugauguaucu

SEQ ID NO: 2805827 - RNA, 17 nt, Human
uguugauguaucugagu

SEQ ID NO: 2805828 - RNA, 19 nt, Human
uguugauguaucugaguug

SEQ ID NO: 2805829 - RNA, 21 nt, Human
uguugauguaucugaguugcc

SEQ ID NO: 2805830 - RNA, 22 nt, Human
uguugauguaucugaguugcca

SEQ ID NO: 2805831 - RNA, 13 nt, Human
uguugauuaaaac

SEQ ID NO: 2805832 - RNA, 14 nt, Human
uguugauuaaaaca

SEQ ID NO: 2805833 - RNA, 21 nt, Human
uguuggacaccuuuagguucu

SEQ ID NO: 2805834 - RNA, 16 nt, Human
uguuggccaggcuggu

SEQ ID NO: 2805835 - RNA, 15 nt, Human
uguuggccaggcugg

SEQ ID NO: 2805836 - RNA, 18 nt, Human
uguuggccaggcugcucu

SEQ ID NO: 2805837 - RNA, 14 nt, Human
uguuggcagccucu

SEQ ID NO: 2805838 - RNA, 14 nt, Human
uguuggcuuuguuu

SEQ ID NO: 2805839 - RNA, 13 nt, Human
uguugggaaaaag

SEQ ID NO: 2805840 - RNA, 23 nt, Human
uguugggaaaaaggccucugucc

SEQ ID NO: 2805841 - RNA, 15 nt, Human
uguuuacauguguag

SEQ ID NO: 2805842 - RNA, 22 nt, Human
uguuuacauguguagccuaugu

SEQ ID NO: 2805843 - RNA, 14 nt, Human
uguuuaagaaaagu

SEQ ID NO: 2805844 - RNA, 18 nt, Human
uguuuaagaaaaguauuu

SEQ ID NO: 2805845 - RNA, 21 nt, Human
uguuuaagaaaaguauuuuga

SEQ ID NO: 2805846 - RNA, 22 nt, Human
uguuuaagaaaaguauuuugaa

SEQ ID NO: 2805847 - RNA, 14 nt, Human
uguuuaagaugggc

SEQ ID NO: 2805848 - RNA, 19 nt, Human
uguuggcugggggccucag

SEQ ID NO: 2805849 - RNA, 22 nt, Human
uguuggcugggaacucaccugg

SEQ ID NO: 2805850 - RNA, 21 nt, Human
uguuggcagugagugagccug

SEQ ID NO: 2805851 - RNA, 23 nt, Human
uguuggccaggcuggucuaaaac

SEQ ID NO: 2805852 - RNA, 17 nt, Human
uguuggcugggggccuc

SEQ ID NO: 2805853 - RNA, 11 nt, Human
uguguuuccuu

SEQ ID NO: 2805854 - RNA, 16 nt, Human
uguguuugaaaucauc

SEQ ID NO: 2805855 - RNA, 15 nt, Human
uguguuuuuaauaaa

SEQ ID NO: 2805856 - RNA, 14 nt, Human
uguguuuuuauugu

SEQ ID NO: 2805857 - RNA, 19 nt, Human
uguguuuuuauuguuaacu

SEQ ID NO: 2805858 - RNA, 20 nt, Human
uguguuuuuaauaaagacag

SEQ ID NO: 2805859 - RNA, 14 nt, Human
uguguuuauuucac

SEQ ID NO: 2805860 - RNA, 15 nt, Human
uguguuuauuucacu

SEQ ID NO: 2805861 - RNA, 13 nt, Human
uguguuucaaacu

SEQ ID NO: 2805862 - RNA, 19 nt, Human
ugugugugcuuauguauga

SEQ ID NO: 2805863 - RNA, 23 nt, Human
ugugugugaccccuccuggggcc

SEQ ID NO: 2805864 - RNA, 16 nt, Human
ugugugucuuaauuau

SEQ ID NO: 2805865 - RNA, 17 nt, Human
ugugugugaaaaugugu

SEQ ID NO: 2805866 - RNA, 20 nt, Human
ugugugugaaugaacacucu

SEQ ID NO: 2805867 - RNA, 16 nt, Human
ugugugugaaugaaca

SEQ ID NO: 2805868 - RNA, 14 nt, Human
uguguaugccaaga

SEQ ID NO: 2805869 - RNA, 21 nt, Human
uguguaucguaaccagccaga

SEQ ID NO: 2805870 - RNA, 17 nt, Human
uguguaucucuuucaca

SEQ ID NO: 2805871 - RNA, 18 nt, Human
uguguaugcgugugugug

SEQ ID NO: 2805872 - RNA, 16 nt, Human
ugugugaugaacuuuc

SEQ ID NO: 2805873 - RNA, 17 nt, Human
ugugugaugaacuuucu

SEQ ID NO: 2805874 - RNA, 19 nt, Human
ugugugcacguacacacac

SEQ ID NO: 2805875 - RNA, 16 nt, Human
ugugugcaaaagcagu

SEQ ID NO: 2805876 - RNA, 17 nt, Human
ugugugcaaaagcagug

SEQ ID NO: 2805877 - RNA, 17 nt, Human
ugugugcaccuuaccaa

SEQ ID NO: 2805878 - RNA, 22 nt, Human
ugugugcaccuuaccaacuuuc

SEQ ID NO: 2805879 - RNA, 23 nt, Human
ugugugcaccuuaccaacuuucu

SEQ ID NO: 2805880 - RNA, 19 nt, Human
uguguaauuuaugugaaaa

SEQ ID NO: 2805881 - RNA, 15 nt, Human
ugugugcuuauguau

SEQ ID NO: 2805882 - RNA, 11 nt, Human
uguguggccug

SEQ ID NO: 2805883 - RNA, 16 nt, Human
uguguggacuguggca

SEQ ID NO: 2805884 - RNA, 22 nt, Human
ugugugcucauguaugugcgaa

SEQ ID NO: 2805885 - RNA, 17 nt, Human
ugugugcucauguaugu

SEQ ID NO: 2805886 - RNA, 23 nt, Human
uguguggacuguggcacuugccu

SEQ ID NO: 2805887 - RNA, 16 nt, Human
uguguggccacuucug

SEQ ID NO: 2805888 - RNA, 17 nt, Human
uguguggccacuucugu

SEQ ID NO: 2805889 - RNA, 18 nt, Human
uguguggccacuucuguc

SEQ ID NO: 2805890 - RNA, 20 nt, Human
uguguggccacuucugucca

SEQ ID NO: 2805891 - RNA, 12 nt, Human
uguuaaaauaac

SEQ ID NO: 2805892 - RNA, 18 nt, Human
uguuaaaacacuucuguc

SEQ ID NO: 2805893 - RNA, 13 nt, Human
uguuaaaaauaaa

SEQ ID NO: 2805894 - RNA, 16 nt, Human
uguuaaaaauaaaucc

SEQ ID NO: 2805895 - RNA, 14 nt, Human
uguguuuuucucca

SEQ ID NO: 2805896 - RNA, 16 nt, Human
uguguuuuucuccagu

SEQ ID NO: 2805897 - RNA, 18 nt, Human
uguguuuuucuccagugc

SEQ ID NO: 2805898 - RNA, 20 nt, Human
uguguuuuucuccagugcug

SEQ ID NO: 2805899 - RNA, 21 nt, Human
uguuaaaauuaucaauaucua

SEQ ID NO: 2805900 - RNA, 14 nt, Human
uguuaaaauaacua

SEQ ID NO: 2805901 - RNA, 12 nt, Human
uguuaaaaucua

SEQ ID NO: 2805902 - RNA, 14 nt, Human
uguuaaaaucuauu

SEQ ID NO: 2805903 - RNA, 15 nt, Human
uguuaaaagauuuuu

SEQ ID NO: 2805904 - RNA, 23 nt, Human
uguuaaaauuaucaauaucuaau

SEQ ID NO: 2805905 - RNA, 17 nt, Human
uguuaaaauuaugaauc

SEQ ID NO: 2805906 - RNA, 20 nt, Human
uguuaaaauuaugaaucuga

SEQ ID NO: 2805907 - RNA, 17 nt, Human
uguuaaacagccuauuc

SEQ ID NO: 2805908 - RNA, 15 nt, Human
uguuacccaugaaaa

SEQ ID NO: 2805909 - RNA, 15 nt, Human
uguuaccgccugucu

SEQ ID NO: 2805910 - RNA, 17 nt, Human
uguuaccgccugucucu

SEQ ID NO: 2805911 - RNA, 18 nt, Human
uguuaccuaaaguauuuu

SEQ ID NO: 2805912 - RNA, 19 nt, Human
uguuaccuccaacagaacu

SEQ ID NO: 2805913 - RNA, 17 nt, Human
uguuacuaaagaaaaua

SEQ ID NO: 2805914 - RNA, 14 nt, Human
uguuacucuuacga

SEQ ID NO: 2805915 - RNA, 14 nt, Human
uguuacuauuuucu

SEQ ID NO: 2805916 - RNA, 15 nt, Human
uguuacuauuuucua

SEQ ID NO: 2805917 - RNA, 18 nt, Human
uguuacuauuuucuacaa

SEQ ID NO: 2805918 - RNA, 20 nt, Human
uguuacuauuuucuacaauu

SEQ ID NO: 2805919 - RNA, 22 nt, Human
uguuacuauuuucuacaauuaa

SEQ ID NO: 2805920 - RNA, 16 nt, Human
uguuaggaaaauuuca

SEQ ID NO: 2805921 - RNA, 14 nt, Human
uguuagcuuccuua

SEQ ID NO: 2805922 - RNA, 15 nt, Human
uguuagcuuccuuaa

SEQ ID NO: 2805923 - RNA, 20 nt, Human
uguuagcuuccuuaaguaua

SEQ ID NO: 2805924 - RNA, 20 nt, Human
uguuagcuuuuuaaaacauu

SEQ ID NO: 2805925 - RNA, 18 nt, Human
uguuagcuccaaagcauu

SEQ ID NO: 2805926 - RNA, 17 nt, Human
uguuagcuccucacugu

SEQ ID NO: 2805927 - RNA, 18 nt, Human
uguuagcuccucacugug

SEQ ID NO: 2805928 - RNA, 17 nt, Human
uguuagccccauaauuu

SEQ ID NO: 2805929 - RNA, 14 nt, Human
uguuacugcaguug

SEQ ID NO: 2805930 - RNA, 12 nt, Human
uguuacuguaau

SEQ ID NO: 2805931 - RNA, 14 nt, Human
uguuacuguaauuc

SEQ ID NO: 2805932 - RNA, 9 nt, Human
uguuacugu

SEQ ID NO: 2805933 - RNA, 20 nt, Human
uguuagcacuguugauguau

SEQ ID NO: 2805934 - RNA, 22 nt, Human
uguuagcacuguugauguaucu

SEQ ID NO: 2805935 - RNA, 22 nt, Human
uguucagaagguugcucuagau

SEQ ID NO: 2805936 - RNA, 18 nt, Human
uguucagaagguugcucu

SEQ ID NO: 2805937 - RNA, 19 nt, Human
uguucacuuuuccucccuc

SEQ ID NO: 2805938 - RNA, 16 nt, Human
uguucacuuuuccucc

SEQ ID NO: 2805939 - RNA, 22 nt, Human
uguucagcuccagcucaccagc

SEQ ID NO: 2805940 - RNA, 21 nt, Human
uguucagcuccagcucaccag

SEQ ID NO: 2805941 - RNA, 20 nt, Human
uguucagcuccagcucacca

SEQ ID NO: 2805942 - RNA, 18 nt, Human
uguucagcuccagcucac

SEQ ID NO: 2805943 - RNA, 12 nt, Human
uguucauacauu

SEQ ID NO: 2805944 - RNA, 13 nt, Human
cugccagggagcu

SEQ ID NO: 2805945 - RNA, 12 nt, Human
cugccagggagc

SEQ ID NO: 2805946 - RNA, 13 nt, Human
cugccagggcagu

SEQ ID NO: 2805947 - RNA, 15 nt, Human
cugccagggcagugc

SEQ ID NO: 2805948 - RNA, 16 nt, Human
cugccagggcagugcu

SEQ ID NO: 2805949 - RNA, 17 nt, Human
cugccagggcagugcua

SEQ ID NO: 2805950 - RNA, 12 nt, Human
cugccagggcag

SEQ ID NO: 2805951 - RNA, 22 nt, Human
cugccagucccccugccccagg

SEQ ID NO: 2805952 - RNA, 20 nt, Human
cugccagucccccugcccca

SEQ ID NO: 2805953 - RNA, 21 nt, Human
cugccagucccccugccccag

SEQ ID NO: 2805954 - RNA, 17 nt, Human
cugccagucccccugcc

SEQ ID NO: 2805955 - RNA, 15 nt, Human
cugccaguguggaac

SEQ ID NO: 2805956 - RNA, 15 nt, Human
cugccaguguggagu

SEQ ID NO: 2805957 - RNA, 17 nt, Human
cugccauauauaacaga

SEQ ID NO: 2805958 - RNA, 19 nt, Human
cugccauccagguucagcu

SEQ ID NO: 2805959 - RNA, 18 nt, Human
cugccauccagguucagc

SEQ ID NO: 2805960 - RNA, 16 nt, Human
cugccauccagguuca

SEQ ID NO: 2805961 - RNA, 16 nt, Human
cugccauauucuguug

SEQ ID NO: 2805962 - RNA, 12 nt, Human
cugcccccacga

SEQ ID NO: 2805963 - RNA, 21 nt, Human
cugcccccacgagggucagga

SEQ ID NO: 2805964 - RNA, 14 nt, Human
cugcccccagccca

SEQ ID NO: 2805965 - RNA, 15 nt, Human
cugcccccagcccaa

SEQ ID NO: 2805966 - RNA, 16 nt, Human
cugcccccagcccaaa

SEQ ID NO: 2805967 - RNA, 18 nt, Human
cugcccccagcccaaagg

SEQ ID NO: 2805968 - RNA, 16 nt, Human
cugccccaucugggga

SEQ ID NO: 2805969 - RNA, 16 nt, Human
cugcccccggcccccu

SEQ ID NO: 2805970 - RNA, 17 nt, Human
cugcccccggcccccug

SEQ ID NO: 2805971 - RNA, 18 nt, Human
cugcccccggcccccugg

SEQ ID NO: 2805972 - RNA, 17 nt, Human
cugccccgcccagcugc

SEQ ID NO: 2805973 - RNA, 16 nt, Human
cugccccgcccagcug

SEQ ID NO: 2805974 - RNA, 15 nt, Human
cugccccgcccagcu

SEQ ID NO: 2805975 - RNA, 19 nt, Human
cugccccccccccccaucu

SEQ ID NO: 2805976 - RNA, 21 nt, Human
cugccccccagccucuggcau

SEQ ID NO: 2805977 - RNA, 13 nt, Human
cugccccccagcc

SEQ ID NO: 2805978 - RNA, 16 nt, Human
cugccccccagccucu

SEQ ID NO: 2805979 - RNA, 19 nt, Human
cugccccccagccucuggc

SEQ ID NO: 2805980 - RNA, 12 nt, Human
cugccccccagc

SEQ ID NO: 2805981 - RNA, 19 nt, Human
cugccccuccucucugccc

SEQ ID NO: 2805982 - RNA, 18 nt, Human
cugccccuccucucugcc

SEQ ID NO: 2805983 - RNA, 17 nt, Human
cugccccuccucucugc

SEQ ID NO: 2805984 - RNA, 13 nt, Human
cugccccucccuu

SEQ ID NO: 2805985 - RNA, 14 nt, Human
cugccccucccuuc

SEQ ID NO: 2805986 - RNA, 17 nt, Human
cugccccucccuucaac

SEQ ID NO: 2805987 - RNA, 23 nt, Human
cugcacuauagccuaggugacag

SEQ ID NO: 2805988 - RNA, 22 nt, Human
cugcacuauagccuaggugaca

SEQ ID NO: 2805989 - RNA, 16 nt, Human
cugcacuaauuugaug

SEQ ID NO: 2805990 - RNA, 18 nt, Human
cugcacuaaagccagccu

SEQ ID NO: 2805991 - RNA, 19 nt, Human
cugcacuaaagccagccug

SEQ ID NO: 2805992 - RNA, 20 nt, Human
cugcacuaaagccagccuga

SEQ ID NO: 2805993 - RNA, 21 nt, Human
cugcacuaaagccagccugac

SEQ ID NO: 2805994 - RNA, 22 nt, Human
cugcacuaaagccagccugacc

SEQ ID NO: 2805995 - RNA, 23 nt, Human
cugcacuaaagccagccugaccu

SEQ ID NO: 2805996 - RNA, 20 nt, Human
cugcacuauagccuagguga

SEQ ID NO: 2805997 - RNA, 18 nt, Human
cugcacuauagccuaggu

SEQ ID NO: 2805998 - RNA, 17 nt, Human
cugcacuauagccuagg

SEQ ID NO: 2805999 - RNA, 16 nt, Human
cugcacuauagccuag

SEQ ID NO: 2806000 - RNA, 17 nt, Human
cugcacuccagccuggg

SEQ ID NO: 2806001 - RNA, 16 nt, Human
cugcacuccagccugg

SEQ ID NO: 2806002 - RNA, 14 nt, Human
cugcacuccagccu

SEQ ID NO: 2806003 - RNA, 14 nt, Human
cugcacucaagcuu

SEQ ID NO: 2806004 - RNA, 17 nt, Human
cugcacucaaccuuaag

SEQ ID NO: 2806005 - RNA, 19 nt, Human
cugcacuccagccugggcg

SEQ ID NO: 2806006 - RNA, 18 nt, Human
cugcacuccagccugggc

SEQ ID NO: 2806007 - RNA, 24 nt, Human
cugcagccucaaccuccugggcua

SEQ ID NO: 2806008 - RNA, 20 nt, Human
cugcacuccagccugggcga

SEQ ID NO: 2806009 - RNA, 23 nt, Human
cugcagccucaaccuccugggcu

SEQ ID NO: 2806010 - RNA, 15 nt, Human
cugcagcuaguccua

SEQ ID NO: 2806011 - RNA, 21 nt, Human
cugcagcuaguccuagugaac

SEQ ID NO: 2806012 - RNA, 20 nt, Human
cugcagccuuugccuccccg

SEQ ID NO: 2806013 - RNA, 18 nt, Human
cugcagccuuugccuccc

SEQ ID NO: 2806014 - RNA, 17 nt, Human
cugcagccuugaacucu

SEQ ID NO: 2806015 - RNA, 21 nt, Human
cugcagccuugaacucugggc

SEQ ID NO: 2806016 - RNA, 22 nt, Human
cugcagccuugaacucugggcu

SEQ ID NO: 2806017 - RNA, 14 nt, Human
cugcagcugggcug

SEQ ID NO: 2806018 - RNA, 13 nt, Human
cugcagcugggcu

SEQ ID NO: 2806019 - RNA, 11 nt, Human
cugcagcuucc

SEQ ID NO: 2806020 - RNA, 12 nt, Human
cugcagcuuccu

SEQ ID NO: 2806021 - RNA, 13 nt, Human
cugcagcuuccug

SEQ ID NO: 2806022 - RNA, 15 nt, Human
cugcagcuuccuguc

SEQ ID NO: 2806023 - RNA, 19 nt, Human
cugcagcuuccugucaaca

SEQ ID NO: 2806024 - RNA, 12 nt, Human
cugcagcuuggg

SEQ ID NO: 2806025 - RNA, 13 nt, Human
cugcagcuuggga

SEQ ID NO: 2806026 - RNA, 22 nt, Human
cugcagcuugggagagccccug

SEQ ID NO: 2806027 - RNA, 11 nt, Human
cugcagcugcc

SEQ ID NO: 2806028 - RNA, 12 nt, Human
cugcagcugccg

SEQ ID NO: 2806029 - RNA, 13 nt, Human
cugcagcugccgg

SEQ ID NO: 2806030 - RNA, 22 nt, Human
cugcagcugccgggccugauuu

SEQ ID NO: 2806031 - RNA, 13 nt, Human
cugcagcuggaca

SEQ ID NO: 2806032 - RNA, 14 nt, Human
cugcagcuggacag

SEQ ID NO: 2806033 - RNA, 15 nt, Human
cugcagcuggacaga

SEQ ID NO: 2806034 - RNA, 16 nt, Human
cugcagcuggacagag

SEQ ID NO: 2806035 - RNA, 17 nt, Human
cugcagcuggacagagg

SEQ ID NO: 2806036 - RNA, 18 nt, Human
cugcagcuggacagaggg

SEQ ID NO: 2806037 - RNA, 19 nt, Human
cugcagcuggacagagggg

SEQ ID NO: 2806038 - RNA, 17 nt, Human
cugcaggccaggccagc

SEQ ID NO: 2806039 - RNA, 24 nt, Human
cugcaggccaagagcagaggcagc

SEQ ID NO: 2806040 - RNA, 23 nt, Human
cugcaggccaagagcagaggcag

SEQ ID NO: 2806041 - RNA, 22 nt, Human
cugcaggccaagagcagaggca

SEQ ID NO: 2806042 - RNA, 23 nt, Human
cugcaggccaggccagcugccuc

SEQ ID NO: 2806043 - RNA, 18 nt, Human
cugcaggccaggccagcu

SEQ ID NO: 2806044 - RNA, 17 nt, Human
cugcaggcaucacagcu

SEQ ID NO: 2806045 - RNA, 21 nt, Human
cugcaggccaagagcagaggc

SEQ ID NO: 2806046 - RNA, 19 nt, Human
cugcaggccaagagcagag

SEQ ID NO: 2806047 - RNA, 15 nt, Human
cugcaggccaagagc

SEQ ID NO: 2806048 - RNA, 12 nt, Human
cugcagcuuuac

SEQ ID NO: 2806049 - RNA, 14 nt, Human
cugcagcuuuacau

SEQ ID NO: 2806050 - RNA, 21 nt, Human
cugcagcuuuacaugcaauuu

SEQ ID NO: 2806051 - RNA, 19 nt, Human
cugcaggacuugagaagac

SEQ ID NO: 2806052 - RNA, 22 nt, Human
cugcaggaccugccuguagccc

SEQ ID NO: 2806053 - RNA, 23 nt, Human
cugcaggacuugagaagaccuca

SEQ ID NO: 2806054 - RNA, 21 nt, Human
cugcaggaccugccuguagcc

SEQ ID NO: 2806055 - RNA, 18 nt, Human
cugcaggaccugccugua

SEQ ID NO: 2806056 - RNA, 17 nt, Human
cugcaggaccugccugu

SEQ ID NO: 2806057 - RNA, 16 nt, Human
cugcaggaccugccug

SEQ ID NO: 2806058 - RNA, 15 nt, Human
cugcaggaccugccu

SEQ ID NO: 2806059 - RNA, 14 nt, Human
cugcaggaccugcc

SEQ ID NO: 2806060 - RNA, 15 nt, Human
cugcaggaaucaaaa

SEQ ID NO: 2806061 - RNA, 20 nt, Human
cugcaggaaucaaaaauuga

SEQ ID NO: 2806062 - RNA, 22 nt, Human
cugcaggaaucaaaaauugaag

SEQ ID NO: 2806063 - RNA, 15 nt, Human
cugcaagaggcuccu

SEQ ID NO: 2806064 - RNA, 16 nt, Human
cugcaagaggcuccug

SEQ ID NO: 2806065 - RNA, 18 nt, Human
cugcaagaggcuccuguc

SEQ ID NO: 2806066 - RNA, 20 nt, Human
cugcaagcacaucugcauuu

SEQ ID NO: 2806067 - RNA, 17 nt, Human
cugcaaggucuuugguu

SEQ ID NO: 2806068 - RNA, 13 nt, Human
cugcaagccuguc

SEQ ID NO: 2806069 - RNA, 14 nt, Human
cugcaaggacauuc

SEQ ID NO: 2806070 - RNA, 19 nt, Human
cugcaaggacauucuugua

SEQ ID NO: 2806071 - RNA, 13 nt, Human
cugcaaggcccac

SEQ ID NO: 2806072 - RNA, 14 nt, Human
cugcaaggcccaca

SEQ ID NO: 2806073 - RNA, 16 nt, Human
cugcaaggcccacagg

SEQ ID NO: 2806074 - RNA, 17 nt, Human
cugcaaggcccacagga

SEQ ID NO: 2806075 - RNA, 18 nt, Human
cugcaaggcccacaggag

SEQ ID NO: 2806076 - RNA, 19 nt, Human
cugcaaggcccacaggagg

SEQ ID NO: 2806077 - RNA, 20 nt, Human
cugcaaggcccacaggaggc

SEQ ID NO: 2806078 - RNA, 23 nt, Human
cugcaccgggccacagagaaagu

SEQ ID NO: 2806079 - RNA, 20 nt, Human
cugcaccgggccacagagaa

SEQ ID NO: 2806080 - RNA, 17 nt, Human
cugcaccguacugugga

SEQ ID NO: 2806081 - RNA, 20 nt, Human
cugcaccugccagccuggcu

SEQ ID NO: 2806082 - RNA, 19 nt, Human
cugcaccugccagccuggc

SEQ ID NO: 2806083 - RNA, 18 nt, Human
cugcaccugccagccugg

SEQ ID NO: 2806084 - RNA, 17 nt, Human
cugcaccugccagccug

SEQ ID NO: 2806085 - RNA, 16 nt, Human
cugcaccugccagccu

SEQ ID NO: 2806086 - RNA, 13 nt, Human
cugcaccugccag

SEQ ID NO: 2806087 - RNA, 22 nt, Human
cugcaaccuccgccucuugggu

SEQ ID NO: 2806088 - RNA, 20 nt, Human
cugcaaccuccgccucuugg

SEQ ID NO: 2806089 - RNA, 12 nt, Human
cugcaacaggcu

SEQ ID NO: 2806090 - RNA, 22 nt, Human
cugcaaccuucgccaccugggu

SEQ ID NO: 2806091 - RNA, 20 nt, Human
cugcaaccuucgccaccugg

SEQ ID NO: 2806092 - RNA, 19 nt, Human
cugcaaccuucgccaccug

SEQ ID NO: 2806093 - RNA, 17 nt, Human
cugcaaccuucgccacc

SEQ ID NO: 2806094 - RNA, 19 nt, Human
cugcaacuuguaaaugugg

SEQ ID NO: 2806095 - RNA, 15 nt, Human
cugcaacuucugccu

SEQ ID NO: 2806096 - RNA, 18 nt, Human
cugcaacuuguaaaugug

SEQ ID NO: 2806097 - RNA, 14 nt, Human
cugcaacuucugcc

SEQ ID NO: 2806098 - RNA, 24 nt, Human
cugaugcucccuccccugcccugg

SEQ ID NO: 2806099 - RNA, 23 nt, Human
cugaugcucccuccccugcccug

SEQ ID NO: 2806100 - RNA, 16 nt, Human
cugaugcugagauucu

SEQ ID NO: 2806101 - RNA, 23 nt, Human
cugaugcugagauucuucaggcu

SEQ ID NO: 2806102 - RNA, 16 nt, Human
cugaugcuguucucuu

SEQ ID NO: 2806103 - RNA, 17 nt, Human
cugaugcuguucucuuc

SEQ ID NO: 2806104 - RNA, 22 nt, Human
cugaugcucccuccccugcccu

SEQ ID NO: 2806105 - RNA, 21 nt, Human
cugaugcucccuccccugccc

SEQ ID NO: 2806106 - RNA, 19 nt, Human
cugaugcucccuccccugc

SEQ ID NO: 2806107 - RNA, 18 nt, Human
cugaugcucccuccccug

SEQ ID NO: 2806108 - RNA, 17 nt, Human
cugaugcucccuccccu

SEQ ID NO: 2806109 - RNA, 15 nt, Human
cugaugcucccuccc

SEQ ID NO: 2806110 - RNA, 14 nt, Human
cugaugcucccucc

SEQ ID NO: 2806111 - RNA, 12 nt, Human
cugaugcucccu

SEQ ID NO: 2806112 - RNA, 20 nt, Human
cugaugauuucuugaaaagg

SEQ ID NO: 2806113 - RNA, 17 nt, Human
cugaugaugugccuggg

SEQ ID NO: 2806114 - RNA, 23 nt, Human
cugaugcagucacguggaggagc

SEQ ID NO: 2806115 - RNA, 23 nt, Human
cugaugcaggauuuguucucugu

SEQ ID NO: 2806116 - RNA, 18 nt, Human
cugaugccaauacuaguc

SEQ ID NO: 2806117 - RNA, 19 nt, Human
cugaugccaauacuaguca

SEQ ID NO: 2806118 - RNA, 20 nt, Human
cugaugccgugauccugagc

SEQ ID NO: 2806119 - RNA, 11 nt, Human
cucuuaucuca

SEQ ID NO: 2806120 - RNA, 15 nt, Human
cucuuaucucaguca

SEQ ID NO: 2806121 - RNA, 21 nt, Human
cucuuaucucagucaugcaua

SEQ ID NO: 2806122 - RNA, 22 nt, Human
cucuuaucucagucaugcauaa

SEQ ID NO: 2806123 - RNA, 23 nt, Human
cucuuaucucagucaugcauaaa

SEQ ID NO: 2806124 - RNA, 14 nt, Human
cucuuauuacaaag

SEQ ID NO: 2806125 - RNA, 11 nt, Human
cugaugagcaa

SEQ ID NO: 2806126 - RNA, 21 nt, Human
cugaugagcaaccgcuucccu

SEQ ID NO: 2806127 - RNA, 17 nt, Human
cugaugagaauacugag

SEQ ID NO: 2806128 - RNA, 21 nt, Human
cugaugggcaacccccagccu

SEQ ID NO: 2806129 - RNA, 18 nt, Human
cugaugggcaacccccag

SEQ ID NO: 2806130 - RNA, 22 nt, Human
cugauggcacuuagcuaucaga

SEQ ID NO: 2806131 - RNA, 22 nt, Human
cugauggaucccgaagaaugga

SEQ ID NO: 2806132 - RNA, 16 nt, Human
cugauggcaggauggc

SEQ ID NO: 2806133 - RNA, 17 nt, Human
cugauggcaggauggcc

SEQ ID NO: 2806134 - RNA, 19 nt, Human
cugauggcaggauggccug

SEQ ID NO: 2806135 - RNA, 22 nt, Human
cugauggcaggauggccuggcc

SEQ ID NO: 2806136 - RNA, 19 nt, Human
cugaugcuuuugucuaauu

SEQ ID NO: 2806137 - RNA, 15 nt, Human
cugauggaccuguca

SEQ ID NO: 2806138 - RNA, 20 nt, Human
cugauggaaguaaagccuca

SEQ ID NO: 2806139 - RNA, 22 nt, Human
cugcaaaggguaucaggugcug

SEQ ID NO: 2806140 - RNA, 21 nt, Human
cugcaaaggguaucaggugcu

SEQ ID NO: 2806141 - RNA, 18 nt, Human
cugcaaagcccagcuuga

SEQ ID NO: 2806142 - RNA, 17 nt, Human
cugcaaagcccagcuug

SEQ ID NO: 2806143 - RNA, 23 nt, Human
cugaugggcaacccccagccugc

SEQ ID NO: 2806144 - RNA, 22 nt, Human
cugaugggcaacccccagccug

SEQ ID NO: 2806145 - RNA, 24 nt, Human
cugaugggcaacccccagccugcu

SEQ ID NO: 2806146 - RNA, 12 nt, Human
cugauggcuucu

SEQ ID NO: 2806147 - RNA, 18 nt, Human
cugauggcuucuccaggg

SEQ ID NO: 2806148 - RNA, 19 nt, Human
cugauggcuucuccagggu

SEQ ID NO: 2806149 - RNA, 21 nt, Human
cugaugggcguacgcuggugc

SEQ ID NO: 2806150 - RNA, 22 nt, Human
cugaugggcguacgcuggugcu

SEQ ID NO: 2806151 - RNA, 23 nt, Human
cugaugggcguacgcuggugcug

SEQ ID NO: 2806152 - RNA, 23 nt, Human
cuggugcccuaaccucugaguca

SEQ ID NO: 2806153 - RNA, 14 nt, Human
cuggugccuccaga

SEQ ID NO: 2806154 - RNA, 16 nt, Human
cuggugccuccagagg

SEQ ID NO: 2806155 - RNA, 15 nt, Human
cuggugccuggcucu

SEQ ID NO: 2806156 - RNA, 16 nt, Human
cuggugccuggcucuu

SEQ ID NO: 2806157 - RNA, 16 nt, Human
cuggugcgaauggacu

SEQ ID NO: 2806158 - RNA, 17 nt, Human
cuggugcgaauggacuu

SEQ ID NO: 2806159 - RNA, 15 nt, Human
cuggugccuccagag

SEQ ID NO: 2806160 - RNA, 14 nt, Human
cuggugcccggaga

SEQ ID NO: 2806161 - RNA, 20 nt, Human
cuggugcccuaaccucugag

SEQ ID NO: 2806162 - RNA, 19 nt, Human
cugggugguacccucugga

SEQ ID NO: 2806163 - RNA, 16 nt, Human
cugggugguacccucu

SEQ ID NO: 2806164 - RNA, 13 nt, Human
cugggugucauuu

SEQ ID NO: 2806165 - RNA, 20 nt, Human
cugggugucauuucauucca

SEQ ID NO: 2806166 - RNA, 21 nt, Human
cugggugucauuucauuccau

SEQ ID NO: 2806167 - RNA, 17 nt, Human
cuggugcacuuuguaaa

SEQ ID NO: 2806168 - RNA, 18 nt, Human
cuggugcacuuuguaaau

SEQ ID NO: 2806169 - RNA, 19 nt, Human
cuggugcacuuuguaaauu

SEQ ID NO: 2806170 - RNA, 17 nt, Human
cugggcagccaggcugc

SEQ ID NO: 2806171 - RNA, 18 nt, Human
cugggcagccaggcugcc

SEQ ID NO: 2806172 - RNA, 16 nt, Human
cugggcagccaggcug

SEQ ID NO: 2806173 - RNA, 15 nt, Human
cugggcagccaggcu

SEQ ID NO: 2806174 - RNA, 18 nt, Human
cugggcagcauagcaaga

SEQ ID NO: 2806175 - RNA, 17 nt, Human
cugggcagcauagcaag

SEQ ID NO: 2806176 - RNA, 17 nt, Human
cugggcaggacucagcu

SEQ ID NO: 2806177 - RNA, 16 nt, Human
cugggcauagaugcag

SEQ ID NO: 2806178 - RNA, 23 nt, Human
cugggcauagaugcaggugagcc

SEQ ID NO: 2806179 - RNA, 23 nt, Human
cugggccauguccaaagaggcug

SEQ ID NO: 2806180 - RNA, 22 nt, Human
cugggccauguccaaagaggcu

SEQ ID NO: 2806181 - RNA, 19 nt, Human
cugggccauguccaaagag

SEQ ID NO: 2806182 - RNA, 18 nt, Human
cugggccauguccaaaga

SEQ ID NO: 2806183 - RNA, 17 nt, Human
cugggccauguccaaag

SEQ ID NO: 2806184 - RNA, 22 nt, Human
cugggccagggucugugugaau

SEQ ID NO: 2806185 - RNA, 20 nt, Human
cugggcaugguaccagcccu

SEQ ID NO: 2806186 - RNA, 21 nt, Human
cugggcaugguaccagcccug

SEQ ID NO: 2806187 - RNA, 22 nt, Human
cugggcaugguaccagcccugg

SEQ ID NO: 2806188 - RNA, 14 nt, Human
cuggggccuggacc

SEQ ID NO: 2806189 - RNA, 16 nt, Human
cuggggccuggaccug

SEQ ID NO: 2806190 - RNA, 17 nt, Human
cuggggccuggaccugc

SEQ ID NO: 2806191 - RNA, 19 nt, Human
cuggggccuggaccugccu

SEQ ID NO: 2806192 - RNA, 12 nt, Human
cuggggccuggc

SEQ ID NO: 2806193 - RNA, 13 nt, Human
cuggggccuggca

SEQ ID NO: 2806194 - RNA, 18 nt, Human
cuggggccuggcagggag

SEQ ID NO: 2806195 - RNA, 19 nt, Human
cuggggccuggcagggagg

SEQ ID NO: 2806196 - RNA, 18 nt, Human
cuggggccuggaccugcc

SEQ ID NO: 2806197 - RNA, 12 nt, Human
cuggggccugag

SEQ ID NO: 2806198 - RNA, 13 nt, Human
cuggggccugaga

SEQ ID NO: 2806199 - RNA, 14 nt, Human
cuggggccugagag

SEQ ID NO: 2806200 - RNA, 15 nt, Human
cuggggccugagaga

SEQ ID NO: 2806201 - RNA, 16 nt, Human
cuggggccugagagaa

SEQ ID NO: 2806202 - RNA, 17 nt, Human
cuggggccugagagaau

SEQ ID NO: 2806203 - RNA, 13 nt, Human
cuggggagaaagu

SEQ ID NO: 2806204 - RNA, 21 nt, Human
cuggggacgcuccgcugccgu

SEQ ID NO: 2806205 - RNA, 19 nt, Human
cuggggacgcuccgcugcc

SEQ ID NO: 2806206 - RNA, 22 nt, Human
cuggggaccugguacccuccug

SEQ ID NO: 2806207 - RNA, 16 nt, Human
cuggggacagcaaggg

SEQ ID NO: 2806208 - RNA, 20 nt, Human
cuggggaccugguacccucc

SEQ ID NO: 2806209 - RNA, 12 nt, Human
cuggggacccac

SEQ ID NO: 2806210 - RNA, 16 nt, Human
cugggugcugauccuu

SEQ ID NO: 2806211 - RNA, 20 nt, Human
cugggugcugauccuugcac

SEQ ID NO: 2806212 - RNA, 23 nt, Human
cuggguggacauggccccuguga

SEQ ID NO: 2806213 - RNA, 20 nt, Human
cuggguggaucggccuccuc

SEQ ID NO: 2806214 - RNA, 14 nt, Human
cugggugcagcuga

SEQ ID NO: 2806215 - RNA, 15 nt, Human
cugggugcagcugag

SEQ ID NO: 2806216 - RNA, 17 nt, Human
cugggucuuuugcuacu

SEQ ID NO: 2806217 - RNA, 15 nt, Human
cuggcuccuuuacaa

SEQ ID NO: 2806218 - RNA, 17 nt, Human
cuggcuccuuuacaaaa

SEQ ID NO: 2806219 - RNA, 22 nt, Human
cuggcuccuuuacaaaagaaau

SEQ ID NO: 2806220 - RNA, 20 nt, Human
cuggcuccguccaggagccu

SEQ ID NO: 2806221 - RNA, 16 nt, Human
cuggcuccucuguggu

SEQ ID NO: 2806222 - RNA, 17 nt, Human
cuggcuccucuguggug

SEQ ID NO: 2806223 - RNA, 18 nt, Human
cuggcuccucuguggugu

SEQ ID NO: 2806224 - RNA, 22 nt, Human
cuggcuccucuguggugucugc

SEQ ID NO: 2806225 - RNA, 24 nt, Human
cuggcuccucuguggugucugccu

SEQ ID NO: 2806226 - RNA, 17 nt, Human
cuggcuccugaggggca

SEQ ID NO: 2806227 - RNA, 16 nt, Human
cuggcuccugaggggc

SEQ ID NO: 2806228 - RNA, 15 nt, Human
cuggcuccugagggg

SEQ ID NO: 2806229 - RNA, 14 nt, Human
cuggcuccugaggg

SEQ ID NO: 2806230 - RNA, 22 nt, Human
cugggacaguuuaucaugaagc

SEQ ID NO: 2806231 - RNA, 23 nt, Human
cugggacaguuuaucaugaagcc

SEQ ID NO: 2806232 - RNA, 16 nt, Human
cugggacuacaggcac

SEQ ID NO: 2806233 - RNA, 15 nt, Human
cugggacuacaggca

SEQ ID NO: 2806234 - RNA, 13 nt, Human
cugggacuacagg

SEQ ID NO: 2806235 - RNA, 22 nt, Human
cugggaccacagguucaugcca

SEQ ID NO: 2806236 - RNA, 14 nt, Human
cugggaccacguga

SEQ ID NO: 2806237 - RNA, 19 nt, Human
cuggcuagaguccucacuc

SEQ ID NO: 2806238 - RNA, 18 nt, Human
cuggcuagaguccucacu

SEQ ID NO: 2806239 - RNA, 17 nt, Human
cuggcuagaguccucac

SEQ ID NO: 2806240 - RNA, 16 nt, Human
cuggcuagaguccuca

SEQ ID NO: 2806241 - RNA, 21 nt, Human
cuggcuagaguccucacuccc

SEQ ID NO: 2806242 - RNA, 20 nt, Human
cuggcuagaguccucacucc

SEQ ID NO: 2806243 - RNA, 22 nt, Human
cuggcuagaguccucacuccca

SEQ ID NO: 2806244 - RNA, 15 nt, Human
cuggcucacaguaca

SEQ ID NO: 2806245 - RNA, 16 nt, Human
cuggcucacaguacag

SEQ ID NO: 2806246 - RNA, 17 nt, Human
cuggcucacaguacagc

SEQ ID NO: 2806247 - RNA, 19 nt, Human
cuggcucacaguacagcau

SEQ ID NO: 2806248 - RNA, 22 nt, Human
cuggcucacaguacagcaugug

SEQ ID NO: 2806249 - RNA, 24 nt, Human
cuggcucacaguacagcaugugcc

SEQ ID NO: 2806250 - RNA, 23 nt, Human
cuggcuaucaaagaauaagaaaa

SEQ ID NO: 2806251 - RNA, 20 nt, Human
cuggccgaggguccuggcuc

SEQ ID NO: 2806252 - RNA, 19 nt, Human
cuggccgaggguccuggcu

SEQ ID NO: 2806253 - RNA, 23 nt, Human
cuggcuagaggccagccccaccc

SEQ ID NO: 2806254 - RNA, 21 nt, Human
cuggccgaggguccuggcucc

SEQ ID NO: 2806255 - RNA, 17 nt, Human
cuggccgaggguccugg

SEQ ID NO: 2806256 - RNA, 12 nt, Human
cugcugacagug

SEQ ID NO: 2806257 - RNA, 11 nt, Human
cugcugacagu

SEQ ID NO: 2806258 - RNA, 9 nt, Human
cugcugacc

SEQ ID NO: 2806259 - RNA, 23 nt, Human
cugcugagucccaggcugagccu

SEQ ID NO: 2806260 - RNA, 19 nt, Human
cugcugagucccaggcuga

SEQ ID NO: 2806261 - RNA, 15 nt, Human
cugcugacaguguug

SEQ ID NO: 2806262 - RNA, 13 nt, Human
cugcugacagugu

SEQ ID NO: 2806263 - RNA, 19 nt, Human
cugcucacauaucugucau

SEQ ID NO: 2806264 - RNA, 16 nt, Human
cugcucacauaucugu

SEQ ID NO: 2806265 - RNA, 14 nt, Human
cugcucacauaucu

SEQ ID NO: 2806266 - RNA, 14 nt, Human
cugcugucuucugg

SEQ ID NO: 2806267 - RNA, 20 nt, Human
cugcugucccucccccuugu

SEQ ID NO: 2806268 - RNA, 20 nt, Human
cuggaugauggucuucagcc

SEQ ID NO: 2806269 - RNA, 13 nt, Human
cuggaugaaauuu

SEQ ID NO: 2806270 - RNA, 23 nt, Human
cuggauggagcccaggcgggagc

SEQ ID NO: 2806271 - RNA, 11 nt, Human
cuggauggagc

SEQ ID NO: 2806272 - RNA, 15 nt, Human
cuggauggagcccag

SEQ ID NO: 2806273 - RNA, 16 nt, Human
cuggauggagcccagg

SEQ ID NO: 2806274 - RNA, 17 nt, Human
cuggauggagcccaggc

SEQ ID NO: 2806275 - RNA, 18 nt, Human
cuggauggagcccaggcg

SEQ ID NO: 2806276 - RNA, 13 nt, Human
cuggacuugagcu

SEQ ID NO: 2806277 - RNA, 20 nt, Human
cuggagaagagaggagagga

SEQ ID NO: 2806278 - RNA, 18 nt, Human
cuggagaagagaggagag

SEQ ID NO: 2806279 - RNA, 19 nt, Human
cuggagaagagaggagagg

SEQ ID NO: 2806280 - RNA, 15 nt, Human
cuggacuugagcuug

SEQ ID NO: 2806281 - RNA, 15 nt, Human
cuggagaagagagga

SEQ ID NO: 2806282 - RNA, 23 nt, Human
cugcuuaguaucucaucaacaaa

SEQ ID NO: 2806283 - RNA, 16 nt, Human
cuggagaagagaggag

SEQ ID NO: 2806284 - RNA, 23 nt, Human
cugcuuaucaauaaaccuguuug

SEQ ID NO: 2806285 - RNA, 19 nt, Human
cugcuuagcuugcaccuug

SEQ ID NO: 2806286 - RNA, 12 nt, Human
cugcuuagcuug

SEQ ID NO: 2806287 - RNA, 13 nt, Human
cuggagacagccc

SEQ ID NO: 2806288 - RNA, 14 nt, Human
cuggagacagcccc

SEQ ID NO: 2806289 - RNA, 15 nt, Human
cuggagacagcccca

SEQ ID NO: 2806290 - RNA, 16 nt, Human
cuggagacagccccag

SEQ ID NO: 2806291 - RNA, 17 nt, Human
cuggagacagccccaga

SEQ ID NO: 2806292 - RNA, 19 nt, Human
cuggagacagccccagagc

SEQ ID NO: 2806293 - RNA, 20 nt, Human
cuggagacagccccagagca

SEQ ID NO: 2806294 - RNA, 11 nt, Human
cuggagacagc

SEQ ID NO: 2806295 - RNA, 19 nt, Human
cuuugagucccccagagau

SEQ ID NO: 2806296 - RNA, 20 nt, Human
cuuugagucccccagagaug

SEQ ID NO: 2806297 - RNA, 14 nt, Human
cuuucuaaugcuga

SEQ ID NO: 2806298 - RNA, 13 nt, Human
cuuugauaauguu

SEQ ID NO: 2806299 - RNA, 14 nt, Human
cuuugauaauguua

SEQ ID NO: 2806300 - RNA, 15 nt, Human
cuuugauaauguuaa

SEQ ID NO: 2806301 - RNA, 19 nt, Human
cuuugauuaguuuucuugu

SEQ ID NO: 2806302 - RNA, 20 nt, Human
cuuugauuaguuuucuuguu

SEQ ID NO: 2806303 - RNA, 23 nt, Human
cuuugauuaguuuucuuguugcu

SEQ ID NO: 2806304 - RNA, 21 nt, Human
cuuugauucauaguaacuucu

SEQ ID NO: 2806305 - RNA, 13 nt, Human
cuuugauucuccu

SEQ ID NO: 2806306 - RNA, 19 nt, Human
cuuugauucauaguaacuu

SEQ ID NO: 2806307 - RNA, 12 nt, Human
cuuugauucaua

SEQ ID NO: 2806308 - RNA, 16 nt, Human
cuuugagcuuaagaau

SEQ ID NO: 2806309 - RNA, 13 nt, Human
cuuugagggacug

SEQ ID NO: 2806310 - RNA, 14 nt, Human
cuuugagggacugc

SEQ ID NO: 2806311 - RNA, 16 nt, Human
cuuugagggacugccu

SEQ ID NO: 2806312 - RNA, 18 nt, Human
cuuugagggacugccucu

SEQ ID NO: 2806313 - RNA, 19 nt, Human
cuuugagggacugccucug

SEQ ID NO: 2806314 - RNA, 20 nt, Human
cuuugagggacugccucugc

SEQ ID NO: 2806315 - RNA, 21 nt, Human
cuuugagggacugccucugcc

SEQ ID NO: 2806316 - RNA, 22 nt, Human
cuuugagggacugccucugcca

SEQ ID NO: 2806317 - RNA, 15 nt, Human
cuuuccuuuucuuua

SEQ ID NO: 2806318 - RNA, 21 nt, Human
cuuuccuuuccccagcccagg

SEQ ID NO: 2806319 - RNA, 20 nt, Human
cuuuccuuuccccagcccag

SEQ ID NO: 2806320 - RNA, 22 nt, Human
cuuucggggagaggcugaggac

SEQ ID NO: 2806321 - RNA, 15 nt, Human
cuuucguacauuggc

SEQ ID NO: 2806322 - RNA, 14 nt, Human
cuuucgucacccuu

SEQ ID NO: 2806323 - RNA, 15 nt, Human
cuuucgucacccuug

SEQ ID NO: 2806324 - RNA, 18 nt, Human
cuuucguccacagcuucc

SEQ ID NO: 2806325 - RNA, 19 nt, Human
cuuucguccacagcuuccu

SEQ ID NO: 2806326 - RNA, 21 nt, Human
cuuucguccacagcuuccugu

SEQ ID NO: 2806327 - RNA, 22 nt, Human
cuuucguguaaauuauguaaug

SEQ ID NO: 2806328 - RNA, 19 nt, Human
cuuucgauacccaggacca

SEQ ID NO: 2806329 - RNA, 14 nt, Human
cuuucgggccaugu

SEQ ID NO: 2806330 - RNA, 20 nt, Human
cuuucgggccauguugcccc

SEQ ID NO: 2806331 - RNA, 21 nt, Human
cuuucuaguggucuuuguaag

SEQ ID NO: 2806332 - RNA, 22 nt, Human
cuuucuaguggucuuuguaaga

SEQ ID NO: 2806333 - RNA, 23 nt, Human
cuuucuaguggucuuuguaagag

SEQ ID NO: 2806334 - RNA, 16 nt, Human
cuuucuaguggucuuu

SEQ ID NO: 2806335 - RNA, 18 nt, Human
cuuucuaguggucuuugu

SEQ ID NO: 2806336 - RNA, 19 nt, Human
cuuucuaguggucuuugua

SEQ ID NO: 2806337 - RNA, 20 nt, Human
cuuucuaguggucuuuguaa

SEQ ID NO: 2806338 - RNA, 14 nt, Human
cuuucuaugcugcu

SEQ ID NO: 2806339 - RNA, 15 nt, Human
cuuucuaugcugcuu

SEQ ID NO: 2806340 - RNA, 17 nt, Human
cuuucuaugcugcuuuu

SEQ ID NO: 2806341 - RNA, 19 nt, Human
cuuucuaugcugcuuuuau

SEQ ID NO: 2806342 - RNA, 20 nt, Human
cuuucuaugcugcuuuuaua

SEQ ID NO: 2806343 - RNA, 21 nt, Human
cuuucuaugcugcuuuuauau

SEQ ID NO: 2806344 - RNA, 20 nt, Human
cuuucuccccgcuaaggaag

SEQ ID NO: 2806345 - RNA, 15 nt, Human
cuuucuccuugaaua

SEQ ID NO: 2806346 - RNA, 12 nt, Human
cuuucuccuguu

SEQ ID NO: 2806347 - RNA, 22 nt, Human
cuuucuccuguuuauucccauc

SEQ ID NO: 2806348 - RNA, 15 nt, Human
cuuuucaaaacauuu

SEQ ID NO: 2806349 - RNA, 22 nt, Human
cuuuuauuuuacacagaaacac

SEQ ID NO: 2806350 - RNA, 12 nt, Human
cuuuuauuuuga

SEQ ID NO: 2806351 - RNA, 13 nt, Human
cuuuuauuuugaa

SEQ ID NO: 2806352 - RNA, 14 nt, Human
cuuuuauuuugaaa

SEQ ID NO: 2806353 - RNA, 19 nt, Human
cuuuuauuuugaaaagcuu

SEQ ID NO: 2806354 - RNA, 21 nt, Human
cuuuuauuuuacacagaaaca

SEQ ID NO: 2806355 - RNA, 20 nt, Human
cuuuuauuuuacacagaaac

SEQ ID NO: 2806356 - RNA, 13 nt, Human
cuuuucaaggcuu

SEQ ID NO: 2806357 - RNA, 18 nt, Human
cuuuucaaacaagaaugu

SEQ ID NO: 2806358 - RNA, 16 nt, Human
cuuuucaaggcuuaua

SEQ ID NO: 2806359 - RNA, 18 nt, Human
cuuuuaggccaaaaaaau

SEQ ID NO: 2806360 - RNA, 14 nt, Human
cuuuuaggaaaauc

SEQ ID NO: 2806361 - RNA, 20 nt, Human
cuuuuaggaaaaucacuuug

SEQ ID NO: 2806362 - RNA, 21 nt, Human
cuuuuaggaaaaucacuuugu

SEQ ID NO: 2806363 - RNA, 16 nt, Human
cuuuuaggccaaaaaa

SEQ ID NO: 2806364 - RNA, 22 nt, Human
cuuuggugguuuaaaaauggua

SEQ ID NO: 2806365 - RNA, 21 nt, Human
cuuuuauuguauaaacuauca

SEQ ID NO: 2806366 - RNA, 19 nt, Human
cuuuuauuugcaacauuua

SEQ ID NO: 2806367 - RNA, 21 nt, Human
cuuuuauuugcaacauuuaca

SEQ ID NO: 2806368 - RNA, 19 nt, Human
cuuuuauuuagcaccaggg

SEQ ID NO: 2806369 - RNA, 22 nt, Human
cuuuggguuaagcauuaccacu

SEQ ID NO: 2806370 - RNA, 22 nt, Human
cuuugguacauggccaguguga

SEQ ID NO: 2806371 - RNA, 17 nt, Human
cuuuggguuaagcauua

SEQ ID NO: 2806372 - RNA, 20 nt, Human
cuuuggguuaagcauuacca

SEQ ID NO: 2806373 - RNA, 17 nt, Human
cuuuggggucuacacug

SEQ ID NO: 2806374 - RNA, 22 nt, Human
cuuuggggucuacacugcaauc

SEQ ID NO: 2806375 - RNA, 23 nt, Human
cuuuggggucuacacugcaauca

SEQ ID NO: 2806376 - RNA, 17 nt, Human
cuuugggguuuuuuaau

SEQ ID NO: 2806377 - RNA, 14 nt, Human
cuuugguagaaaag

SEQ ID NO: 2806378 - RNA, 23 nt, Human
cuuuggugccaacugguguuuga

SEQ ID NO: 2806379 - RNA, 18 nt, Human
cuuuaaagggccugccug

SEQ ID NO: 2806380 - RNA, 19 nt, Human
cuuuaaagggccugccugg

SEQ ID NO: 2806381 - RNA, 17 nt, Human
cuuuaaaguguaauaau

SEQ ID NO: 2806382 - RNA, 19 nt, Human
cuuuaaaguguaauaauau

SEQ ID NO: 2806383 - RNA, 21 nt, Human
cuuuaaaguguaauaauauga

SEQ ID NO: 2806384 - RNA, 14 nt, Human
cuuuaaauaauuua

SEQ ID NO: 2806385 - RNA, 15 nt, Human
cuuuaaauaauuuaa

SEQ ID NO: 2806386 - RNA, 16 nt, Human
cuuuaaauaauuuaac

SEQ ID NO: 2806387 - RNA, 17 nt, Human
cuuuaaauaauuuaacu

SEQ ID NO: 2806388 - RNA, 18 nt, Human
cuuuaaauaauuuaacua

SEQ ID NO: 2806389 - RNA, 13 nt, Human
cuuuaaauagaua

SEQ ID NO: 2806390 - RNA, 19 nt, Human
cuuuaaauagauacaaaug

SEQ ID NO: 2806391 - RNA, 15 nt, Human
cuuuaaaucauuuua

SEQ ID NO: 2806392 - RNA, 11 nt, Human
cuuuaaauguu

SEQ ID NO: 2806393 - RNA, 15 nt, Human
cuuuaaauguuuuau

SEQ ID NO: 2806394 - RNA, 18 nt, Human
cuuuaaauguuuuauaag

SEQ ID NO: 2806395 - RNA, 22 nt, Human
cuuuaaauguuuuauaaguuca

SEQ ID NO: 2806396 - RNA, 15 nt, Human
cuuguggacacagcu

SEQ ID NO: 2806397 - RNA, 14 nt, Human
cuuguggacacagc

SEQ ID NO: 2806398 - RNA, 13 nt, Human
cuuguggacacag

SEQ ID NO: 2806399 - RNA, 21 nt, Human
cuugugcaaaauauuugacua

SEQ ID NO: 2806400 - RNA, 15 nt, Human
cuugugauuauuuau

SEQ ID NO: 2806401 - RNA, 17 nt, Human
cuugugauuauuuauua

SEQ ID NO: 2806402 - RNA, 14 nt, Human
cuuuacacacacag

SEQ ID NO: 2806403 - RNA, 20 nt, Human
cuuuacaaaagaaauaccuu

SEQ ID NO: 2806404 - RNA, 17 nt, Human
cuuuaaguagauaagca

SEQ ID NO: 2806405 - RNA, 17 nt, Human
cuuuaagugcacaacau

SEQ ID NO: 2806406 - RNA, 19 nt, Human
cuuuaagggcaugccuugu

SEQ ID NO: 2806407 - RNA, 20 nt, Human
cuuuaagggcaugccuugug

SEQ ID NO: 2806408 - RNA, 22 nt, Human
cuuuaagggcaugccuugugcu

SEQ ID NO: 2806409 - RNA, 22 nt, Human
cuuuaaucacuuaacauuccua

SEQ ID NO: 2806410 - RNA, 20 nt, Human
cuuucagaaaacgggaagcg

SEQ ID NO: 2806411 - RNA, 16 nt, Human
cuuucagacuugccau

SEQ ID NO: 2806412 - RNA, 18 nt, Human
cuuucagacuugccaugu

SEQ ID NO: 2806413 - RNA, 19 nt, Human
cuuucagacuugccaugug

SEQ ID NO: 2806414 - RNA, 14 nt, Human
cuuucagagacagc

SEQ ID NO: 2806415 - RNA, 19 nt, Human
cuuuacacucggcuuugga

SEQ ID NO: 2806416 - RNA, 15 nt, Human
cuucugagcacagau

SEQ ID NO: 2806417 - RNA, 13 nt, Human
cuucuuaaauauc

SEQ ID NO: 2806418 - RNA, 18 nt, Human
cuucuuaaauaucuuuua

SEQ ID NO: 2806419 - RNA, 22 nt, Human
cuucugaccuuuuggugaaagc

SEQ ID NO: 2806420 - RNA, 14 nt, Human
cuucugacggcccu

SEQ ID NO: 2806421 - RNA, 16 nt, Human
cuucugacggcccugc

SEQ ID NO: 2806422 - RNA, 17 nt, Human
cuucugacggcccugca

SEQ ID NO: 2806423 - RNA, 18 nt, Human
cuucugacggcccugcaa

SEQ ID NO: 2806424 - RNA, 19 nt, Human
cuucugacggcccugcaau

SEQ ID NO: 2806425 - RNA, 21 nt, Human
cuucugacugcugauucuccc

SEQ ID NO: 2806426 - RNA, 13 nt, Human
cuucugacugcug

SEQ ID NO: 2806427 - RNA, 16 nt, Human
cuugaauauggguggc

SEQ ID NO: 2806428 - RNA, 14 nt, Human
cuugaauaauaagc

SEQ ID NO: 2806429 - RNA, 13 nt, Human
cuugaaguccugg

SEQ ID NO: 2806430 - RNA, 15 nt, Human
cuugaaguccuggcu

SEQ ID NO: 2806431 - RNA, 17 nt, Human
cuugaaguccuggcuuc

SEQ ID NO: 2806432 - RNA, 18 nt, Human
cuugaaguccuggcuuca

SEQ ID NO: 2806433 - RNA, 19 nt, Human
cuugaaguccuggcuucag

SEQ ID NO: 2806434 - RNA, 20 nt, Human
cuugaaguccuggcuucagg

SEQ ID NO: 2806435 - RNA, 19 nt, Human
cuugaagucuaaaagcaga

SEQ ID NO: 2806436 - RNA, 20 nt, Human
cuugaagucuaaaagcagaa

SEQ ID NO: 2806437 - RNA, 17 nt, Human
cuuggcaucagcuggcg

SEQ ID NO: 2806438 - RNA, 16 nt, Human
cuuggcaucagcuggc

SEQ ID NO: 2806439 - RNA, 22 nt, Human
cuuggcaucacagggcagagcc

SEQ ID NO: 2806440 - RNA, 20 nt, Human
cuuggcaucacagggcagag

SEQ ID NO: 2806441 - RNA, 19 nt, Human
cuuggcaucacagggcaga

SEQ ID NO: 2806442 - RNA, 12 nt, Human
cuugacagggca

SEQ ID NO: 2806443 - RNA, 17 nt, Human
cuugccuaaauuuaaug

SEQ ID NO: 2806444 - RNA, 21 nt, Human
cuugccuaaauuuaaugcugc

SEQ ID NO: 2806445 - RNA, 22 nt, Human
cuugccuaaauuuaaugcugcc

SEQ ID NO: 2806446 - RNA, 23 nt, Human
cuugccuaaauuuaaugcugccu

SEQ ID NO: 2806447 - RNA, 12 nt, Human
cuugcucugcug

SEQ ID NO: 2806448 - RNA, 20 nt, Human
cuugcucuccccugcccugc

SEQ ID NO: 2806449 - RNA, 19 nt, Human
cuugcucuccccugcccug

SEQ ID NO: 2806450 - RNA, 17 nt, Human
cuugcucccuucagccc

SEQ ID NO: 2806451 - RNA, 18 nt, Human
cuugcucccuucagcccc

SEQ ID NO: 2806452 - RNA, 19 nt, Human
cuugcucccuucagccccc

SEQ ID NO: 2806453 - RNA, 23 nt, Human
cuugcucccuucagcccccagcc

SEQ ID NO: 2806454 - RNA, 20 nt, Human
cuugcuccuggccuugcuga

SEQ ID NO: 2806455 - RNA, 16 nt, Human
cuugccugcacaaacu

SEQ ID NO: 2806456 - RNA, 14 nt, Human
cuucagacucucag

SEQ ID NO: 2806457 - RNA, 14 nt, Human
cuucauggaacuca

SEQ ID NO: 2806458 - RNA, 21 nt, Human
cuucauggaacucagcugucu

SEQ ID NO: 2806459 - RNA, 18 nt, Human
cuucauggaauggacauc

SEQ ID NO: 2806460 - RNA, 20 nt, Human
cuucauggaauggacauccu

SEQ ID NO: 2806461 - RNA, 16 nt, Human
cuucaugccagcuacu

SEQ ID NO: 2806462 - RNA, 14 nt, Human
cuucaugccagcua

SEQ ID NO: 2806463 - RNA, 15 nt, Human
cuucaugccagcuac

SEQ ID NO: 2806464 - RNA, 22 nt, Human
cuucaucucccaaagugcuggg

SEQ ID NO: 2806465 - RNA, 17 nt, Human
cuucaucgaaucuacua

SEQ ID NO: 2806466 - RNA, 15 nt, Human
cuucaucgaaucuac

SEQ ID NO: 2806467 - RNA, 18 nt, Human
cuucaguggcagcugcuu

SEQ ID NO: 2806468 - RNA, 17 nt, Human
cuucaguguauggaaau

SEQ ID NO: 2806469 - RNA, 17 nt, Human
cuucaguuaagccuuug

SEQ ID NO: 2806470 - RNA, 18 nt, Human
cuucaguuaagccuuugg

SEQ ID NO: 2806471 - RNA, 20 nt, Human
cuucaguguauggaaauaaa

SEQ ID NO: 2806472 - RNA, 17 nt, Human
cuucaucauucccucuc

SEQ ID NO: 2806473 - RNA, 18 nt, Human
cuucaucauucccucuca

SEQ ID NO: 2806474 - RNA, 19 nt, Human
cuucaucauucccucucau

SEQ ID NO: 2806475 - RNA, 13 nt, Human
cuucaucccuuuc

SEQ ID NO: 2806476 - RNA, 14 nt, Human
cuucaucccuuucc

SEQ ID NO: 2806477 - RNA, 15 nt, Human
cuucaucccuuucca

SEQ ID NO: 2806478 - RNA, 16 nt, Human
cuucaucccuuuccag

SEQ ID NO: 2806479 - RNA, 20 nt, Human
cuucagaauuccauaucuug

SEQ ID NO: 2806480 - RNA, 21 nt, Human
cuucagaauuccauaucuugc

SEQ ID NO: 2806481 - RNA, 14 nt, Human
cuucacuuuugcaa

SEQ ID NO: 2806482 - RNA, 21 nt, Human
cuucacuuuugcaagguucca

SEQ ID NO: 2806483 - RNA, 17 nt, Human
cuucacuguccuccaag

SEQ ID NO: 2806484 - RNA, 15 nt, Human
cuucacuguugaaaa

SEQ ID NO: 2806485 - RNA, 16 nt, Human
cuucacuguugaaaau

SEQ ID NO: 2806486 - RNA, 18 nt, Human
cuucacuguugaaaauua

SEQ ID NO: 2806487 - RNA, 19 nt, Human
cuucacuguugaaaauuau

SEQ ID NO: 2806488 - RNA, 21 nt, Human
cuucacuguccuccaagccag

SEQ ID NO: 2806489 - RNA, 18 nt, Human
cuucacuguccuccaagc

SEQ ID NO: 2806490 - RNA, 18 nt, Human
cuuauugcccacgcugga

SEQ ID NO: 2806491 - RNA, 21 nt, Human
cuuaugggucccccucagcaa

SEQ ID NO: 2806492 - RNA, 14 nt, Human
cuucaccuccucgc

SEQ ID NO: 2806493 - RNA, 14 nt, Human
cuuauugcgcugcu

SEQ ID NO: 2806494 - RNA, 16 nt, Human
cuuauugcgcugcuac

SEQ ID NO: 2806495 - RNA, 17 nt, Human
cuuauugcgcugcuacc

SEQ ID NO: 2806496 - RNA, 14 nt, Human
cuuauugcugauuu

SEQ ID NO: 2806497 - RNA, 16 nt, Human
cuuauugcugauuuua

SEQ ID NO: 2806498 - RNA, 20 nt, Human
cuucaccuaagucucuguga

SEQ ID NO: 2806499 - RNA, 15 nt, Human
cuuccaugucgccuc

SEQ ID NO: 2806500 - RNA, 16 nt, Human
cuuccaugucgccucu

SEQ ID NO: 2806501 - RNA, 17 nt, Human
cuuccaugauucuauuu

SEQ ID NO: 2806502 - RNA, 14 nt, Human
cuuccaugauuuua

SEQ ID NO: 2806503 - RNA, 14 nt, Human
cuuccaugauucua

SEQ ID NO: 2806504 - RNA, 17 nt, Human
cuuccaugucgccucug

SEQ ID NO: 2806505 - RNA, 18 nt, Human
cuuccaugucgccucugc

SEQ ID NO: 2806506 - RNA, 19 nt, Human
cuuccaugucgccucugca

SEQ ID NO: 2806507 - RNA, 20 nt, Human
cuuccaugucgccucugcau

SEQ ID NO: 2806508 - RNA, 19 nt, Human
cuuccauguaucuuuugaa

SEQ ID NO: 2806509 - RNA, 13 nt, Human
cuuauugcccacg

SEQ ID NO: 2806510 - RNA, 12 nt, Human
cuuauugcccac

SEQ ID NO: 2806511 - RNA, 13 nt, Human
cuuauuacaauuu

SEQ ID NO: 2806512 - RNA, 20 nt, Human
cuuauguggguugccuggug

SEQ ID NO: 2806513 - RNA, 19 nt, Human
cuuauguagcaggaaauaa

SEQ ID NO: 2806514 - RNA, 13 nt, Human
cuuauuaaaguuc

SEQ ID NO: 2806515 - RNA, 14 nt, Human
cuuauuaaaguucu

SEQ ID NO: 2806516 - RNA, 18 nt, Human
cuuauuaaaguucuguaa

SEQ ID NO: 2806517 - RNA, 15 nt, Human
cuuauguagauauuu

SEQ ID NO: 2806518 - RNA, 16 nt, Human
cuuauguagauauuug

SEQ ID NO: 2806519 - RNA, 17 nt, Human
cuuauguagauauuugg

SEQ ID NO: 2806520 - RNA, 18 nt, Human
cuuauguagauauuuggc

SEQ ID NO: 2806521 - RNA, 19 nt, Human
cuuauguagauauuuggcu

SEQ ID NO: 2806522 - RNA, 18 nt, Human
cuuauggauucauuuaua

SEQ ID NO: 2806523 - RNA, 15 nt, Human
cuuauggccacagcc

SEQ ID NO: 2806524 - RNA, 23 nt, Human
cuuauggaauugauuugcauuga

SEQ ID NO: 2806525 - RNA, 21 nt, Human
cuuauggaauugauuugcauu

SEQ ID NO: 2806526 - RNA, 20 nt, Human
cuuauggaauugauuugcau

SEQ ID NO: 2806527 - RNA, 19 nt, Human
cuuauggaauugauuugca

SEQ ID NO: 2806528 - RNA, 17 nt, Human
cuuauggaauugauuug

SEQ ID NO: 2806529 - RNA, 16 nt, Human
cuuauggaauugauuu

SEQ ID NO: 2806530 - RNA, 14 nt, Human
cuuauggaauugau

SEQ ID NO: 2806531 - RNA, 18 nt, Human
cuuagcagggaaacagcu

SEQ ID NO: 2806532 - RNA, 21 nt, Human
cuuagcagggaaacagcuaau

SEQ ID NO: 2806533 - RNA, 12 nt, Human
cuuacacugccu

SEQ ID NO: 2806534 - RNA, 19 nt, Human
cuuacacugccuguauacu

SEQ ID NO: 2806535 - RNA, 20 nt, Human
cuuacacugccuguauacuu

SEQ ID NO: 2806536 - RNA, 21 nt, Human
cuuacacugccuguauacuuu

SEQ ID NO: 2806537 - RNA, 23 nt, Human
cuuacacugccuguauacuuuag

SEQ ID NO: 2806538 - RNA, 20 nt, Human
cuuacacccacaguggaaag

SEQ ID NO: 2806539 - RNA, 11 nt, Human
cuuacacccac

SEQ ID NO: 2806540 - RNA, 13 nt, Human
cuuacacauacag

SEQ ID NO: 2806541 - RNA, 16 nt, Human
cuuacacauacaguuu

SEQ ID NO: 2806542 - RNA, 17 nt, Human
cuuacacauacaguuuu

SEQ ID NO: 2806543 - RNA, 20 nt, Human
cuuacacauacaguuuuaug

SEQ ID NO: 2806544 - RNA, 14 nt, Human
cuuaaagucaggag

SEQ ID NO: 2806545 - RNA, 23 nt, Human
cuuaaagcugccuguaguuagga

SEQ ID NO: 2806546 - RNA, 18 nt, Human
cuuaaagcugccuguagu

SEQ ID NO: 2806547 - RNA, 20 nt, Human
cuuaaaggcaccaucuaaua

SEQ ID NO: 2806548 - RNA, 19 nt, Human
cuuaaagauuuaucaaauc

SEQ ID NO: 2806549 - RNA, 20 nt, Human
cuuaaagauuuaucaaauca

SEQ ID NO: 2806550 - RNA, 16 nt, Human
cuuaaagauuuaucaa

SEQ ID NO: 2806551 - RNA, 11 nt, Human
cuguuggaagc

SEQ ID NO: 2806552 - RNA, 11 nt, Human
cuguugcuuga

SEQ ID NO: 2806553 - RNA, 15 nt, Human
cuguugcuugaauag

SEQ ID NO: 2806554 - RNA, 16 nt, Human
cuguuggauuccaugc

SEQ ID NO: 2806555 - RNA, 17 nt, Human
cuguuggauuccaugcu

SEQ ID NO: 2806556 - RNA, 18 nt, Human
cuguuggauuccaugcua

SEQ ID NO: 2806557 - RNA, 19 nt, Human
cuguuggauuccaugcuaa

SEQ ID NO: 2806558 - RNA, 13 nt, Human
cuuaaaaugcaau

SEQ ID NO: 2806559 - RNA, 14 nt, Human
cuuaaaaugcaaua

SEQ ID NO: 2806560 - RNA, 15 nt, Human
cuuaaaaugcaauau

SEQ ID NO: 2806561 - RNA, 19 nt, Human
cuuaaaaugcaauauuugu

SEQ ID NO: 2806562 - RNA, 20 nt, Human
cuuaaaaugcaauauuugua

SEQ ID NO: 2806563 - RNA, 21 nt, Human
cuuaaaaugcaauauuuguaa

SEQ ID NO: 2806564 - RNA, 22 nt, Human
cuuaaaaugcaauauuuguaag

SEQ ID NO: 2806565 - RNA, 11 nt, Human
cuuaaaaugga

SEQ ID NO: 2806566 - RNA, 14 nt, Human
cuuaaaauggaauu

SEQ ID NO: 2806567 - RNA, 18 nt, Human
cuuaaaauggaauugaaa

SEQ ID NO: 2806568 - RNA, 18 nt, Human
cuuaaaauauuccugcau

SEQ ID NO: 2806569 - RNA, 20 nt, Human
cuuaaaauauuccugcauuu

SEQ ID NO: 2806570 - RNA, 22 nt, Human
cuguuggauuuguuuaaaagga

SEQ ID NO: 2806571 - RNA, 19 nt, Human
cuguuggauuuguuuaaaa

SEQ ID NO: 2806572 - RNA, 13 nt, Human
cuuaccccugccu

SEQ ID NO: 2806573 - RNA, 19 nt, Human
cuuaccccuggcuguuugg

SEQ ID NO: 2806574 - RNA, 22 nt, Human
cuuaccccuggcuguuuggacu

SEQ ID NO: 2806575 - RNA, 19 nt, Human
cuuaccuaagugacauuug

SEQ ID NO: 2806576 - RNA, 21 nt, Human
cuuaccuaagugacauuugua

SEQ ID NO: 2806577 - RNA, 18 nt, Human
cuuaccuaccacaugcca

SEQ ID NO: 2806578 - RNA, 13 nt, Human
cuuacccuuagaa

SEQ ID NO: 2806579 - RNA, 21 nt, Human
cuuacccuuagaauccacgua

SEQ ID NO: 2806580 - RNA, 22 nt, Human
cuuacccuuuccuccuuuauca

SEQ ID NO: 2806581 - RNA, 20 nt, Human
cuuaccccuuagccucccug

SEQ ID NO: 2806582 - RNA, 11 nt, Human
cuuaccugaca

SEQ ID NO: 2806583 - RNA, 12 nt, Human
cuuaccugacac

SEQ ID NO: 2806584 - RNA, 13 nt, Human
cuuaccugacaca

SEQ ID NO: 2806585 - RNA, 16 nt, Human
cuuaccugacacaaga

SEQ ID NO: 2806586 - RNA, 19 nt, Human
cuuaccugacacaagagga

SEQ ID NO: 2806587 - RNA, 17 nt, Human
cuuaccugaccucuugc

SEQ ID NO: 2806588 - RNA, 18 nt, Human
cuuaccugaccucuugcu

SEQ ID NO: 2806589 - RNA, 19 nt, Human
cuuaccugaccucuugcug

SEQ ID NO: 2806590 - RNA, 20 nt, Human
cuuaccugaccucuugcugu

SEQ ID NO: 2806591 - RNA, 21 nt, Human
cuuaccugaccucuugcuguc

SEQ ID NO: 2806592 - RNA, 17 nt, Human
cuuagauugaaguaaac

SEQ ID NO: 2806593 - RNA, 24 nt, Human
cuuagauucucugugucuaagauu

SEQ ID NO: 2806594 - RNA, 21 nt, Human
cuuagcacuaccacuccugcc

SEQ ID NO: 2806595 - RNA, 15 nt, Human
cuuagcaaaaagugg

SEQ ID NO: 2806596 - RNA, 20 nt, Human
cuuagauguuccaguaaucu

SEQ ID NO: 2806597 - RNA, 16 nt, Human
cuuagauguuucacac

SEQ ID NO: 2806598 - RNA, 11 nt, Human
cuuagauucuc

SEQ ID NO: 2806599 - RNA, 20 nt, Human
cuuagauucucugugucuaa

SEQ ID NO: 2806600 - RNA, 22 nt, Human
cuuagauucucugugucuaaga

SEQ ID NO: 2806601 - RNA, 14 nt, Human
cuguugcugccuca

SEQ ID NO: 2806602 - RNA, 20 nt, Human
cuguugcuguguuuaauuug

SEQ ID NO: 2806603 - RNA, 21 nt, Human
cuguugcuguguuuaauuuga

SEQ ID NO: 2806604 - RNA, 17 nt, Human
cuguugcugccucaugc

SEQ ID NO: 2806605 - RNA, 16 nt, Human
cuguugcugccucaug

SEQ ID NO: 2806606 - RNA, 15 nt, Human
cuguugcugccucau

SEQ ID NO: 2806607 - RNA, 13 nt, Human
cuguucagcucca

SEQ ID NO: 2806608 - RNA, 19 nt, Human
cugugucuugcaauggcag

SEQ ID NO: 2806609 - RNA, 16 nt, Human
cugugucuugcaaugg

SEQ ID NO: 2806610 - RNA, 16 nt, Human
cuguucacuuuuccuc

SEQ ID NO: 2806611 - RNA, 18 nt, Human
cuguucacuuuuccuccc

SEQ ID NO: 2806612 - RNA, 17 nt, Human
cuguucacuuuuccucc

SEQ ID NO: 2806613 - RNA, 15 nt, Human
cuguucacucuacuu

SEQ ID NO: 2806614 - RNA, 18 nt, Human
cugugaccaggaaggaag

SEQ ID NO: 2806615 - RNA, 23 nt, Human
cugugaccaggaaggaagucagc

SEQ ID NO: 2806616 - RNA, 17 nt, Human
cugugcguuacuaauug

SEQ ID NO: 2806617 - RNA, 22 nt, Human
cugugcuacugucuuuggaaaa

SEQ ID NO: 2806618 - RNA, 13 nt, Human
cugugcucagaga

SEQ ID NO: 2806619 - RNA, 15 nt, Human
cugugcucagagacc

SEQ ID NO: 2806620 - RNA, 16 nt, Human
cugugcucaggacuca

SEQ ID NO: 2806621 - RNA, 15 nt, Human
cugugcucaggacuc

SEQ ID NO: 2806622 - RNA, 12 nt, Human
cugugcucagga

SEQ ID NO: 2806623 - RNA, 21 nt, Human
cugugacuucuccaggucuca

SEQ ID NO: 2806624 - RNA, 14 nt, Human
cugugagaccccca

SEQ ID NO: 2806625 - RNA, 16 nt, Human
cugugacuucuccagg

SEQ ID NO: 2806626 - RNA, 22 nt, Human
cugugacuucagcucuguuuua

SEQ ID NO: 2806627 - RNA, 14 nt, Human
cugugacucuuuuu

SEQ ID NO: 2806628 - RNA, 17 nt, Human
cugugacuucagcucug

SEQ ID NO: 2806629 - RNA, 12 nt, Human
cugugacccacu

SEQ ID NO: 2806630 - RNA, 15 nt, Human
cugugacccacuucu

SEQ ID NO: 2806631 - RNA, 21 nt, Human
cugugacccacuucucaucac

SEQ ID NO: 2806632 - RNA, 16 nt, Human
cuguguaaccauuuua

SEQ ID NO: 2806633 - RNA, 22 nt, Human
cuguguaaccauuuuauaaagu

SEQ ID NO: 2806634 - RNA, 17 nt, Human
cuguguacaccucugga

SEQ ID NO: 2806635 - RNA, 18 nt, Human
cuguguacuguauagaca

SEQ ID NO: 2806636 - RNA, 12 nt, Human
cuguguacugug

SEQ ID NO: 2806637 - RNA, 13 nt, Human
cuguguacugugu

SEQ ID NO: 2806638 - RNA, 14 nt, Human
cuguguacuguguc

SEQ ID NO: 2806639 - RNA, 14 nt, Human
cugugucuugcaau

SEQ ID NO: 2806640 - RNA, 18 nt, Human
cugugucugagagcaaag

SEQ ID NO: 2806641 - RNA, 18 nt, Human
cugugucuaagauucuag

SEQ ID NO: 2806642 - RNA, 19 nt, Human
cugugucuaagauucuaga

SEQ ID NO: 2806643 - RNA, 20 nt, Human
cugugucuaagauucuagau

SEQ ID NO: 2806644 - RNA, 21 nt, Human
cugugucuaagauucuagauc

SEQ ID NO: 2806645 - RNA, 21 nt, Human
cugugucagguggggcagcuu

SEQ ID NO: 2806646 - RNA, 19 nt, Human
cugugucagcgccuggccu

SEQ ID NO: 2806647 - RNA, 23 nt, Human
cuguguacauaacucuguaaaaa

SEQ ID NO: 2806648 - RNA, 16 nt, Human
cugugucuaagauucu

SEQ ID NO: 2806649 - RNA, 17 nt, Human
cugugucuaagauucua

SEQ ID NO: 2806650 - RNA, 19 nt, Human
cugugucagguggggcagc

SEQ ID NO: 2806651 - RNA, 15 nt, Human
gagugauauggagca

SEQ ID NO: 2806652 - RNA, 17 nt, Human
gagugauauggagcaag

SEQ ID NO: 2806653 - RNA, 14 nt, Human
gagugacuagacgu

SEQ ID NO: 2806654 - RNA, 19 nt, Human
gagugagacaaaauuuuag

SEQ ID NO: 2806655 - RNA, 17 nt, Human
gagugacuccaagaaca

SEQ ID NO: 2806656 - RNA, 20 nt, Human
gagugacagaggcagcccca

SEQ ID NO: 2806657 - RNA, 18 nt, Human
gagucccaaggaaagccc

SEQ ID NO: 2806658 - RNA, 19 nt, Human
gagugacaguggauugcau

SEQ ID NO: 2806659 - RNA, 21 nt, Human
gagugcaagccccugcuccag

SEQ ID NO: 2806660 - RNA, 10 nt, Human
gagugaucuu

SEQ ID NO: 2806661 - RNA, 12 nt, Human
gagugauugcag

SEQ ID NO: 2806662 - RNA, 15 nt, Human
gagugauugcagcuu

SEQ ID NO: 2806663 - RNA, 20 nt, Human
gagugauugcagcuuuaugu

SEQ ID NO: 2806664 - RNA, 19 nt, Human
gagugcaaugacacagucu

SEQ ID NO: 2806665 - RNA, 12 nt, Human
gagugcacagcu

SEQ ID NO: 2806666 - RNA, 13 nt, Human
gagugcacagcug

SEQ ID NO: 2806667 - RNA, 14 nt, Human
gagugcacagcugu

SEQ ID NO: 2806668 - RNA, 15 nt, Human
gagugcacagcuguc

SEQ ID NO: 2806669 - RNA, 16 nt, Human
gagugcacagcugucc

SEQ ID NO: 2806670 - RNA, 17 nt, Human
gagucaccaagcccagu

SEQ ID NO: 2806671 - RNA, 20 nt, Human
gagucacccaugaagacagg

SEQ ID NO: 2806672 - RNA, 14 nt, Human
gagucaccuuccag

SEQ ID NO: 2806673 - RNA, 15 nt, Human
gagucaccuuccagg

SEQ ID NO: 2806674 - RNA, 18 nt, Human
gagucaccuuccaggacc

SEQ ID NO: 2806675 - RNA, 21 nt, Human
gagucaccuuccaggaccccu

SEQ ID NO: 2806676 - RNA, 23 nt, Human
gagucaccuuccaggaccccugg

SEQ ID NO: 2806677 - RNA, 14 nt, Human
gagucaccuucccu

SEQ ID NO: 2806678 - RNA, 15 nt, Human
gagucaccuucccuu

SEQ ID NO: 2806679 - RNA, 22 nt, Human
gagucaccuucccuugccacuu

SEQ ID NO: 2806680 - RNA, 16 nt, Human
gagucaccaagcccag

SEQ ID NO: 2806681 - RNA, 15 nt, Human
gagucaccaagccca

SEQ ID NO: 2806682 - RNA, 16 nt, Human
gaggugaggagcagag

SEQ ID NO: 2806683 - RNA, 14 nt, Human
gaggugauagcauu

SEQ ID NO: 2806684 - RNA, 12 nt, Human
gaggugcuucac

SEQ ID NO: 2806685 - RNA, 11 nt, Human
gagucagccuu

SEQ ID NO: 2806686 - RNA, 22 nt, Human
gagucagacauuuuaagauggu

SEQ ID NO: 2806687 - RNA, 14 nt, Human
gagucagccaggag

SEQ ID NO: 2806688 - RNA, 16 nt, Human
gagucagccaggagcu

SEQ ID NO: 2806689 - RNA, 15 nt, Human
gagucagggcccaga

SEQ ID NO: 2806690 - RNA, 16 nt, Human
gagucagggcccagag

SEQ ID NO: 2806691 - RNA, 17 nt, Human
gagucagggcccagagg

SEQ ID NO: 2806692 - RNA, 22 nt, Human
gagucagggcccagaggcugag

SEQ ID NO: 2806693 - RNA, 18 nt, Human
gagugacagaggcagccc

SEQ ID NO: 2806694 - RNA, 16 nt, Human
gagucccaaggaaagc

SEQ ID NO: 2806695 - RNA, 15 nt, Human
gagucccaaggaaag

SEQ ID NO: 2806696 - RNA, 12 nt, Human
gagucccaccuu

SEQ ID NO: 2806697 - RNA, 14 nt, Human
gagucccaaggaaa

SEQ ID NO: 2806698 - RNA, 23 nt, Human
gaggugaccccagguuucuaugu

SEQ ID NO: 2806699 - RNA, 16 nt, Human
gaggugaaagggagcu

SEQ ID NO: 2806700 - RNA, 15 nt, Human
gaggugaaagggagc

SEQ ID NO: 2806701 - RNA, 22 nt, Human
gaggucgaccccaaagccccuu

SEQ ID NO: 2806702 - RNA, 21 nt, Human
gagguccugugaucuuauuuu

SEQ ID NO: 2806703 - RNA, 13 nt, Human
gaguuuaaagcaa

SEQ ID NO: 2806704 - RNA, 16 nt, Human
gaguuguuguguacag

SEQ ID NO: 2806705 - RNA, 20 nt, Human
gaguuggagacccgccuggc

SEQ ID NO: 2806706 - RNA, 16 nt, Human
gaguugcauugauuca

SEQ ID NO: 2806707 - RNA, 16 nt, Human
gaguugccaagacaaa

SEQ ID NO: 2806708 - RNA, 17 nt, Human
gaguugccaagacaaau

SEQ ID NO: 2806709 - RNA, 20 nt, Human
gaguugccaagacaaaucaa

SEQ ID NO: 2806710 - RNA, 17 nt, Human
gaguugccccgucucug

SEQ ID NO: 2806711 - RNA, 15 nt, Human
gaggcucaacaauaa

SEQ ID NO: 2806712 - RNA, 17 nt, Human
gaggcugaggcaggagg

SEQ ID NO: 2806713 - RNA, 16 nt, Human
gaggcugaggcaggag

SEQ ID NO: 2806714 - RNA, 20 nt, Human
gaggcuauuauuuucacugu

SEQ ID NO: 2806715 - RNA, 19 nt, Human
gaggcauccuacccuuuuc

SEQ ID NO: 2806716 - RNA, 20 nt, Human
gaggcauccuacccuuuucu

SEQ ID NO: 2806717 - RNA, 16 nt, Human
gaggaccuggggcaca

SEQ ID NO: 2806718 - RNA, 17 nt, Human
gaggaccuggggcacag

SEQ ID NO: 2806719 - RNA, 18 nt, Human
gaggaccuggggcacagu

SEQ ID NO: 2806720 - RNA, 16 nt, Human
gaggaccuguauuuaa

SEQ ID NO: 2806721 - RNA, 17 nt, Human
gaggaccuguauuuaag

SEQ ID NO: 2806722 - RNA, 18 nt, Human
gaggaccuguauuuaagc

SEQ ID NO: 2806723 - RNA, 20 nt, Human
gaggaccuguauuuaagcaa

SEQ ID NO: 2806724 - RNA, 22 nt, Human
gaggaccuguauuuaagcaaau

SEQ ID NO: 2806725 - RNA, 23 nt, Human
gaggaccuguauuuaagcaaaua

SEQ ID NO: 2806726 - RNA, 14 nt, Human
gaggcagggucuca

SEQ ID NO: 2806727 - RNA, 16 nt, Human
gaggaccugacccuac

SEQ ID NO: 2806728 - RNA, 20 nt, Human
gaggaccugacccuacuccc

SEQ ID NO: 2806729 - RNA, 22 nt, Human
gaggaccugacccuacucccuu

SEQ ID NO: 2806730 - RNA, 20 nt, Human
gaggacccuggaaauggacu

SEQ ID NO: 2806731 - RNA, 13 nt, Human
gaggcauccagca

SEQ ID NO: 2806732 - RNA, 18 nt, Human
gaggcauccagcagucuc

SEQ ID NO: 2806733 - RNA, 21 nt, Human
gaggcauccagcagucucugc

SEQ ID NO: 2806734 - RNA, 22 nt, Human
gaggcagggucucacucugucg

SEQ ID NO: 2806735 - RNA, 15 nt, Human
gaggcagggucucac

SEQ ID NO: 2806736 - RNA, 17 nt, Human
gaggggccccccugccc

SEQ ID NO: 2806737 - RNA, 22 nt, Human
gaggggcaucugccccuccccc

SEQ ID NO: 2806738 - RNA, 17 nt, Human
gaggggcaucugccccu

SEQ ID NO: 2806739 - RNA, 14 nt, Human
gagggcucugugcu

SEQ ID NO: 2806740 - RNA, 13 nt, Human
gagggcugcccug

SEQ ID NO: 2806741 - RNA, 12 nt, Human
gaggcugaggcg

SEQ ID NO: 2806742 - RNA, 21 nt, Human
gagcugccuuggcucagacau

SEQ ID NO: 2806743 - RNA, 22 nt, Human
gagcugccuuggcucagacaug

SEQ ID NO: 2806744 - RNA, 12 nt, Human
gagcugcuggcu

SEQ ID NO: 2806745 - RNA, 21 nt, Human
gagcugcuggcuugcagugcg

SEQ ID NO: 2806746 - RNA, 16 nt, Human
gagcugcuggcuugca

SEQ ID NO: 2806747 - RNA, 15 nt, Human
gagcuggaccagugg

SEQ ID NO: 2806748 - RNA, 20 nt, Human
gagccuucgugcccccccuu

SEQ ID NO: 2806749 - RNA, 18 nt, Human
gagcgcaccugcccccug

SEQ ID NO: 2806750 - RNA, 12 nt, Human
gagcgcaagaua

SEQ ID NO: 2806751 - RNA, 13 nt, Human
gagcgcaagauag

SEQ ID NO: 2806752 - RNA, 15 nt, Human
gagcugccuuggcuc

SEQ ID NO: 2806753 - RNA, 18 nt, Human
gagcugccuuggcucaga

SEQ ID NO: 2806754 - RNA, 16 nt, Human
gagcgcaucaggccug

SEQ ID NO: 2806755 - RNA, 15 nt, Human
gagcgcauggcaagu

SEQ ID NO: 2806756 - RNA, 20 nt, Human
gagcgcaccugcccccuggu

SEQ ID NO: 2806757 - RNA, 21 nt, Human
gagcgcccacuagacccacug

SEQ ID NO: 2806758 - RNA, 18 nt, Human
gauuauaucaaaguauuu

SEQ ID NO: 2806759 - RNA, 20 nt, Human
gauuauaucaaaguauuugu

SEQ ID NO: 2806760 - RNA, 16 nt, Human
gauuaucuauuugugu

SEQ ID NO: 2806761 - RNA, 20 nt, Human
gauuaucuauuugugugugu

SEQ ID NO: 2806762 - RNA, 12 nt, Human
gauuauccugag

SEQ ID NO: 2806763 - RNA, 20 nt, Human
gauuauaggcaccuaccacc

SEQ ID NO: 2806764 - RNA, 13 nt, Human
gauuauagauucu

SEQ ID NO: 2806765 - RNA, 14 nt, Human
gauuauagauucua

SEQ ID NO: 2806766 - RNA, 15 nt, Human
gauuauagauucuaa

SEQ ID NO: 2806767 - RNA, 22 nt, Human
gauuauagauucuaaagauucu

SEQ ID NO: 2806768 - RNA, 17 nt, Human
gauuauagauucuaaag

SEQ ID NO: 2806769 - RNA, 18 nt, Human
gauuauagauucuaaaga

SEQ ID NO: 2806770 - RNA, 20 nt, Human
gauguaucgggaagauuucu

SEQ ID NO: 2806771 - RNA, 22 nt, Human
gauguaucgggaagauuucuaa

SEQ ID NO: 2806772 - RNA, 13 nt, Human
gauguaucugagu

SEQ ID NO: 2806773 - RNA, 19 nt, Human
gauguaucugaguugccaa

SEQ ID NO: 2806774 - RNA, 21 nt, Human
gauguaucugaguugccaaga

SEQ ID NO: 2806775 - RNA, 20 nt, Human
gauguaugaaggcuuuuggu

SEQ ID NO: 2806776 - RNA, 22 nt, Human
gauguaugaaggcuuuuggucu

SEQ ID NO: 2806777 - RNA, 20 nt, Human
gauguaugaauacagcagca

SEQ ID NO: 2806778 - RNA, 21 nt, Human
gauguaugaauacagcagcaa

SEQ ID NO: 2806779 - RNA, 20 nt, Human
gauguauguugaagccuuug

SEQ ID NO: 2806780 - RNA, 13 nt, Human
gaugucacagggc

SEQ ID NO: 2806781 - RNA, 15 nt, Human
gaugucacagggcca

SEQ ID NO: 2806782 - RNA, 14 nt, Human
gauguauauuccuu

SEQ ID NO: 2806783 - RNA, 21 nt, Human
gauguauauuccuuugaagau

SEQ ID NO: 2806784 - RNA, 21 nt, Human
gauguauguugaagccuuugu

SEQ ID NO: 2806785 - RNA, 23 nt, Human
gauucuuauguagcaggaaauaa

SEQ ID NO: 2806786 - RNA, 13 nt, Human
gauucuuccagau

SEQ ID NO: 2806787 - RNA, 22 nt, Human
gauucuuccagaugugaugcuu

SEQ ID NO: 2806788 - RNA, 16 nt, Human
gauucuucaaaagcau

SEQ ID NO: 2806789 - RNA, 22 nt, Human
gauucugggaggaagcagguug

SEQ ID NO: 2806790 - RNA, 17 nt, Human
gauucugggaugcuccu

SEQ ID NO: 2806791 - RNA, 15 nt, Human
gauucugggaggaag

SEQ ID NO: 2806792 - RNA, 21 nt, Human
gauucugcaguaaaucuuuua

SEQ ID NO: 2806793 - RNA, 19 nt, Human
gauucugcaguaaaucuuu

SEQ ID NO: 2806794 - RNA, 18 nt, Human
gauucugcaguaaaucuu

SEQ ID NO: 2806795 - RNA, 19 nt, Human
gauucuggacagucagcuc

SEQ ID NO: 2806796 - RNA, 21 nt, Human
gauucuggacagucagcucuu

SEQ ID NO: 2806797 - RNA, 20 nt, Human
gauuuaccuguuuucgcacc

SEQ ID NO: 2806798 - RNA, 12 nt, Human
gauuuagaaaaa

SEQ ID NO: 2806799 - RNA, 20 nt, Human
gauuuagaaaaaaguuuaca

SEQ ID NO: 2806800 - RNA, 21 nt, Human
gauuuagaaaaaaguuuacaa

SEQ ID NO: 2806801 - RNA, 18 nt, Human
gauuuaguguaauaagac

SEQ ID NO: 2806802 - RNA, 13 nt, Human
gauuuaguagugu

SEQ ID NO: 2806803 - RNA, 15 nt, Human
gauuuagaacuguau

SEQ ID NO: 2806804 - RNA, 15 nt, Human
gauuuagaaguguca

SEQ ID NO: 2806805 - RNA, 20 nt, Human
gauuuagaagugucauguuu

SEQ ID NO: 2806806 - RNA, 14 nt, Human
gauuuauaaacaga

SEQ ID NO: 2806807 - RNA, 14 nt, Human
gauuuuuuauugcu

SEQ ID NO: 2806808 - RNA, 16 nt, Human
gauuuuuuauugcuag

SEQ ID NO: 2806809 - RNA, 18 nt, Human
gauuuuuuauugcuagua

SEQ ID NO: 2806810 - RNA, 22 nt, Human
gauuuuuuauugcuaguauuug

SEQ ID NO: 2806811 - RNA, 21 nt, Human
gauuuuuucagacuugucaag

SEQ ID NO: 2806812 - RNA, 20 nt, Human
gauuuuuuacagcugccugc

SEQ ID NO: 2806813 - RNA, 17 nt, Human
gauuuauaguuuguaca

SEQ ID NO: 2806814 - RNA, 20 nt, Human
gauuuauaguuuguacaugc

SEQ ID NO: 2806815 - RNA, 21 nt, Human
gauuuauaguuuguacaugca

SEQ ID NO: 2806816 - RNA, 16 nt, Human
gauuuauauaaaugua

SEQ ID NO: 2806817 - RNA, 19 nt, Human
gauuuauauaaauguaaaa

SEQ ID NO: 2806818 - RNA, 12 nt, Human
gauuuaucaaau

SEQ ID NO: 2806819 - RNA, 13 nt, Human
gauuuaucaaauc

SEQ ID NO: 2806820 - RNA, 14 nt, Human
gauuuaucaaauca

SEQ ID NO: 2806821 - RNA, 15 nt, Human
gauuuaucaaaucag

SEQ ID NO: 2806822 - RNA, 17 nt, Human
gauucuccugccucagc

SEQ ID NO: 2806823 - RNA, 15 nt, Human
gauucuccugccuca

SEQ ID NO: 2806824 - RNA, 18 nt, Human
gauucuccugccucagcc

SEQ ID NO: 2806825 - RNA, 16 nt, Human
gauucugcaguaaauc

SEQ ID NO: 2806826 - RNA, 15 nt, Human
gauucugcaguaaau

SEQ ID NO: 2806827 - RNA, 21 nt, Human
gaucugcggaucucagcuuug

SEQ ID NO: 2806828 - RNA, 19 nt, Human
gaucugcggaucucagcuu

SEQ ID NO: 2806829 - RNA, 18 nt, Human
gaucugcggaucucagcu

SEQ ID NO: 2806830 - RNA, 17 nt, Human
gaucugcggaucucagc

SEQ ID NO: 2806831 - RNA, 20 nt, Human
gaugauaaguuccuuuccuu

SEQ ID NO: 2806832 - RNA, 18 nt, Human
gaugauacaagauuagaa

SEQ ID NO: 2806833 - RNA, 15 nt, Human
gauguagcauuaugc

SEQ ID NO: 2806834 - RNA, 16 nt, Human
gauggagcgcaccugc

SEQ ID NO: 2806835 - RNA, 22 nt, Human
gauggagcccaggcgggagcgg

SEQ ID NO: 2806836 - RNA, 14 nt, Human
gauggagcccaggc

SEQ ID NO: 2806837 - RNA, 17 nt, Human
gauggagcccaggcggg

SEQ ID NO: 2806838 - RNA, 19 nt, Human
gauggagcccaggcgggag

SEQ ID NO: 2806839 - RNA, 14 nt, Human
gaugguuucuugca

SEQ ID NO: 2806840 - RNA, 12 nt, Human
gaugcugccuga

SEQ ID NO: 2806841 - RNA, 16 nt, Human
gaugcugccugaguca

SEQ ID NO: 2806842 - RNA, 22 nt, Human
gaugcugcuuccgguagggagg

SEQ ID NO: 2806843 - RNA, 14 nt, Human
gaugcugccugagu

SEQ ID NO: 2806844 - RNA, 14 nt, Human
gaugcuggagaaga

SEQ ID NO: 2806845 - RNA, 21 nt, Human
gaugauacaagauuagaagcu

SEQ ID NO: 2806846 - RNA, 20 nt, Human
gauggacaguucacacccug

SEQ ID NO: 2806847 - RNA, 22 nt, Human
gauggacaguucacacccugca

SEQ ID NO: 2806848 - RNA, 23 nt, Human
gauggacaguucacacccugcaa

SEQ ID NO: 2806849 - RNA, 16 nt, Human
gaugcuggagaagaga

SEQ ID NO: 2806850 - RNA, 19 nt, Human
gaugcuggagaagagagga

SEQ ID NO: 2806851 - RNA, 20 nt, Human
gaugcuggagaagagaggag

SEQ ID NO: 2806852 - RNA, 21 nt, Human
gaugcuggagaagagaggaga

SEQ ID NO: 2806853 - RNA, 22 nt, Human
gauggagacugguccugugugc

SEQ ID NO: 2806854 - RNA, 23 nt, Human
gauggagacugguccugugugca

SEQ ID NO: 2806855 - RNA, 21 nt, Human
gauuuuuuucccaauugagaa

SEQ ID NO: 2806856 - RNA, 14 nt, Human
gcaaguuaagagaa

SEQ ID NO: 2806857 - RNA, 16 nt, Human
gcaaguuaagagaaac

SEQ ID NO: 2806858 - RNA, 19 nt, Human
gcaaguuaagagaaacuuu

SEQ ID NO: 2806859 - RNA, 20 nt, Human
gcaaguuaagagaaacuuua

SEQ ID NO: 2806860 - RNA, 16 nt, Human
gcaaguucaauuuguu

SEQ ID NO: 2806861 - RNA, 22 nt, Human
gcaagugugggggguccuucuc

SEQ ID NO: 2806862 - RNA, 20 nt, Human
gcaagugauugggacagagg

SEQ ID NO: 2806863 - RNA, 19 nt, Human
gcaagugauugggacagag

SEQ ID NO: 2806864 - RNA, 22 nt, Human
gcaagucccugacucucuguga

SEQ ID NO: 2806865 - RNA, 19 nt, Human
gcaagugagagcugggugu

SEQ ID NO: 2806866 - RNA, 20 nt, Human
gcaagucccugacucucugu

SEQ ID NO: 2806867 - RNA, 12 nt, Human
gcaagucaugua

SEQ ID NO: 2806868 - RNA, 14 nt, Human
gcaagucauguaaa

SEQ ID NO: 2806869 - RNA, 15 nt, Human
gcaagucauguaaau

SEQ ID NO: 2806870 - RNA, 16 nt, Human
gcacauauacacacac

SEQ ID NO: 2806871 - RNA, 17 nt, Human
gcacauauacacacaca

SEQ ID NO: 2806872 - RNA, 14 nt, Human
gcacauaaacuuug

SEQ ID NO: 2806873 - RNA, 16 nt, Human
gcacagugucccccag

SEQ ID NO: 2806874 - RNA, 17 nt, Human
gcacacccucacucugc

SEQ ID NO: 2806875 - RNA, 19 nt, Human
gcacacccucacucugcca

SEQ ID NO: 2806876 - RNA, 20 nt, Human
gcacacccucacucugccag

SEQ ID NO: 2806877 - RNA, 21 nt, Human
gcacacccucacucugccagg

SEQ ID NO: 2806878 - RNA, 23 nt, Human
gcacacccucacucugccagggc

SEQ ID NO: 2806879 - RNA, 17 nt, Human
gcacaguguuaaaugaa

SEQ ID NO: 2806880 - RNA, 20 nt, Human
gcacaguguuaaaugaaauu

SEQ ID NO: 2806881 - RNA, 19 nt, Human
gcacagugcaucucagccc

SEQ ID NO: 2806882 - RNA, 20 nt, Human
gcacagugcaucucagccca

SEQ ID NO: 2806883 - RNA, 21 nt, Human
gcacagugcaucucagcccac

SEQ ID NO: 2806884 - RNA, 22 nt, Human
gcaauauuccuuagucaaauca

SEQ ID NO: 2806885 - RNA, 14 nt, Human
gcaauauguaaaua

SEQ ID NO: 2806886 - RNA, 21 nt, Human
gcaauauauuaccagcaagaa

SEQ ID NO: 2806887 - RNA, 13 nt, Human
gcaauaugaaguu

SEQ ID NO: 2806888 - RNA, 15 nt, Human
gcacaaggauugaaa

SEQ ID NO: 2806889 - RNA, 18 nt, Human
gcacaaggauugaaaauu

SEQ ID NO: 2806890 - RNA, 14 nt, Human
gcacaccgggcacu

SEQ ID NO: 2806891 - RNA, 18 nt, Human
gcacacccacucagcucc

SEQ ID NO: 2806892 - RNA, 17 nt, Human
gcacacccacucagcuc

SEQ ID NO: 2806893 - RNA, 19 nt, Human
gcacaauauugaacuuuuu

SEQ ID NO: 2806894 - RNA, 20 nt, Human
gcacaauauugaacuuuuuu

SEQ ID NO: 2806895 - RNA, 15 nt, Human
gcacaauaguaaccu

SEQ ID NO: 2806896 - RNA, 20 nt, Human
gcacaauaguaaccugggua

SEQ ID NO: 2806897 - RNA, 17 nt, Human
gcacaauauugaacuuu

SEQ ID NO: 2806898 - RNA, 23 nt, Human
gcaccgggccacagagaaaguac

SEQ ID NO: 2806899 - RNA, 21 nt, Human
gcaccuaccaccacgcccggc

SEQ ID NO: 2806900 - RNA, 22 nt, Human
gcaccuaccaccacgcccggcu

SEQ ID NO: 2806901 - RNA, 15 nt, Human
gcaccuaccaucagg

SEQ ID NO: 2806902 - RNA, 14 nt, Human
gcaccgggccacag

SEQ ID NO: 2806903 - RNA, 15 nt, Human
gcacauccauuccca

SEQ ID NO: 2806904 - RNA, 21 nt, Human
gcacauccauucccaagaaau

SEQ ID NO: 2806905 - RNA, 23 nt, Human
gcacauccauucccaagaaaugc

SEQ ID NO: 2806906 - RNA, 16 nt, Human
gcaccucagccugcac

SEQ ID NO: 2806907 - RNA, 15 nt, Human
gcaccucagccugca

SEQ ID NO: 2806908 - RNA, 16 nt, Human
gcaccuaguccaguga

SEQ ID NO: 2806909 - RNA, 13 nt, Human
gcaccucagccug

SEQ ID NO: 2806910 - RNA, 21 nt, Human
gcaccuauagucccagcuacu

SEQ ID NO: 2806911 - RNA, 18 nt, Human
gcaccuauagucccagcu

SEQ ID NO: 2806912 - RNA, 17 nt, Human
gcaccuauagucccagc

SEQ ID NO: 2806913 - RNA, 17 nt, Human
gcaccuaccaucaggga

SEQ ID NO: 2806914 - RNA, 19 nt, Human
gcaccuaccaucagggaca

SEQ ID NO: 2806915 - RNA, 20 nt, Human
gcaccuaccaucagggacag

SEQ ID NO: 2806916 - RNA, 23 nt, Human
gcaccuaccaucagggacaggau

SEQ ID NO: 2806917 - RNA, 16 nt, Human
gcacucagaagacacu

SEQ ID NO: 2806918 - RNA, 13 nt, Human
gcacucagaagac

SEQ ID NO: 2806919 - RNA, 23 nt, Human
gcacucccuugguggcaagagcc

SEQ ID NO: 2806920 - RNA, 16 nt, Human
gcacucccuccagcac

SEQ ID NO: 2806921 - RNA, 17 nt, Human
gcacucccuccagcaca

SEQ ID NO: 2806922 - RNA, 18 nt, Human
gcacucccuccagcacaa

SEQ ID NO: 2806923 - RNA, 15 nt, Human
gcacuugccuggguc

SEQ ID NO: 2806924 - RNA, 14 nt, Human
gcacuugccugggu

SEQ ID NO: 2806925 - RNA, 13 nt, Human
gcacuugccuggg

SEQ ID NO: 2806926 - RNA, 18 nt, Human
gcacuugccugggucaca

SEQ ID NO: 2806927 - RNA, 22 nt, Human
gaagacaccagagcagaugcag

SEQ ID NO: 2806928 - RNA, 18 nt, Human
gaagacaccagagcagau

SEQ ID NO: 2806929 - RNA, 21 nt, Human
gaagacaccagagcagaugca

SEQ ID NO: 2806930 - RNA, 14 nt, Human
gaagacaccagagc

SEQ ID NO: 2806931 - RNA, 15 nt, Human
gaagacaccagagca

SEQ ID NO: 2806932 - RNA, 16 nt, Human
gaagacaccagagcag

SEQ ID NO: 2806933 - RNA, 17 nt, Human
gaagacaccagagcaga

SEQ ID NO: 2806934 - RNA, 21 nt, Human
gaagacacagacugcgauuug

SEQ ID NO: 2806935 - RNA, 12 nt, Human
gaagacacagac

SEQ ID NO: 2806936 - RNA, 18 nt, Human
gaagacaauuugauacau

SEQ ID NO: 2806937 - RNA, 19 nt, Human
gaagacaauuugauacaua

SEQ ID NO: 2806938 - RNA, 20 nt, Human
gaagacaauuugauacauaa

SEQ ID NO: 2806939 - RNA, 15 nt, Human
gaagacaaaaagaca

SEQ ID NO: 2806940 - RNA, 20 nt, Human
gaagacaaaaagacaaacau

SEQ ID NO: 2806941 - RNA, 14 nt, Human
gaagcaaauaaaua

SEQ ID NO: 2806942 - RNA, 15 nt, Human
gaagcaaauaaauau

SEQ ID NO: 2806943 - RNA, 13 nt, Human
gaagcaaggaaga

SEQ ID NO: 2806944 - RNA, 18 nt, Human
gaagcaaggaagauauac

SEQ ID NO: 2806945 - RNA, 20 nt, Human
gaagcaaggaagauauacau

SEQ ID NO: 2806946 - RNA, 23 nt, Human
gaagcaaggaagauauacaugaa

SEQ ID NO: 2806947 - RNA, 14 nt, Human
gaagcaaggcggug

SEQ ID NO: 2806948 - RNA, 14 nt, Human
gaagcaacauuuua

SEQ ID NO: 2806949 - RNA, 22 nt, Human
gaagcaacauuuuagcucuauu

SEQ ID NO: 2806950 - RNA, 12 nt, Human
gaagcagagaga

SEQ ID NO: 2806951 - RNA, 14 nt, Human
gaagcagagagaug

SEQ ID NO: 2806952 - RNA, 15 nt, Human
gaagcagagagaugc

SEQ ID NO: 2806953 - RNA, 12 nt, Human
gaacccuuuguu

SEQ ID NO: 2806954 - RNA, 20 nt, Human
gaacccuuuguuucuuguuu

SEQ ID NO: 2806955 - RNA, 23 nt, Human
gaacccuuuguuucuuguuuauu

SEQ ID NO: 2806956 - RNA, 17 nt, Human
gaaccgagcaaagauca

SEQ ID NO: 2806957 - RNA, 21 nt, Human
gaacccuuggcuugcccacgu

SEQ ID NO: 2806958 - RNA, 20 nt, Human
gaacccuuggcuugcccacg

SEQ ID NO: 2806959 - RNA, 18 nt, Human
gaacccuuggcuugccca

SEQ ID NO: 2806960 - RNA, 17 nt, Human
gaacccuuggcuugccc

SEQ ID NO: 2806961 - RNA, 16 nt, Human
gaacccuuggcuugcc

SEQ ID NO: 2806962 - RNA, 12 nt, Human
gaacccuuggcu

SEQ ID NO: 2806963 - RNA, 12 nt, Human
gaacuccuuggc

SEQ ID NO: 2806964 - RNA, 13 nt, Human
gaacuccuuggcc

SEQ ID NO: 2806965 - RNA, 14 nt, Human
gaacuccuuggccu

SEQ ID NO: 2806966 - RNA, 15 nt, Human
gaacuccuuggccua

SEQ ID NO: 2806967 - RNA, 20 nt, Human
gaacuccuuggccuagccca

SEQ ID NO: 2806968 - RNA, 21 nt, Human
gaacuccuuggccuagcccac

SEQ ID NO: 2806969 - RNA, 17 nt, Human
gaacucucuccacccua

SEQ ID NO: 2806970 - RNA, 19 nt, Human
gaacucuaucugggccugg

SEQ ID NO: 2806971 - RNA, 20 nt, Human
gaacucuaucugggccuggg

SEQ ID NO: 2806972 - RNA, 21 nt, Human
gaacucuaucugggccugggc

SEQ ID NO: 2806973 - RNA, 22 nt, Human
gaacucuaucugggccugggcu

SEQ ID NO: 2806974 - RNA, 20 nt, Human
gaacucugacaacagacuuc

SEQ ID NO: 2806975 - RNA, 15 nt, Human
gaacuccuggccuca

SEQ ID NO: 2806976 - RNA, 15 nt, Human
gaaccgcacagcuca

SEQ ID NO: 2806977 - RNA, 14 nt, Human
gaaccgcacagcuc

SEQ ID NO: 2806978 - RNA, 13 nt, Human
gaaccgcacagcu

SEQ ID NO: 2806979 - RNA, 17 nt, Human
gaaccgcacagcucagg

SEQ ID NO: 2806980 - RNA, 16 nt, Human
gaaccgcacagcucag

SEQ ID NO: 2806981 - RNA, 21 nt, Human
gaaccgcacagcucaggaggc

SEQ ID NO: 2806982 - RNA, 19 nt, Human
gaaccgagcaaagaucaaa

SEQ ID NO: 2806983 - RNA, 21 nt, Human
gaaccgagcaaagaucaaaau

SEQ ID NO: 2806984 - RNA, 23 nt, Human
gaaccgagcaaagaucaaaauaa

SEQ ID NO: 2806985 - RNA, 12 nt, Human
gaacuggcugca

SEQ ID NO: 2806986 - RNA, 11 nt, Human
gaacuggcugc

SEQ ID NO: 2806987 - RNA, 20 nt, Human
gaagaaucuguuucccagca

SEQ ID NO: 2806988 - RNA, 19 nt, Human
gaagaauccuuuuguagaa

SEQ ID NO: 2806989 - RNA, 16 nt, Human
gaagaauuaagauaca

SEQ ID NO: 2806990 - RNA, 15 nt, Human
gaagaauggagagga

SEQ ID NO: 2806991 - RNA, 16 nt, Human
gaagaauggagaggaa

SEQ ID NO: 2806992 - RNA, 17 nt, Human
gaagaauggagaggaac

SEQ ID NO: 2806993 - RNA, 18 nt, Human
gaagaauggagaggaaca

SEQ ID NO: 2806994 - RNA, 18 nt, Human
gaagaauguguuucaaac

SEQ ID NO: 2806995 - RNA, 19 nt, Human
gaagaauguguuucaaacu

SEQ ID NO: 2806996 - RNA, 13 nt, Human
gaagaauuuguua

SEQ ID NO: 2806997 - RNA, 14 nt, Human
gaagaauuuguuau

SEQ ID NO: 2806998 - RNA, 17 nt, Human
gaacuggagccaugggc

SEQ ID NO: 2806999 - RNA, 18 nt, Human
gaacuggagccaugggca

SEQ ID NO: 2807000 - RNA, 18 nt, Human
gaacuggcaauugucuau

SEQ ID NO: 2807001 - RNA, 18 nt, Human
gaacugaacuaauccuuc

SEQ ID NO: 2807002 - RNA, 17 nt, Human
gaacucugaacuuugga

SEQ ID NO: 2807003 - RNA, 20 nt, Human
gaacucugaacuuuggagag

SEQ ID NO: 2807004 - RNA, 11 nt, Human
gaacucugaca

SEQ ID NO: 2807005 - RNA, 13 nt, Human
gaacucugacaag

SEQ ID NO: 2807006 - RNA, 14 nt, Human
gaacucugacaagg

SEQ ID NO: 2807007 - RNA, 15 nt, Human
gaacucugacaaggg

SEQ ID NO: 2807008 - RNA, 17 nt, Human
gaacucugacaagggcu

SEQ ID NO: 2807009 - RNA, 19 nt, Human
gaacucugacaagggcuga

SEQ ID NO: 2807010 - RNA, 19 nt, Human
gaacugccauuauuuucug

SEQ ID NO: 2807011 - RNA, 20 nt, Human
gaacugccauuauuuucugu

SEQ ID NO: 2807012 - RNA, 23 nt, Human
gaacugccauuauuuucugucag

SEQ ID NO: 2807013 - RNA, 12 nt, Human
gaacugaacuca

SEQ ID NO: 2807014 - RNA, 14 nt, Human
gaauauuguuucuu

SEQ ID NO: 2807015 - RNA, 15 nt, Human
gaauauuguuucuuu

SEQ ID NO: 2807016 - RNA, 20 nt, Human
gaauauucagagaauaucaa

SEQ ID NO: 2807017 - RNA, 12 nt, Human
gaauauuguguu

SEQ ID NO: 2807018 - RNA, 23 nt, Human
gaauauuguguuccuuuuuauga

SEQ ID NO: 2807019 - RNA, 17 nt, Human
gaaguugaaguuuagga

SEQ ID NO: 2807020 - RNA, 15 nt, Human
gaauauguuuccuug

SEQ ID NO: 2807021 - RNA, 19 nt, Human
gaauauguuuccuuguuua

SEQ ID NO: 2807022 - RNA, 20 nt, Human
gaauauuagugaccucagcu

SEQ ID NO: 2807023 - RNA, 15 nt, Human
gaauauguauguaua

SEQ ID NO: 2807024 - RNA, 12 nt, Human
gaauaugucugc

SEQ ID NO: 2807025 - RNA, 13 nt, Human
gaauauaacauga

SEQ ID NO: 2807026 - RNA, 15 nt, Human
gaauauaacaugaaa

SEQ ID NO: 2807027 - RNA, 20 nt, Human
gaauauaacaugaaaugaua

SEQ ID NO: 2807028 - RNA, 19 nt, Human
gaauauaauauauuugugu

SEQ ID NO: 2807029 - RNA, 20 nt, Human
gaauauaauauauuugugua

SEQ ID NO: 2807030 - RNA, 18 nt, Human
gaaggggacccccgcccc

SEQ ID NO: 2807031 - RNA, 20 nt, Human
gaaggggacccccgcccccu

SEQ ID NO: 2807032 - RNA, 21 nt, Human
gaaggggacccccgcccccug

SEQ ID NO: 2807033 - RNA, 19 nt, Human
gaaggggaagcacucgugu

SEQ ID NO: 2807034 - RNA, 15 nt, Human
gaaguguguuuccuu

SEQ ID NO: 2807035 - RNA, 18 nt, Human
gaaguguugaagggaggu

SEQ ID NO: 2807036 - RNA, 16 nt, Human
gaaguuacuuuauguu

SEQ ID NO: 2807037 - RNA, 20 nt, Human
gaaguuacuuuauguuuguc

SEQ ID NO: 2807038 - RNA, 15 nt, Human
gaaguuacuuucuua

SEQ ID NO: 2807039 - RNA, 16 nt, Human
gaaguuacuuucuuaa

SEQ ID NO: 2807040 - RNA, 20 nt, Human
gaaguuacuuucuuaaugug

SEQ ID NO: 2807041 - RNA, 22 nt, Human
gaaguuagguucuuaaaagugc

SEQ ID NO: 2807042 - RNA, 15 nt, Human
gaaguucauaccuaa

SEQ ID NO: 2807043 - RNA, 20 nt, Human
gaaguucauaccuaaguacu

SEQ ID NO: 2807044 - RNA, 22 nt, Human
gaaguucauaccuaaguacugu

SEQ ID NO: 2807045 - RNA, 23 nt, Human
gaaguucauaccuaaguacugua

SEQ ID NO: 2807046 - RNA, 23 nt, Human
gaaguugacuuauaguacaugau

SEQ ID NO: 2807047 - RNA, 21 nt, Human
gaaguugacuuauaguacaug

SEQ ID NO: 2807048 - RNA, 21 nt, Human
gaauaguuggucaucuagcaa

SEQ ID NO: 2807049 - RNA, 14 nt, Human
gaaguuguuuguca

SEQ ID NO: 2807050 - RNA, 13 nt, Human
gaaguuuaaaaca

SEQ ID NO: 2807051 - RNA, 14 nt, Human
gaaguuuaaaacag

SEQ ID NO: 2807052 - RNA, 19 nt, Human
gaaguuuaaaacaguauuu

SEQ ID NO: 2807053 - RNA, 21 nt, Human
gaaguuuaaaacaguauuuau

SEQ ID NO: 2807054 - RNA, 20 nt, Human
gaaguugcauuccuuugucu

SEQ ID NO: 2807055 - RNA, 18 nt, Human
gaaguugauauagaacag

SEQ ID NO: 2807056 - RNA, 21 nt, Human
gaaguugauauagaacagugc

SEQ ID NO: 2807057 - RNA, 20 nt, Human
gaaguugugccuuuuauagc

SEQ ID NO: 2807058 - RNA, 19 nt, Human
gaaguuguggauuucaguu

SEQ ID NO: 2807059 - RNA, 20 nt, Human
gaaguuguggauuucaguuu

SEQ ID NO: 2807060 - RNA, 17 nt, Human
gaaguugugugacccua

SEQ ID NO: 2807061 - RNA, 19 nt, Human
gaagcuccgcuuucuaccc

SEQ ID NO: 2807062 - RNA, 17 nt, Human
gaagcugagggcaaauc

SEQ ID NO: 2807063 - RNA, 12 nt, Human
gaagcugcagcu

SEQ ID NO: 2807064 - RNA, 15 nt, Human
gaagcugcagcuugg

SEQ ID NO: 2807065 - RNA, 18 nt, Human
gaagcugcagcuugggag

SEQ ID NO: 2807066 - RNA, 22 nt, Human
gaagcugaaaaccuaaguccuu

SEQ ID NO: 2807067 - RNA, 14 nt, Human
gaagcugaaaauau

SEQ ID NO: 2807068 - RNA, 15 nt, Human
gaagcugaaaauaua

SEQ ID NO: 2807069 - RNA, 20 nt, Human
gaagcucugaagucacauca

SEQ ID NO: 2807070 - RNA, 16 nt, Human
gaagcucugaagucac

SEQ ID NO: 2807071 - RNA, 22 nt, Human
gaagcuccgcuuucuacccagc

SEQ ID NO: 2807072 - RNA, 15 nt, Human
gaagcucugaaguca

SEQ ID NO: 2807073 - RNA, 13 nt, Human
gaagcucugaagu

SEQ ID NO: 2807074 - RNA, 21 nt, Human
gaaggcucuucuccccagagu

SEQ ID NO: 2807075 - RNA, 13 nt, Human
gaagggcccagga

SEQ ID NO: 2807076 - RNA, 16 nt, Human
gaaggggacccccgcc

SEQ ID NO: 2807077 - RNA, 22 nt, Human
gaagggccaguccugccuggcc

SEQ ID NO: 2807078 - RNA, 20 nt, Human
gaagggccaguccugccugg

SEQ ID NO: 2807079 - RNA, 19 nt, Human
gaagggccaguccugccug

SEQ ID NO: 2807080 - RNA, 18 nt, Human
gaagggccaguccugccu

SEQ ID NO: 2807081 - RNA, 16 nt, Human
gaagggccaguccugc

SEQ ID NO: 2807082 - RNA, 14 nt, Human
gaagggccaguccu

SEQ ID NO: 2807083 - RNA, 18 nt, Human
gaaggcucuucuccccag

SEQ ID NO: 2807084 - RNA, 12 nt, Human
gaaggccucuug

SEQ ID NO: 2807085 - RNA, 23 nt, Human
gaaggcucuucuccccagaguuc

SEQ ID NO: 2807086 - RNA, 13 nt, Human
gaaggcugccaac

SEQ ID NO: 2807087 - RNA, 16 nt, Human
gaaggcuggcugggca

SEQ ID NO: 2807088 - RNA, 13 nt, Human
gaaggcuggcugg

SEQ ID NO: 2807089 - RNA, 20 nt, Human
gaaggccucccuagccagca

SEQ ID NO: 2807090 - RNA, 15 nt, Human
gacgcgucuccuguu

SEQ ID NO: 2807091 - RNA, 14 nt, Human
gacgcgucuccugu

SEQ ID NO: 2807092 - RNA, 23 nt, Human
gaccugaaauuccaaagucucua

SEQ ID NO: 2807093 - RNA, 17 nt, Human
gaccugaaauuccaaag

SEQ ID NO: 2807094 - RNA, 19 nt, Human
gaccugaaauuccaaaguc

SEQ ID NO: 2807095 - RNA, 15 nt, Human
gaccugaaauuccaa

SEQ ID NO: 2807096 - RNA, 14 nt, Human
gaccucucccaggg

SEQ ID NO: 2807097 - RNA, 12 nt, Human
gaccucucccag

SEQ ID NO: 2807098 - RNA, 23 nt, Human
gaccucuggauuaggucucuguu

SEQ ID NO: 2807099 - RNA, 12 nt, Human
gaccucuugcug

SEQ ID NO: 2807100 - RNA, 13 nt, Human
gaccucuugcugu

SEQ ID NO: 2807101 - RNA, 14 nt, Human
gaccucuugcuguc

SEQ ID NO: 2807102 - RNA, 15 nt, Human
gaccucuugcugucu

SEQ ID NO: 2807103 - RNA, 16 nt, Human
gaccucuugcugucuc

SEQ ID NO: 2807104 - RNA, 17 nt, Human
gaccucuugcugucucu

SEQ ID NO: 2807105 - RNA, 18 nt, Human
gaccucuugcugucucug

SEQ ID NO: 2807106 - RNA, 20 nt, Human
gaccucuugcugucucugcu

SEQ ID NO: 2807107 - RNA, 22 nt, Human
gaccucuugcugucucugcucg

SEQ ID NO: 2807108 - RNA, 23 nt, Human
gaccauccacucuacccucccac

SEQ ID NO: 2807109 - RNA, 21 nt, Human
gaccauccacucuacccuccc

SEQ ID NO: 2807110 - RNA, 13 nt, Human
gaccauccuauuu

SEQ ID NO: 2807111 - RNA, 15 nt, Human
gaccaucugcuuuua

SEQ ID NO: 2807112 - RNA, 17 nt, Human
gaccaucugcuuuuauu

SEQ ID NO: 2807113 - RNA, 18 nt, Human
gaccucuacuuuccaggc

SEQ ID NO: 2807114 - RNA, 21 nt, Human
gaccucuacuuuccaggcuag

SEQ ID NO: 2807115 - RNA, 19 nt, Human
gacucugucucaaaaaaac

SEQ ID NO: 2807116 - RNA, 22 nt, Human
gacucugcccccugcuggcucu

SEQ ID NO: 2807117 - RNA, 19 nt, Human
gacucugcccccugcuggc

SEQ ID NO: 2807118 - RNA, 21 nt, Human
gacucugcccccugcuggcuc

SEQ ID NO: 2807119 - RNA, 18 nt, Human
gacucuguggggccuugg

SEQ ID NO: 2807120 - RNA, 17 nt, Human
gacucuguggggccuug

SEQ ID NO: 2807121 - RNA, 15 nt, Human
gacucuucaaaaacu

SEQ ID NO: 2807122 - RNA, 17 nt, Human
gacucuucaaaaacugu

SEQ ID NO: 2807123 - RNA, 14 nt, Human
gacucuuguuuuca

SEQ ID NO: 2807124 - RNA, 9 nt, Human
gacucuugu

SEQ ID NO: 2807125 - RNA, 22 nt, Human
gacucaccucccccaucucuuc

SEQ ID NO: 2807126 - RNA, 15 nt, Human
gacucaccuccccca

SEQ ID NO: 2807127 - RNA, 12 nt, Human
gacucugccucc

SEQ ID NO: 2807128 - RNA, 10 nt, Human
gacucugccc

SEQ ID NO: 2807129 - RNA, 12 nt, Human
gacucugccccc

SEQ ID NO: 2807130 - RNA, 13 nt, Human
gacucugcccccu

SEQ ID NO: 2807131 - RNA, 14 nt, Human
gacucugcccccug

SEQ ID NO: 2807132 - RNA, 15 nt, Human
gacucugcccccugc

SEQ ID NO: 2807133 - RNA, 16 nt, Human
gacucugcccccugcu

SEQ ID NO: 2807134 - RNA, 17 nt, Human
gacucugcccccugcug

SEQ ID NO: 2807135 - RNA, 18 nt, Human
gacucugcccccugcugg

SEQ ID NO: 2807136 - RNA, 20 nt, Human
gacucugcacaugucuugua

SEQ ID NO: 2807137 - RNA, 19 nt, Human
gacucugcaucccagcacc

SEQ ID NO: 2807138 - RNA, 20 nt, Human
gacucugcaucccagcaccu

SEQ ID NO: 2807139 - RNA, 21 nt, Human
gacucugcaucccagcaccug

SEQ ID NO: 2807140 - RNA, 22 nt, Human
gacucugcaucccagcaccugc

SEQ ID NO: 2807141 - RNA, 17 nt, Human
gacucagaagccucugg

SEQ ID NO: 2807142 - RNA, 19 nt, Human
gacucugcacaugucuugu

SEQ ID NO: 2807143 - RNA, 16 nt, Human
gacucagaagccucug

SEQ ID NO: 2807144 - RNA, 15 nt, Human
gacucagaagccucu

SEQ ID NO: 2807145 - RNA, 13 nt, Human
gacucagaagccu

SEQ ID NO: 2807146 - RNA, 21 nt, Human
gacuguggcacuugccugggu

SEQ ID NO: 2807147 - RNA, 17 nt, Human
gacuguggcacuugccu

SEQ ID NO: 2807148 - RNA, 23 nt, Human
gacuguucaagagcacacuuggc

SEQ ID NO: 2807149 - RNA, 11 nt, Human
gacuguugaug

SEQ ID NO: 2807150 - RNA, 15 nt, Human
gacuguugauguacu

SEQ ID NO: 2807151 - RNA, 22 nt, Human
gacuguuagaaaauggacacug

SEQ ID NO: 2807152 - RNA, 14 nt, Human
gacuguucaagagc

SEQ ID NO: 2807153 - RNA, 18 nt, Human
gacuguucaagagcacac

SEQ ID NO: 2807154 - RNA, 19 nt, Human
gacuguucaagagcacacu

SEQ ID NO: 2807155 - RNA, 18 nt, Human
gacuguacuccucccagg

SEQ ID NO: 2807156 - RNA, 23 nt, Human
gacuguacuccucccaggcgccc

SEQ ID NO: 2807157 - RNA, 18 nt, Human
gacugaagaugcagcuca

SEQ ID NO: 2807158 - RNA, 21 nt, Human
gacugaaugggaucaugaaag

SEQ ID NO: 2807159 - RNA, 19 nt, Human
gacuguaucuguguagacu

SEQ ID NO: 2807160 - RNA, 17 nt, Human
gacuguaucuguguaga

SEQ ID NO: 2807161 - RNA, 16 nt, Human
gacuguaucuguguag

SEQ ID NO: 2807162 - RNA, 15 nt, Human
gacuguaucugugua

SEQ ID NO: 2807163 - RNA, 14 nt, Human
gacuguaucugugu

SEQ ID NO: 2807164 - RNA, 21 nt, Human
gacuuucaaaauuaaaucugu

SEQ ID NO: 2807165 - RNA, 14 nt, Human
gacuuucagguacu

SEQ ID NO: 2807166 - RNA, 17 nt, Human
gacuuucaguaaacaua

SEQ ID NO: 2807167 - RNA, 12 nt, Human
gacuuucaggua

SEQ ID NO: 2807168 - RNA, 13 nt, Human
gacuuuauaagcc

SEQ ID NO: 2807169 - RNA, 21 nt, Human
gacuuuaucuaauaccucugu

SEQ ID NO: 2807170 - RNA, 22 nt, Human
gacuuuaucuaauaccucugug

SEQ ID NO: 2807171 - RNA, 13 nt, Human
gacugugcuacug

SEQ ID NO: 2807172 - RNA, 17 nt, Human
gacuuuaggcuuucagc

SEQ ID NO: 2807173 - RNA, 19 nt, Human
gacuuuagaaagcugacau

SEQ ID NO: 2807174 - RNA, 12 nt, Human
gacuuuaauuua

SEQ ID NO: 2807175 - RNA, 15 nt, Human
gacuuuaauuuaugu

SEQ ID NO: 2807176 - RNA, 21 nt, Human
gacuuuacacucggcuuugga

SEQ ID NO: 2807177 - RNA, 19 nt, Human
gacauuguuggccaaagcc

SEQ ID NO: 2807178 - RNA, 13 nt, Human
gacauuuaauuua

SEQ ID NO: 2807179 - RNA, 14 nt, Human
gacauuuaauuuag

SEQ ID NO: 2807180 - RNA, 17 nt, Human
gacauuucuuuucuuuu

SEQ ID NO: 2807181 - RNA, 19 nt, Human
gacauuucuuuucuuuuua

SEQ ID NO: 2807182 - RNA, 21 nt, Human
gacauuucuuuucuuuuuaca

SEQ ID NO: 2807183 - RNA, 22 nt, Human
gacauuucuuuucuuuuuacau

SEQ ID NO: 2807184 - RNA, 23 nt, Human
gacauuucuuuucuuuuuacaua

SEQ ID NO: 2807185 - RNA, 15 nt, Human
gacauuugccuugcu

SEQ ID NO: 2807186 - RNA, 13 nt, Human
gacagugcacaug

SEQ ID NO: 2807187 - RNA, 15 nt, Human
gacagugcacaugaa

SEQ ID NO: 2807188 - RNA, 16 nt, Human
gacagugcacaugaac

SEQ ID NO: 2807189 - RNA, 13 nt, Human
gacauucaugccu

SEQ ID NO: 2807190 - RNA, 16 nt, Human
gacagugcuucagccu

SEQ ID NO: 2807191 - RNA, 18 nt, Human
gacagaacuugaaugugu

SEQ ID NO: 2807192 - RNA, 15 nt, Human
gacauugcggacagc

SEQ ID NO: 2807193 - RNA, 14 nt, Human
gacauugcggacag

SEQ ID NO: 2807194 - RNA, 19 nt, Human
gacauuguagagcuucugg

SEQ ID NO: 2807195 - RNA, 15 nt, Human
gacauugaggaccuc

SEQ ID NO: 2807196 - RNA, 18 nt, Human
gacauugccaaaaaggau

SEQ ID NO: 2807197 - RNA, 21 nt, Human
gacauucuuguaaggcuuuga

SEQ ID NO: 2807198 - RNA, 24 nt, Human
gacauucuuguaaggcuuugauua

SEQ ID NO: 2807199 - RNA, 16 nt, Human
gacauucaugccuggc

SEQ ID NO: 2807200 - RNA, 18 nt, Human
gacauucaugccuggcuu

SEQ ID NO: 2807201 - RNA, 22 nt, Human
gaccagccuggccaacauggua

SEQ ID NO: 2807202 - RNA, 17 nt, Human
gaccagccugggcagca

SEQ ID NO: 2807203 - RNA, 12 nt, Human
gaccagccuggg

SEQ ID NO: 2807204 - RNA, 14 nt, Human
gaccagggagccuu

SEQ ID NO: 2807205 - RNA, 15 nt, Human
gaccagggagccuuu

SEQ ID NO: 2807206 - RNA, 22 nt, Human
gaccagggagccuuugguucug

SEQ ID NO: 2807207 - RNA, 13 nt, Human
gaccagggccgag

SEQ ID NO: 2807208 - RNA, 15 nt, Human
gaccagggccgagga

SEQ ID NO: 2807209 - RNA, 19 nt, Human
gaccagggccgaggaggug

SEQ ID NO: 2807210 - RNA, 21 nt, Human
gaccagggccgaggaggugcc

SEQ ID NO: 2807211 - RNA, 19 nt, Human
gaccauccacucuacccuc

SEQ ID NO: 2807212 - RNA, 13 nt, Human
gaccauacuaauu

SEQ ID NO: 2807213 - RNA, 16 nt, Human
gacacagcucuucucc

SEQ ID NO: 2807214 - RNA, 14 nt, Human
gacacagcucuucu

SEQ ID NO: 2807215 - RNA, 13 nt, Human
gacacagcucuuc

SEQ ID NO: 2807216 - RNA, 11 nt, Human
gacacagaaaa

SEQ ID NO: 2807217 - RNA, 18 nt, Human
gacacagaaaauguugag

SEQ ID NO: 2807218 - RNA, 16 nt, Human
gacacagaaaauguug

SEQ ID NO: 2807219 - RNA, 23 nt, Human
gacacagcucuucuccaggcugu

SEQ ID NO: 2807220 - RNA, 18 nt, Human
gacacaggaaaccaacac

SEQ ID NO: 2807221 - RNA, 22 nt, Human
gacacagcucuucuccaggcug

SEQ ID NO: 2807222 - RNA, 17 nt, Human
gacacagcucuucucca

SEQ ID NO: 2807223 - RNA, 17 nt, Human
gacacaggaugaaggca

SEQ ID NO: 2807224 - RNA, 20 nt, Human
gacacaggaugaaggcaaug

SEQ ID NO: 2807225 - RNA, 20 nt, Human
gacagaaccccuacaugaaa

SEQ ID NO: 2807226 - RNA, 21 nt, Human
gacagaaaggagaguggccau

SEQ ID NO: 2807227 - RNA, 22 nt, Human
gacagaaaggagaguggccauu

SEQ ID NO: 2807228 - RNA, 15 nt, Human
aaaacuugugcuaua

SEQ ID NO: 2807229 - RNA, 17 nt, Human
aaaacuugugcuauaaa

SEQ ID NO: 2807230 - RNA, 19 nt, Human
aaaacuugugugaaauuuu

SEQ ID NO: 2807231 - RNA, 22 nt, Human
aaaacuugugugaaauuuucuu

SEQ ID NO: 2807232 - RNA, 19 nt, Human
aaaagccugcaauuucaua

SEQ ID NO: 2807233 - RNA, 22 nt, Human
aaaagcggaaaguuagugcuug

SEQ ID NO: 2807234 - RNA, 20 nt, Human
aaaagcgacccauucagaga

SEQ ID NO: 2807235 - RNA, 11 nt, Human
aaaagccuugu

SEQ ID NO: 2807236 - RNA, 13 nt, Human
aaaagccuugugu

SEQ ID NO: 2807237 - RNA, 14 nt, Human
aaaagccuugugua

SEQ ID NO: 2807238 - RNA, 17 nt, Human
aaaagccuuguguauau

SEQ ID NO: 2807239 - RNA, 18 nt, Human
aaaagccuuguguauauu

SEQ ID NO: 2807240 - RNA, 20 nt, Human
aaaagccuuguguauauuug

SEQ ID NO: 2807241 - RNA, 23 nt, Human
aaaagccuuguguauauuuguau

SEQ ID NO: 2807242 - RNA, 21 nt, Human
aaaagcuaguguaccuccucu

SEQ ID NO: 2807243 - RNA, 15 nt, Human
aaaagcuauuagcca

SEQ ID NO: 2807244 - RNA, 17 nt, Human
aaaagcuauuagccagg

SEQ ID NO: 2807245 - RNA, 14 nt, Human
aaaagcucauauuu

SEQ ID NO: 2807246 - RNA, 20 nt, Human
aaaagcuauuagccaggauc

SEQ ID NO: 2807247 - RNA, 21 nt, Human
aaaagcuauuagccaggauca

SEQ ID NO: 2807248 - RNA, 23 nt, Human
gggacugccagucccccugcccc

SEQ ID NO: 2807249 - RNA, 14 nt, Human
aaaagcuuccauga

SEQ ID NO: 2807250 - RNA, 14 nt, Human
aaaagcuucaaauu

SEQ ID NO: 2807251 - RNA, 15 nt, Human
aaaagcuccuggggc

SEQ ID NO: 2807252 - RNA, 12 nt, Human
aaaagcuccugu

SEQ ID NO: 2807253 - RNA, 18 nt, Human
aaaagcucauauuuugua

SEQ ID NO: 2807254 - RNA, 15 nt, Human
aaaagcucauuucau

SEQ ID NO: 2807255 - RNA, 17 nt, Human
aaaagcucauuucaugc

SEQ ID NO: 2807256 - RNA, 22 nt, Human
aaaagcuccaugugccucuuug

SEQ ID NO: 2807257 - RNA, 13 nt, Human
aaaagcuccuguc

SEQ ID NO: 2807258 - RNA, 20 nt, Human
aaaagcucuuacacuacauu

SEQ ID NO: 2807259 - RNA, 13 nt, Human
aaaagcugcucag

SEQ ID NO: 2807260 - RNA, 23 nt, Human
aaaagcugaucauaagugaauuu

SEQ ID NO: 2807261 - RNA, 15 nt, Human
gggacugcugcugcc

SEQ ID NO: 2807262 - RNA, 17 nt, Human
gggacugcugcugccug

SEQ ID NO: 2807263 - RNA, 18 nt, Human
gggacugcugcugccugg

SEQ ID NO: 2807264 - RNA, 19 nt, Human
gggacugcugcugccuggc

SEQ ID NO: 2807265 - RNA, 21 nt, Human
gggacugcugcugccuggcca

SEQ ID NO: 2807266 - RNA, 22 nt, Human
gggacugcugcugccuggccac

SEQ ID NO: 2807267 - RNA, 14 nt, Human
gggacugccucugc

SEQ ID NO: 2807268 - RNA, 15 nt, Human
gggacugccucugcc

SEQ ID NO: 2807269 - RNA, 16 nt, Human
gggacugccucugcca

SEQ ID NO: 2807270 - RNA, 17 nt, Human
gggacugccucugccac

SEQ ID NO: 2807271 - RNA, 20 nt, Human
gggacuggggaugugggagg

SEQ ID NO: 2807272 - RNA, 12 nt, Human
gggaggcagccu

SEQ ID NO: 2807273 - RNA, 16 nt, Human
gggaggcauggcccug

SEQ ID NO: 2807274 - RNA, 11 nt, Human
gggaggcagcc

SEQ ID NO: 2807275 - RNA, 12 nt, Human
gggagagcccag

SEQ ID NO: 2807276 - RNA, 17 nt, Human
gggaggcauggcccugg

SEQ ID NO: 2807277 - RNA, 13 nt, Human
gggagggccuggg

SEQ ID NO: 2807278 - RNA, 18 nt, Human
aaaaauguccugccuuuu

SEQ ID NO: 2807279 - RNA, 12 nt, Human
aaaaaugccuuu

SEQ ID NO: 2807280 - RNA, 18 nt, Human
aaaaaugcccuuaaauca

SEQ ID NO: 2807281 - RNA, 15 nt, Human
aaaaaugccauaaua

SEQ ID NO: 2807282 - RNA, 17 nt, Human
aaaaaugccauaauaca

SEQ ID NO: 2807283 - RNA, 18 nt, Human
aaaaaugccauaauacaa

SEQ ID NO: 2807284 - RNA, 21 nt, Human
aaaaaugccauaauacaaaag

SEQ ID NO: 2807285 - RNA, 22 nt, Human
aaaaaugccauaauacaaaagg

SEQ ID NO: 2807286 - RNA, 21 nt, Human
aaaaaugucuugcuguugaca

SEQ ID NO: 2807287 - RNA, 22 nt, Human
aaaaauguguguauucuuaaaa

SEQ ID NO: 2807288 - RNA, 12 nt, Human
aaaaauguugaa

SEQ ID NO: 2807289 - RNA, 13 nt, Human
aaaaauuaaaaug

SEQ ID NO: 2807290 - RNA, 17 nt, Human
aaaaauuaaaauggaug

SEQ ID NO: 2807291 - RNA, 16 nt, Human
aaaaauguuuuuucau

SEQ ID NO: 2807292 - RNA, 20 nt, Human
aaaaauguuuuuucaugugu

SEQ ID NO: 2807293 - RNA, 11 nt, Human
aaaaauuaaaa

SEQ ID NO: 2807294 - RNA, 16 nt, Human
aaaaaucuucuccaga

SEQ ID NO: 2807295 - RNA, 13 nt, Human
aaaaaucuugugc

SEQ ID NO: 2807296 - RNA, 20 nt, Human
aaaaaucuugugcuagaaua

SEQ ID NO: 2807297 - RNA, 15 nt, Human
aaaaaugauguucau

SEQ ID NO: 2807298 - RNA, 15 nt, Human
aaaaaugaaugucua

SEQ ID NO: 2807299 - RNA, 20 nt, Human
aaaaaugaaugucuaaaauu

SEQ ID NO: 2807300 - RNA, 14 nt, Human
aaaaaugacagacu

SEQ ID NO: 2807301 - RNA, 12 nt, Human
aaaaaugaaaga

SEQ ID NO: 2807302 - RNA, 14 nt, Human
aaaaaugaaagaug

SEQ ID NO: 2807303 - RNA, 17 nt, Human
aaaaaugaaagaugauu

SEQ ID NO: 2807304 - RNA, 22 nt, Human
gggaacagacuggaagcacagc

SEQ ID NO: 2807305 - RNA, 14 nt, Human
gggaacagacugga

SEQ ID NO: 2807306 - RNA, 19 nt, Human
gggaacagacaacagaagu

SEQ ID NO: 2807307 - RNA, 13 nt, Human
gggaacacugccc

SEQ ID NO: 2807308 - RNA, 20 nt, Human
gggaaagggguuggggugac

SEQ ID NO: 2807309 - RNA, 23 nt, Human
gggaaaggaggcaugccucugau

SEQ ID NO: 2807310 - RNA, 20 nt, Human
gggaaagugcauaugaaauc

SEQ ID NO: 2807311 - RNA, 12 nt, Human
aaaaccaaauuc

SEQ ID NO: 2807312 - RNA, 13 nt, Human
aaaaccaaaauga

SEQ ID NO: 2807313 - RNA, 14 nt, Human
aaaaccaaaaugac

SEQ ID NO: 2807314 - RNA, 21 nt, Human
aaaacauuuuuuaauagaaua

SEQ ID NO: 2807315 - RNA, 21 nt, Human
aaaacauuuuuuuuuuaaauc

SEQ ID NO: 2807316 - RNA, 22 nt, Human
aaaaauuaggacagaaauaaua

SEQ ID NO: 2807317 - RNA, 12 nt, Human
aaaaauguuugu

SEQ ID NO: 2807318 - RNA, 14 nt, Human
aaaaauuacuaauu

SEQ ID NO: 2807319 - RNA, 18 nt, Human
aaaaauuacuaauuuuac

SEQ ID NO: 2807320 - RNA, 11 nt, Human
aaaaauuauua

SEQ ID NO: 2807321 - RNA, 19 nt, Human
aaaaauuaucuauagcuaa

SEQ ID NO: 2807322 - RNA, 19 nt, Human
aaaaccaagccguggcuuc

SEQ ID NO: 2807323 - RNA, 21 nt, Human
aaaacuacaaaucaaguauuu

SEQ ID NO: 2807324 - RNA, 18 nt, Human
aaaacuaaaucucuaaua

SEQ ID NO: 2807325 - RNA, 19 nt, Human
aaaacuaaaucucuaauau

SEQ ID NO: 2807326 - RNA, 12 nt, Human
gggcagcugcua

SEQ ID NO: 2807327 - RNA, 16 nt, Human
gggcagccaggcugcc

SEQ ID NO: 2807328 - RNA, 14 nt, Human
gggcagccaggcug

SEQ ID NO: 2807329 - RNA, 17 nt, Human
gggcagccaaacccaug

SEQ ID NO: 2807330 - RNA, 13 nt, Human
gggcagccaggcu

SEQ ID NO: 2807331 - RNA, 20 nt, Human
gggcagcauagcaagacaca

SEQ ID NO: 2807332 - RNA, 23 nt, Human
gggcaggacucagcuccccagag

SEQ ID NO: 2807333 - RNA, 18 nt, Human
gggcaggagggcccuacc

SEQ ID NO: 2807334 - RNA, 22 nt, Human
gggcaggacucagcuccccaga

SEQ ID NO: 2807335 - RNA, 18 nt, Human
gggcaggaaggagagccu

SEQ ID NO: 2807336 - RNA, 16 nt, Human
gggcaggaaggagagc

SEQ ID NO: 2807337 - RNA, 21 nt, Human
gggcaggaaggagagccugcu

SEQ ID NO: 2807338 - RNA, 19 nt, Human
gggcaggaaggagagccug

SEQ ID NO: 2807339 - RNA, 20 nt, Human
aaaaggcugugcugcccuga

SEQ ID NO: 2807340 - RNA, 19 nt, Human
aaaaggcugugcugcccug

SEQ ID NO: 2807341 - RNA, 16 nt, Human
aaaaggcugugcugcc

SEQ ID NO: 2807342 - RNA, 20 nt, Human
aaaaggcuagguacacagcu

SEQ ID NO: 2807343 - RNA, 14 nt, Human
aaaaggcuugaagc

SEQ ID NO: 2807344 - RNA, 19 nt, Human
aaaagggaaguugugccuu

SEQ ID NO: 2807345 - RNA, 20 nt, Human
aaaagggaaguugugccuuu

SEQ ID NO: 2807346 - RNA, 12 nt, Human
aaaagggaagua

SEQ ID NO: 2807347 - RNA, 18 nt, Human
aaaagggaaguaguccuu

SEQ ID NO: 2807348 - RNA, 16 nt, Human
gggauucaggcugcuu

SEQ ID NO: 2807349 - RNA, 15 nt, Human
gggauucaggcugcu

SEQ ID NO: 2807350 - RNA, 14 nt, Human
gggauucaggcugc

SEQ ID NO: 2807351 - RNA, 16 nt, Human
gggagggggagaaaag

SEQ ID NO: 2807352 - RNA, 12 nt, Human
gggaggggaagu

SEQ ID NO: 2807353 - RNA, 18 nt, Human
gggaggggcgcccaccuc

SEQ ID NO: 2807354 - RNA, 15 nt, Human
gggauuuaauuucca

SEQ ID NO: 2807355 - RNA, 20 nt, Human
gggauuuaauuuccaggguu

SEQ ID NO: 2807356 - RNA, 20 nt, Human
gggauuuccagccagggcug

SEQ ID NO: 2807357 - RNA, 13 nt, Human
gggauuucuuagg

SEQ ID NO: 2807358 - RNA, 14 nt, Human
gggauuucuuaggg

SEQ ID NO: 2807359 - RNA, 14 nt, Human
gggauuucuuugcu

SEQ ID NO: 2807360 - RNA, 14 nt, Human
gggcagagccggga

SEQ ID NO: 2807361 - RNA, 13 nt, Human
gggcagagccggg

SEQ ID NO: 2807362 - RNA, 21 nt, Human
gggcagagcccccaggaagcc

SEQ ID NO: 2807363 - RNA, 16 nt, Human
gggcagcaauuuaaau

SEQ ID NO: 2807364 - RNA, 17 nt, Human
gggcagagccgggaagc

SEQ ID NO: 2807365 - RNA, 15 nt, Human
aaaauaaauaaaagc

SEQ ID NO: 2807366 - RNA, 16 nt, Human
aaaauaaauaaaagcc

SEQ ID NO: 2807367 - RNA, 17 nt, Human
aaaauaaauaaaagccu

SEQ ID NO: 2807368 - RNA, 15 nt, Human
aaaauaaauagaaaa

SEQ ID NO: 2807369 - RNA, 20 nt, Human
aaaauaaauagcuuaaaauu

SEQ ID NO: 2807370 - RNA, 12 nt, Human
aaaauaaagaca

SEQ ID NO: 2807371 - RNA, 20 nt, Human
aaaauaaagacaaccauauu

SEQ ID NO: 2807372 - RNA, 22 nt, Human
aaaauaaagacaaccauauuua

SEQ ID NO: 2807373 - RNA, 13 nt, Human
aaaaguaaugccu

SEQ ID NO: 2807374 - RNA, 16 nt, Human
aaaaguaaugccucug

SEQ ID NO: 2807375 - RNA, 13 nt, Human
aaaaguaauguaa

SEQ ID NO: 2807376 - RNA, 21 nt, Human
aaaaguacauauuuauuuucu

SEQ ID NO: 2807377 - RNA, 23 nt, Human
aaaaguaaguaccacucaggcca

SEQ ID NO: 2807378 - RNA, 12 nt, Human
aaaaguaacuug

SEQ ID NO: 2807379 - RNA, 22 nt, Human
aaaaguaaguaccacucaggcc

SEQ ID NO: 2807380 - RNA, 16 nt, Human
aaaauacaaacacaug

SEQ ID NO: 2807381 - RNA, 12 nt, Human
aaaauaaauuua

SEQ ID NO: 2807382 - RNA, 14 nt, Human
aaaauaaauuuaua

SEQ ID NO: 2807383 - RNA, 20 nt, Human
aaaauaaauuuauaugaaaa

SEQ ID NO: 2807384 - RNA, 18 nt, Human
aaaauacaaaaaucagcc

SEQ ID NO: 2807385 - RNA, 16 nt, Human
aaaauacaaaaauuug

SEQ ID NO: 2807386 - RNA, 17 nt, Human
aaaauacaaaaauuugc

SEQ ID NO: 2807387 - RNA, 11 nt, Human
aaaauaaaugg

SEQ ID NO: 2807388 - RNA, 15 nt, Human
aaaauaaauggaaau

SEQ ID NO: 2807389 - RNA, 16 nt, Human
aaaauaccucaggaaa

SEQ ID NO: 2807390 - RNA, 18 nt, Human
aaaauaccucaggaaaga

SEQ ID NO: 2807391 - RNA, 20 nt, Human
aaaauaccucaggaaagaau

SEQ ID NO: 2807392 - RNA, 24 nt, Human
aaaauaccucaggaaagaauagaa

SEQ ID NO: 2807393 - RNA, 14 nt, Human
aaaauagaugucuu

SEQ ID NO: 2807394 - RNA, 17 nt, Human
aaaauagaugucuuuua

SEQ ID NO: 2807395 - RNA, 22 nt, Human
aaaauagcaacacucuauauuu

SEQ ID NO: 2807396 - RNA, 21 nt, Human
aaaauagcaacacucuauauu

SEQ ID NO: 2807397 - RNA, 15 nt, Human
aaaauagcaaugccu

SEQ ID NO: 2807398 - RNA, 13 nt, Human
aaaauagugaauu

SEQ ID NO: 2807399 - RNA, 18 nt, Human
aaaauaggggauauuuaa

SEQ ID NO: 2807400 - RNA, 12 nt, Human
aaaauagcuugu

SEQ ID NO: 2807401 - RNA, 21 nt, Human
aaaauagcuuguauaguguaa

SEQ ID NO: 2807402 - RNA, 13 nt, Human
aaaauagcuugua

SEQ ID NO: 2807403 - RNA, 19 nt, Human
aaaauagcuuguauagugu

SEQ ID NO: 2807404 - RNA, 16 nt, Human
aaaauaguuguccaua

SEQ ID NO: 2807405 - RNA, 23 nt, Human
aaaauaguuaagacaugauuucc

SEQ ID NO: 2807406 - RNA, 15 nt, Human
aaaauauaaacaaag

SEQ ID NO: 2807407 - RNA, 13 nt, Human
aaaauauaaaaua

SEQ ID NO: 2807408 - RNA, 22 nt, Human
aaaauauaaaauaguuguccau

SEQ ID NO: 2807409 - RNA, 16 nt, Human
aaaauauaaacaaaga

SEQ ID NO: 2807410 - RNA, 12 nt, Human
aaaauaguuugu

SEQ ID NO: 2807411 - RNA, 13 nt, Human
aaaauaguuuguu

SEQ ID NO: 2807412 - RNA, 17 nt, Human
aaaauaguuuguuuaau

SEQ ID NO: 2807413 - RNA, 14 nt, Human
aaaauauauuuaau

SEQ ID NO: 2807414 - RNA, 19 nt, Human
aaaauauauauagugcuau

SEQ ID NO: 2807415 - RNA, 20 nt, Human
aaaauauauauagugcuaua

SEQ ID NO: 2807416 - RNA, 14 nt, Human
aaaauauauacuaa

SEQ ID NO: 2807417 - RNA, 12 nt, Human
aaaauauaugua

SEQ ID NO: 2807418 - RNA, 13 nt, Human
aaaauauauguau

SEQ ID NO: 2807419 - RNA, 14 nt, Human
aaaauauauguauu

SEQ ID NO: 2807420 - RNA, 15 nt, Human
aaaauauauguauuu

SEQ ID NO: 2807421 - RNA, 16 nt, Human
aaaauauauguauuuu

SEQ ID NO: 2807422 - RNA, 20 nt, Human
aaaauauggaacuucuaaua

SEQ ID NO: 2807423 - RNA, 21 nt, Human
aaaauauggaacuucuaauau

SEQ ID NO: 2807424 - RNA, 10 nt, Human
aaaauauaua

SEQ ID NO: 2807425 - RNA, 13 nt, Human
aaaauauauacua

SEQ ID NO: 2807426 - RNA, 17 nt, Human
aaaauauauacuaaaca

SEQ ID NO: 2807427 - RNA, 13 nt, Human
aaaauauauauag

SEQ ID NO: 2807428 - RNA, 23 nt, Human
aaaauauauauagaaauauauac

SEQ ID NO: 2807429 - RNA, 13 nt, Human
aaaaaaaaaguuc

SEQ ID NO: 2807430 - RNA, 12 nt, Human
aaaaaaaaaugc

SEQ ID NO: 2807431 - RNA, 13 nt, Human
aaaaaaaaaaaga

SEQ ID NO: 2807432 - RNA, 13 nt, Human
aaaaaaacacaaa

SEQ ID NO: 2807433 - RNA, 12 nt, Human
aaaaaagaggaa

SEQ ID NO: 2807434 - RNA, 15 nt, Human
aaaaaagagaauuag

SEQ ID NO: 2807435 - RNA, 19 nt, Human
aaaaaagauuguauugcug

SEQ ID NO: 2807436 - RNA, 11 nt, Human
aaaaaagcaug

SEQ ID NO: 2807437 - RNA, 10 nt, Human
aaaaaagcuc

SEQ ID NO: 2807438 - RNA, 11 nt, Human
aaaaaagcuca

SEQ ID NO: 2807439 - RNA, 12 nt, Human
aaaaaagcucau

SEQ ID NO: 2807440 - RNA, 14 nt, Human
aaaaaaaagcuuua

SEQ ID NO: 2807441 - RNA, 11 nt, Human
aaaaaaaagcu

SEQ ID NO: 2807442 - RNA, 12 nt, Human
aaaaaaaagcuu

SEQ ID NO: 2807443 - RNA, 13 nt, Human
aaaaaaaaugcca

SEQ ID NO: 2807444 - RNA, 9 nt, Human
aaaaaauag

SEQ ID NO: 2807445 - RNA, 20 nt, Human
aaaaaauagaugucuuuuau

SEQ ID NO: 2807446 - RNA, 20 nt, Human
aaaaaaguuuacaaguguau

SEQ ID NO: 2807447 - RNA, 11 nt, Human
aaaaaagcuuu

SEQ ID NO: 2807448 - RNA, 13 nt, Human
aaaaaagcuuuau

SEQ ID NO: 2807449 - RNA, 19 nt, Human
aaaaaagcuuuaugauuuu

SEQ ID NO: 2807450 - RNA, 11 nt, Human
aaaaaaggaaa

SEQ ID NO: 2807451 - RNA, 16 nt, Human
aaaaaaggcauuguuu

SEQ ID NO: 2807452 - RNA, 16 nt, Human
aaaaaguccaauuuua

SEQ ID NO: 2807453 - RNA, 20 nt, Human
aaaaaguccaauuuuaauuu

SEQ ID NO: 2807454 - RNA, 23 nt, Human
aaaaaguccaauuuuaauuuagu

SEQ ID NO: 2807455 - RNA, 20 nt, Human
aaaaagucagacugcuggga

SEQ ID NO: 2807456 - RNA, 22 nt, Human
aaaaagucuacgcucuccuuuc

SEQ ID NO: 2807457 - RNA, 13 nt, Human
aaaaagugacaca

SEQ ID NO: 2807458 - RNA, 11 nt, Human
aaaaaggguca

SEQ ID NO: 2807459 - RNA, 19 nt, Human
aaaaagggucaaugcuauu

SEQ ID NO: 2807460 - RNA, 21 nt, Human
aaaaagggucaaugcuauuuu

SEQ ID NO: 2807461 - RNA, 23 nt, Human
aaaaagggucaaugcuauuuuug

SEQ ID NO: 2807462 - RNA, 21 nt, Human
aaaaagggauccguacauuca

SEQ ID NO: 2807463 - RNA, 21 nt, Human
aaaaaguaaguaccacucagg

SEQ ID NO: 2807464 - RNA, 9 nt, Human
aaaaagcuc

SEQ ID NO: 2807465 - RNA, 13 nt, Human
aaaaaggaacugc

SEQ ID NO: 2807466 - RNA, 17 nt, Human
aaaaaggaacugcagca

SEQ ID NO: 2807467 - RNA, 13 nt, Human
aaaaagcuucccc

SEQ ID NO: 2807468 - RNA, 12 nt, Human
aaaaagcuuuau

SEQ ID NO: 2807469 - RNA, 19 nt, Human
aaaaagcuuuaugauuuuc

SEQ ID NO: 2807470 - RNA, 23 nt, Human
aaaaagcuuuaugauuuucauaa

SEQ ID NO: 2807471 - RNA, 19 nt, Human
aaaaagcuuccaugauucu

SEQ ID NO: 2807472 - RNA, 14 nt, Human
aaaaagcuuuuucc

SEQ ID NO: 2807473 - RNA, 16 nt, Human
aaaaaggaaaaaaaga

SEQ ID NO: 2807474 - RNA, 17 nt, Human
aaaaaggaaaaaaagac

SEQ ID NO: 2807475 - RNA, 18 nt, Human
aaaaagcucauauuuugu

SEQ ID NO: 2807476 - RNA, 20 nt, Human
aaaaagcuccuguccuccca

SEQ ID NO: 2807477 - RNA, 19 nt, Human
aaaaagcucauauuuugua

SEQ ID NO: 2807478 - RNA, 17 nt, Human
aaaaagcucauuucaug

SEQ ID NO: 2807479 - RNA, 21 nt, Human
aaaaagcucauuucaugcucu

SEQ ID NO: 2807480 - RNA, 20 nt, Human
aaaaagcuccaaaugcagcu

SEQ ID NO: 2807481 - RNA, 19 nt, Human
ggcuuuuuuaaaaaagcaa

SEQ ID NO: 2807482 - RNA, 13 nt, Human
gggaaaagcagcu

SEQ ID NO: 2807483 - RNA, 22 nt, Human
gggaaagacacugccugggcug

SEQ ID NO: 2807484 - RNA, 18 nt, Human
gggaaagacacugccugg

SEQ ID NO: 2807485 - RNA, 17 nt, Human
gggaaagacacugccug

SEQ ID NO: 2807486 - RNA, 13 nt, Human
gggaaagacacug

SEQ ID NO: 2807487 - RNA, 17 nt, Human
gggaaacuugucacuug

SEQ ID NO: 2807488 - RNA, 15 nt, Human
gggaaacacuccuug

SEQ ID NO: 2807489 - RNA, 16 nt, Human
gggaaacacuccuugc

SEQ ID NO: 2807490 - RNA, 20 nt, Human
gggaaaccuagagaagauaa

SEQ ID NO: 2807491 - RNA, 16 nt, Human
gggaaaaaaaucaucu

SEQ ID NO: 2807492 - RNA, 15 nt, Human
gggaaaaaaauguug

SEQ ID NO: 2807493 - RNA, 13 nt, Human
ggcugucaucuga

SEQ ID NO: 2807494 - RNA, 19 nt, Human
ggcuucguuagaccgcucu

SEQ ID NO: 2807495 - RNA, 16 nt, Human
ggcuucaguggcagcu

SEQ ID NO: 2807496 - RNA, 18 nt, Human
ggcuucagucucauauuu

SEQ ID NO: 2807497 - RNA, 15 nt, Human
ggcuucaugccagcu

SEQ ID NO: 2807498 - RNA, 21 nt, Human
ggcuuccagaaaaccccagca

SEQ ID NO: 2807499 - RNA, 18 nt, Human
ggcuucauuagagcaggc

SEQ ID NO: 2807500 - RNA, 16 nt, Human
ggcuucaugccagcua

SEQ ID NO: 2807501 - RNA, 19 nt, Human
ggcuucccaguggcugcug

SEQ ID NO: 2807502 - RNA, 20 nt, Human
ggcuucccaguggcugcugc

SEQ ID NO: 2807503 - RNA, 21 nt, Human
ggcuucccaguggcugcugcc

SEQ ID NO: 2807504 - RNA, 22 nt, Human
ggcuucccaguggcugcugccc

SEQ ID NO: 2807505 - RNA, 23 nt, Human
ggcuuccaucccaaccagugcca

SEQ ID NO: 2807506 - RNA, 17 nt, Human
ggcuucccaguggcugc

SEQ ID NO: 2807507 - RNA, 16 nt, Human
ggcuggugucaccuga

SEQ ID NO: 2807508 - RNA, 13 nt, Human
ggcuggugggagg

SEQ ID NO: 2807509 - RNA, 17 nt, Human
ggcuggugggaggggcg

SEQ ID NO: 2807510 - RNA, 19 nt, Human
ggcuguaucccaugagccu

SEQ ID NO: 2807511 - RNA, 14 nt, Human
ggcugguggcaagu

SEQ ID NO: 2807512 - RNA, 23 nt, Human
aaaaaguguuuauuuuucauauu

SEQ ID NO: 2807513 - RNA, 15 nt, Human
aaaaaguuaaugcuu

SEQ ID NO: 2807514 - RNA, 13 nt, Human
aaaaaguuccuuc

SEQ ID NO: 2807515 - RNA, 13 nt, Human
aaaaaguguuuau

SEQ ID NO: 2807516 - RNA, 12 nt, Human
aaaaaguguuua

SEQ ID NO: 2807517 - RNA, 17 nt, Human
aaaaaguggaauuucuu

SEQ ID NO: 2807518 - RNA, 19 nt, Human
aaaaaguggaauuucuugu

SEQ ID NO: 2807519 - RNA, 15 nt, Human
aaaaaguggggcaga

SEQ ID NO: 2807520 - RNA, 22 nt, Human
aaaaaguggggcagagccuccc

SEQ ID NO: 2807521 - RNA, 14 nt, Human
aaaaagugacacag

SEQ ID NO: 2807522 - RNA, 15 nt, Human
aaaaagugacacagc

SEQ ID NO: 2807523 - RNA, 16 nt, Human
aaaaagugacacagca

SEQ ID NO: 2807524 - RNA, 17 nt, Human
aaaaagugacacagcag

SEQ ID NO: 2807525 - RNA, 19 nt, Human
aaaaagugacacagcagcu

SEQ ID NO: 2807526 - RNA, 20 nt, Human
aaaaagugacacagcagcuu

SEQ ID NO: 2807527 - RNA, 23 nt, Human
aaaaagugacacagcagcuucac

SEQ ID NO: 2807528 - RNA, 23 nt, Human
ggcuguaucccaugagccucagc

SEQ ID NO: 2807529 - RNA, 22 nt, Human
ggcuguaucccaugagccucag

SEQ ID NO: 2807530 - RNA, 20 nt, Human
ggcuguaucccaugagccuc

SEQ ID NO: 2807531 - RNA, 15 nt, Human
ggcuucaguggcagc

SEQ ID NO: 2807532 - RNA, 11 nt, Human
ggcuucagccu

SEQ ID NO: 2807533 - RNA, 13 nt, Human
ggcuucagccuag

SEQ ID NO: 2807534 - RNA, 21 nt, Human
ggcuucagccuaguggcuugu

SEQ ID NO: 2807535 - RNA, 24 nt, Human
ggcuucagccuaguggcuuguccu

SEQ ID NO: 2807536 - RNA, 13 nt, Human
ggcuucagcucca

SEQ ID NO: 2807537 - RNA, 15 nt, Human
ggcuucagcuccagc

SEQ ID NO: 2807538 - RNA, 16 nt, Human
ggcuucagcuccagcc

SEQ ID NO: 2807539 - RNA, 20 nt, Human
ggcuucagcuccagccccuu

SEQ ID NO: 2807540 - RNA, 19 nt, Human
ggcuucaggcaauucuccu

SEQ ID NO: 2807541 - RNA, 16 nt, Human
ggcuucagggcaggug

SEQ ID NO: 2807542 - RNA, 18 nt, Human
ggcuucagggcagguggg

SEQ ID NO: 2807543 - RNA, 15 nt, Human
ggcuggcccugcccu

SEQ ID NO: 2807544 - RNA, 14 nt, Human
ggcuggcccugccc

SEQ ID NO: 2807545 - RNA, 13 nt, Human
ggcuggcccugcc

SEQ ID NO: 2807546 - RNA, 16 nt, Human
ggcuggccccagggca

SEQ ID NO: 2807547 - RNA, 17 nt, Human
ggcuggccccagggcac

SEQ ID NO: 2807548 - RNA, 20 nt, Human
ggcuggccccagggcacccu

SEQ ID NO: 2807549 - RNA, 20 nt, Human
ggcuggcgugcaguggugcg

SEQ ID NO: 2807550 - RNA, 16 nt, Human
ggcuggcgugcagugg

SEQ ID NO: 2807551 - RNA, 14 nt, Human
ggcuggcgugcagu

SEQ ID NO: 2807552 - RNA, 16 nt, Human
ggcuggcccugcccug

SEQ ID NO: 2807553 - RNA, 19 nt, Human
ggcugccccaaccugcuga

SEQ ID NO: 2807554 - RNA, 19 nt, Human
ggcugcccccggcccccug

SEQ ID NO: 2807555 - RNA, 20 nt, Human
ggcugcccccggcccccugg

SEQ ID NO: 2807556 - RNA, 21 nt, Human
ggcugcccccggcccccuggu

SEQ ID NO: 2807557 - RNA, 15 nt, Human
ggcuggauguggugg

SEQ ID NO: 2807558 - RNA, 15 nt, Human
ggcuggaugaaauuu

SEQ ID NO: 2807559 - RNA, 19 nt, Human
ggcuggaugugguggcaua

SEQ ID NO: 2807560 - RNA, 18 nt, Human
ggcuggaugugguggcau

SEQ ID NO: 2807561 - RNA, 19 nt, Human
ggcugggaacucaccuggg

SEQ ID NO: 2807562 - RNA, 14 nt, Human
ggcuggcuuuucug

SEQ ID NO: 2807563 - RNA, 23 nt, Human
ggcuggcuuuucuguuuccugua

SEQ ID NO: 2807564 - RNA, 22 nt, Human
ggcugggaaacacuccuugcau

SEQ ID NO: 2807565 - RNA, 13 nt, Human
ggcuggcugggca

SEQ ID NO: 2807566 - RNA, 15 nt, Human
ggcuggcugcaguga

SEQ ID NO: 2807567 - RNA, 14 nt, Human
ggcuggcugcagug

SEQ ID NO: 2807568 - RNA, 21 nt, Human
ggcucgagcaguccugccuca

SEQ ID NO: 2807569 - RNA, 17 nt, Human
ggcugcagggaguccga

SEQ ID NO: 2807570 - RNA, 22 nt, Human
ggcugcagugacgugcaccugu

SEQ ID NO: 2807571 - RNA, 15 nt, Human
ggcugcagugagcca

SEQ ID NO: 2807572 - RNA, 17 nt, Human
ggcugcaguagccaugu

SEQ ID NO: 2807573 - RNA, 13 nt, Human
ggcugcaguccuc

SEQ ID NO: 2807574 - RNA, 22 nt, Human
ggcugcaguccuccgguugcau

SEQ ID NO: 2807575 - RNA, 13 nt, Human
ggcugccaccaag

SEQ ID NO: 2807576 - RNA, 15 nt, Human
ggcuccgaacacccu

SEQ ID NO: 2807577 - RNA, 21 nt, Human
ggcuccgcccuuaguccccca

SEQ ID NO: 2807578 - RNA, 22 nt, Human
ggcuccgcccuuagucccccaa

SEQ ID NO: 2807579 - RNA, 14 nt, Human
ggcuccucacauag

SEQ ID NO: 2807580 - RNA, 12 nt, Human
ggcuccugccac

SEQ ID NO: 2807581 - RNA, 12 nt, Human
ggcuccugccag

SEQ ID NO: 2807582 - RNA, 13 nt, Human
ggcuccugccacc

SEQ ID NO: 2807583 - RNA, 12 nt, Human
ggcuccugaggg

SEQ ID NO: 2807584 - RNA, 21 nt, Human
ggcuccucuguggugucugcc

SEQ ID NO: 2807585 - RNA, 17 nt, Human
ggcuccucccggugccc

SEQ ID NO: 2807586 - RNA, 12 nt, Human
ggcuccucccag

SEQ ID NO: 2807587 - RNA, 13 nt, Human
ggcuccucccagc

SEQ ID NO: 2807588 - RNA, 17 nt, Human
aaacauaccaacauguu

SEQ ID NO: 2807589 - RNA, 15 nt, Human
aaacauaaugaaaau

SEQ ID NO: 2807590 - RNA, 18 nt, Human
aaacauaaugaaaauauu

SEQ ID NO: 2807591 - RNA, 14 nt, Human
aaacaauaaagaga

SEQ ID NO: 2807592 - RNA, 15 nt, Human
aaacaauaaagagau

SEQ ID NO: 2807593 - RNA, 12 nt, Human
aaacaagaaugu

SEQ ID NO: 2807594 - RNA, 23 nt, Human
aaacaagccaagaaagauguaua

SEQ ID NO: 2807595 - RNA, 19 nt, Human
aaacaaggggcuguuacau

SEQ ID NO: 2807596 - RNA, 20 nt, Human
aaacaaggggcuguuacaua

SEQ ID NO: 2807597 - RNA, 17 nt, Human
aaacacacugaaagcuc

SEQ ID NO: 2807598 - RNA, 17 nt, Human
aaacauaagaucacugc

SEQ ID NO: 2807599 - RNA, 20 nt, Human
aaacacacuguuguuuaguu

SEQ ID NO: 2807600 - RNA, 21 nt, Human
aaacacacgcgcgcacacaca

SEQ ID NO: 2807601 - RNA, 21 nt, Human
aaacacacagauacacacaca

SEQ ID NO: 2807602 - RNA, 13 nt, Human
aaacacaaaugca

SEQ ID NO: 2807603 - RNA, 14 nt, Human
aaacacaaaugcag

SEQ ID NO: 2807604 - RNA, 19 nt, Human
aaacacaaaugcagggauu

SEQ ID NO: 2807605 - RNA, 22 nt, Human
ggggaaagacacugccugggcu

SEQ ID NO: 2807606 - RNA, 23 nt, Human
ggggaaagacacugccugggcug

SEQ ID NO: 2807607 - RNA, 13 nt, Human
ggggaaagcacag

SEQ ID NO: 2807608 - RNA, 23 nt, Human
ggggaacauuucuguaaauacca

SEQ ID NO: 2807609 - RNA, 22 nt, Human
ggggaaccugccaugccaggaa

SEQ ID NO: 2807610 - RNA, 21 nt, Human
ggggaaccugccaugccagga

SEQ ID NO: 2807611 - RNA, 19 nt, Human
aaacaacuucaauauccaa

SEQ ID NO: 2807612 - RNA, 19 nt, Human
aaacaacauuuugagaaca

SEQ ID NO: 2807613 - RNA, 21 nt, Human
aaacaacauuuugagaacaaa

SEQ ID NO: 2807614 - RNA, 22 nt, Human
aaacaacauuuugagaacaaag

SEQ ID NO: 2807615 - RNA, 20 nt, Human
aaacaacagcucgauccaaa

SEQ ID NO: 2807616 - RNA, 22 nt, Human
aaacaacagcucgauccaaauu

SEQ ID NO: 2807617 - RNA, 20 nt, Human
aaacaaaauuuguuugaaau

SEQ ID NO: 2807618 - RNA, 18 nt, Human
aaacaaacaccuucuuau

SEQ ID NO: 2807619 - RNA, 15 nt, Human
aaacaaacauugugu

SEQ ID NO: 2807620 - RNA, 22 nt, Human
aaacaaacauuguguugacauu

SEQ ID NO: 2807621 - RNA, 13 nt, Human
aaacaaaccagaa

SEQ ID NO: 2807622 - RNA, 23 nt, Human
aaacaaacuuuucaaggcuuaua

SEQ ID NO: 2807623 - RNA, 16 nt, Human
aaacaaaacaaaacaa

SEQ ID NO: 2807624 - RNA, 15 nt, Human
aaacaaaacaaaacu

SEQ ID NO: 2807625 - RNA, 16 nt, Human
aaacaaaacaaaacua

SEQ ID NO: 2807626 - RNA, 17 nt, Human
aaacaaaacaaaacuau

SEQ ID NO: 2807627 - RNA, 12 nt, Human
aaacaaaauaga

SEQ ID NO: 2807628 - RNA, 21 nt, Human
aaacaaaaccccuaagagacu

SEQ ID NO: 2807629 - RNA, 12 nt, Human
aaacaaaacuau

SEQ ID NO: 2807630 - RNA, 18 nt, Human
aaacaaaacuauacuuga

SEQ ID NO: 2807631 - RNA, 20 nt, Human
aaacaaaacuauacuugaac

SEQ ID NO: 2807632 - RNA, 16 nt, Human
aaaauugucuucaugu

SEQ ID NO: 2807633 - RNA, 23 nt, Human
aaaauguaagauuauagauucua

SEQ ID NO: 2807634 - RNA, 14 nt, Human
aaaauggaauaaaa

SEQ ID NO: 2807635 - RNA, 18 nt, Human
aaaauauauaccccccca

SEQ ID NO: 2807636 - RNA, 20 nt, Human
aaaauggaagccaacacauc

SEQ ID NO: 2807637 - RNA, 16 nt, Human
aaaauggagguggaaa

SEQ ID NO: 2807638 - RNA, 14 nt, Human
aaaauggcagugau

SEQ ID NO: 2807639 - RNA, 20 nt, Human
aaaauggcagugaugaauuu

SEQ ID NO: 2807640 - RNA, 20 nt, Human
aaaauggauauuauuagaaa

SEQ ID NO: 2807641 - RNA, 21 nt, Human
aaaauggauauuauuagaaau

SEQ ID NO: 2807642 - RNA, 22 nt, Human
aaaauggauauuauuagaaauu

SEQ ID NO: 2807643 - RNA, 21 nt, Human
aaaauggaugccuugaauaau

SEQ ID NO: 2807644 - RNA, 23 nt, Human
aaaauggaugccuugaauaauaa

SEQ ID NO: 2807645 - RNA, 12 nt, Human
aaaauguauaua

SEQ ID NO: 2807646 - RNA, 14 nt, Human
aaaauguauauauu

SEQ ID NO: 2807647 - RNA, 16 nt, Human
aaaauguauauauuua

SEQ ID NO: 2807648 - RNA, 10 nt, Human
aaaauguacu

SEQ ID NO: 2807649 - RNA, 18 nt, Human
aaaauguacugagauuuu

SEQ ID NO: 2807650 - RNA, 23 nt, Human
aaaauggacaugguggcuuuguu

SEQ ID NO: 2807651 - RNA, 15 nt, Human
aaaauauuauguguu

SEQ ID NO: 2807652 - RNA, 14 nt, Human
aaaauauuaugugu

SEQ ID NO: 2807653 - RNA, 22 nt, Human
aaaauauuacucaguuuauguu

SEQ ID NO: 2807654 - RNA, 13 nt, Human
aaaauaugucucg

SEQ ID NO: 2807655 - RNA, 23 nt, Human
aaaauaugucucgcuagugaugu

SEQ ID NO: 2807656 - RNA, 21 nt, Human
aaaauauuauguguuuccaua

SEQ ID NO: 2807657 - RNA, 11 nt, Human
gggcuggaaca

SEQ ID NO: 2807658 - RNA, 23 nt, Human
gggcuggaacagauucacacugu

SEQ ID NO: 2807659 - RNA, 17 nt, Human
gggcuggccaguuggaa

SEQ ID NO: 2807660 - RNA, 16 nt, Human
aaaccaagcaucaggg

SEQ ID NO: 2807661 - RNA, 14 nt, Human
aaaccacagcugcu

SEQ ID NO: 2807662 - RNA, 12 nt, Human
aaacgcugccug

SEQ ID NO: 2807663 - RNA, 16 nt, Human
aaacgcugccugccca

SEQ ID NO: 2807664 - RNA, 13 nt, Human
aaacgcugucaaa

SEQ ID NO: 2807665 - RNA, 18 nt, Human
aaacgcugucaaaaguug

SEQ ID NO: 2807666 - RNA, 22 nt, Human
aaacgcugucaaaaguuggacu

SEQ ID NO: 2807667 - RNA, 14 nt, Human
aaacgcugccugcc

SEQ ID NO: 2807668 - RNA, 16 nt, Human
aaacgcuaccucucug

SEQ ID NO: 2807669 - RNA, 18 nt, Human
aaacgcuaccucucuguc

SEQ ID NO: 2807670 - RNA, 21 nt, Human
aaacgcuaccucucugucccu

SEQ ID NO: 2807671 - RNA, 23 nt, Human
aaacggccucacuaggcuucugg

SEQ ID NO: 2807672 - RNA, 12 nt, Human
aaacgugaaaau

SEQ ID NO: 2807673 - RNA, 18 nt, Human
aaacuaaaucucuaauau

SEQ ID NO: 2807674 - RNA, 13 nt, Human
aaacuaaggugcu

SEQ ID NO: 2807675 - RNA, 15 nt, Human
aaacuaaggugcuaa

SEQ ID NO: 2807676 - RNA, 16 nt, Human
aaacuaaggugcuaaa

SEQ ID NO: 2807677 - RNA, 22 nt, Human
aaacuacacaucccuaaugugu

SEQ ID NO: 2807678 - RNA, 18 nt, Human
aaacuacagaccugcuuu

SEQ ID NO: 2807679 - RNA, 20 nt, Human
aaacuaaugguccacaccca

SEQ ID NO: 2807680 - RNA, 20 nt, Human
aaacuaccuaacauuauuua

SEQ ID NO: 2807681 - RNA, 12 nt, Human
aaacuacucuuu

SEQ ID NO: 2807682 - RNA, 13 nt, Human
aaacuacucuuug

SEQ ID NO: 2807683 - RNA, 14 nt, Human
aaacuacucuuuga

SEQ ID NO: 2807684 - RNA, 17 nt, Human
aaacuacucuuugauuu

SEQ ID NO: 2807685 - RNA, 20 nt, Human
aaacuacuugauuuuauugu

SEQ ID NO: 2807686 - RNA, 12 nt, Human
aaacuagaugac

SEQ ID NO: 2807687 - RNA, 13 nt, Human
aaacuagaugacc

SEQ ID NO: 2807688 - RNA, 15 nt, Human
aaacuagaugaccuc

SEQ ID NO: 2807689 - RNA, 16 nt, Human
aaacuagaugaccuca

SEQ ID NO: 2807690 - RNA, 17 nt, Human
aaacuagaugaccucau

SEQ ID NO: 2807691 - RNA, 20 nt, Human
aaacuagaugaccucauuaa

SEQ ID NO: 2807692 - RNA, 22 nt, Human
aaacuagaugaccucauuaacc

SEQ ID NO: 2807693 - RNA, 15 nt, Human
aaacuccaccuuccc

SEQ ID NO: 2807694 - RNA, 16 nt, Human
aaacuccgcccccagc

SEQ ID NO: 2807695 - RNA, 17 nt, Human
aaacuccggauugcguu

SEQ ID NO: 2807696 - RNA, 23 nt, Human
aaacucccacuugucaugugaca

SEQ ID NO: 2807697 - RNA, 23 nt, Human
aaacucccauuuacgugucugaa

SEQ ID NO: 2807698 - RNA, 11 nt, Human
aaacuccugac

SEQ ID NO: 2807699 - RNA, 11 nt, Human
aaacugccccc

SEQ ID NO: 2807700 - RNA, 12 nt, Human
aaacugcccccu

SEQ ID NO: 2807701 - RNA, 11 nt, Human
aaacuggaguc

SEQ ID NO: 2807702 - RNA, 15 nt, Human
aaacuggagucugga

SEQ ID NO: 2807703 - RNA, 20 nt, Human
aaacugcccccucugcccug

SEQ ID NO: 2807704 - RNA, 19 nt, Human
aaacugcccccucugcccu

SEQ ID NO: 2807705 - RNA, 17 nt, Human
aaacugcccccucugcc

SEQ ID NO: 2807706 - RNA, 13 nt, Human
aaacugcccccuc

SEQ ID NO: 2807707 - RNA, 17 nt, Human
aaacuggggccuccaga

SEQ ID NO: 2807708 - RNA, 18 nt, Human
aaacuggggccuccagaa

SEQ ID NO: 2807709 - RNA, 15 nt, Human
aaacuggccccggau

SEQ ID NO: 2807710 - RNA, 15 nt, Human
aaacuggccugacuu

SEQ ID NO: 2807711 - RNA, 20 nt, Human
aaacuggggccuccagaacu

SEQ ID NO: 2807712 - RNA, 14 nt, Human
aaacuguaaaaaau

SEQ ID NO: 2807713 - RNA, 21 nt, Human
aaacuguaaaaaaugugugua

SEQ ID NO: 2807714 - RNA, 20 nt, Human
ggguagcugccacuugaaca

SEQ ID NO: 2807715 - RNA, 15 nt, Human
ggguagggaauaaaa

SEQ ID NO: 2807716 - RNA, 12 nt, Human
ggguagugagca

SEQ ID NO: 2807717 - RNA, 20 nt, Human
ggguaucaggugcugccauc

SEQ ID NO: 2807718 - RNA, 16 nt, Human
ggguauaucugggcug

SEQ ID NO: 2807719 - RNA, 23 nt, Human
gggucacugaggccugagaccca

SEQ ID NO: 2807720 - RNA, 20 nt, Human
gggucagaggaccuguauuu

SEQ ID NO: 2807721 - RNA, 19 nt, Human
ggggucucuuuuguaaauu

SEQ ID NO: 2807722 - RNA, 23 nt, Human
ggggucugggaggaauggacaga

SEQ ID NO: 2807723 - RNA, 19 nt, Human
ggggcgcccaccuccccac

SEQ ID NO: 2807724 - RNA, 21 nt, Human
ggggcgaucgcggcggagcug

SEQ ID NO: 2807725 - RNA, 14 nt, Human
ggggcgcccaccuc

SEQ ID NO: 2807726 - RNA, 22 nt, Human
ggggcgccgcaaaccacacugg

SEQ ID NO: 2807727 - RNA, 22 nt, Human
gggguccuucaaguuagcucag

SEQ ID NO: 2807728 - RNA, 12 nt, Human
ggggccugugga

SEQ ID NO: 2807729 - RNA, 13 nt, Human
ggggcgaggcagg

SEQ ID NO: 2807730 - RNA, 14 nt, Human
ggggcgaggcaggc

SEQ ID NO: 2807731 - RNA, 12 nt, Human
ggggcccugguc

SEQ ID NO: 2807732 - RNA, 17 nt, Human
ggggaagaagcagagag

SEQ ID NO: 2807733 - RNA, 18 nt, Human
ggggaagaagcagagaga

SEQ ID NO: 2807734 - RNA, 23 nt, Human
gggucucacuauguugcccaggc

SEQ ID NO: 2807735 - RNA, 15 nt, Human
gggucuauuccagcu

SEQ ID NO: 2807736 - RNA, 17 nt, Human
gggucuauuccagcuca

SEQ ID NO: 2807737 - RNA, 22 nt, Human
gggucguuugcuuuucaggguu

SEQ ID NO: 2807738 - RNA, 22 nt, Human
gggucucacuauguugcccagg

SEQ ID NO: 2807739 - RNA, 15 nt, Human
aaaccaaaaacugaa

SEQ ID NO: 2807740 - RNA, 13 nt, Human
aaaccaaaaugac

SEQ ID NO: 2807741 - RNA, 17 nt, Human
aaaccaaaaugacaucu

SEQ ID NO: 2807742 - RNA, 18 nt, Human
aaaccaaaaugacaucuu

SEQ ID NO: 2807743 - RNA, 19 nt, Human
aaaccaaaaugacaucuuu

SEQ ID NO: 2807744 - RNA, 20 nt, Human
aaaccaaaaugacaucuuuu

SEQ ID NO: 2807745 - RNA, 22 nt, Human
aaaccaaaaugacaucuuuuua

SEQ ID NO: 2807746 - RNA, 23 nt, Human
aaaccaaaaugacaucuuuuuaa

SEQ ID NO: 2807747 - RNA, 14 nt, Human
aaaccaaaaugaua

SEQ ID NO: 2807748 - RNA, 13 nt, Human
aaaccaaaggaca

SEQ ID NO: 2807749 - RNA, 17 nt, Human
aaaccaaaggacauuau

SEQ ID NO: 2807750 - RNA, 23 nt, Human
aaaccaaaggacauuaugugugc

SEQ ID NO: 2807751 - RNA, 14 nt, Human
aaaccaagccgugg

SEQ ID NO: 2807752 - RNA, 16 nt, Human
aaaccaagagauugcu

SEQ ID NO: 2807753 - RNA, 17 nt, Human
aaaccaagagauugcua

SEQ ID NO: 2807754 - RNA, 18 nt, Human
aaaccaagagauugcuaa

SEQ ID NO: 2807755 - RNA, 19 nt, Human
aaaccaagagauugcuaau

SEQ ID NO: 2807756 - RNA, 20 nt, Human
aaaccaagagauugcuaauu

SEQ ID NO: 2807757 - RNA, 23 nt, Human
aaaccaaauucagggacaaaugg

SEQ ID NO: 2807758 - RNA, 19 nt, Human
aaacauugacgauuccuuc

SEQ ID NO: 2807759 - RNA, 24 nt, Human
aaacauugacgauuccuucucuga

SEQ ID NO: 2807760 - RNA, 17 nt, Human
aaacauugccuuugaau

SEQ ID NO: 2807761 - RNA, 18 nt, Human
aaacauugccuuugaaug

SEQ ID NO: 2807762 - RNA, 19 nt, Human
aaacauugccuuugaaugu

SEQ ID NO: 2807763 - RNA, 15 nt, Human
gggucaggcagccag

SEQ ID NO: 2807764 - RNA, 17 nt, Human
aaacauuaaaaauggaa

SEQ ID NO: 2807765 - RNA, 15 nt, Human
aaacauuaaaugucu

SEQ ID NO: 2807766 - RNA, 16 nt, Human
aaacauuaaaugucuu

SEQ ID NO: 2807767 - RNA, 20 nt, Human
aaacauuaaaugucuuauau

SEQ ID NO: 2807768 - RNA, 15 nt, Human
aaacauuggauuauc

SEQ ID NO: 2807769 - RNA, 11 nt, Human
aaacauuuaua

SEQ ID NO: 2807770 - RNA, 17 nt, Human
aaacauuguguugacau

SEQ ID NO: 2807771 - RNA, 19 nt, Human
aaacauuguguugacauua

SEQ ID NO: 2807772 - RNA, 17 nt, Human
ggucuguucuguuucaa

SEQ ID NO: 2807773 - RNA, 22 nt, Human
ggucuugaacuccuggccucaa

SEQ ID NO: 2807774 - RNA, 21 nt, Human
ggucuugaacuccuggccuca

SEQ ID NO: 2807775 - RNA, 21 nt, Human
aaagauuuucagaaaauauua

SEQ ID NO: 2807776 - RNA, 19 nt, Human
aaagauuuuuuuuaaucua

SEQ ID NO: 2807777 - RNA, 16 nt, Human
ggucuggacugacagc

SEQ ID NO: 2807778 - RNA, 19 nt, Human
ggucuggacugacagcaug

SEQ ID NO: 2807779 - RNA, 12 nt, Human
aaagcaaaaaug

SEQ ID NO: 2807780 - RNA, 13 nt, Human
aaagcaaaaaugc

SEQ ID NO: 2807781 - RNA, 14 nt, Human
aaagcaaaaaugcu

SEQ ID NO: 2807782 - RNA, 15 nt, Human
aaagcaaaaaugcua

SEQ ID NO: 2807783 - RNA, 16 nt, Human
aaagcaaaaaugcuaa

SEQ ID NO: 2807784 - RNA, 17 nt, Human
aaagcaaaaaugcuaau

SEQ ID NO: 2807785 - RNA, 19 nt, Human
ggucuggccguacuuguga

SEQ ID NO: 2807786 - RNA, 13 nt, Human
aaagauguauaua

SEQ ID NO: 2807787 - RNA, 21 nt, Human
ggucugggaggaauggacaga

SEQ ID NO: 2807788 - RNA, 22 nt, Human
ggucugggcggcgggcggcugg

SEQ ID NO: 2807789 - RNA, 13 nt, Human
ggugcagaggaag

SEQ ID NO: 2807790 - RNA, 15 nt, Human
ggugcagacagaagu

SEQ ID NO: 2807791 - RNA, 23 nt, Human
ggugcagacagaagucuccucaa

SEQ ID NO: 2807792 - RNA, 15 nt, Human
ggugcacuuuguaaa

SEQ ID NO: 2807793 - RNA, 16 nt, Human
ggugcacuuuguaaau

SEQ ID NO: 2807794 - RNA, 18 nt, Human
ggugauuggaccaggcca

SEQ ID NO: 2807795 - RNA, 14 nt, Human
ggugauucaccaaa

SEQ ID NO: 2807796 - RNA, 18 nt, Human
ggugauguagcccauccu

SEQ ID NO: 2807797 - RNA, 13 nt, Human
ggucuugaucucc

SEQ ID NO: 2807798 - RNA, 13 nt, Human
ggucuugaagucc

SEQ ID NO: 2807799 - RNA, 22 nt, Human
ggucuugaaguccuggcuucag

SEQ ID NO: 2807800 - RNA, 23 nt, Human
ggucuuuaaaucauuuuaggaaa

SEQ ID NO: 2807801 - RNA, 12 nt, Human
ggucuuuguaag

SEQ ID NO: 2807802 - RNA, 13 nt, Human
ggucuuuguaaga

SEQ ID NO: 2807803 - RNA, 14 nt, Human
ggucuuuguaagaa

SEQ ID NO: 2807804 - RNA, 15 nt, Human
ggucuuuguaagaac

SEQ ID NO: 2807805 - RNA, 14 nt, Human
ggucuuuguaagag

SEQ ID NO: 2807806 - RNA, 15 nt, Human
ggucuuuguaagagu

SEQ ID NO: 2807807 - RNA, 20 nt, Human
ggucuuuguaagaguguaga

SEQ ID NO: 2807808 - RNA, 14 nt, Human
ggucuuuguaucuu

SEQ ID NO: 2807809 - RNA, 15 nt, Human
ggucuuuuuaaacca

SEQ ID NO: 2807810 - RNA, 19 nt, Human
ggucuuuguaagaguguag

SEQ ID NO: 2807811 - RNA, 17 nt, Human
ggucuuuuuaugcauuu

SEQ ID NO: 2807812 - RNA, 17 nt, Human
ggucuuuuuguaaguga

SEQ ID NO: 2807813 - RNA, 18 nt, Human
ggugaaaauuaggguugg

SEQ ID NO: 2807814 - RNA, 21 nt, Human
ggugauccacucgccuucauc

SEQ ID NO: 2807815 - RNA, 19 nt, Human
aaaggacagaguaugaaca

SEQ ID NO: 2807816 - RNA, 14 nt, Human
aaaggacaucagca

SEQ ID NO: 2807817 - RNA, 15 nt, Human
aaaggacaucagcaa

SEQ ID NO: 2807818 - RNA, 16 nt, Human
aaaggacaucagcaaa

SEQ ID NO: 2807819 - RNA, 14 nt, Human
aaaggacauuaugu

SEQ ID NO: 2807820 - RNA, 15 nt, Human
aaaggacauuaugug

SEQ ID NO: 2807821 - RNA, 18 nt, Human
aaaggacauuaugugugc

SEQ ID NO: 2807822 - RNA, 15 nt, Human
aaaggaaaagaaaaa

SEQ ID NO: 2807823 - RNA, 16 nt, Human
aaaggaaaagaaaaaa

SEQ ID NO: 2807824 - RNA, 17 nt, Human
aaaggaaaagaaaaaaa

SEQ ID NO: 2807825 - RNA, 17 nt, Human
aaaggaagugcccccuc

SEQ ID NO: 2807826 - RNA, 18 nt, Human
aaaggaagugcccccucc

SEQ ID NO: 2807827 - RNA, 21 nt, Human
aaaggaauccacucccaggca

SEQ ID NO: 2807828 - RNA, 14 nt, Human
aaagcuucagggaa

SEQ ID NO: 2807829 - RNA, 11 nt, Human
aaagcuucccc

SEQ ID NO: 2807830 - RNA, 20 nt, Human
aaagcuuccaugauucuauu

SEQ ID NO: 2807831 - RNA, 18 nt, Human
aaagcuuccaugauucua

SEQ ID NO: 2807832 - RNA, 17 nt, Human
aaagcuuccaugauucu

SEQ ID NO: 2807833 - RNA, 20 nt, Human
aaagcuaguguaccuccucu

SEQ ID NO: 2807834 - RNA, 22 nt, Human
aaagcuaguguaccuccucuca

SEQ ID NO: 2807835 - RNA, 23 nt, Human
aaagcuaguguaccuccucucag

SEQ ID NO: 2807836 - RNA, 16 nt, Human
aaagcuaacccagguc

SEQ ID NO: 2807837 - RNA, 14 nt, Human
aaagcuaaguauag

SEQ ID NO: 2807838 - RNA, 15 nt, Human
aaagcuauuagccag

SEQ ID NO: 2807839 - RNA, 17 nt, Human
aaagcuauuagccagga

SEQ ID NO: 2807840 - RNA, 18 nt, Human
aaagcuauuagccaggau

SEQ ID NO: 2807841 - RNA, 19 nt, Human
aaagcuauuagccaggauc

SEQ ID NO: 2807842 - RNA, 20 nt, Human
aaagcuauuagccaggauca

SEQ ID NO: 2807843 - RNA, 22 nt, Human
aaagcuauuagccaggaucaug

SEQ ID NO: 2807844 - RNA, 23 nt, Human
aaagcuauuagccaggaucaugg

SEQ ID NO: 2807845 - RNA, 12 nt, Human
aaagcuucuuaa

SEQ ID NO: 2807846 - RNA, 17 nt, Human
aaagcuucuuaauuaau

SEQ ID NO: 2807847 - RNA, 20 nt, Human
aaagcuucuuaauuaauuug

SEQ ID NO: 2807848 - RNA, 23 nt, Human
aaagcuucuuaauuaauuugauu

SEQ ID NO: 2807849 - RNA, 14 nt, Human
aaaggaaaaagcuc

SEQ ID NO: 2807850 - RNA, 15 nt, Human
aaaggaaaaagcucc

SEQ ID NO: 2807851 - RNA, 17 nt, Human
aaaggaaaaagcuccau

SEQ ID NO: 2807852 - RNA, 15 nt, Human
aaaggaaaaccugaa

SEQ ID NO: 2807853 - RNA, 18 nt, Human
aaaggaaaaccugaagac

SEQ ID NO: 2807854 - RNA, 12 nt, Human
aaaggaaaagaa

SEQ ID NO: 2807855 - RNA, 13 nt, Human
aaaggaaaagaaa

SEQ ID NO: 2807856 - RNA, 16 nt, Human
aaagcuuuuuccuccu

SEQ ID NO: 2807857 - RNA, 17 nt, Human
aaagcuuuuuccuccug

SEQ ID NO: 2807858 - RNA, 11 nt, Human
aaaggaaaaaa

SEQ ID NO: 2807859 - RNA, 12 nt, Human
aaaggaaaaaaa

SEQ ID NO: 2807860 - RNA, 14 nt, Human
aaaggaaaaaaaga

SEQ ID NO: 2807861 - RNA, 15 nt, Human
aaaggaaaaaaagac

SEQ ID NO: 2807862 - RNA, 16 nt, Human
aaaggaaaaaaagacu

SEQ ID NO: 2807863 - RNA, 18 nt, Human
aaagcguuggauguagca

SEQ ID NO: 2807864 - RNA, 18 nt, Human
aaagcuaggccuggccag

SEQ ID NO: 2807865 - RNA, 17 nt, Human
aaagcuaggccuggcca

SEQ ID NO: 2807866 - RNA, 14 nt, Human
aaagcauaaaaaca

SEQ ID NO: 2807867 - RNA, 16 nt, Human
aaagcauaaaaacauu

SEQ ID NO: 2807868 - RNA, 19 nt, Human
aaagcggacaucagcuggu

SEQ ID NO: 2807869 - RNA, 16 nt, Human
aaagcacaguuugaac

SEQ ID NO: 2807870 - RNA, 17 nt, Human
aaagcacaguuugaaca

SEQ ID NO: 2807871 - RNA, 22 nt, Human
aaagcacaggugggcuucccag

SEQ ID NO: 2807872 - RNA, 14 nt, Human
aaagcacaguguua

SEQ ID NO: 2807873 - RNA, 20 nt, Human
aaagcacaguguuaaaugaa

SEQ ID NO: 2807874 - RNA, 21 nt, Human
aaagcacaguguuaaaugaaa

SEQ ID NO: 2807875 - RNA, 15 nt, Human
aaagcacaguuugaa

SEQ ID NO: 2807876 - RNA, 21 nt, Human
ggugcccacaccggggacagg

SEQ ID NO: 2807877 - RNA, 20 nt, Human
aaagcacacucauccccuca

SEQ ID NO: 2807878 - RNA, 15 nt, Human
aaagcacaggagaca

SEQ ID NO: 2807879 - RNA, 19 nt, Human
aaagcacaggagacacugu

SEQ ID NO: 2807880 - RNA, 19 nt, Human
ggugcccagaacuucccug

SEQ ID NO: 2807881 - RNA, 13 nt, Human
aaacuuuuuuuca

SEQ ID NO: 2807882 - RNA, 14 nt, Human
aaacuuuuuuucaa

SEQ ID NO: 2807883 - RNA, 15 nt, Human
aaacuuuuuuucaau

SEQ ID NO: 2807884 - RNA, 16 nt, Human
aaacuuuuuuucaaug

SEQ ID NO: 2807885 - RNA, 17 nt, Human
aaacuuuuuuucaaugu

SEQ ID NO: 2807886 - RNA, 18 nt, Human
aaacuuuuuuucaaugug

SEQ ID NO: 2807887 - RNA, 20 nt, Human
aaacuuuacccaaaaacuaa

SEQ ID NO: 2807888 - RNA, 13 nt, Human
aaacuuuucugcu

SEQ ID NO: 2807889 - RNA, 16 nt, Human
aaacuuuucugcugau

SEQ ID NO: 2807890 - RNA, 24 nt, Human
aaacuuuuguaaagaaauuuacua

SEQ ID NO: 2807891 - RNA, 19 nt, Human
aaacuuguuugcugugaac

SEQ ID NO: 2807892 - RNA, 20 nt, Human
aaacuuguuugcugugaaca

SEQ ID NO: 2807893 - RNA, 12 nt, Human
aaacuuuaaaaa

SEQ ID NO: 2807894 - RNA, 16 nt, Human
aaacuuuaaaaaauau

SEQ ID NO: 2807895 - RNA, 20 nt, Human
aaacuuuaaaaaauauuuau

SEQ ID NO: 2807896 - RNA, 21 nt, Human
aaacuuuaaaaaauauuuauu

SEQ ID NO: 2807897 - RNA, 22 nt, Human
aaacuuuaaaaaauauuuauua

SEQ ID NO: 2807898 - RNA, 14 nt, Human
aaacuuguuauugu

SEQ ID NO: 2807899 - RNA, 16 nt, Human
aaacuuguuauuguga

SEQ ID NO: 2807900 - RNA, 17 nt, Human
aaacuuguuauugugaa

SEQ ID NO: 2807901 - RNA, 18 nt, Human
aaacuuguuauugugaau

SEQ ID NO: 2807902 - RNA, 19 nt, Human
aaacuuguuauugugaaug

SEQ ID NO: 2807903 - RNA, 21 nt, Human
aaacuuguuauugugaaugau

SEQ ID NO: 2807904 - RNA, 22 nt, Human
aaacuuguuauugugaaugauu

SEQ ID NO: 2807905 - RNA, 18 nt, Human
aaacuuguuacuaaagaa

SEQ ID NO: 2807906 - RNA, 22 nt, Human
gguccacccaggagccccgagg

SEQ ID NO: 2807907 - RNA, 20 nt, Human
gguccacccaggagccccga

SEQ ID NO: 2807908 - RNA, 14 nt, Human
gguauuccugccuc

SEQ ID NO: 2807909 - RNA, 20 nt, Human
gguauuacacuguauuugua

SEQ ID NO: 2807910 - RNA, 19 nt, Human
gguccacccaggagccccg

SEQ ID NO: 2807911 - RNA, 15 nt, Human
gguccaacugcaacu

SEQ ID NO: 2807912 - RNA, 16 nt, Human
gguccaacugcaacuc

SEQ ID NO: 2807913 - RNA, 14 nt, Human
ggucauuucuucag

SEQ ID NO: 2807914 - RNA, 20 nt, Human
ggucauuucuucagucagaa

SEQ ID NO: 2807915 - RNA, 14 nt, Human
ggucauccugcccc

SEQ ID NO: 2807916 - RNA, 18 nt, Human
gguauugguggcuuuccu

SEQ ID NO: 2807917 - RNA, 15 nt, Human
ggucauuuaugaaaa

SEQ ID NO: 2807918 - RNA, 13 nt, Human
ggucauggccaca

SEQ ID NO: 2807919 - RNA, 15 nt, Human
ggucauggccacacu

SEQ ID NO: 2807920 - RNA, 17 nt, Human
ggucauggccacacugu

SEQ ID NO: 2807921 - RNA, 18 nt, Human
ggucaugugggucuucca

SEQ ID NO: 2807922 - RNA, 14 nt, Human
ggucauguuugcag

SEQ ID NO: 2807923 - RNA, 19 nt, Human
ggucauguuugcaggggug

SEQ ID NO: 2807924 - RNA, 12 nt, Human
aaacucauuuuu

SEQ ID NO: 2807925 - RNA, 21 nt, Human
gguauggaaggguuuguggcu

SEQ ID NO: 2807926 - RNA, 12 nt, Human
gguauguuuaau

SEQ ID NO: 2807927 - RNA, 18 nt, Human
gguauguuuaaucuguua

SEQ ID NO: 2807928 - RNA, 17 nt, Human
gguauaaugguugacug

SEQ ID NO: 2807929 - RNA, 18 nt, Human
gguauaaguggugugugu

SEQ ID NO: 2807930 - RNA, 15 nt, Human
aaacuguacauuuaa

SEQ ID NO: 2807931 - RNA, 16 nt, Human
aaacuguacauuuaaa

SEQ ID NO: 2807932 - RNA, 17 nt, Human
aaacuguacauuuaaaa

SEQ ID NO: 2807933 - RNA, 22 nt, Human
aaacuguacauuuaaaauugcu

SEQ ID NO: 2807934 - RNA, 16 nt, Human
gguaguaaaacacaga

SEQ ID NO: 2807935 - RNA, 13 nt, Human
aaacuguaugcuc

SEQ ID NO: 2807936 - RNA, 15 nt, Human
aaacuguaugcucac

SEQ ID NO: 2807937 - RNA, 21 nt, Human
gguaguuaggaugcucaguug

SEQ ID NO: 2807938 - RNA, 17 nt, Human
aaagaauggaaggugga

SEQ ID NO: 2807939 - RNA, 19 nt, Human
aaagaauucuuauacacau

SEQ ID NO: 2807940 - RNA, 17 nt, Human
aaagaauguuagagcac

SEQ ID NO: 2807941 - RNA, 12 nt, Human
aaagagaagaag

SEQ ID NO: 2807942 - RNA, 13 nt, Human
aaagagaagaaga

SEQ ID NO: 2807943 - RNA, 14 nt, Human
aaagagaagaagaa

SEQ ID NO: 2807944 - RNA, 19 nt, Human
aaagagaagaagaaaaaaa

SEQ ID NO: 2807945 - RNA, 21 nt, Human
aaagagaauugggggcuuagg

SEQ ID NO: 2807946 - RNA, 22 nt, Human
aaagagacaaacuguaaaaaau

SEQ ID NO: 2807947 - RNA, 19 nt, Human
aaagagaauuagauuauau

SEQ ID NO: 2807948 - RNA, 18 nt, Human
aaagagagaaaaacaaau

SEQ ID NO: 2807949 - RNA, 18 nt, Human
aaagacuuuaaaagugau

SEQ ID NO: 2807950 - RNA, 19 nt, Human
aaagacuuguaauauuuuu

SEQ ID NO: 2807951 - RNA, 16 nt, Human
aaagacuuccaaagaa

SEQ ID NO: 2807952 - RNA, 19 nt, Human
aaagacuuccaaagaaugu

SEQ ID NO: 2807953 - RNA, 14 nt, Human
aaagacuucccuaa

SEQ ID NO: 2807954 - RNA, 11 nt, Human
aaagagagaga

SEQ ID NO: 2807955 - RNA, 20 nt, Human
aaagagagagagagaaaaaa

SEQ ID NO: 2807956 - RNA, 15 nt, Human
aaagagagcagagaa

SEQ ID NO: 2807957 - RNA, 19 nt, Human
aaagaggcguugcuuucac

SEQ ID NO: 2807958 - RNA, 15 nt, Human
aaagauuuucagaaa

SEQ ID NO: 2807959 - RNA, 14 nt, Human
aaagauuuucagaa

SEQ ID NO: 2807960 - RNA, 15 nt, Human
aaagauucaugauuu

SEQ ID NO: 2807961 - RNA, 13 nt, Human
aaagauucauuuu

SEQ ID NO: 2807962 - RNA, 15 nt, Human
aaagauucauuuuua

SEQ ID NO: 2807963 - RNA, 19 nt, Human
aaagauucauuuuuaauca

SEQ ID NO: 2807964 - RNA, 20 nt, Human
aaagauucauuuuuaaucau

SEQ ID NO: 2807965 - RNA, 12 nt, Human
aaagauucuaua

SEQ ID NO: 2807966 - RNA, 18 nt, Human
aaagauucuauaguucua

SEQ ID NO: 2807967 - RNA, 19 nt, Human
aaagauucuauaguucuag

SEQ ID NO: 2807968 - RNA, 13 nt, Human
aaagauuagcaag

SEQ ID NO: 2807969 - RNA, 18 nt, Human
aaagauuagcaaggucau

SEQ ID NO: 2807970 - RNA, 22 nt, Human
aaagauuagcaaggucauuucu

SEQ ID NO: 2807971 - RNA, 22 nt, Human
aaagauucaccuaagagauucu

SEQ ID NO: 2807972 - RNA, 14 nt, Human
aaagauucaccuga

SEQ ID NO: 2807973 - RNA, 11 nt, Human
aaagauuaaac

SEQ ID NO: 2807974 - RNA, 13 nt, Human
aaagauuaaacag

SEQ ID NO: 2807975 - RNA, 14 nt, Human
aaagauuaaacugc

SEQ ID NO: 2807976 - RNA, 19 nt, Human
aaagauucagguauguugc

SEQ ID NO: 2807977 - RNA, 13 nt, Human
aaagaugcacaga

SEQ ID NO: 2807978 - RNA, 22 nt, Human
aaagauguaaugucccuuucag

SEQ ID NO: 2807979 - RNA, 17 nt, Human
aaagaugcucuucugug

SEQ ID NO: 2807980 - RNA, 22 nt, Human
aaagaugccggguuuuauauuu

SEQ ID NO: 2807981 - RNA, 21 nt, Human
aaagaugccaauuauuguuac

SEQ ID NO: 2807982 - RNA, 16 nt, Human
aaagaugcagccgccu

SEQ ID NO: 2807983 - RNA, 21 nt, Human
aaagaugcagccgccuuccuu

SEQ ID NO: 2807984 - RNA, 20 nt, Human
aaagaugcaaggaccaggac

SEQ ID NO: 2807985 - RNA, 12 nt, Human
aaagagaaaaaa

SEQ ID NO: 2807986 - RNA, 12 nt, Human
aaagaugaaguu

SEQ ID NO: 2807987 - RNA, 13 nt, Human
ggccucccaaagu

SEQ ID NO: 2807988 - RNA, 16 nt, Human
ggccucccaaagugcu

SEQ ID NO: 2807989 - RNA, 18 nt, Human
ggcccuuccucuccacug

SEQ ID NO: 2807990 - RNA, 14 nt, Human
ggcccucccaguac

SEQ ID NO: 2807991 - RNA, 19 nt, Human
ggcccuuccucuccacugc

SEQ ID NO: 2807992 - RNA, 22 nt, Human
ggcccuuccucuccacugccuu

SEQ ID NO: 2807993 - RNA, 23 nt, Human
ggcccuuccucuccacugccuuc

SEQ ID NO: 2807994 - RNA, 23 nt, Human
ggccucccucucucuucugcucc

SEQ ID NO: 2807995 - RNA, 15 nt, Human
ggccucccucucucu

SEQ ID NO: 2807996 - RNA, 16 nt, Human
ggcccagcgaccucgg

SEQ ID NO: 2807997 - RNA, 12 nt, Human
ggcccagccccu

SEQ ID NO: 2807998 - RNA, 13 nt, Human
ggcccagccccua

SEQ ID NO: 2807999 - RNA, 14 nt, Human
ggcccagccccuag

SEQ ID NO: 2808000 - RNA, 24 nt, Human
ggcccagccccuagaaacccaagc

SEQ ID NO: 2808001 - RNA, 15 nt, Human
ggcccaggcaggcca

SEQ ID NO: 2808002 - RNA, 21 nt, Human
ggcccucaucuaugaggaaag

SEQ ID NO: 2808003 - RNA, 22 nt, Human
ggcccucaucuaugaggaaagg

SEQ ID NO: 2808004 - RNA, 12 nt, Human
ggcccucccagu

SEQ ID NO: 2808005 - RNA, 16 nt, Human
ggcccgacagccuggc

SEQ ID NO: 2808006 - RNA, 17 nt, Human
ggcccgacagccuggca

SEQ ID NO: 2808007 - RNA, 15 nt, Human
ggcccgacagccugg

SEQ ID NO: 2808008 - RNA, 24 nt, Human
ggcccauaucugugaaaugcuggc

SEQ ID NO: 2808009 - RNA, 18 nt, Human
ggccccagggcuacccuc

SEQ ID NO: 2808010 - RNA, 17 nt, Human
ggccccagggcuacccu

SEQ ID NO: 2808011 - RNA, 13 nt, Human
ggccccagggcac

SEQ ID NO: 2808012 - RNA, 16 nt, Human
ggccccagggcacccu

SEQ ID NO: 2808013 - RNA, 21 nt, Human
ggccaguaucuauauaugugu

SEQ ID NO: 2808014 - RNA, 17 nt, Human
ggccagguuucugccca

SEQ ID NO: 2808015 - RNA, 19 nt, Human
ggccagguggccacuccag

SEQ ID NO: 2808016 - RNA, 17 nt, Human
ggccagggcugcccuga

SEQ ID NO: 2808017 - RNA, 18 nt, Human
ggccagggcugcccugag

SEQ ID NO: 2808018 - RNA, 19 nt, Human
ggccagggcugcccugaga

SEQ ID NO: 2808019 - RNA, 20 nt, Human
ggccagggcugcccugagaa

SEQ ID NO: 2808020 - RNA, 14 nt, Human
ggccaggugcagug

SEQ ID NO: 2808021 - RNA, 17 nt, Human
ggccagggucuguguga

SEQ ID NO: 2808022 - RNA, 19 nt, Human
ggccagggucugugugaau

SEQ ID NO: 2808023 - RNA, 22 nt, Human
ggccagggucugugugaaugug

SEQ ID NO: 2808024 - RNA, 23 nt, Human
ggccagggucugugugaaugugg

SEQ ID NO: 2808025 - RNA, 11 nt, Human
ggccaggucac

SEQ ID NO: 2808026 - RNA, 20 nt, Human
ggccagaugcaccagcccuu

SEQ ID NO: 2808027 - RNA, 19 nt, Human
ggccagaugcaccagcccu

SEQ ID NO: 2808028 - RNA, 17 nt, Human
ggccagaugcaccagcc

SEQ ID NO: 2808029 - RNA, 19 nt, Human
ggccagaguggccuggcca

SEQ ID NO: 2808030 - RNA, 18 nt, Human
ggccagaguggccuggcc

SEQ ID NO: 2808031 - RNA, 20 nt, Human
ggccagaguggccuggccag

SEQ ID NO: 2808032 - RNA, 15 nt, Human
ggccagccccggccc

SEQ ID NO: 2808033 - RNA, 19 nt, Human
ggccagaguauuggucucc

SEQ ID NO: 2808034 - RNA, 23 nt, Human
ggccagauggcccggaugcugcu

SEQ ID NO: 2808035 - RNA, 20 nt, Human
ggccagccccggcccugggc

SEQ ID NO: 2808036 - RNA, 14 nt, Human
ggccagccccucca

SEQ ID NO: 2808037 - RNA, 17 nt, Human
ggccagccccuccaucu

SEQ ID NO: 2808038 - RNA, 17 nt, Human
ggccagccccggcccug

SEQ ID NO: 2808039 - RNA, 19 nt, Human
ggccagccccggcccuggg

SEQ ID NO: 2808040 - RNA, 13 nt, Human
ggccagccgcucu

SEQ ID NO: 2808041 - RNA, 15 nt, Human
ggccagccgcucucc

SEQ ID NO: 2808042 - RNA, 19 nt, Human
ggccagccgcucuccugcc

SEQ ID NO: 2808043 - RNA, 21 nt, Human
ggccagccgcucuccugccac

SEQ ID NO: 2808044 - RNA, 14 nt, Human
ggccagccucaccc

SEQ ID NO: 2808045 - RNA, 15 nt, Human
ggccagccucacccu

SEQ ID NO: 2808046 - RNA, 16 nt, Human
ggccagccucacccuu

SEQ ID NO: 2808047 - RNA, 17 nt, Human
ggccagccucacccuug

SEQ ID NO: 2808048 - RNA, 18 nt, Human
ggccagccucacccuugc

SEQ ID NO: 2808049 - RNA, 23 nt, Human
ggccagagggagugacagaggca

SEQ ID NO: 2808050 - RNA, 16 nt, Human
ggccagaguggccugg

SEQ ID NO: 2808051 - RNA, 15 nt, Human
ggccagaguggccug

SEQ ID NO: 2808052 - RNA, 14 nt, Human
ggccagaguggccu

SEQ ID NO: 2808053 - RNA, 22 nt, Human
ggccagagggagugacagaggc

SEQ ID NO: 2808054 - RNA, 23 nt, Human
ggccaaguccgcagaagcccuga

SEQ ID NO: 2808055 - RNA, 16 nt, Human
ggccaaguccgcagaa

SEQ ID NO: 2808056 - RNA, 16 nt, Human
ggccaaggagggugag

SEQ ID NO: 2808057 - RNA, 16 nt, Human
ggccaaggccuucucc

SEQ ID NO: 2808058 - RNA, 18 nt, Human
ggccaaggccuucuccuc

SEQ ID NO: 2808059 - RNA, 19 nt, Human
ggccaaggccuucuccucc

SEQ ID NO: 2808060 - RNA, 21 nt, Human
ggccaaggggagucaccuucc

SEQ ID NO: 2808061 - RNA, 21 nt, Human
ggccaaggaugccccgucccc

SEQ ID NO: 2808062 - RNA, 17 nt, Human
ggccaacauggcgaaac

SEQ ID NO: 2808063 - RNA, 13 nt, Human
ggccaacauggua

SEQ ID NO: 2808064 - RNA, 13 nt, Human
ggcauuucacaaa

SEQ ID NO: 2808065 - RNA, 21 nt, Human
ggccaaauuauuuguguaaua

SEQ ID NO: 2808066 - RNA, 11 nt, Human
ggccaaacugc

SEQ ID NO: 2808067 - RNA, 12 nt, Human
ggccaaacugcu

SEQ ID NO: 2808068 - RNA, 14 nt, Human
ggccaaacugcugg

SEQ ID NO: 2808069 - RNA, 17 nt, Human
ggccaaacugcuggacg

SEQ ID NO: 2808070 - RNA, 15 nt, Human
ggccaaagccaaagc

SEQ ID NO: 2808071 - RNA, 19 nt, Human
ggccaaaucacccuuagaa

SEQ ID NO: 2808072 - RNA, 22 nt, Human
ggccaaauccgcucucuuccug

SEQ ID NO: 2808073 - RNA, 16 nt, Human
ggccaaaggcuggugg

SEQ ID NO: 2808074 - RNA, 13 nt, Human
ggcauuccugcuu

SEQ ID NO: 2808075 - RNA, 14 nt, Human
ggcauucuuguaca

SEQ ID NO: 2808076 - RNA, 16 nt, Human
ggcauucuuguacagu

SEQ ID NO: 2808077 - RNA, 18 nt, Human
ggcauucuuguacagugu

SEQ ID NO: 2808078 - RNA, 17 nt, Human
ggcauugacaaaucugu

SEQ ID NO: 2808079 - RNA, 20 nt, Human
ggcauugacaaaucugugua

SEQ ID NO: 2808080 - RNA, 19 nt, Human
ggcauugaggaagagucuu

SEQ ID NO: 2808081 - RNA, 15 nt, Human
ggcauuccugcuuau

SEQ ID NO: 2808082 - RNA, 17 nt, Human
ggaugugguuuucuuaa

SEQ ID NO: 2808083 - RNA, 18 nt, Human
ggaugugguuuucuuaag

SEQ ID NO: 2808084 - RNA, 23 nt, Human
ggaugugggagggagcagacagg

SEQ ID NO: 2808085 - RNA, 15 nt, Human
ggaugugggagggag

SEQ ID NO: 2808086 - RNA, 18 nt, Human
ggaugugauuguggaaug

SEQ ID NO: 2808087 - RNA, 20 nt, Human
ggaugagagcccagagguaa

SEQ ID NO: 2808088 - RNA, 21 nt, Human
ggaugacaugcacucagcucu

SEQ ID NO: 2808089 - RNA, 18 nt, Human
ggaugaaugaggucccag

SEQ ID NO: 2808090 - RNA, 14 nt, Human
ggaugaaugagguc

SEQ ID NO: 2808091 - RNA, 22 nt, Human
ggaugaaugaggucccaggcag

SEQ ID NO: 2808092 - RNA, 17 nt, Human
ggaugaaauuuucuaga

SEQ ID NO: 2808093 - RNA, 13 nt, Human
ggaugaaucuccc

SEQ ID NO: 2808094 - RNA, 22 nt, Human
ggaugagaaagguugaagcacc

SEQ ID NO: 2808095 - RNA, 12 nt, Human
ggaugagaaagg

SEQ ID NO: 2808096 - RNA, 14 nt, Human
ggaugagagcccag

SEQ ID NO: 2808097 - RNA, 15 nt, Human
ggaugagagcccaga

SEQ ID NO: 2808098 - RNA, 16 nt, Human
ggaugagagcccagag

SEQ ID NO: 2808099 - RNA, 18 nt, Human
ggaugagagcccagaggu

SEQ ID NO: 2808100 - RNA, 19 nt, Human
ggaugagagcccagaggua

SEQ ID NO: 2808101 - RNA, 15 nt, Human
ggauuuuaaacuaga

SEQ ID NO: 2808102 - RNA, 19 nt, Human
ggauuuuaaacuagaugac

SEQ ID NO: 2808103 - RNA, 23 nt, Human
ggauuuuaaacuagaugaccuca

SEQ ID NO: 2808104 - RNA, 14 nt, Human
ggauuuguucucug

SEQ ID NO: 2808105 - RNA, 15 nt, Human
ggauuuguucucugu

SEQ ID NO: 2808106 - RNA, 21 nt, Human
ggauuuugauccaagcugguc

SEQ ID NO: 2808107 - RNA, 13 nt, Human
ggcaaaauugcaa

SEQ ID NO: 2808108 - RNA, 16 nt, Human
ggcaaaauccuugcuu

SEQ ID NO: 2808109 - RNA, 23 nt, Human
ggauguuggccaccaggugccuu

SEQ ID NO: 2808110 - RNA, 12 nt, Human
ggauuaaacuua

SEQ ID NO: 2808111 - RNA, 16 nt, Human
ggauuaaacuuaugaa

SEQ ID NO: 2808112 - RNA, 19 nt, Human
ggauuaaacuuaugaaugu

SEQ ID NO: 2808113 - RNA, 20 nt, Human
ggauuaaacuuaugaauguu

SEQ ID NO: 2808114 - RNA, 21 nt, Human
ggauuaaacuuaugaauguuu

SEQ ID NO: 2808115 - RNA, 23 nt, Human
ggauuaaacuuaugaauguuucc

SEQ ID NO: 2808116 - RNA, 18 nt, Human
ggauuugaugcuguuuga

SEQ ID NO: 2808117 - RNA, 22 nt, Human
ggauuugcacagaagcacaugc

SEQ ID NO: 2808118 - RNA, 11 nt, Human
ggcaaaucugc

SEQ ID NO: 2808119 - RNA, 18 nt, Human
ggcaaaugacaugcacug

SEQ ID NO: 2808120 - RNA, 19 nt, Human
ggcaaaugacaugcacuga

SEQ ID NO: 2808121 - RNA, 20 nt, Human
ggcaaaugacaugcacugac

SEQ ID NO: 2808122 - RNA, 21 nt, Human
ggcaaaugacaugcacugacc

SEQ ID NO: 2808123 - RNA, 12 nt, Human
ggcaacagagca

SEQ ID NO: 2808124 - RNA, 13 nt, Human
ggcaaauauaaaa

SEQ ID NO: 2808125 - RNA, 20 nt, Human
ggcaacaaagugagacucca

SEQ ID NO: 2808126 - RNA, 14 nt, Human
ggcaaauucuuuug

SEQ ID NO: 2808127 - RNA, 18 nt, Human
ggcaaauucuuuugaauu

SEQ ID NO: 2808128 - RNA, 18 nt, Human
ggcaaauuuuuauuuuuu

SEQ ID NO: 2808129 - RNA, 21 nt, Human
ggcaaauuuuuauuuuuuagu

SEQ ID NO: 2808130 - RNA, 16 nt, Human
ggcaaaugcccaaggg

SEQ ID NO: 2808131 - RNA, 13 nt, Human
ggcaaaugcccaa

SEQ ID NO: 2808132 - RNA, 16 nt, Human
ggcaaccacuaagaau

SEQ ID NO: 2808133 - RNA, 19 nt, Human
ggcaaccacuaagaauuca

SEQ ID NO: 2808134 - RNA, 18 nt, Human
ggcaacauuccaagaaua

SEQ ID NO: 2808135 - RNA, 19 nt, Human
ggcaacagagcaagauccu

SEQ ID NO: 2808136 - RNA, 21 nt, Human
ggcagaacaucgcgaugggaa

SEQ ID NO: 2808137 - RNA, 13 nt, Human
ggcaggcugggcc

SEQ ID NO: 2808138 - RNA, 12 nt, Human
ggcaggcugggc

SEQ ID NO: 2808139 - RNA, 22 nt, Human
ggcaggcuaaggcguggagcug

SEQ ID NO: 2808140 - RNA, 14 nt, Human
ggcaggcccugcag

SEQ ID NO: 2808141 - RNA, 16 nt, Human
ggcaggcccugcagug

SEQ ID NO: 2808142 - RNA, 17 nt, Human
ggcaggcuaaggcgugg

SEQ ID NO: 2808143 - RNA, 21 nt, Human
ggcaggcuaaggcguggagcu

SEQ ID NO: 2808144 - RNA, 10 nt, Human
ggcaggcugg

SEQ ID NO: 2808145 - RNA, 13 nt, Human
ggcaggcauugag

SEQ ID NO: 2808146 - RNA, 13 nt, Human
ggcaggcccugca

SEQ ID NO: 2808147 - RNA, 10 nt, Human
ggcaggcccu

SEQ ID NO: 2808148 - RNA, 11 nt, Human
ggcaggcccug

SEQ ID NO: 2808149 - RNA, 12 nt, Human
ggcaggcccugc

SEQ ID NO: 2808150 - RNA, 20 nt, Human
ggcagaaagguucugcccgg

SEQ ID NO: 2808151 - RNA, 22 nt, Human
ggcagaaagguucugcccggga

SEQ ID NO: 2808152 - RNA, 12 nt, Human
ggcagaagacac

SEQ ID NO: 2808153 - RNA, 15 nt, Human
ggcagaagacaccag

SEQ ID NO: 2808154 - RNA, 14 nt, Human
ggcagagaaucaua

SEQ ID NO: 2808155 - RNA, 9 nt, Human
ggcagagag

SEQ ID NO: 2808156 - RNA, 11 nt, Human
ggcagagagag

SEQ ID NO: 2808157 - RNA, 12 nt, Human
ggcagagagaga

SEQ ID NO: 2808158 - RNA, 14 nt, Human
ggcagagagagaga

SEQ ID NO: 2808159 - RNA, 16 nt, Human
ggcagagagagagaaa

SEQ ID NO: 2808160 - RNA, 10 nt, Human
ggcagagagc

SEQ ID NO: 2808161 - RNA, 19 nt, Human
ggcagagagcggucucagg

SEQ ID NO: 2808162 - RNA, 22 nt, Human
ggcagaagacaccagagcagau

SEQ ID NO: 2808163 - RNA, 19 nt, Human
ggcagaauaaucuuugggu

SEQ ID NO: 2808164 - RNA, 18 nt, Human
ggcagaauaagaaaacaa

SEQ ID NO: 2808165 - RNA, 20 nt, Human
ggcagaagacaccagagcag

SEQ ID NO: 2808166 - RNA, 21 nt, Human
ggcagaagacaccagagcaga

SEQ ID NO: 2808167 - RNA, 16 nt, Human
ggcagaagacaccaga

SEQ ID NO: 2808168 - RNA, 17 nt, Human
ggcagaagacaccagag

SEQ ID NO: 2808169 - RNA, 18 nt, Human
ggcagaagacaccagagc

SEQ ID NO: 2808170 - RNA, 19 nt, Human
ggcagaagacaccagagca

SEQ ID NO: 2808171 - RNA, 22 nt, Human
ggcacuuugaaggggccucacc

SEQ ID NO: 2808172 - RNA, 12 nt, Human
ggcacuuugggg

SEQ ID NO: 2808173 - RNA, 14 nt, Human
ggcagaaaggaaaa

SEQ ID NO: 2808174 - RNA, 22 nt, Human
ggcagaaaggaaaaccugaaga

SEQ ID NO: 2808175 - RNA, 11 nt, Human
ggcagaaaauu

SEQ ID NO: 2808176 - RNA, 17 nt, Human
ggcagaaaauugcacaa

SEQ ID NO: 2808177 - RNA, 19 nt, Human
ggcagccgugccuucagcu

SEQ ID NO: 2808178 - RNA, 21 nt, Human
ggcagccgugccuucagcucu

SEQ ID NO: 2808179 - RNA, 18 nt, Human
ggcagccgugccuucagc

SEQ ID NO: 2808180 - RNA, 15 nt, Human
ggcagccaggcugcc

SEQ ID NO: 2808181 - RNA, 13 nt, Human
ggcagccaggcug

SEQ ID NO: 2808182 - RNA, 19 nt, Human
ggcagccaggcugccaagg

SEQ ID NO: 2808183 - RNA, 12 nt, Human
ggcagccaggcu

SEQ ID NO: 2808184 - RNA, 23 nt, Human
ggcagagauuggaaugggcagcu

SEQ ID NO: 2808185 - RNA, 16 nt, Human
ggcaggacucagcucc

SEQ ID NO: 2808186 - RNA, 21 nt, Human
ggcaggacucagcuccccaga

SEQ ID NO: 2808187 - RNA, 23 nt, Human
ggcaggacucagcuccccagagu

SEQ ID NO: 2808188 - RNA, 23 nt, Human
ggcaggacaugcugaagccaaag

SEQ ID NO: 2808189 - RNA, 16 nt, Human
ggcagccuccagccug

SEQ ID NO: 2808190 - RNA, 22 nt, Human
ggcagccgugccuucagcucua

SEQ ID NO: 2808191 - RNA, 17 nt, Human
ggaggcugaggcaggag

SEQ ID NO: 2808192 - RNA, 14 nt, Human
ggaggcugaggcag

SEQ ID NO: 2808193 - RNA, 12 nt, Human
ggaggcugaggc

SEQ ID NO: 2808194 - RNA, 19 nt, Human
ggaggcugaggcaggagga

SEQ ID NO: 2808195 - RNA, 13 nt, Human
ggagguguucacu

SEQ ID NO: 2808196 - RNA, 14 nt, Human
ggagguguucacug

SEQ ID NO: 2808197 - RNA, 12 nt, Human
ggaggugugagg

SEQ ID NO: 2808198 - RNA, 23 nt, Human
ggagguucuaaggccuaggauuc

SEQ ID NO: 2808199 - RNA, 12 nt, Human
ggagguucuaag

SEQ ID NO: 2808200 - RNA, 13 nt, Human
ggaggaaagacaa

SEQ ID NO: 2808201 - RNA, 17 nt, Human
ggagguugcagggagcc

SEQ ID NO: 2808202 - RNA, 14 nt, Human
ggagguugcaggga

SEQ ID NO: 2808203 - RNA, 12 nt, Human
ggagguugcagg

SEQ ID NO: 2808204 - RNA, 17 nt, Human
ggagcucuucaggccuc

SEQ ID NO: 2808205 - RNA, 19 nt, Human
ggagcuccucuccuggagg

SEQ ID NO: 2808206 - RNA, 20 nt, Human
ggagcuccucuccuggagga

SEQ ID NO: 2808207 - RNA, 13 nt, Human
ggagcuccucucc

SEQ ID NO: 2808208 - RNA, 17 nt, Human
ggagcuccucuccugga

SEQ ID NO: 2808209 - RNA, 18 nt, Human
ggagcuccucuccuggag

SEQ ID NO: 2808210 - RNA, 22 nt, Human
ggagcugccuguucagcuccag

SEQ ID NO: 2808211 - RNA, 17 nt, Human
ggagcugccuuggcuca

SEQ ID NO: 2808212 - RNA, 21 nt, Human
ggagcuccucuccuggaggau

SEQ ID NO: 2808213 - RNA, 20 nt, Human
ggagcucuucaggccucccu

SEQ ID NO: 2808214 - RNA, 18 nt, Human
ggagcucuucaggccucc

SEQ ID NO: 2808215 - RNA, 18 nt, Human
ggagcugccuuggcucag

SEQ ID NO: 2808216 - RNA, 21 nt, Human
ggagcugccuuggcucagaca

SEQ ID NO: 2808217 - RNA, 12 nt, Human
ggagcuggcccc

SEQ ID NO: 2808218 - RNA, 23 nt, Human
ggagcugcuggcuugcagugcgc

SEQ ID NO: 2808219 - RNA, 15 nt, Human
ggagcugcuggcuug

SEQ ID NO: 2808220 - RNA, 13 nt, Human
ggagcugcuggcu

SEQ ID NO: 2808221 - RNA, 15 nt, Human
ggagcuugggaaugg

SEQ ID NO: 2808222 - RNA, 15 nt, Human
ggagcuucugggguc

SEQ ID NO: 2808223 - RNA, 21 nt, Human
ggagcuucugggguccccagg

SEQ ID NO: 2808224 - RNA, 23 nt, Human
ggagcuucugggguccccagggc

SEQ ID NO: 2808225 - RNA, 15 nt, Human
ggagcuggccccgcc

SEQ ID NO: 2808226 - RNA, 16 nt, Human
ggagcuggccccgccg

SEQ ID NO: 2808227 - RNA, 23 nt, Human
ggagccccaggccucuguguccu

SEQ ID NO: 2808228 - RNA, 13 nt, Human
ggagccccagggu

SEQ ID NO: 2808229 - RNA, 12 nt, Human
ggagccccaggg

SEQ ID NO: 2808230 - RNA, 13 nt, Human
ggagccccaggcc

SEQ ID NO: 2808231 - RNA, 14 nt, Human
ggagccccaggccu

SEQ ID NO: 2808232 - RNA, 20 nt, Human
ggagccccaggccucugugu

SEQ ID NO: 2808233 - RNA, 22 nt, Human
ggagccccaggccucugugucc

SEQ ID NO: 2808234 - RNA, 20 nt, Human
ggagccccagggucuucccu

SEQ ID NO: 2808235 - RNA, 14 nt, Human
ggagccccaggguc

SEQ ID NO: 2808236 - RNA, 12 nt, Human
ggagccccaucu

SEQ ID NO: 2808237 - RNA, 16 nt, Human
ggagccccaucugucu

SEQ ID NO: 2808238 - RNA, 23 nt, Human
ggagcccacggcuaagaggcugc

SEQ ID NO: 2808239 - RNA, 17 nt, Human
ggagccccagcuacccu

SEQ ID NO: 2808240 - RNA, 18 nt, Human
ggagccccagcuacccuu

SEQ ID NO: 2808241 - RNA, 18 nt, Human
ggagccaguaaacagagg

SEQ ID NO: 2808242 - RNA, 17 nt, Human
ggaggcauggcccuggg

SEQ ID NO: 2808243 - RNA, 23 nt, Human
ggaggccaggccggcgagcccug

SEQ ID NO: 2808244 - RNA, 14 nt, Human
ggaggccaggccgg

SEQ ID NO: 2808245 - RNA, 15 nt, Human
ggaggcauggcccug

SEQ ID NO: 2808246 - RNA, 16 nt, Human
ggaggcauggcccugg

SEQ ID NO: 2808247 - RNA, 12 nt, Human
ggaggaaagcaa

SEQ ID NO: 2808248 - RNA, 19 nt, Human
ggaggaagcagguugaggg

SEQ ID NO: 2808249 - RNA, 18 nt, Human
ggaggaacacugcacucu

SEQ ID NO: 2808250 - RNA, 22 nt, Human
ggaggaacagggaagggggagc

SEQ ID NO: 2808251 - RNA, 20 nt, Human
ggaggaaaaccaagccgugg

SEQ ID NO: 2808252 - RNA, 19 nt, Human
ggagcuuuguuuugggggu

SEQ ID NO: 2808253 - RNA, 23 nt, Human
ggagcuuuguuuugggggucagg

SEQ ID NO: 2808254 - RNA, 21 nt, Human
ggaggaaaaccaagccguggc

SEQ ID NO: 2808255 - RNA, 22 nt, Human
ggaggaaaaccaagccguggcu

SEQ ID NO: 2808256 - RNA, 15 nt, Human
ggagcagaccacccc

SEQ ID NO: 2808257 - RNA, 20 nt, Human
ggagcagacaggaggaauca

SEQ ID NO: 2808258 - RNA, 15 nt, Human
ggagcaggagauuga

SEQ ID NO: 2808259 - RNA, 13 nt, Human
ggagcagccucag

SEQ ID NO: 2808260 - RNA, 18 nt, Human
ggagcagccuggagaccc

SEQ ID NO: 2808261 - RNA, 13 nt, Human
ggagcaggaacaa

SEQ ID NO: 2808262 - RNA, 16 nt, Human
ggagcaggagauugag

SEQ ID NO: 2808263 - RNA, 21 nt, Human
ggagcaggagauugagaagga

SEQ ID NO: 2808264 - RNA, 22 nt, Human
ggagcaggagauugagaaggag

SEQ ID NO: 2808265 - RNA, 23 nt, Human
ggagcaggagauugagaaggaga

SEQ ID NO: 2808266 - RNA, 11 nt, Human
ggagccaggcg

SEQ ID NO: 2808267 - RNA, 21 nt, Human
ggagcaggcggugggcaccca

SEQ ID NO: 2808268 - RNA, 18 nt, Human
ggagcaggcgguggggag

SEQ ID NO: 2808269 - RNA, 21 nt, Human
ggagcaggcgguggggagaga

SEQ ID NO: 2808270 - RNA, 23 nt, Human
ggagcaggcgguggggagagaug

SEQ ID NO: 2808271 - RNA, 17 nt, Human
ggagcagggaaggccug

SEQ ID NO: 2808272 - RNA, 16 nt, Human
ggagcagggaaggccu

SEQ ID NO: 2808273 - RNA, 13 nt, Human
ggagcagggaagg

SEQ ID NO: 2808274 - RNA, 16 nt, Human
ggagcaguccaugcau

SEQ ID NO: 2808275 - RNA, 17 nt, Human
ggagcaguccaugcaug

SEQ ID NO: 2808276 - RNA, 18 nt, Human
ggagcaguccaugcauga

SEQ ID NO: 2808277 - RNA, 14 nt, Human
ggagcagugcaggc

SEQ ID NO: 2808278 - RNA, 18 nt, Human
ggagcagugcaggcacag

SEQ ID NO: 2808279 - RNA, 21 nt, Human
ggagcagggaaggccugacuu

SEQ ID NO: 2808280 - RNA, 19 nt, Human
ggagcagggaaggccugac

SEQ ID NO: 2808281 - RNA, 11 nt, Human
ggaccccagcu

SEQ ID NO: 2808282 - RNA, 23 nt, Human
ggacccgaccccccgugggcucc

SEQ ID NO: 2808283 - RNA, 21 nt, Human
ggaccccagcugugagccuug

SEQ ID NO: 2808284 - RNA, 12 nt, Human
ggaccccaggcc

SEQ ID NO: 2808285 - RNA, 13 nt, Human
ggaccccaggccc

SEQ ID NO: 2808286 - RNA, 14 nt, Human
ggaccccaggccca

SEQ ID NO: 2808287 - RNA, 18 nt, Human
ggaccccagcugugagcc

SEQ ID NO: 2808288 - RNA, 20 nt, Human
ggacccggaggggccuggca

SEQ ID NO: 2808289 - RNA, 21 nt, Human
ggacccggaggggccuggcag

SEQ ID NO: 2808290 - RNA, 20 nt, Human
ggaccguggcccugcccucu

SEQ ID NO: 2808291 - RNA, 22 nt, Human
gcuugguguuuguaagaaaaug

SEQ ID NO: 2808292 - RNA, 16 nt, Human
gcuuguaccucuggcu

SEQ ID NO: 2808293 - RNA, 17 nt, Human
gcuuguaccucuggcug

SEQ ID NO: 2808294 - RNA, 18 nt, Human
gcuuguaccucuggcuga

SEQ ID NO: 2808295 - RNA, 22 nt, Human
gcuuguaccucuggcugacuaa

SEQ ID NO: 2808296 - RNA, 17 nt, Human
gcuuguagaauuguuau

SEQ ID NO: 2808297 - RNA, 15 nt, Human
gcuuggggcaacauu

SEQ ID NO: 2808298 - RNA, 17 nt, Human
ggacuuagcugggagaa

SEQ ID NO: 2808299 - RNA, 15 nt, Human
ggacuuagaaagcag

SEQ ID NO: 2808300 - RNA, 17 nt, Human
ggacuuagaaagcaggg

SEQ ID NO: 2808301 - RNA, 18 nt, Human
ggacuuagaaagcagggg

SEQ ID NO: 2808302 - RNA, 20 nt, Human
ggacuuagaaagcaggggcu

SEQ ID NO: 2808303 - RNA, 14 nt, Human
ggaccccuaugaag

SEQ ID NO: 2808304 - RNA, 19 nt, Human
ggacuuauuacaauuuguu

SEQ ID NO: 2808305 - RNA, 17 nt, Human
ggacucagcccugaggu

SEQ ID NO: 2808306 - RNA, 16 nt, Human
ggacucagcccugagg

SEQ ID NO: 2808307 - RNA, 15 nt, Human
ggacucagcccugag

SEQ ID NO: 2808308 - RNA, 14 nt, Human
ggacucagcccuga

SEQ ID NO: 2808309 - RNA, 20 nt, Human
ggacuacaggugugagucac

SEQ ID NO: 2808310 - RNA, 21 nt, Human
ggacuagagggaccucuccca

SEQ ID NO: 2808311 - RNA, 19 nt, Human
ggacuagagggaccucucc

SEQ ID NO: 2808312 - RNA, 18 nt, Human
ggacuagagggaccucuc

SEQ ID NO: 2808313 - RNA, 22 nt, Human
ggacucaaugcacugacauugu

SEQ ID NO: 2808314 - RNA, 14 nt, Human
ggacuagccccugu

SEQ ID NO: 2808315 - RNA, 22 nt, Human
ggacuagccccuguggagacug

SEQ ID NO: 2808316 - RNA, 16 nt, Human
ggacuaggguccuggg

SEQ ID NO: 2808317 - RNA, 20 nt, Human
ggacucacagguuggaagag

SEQ ID NO: 2808318 - RNA, 21 nt, Human
ggacucacagguuggaagaga

SEQ ID NO: 2808319 - RNA, 23 nt, Human
ggacucacagguuggaagagaau

SEQ ID NO: 2808320 - RNA, 13 nt, Human
ggacucagcccug

SEQ ID NO: 2808321 - RNA, 18 nt, Human
ggacucagaagccucugg

SEQ ID NO: 2808322 - RNA, 14 nt, Human
ggacucagagaaaa

SEQ ID NO: 2808323 - RNA, 17 nt, Human
ggacucagaagccucug

SEQ ID NO: 2808324 - RNA, 15 nt, Human
ggagaaccucaggcu

SEQ ID NO: 2808325 - RNA, 23 nt, Human
ggagaacaucuuugacacucugc

SEQ ID NO: 2808326 - RNA, 11 nt, Human
ggagaacaaau

SEQ ID NO: 2808327 - RNA, 22 nt, Human
ggagacugcugagucaacccaa

SEQ ID NO: 2808328 - RNA, 16 nt, Human
ggagacugucucaaga

SEQ ID NO: 2808329 - RNA, 15 nt, Human
ggagacuggggggcu

SEQ ID NO: 2808330 - RNA, 18 nt, Human
ggagacuggggggcuuga

SEQ ID NO: 2808331 - RNA, 20 nt, Human
ggagacugguccugugugca

SEQ ID NO: 2808332 - RNA, 17 nt, Human
ggacuuggaagcuccgc

SEQ ID NO: 2808333 - RNA, 15 nt, Human
ggacuuggaagcucc

SEQ ID NO: 2808334 - RNA, 16 nt, Human
ggacuucggaccgcuu

SEQ ID NO: 2808335 - RNA, 23 nt, Human
ggacuucggaccgcuugugggga

SEQ ID NO: 2808336 - RNA, 20 nt, Human
ggagaaaaaaagcauguguc

SEQ ID NO: 2808337 - RNA, 15 nt, Human
ggagaaaaggaaaag

SEQ ID NO: 2808338 - RNA, 22 nt, Human
ggagaaaaggaaaagaaaaaaa

SEQ ID NO: 2808339 - RNA, 19 nt, Human
ggacuuuguauacuuuaaa

SEQ ID NO: 2808340 - RNA, 20 nt, Human
ggacuuuguauacuuuaaau

SEQ ID NO: 2808341 - RNA, 16 nt, Human
ggacuugugucucugu

SEQ ID NO: 2808342 - RNA, 18 nt, Human
ggacuuuuauuuccagug

SEQ ID NO: 2808343 - RNA, 12 nt, Human
ggagagcccagc

SEQ ID NO: 2808344 - RNA, 11 nt, Human
ggagagcccag

SEQ ID NO: 2808345 - RNA, 17 nt, Human
ggagagccccuggggcc

SEQ ID NO: 2808346 - RNA, 16 nt, Human
ggagacuugccagagc

SEQ ID NO: 2808347 - RNA, 17 nt, Human
ggagagacucccaugaa

SEQ ID NO: 2808348 - RNA, 18 nt, Human
ggagagacucccaugaag

SEQ ID NO: 2808349 - RNA, 19 nt, Human
ggagagacucccaugaagc

SEQ ID NO: 2808350 - RNA, 20 nt, Human
ggagagacucccaugaagcc

SEQ ID NO: 2808351 - RNA, 21 nt, Human
ggagagacucccaugaagccu

SEQ ID NO: 2808352 - RNA, 22 nt, Human
ggagagacucccaugaagccuu

SEQ ID NO: 2808353 - RNA, 10 nt, Human
ggagagagaa

SEQ ID NO: 2808354 - RNA, 11 nt, Human
ggagagagaaa

SEQ ID NO: 2808355 - RNA, 12 nt, Human
ggagagagaaag

SEQ ID NO: 2808356 - RNA, 21 nt, Human
ggagagagaaagccaggcagg

SEQ ID NO: 2808357 - RNA, 10 nt, Human
ggagagaggc

SEQ ID NO: 2808358 - RNA, 13 nt, Human
ggagagaggcaga

SEQ ID NO: 2808359 - RNA, 16 nt, Human
ggagagaggcagagag

SEQ ID NO: 2808360 - RNA, 18 nt, Human
ggagagaggcagagagcg

SEQ ID NO: 2808361 - RNA, 14 nt, Human
ggagagagacucca

SEQ ID NO: 2808362 - RNA, 14 nt, Human
ggagagagaaagcc

SEQ ID NO: 2808363 - RNA, 17 nt, Human
ggagagagaaagccagg

SEQ ID NO: 2808364 - RNA, 18 nt, Human
ggagagagaaagccaggc

SEQ ID NO: 2808365 - RNA, 20 nt, Human
ggagagagaaagccaggcag

SEQ ID NO: 2808366 - RNA, 16 nt, Human
ggagagauagccugug

SEQ ID NO: 2808367 - RNA, 18 nt, Human
ggagagauagccuguggc

SEQ ID NO: 2808368 - RNA, 19 nt, Human
ggagagauagccuguggcc

SEQ ID NO: 2808369 - RNA, 18 nt, Human
gcugccugcccacacagg

SEQ ID NO: 2808370 - RNA, 19 nt, Human
gcugccugcccgcacagca

SEQ ID NO: 2808371 - RNA, 20 nt, Human
gcugccugcccgcacagcag

SEQ ID NO: 2808372 - RNA, 22 nt, Human
gcugccugcccgcacagcagcc

SEQ ID NO: 2808373 - RNA, 23 nt, Human
gcugccugcccgcacagcagccu

SEQ ID NO: 2808374 - RNA, 15 nt, Human
gcugccugcccacac

SEQ ID NO: 2808375 - RNA, 14 nt, Human
gcugccugcccaca

SEQ ID NO: 2808376 - RNA, 17 nt, Human
gcugccuagcaagcugg

SEQ ID NO: 2808377 - RNA, 19 nt, Human
gcugccuagcaagcuggcc

SEQ ID NO: 2808378 - RNA, 22 nt, Human
gcugccugccgguaaacacgcc

SEQ ID NO: 2808379 - RNA, 22 nt, Human
gcugccugcccguaaacacgcc

SEQ ID NO: 2808380 - RNA, 13 nt, Human
gcugccugcccgu

SEQ ID NO: 2808381 - RNA, 17 nt, Human
gcugccugcccacacag

SEQ ID NO: 2808382 - RNA, 22 nt, Human
gcugccgugccgccugcacucc

SEQ ID NO: 2808383 - RNA, 18 nt, Human
gcugccgugccgccugca

SEQ ID NO: 2808384 - RNA, 17 nt, Human
gcugccgccccacccag

SEQ ID NO: 2808385 - RNA, 15 nt, Human
gcugccgggccugau

SEQ ID NO: 2808386 - RNA, 19 nt, Human
gcugccgggccugauuugg

SEQ ID NO: 2808387 - RNA, 15 nt, Human
gcugccuaagacaug

SEQ ID NO: 2808388 - RNA, 15 nt, Human
gcugccgccucccag

SEQ ID NO: 2808389 - RNA, 13 nt, Human
gcugccgccuccc

SEQ ID NO: 2808390 - RNA, 20 nt, Human
gcugccgccucccagccugg

SEQ ID NO: 2808391 - RNA, 19 nt, Human
gcugccgccucccagccug

SEQ ID NO: 2808392 - RNA, 18 nt, Human
gcugccgccucccagccu

SEQ ID NO: 2808393 - RNA, 16 nt, Human
gcugccgccucccagc

SEQ ID NO: 2808394 - RNA, 14 nt, Human
gcugccccaaccug

SEQ ID NO: 2808395 - RNA, 16 nt, Human
gcugccccaaccugcu

SEQ ID NO: 2808396 - RNA, 17 nt, Human
gcugccccaaccugcug

SEQ ID NO: 2808397 - RNA, 18 nt, Human
gcugccccaaccugcuga

SEQ ID NO: 2808398 - RNA, 20 nt, Human
gcugccccaaccugcugaag

SEQ ID NO: 2808399 - RNA, 18 nt, Human
gcugcccacuguuucucu

SEQ ID NO: 2808400 - RNA, 18 nt, Human
gcugccauuugauuuuuc

SEQ ID NO: 2808401 - RNA, 16 nt, Human
gcugcccaaucuccau

SEQ ID NO: 2808402 - RNA, 17 nt, Human
gcugcccaaucuccauc

SEQ ID NO: 2808403 - RNA, 23 nt, Human
gcugcccacuguuucucuugagc

SEQ ID NO: 2808404 - RNA, 22 nt, Human
gcugcccacuguuucucuugag

SEQ ID NO: 2808405 - RNA, 16 nt, Human
gcugcccauuucguga

SEQ ID NO: 2808406 - RNA, 21 nt, Human
gcugcccauuucgugagcccc

SEQ ID NO: 2808407 - RNA, 12 nt, Human
gcugcccaggcc

SEQ ID NO: 2808408 - RNA, 14 nt, Human
gcugcccaggccca

SEQ ID NO: 2808409 - RNA, 12 nt, Human
gcugcugcccag

SEQ ID NO: 2808410 - RNA, 13 nt, Human
gcugcugcccagg

SEQ ID NO: 2808411 - RNA, 15 nt, Human
gcugcugcccaggcc

SEQ ID NO: 2808412 - RNA, 12 nt, Human
gcugcugcucug

SEQ ID NO: 2808413 - RNA, 15 nt, Human
gcugcugcugcgccc

SEQ ID NO: 2808414 - RNA, 12 nt, Human
gcugcugcgccc

SEQ ID NO: 2808415 - RNA, 12 nt, Human
gcugcugccugg

SEQ ID NO: 2808416 - RNA, 13 nt, Human
gcugcugccuggc

SEQ ID NO: 2808417 - RNA, 17 nt, Human
gcugcugccuggccacu

SEQ ID NO: 2808418 - RNA, 18 nt, Human
gcugcugccuggccacug

SEQ ID NO: 2808419 - RNA, 13 nt, Human
gcugcuccucaug

SEQ ID NO: 2808420 - RNA, 14 nt, Human
gcugcuccuuggcu

SEQ ID NO: 2808421 - RNA, 15 nt, Human
gcugcuccuuggcuu

SEQ ID NO: 2808422 - RNA, 13 nt, Human
gcugccugcccac

SEQ ID NO: 2808423 - RNA, 22 nt, Human
gcugaggggaggaucacuggag

SEQ ID NO: 2808424 - RNA, 13 nt, Human
gcugagggcagcu

SEQ ID NO: 2808425 - RNA, 14 nt, Human
gcugaggaggccuc

SEQ ID NO: 2808426 - RNA, 22 nt, Human
gcugcaccugccagccuggcuu

SEQ ID NO: 2808427 - RNA, 21 nt, Human
gcugcaccugccagccuggcu

SEQ ID NO: 2808428 - RNA, 14 nt, Human
gcugccacuuuuua

SEQ ID NO: 2808429 - RNA, 23 nt, Human
gcugccauccagguucagcuugu

SEQ ID NO: 2808430 - RNA, 22 nt, Human
gcugccauggcgugucccucuc

SEQ ID NO: 2808431 - RNA, 23 nt, Human
gcugccauggcgugucccucucg

SEQ ID NO: 2808432 - RNA, 21 nt, Human
gcugccauccagguucagcuu

SEQ ID NO: 2808433 - RNA, 20 nt, Human
gcugcaccugccagccuggc

SEQ ID NO: 2808434 - RNA, 19 nt, Human
gcugcaccugccagccugg

SEQ ID NO: 2808435 - RNA, 18 nt, Human
gcugcaccugccagccug

SEQ ID NO: 2808436 - RNA, 17 nt, Human
gcugcaccugccagccu

SEQ ID NO: 2808437 - RNA, 15 nt, Human
gcuggacgucuuucu

SEQ ID NO: 2808438 - RNA, 16 nt, Human
gcuggacgucuuucuu

SEQ ID NO: 2808439 - RNA, 18 nt, Human
gcuggacgucuuucuuuu

SEQ ID NO: 2808440 - RNA, 20 nt, Human
gcuggacgucuuucuuuuuu

SEQ ID NO: 2808441 - RNA, 19 nt, Human
gcuggacggggacugggga

SEQ ID NO: 2808442 - RNA, 21 nt, Human
gcuggacggggacuggggaug

SEQ ID NO: 2808443 - RNA, 13 nt, Human
gcuggacucugca

SEQ ID NO: 2808444 - RNA, 16 nt, Human
gcuggacucugcaucc

SEQ ID NO: 2808445 - RNA, 12 nt, Human
gcuggagugcag

SEQ ID NO: 2808446 - RNA, 16 nt, Human
gcuggacggcauuccu

SEQ ID NO: 2808447 - RNA, 16 nt, Human
gcugggauuacaggug

SEQ ID NO: 2808448 - RNA, 23 nt, Human
gcugggauuacaggcuccugcca

SEQ ID NO: 2808449 - RNA, 22 nt, Human
gcugggauuacaggcuccugcc

SEQ ID NO: 2808450 - RNA, 15 nt, Human
gcuggagugcaguga

SEQ ID NO: 2808451 - RNA, 14 nt, Human
gcuggagugcagug

SEQ ID NO: 2808452 - RNA, 13 nt, Human
gcugggcacuucc

SEQ ID NO: 2808453 - RNA, 14 nt, Human
gcugggcacuuccc

SEQ ID NO: 2808454 - RNA, 15 nt, Human
gcugggcacuucccu

SEQ ID NO: 2808455 - RNA, 18 nt, Human
gcugggcacuucccugcu

SEQ ID NO: 2808456 - RNA, 19 nt, Human
gcugggcacuucccugcug

SEQ ID NO: 2808457 - RNA, 18 nt, Human
gcugggauuacaggugug

SEQ ID NO: 2808458 - RNA, 17 nt, Human
gcugggauuacagggau

SEQ ID NO: 2808459 - RNA, 17 nt, Human
gcugggauuacaggugu

SEQ ID NO: 2808460 - RNA, 19 nt, Human
gcugggauuacagguguga

SEQ ID NO: 2808461 - RNA, 21 nt, Human
gcugggauuacaggcuccugc

SEQ ID NO: 2808462 - RNA, 14 nt, Human
gcugggauuuuaaa

SEQ ID NO: 2808463 - RNA, 15 nt, Human
gcugggauuuuaaac

SEQ ID NO: 2808464 - RNA, 15 nt, Human
gcugggcaaggaaaa

SEQ ID NO: 2808465 - RNA, 16 nt, Human
gcugggcaaggaaaaa

SEQ ID NO: 2808466 - RNA, 19 nt, Human
gcugggcaaggaaaaagaa

SEQ ID NO: 2808467 - RNA, 20 nt, Human
gcugggcaaggaaaaagaaa

SEQ ID NO: 2808468 - RNA, 20 nt, Human
gcugggcacacgccucccac

SEQ ID NO: 2808469 - RNA, 22 nt, Human
gcugggcacacgccucccacug

SEQ ID NO: 2808470 - RNA, 17 nt, Human
gcugggugguacccucu

SEQ ID NO: 2808471 - RNA, 14 nt, Human
gcuggguggcacug

SEQ ID NO: 2808472 - RNA, 15 nt, Human
gcuggguggcacugc

SEQ ID NO: 2808473 - RNA, 17 nt, Human
gcuggguggcacugcca

SEQ ID NO: 2808474 - RNA, 19 nt, Human
gcuuggcguggagcaggcg

SEQ ID NO: 2808475 - RNA, 15 nt, Human
gcuuggcuccaugcu

SEQ ID NO: 2808476 - RNA, 19 nt, Human
gcuugaaaagcuaguguac

SEQ ID NO: 2808477 - RNA, 17 nt, Human
gcuucuuuucuuuguau

SEQ ID NO: 2808478 - RNA, 20 nt, Human
gcuucuuuucuuuguaucau

SEQ ID NO: 2808479 - RNA, 16 nt, Human
gcuuccuuucccaagc

SEQ ID NO: 2808480 - RNA, 22 nt, Human
gcuuccuuggcaucacagggca

SEQ ID NO: 2808481 - RNA, 24 nt, Human
gcuuccuuucccaagccuucgggc

SEQ ID NO: 2808482 - RNA, 14 nt, Human
gcuucgacuuuucu

SEQ ID NO: 2808483 - RNA, 16 nt, Human
gcuucgacuuuucuua

SEQ ID NO: 2808484 - RNA, 21 nt, Human
gcuucgaggcccagcgaccuc

SEQ ID NO: 2808485 - RNA, 19 nt, Human
gcuucgaggcccagcgacc

SEQ ID NO: 2808486 - RNA, 12 nt, Human
gcuucuugugaa

SEQ ID NO: 2808487 - RNA, 13 nt, Human
gcuucuugugaag

SEQ ID NO: 2808488 - RNA, 14 nt, Human
gcuucuugugaagg

SEQ ID NO: 2808489 - RNA, 18 nt, Human
gcuucuugugaaggccau

SEQ ID NO: 2808490 - RNA, 20 nt, Human
gcuucuugugaaggccauga

SEQ ID NO: 2808491 - RNA, 23 nt, Human
gcuuggggccaccaaagcugccc

SEQ ID NO: 2808492 - RNA, 13 nt, Human
gcuuggggccagg

SEQ ID NO: 2808493 - RNA, 22 nt, Human
gcuuggggccaccaaagcugcc

SEQ ID NO: 2808494 - RNA, 20 nt, Human
gcuuggggccaccaaagcug

SEQ ID NO: 2808495 - RNA, 19 nt, Human
gcuuggggccaccaaagcu

SEQ ID NO: 2808496 - RNA, 20 nt, Human
gcuugggagagccccugggg

SEQ ID NO: 2808497 - RNA, 21 nt, Human
gcuugggagagccccuggggc

SEQ ID NO: 2808498 - RNA, 22 nt, Human
gcuuccuucugugaaaguacau

SEQ ID NO: 2808499 - RNA, 23 nt, Human
gcuuccuacccacaccucugcca

SEQ ID NO: 2808500 - RNA, 17 nt, Human
gcuuccgguagggaggc

SEQ ID NO: 2808501 - RNA, 20 nt, Human
gcuuccgguagggaggcagc

SEQ ID NO: 2808502 - RNA, 21 nt, Human
gcuuccgguagggaggcagcc

SEQ ID NO: 2808503 - RNA, 22 nt, Human
gcuuccgguagggaggcagccu

SEQ ID NO: 2808504 - RNA, 22 nt, Human
gcuuccuacccacaccucugcc

SEQ ID NO: 2808505 - RNA, 13 nt, Human
gcuucccuccugc

SEQ ID NO: 2808506 - RNA, 16 nt, Human
gcuucccuccugcccg

SEQ ID NO: 2808507 - RNA, 18 nt, Human
gcuuccccuuuugccaau

SEQ ID NO: 2808508 - RNA, 23 nt, Human
gcuucccgcucagcccucccugc

SEQ ID NO: 2808509 - RNA, 15 nt, Human
gcuucccgcucagcc

SEQ ID NO: 2808510 - RNA, 16 nt, Human
gcuucccgcucagccc

SEQ ID NO: 2808511 - RNA, 17 nt, Human
gcuucccgcucagcccu

SEQ ID NO: 2808512 - RNA, 18 nt, Human
gcuucccgcucagcccuc

SEQ ID NO: 2808513 - RNA, 22 nt, Human
gcuuccauuuuccuacaggcag

SEQ ID NO: 2808514 - RNA, 15 nt, Human
gcuucccccauagcc

SEQ ID NO: 2808515 - RNA, 14 nt, Human
gcuucccccauagc

SEQ ID NO: 2808516 - RNA, 17 nt, Human
gcuucccaugucuuucu

SEQ ID NO: 2808517 - RNA, 18 nt, Human
gcuucccccauagccacc

SEQ ID NO: 2808518 - RNA, 16 nt, Human
gcuucccccauagcca

SEQ ID NO: 2808519 - RNA, 18 nt, Human
gcuucccaguggcugcug

SEQ ID NO: 2808520 - RNA, 19 nt, Human
gcuucccaguggcugcugc

SEQ ID NO: 2808521 - RNA, 20 nt, Human
gcuucccaguggcugcugcc

SEQ ID NO: 2808522 - RNA, 13 nt, Human
gcuucccaccucc

SEQ ID NO: 2808523 - RNA, 14 nt, Human
gcuucccaccuccc

SEQ ID NO: 2808524 - RNA, 15 nt, Human
gcuucccaccucccu

SEQ ID NO: 2808525 - RNA, 17 nt, Human
gcuucccaccucccugc

SEQ ID NO: 2808526 - RNA, 18 nt, Human
gcuucccaccucccugcc

SEQ ID NO: 2808527 - RNA, 22 nt, Human
gcuucccaccucccugcccagg

SEQ ID NO: 2808528 - RNA, 23 nt, Human
gcuucccaccucccugcccaggc

SEQ ID NO: 2808529 - RNA, 21 nt, Human
gcuucccaguggcugcugccc

SEQ ID NO: 2808530 - RNA, 22 nt, Human
gcuucccaguggcugcugccca

SEQ ID NO: 2808531 - RNA, 19 nt, Human
gcugggugacagagcgaga

SEQ ID NO: 2808532 - RNA, 21 nt, Human
gcuggguuggaggguguccca

SEQ ID NO: 2808533 - RNA, 14 nt, Human
gcuggguuggaggg

SEQ ID NO: 2808534 - RNA, 16 nt, Human
gcuguaacuuaaaaua

SEQ ID NO: 2808535 - RNA, 13 nt, Human
gcuguaagaaauc

SEQ ID NO: 2808536 - RNA, 15 nt, Human
gcuguaaaacgcugu

SEQ ID NO: 2808537 - RNA, 23 nt, Human
gcuguaucccaugagccucagca

SEQ ID NO: 2808538 - RNA, 20 nt, Human
gcuguaucccaugagccuca

SEQ ID NO: 2808539 - RNA, 15 nt, Human
gcuguaugcugauca

SEQ ID NO: 2808540 - RNA, 13 nt, Human
gcuguaaggcucu

SEQ ID NO: 2808541 - RNA, 15 nt, Human
gcuguaaggcucuag

SEQ ID NO: 2808542 - RNA, 16 nt, Human
gcuguaaggcucuaga

SEQ ID NO: 2808543 - RNA, 17 nt, Human
gcuguaaggcucuagau

SEQ ID NO: 2808544 - RNA, 23 nt, Human
gcuguaaggcucuagaucauaag

SEQ ID NO: 2808545 - RNA, 15 nt, Human
gcuguaagaugucug

SEQ ID NO: 2808546 - RNA, 16 nt, Human
gcuguaagaugucugu

SEQ ID NO: 2808547 - RNA, 14 nt, Human
gcuguaagcuccuu

SEQ ID NO: 2808548 - RNA, 14 nt, Human
gcuucacuguauaa

SEQ ID NO: 2808549 - RNA, 15 nt, Human
gcuucacuguauaaa

SEQ ID NO: 2808550 - RNA, 16 nt, Human
gcuucacuguauaaau

SEQ ID NO: 2808551 - RNA, 17 nt, Human
gcuucacuguauaaaua

SEQ ID NO: 2808552 - RNA, 18 nt, Human
gcuucagauguggagcca

SEQ ID NO: 2808553 - RNA, 19 nt, Human
gcuucagauguggagccag

SEQ ID NO: 2808554 - RNA, 20 nt, Human
gcuucagauguggagccagg

SEQ ID NO: 2808555 - RNA, 21 nt, Human
gcuucagauguggagccaggc

SEQ ID NO: 2808556 - RNA, 22 nt, Human
gcuuaaauauaguuccuaagaa

SEQ ID NO: 2808557 - RNA, 23 nt, Human
gcuuaaauauaguuccuaagaag

SEQ ID NO: 2808558 - RNA, 19 nt, Human
gcuuaaaauaaacaguugu

SEQ ID NO: 2808559 - RNA, 22 nt, Human
gcuuaaaauaaacaguugugaa

SEQ ID NO: 2808560 - RNA, 16 nt, Human
gcuucaauaaaucuuu

SEQ ID NO: 2808561 - RNA, 18 nt, Human
gcuucacaguagagccag

SEQ ID NO: 2808562 - RNA, 17 nt, Human
gcuucacaguagagcca

SEQ ID NO: 2808563 - RNA, 19 nt, Human
gcuucaauaguucaaggaa

SEQ ID NO: 2808564 - RNA, 15 nt, Human
gcuucaauuaauaaa

SEQ ID NO: 2808565 - RNA, 20 nt, Human
gcuucaccccaaucccagcu

SEQ ID NO: 2808566 - RNA, 22 nt, Human
gcuucacaguagagccagcuug

SEQ ID NO: 2808567 - RNA, 13 nt, Human
gcuucacagugau

SEQ ID NO: 2808568 - RNA, 21 nt, Human
gcuucacaguagagccagcuu

SEQ ID NO: 2808569 - RNA, 20 nt, Human
gcuucacaguagagccagcu

SEQ ID NO: 2808570 - RNA, 19 nt, Human
gcuucacaguagagccagc

SEQ ID NO: 2808571 - RNA, 19 nt, Human
gcuucaccccaaucccagc

SEQ ID NO: 2808572 - RNA, 14 nt, Human
gcuucaccagagca

SEQ ID NO: 2808573 - RNA, 15 nt, Human
gcuucaccagagcau

SEQ ID NO: 2808574 - RNA, 16 nt, Human
gcugugagccccuggu

SEQ ID NO: 2808575 - RNA, 20 nt, Human
gcugugagccccugguccug

SEQ ID NO: 2808576 - RNA, 15 nt, Human
gcuguggaagcaaca

SEQ ID NO: 2808577 - RNA, 19 nt, Human
gcuguggagacaaugucug

SEQ ID NO: 2808578 - RNA, 20 nt, Human
gcuguggagacaaugucugc

SEQ ID NO: 2808579 - RNA, 21 nt, Human
gcuguggagacaaugucugca

SEQ ID NO: 2808580 - RNA, 23 nt, Human
gcuguggagacaaugucugcagc

SEQ ID NO: 2808581 - RNA, 17 nt, Human
gcuguggaggauugcua

SEQ ID NO: 2808582 - RNA, 23 nt, Human
gcuguggaggauugcuaucugga

SEQ ID NO: 2808583 - RNA, 22 nt, Human
gcuguuggcugggggccucagu

SEQ ID NO: 2808584 - RNA, 21 nt, Human
gcuguuggcugggggccucag

SEQ ID NO: 2808585 - RNA, 15 nt, Human
gcuguuguacauuua

SEQ ID NO: 2808586 - RNA, 16 nt, Human
gcuguuguacauuuau

SEQ ID NO: 2808587 - RNA, 12 nt, Human
gcuguuguacau

SEQ ID NO: 2808588 - RNA, 12 nt, Human
gcuguuggucau

SEQ ID NO: 2808589 - RNA, 13 nt, Human
gcuguuguacauu

SEQ ID NO: 2808590 - RNA, 14 nt, Human
gcuguuguacauuu

SEQ ID NO: 2808591 - RNA, 21 nt, Human
gcugugcucuggacaggcaug

SEQ ID NO: 2808592 - RNA, 13 nt, Human
gcugugcugcccu

SEQ ID NO: 2808593 - RNA, 18 nt, Human
gcugugcucuggacaggc

SEQ ID NO: 2808594 - RNA, 17 nt, Human
gcugugaacugaaauua

SEQ ID NO: 2808595 - RNA, 13 nt, Human
gcugugaacaggc

SEQ ID NO: 2808596 - RNA, 16 nt, Human
gcugugaacaggcugg

SEQ ID NO: 2808597 - RNA, 16 nt, Human
gcugugacuucuccag

SEQ ID NO: 2808598 - RNA, 17 nt, Human
gcugugacuucuccagg

SEQ ID NO: 2808599 - RNA, 12 nt, Human
gcugugagcccc

SEQ ID NO: 2808600 - RNA, 15 nt, Human
gcugugagccccugg

SEQ ID NO: 2808601 - RNA, 11 nt, Human
gcuaguauuug

SEQ ID NO: 2808602 - RNA, 14 nt, Human
gcuaguauuugaau

SEQ ID NO: 2808603 - RNA, 15 nt, Human
gcuaguauuugaauu

SEQ ID NO: 2808604 - RNA, 16 nt, Human
gcuaguauuugaauua

SEQ ID NO: 2808605 - RNA, 18 nt, Human
gcuaguauuugaauuaaa

SEQ ID NO: 2808606 - RNA, 22 nt, Human
gcuaguauuugaauuaaaacuu

SEQ ID NO: 2808607 - RNA, 18 nt, Human
gcuaugggagccccaggg

SEQ ID NO: 2808608 - RNA, 17 nt, Human
gcuaugggagccccagg

SEQ ID NO: 2808609 - RNA, 15 nt, Human
gcuaggccuggccag

SEQ ID NO: 2808610 - RNA, 14 nt, Human
gcuaggccuggcca

SEQ ID NO: 2808611 - RNA, 22 nt, Human
gcuaggaccccuccaugugggc

SEQ ID NO: 2808612 - RNA, 15 nt, Human
gcuauuuauuuuccu

SEQ ID NO: 2808613 - RNA, 21 nt, Human
gcuauugucaccagggcugga

SEQ ID NO: 2808614 - RNA, 20 nt, Human
gcuauugucaccagggcugg

SEQ ID NO: 2808615 - RNA, 20 nt, Human
gcuauuuauuuuccuaaaga

SEQ ID NO: 2808616 - RNA, 16 nt, Human
gcuauuuauuuuccua

SEQ ID NO: 2808617 - RNA, 22 nt, Human
gcuauuuauuuuccuaaagaga

SEQ ID NO: 2808618 - RNA, 14 nt, Human
gcuauggugggaga

SEQ ID NO: 2808619 - RNA, 16 nt, Human
gcuauguuacuauuuu

SEQ ID NO: 2808620 - RNA, 17 nt, Human
gcuauguuacuauuuuc

SEQ ID NO: 2808621 - RNA, 16 nt, Human
gcuauugucaccaggg

SEQ ID NO: 2808622 - RNA, 21 nt, Human
gcuaugggagccccagggucu

SEQ ID NO: 2808623 - RNA, 19 nt, Human
gcuaugggagccccagggu

SEQ ID NO: 2808624 - RNA, 19 nt, Human
gccuguucagcuccagcuc

SEQ ID NO: 2808625 - RNA, 23 nt, Human
gccuguguggccacuucugucca

SEQ ID NO: 2808626 - RNA, 20 nt, Human
gccuguucagcuccagcuca

SEQ ID NO: 2808627 - RNA, 20 nt, Human
gccuguuaggagaagcugca

SEQ ID NO: 2808628 - RNA, 21 nt, Human
gcucaggucacauaaaacuuu

SEQ ID NO: 2808629 - RNA, 22 nt, Human
gcucacgccuaugaucccagca

SEQ ID NO: 2808630 - RNA, 21 nt, Human
gcucacgccuaugaucccagc

SEQ ID NO: 2808631 - RNA, 18 nt, Human
gcucacgcuucacaguga

SEQ ID NO: 2808632 - RNA, 19 nt, Human
gcucaggacucagaagccu

SEQ ID NO: 2808633 - RNA, 16 nt, Human
gcucaggacucagaag

SEQ ID NO: 2808634 - RNA, 18 nt, Human
gcucaggacucagaagcc

SEQ ID NO: 2808635 - RNA, 17 nt, Human
gcucaggacucagaagc

SEQ ID NO: 2808636 - RNA, 17 nt, Human
gcuccucuguccugcuu

SEQ ID NO: 2808637 - RNA, 19 nt, Human
gcuccucuguccugcuucu

SEQ ID NO: 2808638 - RNA, 20 nt, Human
gcuccucuguccugcuucug

SEQ ID NO: 2808639 - RNA, 18 nt, Human
gcuccucuccuggaggau

SEQ ID NO: 2808640 - RNA, 14 nt, Human
gcuccucuccugga

SEQ ID NO: 2808641 - RNA, 15 nt, Human
gcuccucuccuggag

SEQ ID NO: 2808642 - RNA, 16 nt, Human
gcuccucuccuggagg

SEQ ID NO: 2808643 - RNA, 17 nt, Human
gcuccucuccuggagga

SEQ ID NO: 2808644 - RNA, 22 nt, Human
gcuccugccaccacgcccggcu

SEQ ID NO: 2808645 - RNA, 21 nt, Human
gcuccugccaccacgcccggc

SEQ ID NO: 2808646 - RNA, 19 nt, Human
gcuccugccaguguggaac

SEQ ID NO: 2808647 - RNA, 14 nt, Human
gcuccucuguggug

SEQ ID NO: 2808648 - RNA, 19 nt, Human
gcuccucuguggugucugc

SEQ ID NO: 2808649 - RNA, 20 nt, Human
gcuccucuguggugucugcc

SEQ ID NO: 2808650 - RNA, 15 nt, Human
gcucuaagucucaac

SEQ ID NO: 2808651 - RNA, 12 nt, Human
gcucuaauaaaa

SEQ ID NO: 2808652 - RNA, 23 nt, Human
gcucggaggcugcccccggcccc

SEQ ID NO: 2808653 - RNA, 17 nt, Human
gcucggaggcugccccc

SEQ ID NO: 2808654 - RNA, 18 nt, Human
gcucggaggcugcccccg

SEQ ID NO: 2808655 - RNA, 14 nt, Human
gcucggaggcugcc

SEQ ID NO: 2808656 - RNA, 15 nt, Human
gcucggaggcugccc

SEQ ID NO: 2808657 - RNA, 16 nt, Human
gcucggaggcugcccc

SEQ ID NO: 2808658 - RNA, 14 nt, Human
gcuccccagcccug

SEQ ID NO: 2808659 - RNA, 15 nt, Human
gcuccccagcccugg

SEQ ID NO: 2808660 - RNA, 16 nt, Human
gcuccccagcccuggc

SEQ ID NO: 2808661 - RNA, 18 nt, Human
gcuccccagcccuggcuc

SEQ ID NO: 2808662 - RNA, 20 nt, Human
gcuccccagcccuggcucug

SEQ ID NO: 2808663 - RNA, 19 nt, Human
gcuccccagcccuggcucu

SEQ ID NO: 2808664 - RNA, 20 nt, Human
gcucuacagcuaaucagcau

SEQ ID NO: 2808665 - RNA, 22 nt, Human
gcucuacagcuaaucagcauuc

SEQ ID NO: 2808666 - RNA, 16 nt, Human
gcucuacaucuucugc

SEQ ID NO: 2808667 - RNA, 18 nt, Human
gcucucagcucagcgcca

SEQ ID NO: 2808668 - RNA, 20 nt, Human
gcucugacagaaagcagaua

SEQ ID NO: 2808669 - RNA, 15 nt, Human
gcucugacccaguga

SEQ ID NO: 2808670 - RNA, 17 nt, Human
gcucugacccagugaga

SEQ ID NO: 2808671 - RNA, 17 nt, Human
gcucugacuuuacacuc

SEQ ID NO: 2808672 - RNA, 14 nt, Human
gcucugagaagagg

SEQ ID NO: 2808673 - RNA, 22 nt, Human
gcucugagaagaggagcccuca

SEQ ID NO: 2808674 - RNA, 20 nt, Human
gcucugcaggcuuaauaaaa

SEQ ID NO: 2808675 - RNA, 15 nt, Human
gcucugcaccccucu

SEQ ID NO: 2808676 - RNA, 17 nt, Human
gcucugcaccccucugc

SEQ ID NO: 2808677 - RNA, 23 nt, Human
gcucugcaauuccccucugcugc

SEQ ID NO: 2808678 - RNA, 18 nt, Human
gcucugcaauuccccucu

SEQ ID NO: 2808679 - RNA, 16 nt, Human
gcucugacagaaagca

SEQ ID NO: 2808680 - RNA, 21 nt, Human
gcucugagagucuagauucuc

SEQ ID NO: 2808681 - RNA, 20 nt, Human
gcucugagcaaauguggcuc

SEQ ID NO: 2808682 - RNA, 21 nt, Human
gcucugagcaaauguggcucc

SEQ ID NO: 2808683 - RNA, 13 nt, Human
gcucugagagucu

SEQ ID NO: 2808684 - RNA, 14 nt, Human
gcucugagagucua

SEQ ID NO: 2808685 - RNA, 18 nt, Human
gcucugagagucuagauu

SEQ ID NO: 2808686 - RNA, 20 nt, Human
gcucugagagucuagauucu

SEQ ID NO: 2808687 - RNA, 16 nt, Human
gcucuguccugggagu

SEQ ID NO: 2808688 - RNA, 19 nt, Human
gcucugucgcccaggcugg

SEQ ID NO: 2808689 - RNA, 16 nt, Human
gcucuguguugccaug

SEQ ID NO: 2808690 - RNA, 17 nt, Human
gcucuguguugccaugu

SEQ ID NO: 2808691 - RNA, 17 nt, Human
gcucuguuacccagggu

SEQ ID NO: 2808692 - RNA, 23 nt, Human
gcucuguuacccaggguggagug

SEQ ID NO: 2808693 - RNA, 14 nt, Human
gcucuguccuggga

SEQ ID NO: 2808694 - RNA, 15 nt, Human
gcucuguccugggag

SEQ ID NO: 2808695 - RNA, 22 nt, Human
gcucugccaacuucuucagagc

SEQ ID NO: 2808696 - RNA, 13 nt, Human
gcucuucaucugc

SEQ ID NO: 2808697 - RNA, 17 nt, Human
gcucuucaucugcccaa

SEQ ID NO: 2808698 - RNA, 13 nt, Human
gcugaaaguucuu

SEQ ID NO: 2808699 - RNA, 12 nt, Human
gcucuucaggcc

SEQ ID NO: 2808700 - RNA, 18 nt, Human
gcucuucaggccucccuc

SEQ ID NO: 2808701 - RNA, 15 nt, Human
gcucuucaggccucc

SEQ ID NO: 2808702 - RNA, 13 nt, Human
gcucuuaaaugua

SEQ ID NO: 2808703 - RNA, 16 nt, Human
gcugacagacacaggc

SEQ ID NO: 2808704 - RNA, 15 nt, Human
gcugacagacacagg

SEQ ID NO: 2808705 - RNA, 14 nt, Human
gcugacagacacag

SEQ ID NO: 2808706 - RNA, 13 nt, Human
gcugaaugccucc

SEQ ID NO: 2808707 - RNA, 14 nt, Human
gcugaaugccuccu

SEQ ID NO: 2808708 - RNA, 19 nt, Human
gcugaaugccuccuguggg

SEQ ID NO: 2808709 - RNA, 23 nt, Human
gccagaaguuguggauuucaguu

SEQ ID NO: 2808710 - RNA, 15 nt, Human
gccagaaucagcaca

SEQ ID NO: 2808711 - RNA, 20 nt, Human
gccagaaucagcacagauaa

SEQ ID NO: 2808712 - RNA, 22 nt, Human
gccagaaucagcacagauaaaa

SEQ ID NO: 2808713 - RNA, 15 nt, Human
gccagaauuucaaac

SEQ ID NO: 2808714 - RNA, 19 nt, Human
gccagaagauccccucagg

SEQ ID NO: 2808715 - RNA, 17 nt, Human
gccagaagauccccuca

SEQ ID NO: 2808716 - RNA, 18 nt, Human
gccagaagauccccucag

SEQ ID NO: 2808717 - RNA, 16 nt, Human
gccagcaacacagagc

SEQ ID NO: 2808718 - RNA, 17 nt, Human
gccagcaacacagagca

SEQ ID NO: 2808719 - RNA, 23 nt, Human
gccagaccaacguuacucagggc

SEQ ID NO: 2808720 - RNA, 23 nt, Human
gccagcaaagaggacucgcuugu

SEQ ID NO: 2808721 - RNA, 13 nt, Human
gccagcaaugaca

SEQ ID NO: 2808722 - RNA, 20 nt, Human
gccagcaaugacaucucagg

SEQ ID NO: 2808723 - RNA, 23 nt, Human
gccagcaaugacaucucaggggc

SEQ ID NO: 2808724 - RNA, 18 nt, Human
gccagcaccacuuccuuu

SEQ ID NO: 2808725 - RNA, 19 nt, Human
gccagcagcagcaggugau

SEQ ID NO: 2808726 - RNA, 16 nt, Human
gccagcagcagcaggu

SEQ ID NO: 2808727 - RNA, 15 nt, Human
gccagcagcagcagg

SEQ ID NO: 2808728 - RNA, 13 nt, Human
gccagcagcagca

SEQ ID NO: 2808729 - RNA, 15 nt, Human
gccagcacuuguaua

SEQ ID NO: 2808730 - RNA, 16 nt, Human
gccagcacuuguauau

SEQ ID NO: 2808731 - RNA, 13 nt, Human
gccaggccgggcc

SEQ ID NO: 2808732 - RNA, 15 nt, Human
gccaggccgggccug

SEQ ID NO: 2808733 - RNA, 18 nt, Human
gccaggccgggccuguac

SEQ ID NO: 2808734 - RNA, 21 nt, Human
gccaggccgggccuguacagu

SEQ ID NO: 2808735 - RNA, 21 nt, Human
gccaggccucucucaccucuc

SEQ ID NO: 2808736 - RNA, 20 nt, Human
gccaggagcucuucaggccu

SEQ ID NO: 2808737 - RNA, 16 nt, Human
gccagccacucuacca

SEQ ID NO: 2808738 - RNA, 21 nt, Human
gccagccacucuaccagugca

SEQ ID NO: 2808739 - RNA, 22 nt, Human
gccaggagcucuucaggccucc

SEQ ID NO: 2808740 - RNA, 23 nt, Human
gccaggagcugucaccaaggaaa

SEQ ID NO: 2808741 - RNA, 12 nt, Human
gccaggccagag

SEQ ID NO: 2808742 - RNA, 22 nt, Human
gccaggaucaugguguaauaag

SEQ ID NO: 2808743 - RNA, 24 nt, Human
gccaggaucaugguguaauaagac

SEQ ID NO: 2808744 - RNA, 19 nt, Human
gccaggaguuugagaccag

SEQ ID NO: 2808745 - RNA, 17 nt, Human
gccaggaucauggugua

SEQ ID NO: 2808746 - RNA, 19 nt, Human
gccaggaucaugguguaau

SEQ ID NO: 2808747 - RNA, 22 nt, Human
gccaggagggcguucuuaggcu

SEQ ID NO: 2808748 - RNA, 23 nt, Human
gccaggccggcgagcccugugga

SEQ ID NO: 2808749 - RNA, 20 nt, Human
gccaggccggcgagcccugu

SEQ ID NO: 2808750 - RNA, 19 nt, Human
gccaggccggcgagcccug

SEQ ID NO: 2808751 - RNA, 13 nt, Human
gccaggccagagg

SEQ ID NO: 2808752 - RNA, 20 nt, Human
gccauauucuguuggccagu

SEQ ID NO: 2808753 - RNA, 19 nt, Human
gccauauucuguuggccag

SEQ ID NO: 2808754 - RNA, 15 nt, Human
gccauguagaagcug

SEQ ID NO: 2808755 - RNA, 16 nt, Human
gccauguagaagcugc

SEQ ID NO: 2808756 - RNA, 18 nt, Human
gccauguagaagcugcau

SEQ ID NO: 2808757 - RNA, 17 nt, Human
gccauguauaaauguga

SEQ ID NO: 2808758 - RNA, 19 nt, Human
gccauguauaaaugugaua

SEQ ID NO: 2808759 - RNA, 17 nt, Human
gccauguacagacagag

SEQ ID NO: 2808760 - RNA, 15 nt, Human
gccauguaccucccc

SEQ ID NO: 2808761 - RNA, 16 nt, Human
gccauguaccuccccu

SEQ ID NO: 2808762 - RNA, 17 nt, Human
gccauguaccuccccug

SEQ ID NO: 2808763 - RNA, 20 nt, Human
gccauguaccuccccugccu

SEQ ID NO: 2808764 - RNA, 21 nt, Human
gccauguaccuccccugccuu

SEQ ID NO: 2808765 - RNA, 15 nt, Human
gccauguacuaguuu

SEQ ID NO: 2808766 - RNA, 17 nt, Human
gccauguacuaguuuua

SEQ ID NO: 2808767 - RNA, 18 nt, Human
gccauguuggccaggcug

SEQ ID NO: 2808768 - RNA, 17 nt, Human
gccauguuggccaggcu

SEQ ID NO: 2808769 - RNA, 16 nt, Human
gccauguuggccaggc

SEQ ID NO: 2808770 - RNA, 15 nt, Human
gccauguuggccagg

SEQ ID NO: 2808771 - RNA, 14 nt, Human
gccauguuggccag

SEQ ID NO: 2808772 - RNA, 14 nt, Human
gccaugugacucug

SEQ ID NO: 2808773 - RNA, 15 nt, Human
gccaugugacucugg

SEQ ID NO: 2808774 - RNA, 18 nt, Human
gccaugugacucuggcuu

SEQ ID NO: 2808775 - RNA, 23 nt, Human
gccaugugacucuggcuuggccu

SEQ ID NO: 2808776 - RNA, 15 nt, Human
gccauguccaaagag

SEQ ID NO: 2808777 - RNA, 14 nt, Human
gccauguccaaaga

SEQ ID NO: 2808778 - RNA, 19 nt, Human
gccauguccaaagaggcug

SEQ ID NO: 2808779 - RNA, 18 nt, Human
gccauguccaaagaggcu

SEQ ID NO: 2808780 - RNA, 22 nt, Human
gccauguccaaagaggcugccc

SEQ ID NO: 2808781 - RNA, 24 nt, Human
gccauguuggccaggcuggucuca

SEQ ID NO: 2808782 - RNA, 22 nt, Human
gccauguuggccaggcuggucu

SEQ ID NO: 2808783 - RNA, 20 nt, Human
gccauguuggccaggcuggu

SEQ ID NO: 2808784 - RNA, 19 nt, Human
gccauguuggccaggcugg

SEQ ID NO: 2808785 - RNA, 20 nt, Human
gccauuauuuucugucagau

SEQ ID NO: 2808786 - RNA, 22 nt, Human
gccauuauuuucugucagauga

SEQ ID NO: 2808787 - RNA, 18 nt, Human
gccauuccccgucucugg

SEQ ID NO: 2808788 - RNA, 17 nt, Human
gccauuccccgucucug

SEQ ID NO: 2808789 - RNA, 18 nt, Human
gcccaccuuggcucaagu

SEQ ID NO: 2808790 - RNA, 17 nt, Human
gcccacgcuggagugca

SEQ ID NO: 2808791 - RNA, 16 nt, Human
gcccacgcuggagugc

SEQ ID NO: 2808792 - RNA, 15 nt, Human
gcccacgcuggagug

SEQ ID NO: 2808793 - RNA, 22 nt, Human
gccauucugccgcccccuccug

SEQ ID NO: 2808794 - RNA, 14 nt, Human
gccaccaaagcugc

SEQ ID NO: 2808795 - RNA, 12 nt, Human
gccacauuuaau

SEQ ID NO: 2808796 - RNA, 19 nt, Human
gccacauuuggaauacuuu

SEQ ID NO: 2808797 - RNA, 22 nt, Human
gccacauuuggaauacuuuuug

SEQ ID NO: 2808798 - RNA, 16 nt, Human
gccacauuugguucua

SEQ ID NO: 2808799 - RNA, 16 nt, Human
gccacauuuucagcca

SEQ ID NO: 2808800 - RNA, 17 nt, Human
gccacauuuucagccaa

SEQ ID NO: 2808801 - RNA, 14 nt, Human
gccacauuuggaau

SEQ ID NO: 2808802 - RNA, 14 nt, Human
gccacauuagaacu

SEQ ID NO: 2808803 - RNA, 15 nt, Human
gccacauuagaacuu

SEQ ID NO: 2808804 - RNA, 16 nt, Human
gccacauuagaacuuc

SEQ ID NO: 2808805 - RNA, 23 nt, Human
gccacauuagaacuucuccgucc

SEQ ID NO: 2808806 - RNA, 20 nt, Human
gccaccaggugccuuucaaa

SEQ ID NO: 2808807 - RNA, 21 nt, Human
gccaccaggugccuuucaaau

SEQ ID NO: 2808808 - RNA, 22 nt, Human
gccaccauauucagugcugugg

SEQ ID NO: 2808809 - RNA, 23 nt, Human
gccaccauauucagugcuguggc

SEQ ID NO: 2808810 - RNA, 18 nt, Human
gccaccauccuauugcaa

SEQ ID NO: 2808811 - RNA, 18 nt, Human
gccaccauggccagccaa

SEQ ID NO: 2808812 - RNA, 17 nt, Human
gccaccauggccagcca

SEQ ID NO: 2808813 - RNA, 16 nt, Human
gccaccauggccagcc

SEQ ID NO: 2808814 - RNA, 14 nt, Human
gccaccauggccag

SEQ ID NO: 2808815 - RNA, 19 nt, Human
gccaccagcucugccgucu

SEQ ID NO: 2808816 - RNA, 22 nt, Human
gccaccaggaucagccaggagg

SEQ ID NO: 2808817 - RNA, 17 nt, Human
gccaccagcucugccgu

SEQ ID NO: 2808818 - RNA, 15 nt, Human
gccaccagcucugcc

SEQ ID NO: 2808819 - RNA, 10 nt, Human
gccaccagcg

SEQ ID NO: 2808820 - RNA, 19 nt, Human
gccaccagagaccguccuc

SEQ ID NO: 2808821 - RNA, 21 nt, Human
gccaccagagaccguccucac

SEQ ID NO: 2808822 - RNA, 22 nt, Human
gccaccagagaccguccucacc

SEQ ID NO: 2808823 - RNA, 23 nt, Human
gccaccagagaccguccucaccc

SEQ ID NO: 2808824 - RNA, 15 nt, Human
gccaccacguccagc

SEQ ID NO: 2808825 - RNA, 14 nt, Human
gccaccacguccag

SEQ ID NO: 2808826 - RNA, 16 nt, Human
gccaccacguccagcu

SEQ ID NO: 2808827 - RNA, 12 nt, Human
gccaccagagac

SEQ ID NO: 2808828 - RNA, 12 nt, Human
gccaccaccucu

SEQ ID NO: 2808829 - RNA, 14 nt, Human
gccaccaccucugu

SEQ ID NO: 2808830 - RNA, 16 nt, Human
gccaccaccucugugg

SEQ ID NO: 2808831 - RNA, 18 nt, Human
gccaccaccucuguggca

SEQ ID NO: 2808832 - RNA, 14 nt, Human
gccaccacgcccgg

SEQ ID NO: 2808833 - RNA, 13 nt, Human
gccaccacgcccg

SEQ ID NO: 2808834 - RNA, 19 nt, Human
gccaccaaagcugcccacu

SEQ ID NO: 2808835 - RNA, 17 nt, Human
gccaccaaagcugccca

SEQ ID NO: 2808836 - RNA, 16 nt, Human
gccaccaaagcugccc

SEQ ID NO: 2808837 - RNA, 15 nt, Human
gccaccaaagcugcc

SEQ ID NO: 2808838 - RNA, 20 nt, Human
gccaccaaagcugcccacug

SEQ ID NO: 2808839 - RNA, 16 nt, Human
gccacuucggccaggu

SEQ ID NO: 2808840 - RNA, 21 nt, Human
gccacuugaugacccccaacc

SEQ ID NO: 2808841 - RNA, 15 nt, Human
gccacuucuguccau

SEQ ID NO: 2808842 - RNA, 16 nt, Human
gccacuucuguccaua

SEQ ID NO: 2808843 - RNA, 17 nt, Human
gccacuucuguccauau

SEQ ID NO: 2808844 - RNA, 15 nt, Human
gccacuugaaauguu

SEQ ID NO: 2808845 - RNA, 21 nt, Human
gccacuugaacaaaaucuguu

SEQ ID NO: 2808846 - RNA, 22 nt, Human
gccacuugaacaaaaucuguug

SEQ ID NO: 2808847 - RNA, 23 nt, Human
gccacuuuugacuagggauucag

SEQ ID NO: 2808848 - RNA, 23 nt, Human
gccacuuugguacauggccagug

SEQ ID NO: 2808849 - RNA, 22 nt, Human
gccacuuugguacauggccagu

SEQ ID NO: 2808850 - RNA, 21 nt, Human
gccacuuugguacauggccag

SEQ ID NO: 2808851 - RNA, 23 nt, Human
gccacuuuacccaccuagaacac

SEQ ID NO: 2808852 - RNA, 18 nt, Human
gccacuuuacccaccuag

SEQ ID NO: 2808853 - RNA, 15 nt, Human
gccacuuuaagagag

SEQ ID NO: 2808854 - RNA, 17 nt, Human
gccacuuuaagagagaa

SEQ ID NO: 2808855 - RNA, 19 nt, Human
gccacuuuaagagagaaau

SEQ ID NO: 2808856 - RNA, 20 nt, Human
gccacuuuaagagagaaauc

SEQ ID NO: 2808857 - RNA, 22 nt, Human
gccacuuuaagagagaaaucug

SEQ ID NO: 2808858 - RNA, 20 nt, Human
gccacuuuacccaccuagaa

SEQ ID NO: 2808859 - RNA, 19 nt, Human
gccacuuuacccaccuaga

SEQ ID NO: 2808860 - RNA, 22 nt, Human
gccacuuuacccaccuagaaca

SEQ ID NO: 2808861 - RNA, 14 nt, Human
gccacuuugcacga

SEQ ID NO: 2808862 - RNA, 21 nt, Human
gccacuuugcacgacgcccuc

SEQ ID NO: 2808863 - RNA, 23 nt, Human
gccacuuugcacgacgcccucuc

SEQ ID NO: 2808864 - RNA, 19 nt, Human
gccacugcucuccagccug

SEQ ID NO: 2808865 - RNA, 16 nt, Human
gccacugugguggcag

SEQ ID NO: 2808866 - RNA, 12 nt, Human
gccacugcuccc

SEQ ID NO: 2808867 - RNA, 21 nt, Human
gccacugcucccuaagccagc

SEQ ID NO: 2808868 - RNA, 22 nt, Human
gccacugcucccuaagccagcc

SEQ ID NO: 2808869 - RNA, 23 nt, Human
gccacugcucccuaagccagccu

SEQ ID NO: 2808870 - RNA, 12 nt, Human
gccacugccucu

SEQ ID NO: 2808871 - RNA, 13 nt, Human
gccacugccucuu

SEQ ID NO: 2808872 - RNA, 16 nt, Human
gccacugccucuuccu

SEQ ID NO: 2808873 - RNA, 17 nt, Human
gccacugccucuuccuc

SEQ ID NO: 2808874 - RNA, 23 nt, Human
gccacugcaccgggccacagaga

SEQ ID NO: 2808875 - RNA, 19 nt, Human
gccacccuggggagaaagu

SEQ ID NO: 2808876 - RNA, 13 nt, Human
gccacccugggga

SEQ ID NO: 2808877 - RNA, 21 nt, Human
gccacugcacuauagccuagg

SEQ ID NO: 2808878 - RNA, 18 nt, Human
gccacugcacuccagccu

SEQ ID NO: 2808879 - RNA, 19 nt, Human
gccacugcauaccaaccug

SEQ ID NO: 2808880 - RNA, 22 nt, Human
gccacugcacuccagccugggc

SEQ ID NO: 2808881 - RNA, 21 nt, Human
gccacugcacuccagccuggg

SEQ ID NO: 2808882 - RNA, 20 nt, Human
gccacugcacuccagccugg

SEQ ID NO: 2808883 - RNA, 19 nt, Human
gccacugcacuccagccug

SEQ ID NO: 2808884 - RNA, 15 nt, Human
gccaccccacccucc

SEQ ID NO: 2808885 - RNA, 18 nt, Human
gccaccccacccucccug

SEQ ID NO: 2808886 - RNA, 13 nt, Human
gccacccagguga

SEQ ID NO: 2808887 - RNA, 19 nt, Human
gccaccccgggcucucugc

SEQ ID NO: 2808888 - RNA, 18 nt, Human
gccaccccgggcucucug

SEQ ID NO: 2808889 - RNA, 20 nt, Human
gccaccccacccucccugga

SEQ ID NO: 2808890 - RNA, 21 nt, Human
gccaccccacccucccuggag

SEQ ID NO: 2808891 - RNA, 22 nt, Human
gccaccccacccucccuggagu

SEQ ID NO: 2808892 - RNA, 12 nt, Human
gccaccccacuu

SEQ ID NO: 2808893 - RNA, 12 nt, Human
gccacccuagcc

SEQ ID NO: 2808894 - RNA, 22 nt, Human
gccacccuagccaaugucuccu

SEQ ID NO: 2808895 - RNA, 21 nt, Human
gccaccccgggcucucugcug

SEQ ID NO: 2808896 - RNA, 18 nt, Human
gcacuuggagacuuguau

SEQ ID NO: 2808897 - RNA, 14 nt, Human
gcccauguucugcc

SEQ ID NO: 2808898 - RNA, 15 nt, Human
gcccauguucugccc

SEQ ID NO: 2808899 - RNA, 16 nt, Human
gcccauguucugcccc

SEQ ID NO: 2808900 - RNA, 19 nt, Human
gcccauguucugcccccag

SEQ ID NO: 2808901 - RNA, 20 nt, Human
gcccauguucugcccccagc

SEQ ID NO: 2808902 - RNA, 22 nt, Human
gcccauuucgugagccccaucu

SEQ ID NO: 2808903 - RNA, 14 nt, Human
gcccauuucuccag

SEQ ID NO: 2808904 - RNA, 15 nt, Human
gcccauuucuccaga

SEQ ID NO: 2808905 - RNA, 16 nt, Human
gcccauuucuccagaa

SEQ ID NO: 2808906 - RNA, 18 nt, Human
gcccauuucuccagaacc

SEQ ID NO: 2808907 - RNA, 14 nt, Human
gccccugcccggcu

SEQ ID NO: 2808908 - RNA, 13 nt, Human
gccccugcccggc

SEQ ID NO: 2808909 - RNA, 22 nt, Human
gcccccuccugaaccgcacagc

SEQ ID NO: 2808910 - RNA, 15 nt, Human
gcccccucucaggag

SEQ ID NO: 2808911 - RNA, 21 nt, Human
gcccccuccugaaccgcacag

SEQ ID NO: 2808912 - RNA, 15 nt, Human
gcccccuccugaacc

SEQ ID NO: 2808913 - RNA, 13 nt, Human
gcccccuccugaa

SEQ ID NO: 2808914 - RNA, 12 nt, Human
gcccccuccuga

SEQ ID NO: 2808915 - RNA, 19 nt, Human
gcccccuccucuagcugug

SEQ ID NO: 2808916 - RNA, 20 nt, Human
gcccccuccucuagcugugg

SEQ ID NO: 2808917 - RNA, 21 nt, Human
gcccccuccucuagcuguggg

SEQ ID NO: 2808918 - RNA, 16 nt, Human
gcccccuccucuagcu

SEQ ID NO: 2808919 - RNA, 17 nt, Human
gcccuacucccugcaga

SEQ ID NO: 2808920 - RNA, 16 nt, Human
gcccuacucccugcag

SEQ ID NO: 2808921 - RNA, 22 nt, Human
gcccuacucccugcagaugcca

SEQ ID NO: 2808922 - RNA, 20 nt, Human
gcccuacucccugcagaugc

SEQ ID NO: 2808923 - RNA, 21 nt, Human
gcccuacuucuuugcuuugcc

SEQ ID NO: 2808924 - RNA, 14 nt, Human
gcccuacuauucag

SEQ ID NO: 2808925 - RNA, 15 nt, Human
gcccuacucauuggg

SEQ ID NO: 2808926 - RNA, 16 nt, Human
gcccuacagagcugug

SEQ ID NO: 2808927 - RNA, 17 nt, Human
gcccuacagagcugugg

SEQ ID NO: 2808928 - RNA, 20 nt, Human
gcccuacagagcuguggagg

SEQ ID NO: 2808929 - RNA, 23 nt, Human
gcccuaaugcgcaggcuggcccu

SEQ ID NO: 2808930 - RNA, 15 nt, Human
gcccuaauucagcca

SEQ ID NO: 2808931 - RNA, 16 nt, Human
gcccuaauucagccau

SEQ ID NO: 2808932 - RNA, 22 nt, Human
gcccuaauucagccauguacag

SEQ ID NO: 2808933 - RNA, 23 nt, Human
gcccuaauucagccauguacaga

SEQ ID NO: 2808934 - RNA, 15 nt, Human
gcccuaaaagcacac

SEQ ID NO: 2808935 - RNA, 14 nt, Human
gcccguguacauag

SEQ ID NO: 2808936 - RNA, 17 nt, Human
gcccguguacauagugc

SEQ ID NO: 2808937 - RNA, 19 nt, Human
gcccguguacauagugcau

SEQ ID NO: 2808938 - RNA, 17 nt, Human
gcccacucugcucgccu

SEQ ID NO: 2808939 - RNA, 16 nt, Human
gcccacucagggguca

SEQ ID NO: 2808940 - RNA, 23 nt, Human
gcccacuagacccacuggacuca

SEQ ID NO: 2808941 - RNA, 17 nt, Human
gcccacuagacccacug

SEQ ID NO: 2808942 - RNA, 15 nt, Human
gcccacgucacgugu

SEQ ID NO: 2808943 - RNA, 22 nt, Human
gcccauggcccucccaguaccu

SEQ ID NO: 2808944 - RNA, 14 nt, Human
gcccauggcccugu

SEQ ID NO: 2808945 - RNA, 20 nt, Human
gcccaugggagcugguuaga

SEQ ID NO: 2808946 - RNA, 23 nt, Human
gcccugcugccgccucccagccu

SEQ ID NO: 2808947 - RNA, 22 nt, Human
gcccugcugccgccucccagcc

SEQ ID NO: 2808948 - RNA, 21 nt, Human
gcccugcugccgccucccagc

SEQ ID NO: 2808949 - RNA, 22 nt, Human
gcccugcugagucccaggcuga

SEQ ID NO: 2808950 - RNA, 21 nt, Human
gcccugcugagucccaggcug

SEQ ID NO: 2808951 - RNA, 23 nt, Human
gcccugcugagucccaggcugag

SEQ ID NO: 2808952 - RNA, 21 nt, Human
gcccuguucugggugcagcug

SEQ ID NO: 2808953 - RNA, 14 nt, Human
gcccuguugugcca

SEQ ID NO: 2808954 - RNA, 16 nt, Human
gcccuguugugccaca

SEQ ID NO: 2808955 - RNA, 17 nt, Human
gcccuguugugccacag

SEQ ID NO: 2808956 - RNA, 20 nt, Human
gcccuguugugccacagagu

SEQ ID NO: 2808957 - RNA, 22 nt, Human
gcccuguucucuaccaagcuau

SEQ ID NO: 2808958 - RNA, 16 nt, Human
gcccugcugaguccca

SEQ ID NO: 2808959 - RNA, 18 nt, Human
gccgccugguacucaagc

SEQ ID NO: 2808960 - RNA, 15 nt, Human
gccgccuuaagcuga

SEQ ID NO: 2808961 - RNA, 17 nt, Human
gccgccuuaagcugauc

SEQ ID NO: 2808962 - RNA, 22 nt, Human
gccgccuuccuugaccuuccuc

SEQ ID NO: 2808963 - RNA, 15 nt, Human
gccgcucuccugcca

SEQ ID NO: 2808964 - RNA, 16 nt, Human
gccgcucuccugccac

SEQ ID NO: 2808965 - RNA, 13 nt, Human
gccgccugcacuc

SEQ ID NO: 2808966 - RNA, 19 nt, Human
gccgccucccagccugggg

SEQ ID NO: 2808967 - RNA, 19 nt, Human
gccgccugcacuccucagg

SEQ ID NO: 2808968 - RNA, 18 nt, Human
gccgccugcacuccucag

SEQ ID NO: 2808969 - RNA, 22 nt, Human
gccgccugcacuccucagggca

SEQ ID NO: 2808970 - RNA, 13 nt, Human
gccgccugguacu

SEQ ID NO: 2808971 - RNA, 15 nt, Human
gccgccugguacuca

SEQ ID NO: 2808972 - RNA, 23 nt, Human
gccgcugugagccccugguccug

SEQ ID NO: 2808973 - RNA, 12 nt, Human
gccgcugugagc

SEQ ID NO: 2808974 - RNA, 17 nt, Human
gccgcugugagccccug

SEQ ID NO: 2808975 - RNA, 19 nt, Human
gccggccaauggaaaccuc

SEQ ID NO: 2808976 - RNA, 11 nt, Human
gccggccagcc

SEQ ID NO: 2808977 - RNA, 12 nt, Human
gccggccagcca

SEQ ID NO: 2808978 - RNA, 13 nt, Human
gccggccagccag

SEQ ID NO: 2808979 - RNA, 14 nt, Human
gccggccagccagc

SEQ ID NO: 2808980 - RNA, 15 nt, Human
gccggccagccagcc

SEQ ID NO: 2808981 - RNA, 17 nt, Human
gccggccagccagccac

SEQ ID NO: 2808982 - RNA, 18 nt, Human
gccgccauugccaccagg

SEQ ID NO: 2808983 - RNA, 17 nt, Human
gccgccauugccaccag

SEQ ID NO: 2808984 - RNA, 16 nt, Human
gccgccauugccacca

SEQ ID NO: 2808985 - RNA, 12 nt, Human
gcccugcugccc

SEQ ID NO: 2808986 - RNA, 16 nt, Human
gccgccaucagcccaa

SEQ ID NO: 2808987 - RNA, 21 nt, Human
gccgccauugccaccaggaga

SEQ ID NO: 2808988 - RNA, 13 nt, Human
gccgccucccagc

SEQ ID NO: 2808989 - RNA, 12 nt, Human
gccgccucccag

SEQ ID NO: 2808990 - RNA, 17 nt, Human
gccgccucccagccugg

SEQ ID NO: 2808991 - RNA, 16 nt, Human
gccgccucccagccug

SEQ ID NO: 2808992 - RNA, 15 nt, Human
gccgccucccagccu

SEQ ID NO: 2808993 - RNA, 14 nt, Human
gccgccucccagcc

SEQ ID NO: 2808994 - RNA, 17 nt, Human
gccugccuguucccauu

SEQ ID NO: 2808995 - RNA, 12 nt, Human
gccugccuggag

SEQ ID NO: 2808996 - RNA, 13 nt, Human
gccugccuggagc

SEQ ID NO: 2808997 - RNA, 14 nt, Human
gccugccuggagcg

SEQ ID NO: 2808998 - RNA, 14 nt, Human
gccugccuggcccc

SEQ ID NO: 2808999 - RNA, 15 nt, Human
gccugccuggccccu

SEQ ID NO: 2809000 - RNA, 16 nt, Human
gccugccuggccccuc

SEQ ID NO: 2809001 - RNA, 16 nt, Human
gccugccuugaagcca

SEQ ID NO: 2809002 - RNA, 23 nt, Human
gccugccuugaagccacugaagc

SEQ ID NO: 2809003 - RNA, 15 nt, Human
gccugggaggcacag

SEQ ID NO: 2809004 - RNA, 13 nt, Human
gccuggccggcca

SEQ ID NO: 2809005 - RNA, 14 nt, Human
gccuggccggccag

SEQ ID NO: 2809006 - RNA, 15 nt, Human
gccuggccggccagc

SEQ ID NO: 2809007 - RNA, 16 nt, Human
gccuggccggccagcc

SEQ ID NO: 2809008 - RNA, 17 nt, Human
gccuggccggccagcca

SEQ ID NO: 2809009 - RNA, 18 nt, Human
gccuggccggccagccag

SEQ ID NO: 2809010 - RNA, 20 nt, Human
gccuggccggccagccagcc

SEQ ID NO: 2809011 - RNA, 22 nt, Human
gccuggccggccagccagccac

SEQ ID NO: 2809012 - RNA, 23 nt, Human
gccuggccggccagccagccacu

SEQ ID NO: 2809013 - RNA, 12 nt, Human
gccuggccucca

SEQ ID NO: 2809014 - RNA, 13 nt, Human
gccuggccuccag

SEQ ID NO: 2809015 - RNA, 14 nt, Human
gccuggccuccagg

SEQ ID NO: 2809016 - RNA, 15 nt, Human
gccuggccuccaggc

SEQ ID NO: 2809017 - RNA, 16 nt, Human
gccuggccuccaggcc

SEQ ID NO: 2809018 - RNA, 17 nt, Human
gccuggccuccaggccc

SEQ ID NO: 2809019 - RNA, 18 nt, Human
gccuggccuccaggcccg

SEQ ID NO: 2809020 - RNA, 12 nt, Human
gccuggcccugc

SEQ ID NO: 2809021 - RNA, 15 nt, Human
gccuggcccugcccu

SEQ ID NO: 2809022 - RNA, 16 nt, Human
gccuggcccugcccug

SEQ ID NO: 2809023 - RNA, 17 nt, Human
gccuggcccugcccuga

SEQ ID NO: 2809024 - RNA, 19 nt, Human
gccuggcccugcccugagg

SEQ ID NO: 2809025 - RNA, 13 nt, Human
gccuggcuucugg

SEQ ID NO: 2809026 - RNA, 23 nt, Human
gccuggcuucuggagcccuuggg

SEQ ID NO: 2809027 - RNA, 20 nt, Human
gccuggcuucuuucucucag

SEQ ID NO: 2809028 - RNA, 22 nt, Human
gccuggcuucuggagcccuugg

SEQ ID NO: 2809029 - RNA, 18 nt, Human
gccuggcuucuggagccc

SEQ ID NO: 2809030 - RNA, 17 nt, Human
gccuggcuucuggagcc

SEQ ID NO: 2809031 - RNA, 16 nt, Human
gccuggcuucuggagc

SEQ ID NO: 2809032 - RNA, 15 nt, Human
gccuggcuucuggag

SEQ ID NO: 2809033 - RNA, 14 nt, Human
gccuggcuucugga

SEQ ID NO: 2809034 - RNA, 14 nt, Human
gccuaccugcucuc

SEQ ID NO: 2809035 - RNA, 13 nt, Human
gccuaccugcucu

SEQ ID NO: 2809036 - RNA, 19 nt, Human
gccuacucgcuugcuagaa

SEQ ID NO: 2809037 - RNA, 12 nt, Human
gccuccucaucc

SEQ ID NO: 2809038 - RNA, 15 nt, Human
gccuccucaucccgu

SEQ ID NO: 2809039 - RNA, 15 nt, Human
gccuccucguuccuu

SEQ ID NO: 2809040 - RNA, 19 nt, Human
gccuccucguuccuuucuc

SEQ ID NO: 2809041 - RNA, 14 nt, Human
gccuccugccugcc

SEQ ID NO: 2809042 - RNA, 17 nt, Human
gccuccucaucccgugu

SEQ ID NO: 2809043 - RNA, 22 nt, Human
gccuccucaucccguguucucc

SEQ ID NO: 2809044 - RNA, 11 nt, Human
gccucugcugc

SEQ ID NO: 2809045 - RNA, 15 nt, Human
gccucugcugccaug

SEQ ID NO: 2809046 - RNA, 12 nt, Human
gccucuggcuag

SEQ ID NO: 2809047 - RNA, 17 nt, Human
gccuccugccugccccu

SEQ ID NO: 2809048 - RNA, 23 nt, Human
gccuccugccugccccucucccg

SEQ ID NO: 2809049 - RNA, 14 nt, Human
gccuccuggguuca

SEQ ID NO: 2809050 - RNA, 16 nt, Human
gccuccuguguacugu

SEQ ID NO: 2809051 - RNA, 18 nt, Human
gccuccuguguacugugu

SEQ ID NO: 2809052 - RNA, 19 nt, Human
gccuccuguguacuguguc

SEQ ID NO: 2809053 - RNA, 12 nt, Human
gccuccuguggg

SEQ ID NO: 2809054 - RNA, 13 nt, Human
gccuccugugggg

SEQ ID NO: 2809055 - RNA, 14 nt, Human
gccuccugugggga

SEQ ID NO: 2809056 - RNA, 18 nt, Human
gccuccuguggggaaagg

SEQ ID NO: 2809057 - RNA, 21 nt, Human
gccucuggcuagaggccagcc

SEQ ID NO: 2809058 - RNA, 19 nt, Human
gccucuggcuagaggccag

SEQ ID NO: 2809059 - RNA, 18 nt, Human
gccucuggcuagaggcca

SEQ ID NO: 2809060 - RNA, 13 nt, Human
gccucuggcuaga

SEQ ID NO: 2809061 - RNA, 12 nt, Human
gccucugugccu

SEQ ID NO: 2809062 - RNA, 23 nt, Human
gccucuggcuagaggccagcccc

SEQ ID NO: 2809063 - RNA, 22 nt, Human
gccucuggcuagaggccagccc

SEQ ID NO: 2809064 - RNA, 21 nt, Human
gccucugucuagcaugccaac

SEQ ID NO: 2809065 - RNA, 22 nt, Human
gccucugucuagcaugccaaca

SEQ ID NO: 2809066 - RNA, 18 nt, Human
gccucuuaaagcugccug

SEQ ID NO: 2809067 - RNA, 18 nt, Human
gccucuguguccuucccu

SEQ ID NO: 2809068 - RNA, 21 nt, Human
gccucuguguccuucccugca

SEQ ID NO: 2809069 - RNA, 14 nt, Human
gccucuguguccuu

SEQ ID NO: 2809070 - RNA, 15 nt, Human
gccucuguguccuuc

SEQ ID NO: 2809071 - RNA, 22 nt, Human
gccucuuccucccucauuccac

SEQ ID NO: 2809072 - RNA, 12 nt, Human
gccucuuccucc

SEQ ID NO: 2809073 - RNA, 19 nt, Human
gccugcccaggccccugcc

SEQ ID NO: 2809074 - RNA, 21 nt, Human
gccugccgguaaacacgccug

SEQ ID NO: 2809075 - RNA, 16 nt, Human
gccugccgguaaacac

SEQ ID NO: 2809076 - RNA, 18 nt, Human
gccugcccaggccccugc

SEQ ID NO: 2809077 - RNA, 17 nt, Human
gccugcccaggccccug

SEQ ID NO: 2809078 - RNA, 14 nt, Human
ccaaaagcugcuca

SEQ ID NO: 2809079 - RNA, 15 nt, Human
ccaaaagcaguaaau

SEQ ID NO: 2809080 - RNA, 20 nt, Human
ccaaaagccaauggcugcag

SEQ ID NO: 2809081 - RNA, 15 nt, Human
ccaaaagcuagacag

SEQ ID NO: 2809082 - RNA, 17 nt, Human
cauuuuuuuuuuaaauc

SEQ ID NO: 2809083 - RNA, 21 nt, Human
cauuuuuuuuuuuguuucuga

SEQ ID NO: 2809084 - RNA, 18 nt, Human
ccaaaaguggaagugaca

SEQ ID NO: 2809085 - RNA, 12 nt, Human
ccaaaaggaaaa

SEQ ID NO: 2809086 - RNA, 13 nt, Human
ccaaaaggaaaaa

SEQ ID NO: 2809087 - RNA, 15 nt, Human
ccaaaaggaaaaagc

SEQ ID NO: 2809088 - RNA, 16 nt, Human
ccaaaaggaaaaagcu

SEQ ID NO: 2809089 - RNA, 17 nt, Human
ccaaaaggaaaaagcuc

SEQ ID NO: 2809090 - RNA, 18 nt, Human
ccaaaaggaaaaagcucc

SEQ ID NO: 2809091 - RNA, 13 nt, Human
cauuuguuaaaau

SEQ ID NO: 2809092 - RNA, 22 nt, Human
cauuuguuaaaauuaucaauau

SEQ ID NO: 2809093 - RNA, 14 nt, Human
cauuuguucacuga

SEQ ID NO: 2809094 - RNA, 22 nt, Human
cauuuguucacugaaggugauu

SEQ ID NO: 2809095 - RNA, 18 nt, Human
cauuuguuaaaauuauca

SEQ ID NO: 2809096 - RNA, 15 nt, Human
cauuuguuaaaauua

SEQ ID NO: 2809097 - RNA, 20 nt, Human
cauuuguacagaauuuugga

SEQ ID NO: 2809098 - RNA, 22 nt, Human
cauuuguacagaauuuuggaag

SEQ ID NO: 2809099 - RNA, 18 nt, Human
cauuuguugugaugucuu

SEQ ID NO: 2809100 - RNA, 20 nt, Human
cauuuguugugaugucuuuu

SEQ ID NO: 2809101 - RNA, 16 nt, Human
cauuuguuggaaugaa

SEQ ID NO: 2809102 - RNA, 23 nt, Human
cauuuaucuacccaagggcagaa

SEQ ID NO: 2809103 - RNA, 12 nt, Human
cauuuaucauuc

SEQ ID NO: 2809104 - RNA, 15 nt, Human
cauuuaucauucuug

SEQ ID NO: 2809105 - RNA, 18 nt, Human
cauuuauccacaggaaag

SEQ ID NO: 2809106 - RNA, 22 nt, Human
cauuuauccacaggaaaguguu

SEQ ID NO: 2809107 - RNA, 16 nt, Human
cauuuaugaagcaagc

SEQ ID NO: 2809108 - RNA, 19 nt, Human
cauuuggcagagcuucuuc

SEQ ID NO: 2809109 - RNA, 15 nt, Human
cauuuaugauuuaau

SEQ ID NO: 2809110 - RNA, 19 nt, Human
cauuuaugaguaacuauua

SEQ ID NO: 2809111 - RNA, 23 nt, Human
cauuuaugaguaacuauuauuau

SEQ ID NO: 2809112 - RNA, 18 nt, Human
cauuuguaaaugcugugu

SEQ ID NO: 2809113 - RNA, 19 nt, Human
cauuuguaauuaaauuaug

SEQ ID NO: 2809114 - RNA, 12 nt, Human
cauuuguaauuu

SEQ ID NO: 2809115 - RNA, 13 nt, Human
cauugguguuguc

SEQ ID NO: 2809116 - RNA, 14 nt, Human
cauugguuaauuuu

SEQ ID NO: 2809117 - RNA, 15 nt, Human
cauugguuaauuuuu

SEQ ID NO: 2809118 - RNA, 13 nt, Human
cauugguccaaga

SEQ ID NO: 2809119 - RNA, 14 nt, Human
cauugguccaagau

SEQ ID NO: 2809120 - RNA, 21 nt, Human
cauugggguuccgcacuuucc

SEQ ID NO: 2809121 - RNA, 23 nt, Human
cauuggguuguagccaaagguuc

SEQ ID NO: 2809122 - RNA, 17 nt, Human
cauugggucuauuccag

SEQ ID NO: 2809123 - RNA, 18 nt, Human
cauugggucuauuccagc

SEQ ID NO: 2809124 - RNA, 19 nt, Human
cauugggucuauuccagcu

SEQ ID NO: 2809125 - RNA, 20 nt, Human
cauugggucuauuccagcuc

SEQ ID NO: 2809126 - RNA, 21 nt, Human
cauugggucuauuccagcuca

SEQ ID NO: 2809127 - RNA, 22 nt, Human
cauugggucuauuccagcucau

SEQ ID NO: 2809128 - RNA, 13 nt, Human
cauuuagucucuu

SEQ ID NO: 2809129 - RNA, 15 nt, Human
cauuuagucucuuua

SEQ ID NO: 2809130 - RNA, 17 nt, Human
cauuuagucucuuuauu

SEQ ID NO: 2809131 - RNA, 21 nt, Human
cauuuagucucuuuauuccua

SEQ ID NO: 2809132 - RNA, 22 nt, Human
cauuuagucucuuuauuccuag

SEQ ID NO: 2809133 - RNA, 23 nt, Human
cauuuagucucuuuauuccuagu

SEQ ID NO: 2809134 - RNA, 19 nt, Human
cauuuagugaguuauuccu

SEQ ID NO: 2809135 - RNA, 15 nt, Human
cauuuauauuuuuau

SEQ ID NO: 2809136 - RNA, 17 nt, Human
cauuggauuauccugag

SEQ ID NO: 2809137 - RNA, 16 nt, Human
cauuggauuauccuga

SEQ ID NO: 2809138 - RNA, 14 nt, Human
cauuggauacagca

SEQ ID NO: 2809139 - RNA, 17 nt, Human
cauuggauacagcagua

SEQ ID NO: 2809140 - RNA, 18 nt, Human
cauuggacccacaugagg

SEQ ID NO: 2809141 - RNA, 15 nt, Human
ccaacuccagcaacu

SEQ ID NO: 2809142 - RNA, 14 nt, Human
ccaacuccagcaac

SEQ ID NO: 2809143 - RNA, 13 nt, Human
ccaacuccagcaa

SEQ ID NO: 2809144 - RNA, 14 nt, Human
ccaacucaccugag

SEQ ID NO: 2809145 - RNA, 15 nt, Human
ccaagcucugcuccu

SEQ ID NO: 2809146 - RNA, 14 nt, Human
ccaagcucugcucc

SEQ ID NO: 2809147 - RNA, 16 nt, Human
ccaagcucugcuccuc

SEQ ID NO: 2809148 - RNA, 21 nt, Human
ccaacuccagcaacuucuucu

SEQ ID NO: 2809149 - RNA, 12 nt, Human
ccaacuccagga

SEQ ID NO: 2809150 - RNA, 14 nt, Human
ccaaggaaaacugc

SEQ ID NO: 2809151 - RNA, 16 nt, Human
ccaaggaaaacugcau

SEQ ID NO: 2809152 - RNA, 16 nt, Human
ccaaaucauaguggcu

SEQ ID NO: 2809153 - RNA, 20 nt, Human
ccaaaucaauaagaagguag

SEQ ID NO: 2809154 - RNA, 23 nt, Human
ccaaagugccacucauuccugua

SEQ ID NO: 2809155 - RNA, 15 nt, Human
ccaaagugcugagau

SEQ ID NO: 2809156 - RNA, 22 nt, Human
ccaauuauaugagacguuuuug

SEQ ID NO: 2809157 - RNA, 13 nt, Human
ccaauucaauaca

SEQ ID NO: 2809158 - RNA, 15 nt, Human
ccaauuauugauaua

SEQ ID NO: 2809159 - RNA, 18 nt, Human
ccaauuauugauauauau

SEQ ID NO: 2809160 - RNA, 20 nt, Human
ccaauuauugauauauauua

SEQ ID NO: 2809161 - RNA, 21 nt, Human
ccaauuauugauauauauuau

SEQ ID NO: 2809162 - RNA, 22 nt, Human
ccaauuauugauauauauuaua

SEQ ID NO: 2809163 - RNA, 18 nt, Human
ccaauuauuguuacacau

SEQ ID NO: 2809164 - RNA, 22 nt, Human
ccaauuauuugacuuuaauuua

SEQ ID NO: 2809165 - RNA, 21 nt, Human
ccaauggagacugucucaaga

SEQ ID NO: 2809166 - RNA, 24 nt, Human
ccaauuccucauccucagaugcuc

SEQ ID NO: 2809167 - RNA, 17 nt, Human
ccaauucucgagcuugg

SEQ ID NO: 2809168 - RNA, 18 nt, Human
ccaauucucgagcuuggg

SEQ ID NO: 2809169 - RNA, 20 nt, Human
ccaaggagggugagugcaag

SEQ ID NO: 2809170 - RNA, 23 nt, Human
ccaaggaggugaggagcagagca

SEQ ID NO: 2809171 - RNA, 12 nt, Human
ccaaggaggauu

SEQ ID NO: 2809172 - RNA, 13 nt, Human
ccaaugccaaaaa

SEQ ID NO: 2809173 - RNA, 21 nt, Human
ccaaugccacauacuugcagc

SEQ ID NO: 2809174 - RNA, 14 nt, Human
ccaaugcugauguc

SEQ ID NO: 2809175 - RNA, 18 nt, Human
ccaaugcuuuuaucaaac

SEQ ID NO: 2809176 - RNA, 12 nt, Human
ccaauggaaacc

SEQ ID NO: 2809177 - RNA, 14 nt, Human
ccaauggaaaccuc

SEQ ID NO: 2809178 - RNA, 15 nt, Human
ccaauggaaaccuca

SEQ ID NO: 2809179 - RNA, 17 nt, Human
ccaaugcugauguccuc

SEQ ID NO: 2809180 - RNA, 12 nt, Human
ccaaggagcaca

SEQ ID NO: 2809181 - RNA, 13 nt, Human
ccaaggagcacag

SEQ ID NO: 2809182 - RNA, 14 nt, Human
ccaaggagcacagg

SEQ ID NO: 2809183 - RNA, 16 nt, Human
ccaaggagcacagguc

SEQ ID NO: 2809184 - RNA, 17 nt, Human
ccaaggagcacaggucc

SEQ ID NO: 2809185 - RNA, 18 nt, Human
ccaaggagcacagguccc

SEQ ID NO: 2809186 - RNA, 19 nt, Human
ccaaggagcacagguccca

SEQ ID NO: 2809187 - RNA, 20 nt, Human
ccaaggagcacaggucccac

SEQ ID NO: 2809188 - RNA, 14 nt, Human
ccaaggagacacaa

SEQ ID NO: 2809189 - RNA, 15 nt, Human
ccaaggagaacaaau

SEQ ID NO: 2809190 - RNA, 23 nt, Human
ccaaggacugagggacucugaag

SEQ ID NO: 2809191 - RNA, 20 nt, Human
ccaaggaccuccucuucccc

SEQ ID NO: 2809192 - RNA, 22 nt, Human
ccaaggaccuccucuucccccu

SEQ ID NO: 2809193 - RNA, 15 nt, Human
ccaaggacugaggga

SEQ ID NO: 2809194 - RNA, 18 nt, Human
ccaaggaaaccacagcug

SEQ ID NO: 2809195 - RNA, 19 nt, Human
ccaaggaaaccacagcugc

SEQ ID NO: 2809196 - RNA, 20 nt, Human
ccaaggaaaccacagcugcu

SEQ ID NO: 2809197 - RNA, 21 nt, Human
ccaaggaaaccacagcugcug

SEQ ID NO: 2809198 - RNA, 22 nt, Human
ccaaggaaaccacagcugcugg

SEQ ID NO: 2809199 - RNA, 23 nt, Human
ccaaggaaaccacagcugcugga

SEQ ID NO: 2809200 - RNA, 17 nt, Human
ccaaggaaacgcuaccu

SEQ ID NO: 2809201 - RNA, 22 nt, Human
ccaaggaaacgcuaccucucug

SEQ ID NO: 2809202 - RNA, 15 nt, Human
ccaaggaaauauauu

SEQ ID NO: 2809203 - RNA, 13 nt, Human
ccaaggaacaaaa

SEQ ID NO: 2809204 - RNA, 14 nt, Human
ccaaagugcuggga

SEQ ID NO: 2809205 - RNA, 17 nt, Human
ccaaagugaccuaccca

SEQ ID NO: 2809206 - RNA, 18 nt, Human
ccaaagucucuaauucua

SEQ ID NO: 2809207 - RNA, 15 nt, Human
ccaaagucucuaauu

SEQ ID NO: 2809208 - RNA, 16 nt, Human
ccaaagucucuaauuc

SEQ ID NO: 2809209 - RNA, 14 nt, Human
ccaaagucucccuu

SEQ ID NO: 2809210 - RNA, 16 nt, Human
ccaaagucucccuucu

SEQ ID NO: 2809211 - RNA, 14 nt, Human
ccaaagucucuaau

SEQ ID NO: 2809212 - RNA, 19 nt, Human
cauguuggccaggcugguc

SEQ ID NO: 2809213 - RNA, 20 nt, Human
cauguuggccaggcugcucu

SEQ ID NO: 2809214 - RNA, 13 nt, Human
cauuaucccugaa

SEQ ID NO: 2809215 - RNA, 17 nt, Human
cauguuggccaggcugg

SEQ ID NO: 2809216 - RNA, 18 nt, Human
cauguuggccaggcuggu

SEQ ID NO: 2809217 - RNA, 14 nt, Human
cauguucugcuuuc

SEQ ID NO: 2809218 - RNA, 13 nt, Human
cauguuaauuuca

SEQ ID NO: 2809219 - RNA, 12 nt, Human
cauguuaccauc

SEQ ID NO: 2809220 - RNA, 16 nt, Human
cauguucuugcaguca

SEQ ID NO: 2809221 - RNA, 20 nt, Human
cauguugaccaugucuauga

SEQ ID NO: 2809222 - RNA, 21 nt, Human
cauguccaaagaggcugcccc

SEQ ID NO: 2809223 - RNA, 20 nt, Human
cauguucugcccccagccca

SEQ ID NO: 2809224 - RNA, 21 nt, Human
cauguucugcccccagcccaa

SEQ ID NO: 2809225 - RNA, 20 nt, Human
cauguccaaagaggcugccc

SEQ ID NO: 2809226 - RNA, 19 nt, Human
cauguccaaagaggcugcc

SEQ ID NO: 2809227 - RNA, 18 nt, Human
cauguccaaagaggcugc

SEQ ID NO: 2809228 - RNA, 17 nt, Human
cauguccaaagaggcug

SEQ ID NO: 2809229 - RNA, 16 nt, Human
cauguccaaagaggcu

SEQ ID NO: 2809230 - RNA, 15 nt, Human
cauguccaaagaggc

SEQ ID NO: 2809231 - RNA, 14 nt, Human
cauguccaaagagg

SEQ ID NO: 2809232 - RNA, 13 nt, Human
cauguccaaagag

SEQ ID NO: 2809233 - RNA, 12 nt, Human
cauguccaaaga

SEQ ID NO: 2809234 - RNA, 15 nt, Human
cauguauuauuucau

SEQ ID NO: 2809235 - RNA, 17 nt, Human
cauguaugucuuggaca

SEQ ID NO: 2809236 - RNA, 18 nt, Human
cauguaugucuuggacac

SEQ ID NO: 2809237 - RNA, 21 nt, Human
cauguaugucuuggacacugu

SEQ ID NO: 2809238 - RNA, 22 nt, Human
cauguaugucuuggacacugua

SEQ ID NO: 2809239 - RNA, 22 nt, Human
cauguauggaaucccacuguau

SEQ ID NO: 2809240 - RNA, 13 nt, Human
cauguaugucuug

SEQ ID NO: 2809241 - RNA, 19 nt, Human
cauuauuaguacugcucuu

SEQ ID NO: 2809242 - RNA, 22 nt, Human
cauuauuauauaaaucaugaug

SEQ ID NO: 2809243 - RNA, 14 nt, Human
cauuaucccugaau

SEQ ID NO: 2809244 - RNA, 15 nt, Human
cauucuccuuguugu

SEQ ID NO: 2809245 - RNA, 19 nt, Human
cauucucgugagucauuua

SEQ ID NO: 2809246 - RNA, 23 nt, Human
cauucucgugagucauuuaaaug

SEQ ID NO: 2809247 - RNA, 14 nt, Human
cauggccgugaacu

SEQ ID NO: 2809248 - RNA, 16 nt, Human
cauggccuaugcacau

SEQ ID NO: 2809249 - RNA, 17 nt, Human
cauggccuaugcacaua

SEQ ID NO: 2809250 - RNA, 19 nt, Human
cauggccuaugcacauaug

SEQ ID NO: 2809251 - RNA, 18 nt, Human
cauggcuuucagaaaacg

SEQ ID NO: 2809252 - RNA, 22 nt, Human
cauggcuuucagaaaacgggaa

SEQ ID NO: 2809253 - RNA, 13 nt, Human
caugggaaaggag

SEQ ID NO: 2809254 - RNA, 21 nt, Human
caugggaaaggaggcaugccu

SEQ ID NO: 2809255 - RNA, 22 nt, Human
caugggaaaggaggcaugccuc

SEQ ID NO: 2809256 - RNA, 20 nt, Human
caugggaaaugucaacaagu

SEQ ID NO: 2809257 - RNA, 12 nt, Human
caucuguacaaa

SEQ ID NO: 2809258 - RNA, 15 nt, Human
cauggccagguggcc

SEQ ID NO: 2809259 - RNA, 14 nt, Human
cauggccagguggc

SEQ ID NO: 2809260 - RNA, 12 nt, Human
cauggcccuggg

SEQ ID NO: 2809261 - RNA, 23 nt, Human
cauggcccucccaguaccuccug

SEQ ID NO: 2809262 - RNA, 14 nt, Human
cauggcccucccag

SEQ ID NO: 2809263 - RNA, 22 nt, Human
cauggcccucccaguaccuccu

SEQ ID NO: 2809264 - RNA, 14 nt, Human
cauggcccuggggu

SEQ ID NO: 2809265 - RNA, 14 nt, Human
cauggcccugugcu

SEQ ID NO: 2809266 - RNA, 12 nt, Human
cauggccccucu

SEQ ID NO: 2809267 - RNA, 13 nt, Human
cauggccccucug

SEQ ID NO: 2809268 - RNA, 16 nt, Human
cauggccccucugacc

SEQ ID NO: 2809269 - RNA, 15 nt, Human
cauggccccugugag

SEQ ID NO: 2809270 - RNA, 16 nt, Human
cauggccccugugagu

SEQ ID NO: 2809271 - RNA, 17 nt, Human
cauggccccucugaccu

SEQ ID NO: 2809272 - RNA, 18 nt, Human
cauggccccucugaccug

SEQ ID NO: 2809273 - RNA, 16 nt, Human
caugcaaaggcuggga

SEQ ID NO: 2809274 - RNA, 14 nt, Human
caugcaaaggcugg

SEQ ID NO: 2809275 - RNA, 15 nt, Human
caugcaaaggcuggg

SEQ ID NO: 2809276 - RNA, 20 nt, Human
caugcaagaacucaucacug

SEQ ID NO: 2809277 - RNA, 22 nt, Human
caugcaagaacucaucacugug

SEQ ID NO: 2809278 - RNA, 11 nt, Human
caugaugcagu

SEQ ID NO: 2809279 - RNA, 12 nt, Human
caugaugcaguc

SEQ ID NO: 2809280 - RNA, 14 nt, Human
caugaugcagucuc

SEQ ID NO: 2809281 - RNA, 15 nt, Human
caugaugcagucucc

SEQ ID NO: 2809282 - RNA, 23 nt, Human
caugaugcagucuccucuuuaaa

SEQ ID NO: 2809283 - RNA, 14 nt, Human
caugaugcuagcca

SEQ ID NO: 2809284 - RNA, 15 nt, Human
caugaugcugggauu

SEQ ID NO: 2809285 - RNA, 19 nt, Human
caugauggagcgcaccugc

SEQ ID NO: 2809286 - RNA, 18 nt, Human
caugauggagcgcaccug

SEQ ID NO: 2809287 - RNA, 16 nt, Human
caugaugcugggauuu

SEQ ID NO: 2809288 - RNA, 16 nt, Human
caugaugcuuuuacug

SEQ ID NO: 2809289 - RNA, 17 nt, Human
caugaugcuuuuacuga

SEQ ID NO: 2809290 - RNA, 18 nt, Human
caugaugcuuuuacugaa

SEQ ID NO: 2809291 - RNA, 14 nt, Human
caugauggaauuuc

SEQ ID NO: 2809292 - RNA, 13 nt, Human
caugaauuuuaca

SEQ ID NO: 2809293 - RNA, 15 nt, Human
caugaauuuuacaug

SEQ ID NO: 2809294 - RNA, 22 nt, Human
caugaaguuuccuuggcuggug

SEQ ID NO: 2809295 - RNA, 23 nt, Human
caugaaguuuccuuggcuggugc

SEQ ID NO: 2809296 - RNA, 20 nt, Human
caucugucaccaauugguua

SEQ ID NO: 2809297 - RNA, 17 nt, Human
caugaaucuuuguuuca

SEQ ID NO: 2809298 - RNA, 14 nt, Human
caugaaucugucuc

SEQ ID NO: 2809299 - RNA, 22 nt, Human
caugaaugguauggaacucucu

SEQ ID NO: 2809300 - RNA, 21 nt, Human
caugaaucccacccacaugug

SEQ ID NO: 2809301 - RNA, 15 nt, Human
caugaaucugcaaug

SEQ ID NO: 2809302 - RNA, 12 nt, Human
cauccugcaggc

SEQ ID NO: 2809303 - RNA, 13 nt, Human
cauccugccagcc

SEQ ID NO: 2809304 - RNA, 14 nt, Human
cauccugccagccc

SEQ ID NO: 2809305 - RNA, 15 nt, Human
cauccugccagcccc

SEQ ID NO: 2809306 - RNA, 17 nt, Human
cauccugccagccccac

SEQ ID NO: 2809307 - RNA, 19 nt, Human
cauccugccagccccacac

SEQ ID NO: 2809308 - RNA, 21 nt, Human
cauccugccagccccacacag

SEQ ID NO: 2809309 - RNA, 22 nt, Human
cauccugccagccccacacagc

SEQ ID NO: 2809310 - RNA, 22 nt, Human
cauccugacucugcccccugcu

SEQ ID NO: 2809311 - RNA, 12 nt, Human
cauccugagccc

SEQ ID NO: 2809312 - RNA, 13 nt, Human
cauccugagcccc

SEQ ID NO: 2809313 - RNA, 14 nt, Human
cauccugagccccg

SEQ ID NO: 2809314 - RNA, 16 nt, Human
cauccugagccccgcc

SEQ ID NO: 2809315 - RNA, 19 nt, Human
cauccugagccccgcccuc

SEQ ID NO: 2809316 - RNA, 20 nt, Human
cauccugagccccgcccucu

SEQ ID NO: 2809317 - RNA, 21 nt, Human
cauccugagccccgcccucuu

SEQ ID NO: 2809318 - RNA, 22 nt, Human
cauccugagccccgcccucuuc

SEQ ID NO: 2809319 - RNA, 17 nt, Human
cauccugacucugcccc

SEQ ID NO: 2809320 - RNA, 19 nt, Human
cauccugacucugcccccu

SEQ ID NO: 2809321 - RNA, 20 nt, Human
cauccugacucugcccccug

SEQ ID NO: 2809322 - RNA, 22 nt, Human
caucguuuucuucacuguccuc

SEQ ID NO: 2809323 - RNA, 21 nt, Human
caucuaaacugcccccucugc

SEQ ID NO: 2809324 - RNA, 15 nt, Human
caucuaaacugcccc

SEQ ID NO: 2809325 - RNA, 17 nt, Human
caucuggcugccuuugc

SEQ ID NO: 2809326 - RNA, 17 nt, Human
caucuggcuuauuuuaa

SEQ ID NO: 2809327 - RNA, 18 nt, Human
caucuggcuuauuuuaau

SEQ ID NO: 2809328 - RNA, 19 nt, Human
caucuggcuuauuuuaaug

SEQ ID NO: 2809329 - RNA, 22 nt, Human
caucuggcuuauuuuaauguga

SEQ ID NO: 2809330 - RNA, 15 nt, Human
caucuggguccuugc

SEQ ID NO: 2809331 - RNA, 14 nt, Human
caucuguagucagc

SEQ ID NO: 2809332 - RNA, 17 nt, Human
caucuguagucagccga

SEQ ID NO: 2809333 - RNA, 15 nt, Human
caucuguacuugguc

SEQ ID NO: 2809334 - RNA, 17 nt, Human
caucuguacuuggucca

SEQ ID NO: 2809335 - RNA, 21 nt, Human
caucuguacuugguccaacug

SEQ ID NO: 2809336 - RNA, 14 nt, Human
caucugucaacagg

SEQ ID NO: 2809337 - RNA, 15 nt, Human
caucuggccuggccu

SEQ ID NO: 2809338 - RNA, 16 nt, Human
caucuggccuggccug

SEQ ID NO: 2809339 - RNA, 17 nt, Human
caucuggccuggccugg

SEQ ID NO: 2809340 - RNA, 18 nt, Human
caucuggccuggccuggc

SEQ ID NO: 2809341 - RNA, 20 nt, Human
caucuggccuggccuggccc

SEQ ID NO: 2809342 - RNA, 21 nt, Human
caucuggccuggccuggcccu

SEQ ID NO: 2809343 - RNA, 23 nt, Human
caucuggccuggccuggcccugc

SEQ ID NO: 2809344 - RNA, 23 nt, Human
caucuggauaggagccugcuggu

SEQ ID NO: 2809345 - RNA, 12 nt, Human
caucuggccugg

SEQ ID NO: 2809346 - RNA, 23 nt, Human
caucuggccguugauguuggcug

SEQ ID NO: 2809347 - RNA, 11 nt, Human
caucuggccug

SEQ ID NO: 2809348 - RNA, 13 nt, Human
caucuggccuggc

SEQ ID NO: 2809349 - RNA, 14 nt, Human
caucuggccuggcc

SEQ ID NO: 2809350 - RNA, 16 nt, Human
caucuggauaggagcc

SEQ ID NO: 2809351 - RNA, 18 nt, Human
caucuggauaggagccug

SEQ ID NO: 2809352 - RNA, 20 nt, Human
caucuggauaggagccugcu

SEQ ID NO: 2809353 - RNA, 21 nt, Human
caucuggauaggagccugcug

SEQ ID NO: 2809354 - RNA, 22 nt, Human
caucuggauaggagccugcugg

SEQ ID NO: 2809355 - RNA, 14 nt, Human
caucccacacccug

SEQ ID NO: 2809356 - RNA, 17 nt, Human
caucccaaccagugcca

SEQ ID NO: 2809357 - RNA, 18 nt, Human
caucccaaccagugccaa

SEQ ID NO: 2809358 - RNA, 20 nt, Human
caucccaaccagugccaagg

SEQ ID NO: 2809359 - RNA, 22 nt, Human
caucccaaccagugccaaggac

SEQ ID NO: 2809360 - RNA, 16 nt, Human
cauccugacucugccc

SEQ ID NO: 2809361 - RNA, 12 nt, Human
cauccugaacag

SEQ ID NO: 2809362 - RNA, 14 nt, Human
cauccugaacagca

SEQ ID NO: 2809363 - RNA, 15 nt, Human
cauccugaacagcau

SEQ ID NO: 2809364 - RNA, 16 nt, Human
cauccugaacagcaug

SEQ ID NO: 2809365 - RNA, 13 nt, Human
caucccagcccaa

SEQ ID NO: 2809366 - RNA, 19 nt, Human
caucccagcccaauccagg

SEQ ID NO: 2809367 - RNA, 21 nt, Human
caucccagcccaauccaggua

SEQ ID NO: 2809368 - RNA, 11 nt, Human
cauccucuuuc

SEQ ID NO: 2809369 - RNA, 13 nt, Human
cauccucuuucuc

SEQ ID NO: 2809370 - RNA, 20 nt, Human
cauccucuuucucuuuucua

SEQ ID NO: 2809371 - RNA, 21 nt, Human
cauccucuuucucuuuucuag

SEQ ID NO: 2809372 - RNA, 15 nt, Human
caucccagcaccugc

SEQ ID NO: 2809373 - RNA, 20 nt, Human
caucccagcaccugccuccu

SEQ ID NO: 2809374 - RNA, 17 nt, Human
caucccagacagguccc

SEQ ID NO: 2809375 - RNA, 21 nt, Human
caucccagacaggucccuccc

SEQ ID NO: 2809376 - RNA, 23 nt, Human
caucccagacaggucccuccccu

SEQ ID NO: 2809377 - RNA, 12 nt, Human
caucagccagcu

SEQ ID NO: 2809378 - RNA, 14 nt, Human
caucagccagcugc

SEQ ID NO: 2809379 - RNA, 15 nt, Human
caucagccagcugcc

SEQ ID NO: 2809380 - RNA, 17 nt, Human
caucacuuuucagugau

SEQ ID NO: 2809381 - RNA, 15 nt, Human
caucacuuguacaaa

SEQ ID NO: 2809382 - RNA, 15 nt, Human
caucacuuuucagug

SEQ ID NO: 2809383 - RNA, 16 nt, Human
caucacuuuucaguga

SEQ ID NO: 2809384 - RNA, 19 nt, Human
caucacuuguacaaaauaa

SEQ ID NO: 2809385 - RNA, 23 nt, Human
cauagcagagaaugaaagggccc

SEQ ID NO: 2809386 - RNA, 16 nt, Human
cauagguauuucaaaa

SEQ ID NO: 2809387 - RNA, 13 nt, Human
cauauguaaaaua

SEQ ID NO: 2809388 - RNA, 18 nt, Human
cauauguugaauacuuuu

SEQ ID NO: 2809389 - RNA, 17 nt, Human
cauaugugaauauggac

SEQ ID NO: 2809390 - RNA, 14 nt, Human
cauaugugaucugu

SEQ ID NO: 2809391 - RNA, 15 nt, Human
cauaugugaucuguc

SEQ ID NO: 2809392 - RNA, 16 nt, Human
cauaugugaucugucu

SEQ ID NO: 2809393 - RNA, 20 nt, Human
cauaugugaucugucuugua

SEQ ID NO: 2809394 - RNA, 22 nt, Human
cauaugugaucugucuuguaau

SEQ ID NO: 2809395 - RNA, 13 nt, Human
cauauguuaagca

SEQ ID NO: 2809396 - RNA, 18 nt, Human
cauauguuaagcagcuaa

SEQ ID NO: 2809397 - RNA, 17 nt, Human
cauauguugaauacuuu

SEQ ID NO: 2809398 - RNA, 16 nt, Human
cauauguugaauacuu

SEQ ID NO: 2809399 - RNA, 16 nt, Human
cauaugucacuagaau

SEQ ID NO: 2809400 - RNA, 21 nt, Human
cauaugucacuagaauggaua

SEQ ID NO: 2809401 - RNA, 14 nt, Human
cauauguaaaauaa

SEQ ID NO: 2809402 - RNA, 13 nt, Human
cauauguaaacau

SEQ ID NO: 2809403 - RNA, 14 nt, Human
cauauguaaacaua

SEQ ID NO: 2809404 - RNA, 15 nt, Human
cauauguaaacauaa

SEQ ID NO: 2809405 - RNA, 15 nt, Human
cauauguacauaaau

SEQ ID NO: 2809406 - RNA, 16 nt, Human
cauauguacauaaauu

SEQ ID NO: 2809407 - RNA, 19 nt, Human
cauauguacauaaauugca

SEQ ID NO: 2809408 - RNA, 17 nt, Human
cauauguagacuauaua

SEQ ID NO: 2809409 - RNA, 19 nt, Human
cauauguagacuauauaca

SEQ ID NO: 2809410 - RNA, 20 nt, Human
cauauguagacuauauacau

SEQ ID NO: 2809411 - RNA, 21 nt, Human
cauauguagacuauauacaug

SEQ ID NO: 2809412 - RNA, 23 nt, Human
cauauguagacuauauacaugug

SEQ ID NO: 2809413 - RNA, 21 nt, Human
cauacaggauuugaacucaga

SEQ ID NO: 2809414 - RNA, 13 nt, Human
cauacaguuuuau

SEQ ID NO: 2809415 - RNA, 20 nt, Human
cauacaguuuuaugcucuuu

SEQ ID NO: 2809416 - RNA, 21 nt, Human
cauacaguuuuaugcucuuuu

SEQ ID NO: 2809417 - RNA, 22 nt, Human
cauacaguuuuaugcucuuuuu

SEQ ID NO: 2809418 - RNA, 11 nt, Human
cauaauuccua

SEQ ID NO: 2809419 - RNA, 16 nt, Human
cauaauuccuacagca

SEQ ID NO: 2809420 - RNA, 18 nt, Human
cauaauuccuacagcacu

SEQ ID NO: 2809421 - RNA, 19 nt, Human
cauaauuccuacagcacua

SEQ ID NO: 2809422 - RNA, 18 nt, Human
cauaaugcuaauuuaaag

SEQ ID NO: 2809423 - RNA, 20 nt, Human
cauaaugcuaauuuaaagag

SEQ ID NO: 2809424 - RNA, 21 nt, Human
cauaaugcuaauuuaaagaga

SEQ ID NO: 2809425 - RNA, 22 nt, Human
cauaaugcuaauuuaaagagac

SEQ ID NO: 2809426 - RNA, 16 nt, Human
cauaaugcuacugucu

SEQ ID NO: 2809427 - RNA, 18 nt, Human
cauaaugcuuaauuucua

SEQ ID NO: 2809428 - RNA, 19 nt, Human
cauaaugcuuaauuucuaa

SEQ ID NO: 2809429 - RNA, 19 nt, Human
cauaaugggccacugaaau

SEQ ID NO: 2809430 - RNA, 21 nt, Human
cauaaugggccacugaaaucu

SEQ ID NO: 2809431 - RNA, 22 nt, Human
cauaaugggccacugaaaucug

SEQ ID NO: 2809432 - RNA, 23 nt, Human
cauaaugggccacugaaaucugu

SEQ ID NO: 2809433 - RNA, 14 nt, Human
cauaaugcuacugu

SEQ ID NO: 2809434 - RNA, 15 nt, Human
cauaaugcuacuguc

SEQ ID NO: 2809435 - RNA, 11 nt, Human
caguuuuccuu

SEQ ID NO: 2809436 - RNA, 15 nt, Human
caguuuuaugcucuu

SEQ ID NO: 2809437 - RNA, 16 nt, Human
caguuuuaugcucuuu

SEQ ID NO: 2809438 - RNA, 18 nt, Human
caguuuuaugcucuuuuu

SEQ ID NO: 2809439 - RNA, 21 nt, Human
caguuuuaugcucuuuuuuac

SEQ ID NO: 2809440 - RNA, 16 nt, Human
caguuuauguuguaca

SEQ ID NO: 2809441 - RNA, 14 nt, Human
caguuuuaacaaau

SEQ ID NO: 2809442 - RNA, 18 nt, Human
caguuucaauucagugcu

SEQ ID NO: 2809443 - RNA, 13 nt, Human
caguuugaacaaa

SEQ ID NO: 2809444 - RNA, 15 nt, Human
caguuucuuagcuuu

SEQ ID NO: 2809445 - RNA, 18 nt, Human
caguuucuuagcuuuuua

SEQ ID NO: 2809446 - RNA, 22 nt, Human
caguuucuucugcgccucaggc

SEQ ID NO: 2809447 - RNA, 15 nt, Human
caguuucuguccugc

SEQ ID NO: 2809448 - RNA, 19 nt, Human
caguuucuguccugcuggu

SEQ ID NO: 2809449 - RNA, 23 nt, Human
caguuguucaauaauaaauauuu

SEQ ID NO: 2809450 - RNA, 18 nt, Human
caguuuauuuuuaaagau

SEQ ID NO: 2809451 - RNA, 21 nt, Human
caguuuauuuuuaaagauaga

SEQ ID NO: 2809452 - RNA, 21 nt, Human
caguuauaaguagcaggccaa

SEQ ID NO: 2809453 - RNA, 19 nt, Human
caguggugcgaucuggguu

SEQ ID NO: 2809454 - RNA, 15 nt, Human
caguggugccaucau

SEQ ID NO: 2809455 - RNA, 19 nt, Human
caguggugcgaucucggcu

SEQ ID NO: 2809456 - RNA, 21 nt, Human
cagugguaugaucacggcuca

SEQ ID NO: 2809457 - RNA, 13 nt, Human
caguggucucaca

SEQ ID NO: 2809458 - RNA, 20 nt, Human
cagugguccacaucccggga

SEQ ID NO: 2809459 - RNA, 16 nt, Human
caguuagcaaacuuug

SEQ ID NO: 2809460 - RNA, 13 nt, Human
caguuagacuagu

SEQ ID NO: 2809461 - RNA, 15 nt, Human
caguuagcaaacuuu

SEQ ID NO: 2809462 - RNA, 23 nt, Human
cagucugauucccaagcucugcu

SEQ ID NO: 2809463 - RNA, 15 nt, Human
cagucguuagaauau

SEQ ID NO: 2809464 - RNA, 14 nt, Human
cagugauuagcacu

SEQ ID NO: 2809465 - RNA, 15 nt, Human
cagugcaaaugucag

SEQ ID NO: 2809466 - RNA, 22 nt, Human
cagugcccacaggaucagucug

SEQ ID NO: 2809467 - RNA, 18 nt, Human
cagugcccacaggaucag

SEQ ID NO: 2809468 - RNA, 21 nt, Human
cagugcccacaggaucagucu

SEQ ID NO: 2809469 - RNA, 20 nt, Human
cagugcaaaugucagauaca

SEQ ID NO: 2809470 - RNA, 14 nt, Human
cagugcaaccucug

SEQ ID NO: 2809471 - RNA, 15 nt, Human
cagugcaaccucugc

SEQ ID NO: 2809472 - RNA, 16 nt, Human
cagugcaaccucugcu

SEQ ID NO: 2809473 - RNA, 19 nt, Human
cagugcaaccucugcuucc

SEQ ID NO: 2809474 - RNA, 21 nt, Human
cagugcaaccucugcuuccca

SEQ ID NO: 2809475 - RNA, 20 nt, Human
cagugguaugaucacggcuc

SEQ ID NO: 2809476 - RNA, 20 nt, Human
cagugggguuucgcagccug

SEQ ID NO: 2809477 - RNA, 21 nt, Human
cagugggguuucgcagccuga

SEQ ID NO: 2809478 - RNA, 22 nt, Human
cagugggguuucgcagccugag

SEQ ID NO: 2809479 - RNA, 23 nt, Human
cagugggguuucgcagccugagu

SEQ ID NO: 2809480 - RNA, 15 nt, Human
caguggguaaaauua

SEQ ID NO: 2809481 - RNA, 16 nt, Human
caguggguaaaauuag

SEQ ID NO: 2809482 - RNA, 13 nt, Human
caguggggccugu

SEQ ID NO: 2809483 - RNA, 14 nt, Human
caguggggccugug

SEQ ID NO: 2809484 - RNA, 15 nt, Human
caguggggccugugg

SEQ ID NO: 2809485 - RNA, 16 nt, Human
caguggggccugugga

SEQ ID NO: 2809486 - RNA, 17 nt, Human
caguggggccuguggaa

SEQ ID NO: 2809487 - RNA, 16 nt, Human
caguggggcucucuga

SEQ ID NO: 2809488 - RNA, 18 nt, Human
caguggggcucucugagu

SEQ ID NO: 2809489 - RNA, 19 nt, Human
caguggggcucucugaguc

SEQ ID NO: 2809490 - RNA, 20 nt, Human
caguggggcucucugagucc

SEQ ID NO: 2809491 - RNA, 21 nt, Human
caguggggcucucugaguccu

SEQ ID NO: 2809492 - RNA, 18 nt, Human
cagugggagcugccuguu

SEQ ID NO: 2809493 - RNA, 17 nt, Human
cagugggagcugccugu

SEQ ID NO: 2809494 - RNA, 15 nt, Human
cagugggagcugccu

SEQ ID NO: 2809495 - RNA, 16 nt, Human
cagugggagcugccug

SEQ ID NO: 2809496 - RNA, 15 nt, Human
cagucucucucuucc

SEQ ID NO: 2809497 - RNA, 14 nt, Human
cagucucucuuaaa

SEQ ID NO: 2809498 - RNA, 17 nt, Human
cagucucucuuaaaguu

SEQ ID NO: 2809499 - RNA, 18 nt, Human
cagucucucuuaaaguug

SEQ ID NO: 2809500 - RNA, 22 nt, Human
cagucugauucccaagcucugc

SEQ ID NO: 2809501 - RNA, 21 nt, Human
cagucugauucccaagcucug

SEQ ID NO: 2809502 - RNA, 12 nt, Human
cagucuccucuu

SEQ ID NO: 2809503 - RNA, 13 nt, Human
cagucuccucuuu

SEQ ID NO: 2809504 - RNA, 15 nt, Human
cagucuccucuuuaa

SEQ ID NO: 2809505 - RNA, 16 nt, Human
cagucuccucuuuaaa

SEQ ID NO: 2809506 - RNA, 17 nt, Human
cagucuccucuuuaaaa

SEQ ID NO: 2809507 - RNA, 19 nt, Human
cagucuccucuuuaaaaca

SEQ ID NO: 2809508 - RNA, 20 nt, Human
cagucuccucuuuaaaacaa

SEQ ID NO: 2809509 - RNA, 22 nt, Human
cagucuccucuuuaaaacaaaa

SEQ ID NO: 2809510 - RNA, 23 nt, Human
cagucuccucuuuaaaacaaaac

SEQ ID NO: 2809511 - RNA, 23 nt, Human
cagucucaaaaauacaaaauaaa

SEQ ID NO: 2809512 - RNA, 19 nt, Human
cagucuaguugccaaaucu

SEQ ID NO: 2809513 - RNA, 19 nt, Human
cagucuaaaaugcuucagu

SEQ ID NO: 2809514 - RNA, 23 nt, Human
caguucagaaucacuucugagaa

SEQ ID NO: 2809515 - RNA, 16 nt, Human
caguucaccugcacuu

SEQ ID NO: 2809516 - RNA, 14 nt, Human
caguucaagaaagc

SEQ ID NO: 2809517 - RNA, 22 nt, Human
caguucaauaaacuuaacuuua

SEQ ID NO: 2809518 - RNA, 14 nt, Human
caguuauuuauagu

SEQ ID NO: 2809519 - RNA, 14 nt, Human
caguuauuuugaua

SEQ ID NO: 2809520 - RNA, 17 nt, Human
caguuauuuugauaaca

SEQ ID NO: 2809521 - RNA, 19 nt, Human
caguucaaucucccgcugc

SEQ ID NO: 2809522 - RNA, 22 nt, Human
caguucaaucucccgcugcugc

SEQ ID NO: 2809523 - RNA, 23 nt, Human
caguucaaucucccgcugcugcu

SEQ ID NO: 2809524 - RNA, 13 nt, Human
caguucacacccu

SEQ ID NO: 2809525 - RNA, 14 nt, Human
caguucacacccug

SEQ ID NO: 2809526 - RNA, 15 nt, Human
caguucacacccugc

SEQ ID NO: 2809527 - RNA, 16 nt, Human
caguucacacccugca

SEQ ID NO: 2809528 - RNA, 17 nt, Human
caguucacacccugcaa

SEQ ID NO: 2809529 - RNA, 18 nt, Human
caguucacacccugcaag

SEQ ID NO: 2809530 - RNA, 19 nt, Human
caguucacacccugcaagg

SEQ ID NO: 2809531 - RNA, 20 nt, Human
caguucacacccugcaaggc

SEQ ID NO: 2809532 - RNA, 16 nt, Human
caguuauguucaguca

SEQ ID NO: 2809533 - RNA, 17 nt, Human
caguuauucauucugug

SEQ ID NO: 2809534 - RNA, 21 nt, Human
caguuauucauucugugauca

SEQ ID NO: 2809535 - RNA, 18 nt, Human
caguuauugguggaaucu

SEQ ID NO: 2809536 - RNA, 20 nt, Human
caguuauugguggaaucuuu

SEQ ID NO: 2809537 - RNA, 21 nt, Human
caguuauugguggaaucuuua

SEQ ID NO: 2809538 - RNA, 13 nt, Human
caguuaugaauca

SEQ ID NO: 2809539 - RNA, 16 nt, Human
caguucagcaccaccc

SEQ ID NO: 2809540 - RNA, 13 nt, Human
caguucagcacca

SEQ ID NO: 2809541 - RNA, 16 nt, Human
caguucauguuugcuu

SEQ ID NO: 2809542 - RNA, 23 nt, Human
caguucaguaauaaacuguguuu

SEQ ID NO: 2809543 - RNA, 23 nt, Human
caguucaggagucccaaggaaag

SEQ ID NO: 2809544 - RNA, 20 nt, Human
caguucaggagucccaagga

SEQ ID NO: 2809545 - RNA, 17 nt, Human
caguucaggagucccaa

SEQ ID NO: 2809546 - RNA, 17 nt, Human
caguucagcaccacccu

SEQ ID NO: 2809547 - RNA, 15 nt, Human
caguucauugcacuu

SEQ ID NO: 2809548 - RNA, 18 nt, Human
caguucauguuugcuuca

SEQ ID NO: 2809549 - RNA, 18 nt, Human
caguucauugcacuuuga

SEQ ID NO: 2809550 - RNA, 12 nt, Human
caguuccaagaa

SEQ ID NO: 2809551 - RNA, 13 nt, Human
caguuccaagaaa

SEQ ID NO: 2809552 - RNA, 16 nt, Human
caguuccaagaaagau

SEQ ID NO: 2809553 - RNA, 21 nt, Human
cagacuggaagcacagcuuca

SEQ ID NO: 2809554 - RNA, 20 nt, Human
cagacuggaagcacagcuuc

SEQ ID NO: 2809555 - RNA, 16 nt, Human
cagacuggcuggcugc

SEQ ID NO: 2809556 - RNA, 18 nt, Human
cagacuggaagcacagcu

SEQ ID NO: 2809557 - RNA, 17 nt, Human
cagacuggaagcacagc

SEQ ID NO: 2809558 - RNA, 16 nt, Human
cagacuggaagcacag

SEQ ID NO: 2809559 - RNA, 14 nt, Human
cagacuggaagcac

SEQ ID NO: 2809560 - RNA, 13 nt, Human
cagacuggaagca

SEQ ID NO: 2809561 - RNA, 23 nt, Human
cagacugcugggacuggccaggu

SEQ ID NO: 2809562 - RNA, 20 nt, Human
cagacugcugggacuggcca

SEQ ID NO: 2809563 - RNA, 20 nt, Human
cagacugcuuccaauuuucu

SEQ ID NO: 2809564 - RNA, 14 nt, Human
cagacugcuuccaa

SEQ ID NO: 2809565 - RNA, 18 nt, Human
cagacugcgauuuguccc

SEQ ID NO: 2809566 - RNA, 13 nt, Human
cagacugcuagug

SEQ ID NO: 2809567 - RNA, 19 nt, Human
cagacugcuaguguucugu

SEQ ID NO: 2809568 - RNA, 22 nt, Human
cagacugcuaguguucugucua

SEQ ID NO: 2809569 - RNA, 13 nt, Human
cagacugcaccca

SEQ ID NO: 2809570 - RNA, 14 nt, Human
cagacugcacccag

SEQ ID NO: 2809571 - RNA, 15 nt, Human
cagacugcacccagg

SEQ ID NO: 2809572 - RNA, 16 nt, Human
cagacugcacccagga

SEQ ID NO: 2809573 - RNA, 17 nt, Human
cagacugcacccaggag

SEQ ID NO: 2809574 - RNA, 18 nt, Human
cagacugcacccaggagg

SEQ ID NO: 2809575 - RNA, 19 nt, Human
cagacugcacccaggaggg

SEQ ID NO: 2809576 - RNA, 12 nt, Human
cagacugcaggu

SEQ ID NO: 2809577 - RNA, 15 nt, Human
cagacugcagguugg

SEQ ID NO: 2809578 - RNA, 21 nt, Human
cagacugcagguuggacccca

SEQ ID NO: 2809579 - RNA, 13 nt, Human
cagacugcuggga

SEQ ID NO: 2809580 - RNA, 16 nt, Human
cagacugcugggacug

SEQ ID NO: 2809581 - RNA, 15 nt, Human
cagacugcugggacu

SEQ ID NO: 2809582 - RNA, 21 nt, Human
cagacucuacagaggccaugg

SEQ ID NO: 2809583 - RNA, 20 nt, Human
cagacucuacagaggccaug

SEQ ID NO: 2809584 - RNA, 19 nt, Human
cagacucuacagaggccau

SEQ ID NO: 2809585 - RNA, 18 nt, Human
cagacucuacagaggcca

SEQ ID NO: 2809586 - RNA, 23 nt, Human
cagacucuacagaggccaugggc

SEQ ID NO: 2809587 - RNA, 15 nt, Human
cagacucucagccca

SEQ ID NO: 2809588 - RNA, 17 nt, Human
cagacucucagcccaga

SEQ ID NO: 2809589 - RNA, 18 nt, Human
cagacucucagcccagaa

SEQ ID NO: 2809590 - RNA, 19 nt, Human
cagacucucagcccagaag

SEQ ID NO: 2809591 - RNA, 21 nt, Human
cagacucucagcccagaagaa

SEQ ID NO: 2809592 - RNA, 20 nt, Human
cagacugacaaauguguauc

SEQ ID NO: 2809593 - RNA, 22 nt, Human
cagacucuuucgauacccagga

SEQ ID NO: 2809594 - RNA, 23 nt, Human
cagacaggcaagcaccuccugcc

SEQ ID NO: 2809595 - RNA, 22 nt, Human
cagacaggcaagcaccuccugc

SEQ ID NO: 2809596 - RNA, 17 nt, Human
cagacucuacagaggcc

SEQ ID NO: 2809597 - RNA, 22 nt, Human
cagacucgauucauauugaaua

SEQ ID NO: 2809598 - RNA, 21 nt, Human
cagacuccugugcaacuuucc

SEQ ID NO: 2809599 - RNA, 23 nt, Human
cagacuccugacugucucccggg

SEQ ID NO: 2809600 - RNA, 16 nt, Human
cagacaggucccuccc

SEQ ID NO: 2809601 - RNA, 16 nt, Human
cagacagguuuucaca

SEQ ID NO: 2809602 - RNA, 18 nt, Human
cagacagguuuucacaua

SEQ ID NO: 2809603 - RNA, 21 nt, Human
cagacagguuuucacauaaau

SEQ ID NO: 2809604 - RNA, 22 nt, Human
cagacagguuuucacauaaaug

SEQ ID NO: 2809605 - RNA, 23 nt, Human
cagacagguuuucacauaaaugc

SEQ ID NO: 2809606 - RNA, 19 nt, Human
cagacagaggaugagcucu

SEQ ID NO: 2809607 - RNA, 23 nt, Human
cagacagaacuugaaugugucag

SEQ ID NO: 2809608 - RNA, 16 nt, Human
cagacagacacacaca

SEQ ID NO: 2809609 - RNA, 19 nt, Human
cagacagacaucucugcac

SEQ ID NO: 2809610 - RNA, 20 nt, Human
cagacagagaauaugucugc

SEQ ID NO: 2809611 - RNA, 21 nt, Human
cagacagagaauaugucugcu

SEQ ID NO: 2809612 - RNA, 22 nt, Human
cagacagagaauaugucugcuc

SEQ ID NO: 2809613 - RNA, 14 nt, Human
cagacagaggauga

SEQ ID NO: 2809614 - RNA, 12 nt, Human
cagacagaggau

SEQ ID NO: 2809615 - RNA, 14 nt, Human
cagacagcaggcag

SEQ ID NO: 2809616 - RNA, 15 nt, Human
cagacagcaggcagc

SEQ ID NO: 2809617 - RNA, 16 nt, Human
cagacagcaggcagcg

SEQ ID NO: 2809618 - RNA, 17 nt, Human
cagacagcaggcagcgc

SEQ ID NO: 2809619 - RNA, 19 nt, Human
cagacagcaggcagcgcca

SEQ ID NO: 2809620 - RNA, 14 nt, Human
cagacagcccucca

SEQ ID NO: 2809621 - RNA, 15 nt, Human
cagacagaacuugaa

SEQ ID NO: 2809622 - RNA, 20 nt, Human
cagacagaacuugaaugugu

SEQ ID NO: 2809623 - RNA, 22 nt, Human
cagacagaacuugaauguguca

SEQ ID NO: 2809624 - RNA, 13 nt, Human
cagacagaagucu

SEQ ID NO: 2809625 - RNA, 17 nt, Human
cagacagaagucuccuc

SEQ ID NO: 2809626 - RNA, 18 nt, Human
cagacagaagucuccuca

SEQ ID NO: 2809627 - RNA, 14 nt, Human
cagacagacacaca

SEQ ID NO: 2809628 - RNA, 15 nt, Human
cagacagacacacac

SEQ ID NO: 2809629 - RNA, 21 nt, Human
cagacaggcaagcaccuccug

SEQ ID NO: 2809630 - RNA, 20 nt, Human
cagacaggcaagcaccuccu

SEQ ID NO: 2809631 - RNA, 18 nt, Human
cagacaggcaagcaccuc

SEQ ID NO: 2809632 - RNA, 13 nt, Human
cagacaggcaagc

SEQ ID NO: 2809633 - RNA, 11 nt, Human
cagacaggcaa

SEQ ID NO: 2809634 - RNA, 12 nt, Human
cagacaggagga

SEQ ID NO: 2809635 - RNA, 23 nt, Human
cagacuguuagaaaauggacacu

SEQ ID NO: 2809636 - RNA, 24 nt, Human
cagacuguuagaaaauggacacug

SEQ ID NO: 2809637 - RNA, 21 nt, Human
cagacuguguaaaaagagagc

SEQ ID NO: 2809638 - RNA, 12 nt, Human
cagacuguguaa

SEQ ID NO: 2809639 - RNA, 14 nt, Human
cagacuguguaaaa

SEQ ID NO: 2809640 - RNA, 22 nt, Human
cagacuguguaaaaagagagcu

SEQ ID NO: 2809641 - RNA, 16 nt, Human
cagacuguuaauuaua

SEQ ID NO: 2809642 - RNA, 12 nt, Human
cagccagccacu

SEQ ID NO: 2809643 - RNA, 13 nt, Human
cagccagccacuc

SEQ ID NO: 2809644 - RNA, 14 nt, Human
cagccagccacucu

SEQ ID NO: 2809645 - RNA, 16 nt, Human
cagccagccacucuac

SEQ ID NO: 2809646 - RNA, 10 nt, Human
cagcacuaac

SEQ ID NO: 2809647 - RNA, 15 nt, Human
cagcacuacugggug

SEQ ID NO: 2809648 - RNA, 16 nt, Human
cagcacuacugggugu

SEQ ID NO: 2809649 - RNA, 19 nt, Human
cagcacuacugggugucau

SEQ ID NO: 2809650 - RNA, 20 nt, Human
cagcacuacugggugucauu

SEQ ID NO: 2809651 - RNA, 14 nt, Human
cagcacggacaaua

SEQ ID NO: 2809652 - RNA, 15 nt, Human
cagcacggacaauaa

SEQ ID NO: 2809653 - RNA, 18 nt, Human
cagcacggacaauaaacc

SEQ ID NO: 2809654 - RNA, 19 nt, Human
cagcacggacaauaaaccu

SEQ ID NO: 2809655 - RNA, 20 nt, Human
cagcaccuguaagaaacaga

SEQ ID NO: 2809656 - RNA, 23 nt, Human
cagcaccuguaagaaacagagca

SEQ ID NO: 2809657 - RNA, 13 nt, Human
cagcaccugucuc

SEQ ID NO: 2809658 - RNA, 18 nt, Human
cagcacgggggccaagga

SEQ ID NO: 2809659 - RNA, 12 nt, Human
cagccaggcugc

SEQ ID NO: 2809660 - RNA, 19 nt, Human
cagccaggcucaggccaug

SEQ ID NO: 2809661 - RNA, 16 nt, Human
cagccaggcugccaag

SEQ ID NO: 2809662 - RNA, 13 nt, Human
cagccaggcugcc

SEQ ID NO: 2809663 - RNA, 18 nt, Human
cagauugcaacaggcugg

SEQ ID NO: 2809664 - RNA, 20 nt, Human
cagauugcaacaggcugggc

SEQ ID NO: 2809665 - RNA, 19 nt, Human
cagauugcaacaggcuggg

SEQ ID NO: 2809666 - RNA, 21 nt, Human
cagauuguaucaugugcuaga

SEQ ID NO: 2809667 - RNA, 14 nt, Human
cagauuguuaucua

SEQ ID NO: 2809668 - RNA, 13 nt, Human
cagauuguuuccu

SEQ ID NO: 2809669 - RNA, 16 nt, Human
cagauuguuucuauac

SEQ ID NO: 2809670 - RNA, 17 nt, Human
cagauuguuucuauaca

SEQ ID NO: 2809671 - RNA, 19 nt, Human
cagauuguuucuauacaaa

SEQ ID NO: 2809672 - RNA, 20 nt, Human
cagauuguuucuauacaaau

SEQ ID NO: 2809673 - RNA, 15 nt, Human
cagauugucuuaauu

SEQ ID NO: 2809674 - RNA, 20 nt, Human
cagauugucuuaauuucuau

SEQ ID NO: 2809675 - RNA, 16 nt, Human
cagauugugccacugc

SEQ ID NO: 2809676 - RNA, 13 nt, Human
cagauuuaauaca

SEQ ID NO: 2809677 - RNA, 13 nt, Human
cagcaccugccuc

SEQ ID NO: 2809678 - RNA, 15 nt, Human
cagcaccugccuccu

SEQ ID NO: 2809679 - RNA, 19 nt, Human
cagcaccugccuccucguu

SEQ ID NO: 2809680 - RNA, 21 nt, Human
cagcaccacccuagucccuuc

SEQ ID NO: 2809681 - RNA, 22 nt, Human
cagcaccacccuagucccuucc

SEQ ID NO: 2809682 - RNA, 16 nt, Human
cagauuucauaccuca

SEQ ID NO: 2809683 - RNA, 19 nt, Human
cagagcugacacaggauga

SEQ ID NO: 2809684 - RNA, 19 nt, Human
cagagcuuggacuggaugc

SEQ ID NO: 2809685 - RNA, 15 nt, Human
cagagcuuggacugg

SEQ ID NO: 2809686 - RNA, 16 nt, Human
cagagcuuggacugga

SEQ ID NO: 2809687 - RNA, 23 nt, Human
cagagcuucuuccaggugcccag

SEQ ID NO: 2809688 - RNA, 20 nt, Human
cagagcuucuuccaggugcc

SEQ ID NO: 2809689 - RNA, 18 nt, Human
cagaggggcuuucuggag

SEQ ID NO: 2809690 - RNA, 23 nt, Human
cagaggaaacaauauuuauaaag

SEQ ID NO: 2809691 - RNA, 13 nt, Human
cagagcuccucug

SEQ ID NO: 2809692 - RNA, 16 nt, Human
cagagcugaagaguug

SEQ ID NO: 2809693 - RNA, 21 nt, Human
cagagcugaagaguugccccg

SEQ ID NO: 2809694 - RNA, 14 nt, Human
cagagcugacacag

SEQ ID NO: 2809695 - RNA, 15 nt, Human
cagagcugacacagg

SEQ ID NO: 2809696 - RNA, 23 nt, Human
cagagaggguggugaccucugcc

SEQ ID NO: 2809697 - RNA, 21 nt, Human
cagagagggcaggcaugaagu

SEQ ID NO: 2809698 - RNA, 22 nt, Human
cagagaggguggugaccucugc

SEQ ID NO: 2809699 - RNA, 20 nt, Human
cagagaggguggugaccucu

SEQ ID NO: 2809700 - RNA, 17 nt, Human
cagagaggguggugacc

SEQ ID NO: 2809701 - RNA, 12 nt, Human
cagagagggugg

SEQ ID NO: 2809702 - RNA, 16 nt, Human
cagagagggcaggcau

SEQ ID NO: 2809703 - RNA, 18 nt, Human
cagagagggcaggcauga

SEQ ID NO: 2809704 - RNA, 13 nt, Human
cagagagggcagg

SEQ ID NO: 2809705 - RNA, 14 nt, Human
cagagagggcaggc

SEQ ID NO: 2809706 - RNA, 15 nt, Human
cagagagggcaggca

SEQ ID NO: 2809707 - RNA, 9 nt, Human
cagagagag

SEQ ID NO: 2809708 - RNA, 14 nt, Human
cagagacuuuguag

SEQ ID NO: 2809709 - RNA, 21 nt, Human
cagagacugucccugaaaccu

SEQ ID NO: 2809710 - RNA, 19 nt, Human
cagaggggcuuucuggaga

SEQ ID NO: 2809711 - RNA, 17 nt, Human
cagagggggacugcugc

SEQ ID NO: 2809712 - RNA, 21 nt, Human
cagagggggacugcugcugcc

SEQ ID NO: 2809713 - RNA, 14 nt, Human
cagauagaaagcau

SEQ ID NO: 2809714 - RNA, 15 nt, Human
cagauagaaagcauu

SEQ ID NO: 2809715 - RNA, 16 nt, Human
cagauagaaagcauua

SEQ ID NO: 2809716 - RNA, 16 nt, Human
cagauagaaucaauca

SEQ ID NO: 2809717 - RNA, 21 nt, Human
cagauagagaguuguugugua

SEQ ID NO: 2809718 - RNA, 15 nt, Human
cagauauacuuugug

SEQ ID NO: 2809719 - RNA, 18 nt, Human
cagauauacuuuguggac

SEQ ID NO: 2809720 - RNA, 19 nt, Human
cagauauauuaagugacug

SEQ ID NO: 2809721 - RNA, 20 nt, Human
cagauauauaucauauuggu

SEQ ID NO: 2809722 - RNA, 21 nt, Human
cagagagggagagcagagaaa

SEQ ID NO: 2809723 - RNA, 14 nt, Human
cagauccccaagcc

SEQ ID NO: 2809724 - RNA, 19 nt, Human
caggcuaaggcguggagcu

SEQ ID NO: 2809725 - RNA, 13 nt, Human
caggcuacacuga

SEQ ID NO: 2809726 - RNA, 22 nt, Human
caggcguucagcucacuguucu

SEQ ID NO: 2809727 - RNA, 13 nt, Human
caggcgugagcca

SEQ ID NO: 2809728 - RNA, 19 nt, Human
caggcguucagcucacugu

SEQ ID NO: 2809729 - RNA, 20 nt, Human
caggcuacacugacacuggu

SEQ ID NO: 2809730 - RNA, 14 nt, Human
caggcuacuagaau

SEQ ID NO: 2809731 - RNA, 16 nt, Human
caggccuuaucuccaa

SEQ ID NO: 2809732 - RNA, 22 nt, Human
caggccuuaucuccaagaccag

SEQ ID NO: 2809733 - RNA, 17 nt, Human
caggccuuaucuccaag

SEQ ID NO: 2809734 - RNA, 12 nt, Human
caggccugugug

SEQ ID NO: 2809735 - RNA, 16 nt, Human
caggcgauccaccugu

SEQ ID NO: 2809736 - RNA, 20 nt, Human
caggcgagagaggagccaga

SEQ ID NO: 2809737 - RNA, 19 nt, Human
caggcgauccaccugucuc

SEQ ID NO: 2809738 - RNA, 21 nt, Human
caggcggugggcacccacccu

SEQ ID NO: 2809739 - RNA, 13 nt, Human
caggcguucagcu

SEQ ID NO: 2809740 - RNA, 21 nt, Human
caggcgugagccaccgugccu

SEQ ID NO: 2809741 - RNA, 22 nt, Human
caggccggugugggcugugucg

SEQ ID NO: 2809742 - RNA, 20 nt, Human
caggccgggguggagcaugg

SEQ ID NO: 2809743 - RNA, 19 nt, Human
caggccggugugggcugug

SEQ ID NO: 2809744 - RNA, 19 nt, Human
caggccgggguggagcaug

SEQ ID NO: 2809745 - RNA, 12 nt, Human
caggccucugug

SEQ ID NO: 2809746 - RNA, 13 nt, Human
caggccucugugu

SEQ ID NO: 2809747 - RNA, 14 nt, Human
caggccucuguguc

SEQ ID NO: 2809748 - RNA, 15 nt, Human
caggccucugugucc

SEQ ID NO: 2809749 - RNA, 17 nt, Human
caggccucuguguccuu

SEQ ID NO: 2809750 - RNA, 22 nt, Human
caggccucuguguccuucccug

SEQ ID NO: 2809751 - RNA, 20 nt, Human
caggccggcgagcccugugg

SEQ ID NO: 2809752 - RNA, 13 nt, Human
caggccgggccug

SEQ ID NO: 2809753 - RNA, 16 nt, Human
caggccgggccuguac

SEQ ID NO: 2809754 - RNA, 17 nt, Human
caggccgggccuguaca

SEQ ID NO: 2809755 - RNA, 18 nt, Human
caggccgggccuguacag

SEQ ID NO: 2809756 - RNA, 19 nt, Human
caggccgggccuguacagu

SEQ ID NO: 2809757 - RNA, 21 nt, Human
caggccgggccuguacagucu

SEQ ID NO: 2809758 - RNA, 19 nt, Human
caggccuaaucucauaccu

SEQ ID NO: 2809759 - RNA, 18 nt, Human
caggggaaaacuguuacc

SEQ ID NO: 2809760 - RNA, 17 nt, Human
cagggcuccucccagcu

SEQ ID NO: 2809761 - RNA, 18 nt, Human
cagggcuccucccagcuu

SEQ ID NO: 2809762 - RNA, 19 nt, Human
cagggcuccucccagcuug

SEQ ID NO: 2809763 - RNA, 20 nt, Human
cagggcuccucccagcuugu

SEQ ID NO: 2809764 - RNA, 19 nt, Human
cagggcuuaccuguacacu

SEQ ID NO: 2809765 - RNA, 21 nt, Human
cagggcuuaccuguacacuga

SEQ ID NO: 2809766 - RNA, 23 nt, Human
cagggcuuaccuguacacugacu

SEQ ID NO: 2809767 - RNA, 12 nt, Human
cagggcucugac

SEQ ID NO: 2809768 - RNA, 15 nt, Human
cagggcucugaccag

SEQ ID NO: 2809769 - RNA, 15 nt, Human
cagggcucugcccca

SEQ ID NO: 2809770 - RNA, 16 nt, Human
cagggcucugccccag

SEQ ID NO: 2809771 - RNA, 10 nt, Human
caggcugggc

SEQ ID NO: 2809772 - RNA, 21 nt, Human
cagggagcaggcggugggcac

SEQ ID NO: 2809773 - RNA, 14 nt, Human
cagggagcagggaa

SEQ ID NO: 2809774 - RNA, 21 nt, Human
cagggagcagggaaggccuga

SEQ ID NO: 2809775 - RNA, 20 nt, Human
cagggagcagggaaggccug

SEQ ID NO: 2809776 - RNA, 18 nt, Human
cagggagcagggaaggcc

SEQ ID NO: 2809777 - RNA, 16 nt, Human
cagggagcagggaagg

SEQ ID NO: 2809778 - RNA, 15 nt, Human
cagggcuacccuccc

SEQ ID NO: 2809779 - RNA, 17 nt, Human
cagggcuacccuccccc

SEQ ID NO: 2809780 - RNA, 16 nt, Human
caggaccaucuucccg

SEQ ID NO: 2809781 - RNA, 17 nt, Human
caggaccucccuuccga

SEQ ID NO: 2809782 - RNA, 19 nt, Human
caggaccucccuuccgacc

SEQ ID NO: 2809783 - RNA, 20 nt, Human
caggaccucccuuccgaccc

SEQ ID NO: 2809784 - RNA, 22 nt, Human
caggaccucccuuccgacccuc

SEQ ID NO: 2809785 - RNA, 23 nt, Human
caggaccucccuuccgacccucu

SEQ ID NO: 2809786 - RNA, 17 nt, Human
caggacaugcugaagcc

SEQ ID NO: 2809787 - RNA, 13 nt, Human
caggaccaagcca

SEQ ID NO: 2809788 - RNA, 15 nt, Human
caggaccaagccaca

SEQ ID NO: 2809789 - RNA, 13 nt, Human
caggacaugcuga

SEQ ID NO: 2809790 - RNA, 16 nt, Human
caggacaugcugaagc

SEQ ID NO: 2809791 - RNA, 17 nt, Human
caggcaaugcuggcugu

SEQ ID NO: 2809792 - RNA, 16 nt, Human
caggcaaugcuggcug

SEQ ID NO: 2809793 - RNA, 15 nt, Human
caggcaaugcuggcu

SEQ ID NO: 2809794 - RNA, 14 nt, Human
caggcaaugcuggc

SEQ ID NO: 2809795 - RNA, 13 nt, Human
caggaggcgcccu

SEQ ID NO: 2809796 - RNA, 22 nt, Human
caggaggcgcccuuggcuucug

SEQ ID NO: 2809797 - RNA, 17 nt, Human
caggaggcgcccuuggc

SEQ ID NO: 2809798 - RNA, 12 nt, Human
caggaggcugag

SEQ ID NO: 2809799 - RNA, 16 nt, Human
caggaggcugaggcag

SEQ ID NO: 2809800 - RNA, 15 nt, Human
caggaggcugaggca

SEQ ID NO: 2809801 - RNA, 13 nt, Human
caggaggcugagg

SEQ ID NO: 2809802 - RNA, 15 nt, Human
caggaggcugagggg

SEQ ID NO: 2809803 - RNA, 21 nt, Human
caggaggcugaggcaggagga

SEQ ID NO: 2809804 - RNA, 20 nt, Human
caggaggcugaggcaggagg

SEQ ID NO: 2809805 - RNA, 19 nt, Human
caggaggcugaggcaggag

SEQ ID NO: 2809806 - RNA, 18 nt, Human
caggaggcugaggcagga

SEQ ID NO: 2809807 - RNA, 17 nt, Human
caggaggcugaggcagg

SEQ ID NO: 2809808 - RNA, 18 nt, Human
caggaggccaggccggcg

SEQ ID NO: 2809809 - RNA, 22 nt, Human
caggaggauugcuugagcccag

SEQ ID NO: 2809810 - RNA, 23 nt, Human
caggaggaaucaugucaggccug

SEQ ID NO: 2809811 - RNA, 23 nt, Human
caggcacuagccuuuggcucugg

SEQ ID NO: 2809812 - RNA, 14 nt, Human
caggcacgguuugg

SEQ ID NO: 2809813 - RNA, 16 nt, Human
caggcacuagccuuug

SEQ ID NO: 2809814 - RNA, 22 nt, Human
caggcacuagccuuuggcucug

SEQ ID NO: 2809815 - RNA, 19 nt, Human
caggcaccuagcaauucca

SEQ ID NO: 2809816 - RNA, 21 nt, Human
caggaggcuuggaaagcauca

SEQ ID NO: 2809817 - RNA, 14 nt, Human
caggccaggccagc

SEQ ID NO: 2809818 - RNA, 12 nt, Human
caggaaagaaua

SEQ ID NO: 2809819 - RNA, 13 nt, Human
caggaaagaauag

SEQ ID NO: 2809820 - RNA, 21 nt, Human
cagcugucccugcccuucuuc

SEQ ID NO: 2809821 - RNA, 17 nt, Human
cagcugccucacuuccu

SEQ ID NO: 2809822 - RNA, 13 nt, Human
cagcuucaccaga

SEQ ID NO: 2809823 - RNA, 14 nt, Human
cagcuucaccagag

SEQ ID NO: 2809824 - RNA, 13 nt, Human
caggaaaccaaca

SEQ ID NO: 2809825 - RNA, 18 nt, Human
caggaaaccaacacccaa

SEQ ID NO: 2809826 - RNA, 20 nt, Human
caggaaacccagucgcccuu

SEQ ID NO: 2809827 - RNA, 23 nt, Human
caggaaaauuguuugaacccagg

SEQ ID NO: 2809828 - RNA, 16 nt, Human
cagcuucaccagagca

SEQ ID NO: 2809829 - RNA, 14 nt, Human
cagcugccucacuu

SEQ ID NO: 2809830 - RNA, 22 nt, Human
cagcugccgggccugauuuggu

SEQ ID NO: 2809831 - RNA, 21 nt, Human
cagcugagagacuuuuaauca

SEQ ID NO: 2809832 - RNA, 22 nt, Human
cagcugagaaaaugagugacua

SEQ ID NO: 2809833 - RNA, 18 nt, Human
cagcuaaauuuucugaaa

SEQ ID NO: 2809834 - RNA, 17 nt, Human
cagcuaacaauugugaa

SEQ ID NO: 2809835 - RNA, 15 nt, Human
cagcuaacacacagc

SEQ ID NO: 2809836 - RNA, 16 nt, Human
cagcuaacacacagcu

SEQ ID NO: 2809837 - RNA, 17 nt, Human
cagcuaacacacagcuc

SEQ ID NO: 2809838 - RNA, 18 nt, Human
cagcuaacacacagcucc

SEQ ID NO: 2809839 - RNA, 20 nt, Human
cagcuaacacacagcuccca

SEQ ID NO: 2809840 - RNA, 14 nt, Human
cagcggccccugca

SEQ ID NO: 2809841 - RNA, 15 nt, Human
cagcggccccugcau

SEQ ID NO: 2809842 - RNA, 16 nt, Human
cagcggccccugcauc

SEQ ID NO: 2809843 - RNA, 17 nt, Human
cagcggagucuguccug

SEQ ID NO: 2809844 - RNA, 21 nt, Human
cagcggagucuguccugugac

SEQ ID NO: 2809845 - RNA, 16 nt, Human
cagcgcuuugggaggc

SEQ ID NO: 2809846 - RNA, 22 nt, Human
cagcgcuuugggaggccgaggc

SEQ ID NO: 2809847 - RNA, 13 nt, Human
cagcgcucugccu

SEQ ID NO: 2809848 - RNA, 20 nt, Human
cagcgcucugccucaccgcu

SEQ ID NO: 2809849 - RNA, 15 nt, Human
caauauuugaauuuu

SEQ ID NO: 2809850 - RNA, 21 nt, Human
caauauuucugcuuucuuuga

SEQ ID NO: 2809851 - RNA, 22 nt, Human
caauauuucugcuuucuuugau

SEQ ID NO: 2809852 - RNA, 23 nt, Human
caauauuucugcuuucuuugauu

SEQ ID NO: 2809853 - RNA, 17 nt, Human
caauauuuauaaagaau

SEQ ID NO: 2809854 - RNA, 14 nt, Human
caauauuuauggau

SEQ ID NO: 2809855 - RNA, 19 nt, Human
caauauuuauggaugcaac

SEQ ID NO: 2809856 - RNA, 14 nt, Human
caauauuuuuagau

SEQ ID NO: 2809857 - RNA, 19 nt, Human
caauauuugaauuuuaaau

SEQ ID NO: 2809858 - RNA, 20 nt, Human
caaugccauccucaaacacu

SEQ ID NO: 2809859 - RNA, 20 nt, Human
caaugcccguaaugcuuaga

SEQ ID NO: 2809860 - RNA, 20 nt, Human
caaugcuauuuuuguuuuua

SEQ ID NO: 2809861 - RNA, 19 nt, Human
caaugcugaugaaucacug

SEQ ID NO: 2809862 - RNA, 20 nt, Human
caaugcugaugaaucacugu

SEQ ID NO: 2809863 - RNA, 23 nt, Human
caaugcugaugaaucacuguuuu

SEQ ID NO: 2809864 - RNA, 16 nt, Human
caaugccauccucaaa

SEQ ID NO: 2809865 - RNA, 18 nt, Human
caaugccauccucaaaca

SEQ ID NO: 2809866 - RNA, 15 nt, Human
caaugccacauacuu

SEQ ID NO: 2809867 - RNA, 19 nt, Human
caaugccacauacuugcag

SEQ ID NO: 2809868 - RNA, 20 nt, Human
caaugccacauacuugcagc

SEQ ID NO: 2809869 - RNA, 17 nt, Human
caaucaaauaaguauuu

SEQ ID NO: 2809870 - RNA, 22 nt, Human
caaucaaauaaguauuuauaau

SEQ ID NO: 2809871 - RNA, 23 nt, Human
caaucaaauaaguauuuauaaua

SEQ ID NO: 2809872 - RNA, 12 nt, Human
caaucaacacua

SEQ ID NO: 2809873 - RNA, 14 nt, Human
caaucaacacuacc

SEQ ID NO: 2809874 - RNA, 12 nt, Human
caaucagcacug

SEQ ID NO: 2809875 - RNA, 13 nt, Human
caaucagcacuga

SEQ ID NO: 2809876 - RNA, 14 nt, Human
caaucagcacugaa

SEQ ID NO: 2809877 - RNA, 15 nt, Human
caaucagcacugaaa

SEQ ID NO: 2809878 - RNA, 16 nt, Human
caaucagcacugaaaa

SEQ ID NO: 2809879 - RNA, 17 nt, Human
caaucagcacugaaaau

SEQ ID NO: 2809880 - RNA, 11 nt, Human
caaucacuguc

SEQ ID NO: 2809881 - RNA, 15 nt, Human
caaucacuguccucc

SEQ ID NO: 2809882 - RNA, 15 nt, Human
caaucagaaugaaca

SEQ ID NO: 2809883 - RNA, 19 nt, Human
caaucagagaccaggcccu

SEQ ID NO: 2809884 - RNA, 20 nt, Human
caaucagagaccaggcccug

SEQ ID NO: 2809885 - RNA, 21 nt, Human
caaucagagaccaggcccugg

SEQ ID NO: 2809886 - RNA, 15 nt, Human
caauggcagccuugg

SEQ ID NO: 2809887 - RNA, 14 nt, Human
caauggcagccuug

SEQ ID NO: 2809888 - RNA, 13 nt, Human
caauggcagccuu

SEQ ID NO: 2809889 - RNA, 14 nt, Human
caaugcugauuugg

SEQ ID NO: 2809890 - RNA, 13 nt, Human
caaugcugauguc

SEQ ID NO: 2809891 - RNA, 20 nt, Human
caaugcugauguccucacca

SEQ ID NO: 2809892 - RNA, 16 nt, Human
caaugcugauuuggug

SEQ ID NO: 2809893 - RNA, 21 nt, Human
caaugcugauuuggugaccaa

SEQ ID NO: 2809894 - RNA, 16 nt, Human
caauugguuaaucuuu

SEQ ID NO: 2809895 - RNA, 12 nt, Human
caauuggaggaa

SEQ ID NO: 2809896 - RNA, 21 nt, Human
caauugugagccaccacgucc

SEQ ID NO: 2809897 - RNA, 13 nt, Human
caauugugcugcc

SEQ ID NO: 2809898 - RNA, 18 nt, Human
caauugugagccaccacg

SEQ ID NO: 2809899 - RNA, 21 nt, Human
caauugucgaaaagagucuuc

SEQ ID NO: 2809900 - RNA, 15 nt, Human
caauuucaagguucu

SEQ ID NO: 2809901 - RNA, 16 nt, Human
caauuucaagguucua

SEQ ID NO: 2809902 - RNA, 19 nt, Human
caauuucaagguucuaacc

SEQ ID NO: 2809903 - RNA, 16 nt, Human
cacaaggauugaaaau

SEQ ID NO: 2809904 - RNA, 18 nt, Human
cacaaggauugaaaauuc

SEQ ID NO: 2809905 - RNA, 22 nt, Human
caaguuccaugggauacaaccu

SEQ ID NO: 2809906 - RNA, 21 nt, Human
caaguuccucuagugcccucc

SEQ ID NO: 2809907 - RNA, 12 nt, Human
caaguuauugua

SEQ ID NO: 2809908 - RNA, 20 nt, Human
caaguuauuguacagcuguu

SEQ ID NO: 2809909 - RNA, 22 nt, Human
caaguauuugggaagugaagac

SEQ ID NO: 2809910 - RNA, 19 nt, Human
caaguauuugggaagugaa

SEQ ID NO: 2809911 - RNA, 12 nt, Human
caaguucuaaga

SEQ ID NO: 2809912 - RNA, 13 nt, Human
caaguucuaagau

SEQ ID NO: 2809913 - RNA, 14 nt, Human
caaguucuaagauu

SEQ ID NO: 2809914 - RNA, 20 nt, Human
caaggauugcuacuguccua

SEQ ID NO: 2809915 - RNA, 19 nt, Human
caaggauugcuacuguccu

SEQ ID NO: 2809916 - RNA, 17 nt, Human
caaggccagaguggccu

SEQ ID NO: 2809917 - RNA, 15 nt, Human
caaggccagggacag

SEQ ID NO: 2809918 - RNA, 22 nt, Human
caaggccagaguggccuggcca

SEQ ID NO: 2809919 - RNA, 21 nt, Human
caaggccagaguggccuggcc

SEQ ID NO: 2809920 - RNA, 20 nt, Human
caaggccagaguggccuggc

SEQ ID NO: 2809921 - RNA, 19 nt, Human
caaggccagaguggccugg

SEQ ID NO: 2809922 - RNA, 18 nt, Human
caaggccagaguggccug

SEQ ID NO: 2809923 - RNA, 23 nt, Human
caaguaauauaauggaagagaaa

SEQ ID NO: 2809924 - RNA, 20 nt, Human
caaguaagagacucagccug

SEQ ID NO: 2809925 - RNA, 21 nt, Human
caaguaagagacucagccugc

SEQ ID NO: 2809926 - RNA, 22 nt, Human
caaguaagagacucagccugca

SEQ ID NO: 2809927 - RNA, 15 nt, Human
caaguaagaggcugg

SEQ ID NO: 2809928 - RNA, 16 nt, Human
caaguaagaggcugga

SEQ ID NO: 2809929 - RNA, 17 nt, Human
caaguaagaggcuggag

SEQ ID NO: 2809930 - RNA, 20 nt, Human
caaguaagaggcuggaguug

SEQ ID NO: 2809931 - RNA, 21 nt, Human
caagguuuuagguucuaaagu

SEQ ID NO: 2809932 - RNA, 23 nt, Human
caagguuuuagguucuaaaguuc

SEQ ID NO: 2809933 - RNA, 13 nt, Human
caagguuuuaggu

SEQ ID NO: 2809934 - RNA, 18 nt, Human
caagguuuuagguucuaa

SEQ ID NO: 2809935 - RNA, 20 nt, Human
caagguuuuagguucuaaag

SEQ ID NO: 2809936 - RNA, 15 nt, Human
caaggcccacaggag

SEQ ID NO: 2809937 - RNA, 21 nt, Human
caagcuccaucuccacuccag

SEQ ID NO: 2809938 - RNA, 13 nt, Human
caagcucccaagg

SEQ ID NO: 2809939 - RNA, 18 nt, Human
caagcucccaagggaugg

SEQ ID NO: 2809940 - RNA, 22 nt, Human
caagcucccaagggauggugcc

SEQ ID NO: 2809941 - RNA, 17 nt, Human
caagcuccaucuccacu

SEQ ID NO: 2809942 - RNA, 16 nt, Human
caagcucugcuccucu

SEQ ID NO: 2809943 - RNA, 14 nt, Human
caagcuccuccucg

SEQ ID NO: 2809944 - RNA, 16 nt, Human
caagcuccuccucgga

SEQ ID NO: 2809945 - RNA, 19 nt, Human
caagcuccuccucggaacc

SEQ ID NO: 2809946 - RNA, 20 nt, Human
caagcuccuccucggaaccg

SEQ ID NO: 2809947 - RNA, 15 nt, Human
caagcucugcuccuc

SEQ ID NO: 2809948 - RNA, 13 nt, Human
caagcucccugcc

SEQ ID NO: 2809949 - RNA, 16 nt, Human
caagcucccugcccca

SEQ ID NO: 2809950 - RNA, 19 nt, Human
caagcucccugccccaaau

SEQ ID NO: 2809951 - RNA, 20 nt, Human
caagcuccgccucccggguu

SEQ ID NO: 2809952 - RNA, 12 nt, Human
caagcuccuccu

SEQ ID NO: 2809953 - RNA, 19 nt, Human
caacuauaagcccacuguu

SEQ ID NO: 2809954 - RNA, 19 nt, Human
caacuauccugacuucuaa

SEQ ID NO: 2809955 - RNA, 22 nt, Human
caacuaugauuuggaaaauaaa

SEQ ID NO: 2809956 - RNA, 16 nt, Human
caaccccuucgcuccu

SEQ ID NO: 2809957 - RNA, 14 nt, Human
caaccccuucgcuc

SEQ ID NO: 2809958 - RNA, 17 nt, Human
caaccccuucgcuccug

SEQ ID NO: 2809959 - RNA, 16 nt, Human
caacuaguuuuguuua

SEQ ID NO: 2809960 - RNA, 19 nt, Human
caaccccuuaagcccuggc

SEQ ID NO: 2809961 - RNA, 20 nt, Human
caaccccuuaagcccuggcc

SEQ ID NO: 2809962 - RNA, 21 nt, Human
caaccccuuaagcccuggccc

SEQ ID NO: 2809963 - RNA, 14 nt, Human
caacccccagccug

SEQ ID NO: 2809964 - RNA, 23 nt, Human
caacccccaccccacacuuguuc

SEQ ID NO: 2809965 - RNA, 18 nt, Human
caacccccaccccacacu

SEQ ID NO: 2809966 - RNA, 17 nt, Human
caacccccaccccacac

SEQ ID NO: 2809967 - RNA, 14 nt, Human
caacccccacccca

SEQ ID NO: 2809968 - RNA, 13 nt, Human
caacccccacccc

SEQ ID NO: 2809969 - RNA, 12 nt, Human
caacccccaccc

SEQ ID NO: 2809970 - RNA, 11 nt, Human
caacccccacc

SEQ ID NO: 2809971 - RNA, 15 nt, Human
caacuauuuuuccaa

SEQ ID NO: 2809972 - RNA, 12 nt, Human
caacuauuuuau

SEQ ID NO: 2809973 - RNA, 21 nt, Human
caacuauuuuauuauccuaga

SEQ ID NO: 2809974 - RNA, 17 nt, Human
caacuauggaucagaau

SEQ ID NO: 2809975 - RNA, 16 nt, Human
caacuauggaucagaa

SEQ ID NO: 2809976 - RNA, 21 nt, Human
caacucccugccccccagccc

SEQ ID NO: 2809977 - RNA, 13 nt, Human
caacuccagcaac

SEQ ID NO: 2809978 - RNA, 22 nt, Human
caacuccagcaacuucuucucc

SEQ ID NO: 2809979 - RNA, 20 nt, Human
caacuccagcaacuucuucu

SEQ ID NO: 2809980 - RNA, 20 nt, Human
caacucccugccccccagcc

SEQ ID NO: 2809981 - RNA, 19 nt, Human
caacucccugccccccagc

SEQ ID NO: 2809982 - RNA, 18 nt, Human
caagaauagaugcugacu

SEQ ID NO: 2809983 - RNA, 23 nt, Human
caagaauaauucaauuuuaaaga

SEQ ID NO: 2809984 - RNA, 22 nt, Human
caagaagcuuuaauauuuaaau

SEQ ID NO: 2809985 - RNA, 16 nt, Human
caagaauauugucccu

SEQ ID NO: 2809986 - RNA, 18 nt, Human
caagaauagcaucuguac

SEQ ID NO: 2809987 - RNA, 19 nt, Human
caagaauagcaucuguaca

SEQ ID NO: 2809988 - RNA, 22 nt, Human
caagaauagcaucuguacaaag

SEQ ID NO: 2809989 - RNA, 23 nt, Human
caagaauagcaucuguacaaagg

SEQ ID NO: 2809990 - RNA, 14 nt, Human
caagaauccacauu

SEQ ID NO: 2809991 - RNA, 18 nt, Human
caagaauccacauuucua

SEQ ID NO: 2809992 - RNA, 19 nt, Human
caagaauccacauuucuaa

SEQ ID NO: 2809993 - RNA, 23 nt, Human
caacuccaccagauagcagaggg

SEQ ID NO: 2809994 - RNA, 22 nt, Human
caagacagaugccccagagcug

SEQ ID NO: 2809995 - RNA, 21 nt, Human
caagaauccacauuucuaaaa

SEQ ID NO: 2809996 - RNA, 22 nt, Human
caagaauccacauuucuaaaau

SEQ ID NO: 2809997 - RNA, 12 nt, Human
caagcaagcucc

SEQ ID NO: 2809998 - RNA, 23 nt, Human
caagcaagcucccaagggauggu

SEQ ID NO: 2809999 - RNA, 15 nt, Human
caagcaagcucucuu

SEQ ID NO: 2810000 - RNA, 22 nt, Human
caagcaagcucucuugccgagg

SEQ ID NO: 2810001 - RNA, 18 nt, Human
caagcaagaaacacuggg

SEQ ID NO: 2810002 - RNA, 18 nt, Human
caagcaacacagaggaau

SEQ ID NO: 2810003 - RNA, 13 nt, Human
caagcaagaaaca

SEQ ID NO: 2810004 - RNA, 19 nt, Human
caagauccugucuuuaagg

SEQ ID NO: 2810005 - RNA, 15 nt, Human
caagaucauucagug

SEQ ID NO: 2810006 - RNA, 19 nt, Human
caagaccaccacuucgaaa

SEQ ID NO: 2810007 - RNA, 16 nt, Human
caagcaaaaggagaga

SEQ ID NO: 2810008 - RNA, 23 nt, Human
caagauuuugggagaguaaagcu

SEQ ID NO: 2810009 - RNA, 22 nt, Human
caagauccugucuuuaaggaaa

SEQ ID NO: 2810010 - RNA, 19 nt, Human
caagaugagagaacuggag

SEQ ID NO: 2810011 - RNA, 21 nt, Human
caagaugagauuggcauggcu

SEQ ID NO: 2810012 - RNA, 23 nt, Human
caagaugagauuggcauggcuuu

SEQ ID NO: 2810013 - RNA, 18 nt, Human
caagaugaaggagaggca

SEQ ID NO: 2810014 - RNA, 15 nt, Human
caagaugacuggggu

SEQ ID NO: 2810015 - RNA, 16 nt, Human
caagaugacuggggug

SEQ ID NO: 2810016 - RNA, 17 nt, Human
caagaugacuggggugg

SEQ ID NO: 2810017 - RNA, 15 nt, Human
caagcaaguucugag

SEQ ID NO: 2810018 - RNA, 13 nt, Human
caagcaccuccug

SEQ ID NO: 2810019 - RNA, 20 nt, Human
caagcacaucugcauuuuca

SEQ ID NO: 2810020 - RNA, 17 nt, Human
caagcacaucugcauuu

SEQ ID NO: 2810021 - RNA, 14 nt, Human
caagcaccuccugc

SEQ ID NO: 2810022 - RNA, 18 nt, Human
caagcaccuagccucgcu

SEQ ID NO: 2810023 - RNA, 13 nt, Human
cacuccagugcca

SEQ ID NO: 2810024 - RNA, 17 nt, Human
cacuccagaccccuggc

SEQ ID NO: 2810025 - RNA, 12 nt, Human
cacuccauuccc

SEQ ID NO: 2810026 - RNA, 13 nt, Human
cacuccauuccca

SEQ ID NO: 2810027 - RNA, 15 nt, Human
cacuccauucccaac

SEQ ID NO: 2810028 - RNA, 16 nt, Human
cacuccagugccagca

SEQ ID NO: 2810029 - RNA, 17 nt, Human
cacuccagugccagcaa

SEQ ID NO: 2810030 - RNA, 13 nt, Human
cacugaagcuggg

SEQ ID NO: 2810031 - RNA, 14 nt, Human
cacugaagccugcg

SEQ ID NO: 2810032 - RNA, 17 nt, Human
cacugaagccugcguug

SEQ ID NO: 2810033 - RNA, 15 nt, Human
cacucccacccaguc

SEQ ID NO: 2810034 - RNA, 11 nt, Human
cacugaagacg

SEQ ID NO: 2810035 - RNA, 17 nt, Human
cacugaagcugggauuc

SEQ ID NO: 2810036 - RNA, 19 nt, Human
cacugaaguagugugcagu

SEQ ID NO: 2810037 - RNA, 19 nt, Human
cacugaagggaaucacauc

SEQ ID NO: 2810038 - RNA, 15 nt, Human
cacgcuggagugcag

SEQ ID NO: 2810039 - RNA, 20 nt, Human
cacgcuggagugcagugagc

SEQ ID NO: 2810040 - RNA, 18 nt, Human
cacgcuggagugcaguga

SEQ ID NO: 2810041 - RNA, 17 nt, Human
cacgcuggagugcagug

SEQ ID NO: 2810042 - RNA, 16 nt, Human
cacgcuggagugcagu

SEQ ID NO: 2810043 - RNA, 21 nt, Human
cacgcuggagugcagugagcc

SEQ ID NO: 2810044 - RNA, 18 nt, Human
cacgcuggguccuaauua

SEQ ID NO: 2810045 - RNA, 13 nt, Human
cacgcuguucuaa

SEQ ID NO: 2810046 - RNA, 14 nt, Human
cacgcuucacagug

SEQ ID NO: 2810047 - RNA, 15 nt, Human
cacuacauucauuua

SEQ ID NO: 2810048 - RNA, 12 nt, Human
cacuacugggug

SEQ ID NO: 2810049 - RNA, 13 nt, Human
cacuacugggugu

SEQ ID NO: 2810050 - RNA, 14 nt, Human
cacuacuggguguc

SEQ ID NO: 2810051 - RNA, 15 nt, Human
cacuacuggguguca

SEQ ID NO: 2810052 - RNA, 16 nt, Human
cacuacugggugucau

SEQ ID NO: 2810053 - RNA, 21 nt, Human
cacuacugggugucauuucau

SEQ ID NO: 2810054 - RNA, 22 nt, Human
cacuacugggugucauuucauu

SEQ ID NO: 2810055 - RNA, 12 nt, Human
cacuagaaaacu

SEQ ID NO: 2810056 - RNA, 20 nt, Human
cacuagaaaagcugaucaua

SEQ ID NO: 2810057 - RNA, 17 nt, Human
cacuagaacucuccauc

SEQ ID NO: 2810058 - RNA, 13 nt, Human
cacuagaauggau

SEQ ID NO: 2810059 - RNA, 18 nt, Human
cacuagaauggauaaaau

SEQ ID NO: 2810060 - RNA, 19 nt, Human
cacuagaauggauaaaaua

SEQ ID NO: 2810061 - RNA, 15 nt, Human
cacuagaacucucca

SEQ ID NO: 2810062 - RNA, 16 nt, Human
cacuagacccacugga

SEQ ID NO: 2810063 - RNA, 16 nt, Human
cacuagagaaugcaca

SEQ ID NO: 2810064 - RNA, 23 nt, Human
cacuagagaaugcacagauauac

SEQ ID NO: 2810065 - RNA, 14 nt, Human
cacuccagaccccu

SEQ ID NO: 2810066 - RNA, 16 nt, Human
cacuccagaccccugg

SEQ ID NO: 2810067 - RNA, 21 nt, Human
cacuacauuauaaaugucucu

SEQ ID NO: 2810068 - RNA, 15 nt, Human
cacggacaauaaacc

SEQ ID NO: 2810069 - RNA, 17 nt, Human
cacggacaauaaaccuc

SEQ ID NO: 2810070 - RNA, 19 nt, Human
cacggacaauaaaccuccg

SEQ ID NO: 2810071 - RNA, 20 nt, Human
cacggagauaugaagagcaa

SEQ ID NO: 2810072 - RNA, 14 nt, Human
caccugcccugccc

SEQ ID NO: 2810073 - RNA, 12 nt, Human
cacccuccuuuc

SEQ ID NO: 2810074 - RNA, 23 nt, Human
cacccucgaagcgcgccacucgc

SEQ ID NO: 2810075 - RNA, 19 nt, Human
cacccucgaagcgcgccac

SEQ ID NO: 2810076 - RNA, 24 nt, Human
cacccucgaagcgcgccacucgcu

SEQ ID NO: 2810077 - RNA, 16 nt, Human
cacccucgaagcgcgc

SEQ ID NO: 2810078 - RNA, 12 nt, Human
cacccugcucuc

SEQ ID NO: 2810079 - RNA, 12 nt, Human
cacccugcuaca

SEQ ID NO: 2810080 - RNA, 21 nt, Human
cacccuggaggauuucaucuc

SEQ ID NO: 2810081 - RNA, 11 nt, Human
cacccuggaau

SEQ ID NO: 2810082 - RNA, 16 nt, Human
cacccugggagacaga

SEQ ID NO: 2810083 - RNA, 17 nt, Human
cacccugggagacagac

SEQ ID NO: 2810084 - RNA, 17 nt, Human
cacccugaggucaggga

SEQ ID NO: 2810085 - RNA, 20 nt, Human
cacccugaggucagggagug

SEQ ID NO: 2810086 - RNA, 17 nt, Human
cacccugauuucuugcu

SEQ ID NO: 2810087 - RNA, 11 nt, Human
cacccugcaag

SEQ ID NO: 2810088 - RNA, 13 nt, Human
cacccugcaaggc

SEQ ID NO: 2810089 - RNA, 14 nt, Human
cacccugcaaggcc

SEQ ID NO: 2810090 - RNA, 17 nt, Human
cacccugcaaggcccac

SEQ ID NO: 2810091 - RNA, 21 nt, Human
cacccugcaaggcccacagga

SEQ ID NO: 2810092 - RNA, 23 nt, Human
cacccugcaaggcccacaggagg

SEQ ID NO: 2810093 - RNA, 22 nt, Human
caccugccagccuggcuucugg

SEQ ID NO: 2810094 - RNA, 13 nt, Human
caccugcccugcc

SEQ ID NO: 2810095 - RNA, 12 nt, Human
caccugcccugc

SEQ ID NO: 2810096 - RNA, 20 nt, Human
caccugccagccuggcuucu

SEQ ID NO: 2810097 - RNA, 17 nt, Human
caccugccagccuggcu

SEQ ID NO: 2810098 - RNA, 16 nt, Human
caccugccagccuggc

SEQ ID NO: 2810099 - RNA, 15 nt, Human
caccugccagccugg

SEQ ID NO: 2810100 - RNA, 14 nt, Human
caccugccagccug

SEQ ID NO: 2810101 - RNA, 13 nt, Human
caccugccagccu

SEQ ID NO: 2810102 - RNA, 16 nt, Human
caccuauagucccagc

SEQ ID NO: 2810103 - RNA, 17 nt, Human
cacccuggggagaaagu

SEQ ID NO: 2810104 - RNA, 13 nt, Human
cacccuggggccu

SEQ ID NO: 2810105 - RNA, 16 nt, Human
cacccuguaccucauc

SEQ ID NO: 2810106 - RNA, 22 nt, Human
cacccuguaccucaucccauga

SEQ ID NO: 2810107 - RNA, 16 nt, Human
cacccuguacuguucu

SEQ ID NO: 2810108 - RNA, 17 nt, Human
cacccuguacuguucug

SEQ ID NO: 2810109 - RNA, 21 nt, Human
cacccuguacuguucuguguc

SEQ ID NO: 2810110 - RNA, 21 nt, Human
cacccuggggccuggaccugc

SEQ ID NO: 2810111 - RNA, 22 nt, Human
cacccuggggccuggaccugcc

SEQ ID NO: 2810112 - RNA, 14 nt, Human
cacccuggggccug

SEQ ID NO: 2810113 - RNA, 15 nt, Human
cacccuggggccugg

SEQ ID NO: 2810114 - RNA, 19 nt, Human
cacccuggggccuggaccu

SEQ ID NO: 2810115 - RNA, 20 nt, Human
cacccuggggccuggaccug

SEQ ID NO: 2810116 - RNA, 15 nt, Human
caccuaguccaguga

SEQ ID NO: 2810117 - RNA, 15 nt, Human
cacccugcugccuuc

SEQ ID NO: 2810118 - RNA, 23 nt, Human
cacccuguacuguucugugucuu

SEQ ID NO: 2810119 - RNA, 22 nt, Human
cacaucuugcucugcugacaga

SEQ ID NO: 2810120 - RNA, 21 nt, Human
cacaucuugcucugcugacag

SEQ ID NO: 2810121 - RNA, 20 nt, Human
cacaucuugcucugcugaca

SEQ ID NO: 2810122 - RNA, 15 nt, Human
cacaucuugcucugc

SEQ ID NO: 2810123 - RNA, 14 nt, Human
cacaucuugcucug

SEQ ID NO: 2810124 - RNA, 13 nt, Human
cacaucuugcucu

SEQ ID NO: 2810125 - RNA, 18 nt, Human
cacauccaacuccagcaa

SEQ ID NO: 2810126 - RNA, 16 nt, Human
cacauccaacuccagc

SEQ ID NO: 2810127 - RNA, 12 nt, Human
cacauccaacuc

SEQ ID NO: 2810128 - RNA, 19 nt, Human
cacauccaacuccagcaac

SEQ ID NO: 2810129 - RNA, 13 nt, Human
cacauccauuccc

SEQ ID NO: 2810130 - RNA, 14 nt, Human
cacauccauuccca

SEQ ID NO: 2810131 - RNA, 21 nt, Human
cacauccauucccaagaaaug

SEQ ID NO: 2810132 - RNA, 22 nt, Human
cacauccauucccaagaaaugc

SEQ ID NO: 2810133 - RNA, 12 nt, Human
cacaucccagcc

SEQ ID NO: 2810134 - RNA, 14 nt, Human
cacaucccagccca

SEQ ID NO: 2810135 - RNA, 15 nt, Human
cacaucccagcccaa

SEQ ID NO: 2810136 - RNA, 19 nt, Human
caccaggagaaccacuaca

SEQ ID NO: 2810137 - RNA, 17 nt, Human
caccaggagaaccacua

SEQ ID NO: 2810138 - RNA, 16 nt, Human
caccaggagaaccacu

SEQ ID NO: 2810139 - RNA, 19 nt, Human
caccagcccuuagcaggga

SEQ ID NO: 2810140 - RNA, 22 nt, Human
caccagccccagugcccacagg

SEQ ID NO: 2810141 - RNA, 16 nt, Human
cacauuuaagagacag

SEQ ID NO: 2810142 - RNA, 21 nt, Human
caccagccccagugcccacag

SEQ ID NO: 2810143 - RNA, 18 nt, Human
caccagccccagugccca

SEQ ID NO: 2810144 - RNA, 17 nt, Human
caccagccccagugccc

SEQ ID NO: 2810145 - RNA, 18 nt, Human
cacauuuauucugcucac

SEQ ID NO: 2810146 - RNA, 17 nt, Human
cacauuuauucugcuca

SEQ ID NO: 2810147 - RNA, 15 nt, Human
cacauuguuuuaaaa

SEQ ID NO: 2810148 - RNA, 16 nt, Human
cacauuguuuuaaaaa

SEQ ID NO: 2810149 - RNA, 18 nt, Human
cacauuguuuuaaaaaga

SEQ ID NO: 2810150 - RNA, 23 nt, Human
cacauuguuuuaaaaagaaacaa

SEQ ID NO: 2810151 - RNA, 19 nt, Human
cacauuuaagagacaguca

SEQ ID NO: 2810152 - RNA, 11 nt, Human
cacauuuaagg

SEQ ID NO: 2810153 - RNA, 13 nt, Human
cacauuuaaggau

SEQ ID NO: 2810154 - RNA, 14 nt, Human
cacauuuaaggaug

SEQ ID NO: 2810155 - RNA, 17 nt, Human
cacauuuagucucuuua

SEQ ID NO: 2810156 - RNA, 18 nt, Human
cacauuuagucucuuuau

SEQ ID NO: 2810157 - RNA, 19 nt, Human
cacauuuagucucuuuauu

SEQ ID NO: 2810158 - RNA, 19 nt, Human
cacaucuugcucugcugac

SEQ ID NO: 2810159 - RNA, 13 nt, Human
cacaucuuggcac

SEQ ID NO: 2810160 - RNA, 21 nt, Human
cacaucuuggcuauguaauuc

SEQ ID NO: 2810161 - RNA, 15 nt, Human
cacaucuuuaucugu

SEQ ID NO: 2810162 - RNA, 22 nt, Human
cacaucuuuaucuguucuugcu

SEQ ID NO: 2810163 - RNA, 23 nt, Human
cacaucuugcucugcugacagac

SEQ ID NO: 2810164 - RNA, 21 nt, Human
cacaugaaaccuacacacugu

SEQ ID NO: 2810165 - RNA, 14 nt, Human
cacaucuuuccugu

SEQ ID NO: 2810166 - RNA, 15 nt, Human
cacaucuuuccuguc

SEQ ID NO: 2810167 - RNA, 12 nt, Human
cacauuguuuua

SEQ ID NO: 2810168 - RNA, 13 nt, Human
cacaugaagaaau

SEQ ID NO: 2810169 - RNA, 14 nt, Human
cacaugaagaaaua

SEQ ID NO: 2810170 - RNA, 18 nt, Human
cacaugaagaaauacugc

SEQ ID NO: 2810171 - RNA, 22 nt, Human
cacaugaagaaauacugcacuu

SEQ ID NO: 2810172 - RNA, 12 nt, Human
cacccagcccac

SEQ ID NO: 2810173 - RNA, 21 nt, Human
cacccaggaggggaacacugc

SEQ ID NO: 2810174 - RNA, 22 nt, Human
cacccaggaggggaacacugcc

SEQ ID NO: 2810175 - RNA, 21 nt, Human
cacccaggccuauguugaucc

SEQ ID NO: 2810176 - RNA, 20 nt, Human
cacccaggcuggagugcagu

SEQ ID NO: 2810177 - RNA, 18 nt, Human
cacccagucucugcucca

SEQ ID NO: 2810178 - RNA, 19 nt, Human
cacccagucucugcuccac

SEQ ID NO: 2810179 - RNA, 15 nt, Human
cacccacucagcucc

SEQ ID NO: 2810180 - RNA, 21 nt, Human
cacccagaugggggaaagcac

SEQ ID NO: 2810181 - RNA, 14 nt, Human
cacccaugaagaca

SEQ ID NO: 2810182 - RNA, 21 nt, Human
cacccagaagaagauggcugu

SEQ ID NO: 2810183 - RNA, 17 nt, Human
cacccauaauccuuucu

SEQ ID NO: 2810184 - RNA, 17 nt, Human
auuuucucaaaagcauu

SEQ ID NO: 2810185 - RNA, 19 nt, Human
auuuucucaaaagcauuua

SEQ ID NO: 2810186 - RNA, 20 nt, Human
auuuucucaaaagcauuuau

SEQ ID NO: 2810187 - RNA, 22 nt, Human
auuuucucaaaagcauuuauca

SEQ ID NO: 2810188 - RNA, 23 nt, Human
auuuucucaaaagcauuuaucau

SEQ ID NO: 2810189 - RNA, 12 nt, Human
auuuuauaaagu

SEQ ID NO: 2810190 - RNA, 12 nt, Human
auuuucugaaag

SEQ ID NO: 2810191 - RNA, 18 nt, Human
auuuucugaaaguuaccc

SEQ ID NO: 2810192 - RNA, 22 nt, Human
auuuucugaaaguuacccacug

SEQ ID NO: 2810193 - RNA, 14 nt, Human
auuuucuccagcuc

SEQ ID NO: 2810194 - RNA, 14 nt, Human
auuuucuauguacu

SEQ ID NO: 2810195 - RNA, 15 nt, Human
auuuucuauguacua

SEQ ID NO: 2810196 - RNA, 19 nt, Human
auuuucuauguacuaguac

SEQ ID NO: 2810197 - RNA, 21 nt, Human
auuuucuauguacuaguacug

SEQ ID NO: 2810198 - RNA, 22 nt, Human
auuuucuauguacuaguacugu

SEQ ID NO: 2810199 - RNA, 23 nt, Human
auuuucuauguacuaguacugug

SEQ ID NO: 2810200 - RNA, 22 nt, Human
auuuucuggaauacaugaaaua

SEQ ID NO: 2810201 - RNA, 22 nt, Human
auuuucuggggcuccucacaua

SEQ ID NO: 2810202 - RNA, 23 nt, Human
auuuucuggggcuccucacauag

SEQ ID NO: 2810203 - RNA, 19 nt, Human
auuuucuggaauacaugaa

SEQ ID NO: 2810204 - RNA, 18 nt, Human
auuuucuggaauacauga

SEQ ID NO: 2810205 - RNA, 21 nt, Human
auuugcacuggaguucuaugc

SEQ ID NO: 2810206 - RNA, 16 nt, Human
auuugcacccuccgcc

SEQ ID NO: 2810207 - RNA, 13 nt, Human
auuuguguuuuaa

SEQ ID NO: 2810208 - RNA, 20 nt, Human
auuuguguuuuaauuuaaac

SEQ ID NO: 2810209 - RNA, 22 nt, Human
auuuguguguuauaccuugauu

SEQ ID NO: 2810210 - RNA, 14 nt, Human
auuuguuaaaauua

SEQ ID NO: 2810211 - RNA, 21 nt, Human
auuuguuaaaauuaucaauau

SEQ ID NO: 2810212 - RNA, 21 nt, Human
auuuguguuuuaauuuaaaca

SEQ ID NO: 2810213 - RNA, 14 nt, Human
auuuguuaaaauac

SEQ ID NO: 2810214 - RNA, 22 nt, Human
auuuguuaaaauacaguucugu

SEQ ID NO: 2810215 - RNA, 15 nt, Human
auuuguuauggcaga

SEQ ID NO: 2810216 - RNA, 21 nt, Human
auuuguuauggcagaugacaa

SEQ ID NO: 2810217 - RNA, 14 nt, Human
auuuguuacagcca

SEQ ID NO: 2810218 - RNA, 21 nt, Human
auuuguuaguuccuguaugaa

SEQ ID NO: 2810219 - RNA, 22 nt, Human
auuuguuaguuccuguaugaaa

SEQ ID NO: 2810220 - RNA, 12 nt, Human
auuuguucaagu

SEQ ID NO: 2810221 - RNA, 18 nt, Human
auuuguucacugaaggug

SEQ ID NO: 2810222 - RNA, 23 nt, Human
auuuguucacugaaggugauuca

SEQ ID NO: 2810223 - RNA, 17 nt, Human
auuuguuauuuucagua

SEQ ID NO: 2810224 - RNA, 12 nt, Human
auuuguucaugu

SEQ ID NO: 2810225 - RNA, 13 nt, Human
auuuguucauguu

SEQ ID NO: 2810226 - RNA, 14 nt, Human
auuuguucauguuu

SEQ ID NO: 2810227 - RNA, 15 nt, Human
auuuguucauguuug

SEQ ID NO: 2810228 - RNA, 16 nt, Human
auuuguucauguuugg

SEQ ID NO: 2810229 - RNA, 13 nt, Human
auuuuaguauuca

SEQ ID NO: 2810230 - RNA, 14 nt, Human
auuuuaguauucau

SEQ ID NO: 2810231 - RNA, 16 nt, Human
auuuuaguauucauuc

SEQ ID NO: 2810232 - RNA, 19 nt, Human
auuuuaguauucauucugc

SEQ ID NO: 2810233 - RNA, 20 nt, Human
auuuuaguauucauucugca

SEQ ID NO: 2810234 - RNA, 13 nt, Human
auuuguucucugu

SEQ ID NO: 2810235 - RNA, 14 nt, Human
auuuguucucuguc

SEQ ID NO: 2810236 - RNA, 15 nt, Human
auuuguucugggagu

SEQ ID NO: 2810237 - RNA, 16 nt, Human
auuuguucugggagua

SEQ ID NO: 2810238 - RNA, 16 nt, Human
auuuguucuucaagaa

SEQ ID NO: 2810239 - RNA, 23 nt, Human
auuuuagucacacguggucuuuc

SEQ ID NO: 2810240 - RNA, 14 nt, Human
auuuuaguccaaau

SEQ ID NO: 2810241 - RNA, 16 nt, Human
auuuuaguccaaauaa

SEQ ID NO: 2810242 - RNA, 17 nt, Human
auuuugaaaagauguac

SEQ ID NO: 2810243 - RNA, 13 nt, Human
auuuugaaaagcu

SEQ ID NO: 2810244 - RNA, 14 nt, Human
auuuugaaaagcuu

SEQ ID NO: 2810245 - RNA, 18 nt, Human
auuuugaaaagcuucuua

SEQ ID NO: 2810246 - RNA, 19 nt, Human
auuuugaaaagcuucuuaa

SEQ ID NO: 2810247 - RNA, 20 nt, Human
auuuugaaaagcuucuuaau

SEQ ID NO: 2810248 - RNA, 19 nt, Human
caaaagcauuuaucauucu

SEQ ID NO: 2810249 - RNA, 21 nt, Human
caaaagcauuuaucauucuug

SEQ ID NO: 2810250 - RNA, 21 nt, Human
caaacaugaaguguguuuccu

SEQ ID NO: 2810251 - RNA, 14 nt, Human
caaacaugaagugu

SEQ ID NO: 2810252 - RNA, 12 nt, Human
caaacaugaagu

SEQ ID NO: 2810253 - RNA, 17 nt, Human
caaacaucacucugcug

SEQ ID NO: 2810254 - RNA, 16 nt, Human
caaacauaugcacauu

SEQ ID NO: 2810255 - RNA, 18 nt, Human
caaacauccuaucaacaa

SEQ ID NO: 2810256 - RNA, 18 nt, Human
caaacaucacucugcugc

SEQ ID NO: 2810257 - RNA, 21 nt, Human
caaacaucacucugcugcuua

SEQ ID NO: 2810258 - RNA, 14 nt, Human
auuuuuuuuaguau

SEQ ID NO: 2810259 - RNA, 14 nt, Human
auuuuuuuuacauu

SEQ ID NO: 2810260 - RNA, 18 nt, Human
auuuuuuuuaguauuuau

SEQ ID NO: 2810261 - RNA, 18 nt, Human
auuuuuuuuaaguauuua

SEQ ID NO: 2810262 - RNA, 21 nt, Human
auuuuuuuuguuguuucagug

SEQ ID NO: 2810263 - RNA, 22 nt, Human
auuuuuuuuguuguuucaguga

SEQ ID NO: 2810264 - RNA, 20 nt, Human
caaaagcaguaaauuugcua

SEQ ID NO: 2810265 - RNA, 21 nt, Human
caaaagcagugggcuccuggc

SEQ ID NO: 2810266 - RNA, 23 nt, Human
auuuuuuuuucauagagauuugu

SEQ ID NO: 2810267 - RNA, 11 nt, Human
auuuuuaucag

SEQ ID NO: 2810268 - RNA, 21 nt, Human
auuuuuaaacagguggugaga

SEQ ID NO: 2810269 - RNA, 12 nt, Human
auuuuuaucuuu

SEQ ID NO: 2810270 - RNA, 15 nt, Human
auuuuuaucuuucgu

SEQ ID NO: 2810271 - RNA, 19 nt, Human
auuuuuaucuuucgugaua

SEQ ID NO: 2810272 - RNA, 17 nt, Human
auuuuuaugaugaugaa

SEQ ID NO: 2810273 - RNA, 13 nt, Human
auuuuuaaaagau

SEQ ID NO: 2810274 - RNA, 16 nt, Human
auuuuuaaaauauuua

SEQ ID NO: 2810275 - RNA, 17 nt, Human
auuuuuaaaauauuuau

SEQ ID NO: 2810276 - RNA, 16 nt, Human
auuuuuaaaaaaugaa

SEQ ID NO: 2810277 - RNA, 22 nt, Human
auuuuuaaaaaaugaaauccuu

SEQ ID NO: 2810278 - RNA, 12 nt, Human
auuuuuaaaaac

SEQ ID NO: 2810279 - RNA, 13 nt, Human
auuuuuaaaaaga

SEQ ID NO: 2810280 - RNA, 17 nt, Human
auuuuuaaaaagaaauc

SEQ ID NO: 2810281 - RNA, 23 nt, Human
auuuuuaaaaagaaaucuggucu

SEQ ID NO: 2810282 - RNA, 19 nt, Human
auuuuuuucccaauugaga

SEQ ID NO: 2810283 - RNA, 14 nt, Human
auuuuuauuucaga

SEQ ID NO: 2810284 - RNA, 16 nt, Human
auuuuuauuucagauu

SEQ ID NO: 2810285 - RNA, 17 nt, Human
auuuuuauuucagauuu

SEQ ID NO: 2810286 - RNA, 19 nt, Human
auuuuuauuucagauuuug

SEQ ID NO: 2810287 - RNA, 20 nt, Human
auuuuuauuucagauuuuga

SEQ ID NO: 2810288 - RNA, 21 nt, Human
auuuuuauuucagauuuugau

SEQ ID NO: 2810289 - RNA, 13 nt, Human
auuuuuauuuaug

SEQ ID NO: 2810290 - RNA, 14 nt, Human
auuuuuauuuauga

SEQ ID NO: 2810291 - RNA, 16 nt, Human
auuuuuauuuaugaag

SEQ ID NO: 2810292 - RNA, 15 nt, Human
caaacaugagaugug

SEQ ID NO: 2810293 - RNA, 22 nt, Human
caaacaugaaguguguuuccuu

SEQ ID NO: 2810294 - RNA, 13 nt, Human
caaacauguauuu

SEQ ID NO: 2810295 - RNA, 14 nt, Human
caaacauguauuua

SEQ ID NO: 2810296 - RNA, 15 nt, Human
caaacauguauuuau

SEQ ID NO: 2810297 - RNA, 16 nt, Human
caaacauguauuuaug

SEQ ID NO: 2810298 - RNA, 18 nt, Human
caaacauguauuuaugua

SEQ ID NO: 2810299 - RNA, 23 nt, Human
caaacaugagauguguggacugu

SEQ ID NO: 2810300 - RNA, 16 nt, Human
auuucacuagaaaagc

SEQ ID NO: 2810301 - RNA, 15 nt, Human
auuucaggagcagcc

SEQ ID NO: 2810302 - RNA, 20 nt, Human
auuucacgucgucuucugua

SEQ ID NO: 2810303 - RNA, 17 nt, Human
auuucaggcuccccaga

SEQ ID NO: 2810304 - RNA, 21 nt, Human
auuucacauuaauauuugcug

SEQ ID NO: 2810305 - RNA, 22 nt, Human
auuucacauuaauauuugcuga

SEQ ID NO: 2810306 - RNA, 16 nt, Human
auuucacauuaauggu

SEQ ID NO: 2810307 - RNA, 18 nt, Human
auuucacauuaauggucu

SEQ ID NO: 2810308 - RNA, 22 nt, Human
auuucacauuaauggucuaaaa

SEQ ID NO: 2810309 - RNA, 14 nt, Human
auuuaucucuauuu

SEQ ID NO: 2810310 - RNA, 15 nt, Human
auuucaauucucaaa

SEQ ID NO: 2810311 - RNA, 14 nt, Human
auuucacaaauaau

SEQ ID NO: 2810312 - RNA, 13 nt, Human
auuucacauuaau

SEQ ID NO: 2810313 - RNA, 23 nt, Human
auuucacaguguguuugugauug

SEQ ID NO: 2810314 - RNA, 19 nt, Human
auuucacacgcuguucuaa

SEQ ID NO: 2810315 - RNA, 14 nt, Human
auuucacaggcuaa

SEQ ID NO: 2810316 - RNA, 15 nt, Human
auuuauccauuugua

SEQ ID NO: 2810317 - RNA, 16 nt, Human
auuuauccauuuguaa

SEQ ID NO: 2810318 - RNA, 13 nt, Human
auuuaucauucuu

SEQ ID NO: 2810319 - RNA, 17 nt, Human
auuuauccaaaaugugu

SEQ ID NO: 2810320 - RNA, 18 nt, Human
auuuauccaaaaugugua

SEQ ID NO: 2810321 - RNA, 19 nt, Human
auuuauccaaaauguguau

SEQ ID NO: 2810322 - RNA, 20 nt, Human
auuuauccacaggaaagugu

SEQ ID NO: 2810323 - RNA, 21 nt, Human
auuuauccacaggaaaguguu

SEQ ID NO: 2810324 - RNA, 12 nt, Human
auuuauccacua

SEQ ID NO: 2810325 - RNA, 18 nt, Human
auuuauauauuuauaacu

SEQ ID NO: 2810326 - RNA, 17 nt, Human
auuuauauauuuauaac

SEQ ID NO: 2810327 - RNA, 16 nt, Human
auuuauauauuuauaa

SEQ ID NO: 2810328 - RNA, 15 nt, Human
auuuauauauuuaua

SEQ ID NO: 2810329 - RNA, 18 nt, Human
auuuauccugaaauuuca

SEQ ID NO: 2810330 - RNA, 20 nt, Human
auuuauccugaaauuucaga

SEQ ID NO: 2810331 - RNA, 19 nt, Human
auuuauccugaaauuucag

SEQ ID NO: 2810332 - RNA, 21 nt, Human
auuuauccugaaauuucagau

SEQ ID NO: 2810333 - RNA, 13 nt, Human
auuuaucuaaauu

SEQ ID NO: 2810334 - RNA, 15 nt, Human
auuuaucuaaauuaa

SEQ ID NO: 2810335 - RNA, 20 nt, Human
auuuaucuaaauuaaagccu

SEQ ID NO: 2810336 - RNA, 16 nt, Human
auuuaauaaaaaaaca

SEQ ID NO: 2810337 - RNA, 19 nt, Human
auuuaauaaaauaauucua

SEQ ID NO: 2810338 - RNA, 21 nt, Human
auuuaauaaaauaauucuaaa

SEQ ID NO: 2810339 - RNA, 22 nt, Human
auuuaauaaaauaauucuaaag

SEQ ID NO: 2810340 - RNA, 19 nt, Human
auuuaaguucauauuccau

SEQ ID NO: 2810341 - RNA, 20 nt, Human
auuuaaguuucaaacuuacu

SEQ ID NO: 2810342 - RNA, 20 nt, Human
auuuaagugcguguguagag

SEQ ID NO: 2810343 - RNA, 21 nt, Human
auuuaagugcguguguagagu

SEQ ID NO: 2810344 - RNA, 22 nt, Human
auuuaagugcguguguagaguu

SEQ ID NO: 2810345 - RNA, 20 nt, Human
auuuaaguggggcaaaaccu

SEQ ID NO: 2810346 - RNA, 13 nt, Human
auuuaagcaaaua

SEQ ID NO: 2810347 - RNA, 15 nt, Human
auuuaagcaaauacu

SEQ ID NO: 2810348 - RNA, 16 nt, Human
auuuaagcaaauacuu

SEQ ID NO: 2810349 - RNA, 17 nt, Human
auuuaagcaaauacuua

SEQ ID NO: 2810350 - RNA, 22 nt, Human
auuuaagcaaauacuuagcaaa

SEQ ID NO: 2810351 - RNA, 16 nt, Human
auuuaagcaacaucuu

SEQ ID NO: 2810352 - RNA, 15 nt, Human
auuuaagcacaaacu

SEQ ID NO: 2810353 - RNA, 18 nt, Human
auuuaagcacaaacuuua

SEQ ID NO: 2810354 - RNA, 17 nt, Human
auuuaagccucauauuu

SEQ ID NO: 2810355 - RNA, 19 nt, Human
auuuaagccucauauuuaa

SEQ ID NO: 2810356 - RNA, 21 nt, Human
auuuaagccucauauuuaaag

SEQ ID NO: 2810357 - RNA, 19 nt, Human
auuuaagugcguguguaga

SEQ ID NO: 2810358 - RNA, 14 nt, Human
auuuaagugcgugu

SEQ ID NO: 2810359 - RNA, 16 nt, Human
auuuauaguuuguaca

SEQ ID NO: 2810360 - RNA, 22 nt, Human
auuuauaguuuguacaugcauu

SEQ ID NO: 2810361 - RNA, 15 nt, Human
auuuauauaaaugua

SEQ ID NO: 2810362 - RNA, 18 nt, Human
auuuauauaaauguaaaa

SEQ ID NO: 2810363 - RNA, 13 nt, Human
auuuauauaugaa

SEQ ID NO: 2810364 - RNA, 14 nt, Human
auuuauauaugaaa

SEQ ID NO: 2810365 - RNA, 15 nt, Human
auuuauauaugaaaa

SEQ ID NO: 2810366 - RNA, 16 nt, Human
auuuauauaugaaaac

SEQ ID NO: 2810367 - RNA, 17 nt, Human
auuuauauaugaaaacu

SEQ ID NO: 2810368 - RNA, 18 nt, Human
auuuauauaugaaaacua

SEQ ID NO: 2810369 - RNA, 19 nt, Human
auuuauauaugaaaacuau

SEQ ID NO: 2810370 - RNA, 20 nt, Human
auuuauauaugaaaacuaua

SEQ ID NO: 2810371 - RNA, 22 nt, Human
auuuauauaugaaaacuauaca

SEQ ID NO: 2810372 - RNA, 14 nt, Human
auuuauauauuuau

SEQ ID NO: 2810373 - RNA, 18 nt, Human
auuuaauuuaggacacau

SEQ ID NO: 2810374 - RNA, 15 nt, Human
auuuaauuuagugau

SEQ ID NO: 2810375 - RNA, 12 nt, Human
auuuaauuucca

SEQ ID NO: 2810376 - RNA, 13 nt, Human
auuuaauuuccag

SEQ ID NO: 2810377 - RNA, 12 nt, Human
auuuaauuauua

SEQ ID NO: 2810378 - RNA, 13 nt, Human
auuuaauuauuaa

SEQ ID NO: 2810379 - RNA, 15 nt, Human
auuuaauuauuaacu

SEQ ID NO: 2810380 - RNA, 20 nt, Human
auuuaauuauuaacuacauu

SEQ ID NO: 2810381 - RNA, 22 nt, Human
auugauaagagggcacacacug

SEQ ID NO: 2810382 - RNA, 23 nt, Human
auugauaagagggcacacacugu

SEQ ID NO: 2810383 - RNA, 16 nt, Human
auugauaagagggcac

SEQ ID NO: 2810384 - RNA, 14 nt, Human
auugagguaaguuu

SEQ ID NO: 2810385 - RNA, 14 nt, Human
auugaggcuuugug

SEQ ID NO: 2810386 - RNA, 15 nt, Human
auugaggcuuugugu

SEQ ID NO: 2810387 - RNA, 16 nt, Human
auugaggcuuuguguu

SEQ ID NO: 2810388 - RNA, 19 nt, Human
auugaggcuuuguguugua

SEQ ID NO: 2810389 - RNA, 22 nt, Human
auugaggcuuuguguuguaauu

SEQ ID NO: 2810390 - RNA, 16 nt, Human
auuuaagagacaguca

SEQ ID NO: 2810391 - RNA, 19 nt, Human
auuuaagagcaguccauuu

SEQ ID NO: 2810392 - RNA, 23 nt, Human
auuucuuaaauaaugcuucagau

SEQ ID NO: 2810393 - RNA, 14 nt, Human
auuucuguuucuca

SEQ ID NO: 2810394 - RNA, 15 nt, Human
auuucuguuucucau

SEQ ID NO: 2810395 - RNA, 23 nt, Human
auuucugaguuucauucuccugc

SEQ ID NO: 2810396 - RNA, 13 nt, Human
auuucugcaaaca

SEQ ID NO: 2810397 - RNA, 23 nt, Human
auuucagguuguuggugacuauc

SEQ ID NO: 2810398 - RNA, 21 nt, Human
auuucagguuuuguaaagaug

SEQ ID NO: 2810399 - RNA, 20 nt, Human
auuucagguuuuguaaagau

SEQ ID NO: 2810400 - RNA, 14 nt, Human
auuucaguacuuca

SEQ ID NO: 2810401 - RNA, 17 nt, Human
auuucaguacuucagca

SEQ ID NO: 2810402 - RNA, 18 nt, Human
auuucaguacuucagcaa

SEQ ID NO: 2810403 - RNA, 19 nt, Human
auuucaguacuucagcaag

SEQ ID NO: 2810404 - RNA, 22 nt, Human
auuucaguacuucagcaagaga

SEQ ID NO: 2810405 - RNA, 17 nt, Human
auuucaguccuguaguu

SEQ ID NO: 2810406 - RNA, 17 nt, Human
auuucucuaguaguuaa

SEQ ID NO: 2810407 - RNA, 22 nt, Human
auuucucuaguaguuaaaaaaa

SEQ ID NO: 2810408 - RNA, 16 nt, Human
auuucaguguaguuaa

SEQ ID NO: 2810409 - RNA, 17 nt, Human
auuucucuaauuaugca

SEQ ID NO: 2810410 - RNA, 21 nt, Human
auuugcaauauuccuuugggc

SEQ ID NO: 2810411 - RNA, 18 nt, Human
auuugcaaugggauguau

SEQ ID NO: 2810412 - RNA, 21 nt, Human
auuugcaaugggauguaugaa

SEQ ID NO: 2810413 - RNA, 23 nt, Human
auuugcacagaagcacaugcacc

SEQ ID NO: 2810414 - RNA, 12 nt, Human
auugaggaagag

SEQ ID NO: 2810415 - RNA, 15 nt, Human
auugaggaagagucu

SEQ ID NO: 2810416 - RNA, 21 nt, Human
auucgugauuuucaagcagca

SEQ ID NO: 2810417 - RNA, 16 nt, Human
auucgaaugaaaagac

SEQ ID NO: 2810418 - RNA, 18 nt, Human
auuccuuuguguuucuau

SEQ ID NO: 2810419 - RNA, 16 nt, Human
auuccuuugucuucaa

SEQ ID NO: 2810420 - RNA, 23 nt, Human
auuccuuugucuucaaacuguga

SEQ ID NO: 2810421 - RNA, 19 nt, Human
auucgcccgagcuguuuau

SEQ ID NO: 2810422 - RNA, 19 nt, Human
auucauuuauaagaagaga

SEQ ID NO: 2810423 - RNA, 18 nt, Human
auuccuuucccuuccucu

SEQ ID NO: 2810424 - RNA, 19 nt, Human
auuccuuucccuuccucuu

SEQ ID NO: 2810425 - RNA, 20 nt, Human
auuccuuucccuuccucuuc

SEQ ID NO: 2810426 - RNA, 13 nt, Human
auucauugucucu

SEQ ID NO: 2810427 - RNA, 23 nt, Human
auucucugugucuaagauucuag

SEQ ID NO: 2810428 - RNA, 22 nt, Human
auucucugugucuaagauucua

SEQ ID NO: 2810429 - RNA, 17 nt, Human
auucuuuaaauuucauc

SEQ ID NO: 2810430 - RNA, 15 nt, Human
auucucuuguauaag

SEQ ID NO: 2810431 - RNA, 18 nt, Human
auucucuuguauaagauc

SEQ ID NO: 2810432 - RNA, 17 nt, Human
auucuuuauuucuguca

SEQ ID NO: 2810433 - RNA, 21 nt, Human
auucuuuauuucugucauuca

SEQ ID NO: 2810434 - RNA, 14 nt, Human
auucuuucaauucu

SEQ ID NO: 2810435 - RNA, 20 nt, Human
auucuuucaauucuguaggu

SEQ ID NO: 2810436 - RNA, 18 nt, Human
auucuuucagcuaucagu

SEQ ID NO: 2810437 - RNA, 17 nt, Human
auucgcucccacauucu

SEQ ID NO: 2810438 - RNA, 11 nt, Human
auuagaugaau

SEQ ID NO: 2810439 - RNA, 23 nt, Human
auuagaugaauuauccuauuuca

SEQ ID NO: 2810440 - RNA, 13 nt, Human
auuagaugcaugu

SEQ ID NO: 2810441 - RNA, 14 nt, Human
auuagaugcauguu

SEQ ID NO: 2810442 - RNA, 20 nt, Human
auuagaugcauguugaccau

SEQ ID NO: 2810443 - RNA, 21 nt, Human
auuagaugcauguugaccaug

SEQ ID NO: 2810444 - RNA, 15 nt, Human
auuagagucagccuu

SEQ ID NO: 2810445 - RNA, 19 nt, Human
auuagagggaggagaauga

SEQ ID NO: 2810446 - RNA, 21 nt, Human
auuagagggaggagaaugagc

SEQ ID NO: 2810447 - RNA, 20 nt, Human
auuaugugacauuuuacauu

SEQ ID NO: 2810448 - RNA, 15 nt, Human
auucaagguggccaa

SEQ ID NO: 2810449 - RNA, 19 nt, Human
auuaugucuuuuauauuug

SEQ ID NO: 2810450 - RNA, 23 nt, Human
auuaugucuuuuauauuuguauc

SEQ ID NO: 2810451 - RNA, 14 nt, Human
auucaaguuauugu

SEQ ID NO: 2810452 - RNA, 15 nt, Human
auucaaguuauugua

SEQ ID NO: 2810453 - RNA, 16 nt, Human
auucaaguuauuguac

SEQ ID NO: 2810454 - RNA, 17 nt, Human
auuauguccacugugua

SEQ ID NO: 2810455 - RNA, 19 nt, Human
auuauguccacuguguaua

SEQ ID NO: 2810456 - RNA, 19 nt, Human
auuaugugacauuuuacau

SEQ ID NO: 2810457 - RNA, 13 nt, Human
auuaugugacauu

SEQ ID NO: 2810458 - RNA, 14 nt, Human
auuauguaaugcaa

SEQ ID NO: 2810459 - RNA, 14 nt, Human
auucauauugaaua

SEQ ID NO: 2810460 - RNA, 17 nt, Human
auucauauugaauauaa

SEQ ID NO: 2810461 - RNA, 15 nt, Human
auucauauuggaaaa

SEQ ID NO: 2810462 - RNA, 20 nt, Human
auucauauuggaaaaaucac

SEQ ID NO: 2810463 - RNA, 13 nt, Human
auucauauugaau

SEQ ID NO: 2810464 - RNA, 19 nt, Human
auucauauucuguuggaag

SEQ ID NO: 2810465 - RNA, 16 nt, Human
auucauauucuucaua

SEQ ID NO: 2810466 - RNA, 14 nt, Human
auucauauucuuuu

SEQ ID NO: 2810467 - RNA, 18 nt, Human
auucauucugugaucauu

SEQ ID NO: 2810468 - RNA, 19 nt, Human
auucauucugugaucauuu

SEQ ID NO: 2810469 - RNA, 22 nt, Human
auucauucugugaucauuuauu

SEQ ID NO: 2810470 - RNA, 12 nt, Human
auucauucucau

SEQ ID NO: 2810471 - RNA, 20 nt, Human
auucauucucauaauuccua

SEQ ID NO: 2810472 - RNA, 22 nt, Human
auucauucucauaauuccuaca

SEQ ID NO: 2810473 - RNA, 18 nt, Human
auucauucugcauugcua

SEQ ID NO: 2810474 - RNA, 17 nt, Human
auucauguuauauuuaa

SEQ ID NO: 2810475 - RNA, 22 nt, Human
auucauguuauauuuaaugcau

SEQ ID NO: 2810476 - RNA, 15 nt, Human
auucauuagcuguga

SEQ ID NO: 2810477 - RNA, 15 nt, Human
auucauuaaauguuu

SEQ ID NO: 2810478 - RNA, 16 nt, Human
auucauuaaauguuug

SEQ ID NO: 2810479 - RNA, 19 nt, Human
auucauaguaacuucuuau

SEQ ID NO: 2810480 - RNA, 22 nt, Human
auuacaagcgugagccacugca

SEQ ID NO: 2810481 - RNA, 13 nt, Human
auuaauuuuacuc

SEQ ID NO: 2810482 - RNA, 12 nt, Human
auuacaauggaa

SEQ ID NO: 2810483 - RNA, 15 nt, Human
auuacaauggaaaca

SEQ ID NO: 2810484 - RNA, 17 nt, Human
auuacaauggaaacaau

SEQ ID NO: 2810485 - RNA, 15 nt, Human
auuacacauuuguac

SEQ ID NO: 2810486 - RNA, 18 nt, Human
auuacacauuuguacaga

SEQ ID NO: 2810487 - RNA, 14 nt, Human
auuacacccaaaga

SEQ ID NO: 2810488 - RNA, 18 nt, Human
auuacacuguauuuguau

SEQ ID NO: 2810489 - RNA, 19 nt, Human
auuacacuguauuuguauc

SEQ ID NO: 2810490 - RNA, 15 nt, Human
auuacaggcuugagc

SEQ ID NO: 2810491 - RNA, 13 nt, Human
auuacagguguga

SEQ ID NO: 2810492 - RNA, 19 nt, Human
auuacaggcuccugccacc

SEQ ID NO: 2810493 - RNA, 17 nt, Human
auuacaggcuccugcca

SEQ ID NO: 2810494 - RNA, 20 nt, Human
auuacacuguauuuguaucu

SEQ ID NO: 2810495 - RNA, 16 nt, Human
auuacaggcuccugcc

SEQ ID NO: 2810496 - RNA, 15 nt, Human
auuacaggcuccugc

SEQ ID NO: 2810497 - RNA, 21 nt, Human
auuaauuugcaucugaaauag

SEQ ID NO: 2810498 - RNA, 15 nt, Human
auuaauuugcaucug

SEQ ID NO: 2810499 - RNA, 16 nt, Human
auuaauuugauuaaca

SEQ ID NO: 2810500 - RNA, 17 nt, Human
auuaauuugauuaacaa

SEQ ID NO: 2810501 - RNA, 18 nt, Human
auuaauuugauuaacaaa

SEQ ID NO: 2810502 - RNA, 20 nt, Human
auuaauuugauuaacaaaua

SEQ ID NO: 2810503 - RNA, 21 nt, Human
auuaauuugauuaacaaauau

SEQ ID NO: 2810504 - RNA, 22 nt, Human
auuaauuugauuaacaaauaug

SEQ ID NO: 2810505 - RNA, 18 nt, Human
auuaauuguuuugcacuu

SEQ ID NO: 2810506 - RNA, 19 nt, Human
auuaauuguuuugcacuuu

SEQ ID NO: 2810507 - RNA, 20 nt, Human
auuaauuguuuugcacuuuu

SEQ ID NO: 2810508 - RNA, 13 nt, Human
auuaauggcacug

SEQ ID NO: 2810509 - RNA, 14 nt, Human
auuaauggcacuga

SEQ ID NO: 2810510 - RNA, 15 nt, Human
auuaauggcacugau

SEQ ID NO: 2810511 - RNA, 15 nt, Human
auuaauggucuaaaa

SEQ ID NO: 2810512 - RNA, 17 nt, Human
auuaauggucuaaaaau

SEQ ID NO: 2810513 - RNA, 16 nt, Human
auuaauguacuuguuu

SEQ ID NO: 2810514 - RNA, 23 nt, Human
auuaauguacuuguuucucuguu

SEQ ID NO: 2810515 - RNA, 15 nt, Human
auuaauggaaauguu

SEQ ID NO: 2810516 - RNA, 20 nt, Human
auuaaugccauuaucccuga

SEQ ID NO: 2810517 - RNA, 20 nt, Human
auuaaauuuugaguucuaca

SEQ ID NO: 2810518 - RNA, 17 nt, Human
auuaaauuuuuuuuaca

SEQ ID NO: 2810519 - RNA, 19 nt, Human
auuaaauuuuuuuuacauu

SEQ ID NO: 2810520 - RNA, 18 nt, Human
auuaaauuuuuuuuacau

SEQ ID NO: 2810521 - RNA, 20 nt, Human
auuaaauuuuuuuuacauuu

SEQ ID NO: 2810522 - RNA, 12 nt, Human
auuaacaaaagu

SEQ ID NO: 2810523 - RNA, 12 nt, Human
auuaacaaauau

SEQ ID NO: 2810524 - RNA, 13 nt, Human
auuaacaaauaug

SEQ ID NO: 2810525 - RNA, 15 nt, Human
auuaacaaauaugcu

SEQ ID NO: 2810526 - RNA, 16 nt, Human
auuaacaaauaugcua

SEQ ID NO: 2810527 - RNA, 17 nt, Human
auuaacaaauaugcuaa

SEQ ID NO: 2810528 - RNA, 20 nt, Human
auuaacaaauaugcuaauuu

SEQ ID NO: 2810529 - RNA, 21 nt, Human
auuaacaaauaugcuaauuug

SEQ ID NO: 2810530 - RNA, 18 nt, Human
auuaacaacaauaacacu

SEQ ID NO: 2810531 - RNA, 13 nt, Human
auuaacacaaagg

SEQ ID NO: 2810532 - RNA, 22 nt, Human
ccuuuccuggacacucagaccu

SEQ ID NO: 2810533 - RNA, 17 nt, Human
ccuuuccuccuuuauca

SEQ ID NO: 2810534 - RNA, 18 nt, Human
ccuuuccuccuuuaucac

SEQ ID NO: 2810535 - RNA, 17 nt, Human
ccuuuccucucuccugu

SEQ ID NO: 2810536 - RNA, 13 nt, Human
ccuuuccuuccua

SEQ ID NO: 2810537 - RNA, 15 nt, Human
ccuuuccuuccuaau

SEQ ID NO: 2810538 - RNA, 18 nt, Human
ccuuuccuuccaucccua

SEQ ID NO: 2810539 - RNA, 16 nt, Human
ccuuuccuuccauccc

SEQ ID NO: 2810540 - RNA, 16 nt, Human
cgccaagugcgugccg

SEQ ID NO: 2810541 - RNA, 21 nt, Human
cgccacacagaccaccaucca

SEQ ID NO: 2810542 - RNA, 13 nt, Human
cgcaggggaaacg

SEQ ID NO: 2810543 - RNA, 22 nt, Human
cgcaggcuggcccugcccuggu

SEQ ID NO: 2810544 - RNA, 21 nt, Human
cgcaggcuggcccugcccugg

SEQ ID NO: 2810545 - RNA, 15 nt, Human
cgagucugggacaca

SEQ ID NO: 2810546 - RNA, 16 nt, Human
cgagucugggacacaa

SEQ ID NO: 2810547 - RNA, 17 nt, Human
cgagugagacaaaauuu

SEQ ID NO: 2810548 - RNA, 16 nt, Human
cgagugcuaaguguag

SEQ ID NO: 2810549 - RNA, 21 nt, Human
cgagugcuaaguguaggauau

SEQ ID NO: 2810550 - RNA, 20 nt, Human
cgagucucuucuccacugga

SEQ ID NO: 2810551 - RNA, 21 nt, Human
cgagucucuucuccacuggau

SEQ ID NO: 2810552 - RNA, 15 nt, Human
cgaggguccuggcuc

SEQ ID NO: 2810553 - RNA, 14 nt, Human
cgaggguccuggcu

SEQ ID NO: 2810554 - RNA, 20 nt, Human
cgaggggcucucagcucagc

SEQ ID NO: 2810555 - RNA, 17 nt, Human
cgagucucuucuccacu

SEQ ID NO: 2810556 - RNA, 18 nt, Human
cgagucucuucuccacug

SEQ ID NO: 2810557 - RNA, 23 nt, Human
cgaggguccuggcuccugagggg

SEQ ID NO: 2810558 - RNA, 20 nt, Human
cgaggguugauuaaggcagu

SEQ ID NO: 2810559 - RNA, 16 nt, Human
cgaggguccuggcucc

SEQ ID NO: 2810560 - RNA, 16 nt, Human
cgagucucuucuccac

SEQ ID NO: 2810561 - RNA, 21 nt, Human
cgagggcagggaccacacccu

SEQ ID NO: 2810562 - RNA, 20 nt, Human
cgcugaguauggagcagccu

SEQ ID NO: 2810563 - RNA, 21 nt, Human
cgcucuguggaugccagggcc

SEQ ID NO: 2810564 - RNA, 20 nt, Human
cgcucuguggaugccagggc

SEQ ID NO: 2810565 - RNA, 22 nt, Human
cgcucuguugcccaggcuggag

SEQ ID NO: 2810566 - RNA, 24 nt, Human
cgcucuucgcgcccgccccugcag

SEQ ID NO: 2810567 - RNA, 21 nt, Human
cgcucuuggcagguacucagc

SEQ ID NO: 2810568 - RNA, 19 nt, Human
cgcucuguugcccaggcug

SEQ ID NO: 2810569 - RNA, 20 nt, Human
cgcucugucgcccaggcugg

SEQ ID NO: 2810570 - RNA, 13 nt, Human
cgcucucuuuucu

SEQ ID NO: 2810571 - RNA, 19 nt, Human
cgcucucuuuucuguacuu

SEQ ID NO: 2810572 - RNA, 21 nt, Human
cgcucugccucaccgcuuccc

SEQ ID NO: 2810573 - RNA, 15 nt, Human
cgcucugcucagugg

SEQ ID NO: 2810574 - RNA, 12 nt, Human
cgcucucuuccu

SEQ ID NO: 2810575 - RNA, 14 nt, Human
cgcucucuuccugc

SEQ ID NO: 2810576 - RNA, 15 nt, Human
cgcucucuuccugcc

SEQ ID NO: 2810577 - RNA, 16 nt, Human
cgcucucuuccugccc

SEQ ID NO: 2810578 - RNA, 23 nt, Human
cgcucucuuccugccccucuuuc

SEQ ID NO: 2810579 - RNA, 22 nt, Human
cgccugcacuccucagggcagc

SEQ ID NO: 2810580 - RNA, 12 nt, Human
cgccugcccacc

SEQ ID NO: 2810581 - RNA, 13 nt, Human
cgccugcccaccu

SEQ ID NO: 2810582 - RNA, 15 nt, Human
cgccugcccaccugc

SEQ ID NO: 2810583 - RNA, 17 nt, Human
cgccugcccaccugccu

SEQ ID NO: 2810584 - RNA, 18 nt, Human
cgccugcccaccugccug

SEQ ID NO: 2810585 - RNA, 20 nt, Human
cgccugcccaccugccuggc

SEQ ID NO: 2810586 - RNA, 21 nt, Human
cgccugcccaccugccuggcc

SEQ ID NO: 2810587 - RNA, 17 nt, Human
cgccugcccucauggcc

SEQ ID NO: 2810588 - RNA, 20 nt, Human
cgccugcccucauggccccu

SEQ ID NO: 2810589 - RNA, 22 nt, Human
cgccugcccucauggccccucu

SEQ ID NO: 2810590 - RNA, 19 nt, Human
cgccugcaaacgcugccug

SEQ ID NO: 2810591 - RNA, 21 nt, Human
cgccugcaaacgcugccugcc

SEQ ID NO: 2810592 - RNA, 20 nt, Human
cgccugcaaacgcugccugc

SEQ ID NO: 2810593 - RNA, 22 nt, Human
cgccugcauguaaacacgccug

SEQ ID NO: 2810594 - RNA, 17 nt, Human
cgccugcauguaaacac

SEQ ID NO: 2810595 - RNA, 22 nt, Human
cgccugcaaacgcugccugccg

SEQ ID NO: 2810596 - RNA, 22 nt, Human
cgccugcaaacgcugccugccc

SEQ ID NO: 2810597 - RNA, 13 nt, Human
cgccacccgcagc

SEQ ID NO: 2810598 - RNA, 18 nt, Human
cgccaccgccacccgcag

SEQ ID NO: 2810599 - RNA, 18 nt, Human
cgcuggagugcagugagc

SEQ ID NO: 2810600 - RNA, 17 nt, Human
cgcuggagugcagugag

SEQ ID NO: 2810601 - RNA, 20 nt, Human
cgcugagugggagaaggcag

SEQ ID NO: 2810602 - RNA, 15 nt, Human
cgcugccugcccaca

SEQ ID NO: 2810603 - RNA, 19 nt, Human
cgcugcuccacgcgcuucg

SEQ ID NO: 2810604 - RNA, 21 nt, Human
cgcugcuccacgcgcuucgac

SEQ ID NO: 2810605 - RNA, 12 nt, Human
cgcugcuccuug

SEQ ID NO: 2810606 - RNA, 20 nt, Human
cgcuggccccuuugggcccu

SEQ ID NO: 2810607 - RNA, 22 nt, Human
cgcuggccccuuugggcccugc

SEQ ID NO: 2810608 - RNA, 16 nt, Human
cgcugacuucauggaa

SEQ ID NO: 2810609 - RNA, 20 nt, Human
cgguggcucaggccuauaac

SEQ ID NO: 2810610 - RNA, 15 nt, Human
cggugggcacccacc

SEQ ID NO: 2810611 - RNA, 18 nt, Human
cggugggcacccacccug

SEQ ID NO: 2810612 - RNA, 17 nt, Human
cgguggcggccccagca

SEQ ID NO: 2810613 - RNA, 20 nt, Human
cgggcuuugugugaaggcag

SEQ ID NO: 2810614 - RNA, 22 nt, Human
cgggcuuugugugaaggcagag

SEQ ID NO: 2810615 - RNA, 19 nt, Human
cggugggcacccacccugg

SEQ ID NO: 2810616 - RNA, 23 nt, Human
cggugggcacccacccugggacc

SEQ ID NO: 2810617 - RNA, 15 nt, Human
cguaaccacggaaaa

SEQ ID NO: 2810618 - RNA, 20 nt, Human
cguaaauacacaacacacac

SEQ ID NO: 2810619 - RNA, 13 nt, Human
cguaagcacuguu

SEQ ID NO: 2810620 - RNA, 14 nt, Human
cguaagcacuguuu

SEQ ID NO: 2810621 - RNA, 15 nt, Human
cguaagcacuguuuu

SEQ ID NO: 2810622 - RNA, 12 nt, Human
cguaaccagcca

SEQ ID NO: 2810623 - RNA, 13 nt, Human
cguaaccagccag

SEQ ID NO: 2810624 - RNA, 14 nt, Human
cguaaccagccaga

SEQ ID NO: 2810625 - RNA, 23 nt, Human
cguaaccagccagauccucuugg

SEQ ID NO: 2810626 - RNA, 17 nt, Human
cguacauucaauguuua

SEQ ID NO: 2810627 - RNA, 13 nt, Human
cguacuugugauu

SEQ ID NO: 2810628 - RNA, 16 nt, Human
cgggcugggagcucug

SEQ ID NO: 2810629 - RNA, 20 nt, Human
cgggcugggagcucugcaga

SEQ ID NO: 2810630 - RNA, 16 nt, Human
cgggccuggagaacua

SEQ ID NO: 2810631 - RNA, 20 nt, Human
cgggccuggagaacuagaga

SEQ ID NO: 2810632 - RNA, 15 nt, Human
cgggcucucugcugu

SEQ ID NO: 2810633 - RNA, 14 nt, Human
cgggcucucugcug

SEQ ID NO: 2810634 - RNA, 13 nt, Human
cgggccuguacag

SEQ ID NO: 2810635 - RNA, 14 nt, Human
cgggccuguacagu

SEQ ID NO: 2810636 - RNA, 17 nt, Human
cgggccuguacagucug

SEQ ID NO: 2810637 - RNA, 18 nt, Human
cgggccuguacagucugu

SEQ ID NO: 2810638 - RNA, 20 nt, Human
cgggccuguacagucugucu

SEQ ID NO: 2810639 - RNA, 14 nt, Human
cgggcccagcacuu

SEQ ID NO: 2810640 - RNA, 19 nt, Human
cggcuaauuuuuauauuuu

SEQ ID NO: 2810641 - RNA, 17 nt, Human
cggagacggagucccac

SEQ ID NO: 2810642 - RNA, 20 nt, Human
cggagacggagucccaccuu

SEQ ID NO: 2810643 - RNA, 17 nt, Human
cggaggccccacugaug

SEQ ID NO: 2810644 - RNA, 18 nt, Human
cggaggccccacugaugc

SEQ ID NO: 2810645 - RNA, 13 nt, Human
cggaggcugcccc

SEQ ID NO: 2810646 - RNA, 11 nt, Human
cggagaggaag

SEQ ID NO: 2810647 - RNA, 19 nt, Human
cggagaggaagagacacuc

SEQ ID NO: 2810648 - RNA, 13 nt, Human
cggagaggacagu

SEQ ID NO: 2810649 - RNA, 22 nt, Human
cggagucccaccuuggcugcag

SEQ ID NO: 2810650 - RNA, 21 nt, Human
cggagucccaccuuggcugca

SEQ ID NO: 2810651 - RNA, 16 nt, Human
cggaggcugcccccgg

SEQ ID NO: 2810652 - RNA, 19 nt, Human
cggaggcugcccccggccc

SEQ ID NO: 2810653 - RNA, 22 nt, Human
cggaggcugcccccggcccccu

SEQ ID NO: 2810654 - RNA, 12 nt, Human
cggaggcugugu

SEQ ID NO: 2810655 - RNA, 23 nt, Human
cggagucccaccuuggcugcagg

SEQ ID NO: 2810656 - RNA, 15 nt, Human
cggaggggccuggca

SEQ ID NO: 2810657 - RNA, 15 nt, Human
cggcuaagaggcugc

SEQ ID NO: 2810658 - RNA, 16 nt, Human
cggcuaagaggcugcu

SEQ ID NO: 2810659 - RNA, 18 nt, Human
cggcuaauuuuuguauuu

SEQ ID NO: 2810660 - RNA, 22 nt, Human
cuaauuugcauuaaauucacaa

SEQ ID NO: 2810661 - RNA, 21 nt, Human
cuaauuugcauuaaauucaca

SEQ ID NO: 2810662 - RNA, 19 nt, Human
cuaauuugcauuaaauuca

SEQ ID NO: 2810663 - RNA, 15 nt, Human
cuaauuuuaguauuc

SEQ ID NO: 2810664 - RNA, 17 nt, Human
cuaauuuuaguauucau

SEQ ID NO: 2810665 - RNA, 13 nt, Human
cuaauuuucucaa

SEQ ID NO: 2810666 - RNA, 19 nt, Human
cuaauuuucucaaaagcau

SEQ ID NO: 2810667 - RNA, 20 nt, Human
cuaauuuucucaaaagcauu

SEQ ID NO: 2810668 - RNA, 22 nt, Human
cuaauuuucucaaaagcauuua

SEQ ID NO: 2810669 - RNA, 20 nt, Human
cuaauuuuacacauuagauu

SEQ ID NO: 2810670 - RNA, 16 nt, Human
cuaauuugaggcucag

SEQ ID NO: 2810671 - RNA, 15 nt, Human
cuaauuugauguuua

SEQ ID NO: 2810672 - RNA, 16 nt, Human
cuaauuugauguuuac

SEQ ID NO: 2810673 - RNA, 12 nt, Human
cuaauuugcauu

SEQ ID NO: 2810674 - RNA, 14 nt, Human
cuaauuugcauuaa

SEQ ID NO: 2810675 - RNA, 13 nt, Human
cuaauuugcauua

SEQ ID NO: 2810676 - RNA, 19 nt, Human
cuaaguuucuaagauucua

SEQ ID NO: 2810677 - RNA, 21 nt, Human
cuaaguuucuaagauucuaaa

SEQ ID NO: 2810678 - RNA, 22 nt, Human
cuaaguuucuaagauucuaaag

SEQ ID NO: 2810679 - RNA, 23 nt, Human
cuaaguuucuaagauucuaaagg

SEQ ID NO: 2810680 - RNA, 12 nt, Human
cuaaguuucuaa

SEQ ID NO: 2810681 - RNA, 13 nt, Human
cuaaguuucuaag

SEQ ID NO: 2810682 - RNA, 14 nt, Human
cuaaguuucuaaga

SEQ ID NO: 2810683 - RNA, 15 nt, Human
cuaaguuucuaagau

SEQ ID NO: 2810684 - RNA, 17 nt, Human
cuaaguuucuaagauuc

SEQ ID NO: 2810685 - RNA, 18 nt, Human
cuaaguuucuaagauucu

SEQ ID NO: 2810686 - RNA, 20 nt, Human
cuaaguauuaaaacauugga

SEQ ID NO: 2810687 - RNA, 13 nt, Human
cuaaguauuaaaa

SEQ ID NO: 2810688 - RNA, 18 nt, Human
cuaaguauuaaaacauug

SEQ ID NO: 2810689 - RNA, 15 nt, Human
cuaaguccuuuaugu

SEQ ID NO: 2810690 - RNA, 14 nt, Human
cuaagucucuguga

SEQ ID NO: 2810691 - RNA, 13 nt, Human
cuaagucucugug

SEQ ID NO: 2810692 - RNA, 12 nt, Human
cuaagucucugu

SEQ ID NO: 2810693 - RNA, 19 nt, Human
cuaaguacacaauaagcaa

SEQ ID NO: 2810694 - RNA, 11 nt, Human
cuaaguauuaa

SEQ ID NO: 2810695 - RNA, 12 nt, Human
cuaaguauuaaa

SEQ ID NO: 2810696 - RNA, 20 nt, Human
cuaaguacacaauaagcaaa

SEQ ID NO: 2810697 - RNA, 13 nt, Human
cuaaguacuguaa

SEQ ID NO: 2810698 - RNA, 21 nt, Human
cuaaguacuguaauaauaccu

SEQ ID NO: 2810699 - RNA, 22 nt, Human
cuaaguacuguaauaauaccuc

SEQ ID NO: 2810700 - RNA, 23 nt, Human
cuaagacuuacucuaagaucuua

SEQ ID NO: 2810701 - RNA, 22 nt, Human
cuaagacugugacaacugucua

SEQ ID NO: 2810702 - RNA, 21 nt, Human
cuaagacucaaauguucuaag

SEQ ID NO: 2810703 - RNA, 22 nt, Human
cuaagacucaaauguucuaagu

SEQ ID NO: 2810704 - RNA, 17 nt, Human
cuaagacuuacucuaag

SEQ ID NO: 2810705 - RNA, 18 nt, Human
cuaagacuuacucuaaga

SEQ ID NO: 2810706 - RNA, 19 nt, Human
cuaagacuuacucuaagau

SEQ ID NO: 2810707 - RNA, 22 nt, Human
cuaagacuuacucuaagaucuu

SEQ ID NO: 2810708 - RNA, 17 nt, Human
cuaagaauucaaacugg

SEQ ID NO: 2810709 - RNA, 15 nt, Human
cuaagacacaaaugc

SEQ ID NO: 2810710 - RNA, 22 nt, Human
cuaagacacaaaugcaugaaca

SEQ ID NO: 2810711 - RNA, 23 nt, Human
cuaagacacaaaugcaugaacaa

SEQ ID NO: 2810712 - RNA, 21 nt, Human
cuaagacaccugaacccucca

SEQ ID NO: 2810713 - RNA, 13 nt, Human
cuaagacauguaa

SEQ ID NO: 2810714 - RNA, 16 nt, Human
cuaagaauacagcuuu

SEQ ID NO: 2810715 - RNA, 17 nt, Human
cuaagaauacagcuuuc

SEQ ID NO: 2810716 - RNA, 20 nt, Human
cuaagaauacagcuuucuga

SEQ ID NO: 2810717 - RNA, 13 nt, Human
cuaagacucaaau

SEQ ID NO: 2810718 - RNA, 16 nt, Human
cuaagacucaaauguu

SEQ ID NO: 2810719 - RNA, 17 nt, Human
cuaagacucaaauguuc

SEQ ID NO: 2810720 - RNA, 19 nt, Human
cuaagacucaaauguucua

SEQ ID NO: 2810721 - RNA, 20 nt, Human
cuaagacucaaauguucuaa

SEQ ID NO: 2810722 - RNA, 21 nt, Human
cuaaagugaugggcuuucucu

SEQ ID NO: 2810723 - RNA, 14 nt, Human
cuaaagugcuggga

SEQ ID NO: 2810724 - RNA, 16 nt, Human
cuaaagugcugggauu

SEQ ID NO: 2810725 - RNA, 20 nt, Human
cuaaagugcugggauuacag

SEQ ID NO: 2810726 - RNA, 15 nt, Human
cuaacguaaauacac

SEQ ID NO: 2810727 - RNA, 17 nt, Human
cuaacguugagccccug

SEQ ID NO: 2810728 - RNA, 22 nt, Human
cuaacggucuguucuguuucaa

SEQ ID NO: 2810729 - RNA, 16 nt, Human
cuaaaguauguaaagu

SEQ ID NO: 2810730 - RNA, 20 nt, Human
cuaaaguauguaaaguaugu

SEQ ID NO: 2810731 - RNA, 19 nt, Human
cuaaaguauuuuuauaaau

SEQ ID NO: 2810732 - RNA, 23 nt, Human
cuaaagguggccacaaauucuuu

SEQ ID NO: 2810733 - RNA, 16 nt, Human
cuaaagguguauuuaa

SEQ ID NO: 2810734 - RNA, 17 nt, Human
cuaaagguguauuuaaa

SEQ ID NO: 2810735 - RNA, 12 nt, Human
cuaaagcucuga

SEQ ID NO: 2810736 - RNA, 23 nt, Human
cuaaagguccacaggucuagacu

SEQ ID NO: 2810737 - RNA, 14 nt, Human
cuaaagcucugaca

SEQ ID NO: 2810738 - RNA, 22 nt, Human
cuaacguugagccccuggaggc

SEQ ID NO: 2810739 - RNA, 15 nt, Human
cuaagaaauauguga

SEQ ID NO: 2810740 - RNA, 16 nt, Human
cuaagaaauaugugag

SEQ ID NO: 2810741 - RNA, 17 nt, Human
cuaagaaauaugugaga

SEQ ID NO: 2810742 - RNA, 20 nt, Human
cuaagaaauaugugagauuu

SEQ ID NO: 2810743 - RNA, 21 nt, Human
cuaagaaauaugugagauuuu

SEQ ID NO: 2810744 - RNA, 15 nt, Human
cuaagaaauauucca

SEQ ID NO: 2810745 - RNA, 20 nt, Human
cuaacuuuagaagugcauuu

SEQ ID NO: 2810746 - RNA, 22 nt, Human
cuaacuuuagaagugcauuucu

SEQ ID NO: 2810747 - RNA, 23 nt, Human
cuaacuuuagaagugcauuucug

SEQ ID NO: 2810748 - RNA, 14 nt, Human
cuaagaagcuucua

SEQ ID NO: 2810749 - RNA, 16 nt, Human
cuaagaagcuucuaau

SEQ ID NO: 2810750 - RNA, 17 nt, Human
cuaagaagcuucuaaua

SEQ ID NO: 2810751 - RNA, 18 nt, Human
cuaagaagcuucuaauaa

SEQ ID NO: 2810752 - RNA, 21 nt, Human
cuaagaagcuucuaauaaauu

SEQ ID NO: 2810753 - RNA, 22 nt, Human
cuaagaagcuucuaauaaauua

SEQ ID NO: 2810754 - RNA, 23 nt, Human
cuaagaagcuucuaauaaauuau

SEQ ID NO: 2810755 - RNA, 13 nt, Human
cguucacuccaau

SEQ ID NO: 2810756 - RNA, 20 nt, Human
cuaaagauucuauaguucua

SEQ ID NO: 2810757 - RNA, 22 nt, Human
cuaaagauucuauaguucuaga

SEQ ID NO: 2810758 - RNA, 23 nt, Human
cuaaagauucuauaguucuagac

SEQ ID NO: 2810759 - RNA, 14 nt, Human
cuaaagccagccug

SEQ ID NO: 2810760 - RNA, 15 nt, Human
cuaaagccagccuga

SEQ ID NO: 2810761 - RNA, 13 nt, Human
cguuagcuuuuuc

SEQ ID NO: 2810762 - RNA, 16 nt, Human
cguuagaccgcucucu

SEQ ID NO: 2810763 - RNA, 11 nt, Human
cguuauauuaa

SEQ ID NO: 2810764 - RNA, 18 nt, Human
cguuauaaagugugccac

SEQ ID NO: 2810765 - RNA, 14 nt, Human
cgugaucaaagcca

SEQ ID NO: 2810766 - RNA, 13 nt, Human
cgugauacauuug

SEQ ID NO: 2810767 - RNA, 19 nt, Human
cgugagugucucuugucua

SEQ ID NO: 2810768 - RNA, 16 nt, Human
cguguucuccuuuucc

SEQ ID NO: 2810769 - RNA, 18 nt, Human
cgugaucaaagccacacu

SEQ ID NO: 2810770 - RNA, 12 nt, Human
cgugacaacacu

SEQ ID NO: 2810771 - RNA, 15 nt, Human
cgugacaacacuugu

SEQ ID NO: 2810772 - RNA, 14 nt, Human
cgugacaacacuug

SEQ ID NO: 2810773 - RNA, 20 nt, Human
cgugagccacugcaccgggc

SEQ ID NO: 2810774 - RNA, 15 nt, Human
cgugagccacugcac

SEQ ID NO: 2810775 - RNA, 14 nt, Human
cgugagccacugca

SEQ ID NO: 2810776 - RNA, 16 nt, Human
cgugacacucuccuug

SEQ ID NO: 2810777 - RNA, 18 nt, Human
cgugacacucuccuugca

SEQ ID NO: 2810778 - RNA, 21 nt, Human
cgugacacucuccuugcaguu

SEQ ID NO: 2810779 - RNA, 22 nt, Human
cgugacacucuccuugcaguuc

SEQ ID NO: 2810780 - RNA, 16 nt, Human
cgugagcgccugugca

SEQ ID NO: 2810781 - RNA, 20 nt, Human
cgugagcgccugugcacaca

SEQ ID NO: 2810782 - RNA, 21 nt, Human
cgugagcgccugugcacacac

SEQ ID NO: 2810783 - RNA, 22 nt, Human
cgugagccacugcaccgggcca

SEQ ID NO: 2810784 - RNA, 13 nt, Human
cgugagccccauc

SEQ ID NO: 2810785 - RNA, 14 nt, Human
cgugagccccaucu

SEQ ID NO: 2810786 - RNA, 16 nt, Human
cgugagccccaucuuc

SEQ ID NO: 2810787 - RNA, 11 nt, Human
ccuucucugug

SEQ ID NO: 2810788 - RNA, 12 nt, Human
ccuucucuguga

SEQ ID NO: 2810789 - RNA, 21 nt, Human
ccuucuguccuacucuguguc

SEQ ID NO: 2810790 - RNA, 20 nt, Human
ccuucuguccuacucugugu

SEQ ID NO: 2810791 - RNA, 22 nt, Human
ccuucuguccuacucuguguca

SEQ ID NO: 2810792 - RNA, 15 nt, Human
ccuucucucccugcc

SEQ ID NO: 2810793 - RNA, 16 nt, Human
ccuucccuaaagugau

SEQ ID NO: 2810794 - RNA, 17 nt, Human
ccuucccuaaagugaug

SEQ ID NO: 2810795 - RNA, 18 nt, Human
ccuuccccucccuggcuc

SEQ ID NO: 2810796 - RNA, 17 nt, Human
ccuuccccucccuggcu

SEQ ID NO: 2810797 - RNA, 15 nt, Human
ccuuccccucccugg

SEQ ID NO: 2810798 - RNA, 23 nt, Human
ccuuccccucagccacacccagg

SEQ ID NO: 2810799 - RNA, 22 nt, Human
ccuuccccucccuggcucccau

SEQ ID NO: 2810800 - RNA, 19 nt, Human
ccuuccccucccuggcucc

SEQ ID NO: 2810801 - RNA, 16 nt, Human
ccuuccccuccuucuc

SEQ ID NO: 2810802 - RNA, 23 nt, Human
ccuucccaugacccaggcugggc

SEQ ID NO: 2810803 - RNA, 22 nt, Human
ccuucccccaccgguccagcug

SEQ ID NO: 2810804 - RNA, 15 nt, Human
ccuuccccagcgucc

SEQ ID NO: 2810805 - RNA, 21 nt, Human
ccuucccccaccgguccagcu

SEQ ID NO: 2810806 - RNA, 19 nt, Human
ccuucccccuccaauccca

SEQ ID NO: 2810807 - RNA, 20 nt, Human
ccuucccccucccagggcca

SEQ ID NO: 2810808 - RNA, 17 nt, Human
ccuucccccucccaggg

SEQ ID NO: 2810809 - RNA, 16 nt, Human
ccuucccccucccagg

SEQ ID NO: 2810810 - RNA, 12 nt, Human
ccuucccuugcc

SEQ ID NO: 2810811 - RNA, 13 nt, Human
ccuucccuugcca

SEQ ID NO: 2810812 - RNA, 14 nt, Human
ccuucccuugccac

SEQ ID NO: 2810813 - RNA, 16 nt, Human
ccuucccuugccacuu

SEQ ID NO: 2810814 - RNA, 18 nt, Human
ccuucccuugccacuuug

SEQ ID NO: 2810815 - RNA, 19 nt, Human
ccuucccuugccacuuugc

SEQ ID NO: 2810816 - RNA, 20 nt, Human
ccuucccuugccacuuugca

SEQ ID NO: 2810817 - RNA, 14 nt, Human
ccuuccgacccucu

SEQ ID NO: 2810818 - RNA, 16 nt, Human
ccuuccgacccucugg

SEQ ID NO: 2810819 - RNA, 17 nt, Human
ccuuccgacccucuggg

SEQ ID NO: 2810820 - RNA, 18 nt, Human
ccuuccgacccucuggga

SEQ ID NO: 2810821 - RNA, 19 nt, Human
ccuuccgacccucugggaa

SEQ ID NO: 2810822 - RNA, 22 nt, Human
ccuuccgacccucugggaaccu

SEQ ID NO: 2810823 - RNA, 18 nt, Human
ccuuccuaauuccacagc

SEQ ID NO: 2810824 - RNA, 9 nt, Human
ccuuccuaa

SEQ ID NO: 2810825 - RNA, 16 nt, Human
ccuuccgccccuuccc

SEQ ID NO: 2810826 - RNA, 19 nt, Human
ccuuccgccccuucccuuc

SEQ ID NO: 2810827 - RNA, 20 nt, Human
ccuuccuaauuccacagcug

SEQ ID NO: 2810828 - RNA, 19 nt, Human
ccuuccuaauuccacagcu

SEQ ID NO: 2810829 - RNA, 20 nt, Human
ccuucccuuccacugccucu

SEQ ID NO: 2810830 - RNA, 23 nt, Human
ccuucccuuccacugccucugcc

SEQ ID NO: 2810831 - RNA, 12 nt, Human
ccuucccugcac

SEQ ID NO: 2810832 - RNA, 13 nt, Human
ccuucccugcacu

SEQ ID NO: 2810833 - RNA, 16 nt, Human
ccuuccucuccacugc

SEQ ID NO: 2810834 - RNA, 17 nt, Human
ccuuccucuccacugcc

SEQ ID NO: 2810835 - RNA, 14 nt, Human
ccuuccucuccacu

SEQ ID NO: 2810836 - RNA, 15 nt, Human
ccuuccucuccacug

SEQ ID NO: 2810837 - RNA, 16 nt, Human
ccuuccuccuccacca

SEQ ID NO: 2810838 - RNA, 21 nt, Human
ccuuccuccuccaccaccgcc

SEQ ID NO: 2810839 - RNA, 20 nt, Human
ccuuccucauccaccccauc

SEQ ID NO: 2810840 - RNA, 21 nt, Human
ccuuccucauccaccccaucc

SEQ ID NO: 2810841 - RNA, 14 nt, Human
ccuuccuccauccu

SEQ ID NO: 2810842 - RNA, 16 nt, Human
ccuuccucauccaccc

SEQ ID NO: 2810843 - RNA, 17 nt, Human
ccuuccucauccacccc

SEQ ID NO: 2810844 - RNA, 18 nt, Human
ccuuccucauccacccca

SEQ ID NO: 2810845 - RNA, 19 nt, Human
ccuuccucauccaccccau

SEQ ID NO: 2810846 - RNA, 14 nt, Human
ccuuccucacugcc

SEQ ID NO: 2810847 - RNA, 11 nt, Human
ccuuccuauaa

SEQ ID NO: 2810848 - RNA, 21 nt, Human
ccuuccuauaacuugaugcau

SEQ ID NO: 2810849 - RNA, 23 nt, Human
ccuuccuauaacuugaugcaugu

SEQ ID NO: 2810850 - RNA, 23 nt, Human
ccuucccccuuuuuuguccccca

SEQ ID NO: 2810851 - RNA, 18 nt, Human
ccuuccuacccuccugca

SEQ ID NO: 2810852 - RNA, 21 nt, Human
ccuuccuaauuccacagcugc

SEQ ID NO: 2810853 - RNA, 16 nt, Human
ccuuccuaagccugug

SEQ ID NO: 2810854 - RNA, 17 nt, Human
ccuuccuaagccugugg

SEQ ID NO: 2810855 - RNA, 23 nt, Human
ccuuccuaagccuguggcugugg

SEQ ID NO: 2810856 - RNA, 16 nt, Human
ccuucucugaaggaca

SEQ ID NO: 2810857 - RNA, 14 nt, Human
ccuucucugaagga

SEQ ID NO: 2810858 - RNA, 22 nt, Human
ccuucucugcuccaccacaucc

SEQ ID NO: 2810859 - RNA, 20 nt, Human
ccuucucugcuccaccacau

SEQ ID NO: 2810860 - RNA, 17 nt, Human
ccuucucugcuccacca

SEQ ID NO: 2810861 - RNA, 16 nt, Human
ccuucucugcuccacc

SEQ ID NO: 2810862 - RNA, 14 nt, Human
ccuucucugcucca

SEQ ID NO: 2810863 - RNA, 13 nt, Human
ccuucucugcucc

SEQ ID NO: 2810864 - RNA, 13 nt, Human
ccuucucugaaca

SEQ ID NO: 2810865 - RNA, 15 nt, Human
ccuucucugaacaca

SEQ ID NO: 2810866 - RNA, 17 nt, Human
ccuucucugaacacagg

SEQ ID NO: 2810867 - RNA, 18 nt, Human
ccuucucugaacacaggc

SEQ ID NO: 2810868 - RNA, 19 nt, Human
ccuucucugaacacaggca

SEQ ID NO: 2810869 - RNA, 20 nt, Human
ccuucucugaacacaggcag

SEQ ID NO: 2810870 - RNA, 21 nt, Human
ccuucucugaacacaggcagc

SEQ ID NO: 2810871 - RNA, 22 nt, Human
ccuucucugaacacaggcagcu

SEQ ID NO: 2810872 - RNA, 20 nt, Human
ccuuccucuccacugccuuc

SEQ ID NO: 2810873 - RNA, 24 nt, Human
ccuugccaccccacccucccugga

SEQ ID NO: 2810874 - RNA, 15 nt, Human
ccuugccacuuugca

SEQ ID NO: 2810875 - RNA, 19 nt, Human
ccuugccacuuugcacgac

SEQ ID NO: 2810876 - RNA, 23 nt, Human
ccuugccaccccacccucccugg

SEQ ID NO: 2810877 - RNA, 19 nt, Human
ccuuuauguggaaaacaga

SEQ ID NO: 2810878 - RNA, 23 nt, Human
ccuuuauguggaaaacagaacau

SEQ ID NO: 2810879 - RNA, 19 nt, Human
ccuuuauauuuagugaacu

SEQ ID NO: 2810880 - RNA, 19 nt, Human
ccuuuaguaccugaaaagu

SEQ ID NO: 2810881 - RNA, 17 nt, Human
ccuuuaguaucaguguu

SEQ ID NO: 2810882 - RNA, 18 nt, Human
ccuuuaguaucaguguuu

SEQ ID NO: 2810883 - RNA, 21 nt, Human
ccuuuaguaucaguguuuuaa

SEQ ID NO: 2810884 - RNA, 18 nt, Human
ccuuuaguaccugaaaag

SEQ ID NO: 2810885 - RNA, 21 nt, Human
ccuugcuccuggccuugcuga

SEQ ID NO: 2810886 - RNA, 14 nt, Human
ccuugcuaauuuuc

SEQ ID NO: 2810887 - RNA, 21 nt, Human
ccuugcggggauaaagagaga

SEQ ID NO: 2810888 - RNA, 15 nt, Human
ccuuucaaauuucac

SEQ ID NO: 2810889 - RNA, 16 nt, Human
ccuuucaaauuucaca

SEQ ID NO: 2810890 - RNA, 14 nt, Human
ccuuucccucgcua

SEQ ID NO: 2810891 - RNA, 12 nt, Human
ccuuucccuucc

SEQ ID NO: 2810892 - RNA, 13 nt, Human
ccuuucccuuccu

SEQ ID NO: 2810893 - RNA, 14 nt, Human
ccuuucccuuccuc

SEQ ID NO: 2810894 - RNA, 15 nt, Human
ccuuucccuuccucu

SEQ ID NO: 2810895 - RNA, 16 nt, Human
ccuuucccuuccucuu

SEQ ID NO: 2810896 - RNA, 14 nt, Human
ccuuucaaauuuag

SEQ ID NO: 2810897 - RNA, 15 nt, Human
ccuuucaaauuuaga

SEQ ID NO: 2810898 - RNA, 16 nt, Human
ccuuucaaauuuagaa

SEQ ID NO: 2810899 - RNA, 21 nt, Human
ccuuucaaauuuagaaacuaa

SEQ ID NO: 2810900 - RNA, 22 nt, Human
ccuuucaaauuuagaaacuaau

SEQ ID NO: 2810901 - RNA, 23 nt, Human
ccuuuauuacccccuccuucaga

SEQ ID NO: 2810902 - RNA, 14 nt, Human
ccuuuauucuggca

SEQ ID NO: 2810903 - RNA, 21 nt, Human
ccuuuauuggguaucaagaca

SEQ ID NO: 2810904 - RNA, 23 nt, Human
ccuugcaguucagcaccacccua

SEQ ID NO: 2810905 - RNA, 13 nt, Human
ccuugccacccca

SEQ ID NO: 2810906 - RNA, 17 nt, Human
ccuugccaccccacccu

SEQ ID NO: 2810907 - RNA, 19 nt, Human
ccuugccaccccacccucc

SEQ ID NO: 2810908 - RNA, 22 nt, Human
ccuugcaguucagcaccacccu

SEQ ID NO: 2810909 - RNA, 20 nt, Human
ccuugcaguucagcaccacc

SEQ ID NO: 2810910 - RNA, 19 nt, Human
ccuugcaguucagcaccac

SEQ ID NO: 2810911 - RNA, 17 nt, Human
ccuugcaguucagcacc

SEQ ID NO: 2810912 - RNA, 15 nt, Human
ccuugcagcuaguuu

SEQ ID NO: 2810913 - RNA, 13 nt, Human
ccuugcagaacug

SEQ ID NO: 2810914 - RNA, 14 nt, Human
ccuugcagaacugc

SEQ ID NO: 2810915 - RNA, 16 nt, Human
ccuugcagaacugcca

SEQ ID NO: 2810916 - RNA, 17 nt, Human
ccuugcagaacugccau

SEQ ID NO: 2810917 - RNA, 18 nt, Human
ccuugcagaacugccauu

SEQ ID NO: 2810918 - RNA, 18 nt, Human
ccuugcaccccucacucu

SEQ ID NO: 2810919 - RNA, 13 nt, Human
ccuugcaccccuc

SEQ ID NO: 2810920 - RNA, 14 nt, Human
ccuugcaccccuca

SEQ ID NO: 2810921 - RNA, 17 nt, Human
ccuugcaccccucacuc

SEQ ID NO: 2810922 - RNA, 23 nt, Human
ccuuaggccuuccucucuccaga

SEQ ID NO: 2810923 - RNA, 18 nt, Human
ccuuagggaagcuggccu

SEQ ID NO: 2810924 - RNA, 20 nt, Human
ccuuaggugauccacucgcc

SEQ ID NO: 2810925 - RNA, 14 nt, Human
ccuuaggccuuccu

SEQ ID NO: 2810926 - RNA, 15 nt, Human
ccuuaggccuuccuc

SEQ ID NO: 2810927 - RNA, 13 nt, Human
ccuuaggccuucc

SEQ ID NO: 2810928 - RNA, 22 nt, Human
ccuuaggccacaugggagcagu

SEQ ID NO: 2810929 - RNA, 19 nt, Human
ccuuaggccuaccugaugg

SEQ ID NO: 2810930 - RNA, 16 nt, Human
ccuuauaguuugggcu

SEQ ID NO: 2810931 - RNA, 19 nt, Human
ccuuauaguuugggcuuca

SEQ ID NO: 2810932 - RNA, 22 nt, Human
ccuuauaguuugggcuucagcc

SEQ ID NO: 2810933 - RNA, 13 nt, Human
ccuuaucaaagga

SEQ ID NO: 2810934 - RNA, 22 nt, Human
ccuuagucccccaacucugagc

SEQ ID NO: 2810935 - RNA, 15 nt, Human
ccuuagugggccagg

SEQ ID NO: 2810936 - RNA, 19 nt, Human
ccuuagugggccagggcug

SEQ ID NO: 2810937 - RNA, 22 nt, Human
ccuuagugggccagggcugccc

SEQ ID NO: 2810938 - RNA, 21 nt, Human
ccuuagggaagcuggccugag

SEQ ID NO: 2810939 - RNA, 20 nt, Human
ccuuagggaagcuggccuga

SEQ ID NO: 2810940 - RNA, 14 nt, Human
ccuuagucucaguu

SEQ ID NO: 2810941 - RNA, 20 nt, Human
ccuuagucucaguuugugug

SEQ ID NO: 2810942 - RNA, 17 nt, Human
ccuuaucugugcucagg

SEQ ID NO: 2810943 - RNA, 15 nt, Human
ccuuaucugugcuca

SEQ ID NO: 2810944 - RNA, 19 nt, Human
ccuuaugacuugcuacuuu

SEQ ID NO: 2810945 - RNA, 22 nt, Human
ccuuaucuccaagaccagagau

SEQ ID NO: 2810946 - RNA, 16 nt, Human
ccuuaucuccaagacc

SEQ ID NO: 2810947 - RNA, 16 nt, Human
ccuuauccuucaucuu

SEQ ID NO: 2810948 - RNA, 14 nt, Human
ccuuauccuuccuc

SEQ ID NO: 2810949 - RNA, 20 nt, Human
ccuuauccuuccucuccuuc

SEQ ID NO: 2810950 - RNA, 14 nt, Human
ccuuauccccacuu

SEQ ID NO: 2810951 - RNA, 18 nt, Human
ccuuaucaaaggacacca

SEQ ID NO: 2810952 - RNA, 14 nt, Human
ccuuaucaaaggac

SEQ ID NO: 2810953 - RNA, 13 nt, Human
ccuuaucagagcu

SEQ ID NO: 2810954 - RNA, 14 nt, Human
ccuuaucagagcua

SEQ ID NO: 2810955 - RNA, 22 nt, Human
ccuucccaaguaagaggcugga

SEQ ID NO: 2810956 - RNA, 17 nt, Human
ccuucccaaucagcacu

SEQ ID NO: 2810957 - RNA, 18 nt, Human
ccuucccaaucagcacug

SEQ ID NO: 2810958 - RNA, 19 nt, Human
ccuucccaaucagcacuga

SEQ ID NO: 2810959 - RNA, 20 nt, Human
ccuucccaaucagcacugaa

SEQ ID NO: 2810960 - RNA, 21 nt, Human
ccuucccaaucagcacugaaa

SEQ ID NO: 2810961 - RNA, 14 nt, Human
ccuucccaucgcug

SEQ ID NO: 2810962 - RNA, 15 nt, Human
ccuucccaucgcugu

SEQ ID NO: 2810963 - RNA, 18 nt, Human
ccuucccaugacccaggc

SEQ ID NO: 2810964 - RNA, 21 nt, Human
ccuucccaugacccaggcugg

SEQ ID NO: 2810965 - RNA, 15 nt, Human
ccuucccaugcccug

SEQ ID NO: 2810966 - RNA, 18 nt, Human
ccuucccacucaccccgg

SEQ ID NO: 2810967 - RNA, 15 nt, Human
ccuucccacucaccc

SEQ ID NO: 2810968 - RNA, 17 nt, Human
ccuucccacucaccccg

SEQ ID NO: 2810969 - RNA, 22 nt, Human
ccuuagcuggcauuacagcugg

SEQ ID NO: 2810970 - RNA, 19 nt, Human
ccuuagcuggcauuacagc

SEQ ID NO: 2810971 - RNA, 19 nt, Human
ccuuagcucccucccgcac

SEQ ID NO: 2810972 - RNA, 16 nt, Human
ccuuagccucccugaa

SEQ ID NO: 2810973 - RNA, 15 nt, Human
ccuuagccucccuga

SEQ ID NO: 2810974 - RNA, 14 nt, Human
ccuuagccucccug

SEQ ID NO: 2810975 - RNA, 21 nt, Human
ccuuagccuaaaauccacacc

SEQ ID NO: 2810976 - RNA, 20 nt, Human
ccuuagcacuaccacuccug

SEQ ID NO: 2810977 - RNA, 20 nt, Human
ccuuagcagggaaacagcua

SEQ ID NO: 2810978 - RNA, 19 nt, Human
ccuuagcagggaaacagcu

SEQ ID NO: 2810979 - RNA, 17 nt, Human
ccuguuggauuuguuua

SEQ ID NO: 2810980 - RNA, 24 nt, Human
ccuguuggauuuguuuaaaaggau

SEQ ID NO: 2810981 - RNA, 20 nt, Human
ccuuagauuuaguaguguaa

SEQ ID NO: 2810982 - RNA, 17 nt, Human
ccuguugcuguguuuaa

SEQ ID NO: 2810983 - RNA, 22 nt, Human
ccuguugcuguguuuaauuuga

SEQ ID NO: 2810984 - RNA, 22 nt, Human
ccuguugcccuuucuguaccau

SEQ ID NO: 2810985 - RNA, 21 nt, Human
ccuguugcgugacacucuccu

SEQ ID NO: 2810986 - RNA, 19 nt, Human
ccuguucagcuccagcuca

SEQ ID NO: 2810987 - RNA, 16 nt, Human
ccuguucagcuccagc

SEQ ID NO: 2810988 - RNA, 15 nt, Human
ccuguucagcuccag

SEQ ID NO: 2810989 - RNA, 14 nt, Human
ccuguucagcucca

SEQ ID NO: 2810990 - RNA, 21 nt, Human
ccuguucagcuccagcucacc

SEQ ID NO: 2810991 - RNA, 20 nt, Human
ccuguucagcuccagcucac

SEQ ID NO: 2810992 - RNA, 23 nt, Human
ccuguucagcuccagcucaccag

SEQ ID NO: 2810993 - RNA, 16 nt, Human
ccuguucugcuuuccu

SEQ ID NO: 2810994 - RNA, 19 nt, Human
ccuguucugggugcagcug

SEQ ID NO: 2810995 - RNA, 12 nt, Human
ccuguucuuccu

SEQ ID NO: 2810996 - RNA, 13 nt, Human
ccuguucuuccuc

SEQ ID NO: 2810997 - RNA, 14 nt, Human
ccuguucuuccucc

SEQ ID NO: 2810998 - RNA, 16 nt, Human
ccuguucuuccuccag

SEQ ID NO: 2810999 - RNA, 20 nt, Human
ccuguucuuccuccagcugc

SEQ ID NO: 2811000 - RNA, 24 nt, Human
ccuguucuuccuccagcugcacca

SEQ ID NO: 2811001 - RNA, 12 nt, Human
ccuguucccauu

SEQ ID NO: 2811002 - RNA, 12 nt, Human
ccuguucuaagg

SEQ ID NO: 2811003 - RNA, 16 nt, Human
ccuguucuaaggggga

SEQ ID NO: 2811004 - RNA, 21 nt, Human
ccuguucuaagggggagggga

SEQ ID NO: 2811005 - RNA, 13 nt, Human
ccuguucagcucc

SEQ ID NO: 2811006 - RNA, 19 nt, Human
ccuguuaggagaagcugca

SEQ ID NO: 2811007 - RNA, 13 nt, Human
ccuguuauuuuca

SEQ ID NO: 2811008 - RNA, 19 nt, Human
ccuguuauuuucaaguagc

SEQ ID NO: 2811009 - RNA, 15 nt, Human
ccuguucaaggcccc

SEQ ID NO: 2811010 - RNA, 21 nt, Human
ccuguucacucuacuuagcau

SEQ ID NO: 2811011 - RNA, 18 nt, Human
ccuguuagcuccucacug

SEQ ID NO: 2811012 - RNA, 22 nt, Human
ccuguuagcuccucacuguggu

SEQ ID NO: 2811013 - RNA, 23 nt, Human
ccuguuagcuccucacuguggua

SEQ ID NO: 2811014 - RNA, 16 nt, Human
ccugcugcugucaccu

SEQ ID NO: 2811015 - RNA, 18 nt, Human
ccugcugcugucaccucu

SEQ ID NO: 2811016 - RNA, 19 nt, Human
ccugcugcugucaccucuc

SEQ ID NO: 2811017 - RNA, 20 nt, Human
ccugcugcugucaccucucc

SEQ ID NO: 2811018 - RNA, 22 nt, Human
ccugcugcugucaccucuccca

SEQ ID NO: 2811019 - RNA, 23 nt, Human
ccugcugcugucaccucucccac

SEQ ID NO: 2811020 - RNA, 15 nt, Human
cuauguuacuauuuu

SEQ ID NO: 2811021 - RNA, 16 nt, Human
cuauguuacuauuuuc

SEQ ID NO: 2811022 - RNA, 18 nt, Human
cuauguuacuauuuucua

SEQ ID NO: 2811023 - RNA, 22 nt, Human
cuauguuacuauuuucuacaau

SEQ ID NO: 2811024 - RNA, 22 nt, Human
cuauguugcccaggcaggucuu

SEQ ID NO: 2811025 - RNA, 21 nt, Human
cuauguugcccaggcaggucu

SEQ ID NO: 2811026 - RNA, 19 nt, Human
cuauguugcccaggcaggu

SEQ ID NO: 2811027 - RNA, 18 nt, Human
cuauguugcccaggcagg

SEQ ID NO: 2811028 - RNA, 12 nt, Human
cuauccuucgug

SEQ ID NO: 2811029 - RNA, 13 nt, Human
cuauccuucguga

SEQ ID NO: 2811030 - RNA, 11 nt, Human
cuauccuuggc

SEQ ID NO: 2811031 - RNA, 12 nt, Human
cuauccuuggca

SEQ ID NO: 2811032 - RNA, 17 nt, Human
cuauccuuggcaccaaa

SEQ ID NO: 2811033 - RNA, 18 nt, Human
cuauccuuggcaccaaag

SEQ ID NO: 2811034 - RNA, 20 nt, Human
cuauccuuggcaccaaagau

SEQ ID NO: 2811035 - RNA, 13 nt, Human
cuauccuggcucu

SEQ ID NO: 2811036 - RNA, 19 nt, Human
cuauccuggcucuuuggag

SEQ ID NO: 2811037 - RNA, 14 nt, Human
cuaucucagagaua

SEQ ID NO: 2811038 - RNA, 13 nt, Human
cuaugucccuugc

SEQ ID NO: 2811039 - RNA, 16 nt, Human
cuaugucccuugcugu

SEQ ID NO: 2811040 - RNA, 15 nt, Human
cuauccugcuguucu

SEQ ID NO: 2811041 - RNA, 11 nt, Human
cuauccuggcc

SEQ ID NO: 2811042 - RNA, 19 nt, Human
cuauccugaaaauucugua

SEQ ID NO: 2811043 - RNA, 23 nt, Human
cuauccugacuucuaauaucauu

SEQ ID NO: 2811044 - RNA, 17 nt, Human
cuauccuacuuccccuu

SEQ ID NO: 2811045 - RNA, 18 nt, Human
cuauccuacaaggccuau

SEQ ID NO: 2811046 - RNA, 14 nt, Human
cuauccucacugcc

SEQ ID NO: 2811047 - RNA, 13 nt, Human
cuauccuacccca

SEQ ID NO: 2811048 - RNA, 14 nt, Human
cuaucccucacaca

SEQ ID NO: 2811049 - RNA, 22 nt, Human
cuaucauacuacugaaacagau

SEQ ID NO: 2811050 - RNA, 16 nt, Human
cuaucauaguuaacau

SEQ ID NO: 2811051 - RNA, 17 nt, Human
cuaucauaguuaacaua

SEQ ID NO: 2811052 - RNA, 13 nt, Human
cuaucagaagacc

SEQ ID NO: 2811053 - RNA, 19 nt, Human
cuaucagcagcuagaaaac

SEQ ID NO: 2811054 - RNA, 17 nt, Human
cuaucaccuauuuccau

SEQ ID NO: 2811055 - RNA, 16 nt, Human
cuaucaccuauuucca

SEQ ID NO: 2811056 - RNA, 18 nt, Human
cuacaaaacgcgcagaug

SEQ ID NO: 2811057 - RNA, 12 nt, Human
cucaauguuuga

SEQ ID NO: 2811058 - RNA, 18 nt, Human
cucaauguuuguaauaau

SEQ ID NO: 2811059 - RNA, 13 nt, Human
cuauuaaaacuca

SEQ ID NO: 2811060 - RNA, 16 nt, Human
cucaaugaagccagcu

SEQ ID NO: 2811061 - RNA, 22 nt, Human
cucaaugaaaaauagugucuuu

SEQ ID NO: 2811062 - RNA, 13 nt, Human
cucaaugaaaaau

SEQ ID NO: 2811063 - RNA, 12 nt, Human
cucaaugaaaaa

SEQ ID NO: 2811064 - RNA, 14 nt, Human
cucaauggacugga

SEQ ID NO: 2811065 - RNA, 17 nt, Human
cucaauggacuggaagg

SEQ ID NO: 2811066 - RNA, 20 nt, Human
cucaauggacuggaagggga

SEQ ID NO: 2811067 - RNA, 20 nt, Human
cucaauggaguaugucugau

SEQ ID NO: 2811068 - RNA, 22 nt, Human
cucaauggccuaaaacuggccu

SEQ ID NO: 2811069 - RNA, 23 nt, Human
cucaauggccuaaaacuggccug

SEQ ID NO: 2811070 - RNA, 11 nt, Human
cucaaugugaa

SEQ ID NO: 2811071 - RNA, 13 nt, Human
cucaaugugaaaa

SEQ ID NO: 2811072 - RNA, 14 nt, Human
cucaauccucuaag

SEQ ID NO: 2811073 - RNA, 17 nt, Human
cucaauccugcaguggg

SEQ ID NO: 2811074 - RNA, 15 nt, Human
cucaaucaagaaaau

SEQ ID NO: 2811075 - RNA, 21 nt, Human
cucaagugauucuccugccuc

SEQ ID NO: 2811076 - RNA, 22 nt, Human
cuauguugauccauccagcuug

SEQ ID NO: 2811077 - RNA, 11 nt, Human
cuauguuuacu

SEQ ID NO: 2811078 - RNA, 14 nt, Human
cuauguuucaucuu

SEQ ID NO: 2811079 - RNA, 15 nt, Human
cuauguuucaucuug

SEQ ID NO: 2811080 - RNA, 14 nt, Human
cuauguuugcacuu

SEQ ID NO: 2811081 - RNA, 18 nt, Human
cuauguugugguccauca

SEQ ID NO: 2811082 - RNA, 14 nt, Human
cucaaguugaaaga

SEQ ID NO: 2811083 - RNA, 20 nt, Human
cucaaguguucacaaccugg

SEQ ID NO: 2811084 - RNA, 13 nt, Human
cucaaguucuaag

SEQ ID NO: 2811085 - RNA, 14 nt, Human
cucaaguucuaaga

SEQ ID NO: 2811086 - RNA, 15 nt, Human
cucaaguucuaagau

SEQ ID NO: 2811087 - RNA, 18 nt, Human
cucaaguucuaagauucu

SEQ ID NO: 2811088 - RNA, 19 nt, Human
cucaaguucuaagauucua

SEQ ID NO: 2811089 - RNA, 20 nt, Human
cucaaguucuaagauucuaa

SEQ ID NO: 2811090 - RNA, 15 nt, Human
cucaguccauuuaua

SEQ ID NO: 2811091 - RNA, 19 nt, Human
cucaguccauuuauauaug

SEQ ID NO: 2811092 - RNA, 23 nt, Human
cucaguccauuuauauaugaaaa

SEQ ID NO: 2811093 - RNA, 12 nt, Human
cucagucccaaa

SEQ ID NO: 2811094 - RNA, 21 nt, Human
cucagucccaaauccuuccca

SEQ ID NO: 2811095 - RNA, 18 nt, Human
cucagucauuagacuccu

SEQ ID NO: 2811096 - RNA, 22 nt, Human
cucagucaugcauaaauaugca

SEQ ID NO: 2811097 - RNA, 23 nt, Human
cucagucaugcauaaauaugcag

SEQ ID NO: 2811098 - RNA, 14 nt, Human
cucaguccuccccu

SEQ ID NO: 2811099 - RNA, 16 nt, Human
cucaguccuccccuca

SEQ ID NO: 2811100 - RNA, 17 nt, Human
cucaguccuccccucac

SEQ ID NO: 2811101 - RNA, 18 nt, Human
cucaguccuccccucaca

SEQ ID NO: 2811102 - RNA, 19 nt, Human
cucaguccuccccucacag

SEQ ID NO: 2811103 - RNA, 20 nt, Human
cucaguccuccccucacagc

SEQ ID NO: 2811104 - RNA, 17 nt, Human
cucaguccauagcagag

SEQ ID NO: 2811105 - RNA, 15 nt, Human
cucaguccauagcag

SEQ ID NO: 2811106 - RNA, 15 nt, Human
cucaguauauuuaaa

SEQ ID NO: 2811107 - RNA, 18 nt, Human
cucaguauauuuaaacuc

SEQ ID NO: 2811108 - RNA, 14 nt, Human
cucagguugucuga

SEQ ID NO: 2811109 - RNA, 18 nt, Human
cucaguaugcugccccug

SEQ ID NO: 2811110 - RNA, 14 nt, Human
cucagucaugcaua

SEQ ID NO: 2811111 - RNA, 15 nt, Human
cucagucaugcauaa

SEQ ID NO: 2811112 - RNA, 16 nt, Human
cucagucaugcauaaa

SEQ ID NO: 2811113 - RNA, 18 nt, Human
cucagucaugcauaaaua

SEQ ID NO: 2811114 - RNA, 14 nt, Human
cucagugcagcaau

SEQ ID NO: 2811115 - RNA, 17 nt, Human
cucaugaggaggggccc

SEQ ID NO: 2811116 - RNA, 15 nt, Human
cucagugcaaccucu

SEQ ID NO: 2811117 - RNA, 16 nt, Human
cucagugcaaccucug

SEQ ID NO: 2811118 - RNA, 17 nt, Human
cucagugcaaccucugc

SEQ ID NO: 2811119 - RNA, 22 nt, Human
cucagugcaaccucugcuuccc

SEQ ID NO: 2811120 - RNA, 23 nt, Human
cucagugcaaccucugcuuccca

SEQ ID NO: 2811121 - RNA, 14 nt, Human
cucauggccccucu

SEQ ID NO: 2811122 - RNA, 15 nt, Human
cucauggccccucug

SEQ ID NO: 2811123 - RNA, 17 nt, Human
cucauggccccucugac

SEQ ID NO: 2811124 - RNA, 19 nt, Human
cucauggccccucugaccu

SEQ ID NO: 2811125 - RNA, 23 nt, Human
cucaugaggaggggccccccugc

SEQ ID NO: 2811126 - RNA, 23 nt, Human
cucaggugucccugcacuugcag

SEQ ID NO: 2811127 - RNA, 22 nt, Human
cucagguguuuuuuaugaagug

SEQ ID NO: 2811128 - RNA, 22 nt, Human
cucagccucccgaauagcuggg

SEQ ID NO: 2811129 - RNA, 23 nt, Human
cucagccggcguggcaaauauaa

SEQ ID NO: 2811130 - RNA, 21 nt, Human
cucagccucccgaauagcugg

SEQ ID NO: 2811131 - RNA, 19 nt, Human
cucagccucccgaauagcu

SEQ ID NO: 2811132 - RNA, 15 nt, Human
cucagcccugaggug

SEQ ID NO: 2811133 - RNA, 14 nt, Human
cucagcccugaggu

SEQ ID NO: 2811134 - RNA, 13 nt, Human
cucagcccugagg

SEQ ID NO: 2811135 - RNA, 23 nt, Human
cucagaagacacugaugggcaac

SEQ ID NO: 2811136 - RNA, 11 nt, Human
cucagaagccu

SEQ ID NO: 2811137 - RNA, 15 nt, Human
cucagaagccucugg

SEQ ID NO: 2811138 - RNA, 17 nt, Human
cucagaagccugaggcu

SEQ ID NO: 2811139 - RNA, 16 nt, Human
cucagaagccugaggc

SEQ ID NO: 2811140 - RNA, 18 nt, Human
cucagaagccugaggcug

SEQ ID NO: 2811141 - RNA, 15 nt, Human
cucagaagccugagg

SEQ ID NO: 2811142 - RNA, 14 nt, Human
cucagaagccugag

SEQ ID NO: 2811143 - RNA, 13 nt, Human
cucagaagccuga

SEQ ID NO: 2811144 - RNA, 17 nt, Human
cucagaagccucugggu

SEQ ID NO: 2811145 - RNA, 15 nt, Human
cucagaccagcucuu

SEQ ID NO: 2811146 - RNA, 14 nt, Human
cucagaccagcucu

SEQ ID NO: 2811147 - RNA, 16 nt, Human
cucagaccagcucuuc

SEQ ID NO: 2811148 - RNA, 14 nt, Human
cucagaccagagaa

SEQ ID NO: 2811149 - RNA, 15 nt, Human
cucagaccagagaag

SEQ ID NO: 2811150 - RNA, 15 nt, Human
cucagacugcaccca

SEQ ID NO: 2811151 - RNA, 16 nt, Human
cucagacugcacccag

SEQ ID NO: 2811152 - RNA, 17 nt, Human
cucagacugcacccagg

SEQ ID NO: 2811153 - RNA, 18 nt, Human
cucagacugcacccagga

SEQ ID NO: 2811154 - RNA, 19 nt, Human
cucagacugcacccaggag

SEQ ID NO: 2811155 - RNA, 20 nt, Human
cucagacugcacccaggagg

SEQ ID NO: 2811156 - RNA, 21 nt, Human
cucagacugcacccaggaggg

SEQ ID NO: 2811157 - RNA, 20 nt, Human
cucacgccuaugaucccagc

SEQ ID NO: 2811158 - RNA, 18 nt, Human
cucacgccuguaauccca

SEQ ID NO: 2811159 - RNA, 14 nt, Human
cucacgcugggucc

SEQ ID NO: 2811160 - RNA, 23 nt, Human
cucacgcuuaccucaaccauccu

SEQ ID NO: 2811161 - RNA, 13 nt, Human
cucacgcuucaca

SEQ ID NO: 2811162 - RNA, 15 nt, Human
cucacgcuucacagu

SEQ ID NO: 2811163 - RNA, 22 nt, Human
cucacgucuguaaucccagcgc

SEQ ID NO: 2811164 - RNA, 21 nt, Human
cucacgggcaugggcacuccc

SEQ ID NO: 2811165 - RNA, 16 nt, Human
cucacguccagguuca

SEQ ID NO: 2811166 - RNA, 17 nt, Human
cucacgggcaugggcac

SEQ ID NO: 2811167 - RNA, 22 nt, Human
cucagaagacacugaugggcaa

SEQ ID NO: 2811168 - RNA, 20 nt, Human
cucagaagacacugaugggc

SEQ ID NO: 2811169 - RNA, 17 nt, Human
cucagaagacacugaug

SEQ ID NO: 2811170 - RNA, 15 nt, Human
cucagaagacacuga

SEQ ID NO: 2811171 - RNA, 13 nt, Human
cucagaagacacu

SEQ ID NO: 2811172 - RNA, 13 nt, Human
cucagaacccagg

SEQ ID NO: 2811173 - RNA, 14 nt, Human
cucagaacccaggg

SEQ ID NO: 2811174 - RNA, 16 nt, Human
cucagaacccagggcu

SEQ ID NO: 2811175 - RNA, 17 nt, Human
cucagaacccagggcuc

SEQ ID NO: 2811176 - RNA, 23 nt, Human
cucagaacccagggcucugcccc

SEQ ID NO: 2811177 - RNA, 21 nt, Human
cucagaacccuuggcuugccc

SEQ ID NO: 2811178 - RNA, 21 nt, Human
cucagaacugucggaggaaag

SEQ ID NO: 2811179 - RNA, 22 nt, Human
cucagaacugucggaggaaaga

SEQ ID NO: 2811180 - RNA, 14 nt, Human
cucagaacccuugg

SEQ ID NO: 2811181 - RNA, 20 nt, Human
cucacuacccuauucucucu

SEQ ID NO: 2811182 - RNA, 23 nt, Human
cucaggccuauaaccccagcucc

SEQ ID NO: 2811183 - RNA, 19 nt, Human
cucaggccaacaagccaac

SEQ ID NO: 2811184 - RNA, 20 nt, Human
cucaggccaagaaacgucuu

SEQ ID NO: 2811185 - RNA, 13 nt, Human
cucagccugcaca

SEQ ID NO: 2811186 - RNA, 14 nt, Human
cucagccugcugcc

SEQ ID NO: 2811187 - RNA, 15 nt, Human
cucagccugcugccc

SEQ ID NO: 2811188 - RNA, 16 nt, Human
cucagccugcugccca

SEQ ID NO: 2811189 - RNA, 17 nt, Human
cucagccugcugcccag

SEQ ID NO: 2811190 - RNA, 19 nt, Human
cucagccugcugcccaggc

SEQ ID NO: 2811191 - RNA, 11 nt, Human
cucagccugca

SEQ ID NO: 2811192 - RNA, 14 nt, Human
cucagccugggaca

SEQ ID NO: 2811193 - RNA, 23 nt, Human
cucagggaaaagcagcucucccc

SEQ ID NO: 2811194 - RNA, 17 nt, Human
cucagggaaaagcagcu

SEQ ID NO: 2811195 - RNA, 17 nt, Human
cucaggcuuccuuggca

SEQ ID NO: 2811196 - RNA, 17 nt, Human
cucaggcuggugggagg

SEQ ID NO: 2811197 - RNA, 22 nt, Human
cucagggaaaagcagcucuccc

SEQ ID NO: 2811198 - RNA, 20 nt, Human
cucagggaaaagcagcucuc

SEQ ID NO: 2811199 - RNA, 24 nt, Human
cucaggcugcuggggccucagacg

SEQ ID NO: 2811200 - RNA, 13 nt, Human
cucaggcugcagc

SEQ ID NO: 2811201 - RNA, 16 nt, Human
cucaggcugcagcugg

SEQ ID NO: 2811202 - RNA, 17 nt, Human
cucaggcugcagcugga

SEQ ID NO: 2811203 - RNA, 18 nt, Human
cucaggcugcagcuggac

SEQ ID NO: 2811204 - RNA, 19 nt, Human
cucaggcugcagcuggaca

SEQ ID NO: 2811205 - RNA, 20 nt, Human
cucaggcugcagcuggacag

SEQ ID NO: 2811206 - RNA, 21 nt, Human
cucaggcugcagcuggacaga

SEQ ID NO: 2811207 - RNA, 22 nt, Human
cucaggcugcagcuggacagag

SEQ ID NO: 2811208 - RNA, 23 nt, Human
cucaggcugcagcuggacagagg

SEQ ID NO: 2811209 - RNA, 21 nt, Human
cucaggcgauccaccugucuc

SEQ ID NO: 2811210 - RNA, 13 nt, Human
cucaggcucucca

SEQ ID NO: 2811211 - RNA, 20 nt, Human
cucaggcgauccaccugucu

SEQ ID NO: 2811212 - RNA, 15 nt, Human
cuccccucacagccu

SEQ ID NO: 2811213 - RNA, 16 nt, Human
cuccccucacagccuc

SEQ ID NO: 2811214 - RNA, 17 nt, Human
cuccccucacagccucu

SEQ ID NO: 2811215 - RNA, 18 nt, Human
cuccccucacagccucug

SEQ ID NO: 2811216 - RNA, 13 nt, Human
cuccccucacagc

SEQ ID NO: 2811217 - RNA, 14 nt, Human
cuccccucacagcc

SEQ ID NO: 2811218 - RNA, 14 nt, Human
cuccccggcucgag

SEQ ID NO: 2811219 - RNA, 13 nt, Human
cucccuccagcac

SEQ ID NO: 2811220 - RNA, 14 nt, Human
cucccuccagcaca

SEQ ID NO: 2811221 - RNA, 15 nt, Human
cucccuccagcacaa

SEQ ID NO: 2811222 - RNA, 16 nt, Human
cucccuccagcacaaa

SEQ ID NO: 2811223 - RNA, 16 nt, Human
cucccaggagacaguu

SEQ ID NO: 2811224 - RNA, 21 nt, Human
cucccaggacucugaccccag

SEQ ID NO: 2811225 - RNA, 18 nt, Human
cucccaggaacugggcca

SEQ ID NO: 2811226 - RNA, 18 nt, Human
cucccagcuuguaggagc

SEQ ID NO: 2811227 - RNA, 19 nt, Human
cucccagcuuguaggagcu

SEQ ID NO: 2811228 - RNA, 20 nt, Human
cucccagcuuguaggagcug

SEQ ID NO: 2811229 - RNA, 19 nt, Human
cucccaggagacaguucaa

SEQ ID NO: 2811230 - RNA, 15 nt, Human
cucccccggcucuac

SEQ ID NO: 2811231 - RNA, 15 nt, Human
cucccccgccacucc

SEQ ID NO: 2811232 - RNA, 21 nt, Human
cucccccuaaaccccuguccc

SEQ ID NO: 2811233 - RNA, 22 nt, Human
cucccccuaaaccccuguccca

SEQ ID NO: 2811234 - RNA, 12 nt, Human
cucccccgccac

SEQ ID NO: 2811235 - RNA, 14 nt, Human
cucccccgccacuc

SEQ ID NO: 2811236 - RNA, 17 nt, Human
cucccucucaggaucca

SEQ ID NO: 2811237 - RNA, 22 nt, Human
cucccucucccccuuaccccac

SEQ ID NO: 2811238 - RNA, 13 nt, Human
cucccucucccug

SEQ ID NO: 2811239 - RNA, 15 nt, Human
cucccucucccuguc

SEQ ID NO: 2811240 - RNA, 14 nt, Human
cucccucuauuuau

SEQ ID NO: 2811241 - RNA, 19 nt, Human
cucccucuaggcucugccu

SEQ ID NO: 2811242 - RNA, 20 nt, Human
cucccucuaggcucugccuu

SEQ ID NO: 2811243 - RNA, 21 nt, Human
cucccucuaggcucugccuuc

SEQ ID NO: 2811244 - RNA, 22 nt, Human
cucccucuaggcucugccuucg

SEQ ID NO: 2811245 - RNA, 23 nt, Human
cucccugaaaauguuuuucugcc

SEQ ID NO: 2811246 - RNA, 21 nt, Human
cucccugaaaauguuuuucug

SEQ ID NO: 2811247 - RNA, 13 nt, Human
cucccugaagcca

SEQ ID NO: 2811248 - RNA, 14 nt, Human
cucccugaagccag

SEQ ID NO: 2811249 - RNA, 20 nt, Human
cucccugaaguaagcaaaga

SEQ ID NO: 2811250 - RNA, 15 nt, Human
cucccugaagccagc

SEQ ID NO: 2811251 - RNA, 16 nt, Human
cucccugaagccagcc

SEQ ID NO: 2811252 - RNA, 17 nt, Human
cucccugaagccagccu

SEQ ID NO: 2811253 - RNA, 18 nt, Human
cucccugaagccagccuu

SEQ ID NO: 2811254 - RNA, 19 nt, Human
cucccugaagccagccuuc

SEQ ID NO: 2811255 - RNA, 16 nt, Human
cucccugacccgucua

SEQ ID NO: 2811256 - RNA, 20 nt, Human
cucauggccccucugaccug

SEQ ID NO: 2811257 - RNA, 16 nt, Human
cucaugggguccaagu

SEQ ID NO: 2811258 - RNA, 15 nt, Human
cucaugguggguuca

SEQ ID NO: 2811259 - RNA, 16 nt, Human
cucauguaucaucugg

SEQ ID NO: 2811260 - RNA, 16 nt, Human
cucauguacauacccu

SEQ ID NO: 2811261 - RNA, 19 nt, Human
cucauguaucaucuggaua

SEQ ID NO: 2811262 - RNA, 17 nt, Human
cucauguaucaucugga

SEQ ID NO: 2811263 - RNA, 22 nt, Human
cucccagagcugguggacccag

SEQ ID NO: 2811264 - RNA, 17 nt, Human
cucccagagcuggugga

SEQ ID NO: 2811265 - RNA, 13 nt, Human
cucccagaauccc

SEQ ID NO: 2811266 - RNA, 15 nt, Human
cucccagaaucccag

SEQ ID NO: 2811267 - RNA, 16 nt, Human
cucccagaaucccagc

SEQ ID NO: 2811268 - RNA, 17 nt, Human
cucccagaaucccagcc

SEQ ID NO: 2811269 - RNA, 19 nt, Human
cucccagaaucccagccgg

SEQ ID NO: 2811270 - RNA, 20 nt, Human
cucccagaaucccagccggc

SEQ ID NO: 2811271 - RNA, 21 nt, Human
cucccagaaucccagccggcc

SEQ ID NO: 2811272 - RNA, 23 nt, Human
cucccacugggguccagggagca

SEQ ID NO: 2811273 - RNA, 15 nt, Human
cucccacaggcccuu

SEQ ID NO: 2811274 - RNA, 14 nt, Human
cucccacaggcccu

SEQ ID NO: 2811275 - RNA, 16 nt, Human
cucccacaggcccuuc

SEQ ID NO: 2811276 - RNA, 20 nt, Human
cucccacaggcccuuccucu

SEQ ID NO: 2811277 - RNA, 21 nt, Human
cucccacaggcccuuccucuc

SEQ ID NO: 2811278 - RNA, 14 nt, Human
cucccacugaguuu

SEQ ID NO: 2811279 - RNA, 21 nt, Human
cucccacgugggagacaagaa

SEQ ID NO: 2811280 - RNA, 20 nt, Human
cuccaggcuguaucccauga

SEQ ID NO: 2811281 - RNA, 23 nt, Human
cuccaggcuccuuuagcgcccag

SEQ ID NO: 2811282 - RNA, 15 nt, Human
cuccaggcuccuuua

SEQ ID NO: 2811283 - RNA, 14 nt, Human
cuccagguggcucu

SEQ ID NO: 2811284 - RNA, 17 nt, Human
cuccagguggcucugag

SEQ ID NO: 2811285 - RNA, 14 nt, Human
cuccaguauucuug

SEQ ID NO: 2811286 - RNA, 16 nt, Human
cuccaguaccuugcuu

SEQ ID NO: 2811287 - RNA, 21 nt, Human
cuccaggcugggugacagagc

SEQ ID NO: 2811288 - RNA, 15 nt, Human
cuccucuguccaggc

SEQ ID NO: 2811289 - RNA, 12 nt, Human
cuccucugucca

SEQ ID NO: 2811290 - RNA, 16 nt, Human
cuccucuguccugcuu

SEQ ID NO: 2811291 - RNA, 17 nt, Human
cuccucuguccugcuuc

SEQ ID NO: 2811292 - RNA, 19 nt, Human
cuccucuucccccuuccaa

SEQ ID NO: 2811293 - RNA, 23 nt, Human
cuccucuucuuuuuuuucauuau

SEQ ID NO: 2811294 - RNA, 12 nt, Human
cuccucuugcca

SEQ ID NO: 2811295 - RNA, 15 nt, Human
cuccucuugccacug

SEQ ID NO: 2811296 - RNA, 16 nt, Human
cuccucuugccacugc

SEQ ID NO: 2811297 - RNA, 18 nt, Human
cuccugggcuaagugauc

SEQ ID NO: 2811298 - RNA, 19 nt, Human
cuccuggccucaagugauu

SEQ ID NO: 2811299 - RNA, 22 nt, Human
cuccuggcucuugauacccccc

SEQ ID NO: 2811300 - RNA, 14 nt, Human
cuccuggccucaga

SEQ ID NO: 2811301 - RNA, 15 nt, Human
cuccuggccucagac

SEQ ID NO: 2811302 - RNA, 18 nt, Human
cuccuggccucagacugc

SEQ ID NO: 2811303 - RNA, 23 nt, Human
cuccuggccucagacugcaccca

SEQ ID NO: 2811304 - RNA, 23 nt, Human
cuccuggccuuuccugguuuuca

SEQ ID NO: 2811305 - RNA, 21 nt, Human
cuccuguccucccauccccug

SEQ ID NO: 2811306 - RNA, 16 nt, Human
cuccuuguggccuggg

SEQ ID NO: 2811307 - RNA, 15 nt, Human
cuccuuguccaccca

SEQ ID NO: 2811308 - RNA, 20 nt, Human
cuccuuguggccugggccuc

SEQ ID NO: 2811309 - RNA, 16 nt, Human
cuccuuguccacccac

SEQ ID NO: 2811310 - RNA, 18 nt, Human
cuccuuguggccugggcc

SEQ ID NO: 2811311 - RNA, 15 nt, Human
cuccuuucaccacau

SEQ ID NO: 2811312 - RNA, 16 nt, Human
cuccuuucacaaccuu

SEQ ID NO: 2811313 - RNA, 17 nt, Human
cuccuuucacaaccuuc

SEQ ID NO: 2811314 - RNA, 22 nt, Human
cuccuuuacaaaagaaauaccu

SEQ ID NO: 2811315 - RNA, 17 nt, Human
cuccuuuaagagcucug

SEQ ID NO: 2811316 - RNA, 13 nt, Human
cuccuuucacaac

SEQ ID NO: 2811317 - RNA, 20 nt, Human
cuccuguaacauacuggccu

SEQ ID NO: 2811318 - RNA, 22 nt, Human
cuccuguaacauacuggccugg

SEQ ID NO: 2811319 - RNA, 23 nt, Human
cuccuguaacauacuggccugga

SEQ ID NO: 2811320 - RNA, 17 nt, Human
cuccuguaagccaaaga

SEQ ID NO: 2811321 - RNA, 20 nt, Human
cuccuguaagccaaagaaau

SEQ ID NO: 2811322 - RNA, 20 nt, Human
cuccuguccaucagccagga

SEQ ID NO: 2811323 - RNA, 12 nt, Human
cuccuguccucc

SEQ ID NO: 2811324 - RNA, 13 nt, Human
cuccuguccuccc

SEQ ID NO: 2811325 - RNA, 15 nt, Human
cuccuguccucccau

SEQ ID NO: 2811326 - RNA, 20 nt, Human
cuccuguccucccauccccu

SEQ ID NO: 2811327 - RNA, 16 nt, Human
cuccuggggcguccag

SEQ ID NO: 2811328 - RNA, 13 nt, Human
cuccuggugucac

SEQ ID NO: 2811329 - RNA, 15 nt, Human
cuccuggugucaccc

SEQ ID NO: 2811330 - RNA, 17 nt, Human
cuccuggugucacccca

SEQ ID NO: 2811331 - RNA, 18 nt, Human
cuccuggugucaccccag

SEQ ID NO: 2811332 - RNA, 19 nt, Human
cuccuggugucaccccaga

SEQ ID NO: 2811333 - RNA, 20 nt, Human
cuccuggugucaccccagag

SEQ ID NO: 2811334 - RNA, 21 nt, Human
cuccuggugucaccccagagc

SEQ ID NO: 2811335 - RNA, 22 nt, Human
cuccuggugucaccccagagcc

SEQ ID NO: 2811336 - RNA, 23 nt, Human
cuccuggugucaccccagagcca

SEQ ID NO: 2811337 - RNA, 13 nt, Human
cuccugggcucag

SEQ ID NO: 2811338 - RNA, 14 nt, Human
cuccuggggccagg

SEQ ID NO: 2811339 - RNA, 15 nt, Human
cuccuggggccaggc

SEQ ID NO: 2811340 - RNA, 16 nt, Human
cuccuggggccaggcc

SEQ ID NO: 2811341 - RNA, 17 nt, Human
cuccuggggccaggccg

SEQ ID NO: 2811342 - RNA, 22 nt, Human
cuccuggggccaggccgggccu

SEQ ID NO: 2811343 - RNA, 23 nt, Human
cuccuggggccaggccgggccug

SEQ ID NO: 2811344 - RNA, 15 nt, Human
cuccuacccugcgcc

SEQ ID NO: 2811345 - RNA, 18 nt, Human
cuccuacccugcgcccag

SEQ ID NO: 2811346 - RNA, 15 nt, Human
cuccuaccucagccu

SEQ ID NO: 2811347 - RNA, 14 nt, Human
cuccuaccucagcc

SEQ ID NO: 2811348 - RNA, 13 nt, Human
cuccuaccucagc

SEQ ID NO: 2811349 - RNA, 12 nt, Human
cuccuaccucag

SEQ ID NO: 2811350 - RNA, 18 nt, Human
cuccuaccucagccuaga

SEQ ID NO: 2811351 - RNA, 16 nt, Human
cuccuaccucagccua

SEQ ID NO: 2811352 - RNA, 13 nt, Human
cuccuaccuggua

SEQ ID NO: 2811353 - RNA, 13 nt, Human
cuccuacuccuga

SEQ ID NO: 2811354 - RNA, 14 nt, Human
cuccuacuccugac

SEQ ID NO: 2811355 - RNA, 17 nt, Human
cuccuaccugcccugga

SEQ ID NO: 2811356 - RNA, 18 nt, Human
cuccuaccugcccuggaa

SEQ ID NO: 2811357 - RNA, 20 nt, Human
cuccuaccugcccuggaaca

SEQ ID NO: 2811358 - RNA, 23 nt, Human
cuccgcuuucuacccagcgagcc

SEQ ID NO: 2811359 - RNA, 21 nt, Human
cuccggcccuccuacccugcg

SEQ ID NO: 2811360 - RNA, 16 nt, Human
cucucccugccagagg

SEQ ID NO: 2811361 - RNA, 21 nt, Human
cucuaugccagcucaguccca

SEQ ID NO: 2811362 - RNA, 16 nt, Human
cucuaugccccaaaua

SEQ ID NO: 2811363 - RNA, 19 nt, Human
cucuaugccccaaauauag

SEQ ID NO: 2811364 - RNA, 18 nt, Human
cucucccccuuaccccac

SEQ ID NO: 2811365 - RNA, 17 nt, Human
cucucccuccccugcca

SEQ ID NO: 2811366 - RNA, 15 nt, Human
cucucccucuaggcu

SEQ ID NO: 2811367 - RNA, 22 nt, Human
cucucccucuaggcucugccuu

SEQ ID NO: 2811368 - RNA, 23 nt, Human
cucucccucuaggcucugccuuc

SEQ ID NO: 2811369 - RNA, 13 nt, Human
cucucccuccccu

SEQ ID NO: 2811370 - RNA, 11 nt, Human
cucucuuccug

SEQ ID NO: 2811371 - RNA, 12 nt, Human
cucucuuccugc

SEQ ID NO: 2811372 - RNA, 13 nt, Human
cucucuuccugcc

SEQ ID NO: 2811373 - RNA, 14 nt, Human
cucucuuccugccc

SEQ ID NO: 2811374 - RNA, 15 nt, Human
cucucuuccugcccc

SEQ ID NO: 2811375 - RNA, 18 nt, Human
cucucuuccugccccucu

SEQ ID NO: 2811376 - RNA, 19 nt, Human
cucucuuccugccccucuu

SEQ ID NO: 2811377 - RNA, 20 nt, Human
cucucuuccugccccucuuu

SEQ ID NO: 2811378 - RNA, 21 nt, Human
cucucuuccugccccucuuuc

SEQ ID NO: 2811379 - RNA, 15 nt, Human
cucucuucugcucca

SEQ ID NO: 2811380 - RNA, 14 nt, Human
cucucuucugcucc

SEQ ID NO: 2811381 - RNA, 12 nt, Human
cucucuucugcu

SEQ ID NO: 2811382 - RNA, 16 nt, Human
cucucugugcugugga

SEQ ID NO: 2811383 - RNA, 15 nt, Human
cucucugguggcucu

SEQ ID NO: 2811384 - RNA, 16 nt, Human
cucucugugucugaga

SEQ ID NO: 2811385 - RNA, 20 nt, Human
cucucuuaaaguuggaauuu

SEQ ID NO: 2811386 - RNA, 15 nt, Human
cucucuucagacucu

SEQ ID NO: 2811387 - RNA, 22 nt, Human
cucucuucagacucucagccca

SEQ ID NO: 2811388 - RNA, 23 nt, Human
cucucuucagacucucagcccag

SEQ ID NO: 2811389 - RNA, 12 nt, Human
cucucuucccuc

SEQ ID NO: 2811390 - RNA, 13 nt, Human
cucucuucccuca

SEQ ID NO: 2811391 - RNA, 14 nt, Human
cucucuucccucag

SEQ ID NO: 2811392 - RNA, 15 nt, Human
cucucuucccucaga

SEQ ID NO: 2811393 - RNA, 15 nt, Human
cucucuucccuuucc

SEQ ID NO: 2811394 - RNA, 20 nt, Human
cucucuucccuuuccccagc

SEQ ID NO: 2811395 - RNA, 22 nt, Human
cucucuucccuuuccccagcau

SEQ ID NO: 2811396 - RNA, 23 nt, Human
cucucuucccuuuccccagcauc

SEQ ID NO: 2811397 - RNA, 13 nt, Human
cucucuguauaaa

SEQ ID NO: 2811398 - RNA, 15 nt, Human
cucucuguauaaaca

SEQ ID NO: 2811399 - RNA, 16 nt, Human
cucucuguauaaacau

SEQ ID NO: 2811400 - RNA, 18 nt, Human
cucucuguauaaacauua

SEQ ID NO: 2811401 - RNA, 20 nt, Human
cucucuguauaaacauuaaa

SEQ ID NO: 2811402 - RNA, 17 nt, Human
cucucuguauuuuuucu

SEQ ID NO: 2811403 - RNA, 18 nt, Human
cucucugucccuugcugu

SEQ ID NO: 2811404 - RNA, 19 nt, Human
cucucugucccuugcugua

SEQ ID NO: 2811405 - RNA, 23 nt, Human
cucucugucccuugcuguaugcu

SEQ ID NO: 2811406 - RNA, 16 nt, Human
cucucugggccucaga

SEQ ID NO: 2811407 - RNA, 20 nt, Human
cucucugggccucagaggcc

SEQ ID NO: 2811408 - RNA, 15 nt, Human
cucgugagucauuua

SEQ ID NO: 2811409 - RNA, 20 nt, Human
cucgugagucauuuaaaugu

SEQ ID NO: 2811410 - RNA, 17 nt, Human
cucuaugccagcucagu

SEQ ID NO: 2811411 - RNA, 17 nt, Human
cucuaugagucuagaug

SEQ ID NO: 2811412 - RNA, 19 nt, Human
cucuaugagucuagauguu

SEQ ID NO: 2811413 - RNA, 13 nt, Human
cucuaugagucua

SEQ ID NO: 2811414 - RNA, 14 nt, Human
cucuaugagucuag

SEQ ID NO: 2811415 - RNA, 15 nt, Human
cucuaugagucuaga

SEQ ID NO: 2811416 - RNA, 16 nt, Human
cucuaugagucuagau

SEQ ID NO: 2811417 - RNA, 20 nt, Human
cuccuuucacaaccuucugu

SEQ ID NO: 2811418 - RNA, 22 nt, Human
cucugucccacuuggcaucagc

SEQ ID NO: 2811419 - RNA, 17 nt, Human
cucuguccauuuaucca

SEQ ID NO: 2811420 - RNA, 21 nt, Human
cucuguccauuuauccacagg

SEQ ID NO: 2811421 - RNA, 17 nt, Human
cucuuaggcacuuuggg

SEQ ID NO: 2811422 - RNA, 22 nt, Human
cucuuaggcauguaggacccug

SEQ ID NO: 2811423 - RNA, 13 nt, Human
cucuuagcugucu

SEQ ID NO: 2811424 - RNA, 15 nt, Human
cucugucccuugcug

SEQ ID NO: 2811425 - RNA, 16 nt, Human
cucugucccuugcugu

SEQ ID NO: 2811426 - RNA, 14 nt, Human
cucuguccugcuuc

SEQ ID NO: 2811427 - RNA, 15 nt, Human
cucuguccugcuucu

SEQ ID NO: 2811428 - RNA, 16 nt, Human
cucuguccugcuucug

SEQ ID NO: 2811429 - RNA, 17 nt, Human
cucuguccugcuucuga

SEQ ID NO: 2811430 - RNA, 16 nt, Human
cucugcugcugucccu

SEQ ID NO: 2811431 - RNA, 21 nt, Human
cucugcugccgccccacccag

SEQ ID NO: 2811432 - RNA, 22 nt, Human
cucugcugccugcccgcacagc

SEQ ID NO: 2811433 - RNA, 23 nt, Human
cucugcugccugcccgcacagca

SEQ ID NO: 2811434 - RNA, 21 nt, Human
cucugcugcugucccuccccc

SEQ ID NO: 2811435 - RNA, 22 nt, Human
cucugcugcugucccucccccu

SEQ ID NO: 2811436 - RNA, 18 nt, Human
cucugcuggcccagccaa

SEQ ID NO: 2811437 - RNA, 14 nt, Human
cucugcuggcccag

SEQ ID NO: 2811438 - RNA, 13 nt, Human
cucugcugcuuag

SEQ ID NO: 2811439 - RNA, 13 nt, Human
cucugcugccgcc

SEQ ID NO: 2811440 - RNA, 11 nt, Human
cucugcugcuu

SEQ ID NO: 2811441 - RNA, 23 nt, Human
cucugcugacagacacaggcccg

SEQ ID NO: 2811442 - RNA, 15 nt, Human
cucugcugccauggc

SEQ ID NO: 2811443 - RNA, 13 nt, Human
cucugcugccaug

SEQ ID NO: 2811444 - RNA, 20 nt, Human
cucugcugacagacacaggc

SEQ ID NO: 2811445 - RNA, 17 nt, Human
cucugcucgccuuagca

SEQ ID NO: 2811446 - RNA, 16 nt, Human
cucugcucgccuuagc

SEQ ID NO: 2811447 - RNA, 22 nt, Human
cucugcugacagacacaggccc

SEQ ID NO: 2811448 - RNA, 21 nt, Human
cucugcugacagacacaggcc

SEQ ID NO: 2811449 - RNA, 11 nt, Human
cucugcagcug

SEQ ID NO: 2811450 - RNA, 21 nt, Human
cucugcuccucuccccagcaa

SEQ ID NO: 2811451 - RNA, 15 nt, Human
cucugcucgccuuag

SEQ ID NO: 2811452 - RNA, 13 nt, Human
cucugcucgccuu

SEQ ID NO: 2811453 - RNA, 17 nt, Human
cucugcucgcccuccuu

SEQ ID NO: 2811454 - RNA, 20 nt, Human
cucugcucgcccuccuuucu

SEQ ID NO: 2811455 - RNA, 21 nt, Human
cucugcucgcccuccuuucug

SEQ ID NO: 2811456 - RNA, 12 nt, Human
cucugcagcugc

SEQ ID NO: 2811457 - RNA, 13 nt, Human
cucugcagcugcc

SEQ ID NO: 2811458 - RNA, 14 nt, Human
cucugcagcugccg

SEQ ID NO: 2811459 - RNA, 19 nt, Human
cucugcaggcuuaauaaaa

SEQ ID NO: 2811460 - RNA, 23 nt, Human
cucugcaggcuuaauaaaaauga

SEQ ID NO: 2811461 - RNA, 13 nt, Human
cucugcacauguc

SEQ ID NO: 2811462 - RNA, 14 nt, Human
cucugcacaugucu

SEQ ID NO: 2811463 - RNA, 12 nt, Human
ccuaagacaugu

SEQ ID NO: 2811464 - RNA, 15 nt, Human
ccuaagaccuggggu

SEQ ID NO: 2811465 - RNA, 23 nt, Human
ccuaagaccugggguugucagcu

SEQ ID NO: 2811466 - RNA, 15 nt, Human
ccuaagacugugaca

SEQ ID NO: 2811467 - RNA, 22 nt, Human
ccuaagagacugcguucugcaa

SEQ ID NO: 2811468 - RNA, 16 nt, Human
ccuaacugaagagaca

SEQ ID NO: 2811469 - RNA, 11 nt, Human
ccuaacuguau

SEQ ID NO: 2811470 - RNA, 14 nt, Human
ccuaacuguaucuu

SEQ ID NO: 2811471 - RNA, 16 nt, Human
ccuaacuguaucuuga

SEQ ID NO: 2811472 - RNA, 14 nt, Human
ccuaacuuuucaau

SEQ ID NO: 2811473 - RNA, 15 nt, Human
ccuaagaaauaugug

SEQ ID NO: 2811474 - RNA, 19 nt, Human
ccuaagaaauaugugagau

SEQ ID NO: 2811475 - RNA, 20 nt, Human
ccuaagaaauaugugagauu

SEQ ID NO: 2811476 - RNA, 15 nt, Human
ccggcuccaggcucc

SEQ ID NO: 2811477 - RNA, 21 nt, Human
ccgucgaggggcucucagcuc

SEQ ID NO: 2811478 - RNA, 22 nt, Human
ccgucgaggggcucucagcuca

SEQ ID NO: 2811479 - RNA, 14 nt, Human
ccggcuccaggcuc

SEQ ID NO: 2811480 - RNA, 13 nt, Human
ccggcuccaggcu

SEQ ID NO: 2811481 - RNA, 12 nt, Human
ccggcuccaggc

SEQ ID NO: 2811482 - RNA, 17 nt, Human
ccggccgcuccaccagc

SEQ ID NO: 2811483 - RNA, 12 nt, Human
ccuaagagauuc

SEQ ID NO: 2811484 - RNA, 14 nt, Human
ccuaagaaucagag

SEQ ID NO: 2811485 - RNA, 14 nt, Human
ccuaaucucauacc

SEQ ID NO: 2811486 - RNA, 18 nt, Human
ccuaaucucauaccucug

SEQ ID NO: 2811487 - RNA, 19 nt, Human
ccuaaucucauaccucuga

SEQ ID NO: 2811488 - RNA, 21 nt, Human
ccuaaucucauaccucugacc

SEQ ID NO: 2811489 - RNA, 12 nt, Human
ccuaaugaaagu

SEQ ID NO: 2811490 - RNA, 21 nt, Human
ccuaaugaaagugaugacaua

SEQ ID NO: 2811491 - RNA, 22 nt, Human
ccuaaugaaagugaugacauau

SEQ ID NO: 2811492 - RNA, 13 nt, Human
ccuagcccucuca

SEQ ID NO: 2811493 - RNA, 20 nt, Human
ccuagcccucucacauuuau

SEQ ID NO: 2811494 - RNA, 16 nt, Human
ccuagcccucucccuc

SEQ ID NO: 2811495 - RNA, 12 nt, Human
ccuagcagugaa

SEQ ID NO: 2811496 - RNA, 13 nt, Human
ccuagcagugaac

SEQ ID NO: 2811497 - RNA, 16 nt, Human
ccuagcagugaacuau

SEQ ID NO: 2811498 - RNA, 15 nt, Human
ccggccccugcuggu

SEQ ID NO: 2811499 - RNA, 14 nt, Human
ccggccgauggaga

SEQ ID NO: 2811500 - RNA, 15 nt, Human
ccggccgcuccacca

SEQ ID NO: 2811501 - RNA, 22 nt, Human
ccggcccugggcucggaggcug

SEQ ID NO: 2811502 - RNA, 24 nt, Human
ccggcccugggcucggaggcugcc

SEQ ID NO: 2811503 - RNA, 14 nt, Human
ccggcccuagccca

SEQ ID NO: 2811504 - RNA, 21 nt, Human
ccggcccuccuacccugcgcc

SEQ ID NO: 2811505 - RNA, 19 nt, Human
ccggcccugggcucggagg

SEQ ID NO: 2811506 - RNA, 18 nt, Human
ccggcauguuuccagcag

SEQ ID NO: 2811507 - RNA, 15 nt, Human
ccggccaauggaaac

SEQ ID NO: 2811508 - RNA, 16 nt, Human
ccggccaauggaaacc

SEQ ID NO: 2811509 - RNA, 17 nt, Human
ccggccaauggaaaccu

SEQ ID NO: 2811510 - RNA, 18 nt, Human
ccggccaauggaaaccuc

SEQ ID NO: 2811511 - RNA, 12 nt, Human
ccggccaccucu

SEQ ID NO: 2811512 - RNA, 13 nt, Human
ccggccaccucug

SEQ ID NO: 2811513 - RNA, 14 nt, Human
ccggccaccucugc

SEQ ID NO: 2811514 - RNA, 15 nt, Human
ccggccaccucugcg

SEQ ID NO: 2811515 - RNA, 21 nt, Human
cccuuccucuccacugccuuc

SEQ ID NO: 2811516 - RNA, 14 nt, Human
cccugucuaaaaaa

SEQ ID NO: 2811517 - RNA, 18 nt, Human
cccuguccucacugcucc

SEQ ID NO: 2811518 - RNA, 14 nt, Human
cccuguccucacug

SEQ ID NO: 2811519 - RNA, 15 nt, Human
cccuguccucacugc

SEQ ID NO: 2811520 - RNA, 16 nt, Human
cccuguccucacugcu

SEQ ID NO: 2811521 - RNA, 17 nt, Human
cccuguccucacugcuc

SEQ ID NO: 2811522 - RNA, 13 nt, Human
cccuguccucacu

SEQ ID NO: 2811523 - RNA, 22 nt, Human
cccuguccggaaugccacccac

SEQ ID NO: 2811524 - RNA, 21 nt, Human
cccuguccggaaugccaccca

SEQ ID NO: 2811525 - RNA, 23 nt, Human
cccugucccucccaccucuguga

SEQ ID NO: 2811526 - RNA, 24 nt, Human
cccugucccucccaccucugugac

SEQ ID NO: 2811527 - RNA, 21 nt, Human
cccugucgaguucggcucugg

SEQ ID NO: 2811528 - RNA, 23 nt, Human
cccugucgaguucggcucugggu

SEQ ID NO: 2811529 - RNA, 17 nt, Human
cccugucgggcuuugug

SEQ ID NO: 2811530 - RNA, 21 nt, Human
cccugucgggcuuugugugaa

SEQ ID NO: 2811531 - RNA, 13 nt, Human
cccuguccugcca

SEQ ID NO: 2811532 - RNA, 15 nt, Human
cccuguccugccaug

SEQ ID NO: 2811533 - RNA, 20 nt, Human
ccgcagaccuccccagcccc

SEQ ID NO: 2811534 - RNA, 21 nt, Human
ccgcagaccuccccagccccu

SEQ ID NO: 2811535 - RNA, 14 nt, Human
ccgcagaccucugg

SEQ ID NO: 2811536 - RNA, 17 nt, Human
ccgaccacuuccagggg

SEQ ID NO: 2811537 - RNA, 13 nt, Human
ccgcagaccuccc

SEQ ID NO: 2811538 - RNA, 15 nt, Human
ccgcagaccucccca

SEQ ID NO: 2811539 - RNA, 16 nt, Human
ccgcagaccuccccag

SEQ ID NO: 2811540 - RNA, 17 nt, Human
ccgcagaccuccccagc

SEQ ID NO: 2811541 - RNA, 18 nt, Human
ccgcagaccuccccagcc

SEQ ID NO: 2811542 - RNA, 19 nt, Human
ccgcagaccuccccagccc

SEQ ID NO: 2811543 - RNA, 23 nt, Human
ccgcccacaggaagccugcaguc

SEQ ID NO: 2811544 - RNA, 22 nt, Human
ccgcccagcugcaccugccagc

SEQ ID NO: 2811545 - RNA, 17 nt, Human
ccgcccagcugcaccug

SEQ ID NO: 2811546 - RNA, 17 nt, Human
ccgaccagacaccuuga

SEQ ID NO: 2811547 - RNA, 13 nt, Human
ccgaccagacacc

SEQ ID NO: 2811548 - RNA, 15 nt, Human
ccgaccaccugccca

SEQ ID NO: 2811549 - RNA, 18 nt, Human
ccgaccagacaccuugac

SEQ ID NO: 2811550 - RNA, 17 nt, Human
ccgaauagcugggacua

SEQ ID NO: 2811551 - RNA, 16 nt, Human
ccgaauagcugggacu

SEQ ID NO: 2811552 - RNA, 21 nt, Human
ccgaaguggacuggccccugg

SEQ ID NO: 2811553 - RNA, 13 nt, Human
ccgaagucuuuug

SEQ ID NO: 2811554 - RNA, 15 nt, Human
ccgaaggugcuggag

SEQ ID NO: 2811555 - RNA, 23 nt, Human
ccgaaggugcuggaggugggagc

SEQ ID NO: 2811556 - RNA, 21 nt, Human
ccgaagguuauggucaauccc

SEQ ID NO: 2811557 - RNA, 19 nt, Human
ccgaaagggacuuggaagc

SEQ ID NO: 2811558 - RNA, 11 nt, Human
cccuuccuuua

SEQ ID NO: 2811559 - RNA, 12 nt, Human
cccuuccucuuc

SEQ ID NO: 2811560 - RNA, 16 nt, Human
cccuuccucuucggcc

SEQ ID NO: 2811561 - RNA, 22 nt, Human
cccuuccucuucggcccucaga

SEQ ID NO: 2811562 - RNA, 14 nt, Human
cccugagauccccu

SEQ ID NO: 2811563 - RNA, 16 nt, Human
cccugagauccccuga

SEQ ID NO: 2811564 - RNA, 17 nt, Human
cccugagauccccugag

SEQ ID NO: 2811565 - RNA, 19 nt, Human
cccugagauccccugagcc

SEQ ID NO: 2811566 - RNA, 20 nt, Human
cccugagauccccugagccc

SEQ ID NO: 2811567 - RNA, 16 nt, Human
cccugagcaggaaagu

SEQ ID NO: 2811568 - RNA, 12 nt, Human
cccugagcgccu

SEQ ID NO: 2811569 - RNA, 22 nt, Human
cccugagcgccuggauuucugg

SEQ ID NO: 2811570 - RNA, 15 nt, Human
cccugaccucacugu

SEQ ID NO: 2811571 - RNA, 17 nt, Human
cccugacucucugugac

SEQ ID NO: 2811572 - RNA, 13 nt, Human
cccugacucucug

SEQ ID NO: 2811573 - RNA, 18 nt, Human
cccugacucucugugacc

SEQ ID NO: 2811574 - RNA, 9 nt, Human
cccugacug

SEQ ID NO: 2811575 - RNA, 16 nt, Human
cccugagaagcugcuc

SEQ ID NO: 2811576 - RNA, 20 nt, Human
cccugagaagcugcuccagg

SEQ ID NO: 2811577 - RNA, 17 nt, Human
cccugcccggcugcgga

SEQ ID NO: 2811578 - RNA, 14 nt, Human
cccugcccggcugc

SEQ ID NO: 2811579 - RNA, 20 nt, Human
cccugcccguucuugaaaug

SEQ ID NO: 2811580 - RNA, 16 nt, Human
cccugcccguguacau

SEQ ID NO: 2811581 - RNA, 17 nt, Human
cccugcccguguacaua

SEQ ID NO: 2811582 - RNA, 14 nt, Human
cccugcccuccccu

SEQ ID NO: 2811583 - RNA, 18 nt, Human
cccugccccucccuucaa

SEQ ID NO: 2811584 - RNA, 19 nt, Human
cccugccccucccuucaac

SEQ ID NO: 2811585 - RNA, 23 nt, Human
cccugccccucccuucaaccauu

SEQ ID NO: 2811586 - RNA, 17 nt, Human
cccugccccucccuuca

SEQ ID NO: 2811587 - RNA, 16 nt, Human
cccugccccccagccu

SEQ ID NO: 2811588 - RNA, 19 nt, Human
cccugccccccagccucug

SEQ ID NO: 2811589 - RNA, 21 nt, Human
cccugccccccagccucuggc

SEQ ID NO: 2811590 - RNA, 18 nt, Human
cccugagccccagggugc

SEQ ID NO: 2811591 - RNA, 22 nt, Human
cccugaggaaggaggggaagcu

SEQ ID NO: 2811592 - RNA, 15 nt, Human
cccugcccaggccgg

SEQ ID NO: 2811593 - RNA, 18 nt, Human
cccugcccaggccggcca

SEQ ID NO: 2811594 - RNA, 22 nt, Human
cccugcccaggccggccagccu

SEQ ID NO: 2811595 - RNA, 10 nt, Human
cccugcccau

SEQ ID NO: 2811596 - RNA, 12 nt, Human
cccugccccaaa

SEQ ID NO: 2811597 - RNA, 13 nt, Human
cccugccccaaau

SEQ ID NO: 2811598 - RNA, 15 nt, Human
cccugccccccagcc

SEQ ID NO: 2811599 - RNA, 20 nt, Human
cccugccccccagcccuccu

SEQ ID NO: 2811600 - RNA, 14 nt, Human
cccugccccccagc

SEQ ID NO: 2811601 - RNA, 12 nt, Human
cccugcccccca

SEQ ID NO: 2811602 - RNA, 23 nt, Human
cccuggaguguggcugaggaggc

SEQ ID NO: 2811603 - RNA, 15 nt, Human
cccuggccgcccccu

SEQ ID NO: 2811604 - RNA, 19 nt, Human
cccuggauccaucaggcca

SEQ ID NO: 2811605 - RNA, 22 nt, Human
cccuggaucacgacgcugcaga

SEQ ID NO: 2811606 - RNA, 23 nt, Human
cccuggaucacgacgcugcagag

SEQ ID NO: 2811607 - RNA, 24 nt, Human
cccuggaucacgacgcugcagagc

SEQ ID NO: 2811608 - RNA, 20 nt, Human
cccuggaguguggcugagga

SEQ ID NO: 2811609 - RNA, 21 nt, Human
cccuggaguguggcugaggag

SEQ ID NO: 2811610 - RNA, 15 nt, Human
cccugcccuggucca

SEQ ID NO: 2811611 - RNA, 14 nt, Human
cccugcccuggucc

SEQ ID NO: 2811612 - RNA, 22 nt, Human
cccugcccugguuuccugcccu

SEQ ID NO: 2811613 - RNA, 18 nt, Human
cccugcccugguccaggg

SEQ ID NO: 2811614 - RNA, 23 nt, Human
cccugcccugguuuccugcccug

SEQ ID NO: 2811615 - RNA, 11 nt, Human
cccugcccugc

SEQ ID NO: 2811616 - RNA, 11 nt, Human
cccugcccucu

SEQ ID NO: 2811617 - RNA, 17 nt, Human
cccugcccucuccuucc

SEQ ID NO: 2811618 - RNA, 17 nt, Human
cccugcccugaggaagg

SEQ ID NO: 2811619 - RNA, 15 nt, Human
cccugcccuccccuc

SEQ ID NO: 2811620 - RNA, 13 nt, Human
cccugcccugcug

SEQ ID NO: 2811621 - RNA, 12 nt, Human
cccugcccuggu

SEQ ID NO: 2811622 - RNA, 11 nt, Human
cccugcccugg

SEQ ID NO: 2811623 - RNA, 13 nt, Human
cccuggccucugu

SEQ ID NO: 2811624 - RNA, 15 nt, Human
cccuggccucugugc

SEQ ID NO: 2811625 - RNA, 18 nt, Human
cccuggccucugugccuu

SEQ ID NO: 2811626 - RNA, 19 nt, Human
cccuggccucugugccuuc

SEQ ID NO: 2811627 - RNA, 19 nt, Human
cccuggcucccacaggccc

SEQ ID NO: 2811628 - RNA, 23 nt, Human
cccuggcucccaugaccauacug

SEQ ID NO: 2811629 - RNA, 15 nt, Human
cccuggcucccauga

SEQ ID NO: 2811630 - RNA, 14 nt, Human
cccuggcucccaug

SEQ ID NO: 2811631 - RNA, 13 nt, Human
cccuggcucccau

SEQ ID NO: 2811632 - RNA, 20 nt, Human
cccuggcucccacaggcccu

SEQ ID NO: 2811633 - RNA, 13 nt, Human
cccuggcucugca

SEQ ID NO: 2811634 - RNA, 13 nt, Human
cccuggcucugcu

SEQ ID NO: 2811635 - RNA, 17 nt, Human
cccuggcugagggcagc

SEQ ID NO: 2811636 - RNA, 21 nt, Human
cccucgcuuggacggcugggc

SEQ ID NO: 2811637 - RNA, 23 nt, Human
cccucgcuuggacggcugggcac

SEQ ID NO: 2811638 - RNA, 22 nt, Human
cccucgaagcgcgccacucgcu

SEQ ID NO: 2811639 - RNA, 16 nt, Human
cccucgauauuuuuaa

SEQ ID NO: 2811640 - RNA, 12 nt, Human
cccucgccugug

SEQ ID NO: 2811641 - RNA, 23 nt, Human
cccucgccuguggagcucagccc

SEQ ID NO: 2811642 - RNA, 14 nt, Human
cccucgcugcuucu

SEQ ID NO: 2811643 - RNA, 15 nt, Human
cccucgcugcuucug

SEQ ID NO: 2811644 - RNA, 17 nt, Human
cccucgcugcuucugug

SEQ ID NO: 2811645 - RNA, 17 nt, Human
cccuccuacccugcgcc

SEQ ID NO: 2811646 - RNA, 18 nt, Human
cccuccuacccugcgccc

SEQ ID NO: 2811647 - RNA, 11 nt, Human
cccuccuccug

SEQ ID NO: 2811648 - RNA, 18 nt, Human
cccuccuccuggacuccu

SEQ ID NO: 2811649 - RNA, 16 nt, Human
cccuccuccuggacuc

SEQ ID NO: 2811650 - RNA, 21 nt, Human
cccuccgccuucacuccggug

SEQ ID NO: 2811651 - RNA, 13 nt, Human
cccuccgccuuca

SEQ ID NO: 2811652 - RNA, 14 nt, Human
cccuccgccuucac

SEQ ID NO: 2811653 - RNA, 22 nt, Human
cccuccgccuucacuccggugu

SEQ ID NO: 2811654 - RNA, 21 nt, Human
cccucgaagcgcgccacucgc

SEQ ID NO: 2811655 - RNA, 19 nt, Human
cccucgaagcgcgccacuc

SEQ ID NO: 2811656 - RNA, 15 nt, Human
cccucgaagcgcgcc

SEQ ID NO: 2811657 - RNA, 18 nt, Human
cccuccucuagcuguggg

SEQ ID NO: 2811658 - RNA, 19 nt, Human
cccuccucuagcugugggg

SEQ ID NO: 2811659 - RNA, 14 nt, Human
cccuccucucugcc

SEQ ID NO: 2811660 - RNA, 21 nt, Human
cccugaaucccccuugccacc

SEQ ID NO: 2811661 - RNA, 23 nt, Human
cccugaaucccccuugccacccc

SEQ ID NO: 2811662 - RNA, 20 nt, Human
cccugacagucccuccucuc

SEQ ID NO: 2811663 - RNA, 23 nt, Human
cccugaaggaacauuccuuaguc

SEQ ID NO: 2811664 - RNA, 20 nt, Human
cccugaagugagcacagccu

SEQ ID NO: 2811665 - RNA, 15 nt, Human
cccugaaucccccuu

SEQ ID NO: 2811666 - RNA, 20 nt, Human
cccugaaucccccuugccac

SEQ ID NO: 2811667 - RNA, 18 nt, Human
cccugaagccagccuucu

SEQ ID NO: 2811668 - RNA, 16 nt, Human
cccugaagccagccuu

SEQ ID NO: 2811669 - RNA, 17 nt, Human
cccugaagccagccuuc

SEQ ID NO: 2811670 - RNA, 11 nt, Human
cccugaagcca

SEQ ID NO: 2811671 - RNA, 14 nt, Human
cccugaagccagcc

SEQ ID NO: 2811672 - RNA, 15 nt, Human
cccugaagccagccu

SEQ ID NO: 2811673 - RNA, 14 nt, Human
cccugaacaagaau

SEQ ID NO: 2811674 - RNA, 12 nt, Human
ccccggcccccu

SEQ ID NO: 2811675 - RNA, 13 nt, Human
ccccggcccccug

SEQ ID NO: 2811676 - RNA, 17 nt, Human
ccucuccuuccuuaccc

SEQ ID NO: 2811677 - RNA, 14 nt, Human
ccucuccuuccuug

SEQ ID NO: 2811678 - RNA, 15 nt, Human
ccucuccuuccuugu

SEQ ID NO: 2811679 - RNA, 16 nt, Human
ccucuccuuccuuguu

SEQ ID NO: 2811680 - RNA, 21 nt, Human
ccucuccuucguaucccgagu

SEQ ID NO: 2811681 - RNA, 16 nt, Human
ccucucgagggcaggg

SEQ ID NO: 2811682 - RNA, 17 nt, Human
ccucucggaaggcuggc

SEQ ID NO: 2811683 - RNA, 13 nt, Human
ccucuccuuccua

SEQ ID NO: 2811684 - RNA, 21 nt, Human
ccucuccuuguggccugggcc

SEQ ID NO: 2811685 - RNA, 14 nt, Human
ccucuccuuugaaa

SEQ ID NO: 2811686 - RNA, 16 nt, Human
ccucgaggugccuucu

SEQ ID NO: 2811687 - RNA, 18 nt, Human
ccucgaggugccuucuuc

SEQ ID NO: 2811688 - RNA, 23 nt, Human
ccucgaggugccuucuucagggc

SEQ ID NO: 2811689 - RNA, 14 nt, Human
ccucgccucuccca

SEQ ID NO: 2811690 - RNA, 12 nt, Human
ccucgccugugg

SEQ ID NO: 2811691 - RNA, 13 nt, Human
ccucgccugugga

SEQ ID NO: 2811692 - RNA, 15 nt, Human
ccucgccuguggagc

SEQ ID NO: 2811693 - RNA, 21 nt, Human
ccucgccuguggagcucagcc

SEQ ID NO: 2811694 - RNA, 22 nt, Human
ccucgccuguggagcucagccc

SEQ ID NO: 2811695 - RNA, 12 nt, Human
ccucgcucuguu

SEQ ID NO: 2811696 - RNA, 15 nt, Human
ccucgcucuguuacc

SEQ ID NO: 2811697 - RNA, 19 nt, Human
ccucgcucuguuacccagg

SEQ ID NO: 2811698 - RNA, 21 nt, Human
ccucgcucuguuacccagggu

SEQ ID NO: 2811699 - RNA, 20 nt, Human
ccucggcuuuucucagcugg

SEQ ID NO: 2811700 - RNA, 19 nt, Human
ccucggcuuuucucagcug

SEQ ID NO: 2811701 - RNA, 17 nt, Human
ccucucgguugaaaccu

SEQ ID NO: 2811702 - RNA, 23 nt, Human
ccucucgguugaaaccuguauaa

SEQ ID NO: 2811703 - RNA, 21 nt, Human
ccucucggaaggcuggcuggg

SEQ ID NO: 2811704 - RNA, 20 nt, Human
ccucugccugaagucacaca

SEQ ID NO: 2811705 - RNA, 11 nt, Human
ccucugccuga

SEQ ID NO: 2811706 - RNA, 23 nt, Human
ccucugccucugacacacagcuc

SEQ ID NO: 2811707 - RNA, 21 nt, Human
ccucugccucugacacacagc

SEQ ID NO: 2811708 - RNA, 20 nt, Human
ccucugccucugacacacag

SEQ ID NO: 2811709 - RNA, 23 nt, Human
ccucugcccucauuacugggccu

SEQ ID NO: 2811710 - RNA, 14 nt, Human
ccucugcccugcgg

SEQ ID NO: 2811711 - RNA, 13 nt, Human
ccucugcccugcg

SEQ ID NO: 2811712 - RNA, 12 nt, Human
ccucugcccugc

SEQ ID NO: 2811713 - RNA, 11 nt, Human
ccucugcccug

SEQ ID NO: 2811714 - RNA, 12 nt, Human
ccuccuuucucc

SEQ ID NO: 2811715 - RNA, 14 nt, Human
ccuccuuucuccuc

SEQ ID NO: 2811716 - RNA, 13 nt, Human
ccuccuuucugug

SEQ ID NO: 2811717 - RNA, 14 nt, Human
ccuccuuucugugc

SEQ ID NO: 2811718 - RNA, 16 nt, Human
ccuccuuucugugccc

SEQ ID NO: 2811719 - RNA, 18 nt, Human
ccuccuuucugugcccua

SEQ ID NO: 2811720 - RNA, 22 nt, Human
ccuccuuucugugcccuacuca

SEQ ID NO: 2811721 - RNA, 15 nt, Human
ccucgaacuggcugc

SEQ ID NO: 2811722 - RNA, 16 nt, Human
ccucgaacuggcugca

SEQ ID NO: 2811723 - RNA, 19 nt, Human
ccucgaagcgcgccacucg

SEQ ID NO: 2811724 - RNA, 18 nt, Human
ccucgaagcgcgccacuc

SEQ ID NO: 2811725 - RNA, 15 nt, Human
ccucgcccuuucuua

SEQ ID NO: 2811726 - RNA, 15 nt, Human
ccucgacaucacugu

SEQ ID NO: 2811727 - RNA, 16 nt, Human
ccuccgccucccgggu

SEQ ID NO: 2811728 - RNA, 13 nt, Human
ccuccgccucccg

SEQ ID NO: 2811729 - RNA, 18 nt, Human
ccuccguccaggagccug

SEQ ID NO: 2811730 - RNA, 19 nt, Human
ccuccgguugcauacugga

SEQ ID NO: 2811731 - RNA, 16 nt, Human
ccuccuacccugcgcc

SEQ ID NO: 2811732 - RNA, 12 nt, Human
ccucccugucaa

SEQ ID NO: 2811733 - RNA, 23 nt, Human
ccucccugucaaagcugucacuu

SEQ ID NO: 2811734 - RNA, 15 nt, Human
ccucccuuccgaccc

SEQ ID NO: 2811735 - RNA, 18 nt, Human
ccuccgccaaugcacggc

SEQ ID NO: 2811736 - RNA, 20 nt, Human
ccuccgccaaugcacggccu

SEQ ID NO: 2811737 - RNA, 21 nt, Human
ccuccgccaaugcacggccuc

SEQ ID NO: 2811738 - RNA, 19 nt, Human
ccucccuguucaaggcccc

SEQ ID NO: 2811739 - RNA, 20 nt, Human
ccucccuggcucccaugacc

SEQ ID NO: 2811740 - RNA, 18 nt, Human
ccucccuggcucccauga

SEQ ID NO: 2811741 - RNA, 16 nt, Human
ccucccuggcucccau

SEQ ID NO: 2811742 - RNA, 15 nt, Human
ccucccuggcuccca

SEQ ID NO: 2811743 - RNA, 14 nt, Human
ccucccuggcuccc

SEQ ID NO: 2811744 - RNA, 13 nt, Human
ccucccuggcucc

SEQ ID NO: 2811745 - RNA, 12 nt, Human
ccucccuggcuc

SEQ ID NO: 2811746 - RNA, 23 nt, Human
ccucccuggaguguggcugagga

SEQ ID NO: 2811747 - RNA, 20 nt, Human
ccucccuggagccuccacug

SEQ ID NO: 2811748 - RNA, 12 nt, Human
ccucccuggagu

SEQ ID NO: 2811749 - RNA, 13 nt, Human
ccucccuggagug

SEQ ID NO: 2811750 - RNA, 13 nt, Human
ccucccaccucca

SEQ ID NO: 2811751 - RNA, 14 nt, Human
ccucccaccuccag

SEQ ID NO: 2811752 - RNA, 15 nt, Human
ccucccaccuccagu

SEQ ID NO: 2811753 - RNA, 19 nt, Human
ccucccaccucugugaccu

SEQ ID NO: 2811754 - RNA, 12 nt, Human
ccucccaccucu

SEQ ID NO: 2811755 - RNA, 13 nt, Human
ccucccaccucug

SEQ ID NO: 2811756 - RNA, 14 nt, Human
ccucccaccucugu

SEQ ID NO: 2811757 - RNA, 15 nt, Human
ccucccaccucugug

SEQ ID NO: 2811758 - RNA, 15 nt, Human
ccucccacugggguc

SEQ ID NO: 2811759 - RNA, 13 nt, Human
ccucccacugggg

SEQ ID NO: 2811760 - RNA, 23 nt, Human
ccucccagagcugguggacccag

SEQ ID NO: 2811761 - RNA, 11 nt, Human
ccucccagagg

SEQ ID NO: 2811762 - RNA, 18 nt, Human
ccuccccacccuccuggc

SEQ ID NO: 2811763 - RNA, 13 nt, Human
ccuccccacgccc

SEQ ID NO: 2811764 - RNA, 15 nt, Human
ccuccccacgcccuc

SEQ ID NO: 2811765 - RNA, 17 nt, Human
ccuccccacgcccuccc

SEQ ID NO: 2811766 - RNA, 12 nt, Human
ccuccccagccc

SEQ ID NO: 2811767 - RNA, 14 nt, Human
ccuccccagccccu

SEQ ID NO: 2811768 - RNA, 15 nt, Human
ccuccccagccccua

SEQ ID NO: 2811769 - RNA, 16 nt, Human
ccuccccagccccuag

SEQ ID NO: 2811770 - RNA, 17 nt, Human
ccuccccagccccuagc

SEQ ID NO: 2811771 - RNA, 22 nt, Human
ccuccccagccccuagcccagg

SEQ ID NO: 2811772 - RNA, 20 nt, Human
ccuagcuuuauauauggaca

SEQ ID NO: 2811773 - RNA, 21 nt, Human
ccuagcuuuauauauggacau

SEQ ID NO: 2811774 - RNA, 22 nt, Human
ccuagcuuuauauauggacaug

SEQ ID NO: 2811775 - RNA, 23 nt, Human
ccuagcuuuauauauggacaugg

SEQ ID NO: 2811776 - RNA, 20 nt, Human
ccuagcuugggaggcuuccc

SEQ ID NO: 2811777 - RNA, 21 nt, Human
ccuagcuugggaggcuucccc

SEQ ID NO: 2811778 - RNA, 14 nt, Human
ccucagccugcaca

SEQ ID NO: 2811779 - RNA, 12 nt, Human
ccucagccugca

SEQ ID NO: 2811780 - RNA, 15 nt, Human
ccucagccuccugag

SEQ ID NO: 2811781 - RNA, 18 nt, Human
ccucagccuccugaguag

SEQ ID NO: 2811782 - RNA, 16 nt, Human
ccuaggaccacucagc

SEQ ID NO: 2811783 - RNA, 17 nt, Human
ccuaggaccacucagcc

SEQ ID NO: 2811784 - RNA, 18 nt, Human
ccuaggaccacucagccc

SEQ ID NO: 2811785 - RNA, 19 nt, Human
ccuaggaccacucagcccc

SEQ ID NO: 2811786 - RNA, 20 nt, Human
ccuaggaccacucagccccu

SEQ ID NO: 2811787 - RNA, 21 nt, Human
ccuaggaccacucagccccua

SEQ ID NO: 2811788 - RNA, 23 nt, Human
ccuaggaccacucagccccuagg

SEQ ID NO: 2811789 - RNA, 14 nt, Human
ccucagccuccuga

SEQ ID NO: 2811790 - RNA, 15 nt, Human
ccucaggcacuagcc

SEQ ID NO: 2811791 - RNA, 16 nt, Human
ccucaggcacuagccu

SEQ ID NO: 2811792 - RNA, 17 nt, Human
ccucaggcacuagccuu

SEQ ID NO: 2811793 - RNA, 18 nt, Human
ccucaggcacuagccuuu

SEQ ID NO: 2811794 - RNA, 13 nt, Human
ccucaggcagcuc

SEQ ID NO: 2811795 - RNA, 19 nt, Human
ccucaggcacuagccuuug

SEQ ID NO: 2811796 - RNA, 22 nt, Human
ccucaggcacuagccuuuggcu

SEQ ID NO: 2811797 - RNA, 14 nt, Human
ccucaggcagcuca

SEQ ID NO: 2811798 - RNA, 15 nt, Human
ccucaggcagcucaa

SEQ ID NO: 2811799 - RNA, 13 nt, Human
ccugccuccugcc

SEQ ID NO: 2811800 - RNA, 20 nt, Human
ccugccuccugccugccccu

SEQ ID NO: 2811801 - RNA, 12 nt, Human
ccugccugccau

SEQ ID NO: 2811802 - RNA, 13 nt, Human
ccugccugccaug

SEQ ID NO: 2811803 - RNA, 14 nt, Human
ccugccugccaugu

SEQ ID NO: 2811804 - RNA, 12 nt, Human
ccugccuggagc

SEQ ID NO: 2811805 - RNA, 13 nt, Human
ccugccugcgucu

SEQ ID NO: 2811806 - RNA, 18 nt, Human
ccugccugcgucuuccgc

SEQ ID NO: 2811807 - RNA, 14 nt, Human
ccugcugcaggggc

SEQ ID NO: 2811808 - RNA, 15 nt, Human
ccugcugcaggggcu

SEQ ID NO: 2811809 - RNA, 17 nt, Human
ccugcugcaggggcucu

SEQ ID NO: 2811810 - RNA, 20 nt, Human
ccugcugcaggggcucugga

SEQ ID NO: 2811811 - RNA, 21 nt, Human
ccugcugcaggggcucuggag

SEQ ID NO: 2811812 - RNA, 22 nt, Human
ccugcugcaggggcucuggaga

SEQ ID NO: 2811813 - RNA, 23 nt, Human
ccugcugcaggggcucuggagag

SEQ ID NO: 2811814 - RNA, 10 nt, Human
ccugcugcau

SEQ ID NO: 2811815 - RNA, 22 nt, Human
ccugcugcccaaucuccaucug

SEQ ID NO: 2811816 - RNA, 15 nt, Human
ccugcugcccaggcu

SEQ ID NO: 2811817 - RNA, 17 nt, Human
ccugcugcccaggcugu

SEQ ID NO: 2811818 - RNA, 22 nt, Human
ccugcugcccaggcugugcagc

SEQ ID NO: 2811819 - RNA, 21 nt, Human
ccugcugccgccucccagccu

SEQ ID NO: 2811820 - RNA, 18 nt, Human
ccugcugccgccucccag

SEQ ID NO: 2811821 - RNA, 15 nt, Human
ccugcugccgccucc

SEQ ID NO: 2811822 - RNA, 14 nt, Human
ccugcugccgccuc

SEQ ID NO: 2811823 - RNA, 14 nt, Human
ccucuuuggcuccc

SEQ ID NO: 2811824 - RNA, 18 nt, Human
ccucuuuggcuccccugu

SEQ ID NO: 2811825 - RNA, 18 nt, Human
ccucuugcugucucugcu

SEQ ID NO: 2811826 - RNA, 19 nt, Human
ccucuugcugucucugcuc

SEQ ID NO: 2811827 - RNA, 20 nt, Human
ccucuugcugucucugcucg

SEQ ID NO: 2811828 - RNA, 23 nt, Human
ccucuugcugucucugcucgccc

SEQ ID NO: 2811829 - RNA, 21 nt, Human
ccucuucuuucagacuugcca

SEQ ID NO: 2811830 - RNA, 22 nt, Human
ccucuucuuucagacuugccau

SEQ ID NO: 2811831 - RNA, 23 nt, Human
ccucuucuuucagacuugccaug

SEQ ID NO: 2811832 - RNA, 12 nt, Human
ccucuuggagac

SEQ ID NO: 2811833 - RNA, 15 nt, Human
ccucuucuggcucaa

SEQ ID NO: 2811834 - RNA, 16 nt, Human
ccucuucugccaagag

SEQ ID NO: 2811835 - RNA, 21 nt, Human
ccucugccugaagucacacag

SEQ ID NO: 2811836 - RNA, 15 nt, Human
ccucugccugucucc

SEQ ID NO: 2811837 - RNA, 13 nt, Human
ccucugcggaccc

SEQ ID NO: 2811838 - RNA, 18 nt, Human
ccucugccuuagaggagc

SEQ ID NO: 2811839 - RNA, 20 nt, Human
ccucugccuuagaggagccc

SEQ ID NO: 2811840 - RNA, 19 nt, Human
ccucugccugucuccccca

SEQ ID NO: 2811841 - RNA, 16 nt, Human
ccucugcggaccccag

SEQ ID NO: 2811842 - RNA, 17 nt, Human
ccucugcggaccccagc

SEQ ID NO: 2811843 - RNA, 18 nt, Human
ccucugcggaccccagcu

SEQ ID NO: 2811844 - RNA, 20 nt, Human
ccucugcggaccccagcugu

SEQ ID NO: 2811845 - RNA, 12 nt, Human
ccucugcucagc

SEQ ID NO: 2811846 - RNA, 13 nt, Human
ccucugcucagcc

SEQ ID NO: 2811847 - RNA, 14 nt, Human
ccucugcucagcca

SEQ ID NO: 2811848 - RNA, 15 nt, Human
ccucugcucagccaa

SEQ ID NO: 2811849 - RNA, 17 nt, Human
ccucugcucagccaagc

SEQ ID NO: 2811850 - RNA, 14 nt, Human
ccugaguucaucca

SEQ ID NO: 2811851 - RNA, 20 nt, Human
ccugaguucauccaggccca

SEQ ID NO: 2811852 - RNA, 21 nt, Human
ccugaguggccagggaaucua

SEQ ID NO: 2811853 - RNA, 19 nt, Human
ccucuuuggcuccccugua

SEQ ID NO: 2811854 - RNA, 20 nt, Human
ccucuuuggcuccccuguac

SEQ ID NO: 2811855 - RNA, 16 nt, Human
ccugacucaucauuug

SEQ ID NO: 2811856 - RNA, 20 nt, Human
ccugacgucugaagcuugac

SEQ ID NO: 2811857 - RNA, 23 nt, Human
ccugacuauuauguuguuagaga

SEQ ID NO: 2811858 - RNA, 13 nt, Human
ccugacgaaacug

SEQ ID NO: 2811859 - RNA, 16 nt, Human
ccugacgaaacuggcc

SEQ ID NO: 2811860 - RNA, 17 nt, Human
ccugacgaaacuggccc

SEQ ID NO: 2811861 - RNA, 18 nt, Human
ccugacgaaacuggcccc

SEQ ID NO: 2811862 - RNA, 21 nt, Human
ccugacgaaacuggccccgga

SEQ ID NO: 2811863 - RNA, 17 nt, Human
ccugaccuuccuuccug

SEQ ID NO: 2811864 - RNA, 14 nt, Human
ccugagugccuggc

SEQ ID NO: 2811865 - RNA, 15 nt, Human
ccugagugccuggcc

SEQ ID NO: 2811866 - RNA, 23 nt, Human
ccugaggggcaucugccccuccc

SEQ ID NO: 2811867 - RNA, 22 nt, Human
ccugaggggcaucugccccucc

SEQ ID NO: 2811868 - RNA, 20 nt, Human
ccugaggggcaucugccccu

SEQ ID NO: 2811869 - RNA, 19 nt, Human
ccugaggggcaucugcccc

SEQ ID NO: 2811870 - RNA, 18 nt, Human
ccugaggggcaucugccc

SEQ ID NO: 2811871 - RNA, 16 nt, Human
cccccuucaagccugu

SEQ ID NO: 2811872 - RNA, 11 nt, Human
cccccuuccac

SEQ ID NO: 2811873 - RNA, 23 nt, Human
ccccgcccagcugcaccugccag

SEQ ID NO: 2811874 - RNA, 17 nt, Human
ccccgcccagcugcacc

SEQ ID NO: 2811875 - RNA, 13 nt, Human
ccccgcagcccug

SEQ ID NO: 2811876 - RNA, 23 nt, Human
ccccgcagaccuccccagccccu

SEQ ID NO: 2811877 - RNA, 20 nt, Human
ccccgcagaccuccccagcc

SEQ ID NO: 2811878 - RNA, 21 nt, Human
ccccgcagaccuccccagccc

SEQ ID NO: 2811879 - RNA, 19 nt, Human
ccccgcagaccuccccagc

SEQ ID NO: 2811880 - RNA, 17 nt, Human
cccccuucucugcucca

SEQ ID NO: 2811881 - RNA, 16 nt, Human
cccccuucucugcucc

SEQ ID NO: 2811882 - RNA, 15 nt, Human
cccccuucucugcuc

SEQ ID NO: 2811883 - RNA, 18 nt, Human
ccccgccugcccucaugg

SEQ ID NO: 2811884 - RNA, 21 nt, Human
ccccgcccccugcccuccccu

SEQ ID NO: 2811885 - RNA, 17 nt, Human
ccccgcccucuuccuga

SEQ ID NO: 2811886 - RNA, 13 nt, Human
ccccgcccccugc

SEQ ID NO: 2811887 - RNA, 17 nt, Human
ccccgcccccugcccuc

SEQ ID NO: 2811888 - RNA, 18 nt, Human
ccccgcccccugcccucc

SEQ ID NO: 2811889 - RNA, 16 nt, Human
ccccgcuaaggaagau

SEQ ID NO: 2811890 - RNA, 21 nt, Human
ccccgccuuccgccccuuccc

SEQ ID NO: 2811891 - RNA, 17 nt, Human
cccauugguguugucau

SEQ ID NO: 2811892 - RNA, 21 nt, Human
cccauugguguugucauugua

SEQ ID NO: 2811893 - RNA, 18 nt, Human
ccccaaaacaaagucuuu

SEQ ID NO: 2811894 - RNA, 19 nt, Human
ccccaaaacaaagucuuug

SEQ ID NO: 2811895 - RNA, 20 nt, Human
cccauucuuccuaguuuucu

SEQ ID NO: 2811896 - RNA, 21 nt, Human
cccauugcaucaccucuguaa

SEQ ID NO: 2811897 - RNA, 23 nt, Human
ccccagcaguugaaugacaacag

SEQ ID NO: 2811898 - RNA, 12 nt, Human
ccccagcaucac

SEQ ID NO: 2811899 - RNA, 16 nt, Human
ccccagcaucacuccc

SEQ ID NO: 2811900 - RNA, 20 nt, Human
ccccagcaucacuccccaag

SEQ ID NO: 2811901 - RNA, 18 nt, Human
ccccagcauucucaggca

SEQ ID NO: 2811902 - RNA, 20 nt, Human
ccccagcauucucaggcacc

SEQ ID NO: 2811903 - RNA, 19 nt, Human
ccccagcauucucaggcac

SEQ ID NO: 2811904 - RNA, 22 nt, Human
ccccagcauucucaggcaccag

SEQ ID NO: 2811905 - RNA, 21 nt, Human
ccccagcauucucaggcacca

SEQ ID NO: 2811906 - RNA, 21 nt, Human
ccccauucugccugcccaggc

SEQ ID NO: 2811907 - RNA, 16 nt, Human
ccccauucuuccuagu

SEQ ID NO: 2811908 - RNA, 23 nt, Human
ccccauucuuccuaguuuucucc

SEQ ID NO: 2811909 - RNA, 21 nt, Human
ccccauucuuccuaguuuucu

SEQ ID NO: 2811910 - RNA, 14 nt, Human
ccccagcccaaagg

SEQ ID NO: 2811911 - RNA, 22 nt, Human
ccccagcccaaaggggacaggc

SEQ ID NO: 2811912 - RNA, 23 nt, Human
cccauucugccugcccaggcccc

SEQ ID NO: 2811913 - RNA, 12 nt, Human
cccauucuuccu

SEQ ID NO: 2811914 - RNA, 21 nt, Human
cccauucuuccuaguuuucuc

SEQ ID NO: 2811915 - RNA, 13 nt, Human
cccaucccacacc

SEQ ID NO: 2811916 - RNA, 15 nt, Human
cccaucccacacccu

SEQ ID NO: 2811917 - RNA, 21 nt, Human
cccauccaguucaugagaauc

SEQ ID NO: 2811918 - RNA, 14 nt, Human
cccauccaguucau

SEQ ID NO: 2811919 - RNA, 22 nt, Human
cccaucauuacccuucccugca

SEQ ID NO: 2811920 - RNA, 22 nt, Human
cccaucaugcccggucccaccc

SEQ ID NO: 2811921 - RNA, 18 nt, Human
cccagggccagggcccug

SEQ ID NO: 2811922 - RNA, 17 nt, Human
cccagggccagggcccu

SEQ ID NO: 2811923 - RNA, 15 nt, Human
cccagggccagggcc

SEQ ID NO: 2811924 - RNA, 12 nt, Human
cccagggcaccc

SEQ ID NO: 2811925 - RNA, 13 nt, Human
cccagggcacccu

SEQ ID NO: 2811926 - RNA, 18 nt, Human
cccaggcuggcgugcagu

SEQ ID NO: 2811927 - RNA, 20 nt, Human
cccaggcuggcgugcagugg

SEQ ID NO: 2811928 - RNA, 19 nt, Human
cccaggcuggcgugcagug

SEQ ID NO: 2811929 - RNA, 15 nt, Human
cccagcugugagccu

SEQ ID NO: 2811930 - RNA, 16 nt, Human
cccagcugugagccuu

SEQ ID NO: 2811931 - RNA, 17 nt, Human
cccagcugugagccuug

SEQ ID NO: 2811932 - RNA, 19 nt, Human
cccagcccacuucugccau

SEQ ID NO: 2811933 - RNA, 17 nt, Human
cccagcccacuucugcc

SEQ ID NO: 2811934 - RNA, 20 nt, Human
cccagcauuuuacugauuca

SEQ ID NO: 2811935 - RNA, 11 nt, Human
cccagcccaga

SEQ ID NO: 2811936 - RNA, 21 nt, Human
cccagcauccuuuucugcaga

SEQ ID NO: 2811937 - RNA, 17 nt, Human
cccagcaucacucccca

SEQ ID NO: 2811938 - RNA, 19 nt, Human
cccagcaucacuccccaag

SEQ ID NO: 2811939 - RNA, 12 nt, Human
cccagcaguucu

SEQ ID NO: 2811940 - RNA, 13 nt, Human
cccagcauucuca

SEQ ID NO: 2811941 - RNA, 22 nt, Human
cccagcaugacauaacagugca

SEQ ID NO: 2811942 - RNA, 23 nt, Human
cccagcaugacauaacagugcag

SEQ ID NO: 2811943 - RNA, 17 nt, Human
cccagccaaacccuguc

SEQ ID NO: 2811944 - RNA, 19 nt, Human
cccagcauucucaggcacc

SEQ ID NO: 2811945 - RNA, 17 nt, Human
cccagcauucucaggca

SEQ ID NO: 2811946 - RNA, 16 nt, Human
cccagcauucucaggc

SEQ ID NO: 2811947 - RNA, 15 nt, Human
cccagcauucucagg

SEQ ID NO: 2811948 - RNA, 21 nt, Human
ccaugggcacaaagggcccag

SEQ ID NO: 2811949 - RNA, 16 nt, Human
ccaugggauacaaccu

SEQ ID NO: 2811950 - RNA, 23 nt, Human
ccaugggauacaaccucccucuu

SEQ ID NO: 2811951 - RNA, 24 nt, Human
ccaugggauacaaccucccucuug

SEQ ID NO: 2811952 - RNA, 22 nt, Human
ccaugagaauaagagaaagaaa

SEQ ID NO: 2811953 - RNA, 15 nt, Human
ccaugagacccuggu

SEQ ID NO: 2811954 - RNA, 20 nt, Human
ccaugagacccuggugccug

SEQ ID NO: 2811955 - RNA, 23 nt, Human
ccaugagacccuggugccuggcu

SEQ ID NO: 2811956 - RNA, 17 nt, Human
ccaugggccuccugugu

SEQ ID NO: 2811957 - RNA, 13 nt, Human
ccaugggcucuga

SEQ ID NO: 2811958 - RNA, 13 nt, Human
ccaugggcuucac

SEQ ID NO: 2811959 - RNA, 16 nt, Human
ccaugggcuucacugu

SEQ ID NO: 2811960 - RNA, 19 nt, Human
ccaugggcuucacuguaua

SEQ ID NO: 2811961 - RNA, 20 nt, Human
ccaugggcuucacuguauaa

SEQ ID NO: 2811962 - RNA, 21 nt, Human
ccaugggcuucacuguauaaa

SEQ ID NO: 2811963 - RNA, 23 nt, Human
ccauggggacgcccucagucuag

SEQ ID NO: 2811964 - RNA, 20 nt, Human
ccaugucucugagcauuaga

SEQ ID NO: 2811965 - RNA, 17 nt, Human
ccaugugacucuggcuu

SEQ ID NO: 2811966 - RNA, 18 nt, Human
ccaugugacucuggcuug

SEQ ID NO: 2811967 - RNA, 22 nt, Human
ccaugugacucuggcuuggccu

SEQ ID NO: 2811968 - RNA, 15 nt, Human
ccaugucuuucucca

SEQ ID NO: 2811969 - RNA, 21 nt, Human
ccaugucuuucuccaaaguua

SEQ ID NO: 2811970 - RNA, 15 nt, Human
ccaugucucgacuca

SEQ ID NO: 2811971 - RNA, 14 nt, Human
ccaugucucgacuc

SEQ ID NO: 2811972 - RNA, 19 nt, Human
ccaugucgccucugcauuc

SEQ ID NO: 2811973 - RNA, 13 nt, Human
ccauugguguugu

SEQ ID NO: 2811974 - RNA, 14 nt, Human
ccauugguccaaga

SEQ ID NO: 2811975 - RNA, 14 nt, Human
ccauuuaaaaaguu

SEQ ID NO: 2811976 - RNA, 13 nt, Human
cccaaccugcucu

SEQ ID NO: 2811977 - RNA, 14 nt, Human
cccaaccugcucuc

SEQ ID NO: 2811978 - RNA, 21 nt, Human
cccaaccugcucuccucuugc

SEQ ID NO: 2811979 - RNA, 14 nt, Human
cccaaccugcugaa

SEQ ID NO: 2811980 - RNA, 23 nt, Human
cccaaccugcucuccucuugcca

SEQ ID NO: 2811981 - RNA, 15 nt, Human
cccaacgcacaggaa

SEQ ID NO: 2811982 - RNA, 16 nt, Human
cccaacgcacaggaaa

SEQ ID NO: 2811983 - RNA, 16 nt, Human
cccaacggcccugcag

SEQ ID NO: 2811984 - RNA, 20 nt, Human
cccaacggcccugcagccag

SEQ ID NO: 2811985 - RNA, 22 nt, Human
cccaacggcccugcagccagcu

SEQ ID NO: 2811986 - RNA, 14 nt, Human
cccaacgggaagca

SEQ ID NO: 2811987 - RNA, 14 nt, Human
cccaacucugagcc

SEQ ID NO: 2811988 - RNA, 15 nt, Human
cccaacucugagccc

SEQ ID NO: 2811989 - RNA, 16 nt, Human
cccaacucugagccca

SEQ ID NO: 2811990 - RNA, 17 nt, Human
cccaacucugagcccau

SEQ ID NO: 2811991 - RNA, 18 nt, Human
cccaacucugagcccaug

SEQ ID NO: 2811992 - RNA, 19 nt, Human
cccaacucugagcccaugu

SEQ ID NO: 2811993 - RNA, 17 nt, Human
cccaacugugagcaagg

SEQ ID NO: 2811994 - RNA, 16 nt, Human
cccaacuguguagcau

SEQ ID NO: 2811995 - RNA, 17 nt, Human
cccaagcucugcuccuc

SEQ ID NO: 2811996 - RNA, 12 nt, Human
cccaagcuccuc

SEQ ID NO: 2811997 - RNA, 13 nt, Human
cccaagcuccucc

SEQ ID NO: 2811998 - RNA, 14 nt, Human
cccaagcuccuccu

SEQ ID NO: 2811999 - RNA, 14 nt, Human
cccaagcuuagaac

SEQ ID NO: 2812000 - RNA, 19 nt, Human
cccaagcuguuuucuucua

SEQ ID NO: 2812001 - RNA, 16 nt, Human
cccaagcuggcugggg

SEQ ID NO: 2812002 - RNA, 22 nt, Human
cccaagccuucgggcgucugug

SEQ ID NO: 2812003 - RNA, 16 nt, Human
cccaagccuggcaagg

SEQ ID NO: 2812004 - RNA, 16 nt, Human
cccaagcccaggccac

SEQ ID NO: 2812005 - RNA, 20 nt, Human
cccaacuucucuugcuuucu

SEQ ID NO: 2812006 - RNA, 16 nt, Human
cccaagccaaaaaccu

SEQ ID NO: 2812007 - RNA, 23 nt, Human
cccaagccuacuuuugccauuga

SEQ ID NO: 2812008 - RNA, 20 nt, Human
cccaagaauagaugcugacu

SEQ ID NO: 2812009 - RNA, 21 nt, Human
cccaagaauagaugcugacug

SEQ ID NO: 2812010 - RNA, 18 nt, Human
cccaccaucaugucuggc

SEQ ID NO: 2812011 - RNA, 19 nt, Human
cccaaggaaagccccagca

SEQ ID NO: 2812012 - RNA, 14 nt, Human
cccaaggaaagccc

SEQ ID NO: 2812013 - RNA, 17 nt, Human
cccaaggaaaacugcau

SEQ ID NO: 2812014 - RNA, 19 nt, Human
cccacccccuucucugcuc

SEQ ID NO: 2812015 - RNA, 16 nt, Human
cccacccccuucucug

SEQ ID NO: 2812016 - RNA, 22 nt, Human
cccacccccuucucugcuccac

SEQ ID NO: 2812017 - RNA, 14 nt, Human
cccacccugggacc

SEQ ID NO: 2812018 - RNA, 12 nt, Human
cccacuguauga

SEQ ID NO: 2812019 - RNA, 17 nt, Human
cccacuguaugauuuau

SEQ ID NO: 2812020 - RNA, 17 nt, Human
cccacccuguuuggauu

SEQ ID NO: 2812021 - RNA, 21 nt, Human
cccacccuguuuggauuuuua

SEQ ID NO: 2812022 - RNA, 21 nt, Human
ccacuuggcuacacagggaug

SEQ ID NO: 2812023 - RNA, 18 nt, Human
ccacuuggcaucagcugg

SEQ ID NO: 2812024 - RNA, 18 nt, Human
ccacuucggccaggucac

SEQ ID NO: 2812025 - RNA, 20 nt, Human
ccacuucggccaggucacac

SEQ ID NO: 2812026 - RNA, 14 nt, Human
ccacuucucaucac

SEQ ID NO: 2812027 - RNA, 18 nt, Human
ccacuucucaucacacac

SEQ ID NO: 2812028 - RNA, 19 nt, Human
ccacuucucaucacacaca

SEQ ID NO: 2812029 - RNA, 20 nt, Human
ccacuucucaucacacacau

SEQ ID NO: 2812030 - RNA, 23 nt, Human
ccacuucucaucacacacaugga

SEQ ID NO: 2812031 - RNA, 14 nt, Human
ccacuucuggucaa

SEQ ID NO: 2812032 - RNA, 18 nt, Human
ccacuucuggucaaucaa

SEQ ID NO: 2812033 - RNA, 13 nt, Human
ccacuucugucca

SEQ ID NO: 2812034 - RNA, 17 nt, Human
ccacuucuguccauauu

SEQ ID NO: 2812035 - RNA, 13 nt, Human
ccacuucuuccuu

SEQ ID NO: 2812036 - RNA, 15 nt, Human
ccacuucuuccuuuc

SEQ ID NO: 2812037 - RNA, 17 nt, Human
ccacuucuuccuuucuc

SEQ ID NO: 2812038 - RNA, 18 nt, Human
ccacuucuuccuuucucu

SEQ ID NO: 2812039 - RNA, 22 nt, Human
ccacuucuuccuuucucuuucu

SEQ ID NO: 2812040 - RNA, 23 nt, Human
ccacuucuuccuuucucuuucuc

SEQ ID NO: 2812041 - RNA, 19 nt, Human
ccacuucuuguuccccacu

SEQ ID NO: 2812042 - RNA, 16 nt, Human
ccacuucuuuuauaac

SEQ ID NO: 2812043 - RNA, 14 nt, Human
ccacuugaaauguu

SEQ ID NO: 2812044 - RNA, 17 nt, Human
ccacuugaaauguuagu

SEQ ID NO: 2812045 - RNA, 20 nt, Human
ccacuucuuguuccccacug

SEQ ID NO: 2812046 - RNA, 19 nt, Human
ccacugcaccgggccacag

SEQ ID NO: 2812047 - RNA, 17 nt, Human
ccacugcaccgggccac

SEQ ID NO: 2812048 - RNA, 14 nt, Human
ccacugcaccgggc

SEQ ID NO: 2812049 - RNA, 13 nt, Human
ccacugcaccggg

SEQ ID NO: 2812050 - RNA, 20 nt, Human
ccacugcacuauagccuagg

SEQ ID NO: 2812051 - RNA, 19 nt, Human
ccacugcacuauagccuag

SEQ ID NO: 2812052 - RNA, 21 nt, Human
ccacuuccaggggaaccugcc

SEQ ID NO: 2812053 - RNA, 19 nt, Human
ccacuuccaggggaaccug

SEQ ID NO: 2812054 - RNA, 18 nt, Human
ccacuuccaggggaaccu

SEQ ID NO: 2812055 - RNA, 13 nt, Human
ccacuuccagggg

SEQ ID NO: 2812056 - RNA, 17 nt, Human
ccacugcacuccagccu

SEQ ID NO: 2812057 - RNA, 14 nt, Human
ccacugcacuccag

SEQ ID NO: 2812058 - RNA, 18 nt, Human
ccacugcaaguccuuuug

SEQ ID NO: 2812059 - RNA, 22 nt, Human
ccacugcaaguccuuuuguaaa

SEQ ID NO: 2812060 - RNA, 23 nt, Human
ccacugcaaguccuuuuguaaag

SEQ ID NO: 2812061 - RNA, 23 nt, Human
ccacugauauucagaauuaugau

SEQ ID NO: 2812062 - RNA, 16 nt, Human
ccacugaugcuguucu

SEQ ID NO: 2812063 - RNA, 17 nt, Human
ccacugaugcuguucuc

SEQ ID NO: 2812064 - RNA, 19 nt, Human
ccacugaugcuguucucuu

SEQ ID NO: 2812065 - RNA, 19 nt, Human
ccacugacagccucccacc

SEQ ID NO: 2812066 - RNA, 17 nt, Human
ccacugacagccuccca

SEQ ID NO: 2812067 - RNA, 16 nt, Human
ccacugacagccuccc

SEQ ID NO: 2812068 - RNA, 15 nt, Human
ccacugacagccucc

SEQ ID NO: 2812069 - RNA, 21 nt, Human
ccacugaaguagugugcaguu

SEQ ID NO: 2812070 - RNA, 18 nt, Human
ccacugaagcccauuucu

SEQ ID NO: 2812071 - RNA, 16 nt, Human
ccacugaagcugggau

SEQ ID NO: 2812072 - RNA, 15 nt, Human
ccacugaagcuggga

SEQ ID NO: 2812073 - RNA, 14 nt, Human
ccacugaagcuggg

SEQ ID NO: 2812074 - RNA, 14 nt, Human
ccacugaaaucugu

SEQ ID NO: 2812075 - RNA, 10 nt, Human
ccacuucugg

SEQ ID NO: 2812076 - RNA, 18 nt, Human
ccacuugucacugacaca

SEQ ID NO: 2812077 - RNA, 15 nt, Human
ccacuuguccgcugg

SEQ ID NO: 2812078 - RNA, 21 nt, Human
ccacuuguccgcuggguggua

SEQ ID NO: 2812079 - RNA, 20 nt, Human
ccacuuugcacagcucuccg

SEQ ID NO: 2812080 - RNA, 14 nt, Human
ccacuuugcacauu

SEQ ID NO: 2812081 - RNA, 15 nt, Human
ccacuuugcacauuu

SEQ ID NO: 2812082 - RNA, 19 nt, Human
ccacuuugcacauuuugau

SEQ ID NO: 2812083 - RNA, 21 nt, Human
ccacuuugcacgacgcccucu

SEQ ID NO: 2812084 - RNA, 23 nt, Human
ccacuuugcacgacgcccucucc

SEQ ID NO: 2812085 - RNA, 21 nt, Human
ccacuuugcauaugagccgug

SEQ ID NO: 2812086 - RNA, 13 nt, Human
ccacuuuguccau

SEQ ID NO: 2812087 - RNA, 21 nt, Human
ccacuuugguacauggccagu

SEQ ID NO: 2812088 - RNA, 18 nt, Human
ccacuuuacccaccuaga

SEQ ID NO: 2812089 - RNA, 17 nt, Human
ccacuuuaagagagaaa

SEQ ID NO: 2812090 - RNA, 19 nt, Human
ccacuuuacccaccuagaa

SEQ ID NO: 2812091 - RNA, 17 nt, Human
ccagacuacuauuuucu

SEQ ID NO: 2812092 - RNA, 14 nt, Human
ccagaccuuuuauc

SEQ ID NO: 2812093 - RNA, 15 nt, Human
ccagaccuucuagga

SEQ ID NO: 2812094 - RNA, 16 nt, Human
ccagacccggcugcgu

SEQ ID NO: 2812095 - RNA, 17 nt, Human
ccagacccggcugcgug

SEQ ID NO: 2812096 - RNA, 14 nt, Human
ccagaugcaccagc

SEQ ID NO: 2812097 - RNA, 13 nt, Human
ccagaugcaccag

SEQ ID NO: 2812098 - RNA, 19 nt, Human
ccagaucuggucccuugca

SEQ ID NO: 2812099 - RNA, 19 nt, Human
ccagaugaggcuggccaag

SEQ ID NO: 2812100 - RNA, 20 nt, Human
ccagaucacugccacacucu

SEQ ID NO: 2812101 - RNA, 13 nt, Human
ccagauccugggu

SEQ ID NO: 2812102 - RNA, 13 nt, Human
ccagaucuggucc

SEQ ID NO: 2812103 - RNA, 18 nt, Human
ccagaucacugccacacu

SEQ ID NO: 2812104 - RNA, 16 nt, Human
ccagaucacugccaca

SEQ ID NO: 2812105 - RNA, 15 nt, Human
ccagaucacugccac

SEQ ID NO: 2812106 - RNA, 16 nt, Human
ccagauaacugaggag

SEQ ID NO: 2812107 - RNA, 13 nt, Human
ccagagagggugg

SEQ ID NO: 2812108 - RNA, 13 nt, Human
ccagaggggaagg

SEQ ID NO: 2812109 - RNA, 14 nt, Human
ccagaggggaagga

SEQ ID NO: 2812110 - RNA, 23 nt, Human
ccagaggggaaggaggguacagc

SEQ ID NO: 2812111 - RNA, 18 nt, Human
ccagagagcaacucugag

SEQ ID NO: 2812112 - RNA, 20 nt, Human
ccagagagcaacucugagau

SEQ ID NO: 2812113 - RNA, 21 nt, Human
ccagagagcaacucugagauc

SEQ ID NO: 2812114 - RNA, 22 nt, Human
ccagagguaacagaacagcuuc

SEQ ID NO: 2812115 - RNA, 12 nt, Human
ccagaggugcuu

SEQ ID NO: 2812116 - RNA, 23 nt, Human
ccagagggguggguuccucuucc

SEQ ID NO: 2812117 - RNA, 17 nt, Human
ccagagguaacagaaca

SEQ ID NO: 2812118 - RNA, 18 nt, Human
ccagagguaacagaacag

SEQ ID NO: 2812119 - RNA, 19 nt, Human
ccagagguaacagaacagc

SEQ ID NO: 2812120 - RNA, 21 nt, Human
ccagagguaacagaacagcuu

SEQ ID NO: 2812121 - RNA, 23 nt, Human
ccagagguaacagaacagcuuca

SEQ ID NO: 2812122 - RNA, 14 nt, Human
ccagagguccagcc

SEQ ID NO: 2812123 - RNA, 15 nt, Human
ccagagguccagccc

SEQ ID NO: 2812124 - RNA, 16 nt, Human
ccagagguccagccca

SEQ ID NO: 2812125 - RNA, 17 nt, Human
ccagagguccagcccau

SEQ ID NO: 2812126 - RNA, 19 nt, Human
ccagagguccagcccaucu

SEQ ID NO: 2812127 - RNA, 16 nt, Human
ccagagaauucuuaga

SEQ ID NO: 2812128 - RNA, 12 nt, Human
ccagagaacagc

SEQ ID NO: 2812129 - RNA, 16 nt, Human
ccagagacuuuguaga

SEQ ID NO: 2812130 - RNA, 20 nt, Human
ccagagaccaggcugugucc

SEQ ID NO: 2812131 - RNA, 18 nt, Human
ccagagaccguccucacc

SEQ ID NO: 2812132 - RNA, 19 nt, Human
ccagagaccguccucaccc

SEQ ID NO: 2812133 - RNA, 21 nt, Human
ccagagaccguccucaccccu

SEQ ID NO: 2812134 - RNA, 15 nt, Human
ccagacuuccuugag

SEQ ID NO: 2812135 - RNA, 13 nt, Human
ccagacuuccuug

SEQ ID NO: 2812136 - RNA, 14 nt, Human
ccagacuuccuuga

SEQ ID NO: 2812137 - RNA, 15 nt, Human
ccagacuguuagaaa

SEQ ID NO: 2812138 - RNA, 20 nt, Human
ccagacuccugacugucucc

SEQ ID NO: 2812139 - RNA, 21 nt, Human
ccagacuccugacugucuccc

SEQ ID NO: 2812140 - RNA, 22 nt, Human
ccagacugcuuccaauuuucug

SEQ ID NO: 2812141 - RNA, 13 nt, Human
ccagacugcaggu

SEQ ID NO: 2812142 - RNA, 22 nt, Human
ccagacugcagguuggacccca

SEQ ID NO: 2812143 - RNA, 23 nt, Human
ccacuuuccuuuucuauuccuuc

SEQ ID NO: 2812144 - RNA, 19 nt, Human
ccagagaaggggugugcau

SEQ ID NO: 2812145 - RNA, 19 nt, Human
ccaggggcccaaggcggcc

SEQ ID NO: 2812146 - RNA, 22 nt, Human
ccaggggcccaaggcggccccu

SEQ ID NO: 2812147 - RNA, 22 nt, Human
ccaggcugagccucagucuccc

SEQ ID NO: 2812148 - RNA, 19 nt, Human
ccaggcugagccucagucu

SEQ ID NO: 2812149 - RNA, 17 nt, Human
ccaggcugagccucagu

SEQ ID NO: 2812150 - RNA, 16 nt, Human
ccaggcugagccucag

SEQ ID NO: 2812151 - RNA, 14 nt, Human
ccaggcugagccuc

SEQ ID NO: 2812152 - RNA, 13 nt, Human
ccaggcugagccu

SEQ ID NO: 2812153 - RNA, 14 nt, Human
ccaguauuagacug

SEQ ID NO: 2812154 - RNA, 17 nt, Human
ccaguccugccuggcca

SEQ ID NO: 2812155 - RNA, 16 nt, Human
ccaguccugccuggcc

SEQ ID NO: 2812156 - RNA, 15 nt, Human
ccaguccugccuggc

SEQ ID NO: 2812157 - RNA, 14 nt, Human
ccaguccugccugg

SEQ ID NO: 2812158 - RNA, 12 nt, Human
ccaguauucuug

SEQ ID NO: 2812159 - RNA, 13 nt, Human
ccaguccuuccac

SEQ ID NO: 2812160 - RNA, 17 nt, Human
ccaguccuuccaccucg

SEQ ID NO: 2812161 - RNA, 23 nt, Human
ccagucgcccuuacuucuugccc

SEQ ID NO: 2812162 - RNA, 22 nt, Human
ccaguccugccuggccaggcag

SEQ ID NO: 2812163 - RNA, 21 nt, Human
ccaguccugccuggccaggca

SEQ ID NO: 2812164 - RNA, 19 nt, Human
ccaguccugccuggccagg

SEQ ID NO: 2812165 - RNA, 18 nt, Human
ccaguccugccuggccag

SEQ ID NO: 2812166 - RNA, 14 nt, Human
ccaguauucuuguc

SEQ ID NO: 2812167 - RNA, 18 nt, Human
ccaggaguuugagaccag

SEQ ID NO: 2812168 - RNA, 17 nt, Human
ccaggaguuugagacca

SEQ ID NO: 2812169 - RNA, 22 nt, Human
ccaggaguuugaggcugcagcg

SEQ ID NO: 2812170 - RNA, 21 nt, Human
ccaggaguuugaggcugcagc

SEQ ID NO: 2812171 - RNA, 20 nt, Human
ccaggaguuugaggcugcag

SEQ ID NO: 2812172 - RNA, 17 nt, Human
ccaggaguuugaggcug

SEQ ID NO: 2812173 - RNA, 21 nt, Human
ccaggcagaucugugccccau

SEQ ID NO: 2812174 - RNA, 20 nt, Human
ccaggcagaucugugcccca

SEQ ID NO: 2812175 - RNA, 23 nt, Human
ccaggcagaucugugccccaugc

SEQ ID NO: 2812176 - RNA, 18 nt, Human
ccaggcaggcuaaggcgu

SEQ ID NO: 2812177 - RNA, 20 nt, Human
ccaggcaggcuaaggcgugg

SEQ ID NO: 2812178 - RNA, 21 nt, Human
ccaggcaggcuaaggcgugga

SEQ ID NO: 2812179 - RNA, 14 nt, Human
ccaggcagguagcc

SEQ ID NO: 2812180 - RNA, 18 nt, Human
ccaggcagguagccaggg

SEQ ID NO: 2812181 - RNA, 15 nt, Human
ccagcagaagacaaa

SEQ ID NO: 2812182 - RNA, 22 nt, Human
ccagcagaagacaaaaagacaa

SEQ ID NO: 2812183 - RNA, 21 nt, Human
ccagcgagcccugguggcagu

SEQ ID NO: 2812184 - RNA, 17 nt, Human
ccagccccggcccuggg

SEQ ID NO: 2812185 - RNA, 21 nt, Human
ccagcuuggggccaccaaagc

SEQ ID NO: 2812186 - RNA, 19 nt, Human
ccagcuuggggccaccaaa

SEQ ID NO: 2812187 - RNA, 22 nt, Human
ccagcuuggggccaccaaagcu

SEQ ID NO: 2812188 - RNA, 16 nt, Human
ccagcuuguaggagcu

SEQ ID NO: 2812189 - RNA, 16 nt, Human
ccagcuuggggccacc

SEQ ID NO: 2812190 - RNA, 14 nt, Human
ccagcuuggggcca

SEQ ID NO: 2812191 - RNA, 22 nt, Human
ccagcgucccagucucuggcag

SEQ ID NO: 2812192 - RNA, 19 nt, Human
ccagcguauauauaagaaa

SEQ ID NO: 2812193 - RNA, 21 nt, Human
ccagcguauauauaagaaaga

SEQ ID NO: 2812194 - RNA, 22 nt, Human
ccagcguauauauaagaaagac

SEQ ID NO: 2812195 - RNA, 23 nt, Human
ccagcguauauauaagaaagaca

SEQ ID NO: 2812196 - RNA, 15 nt, Human
ccagcgucccagucu

SEQ ID NO: 2812197 - RNA, 21 nt, Human
ccagcgucccagucucuggca

SEQ ID NO: 2812198 - RNA, 20 nt, Human
ccagcuugaaaccuucacuu

SEQ ID NO: 2812199 - RNA, 15 nt, Human
ccagcuugccagaug

SEQ ID NO: 2812200 - RNA, 18 nt, Human
ccagcuugccagaugcug

SEQ ID NO: 2812201 - RNA, 22 nt, Human
ccagcuugccagaugcugcaga

SEQ ID NO: 2812202 - RNA, 17 nt, Human
ccagcuugcgaauaaca

SEQ ID NO: 2812203 - RNA, 13 nt, Human
ccagcgcucugcc

SEQ ID NO: 2812204 - RNA, 14 nt, Human
ccagcgcucugccu

SEQ ID NO: 2812205 - RNA, 15 nt, Human
ccagcgcucugccuc

SEQ ID NO: 2812206 - RNA, 14 nt, Human
ccagcgcugagugg

SEQ ID NO: 2812207 - RNA, 23 nt, Human
ccagcgggaauggcagcugccac

SEQ ID NO: 2812208 - RNA, 17 nt, Human
ccagcgggaauggcagc

SEQ ID NO: 2812209 - RNA, 14 nt, Human
aaauuuacuuuaca

SEQ ID NO: 2812210 - RNA, 16 nt, Human
aaauuuacuuuacaca

SEQ ID NO: 2812211 - RNA, 13 nt, Human
aaauuuagaaacu

SEQ ID NO: 2812212 - RNA, 17 nt, Human
aaauuuagaaacuaauu

SEQ ID NO: 2812213 - RNA, 24 nt, Human
aaauuccuaagaaucagaguagaa

SEQ ID NO: 2812214 - RNA, 12 nt, Human
aaauuuaauucu

SEQ ID NO: 2812215 - RNA, 12 nt, Human
aaauuuacuaua

SEQ ID NO: 2812216 - RNA, 13 nt, Human
aaauuuacuauau

SEQ ID NO: 2812217 - RNA, 15 nt, Human
aaauuuacuauauau

SEQ ID NO: 2812218 - RNA, 14 nt, Human
aaauuuauaugaaa

SEQ ID NO: 2812219 - RNA, 12 nt, Human
aaauuuaucaaa

SEQ ID NO: 2812220 - RNA, 13 nt, Human
aaauuuaucaaag

SEQ ID NO: 2812221 - RNA, 17 nt, Human
aaauuuaucaaagcaua

SEQ ID NO: 2812222 - RNA, 18 nt, Human
aaauuucagguuguuggu

SEQ ID NO: 2812223 - RNA, 12 nt, Human
aaauuucagauu

SEQ ID NO: 2812224 - RNA, 20 nt, Human
gucacacaguauuacuucug

SEQ ID NO: 2812225 - RNA, 16 nt, Human
gucacacacuuuggcu

SEQ ID NO: 2812226 - RNA, 21 nt, Human
gucacaaauccuaaaagaagc

SEQ ID NO: 2812227 - RNA, 21 nt, Human
gucacaagccucgaggugccu

SEQ ID NO: 2812228 - RNA, 13 nt, Human
gucacacacugau

SEQ ID NO: 2812229 - RNA, 15 nt, Human
gucacaauguucuuu

SEQ ID NO: 2812230 - RNA, 17 nt, Human
gucacaauguucuuuau

SEQ ID NO: 2812231 - RNA, 18 nt, Human
gucacaauguucuuuaua

SEQ ID NO: 2812232 - RNA, 21 nt, Human
gucacaauguucuuuauauac

SEQ ID NO: 2812233 - RNA, 22 nt, Human
gucaaaugguaggcauuuccua

SEQ ID NO: 2812234 - RNA, 15 nt, Human
gucaaauuauguauu

SEQ ID NO: 2812235 - RNA, 16 nt, Human
gucaacaugaaacacc

SEQ ID NO: 2812236 - RNA, 12 nt, Human
gucaacauugug

SEQ ID NO: 2812237 - RNA, 19 nt, Human
gucaacccuucuggaaacu

SEQ ID NO: 2812238 - RNA, 17 nt, Human
gucaacccuucuggaaa

SEQ ID NO: 2812239 - RNA, 15 nt, Human
gucaacccuucugga

SEQ ID NO: 2812240 - RNA, 12 nt, Human
gucaaccagaca

SEQ ID NO: 2812241 - RNA, 13 nt, Human
gucaaccagacag

SEQ ID NO: 2812242 - RNA, 14 nt, Human
gucaaccagacaga

SEQ ID NO: 2812243 - RNA, 15 nt, Human
gucaaccagacagag

SEQ ID NO: 2812244 - RNA, 16 nt, Human
gucaaccagacagagg

SEQ ID NO: 2812245 - RNA, 17 nt, Human
gucaacccucaggggaa

SEQ ID NO: 2812246 - RNA, 16 nt, Human
gucaacguuguacugu

SEQ ID NO: 2812247 - RNA, 17 nt, Human
guauuuuuuuguaauug

SEQ ID NO: 2812248 - RNA, 15 nt, Human
guauuuuuucuugca

SEQ ID NO: 2812249 - RNA, 19 nt, Human
guauuuuuucuugcauuga

SEQ ID NO: 2812250 - RNA, 20 nt, Human
guauuuuuucuugcauugac

SEQ ID NO: 2812251 - RNA, 12 nt, Human
gucaaaacacug

SEQ ID NO: 2812252 - RNA, 13 nt, Human
gucaaaacacugu

SEQ ID NO: 2812253 - RNA, 14 nt, Human
gucaaaacacugug

SEQ ID NO: 2812254 - RNA, 15 nt, Human
gucaaaacacugugg

SEQ ID NO: 2812255 - RNA, 16 nt, Human
gucaaaacacugugga

SEQ ID NO: 2812256 - RNA, 14 nt, Human
aaauucauuucaca

SEQ ID NO: 2812257 - RNA, 16 nt, Human
aaauucauuucacauu

SEQ ID NO: 2812258 - RNA, 17 nt, Human
aaauucauuucacauua

SEQ ID NO: 2812259 - RNA, 19 nt, Human
aaauucauuucacauuaau

SEQ ID NO: 2812260 - RNA, 22 nt, Human
aaauucaggugaaaauguucau

SEQ ID NO: 2812261 - RNA, 16 nt, Human
aaauucauauucuguc

SEQ ID NO: 2812262 - RNA, 17 nt, Human
aaauucauauucuuuua

SEQ ID NO: 2812263 - RNA, 21 nt, Human
aaauucaucaaauggaagaca

SEQ ID NO: 2812264 - RNA, 22 nt, Human
aaauucacccccuuuccuggac

SEQ ID NO: 2812265 - RNA, 17 nt, Human
aaauuauuuuaaacaaa

SEQ ID NO: 2812266 - RNA, 14 nt, Human
aaauucaaaaagug

SEQ ID NO: 2812267 - RNA, 22 nt, Human
aaauuacuaauuuuacacauua

SEQ ID NO: 2812268 - RNA, 21 nt, Human
aaauucagcaaaccauuuuua

SEQ ID NO: 2812269 - RNA, 16 nt, Human
aaauuagaugcauguu

SEQ ID NO: 2812270 - RNA, 12 nt, Human
aaauuagaaaaa

SEQ ID NO: 2812271 - RNA, 19 nt, Human
aaauuagaaaaaaauuacu

SEQ ID NO: 2812272 - RNA, 23 nt, Human
aaauuagaaaccuuaauaugugg

SEQ ID NO: 2812273 - RNA, 20 nt, Human
aaauuagaaagcaacuuauc

SEQ ID NO: 2812274 - RNA, 15 nt, Human
aaauuauuuuaaaca

SEQ ID NO: 2812275 - RNA, 16 nt, Human
aaauuauuuuaaacaa

SEQ ID NO: 2812276 - RNA, 22 nt, Human
aaauuauuuguguaauagaaaa

SEQ ID NO: 2812277 - RNA, 23 nt, Human
aaauuauuuguguaauagaaaac

SEQ ID NO: 2812278 - RNA, 16 nt, Human
aaauuaucaauaucua

SEQ ID NO: 2812279 - RNA, 18 nt, Human
aaauuauauuugugcuau

SEQ ID NO: 2812280 - RNA, 22 nt, Human
aaauuauauuugugcuauagua

SEQ ID NO: 2812281 - RNA, 15 nt, Human
aaauguuauuucugc

SEQ ID NO: 2812282 - RNA, 17 nt, Human
aaauguuauuucugcaa

SEQ ID NO: 2812283 - RNA, 21 nt, Human
aaauuacuuaucauccacauu

SEQ ID NO: 2812284 - RNA, 12 nt, Human
aaauguuauuuc

SEQ ID NO: 2812285 - RNA, 20 nt, Human
aaauguuaaguugaugguga

SEQ ID NO: 2812286 - RNA, 17 nt, Human
aaauguuaucuucucaa

SEQ ID NO: 2812287 - RNA, 22 nt, Human
aaauguuaugacuauguaaacu

SEQ ID NO: 2812288 - RNA, 18 nt, Human
aaauguuaucuucucaag

SEQ ID NO: 2812289 - RNA, 23 nt, Human
aaauguuaucuucucaaguucua

SEQ ID NO: 2812290 - RNA, 20 nt, Human
guauugcuguccuugaaugc

SEQ ID NO: 2812291 - RNA, 14 nt, Human
guauugcuugccac

SEQ ID NO: 2812292 - RNA, 10 nt, Human
guauuggaaa

SEQ ID NO: 2812293 - RNA, 14 nt, Human
guauuuaagcaaau

SEQ ID NO: 2812294 - RNA, 15 nt, Human
guauuuaagcaaaua

SEQ ID NO: 2812295 - RNA, 17 nt, Human
guauuuaagcaaauacu

SEQ ID NO: 2812296 - RNA, 17 nt, Human
guauugguggcuuuccu

SEQ ID NO: 2812297 - RNA, 18 nt, Human
aaauguuagucauuguua

SEQ ID NO: 2812298 - RNA, 15 nt, Human
aaauguuaguuucuu

SEQ ID NO: 2812299 - RNA, 16 nt, Human
aaauguuaguuucuug

SEQ ID NO: 2812300 - RNA, 17 nt, Human
aaauguuaguuucuugg

SEQ ID NO: 2812301 - RNA, 19 nt, Human
aaauguuaguuucuuggua

SEQ ID NO: 2812302 - RNA, 20 nt, Human
aaauguuaucuuauacugua

SEQ ID NO: 2812303 - RNA, 21 nt, Human
aaauguuaucuuauacuguac

SEQ ID NO: 2812304 - RNA, 23 nt, Human
aaauguuaucuuauacuguacaa

SEQ ID NO: 2812305 - RNA, 23 nt, Human
guaugauuuauaaacagacaaua

SEQ ID NO: 2812306 - RNA, 13 nt, Human
guaguucuaagac

SEQ ID NO: 2812307 - RNA, 17 nt, Human
guaguucucuugguguu

SEQ ID NO: 2812308 - RNA, 20 nt, Human
guaguucucuugguguuaaa

SEQ ID NO: 2812309 - RNA, 17 nt, Human
guaguuauauaauuguu

SEQ ID NO: 2812310 - RNA, 14 nt, Human
guaguuauuuugca

SEQ ID NO: 2812311 - RNA, 21 nt, Human
aaauguaggcaucaugcaugu

SEQ ID NO: 2812312 - RNA, 15 nt, Human
aaauguacugagauu

SEQ ID NO: 2812313 - RNA, 17 nt, Human
aaauguaccuucuuuca

SEQ ID NO: 2812314 - RNA, 16 nt, Human
aaauguacagacauau

SEQ ID NO: 2812315 - RNA, 17 nt, Human
aaauguacagacauauu

SEQ ID NO: 2812316 - RNA, 19 nt, Human
aaauguacagacauauuua

SEQ ID NO: 2812317 - RNA, 20 nt, Human
aaauguacagacauauuuaa

SEQ ID NO: 2812318 - RNA, 18 nt, Human
aaauguaaugcgauuuua

SEQ ID NO: 2812319 - RNA, 18 nt, Human
guauaaauaggagaggau

SEQ ID NO: 2812320 - RNA, 11 nt, Human
guauaaaugua

SEQ ID NO: 2812321 - RNA, 12 nt, Human
guauaaauguau

SEQ ID NO: 2812322 - RNA, 13 nt, Human
guauaaauguaua

SEQ ID NO: 2812323 - RNA, 14 nt, Human
guauaaauguauau

SEQ ID NO: 2812324 - RNA, 16 nt, Human
guauaaauguauauac

SEQ ID NO: 2812325 - RNA, 17 nt, Human
guauaaauguauauaca

SEQ ID NO: 2812326 - RNA, 18 nt, Human
guauaaauguauauacac

SEQ ID NO: 2812327 - RNA, 19 nt, Human
guauaaauguauauacaca

SEQ ID NO: 2812328 - RNA, 21 nt, Human
guauaaauguauauacacaua

SEQ ID NO: 2812329 - RNA, 22 nt, Human
guauaaauguauauacacauau

SEQ ID NO: 2812330 - RNA, 13 nt, Human
guauaaauaggag

SEQ ID NO: 2812331 - RNA, 21 nt, Human
guauaaagcaacuguuaugaa

SEQ ID NO: 2812332 - RNA, 23 nt, Human
guauaaagcaacuguuaugaaau

SEQ ID NO: 2812333 - RNA, 20 nt, Human
guauaaagcaacuguuauga

SEQ ID NO: 2812334 - RNA, 18 nt, Human
guauaaagcaacuguuau

SEQ ID NO: 2812335 - RNA, 13 nt, Human
guauaaagaaaag

SEQ ID NO: 2812336 - RNA, 14 nt, Human
guauaaagaaaagu

SEQ ID NO: 2812337 - RNA, 13 nt, Human
guauaaacuauca

SEQ ID NO: 2812338 - RNA, 17 nt, Human
guauaaacuaucaguuu

SEQ ID NO: 2812339 - RNA, 11 nt, Human
guauaaacauu

SEQ ID NO: 2812340 - RNA, 13 nt, Human
guauaaacauuaa

SEQ ID NO: 2812341 - RNA, 14 nt, Human
guauaaacauuaaa

SEQ ID NO: 2812342 - RNA, 18 nt, Human
guauaaacauuaaauguc

SEQ ID NO: 2812343 - RNA, 19 nt, Human
guauaaacauuaaaugucu

SEQ ID NO: 2812344 - RNA, 21 nt, Human
guaguucuguuuggugugucc

SEQ ID NO: 2812345 - RNA, 17 nt, Human
guauauuacacauuugu

SEQ ID NO: 2812346 - RNA, 18 nt, Human
guauauuacacauuugua

SEQ ID NO: 2812347 - RNA, 22 nt, Human
guauauuacacauuuguacaga

SEQ ID NO: 2812348 - RNA, 20 nt, Human
guauaacuucuuaaaaguug

SEQ ID NO: 2812349 - RNA, 14 nt, Human
guauaagauccuag

SEQ ID NO: 2812350 - RNA, 22 nt, Human
guauaagauccuagauccuaag

SEQ ID NO: 2812351 - RNA, 17 nt, Human
guauaagcacugaaaaa

SEQ ID NO: 2812352 - RNA, 22 nt, Human
guauaagcacugaaaaacaaca

SEQ ID NO: 2812353 - RNA, 18 nt, Human
guauaagauccuagaucc

SEQ ID NO: 2812354 - RNA, 18 nt, Human
guauaacccuguuacaaa

SEQ ID NO: 2812355 - RNA, 14 nt, Human
guauaagaaaugca

SEQ ID NO: 2812356 - RNA, 17 nt, Human
guauaagaaaugcauau

SEQ ID NO: 2812357 - RNA, 15 nt, Human
guauauucauauauu

SEQ ID NO: 2812358 - RNA, 14 nt, Human
guauauuauuuggc

SEQ ID NO: 2812359 - RNA, 15 nt, Human
guauauuauuuggca

SEQ ID NO: 2812360 - RNA, 16 nt, Human
guaugauguguuguga

SEQ ID NO: 2812361 - RNA, 17 nt, Human
guaugauguguugugau

SEQ ID NO: 2812362 - RNA, 13 nt, Human
guaugauguguug

SEQ ID NO: 2812363 - RNA, 13 nt, Human
guauggaaauaaa

SEQ ID NO: 2812364 - RNA, 21 nt, Human
guauggaaaaaccauuugaag

SEQ ID NO: 2812365 - RNA, 14 nt, Human
guauggcucugcac

SEQ ID NO: 2812366 - RNA, 20 nt, Human
guauggcucugcaccccucu

SEQ ID NO: 2812367 - RNA, 21 nt, Human
guauggcucugcaccccucug

SEQ ID NO: 2812368 - RNA, 13 nt, Human
guauggagcucag

SEQ ID NO: 2812369 - RNA, 21 nt, Human
guauggagcagccuggagacc

SEQ ID NO: 2812370 - RNA, 18 nt, Human
guauggagcucagagagg

SEQ ID NO: 2812371 - RNA, 20 nt, Human
guauggauugggggggccaa

SEQ ID NO: 2812372 - RNA, 15 nt, Human
guauggagcucagag

SEQ ID NO: 2812373 - RNA, 21 nt, Human
guaucccaugagccucagcau

SEQ ID NO: 2812374 - RNA, 22 nt, Human
guaucacauuuuaguccagaga

SEQ ID NO: 2812375 - RNA, 19 nt, Human
guaucacgggucacuugaa

SEQ ID NO: 2812376 - RNA, 18 nt, Human
guaucagaagagagggga

SEQ ID NO: 2812377 - RNA, 19 nt, Human
guaucagaauugaaacacu

SEQ ID NO: 2812378 - RNA, 20 nt, Human
guaucagaauugaaacacuu

SEQ ID NO: 2812379 - RNA, 22 nt, Human
guaugaucacggcucacugcag

SEQ ID NO: 2812380 - RNA, 20 nt, Human
guauccccccccuguauagu

SEQ ID NO: 2812381 - RNA, 13 nt, Human
guaucccuucuca

SEQ ID NO: 2812382 - RNA, 17 nt, Human
guaucccuucucacagc

SEQ ID NO: 2812383 - RNA, 18 nt, Human
guaucccuucucacagca

SEQ ID NO: 2812384 - RNA, 19 nt, Human
guaucccuucucacagcac

SEQ ID NO: 2812385 - RNA, 18 nt, Human
guaucccgagucugggac

SEQ ID NO: 2812386 - RNA, 19 nt, Human
guaucccgagucugggaca

SEQ ID NO: 2812387 - RNA, 20 nt, Human
guaucccgagucugggacac

SEQ ID NO: 2812388 - RNA, 12 nt, Human
guauguggaagg

SEQ ID NO: 2812389 - RNA, 14 nt, Human
guauugagauacuu

SEQ ID NO: 2812390 - RNA, 23 nt, Human
guauugagauacuuuuucuuuug

SEQ ID NO: 2812391 - RNA, 15 nt, Human
guauucuuaaaaugc

SEQ ID NO: 2812392 - RNA, 19 nt, Human
guauucuuaaaaugcaaua

SEQ ID NO: 2812393 - RNA, 20 nt, Human
guauucuuaaaaugcaauau

SEQ ID NO: 2812394 - RNA, 15 nt, Human
guauucuucaaccuc

SEQ ID NO: 2812395 - RNA, 16 nt, Human
guauugagauuucuua

SEQ ID NO: 2812396 - RNA, 19 nt, Human
guauggguuaaaucaaaga

SEQ ID NO: 2812397 - RNA, 16 nt, Human
guaugggacuggccuc

SEQ ID NO: 2812398 - RNA, 13 nt, Human
guaugguggcugg

SEQ ID NO: 2812399 - RNA, 13 nt, Human
guauggucuaaca

SEQ ID NO: 2812400 - RNA, 13 nt, Human
guaugucuccagu

SEQ ID NO: 2812401 - RNA, 11 nt, Human
guaugucuguc

SEQ ID NO: 2812402 - RNA, 21 nt, Human
guaugugacaccaaagccacc

SEQ ID NO: 2812403 - RNA, 23 nt, Human
guaugugacaccaaagccaccuc

SEQ ID NO: 2812404 - RNA, 14 nt, Human
guaugugccauuua

SEQ ID NO: 2812405 - RNA, 16 nt, Human
guaugugcuguaauuu

SEQ ID NO: 2812406 - RNA, 11 nt, Human
guaugugccau

SEQ ID NO: 2812407 - RNA, 18 nt, Human
aaaucuaauauuaaaaau

SEQ ID NO: 2812408 - RNA, 19 nt, Human
aaaucuaauauuaaaaaua

SEQ ID NO: 2812409 - RNA, 23 nt, Human
aaauccccaugccuguggcugcg

SEQ ID NO: 2812410 - RNA, 20 nt, Human
aaaucuaaaucuauuuauua

SEQ ID NO: 2812411 - RNA, 17 nt, Human
aaaucuaauauuaaaaa

SEQ ID NO: 2812412 - RNA, 15 nt, Human
aaaucuaaaucuauu

SEQ ID NO: 2812413 - RNA, 16 nt, Human
aaaucuaaaucuauuu

SEQ ID NO: 2812414 - RNA, 17 nt, Human
aaaucuaaaucuauuua

SEQ ID NO: 2812415 - RNA, 15 nt, Human
aaaucuauucugugu

SEQ ID NO: 2812416 - RNA, 19 nt, Human
aaaucuauuuaauuaggaa

SEQ ID NO: 2812417 - RNA, 22 nt, Human
aaaucuauuuaauuaggaaaaa

SEQ ID NO: 2812418 - RNA, 22 nt, Human
aaaucuaguauuucaugcuggg

SEQ ID NO: 2812419 - RNA, 17 nt, Human
aaaugaaaaucgugaca

SEQ ID NO: 2812420 - RNA, 20 nt, Human
aaaugaaaaacaaccaagcg

SEQ ID NO: 2812421 - RNA, 22 nt, Human
aaaucuauuuauuaauauuuaa

SEQ ID NO: 2812422 - RNA, 12 nt, Human
aaaucuauuuau

SEQ ID NO: 2812423 - RNA, 16 nt, Human
aaaucuauuuauuaau

SEQ ID NO: 2812424 - RNA, 17 nt, Human
aaaucuauuuauuaaua

SEQ ID NO: 2812425 - RNA, 19 nt, Human
aaaucuauuuauuaauauu

SEQ ID NO: 2812426 - RNA, 21 nt, Human
aaaugaaacaaauaaucacau

SEQ ID NO: 2812427 - RNA, 11 nt, Human
aaaugaaaauu

SEQ ID NO: 2812428 - RNA, 11 nt, Human
aaaugaaaaua

SEQ ID NO: 2812429 - RNA, 16 nt, Human
aaauccuuccaugaaa

SEQ ID NO: 2812430 - RNA, 15 nt, Human
aaauccuucccaagu

SEQ ID NO: 2812431 - RNA, 22 nt, Human
aaauccuaagacacaaaugcau

SEQ ID NO: 2812432 - RNA, 21 nt, Human
aaauccuaguuuccucuccuu

SEQ ID NO: 2812433 - RNA, 18 nt, Human
aaauccgcucucuuccug

SEQ ID NO: 2812434 - RNA, 19 nt, Human
aaauccgcucucuuccugc

SEQ ID NO: 2812435 - RNA, 14 nt, Human
aaaucccuggauca

SEQ ID NO: 2812436 - RNA, 20 nt, Human
aaauccauaucuuaaagaaa

SEQ ID NO: 2812437 - RNA, 23 nt, Human
aaauccauaucuuaaagaaacag

SEQ ID NO: 2812438 - RNA, 17 nt, Human
aaaucccuguuuaauau

SEQ ID NO: 2812439 - RNA, 22 nt, Human
aaauccugacuauuauguuguu

SEQ ID NO: 2812440 - RNA, 22 nt, Human
aaauccugcaaugaaagguacu

SEQ ID NO: 2812441 - RNA, 16 nt, Human
aaauccugccauuuaa

SEQ ID NO: 2812442 - RNA, 18 nt, Human
aaauccugccauuuaaaa

SEQ ID NO: 2812443 - RNA, 13 nt, Human
aaauccuuccaaa

SEQ ID NO: 2812444 - RNA, 14 nt, Human
guaggcauuuccua

SEQ ID NO: 2812445 - RNA, 18 nt, Human
guaggccuuuuaacauuu

SEQ ID NO: 2812446 - RNA, 19 nt, Human
guaggccuuuuaacauuuu

SEQ ID NO: 2812447 - RNA, 20 nt, Human
guaggccuuuuaacauuuug

SEQ ID NO: 2812448 - RNA, 15 nt, Human
guaggaugaaaagau

SEQ ID NO: 2812449 - RNA, 20 nt, Human
guaggauauuuugucaccag

SEQ ID NO: 2812450 - RNA, 15 nt, Human
guaggaucuaaggcu

SEQ ID NO: 2812451 - RNA, 17 nt, Human
guaggaucuaaggcugu

SEQ ID NO: 2812452 - RNA, 14 nt, Human
guaggagcugccuu

SEQ ID NO: 2812453 - RNA, 22 nt, Human
guaggagcugccuuggcucaga

SEQ ID NO: 2812454 - RNA, 23 nt, Human
guaggagcugccuuggcucagac

SEQ ID NO: 2812455 - RNA, 22 nt, Human
guaggacuuuggugguuuaaaa

SEQ ID NO: 2812456 - RNA, 14 nt, Human
guaggaaagggcaa

SEQ ID NO: 2812457 - RNA, 12 nt, Human
guagcuuugcuc

SEQ ID NO: 2812458 - RNA, 14 nt, Human
guaggaaaaaaaua

SEQ ID NO: 2812459 - RNA, 15 nt, Human
guaggaaaaaaauag

SEQ ID NO: 2812460 - RNA, 17 nt, Human
guagcuuaccagaagcu

SEQ ID NO: 2812461 - RNA, 17 nt, Human
guagcuuucccaaauaa

SEQ ID NO: 2812462 - RNA, 14 nt, Human
guagcuugcucccu

SEQ ID NO: 2812463 - RNA, 19 nt, Human
guagcuugcucccuguguc

SEQ ID NO: 2812464 - RNA, 21 nt, Human
guagcugggacuacaggcacc

SEQ ID NO: 2812465 - RNA, 18 nt, Human
guagcugggauuacaggc

SEQ ID NO: 2812466 - RNA, 16 nt, Human
guagcuguaaaacgcu

SEQ ID NO: 2812467 - RNA, 21 nt, Human
guagcugggauuacaggugug

SEQ ID NO: 2812468 - RNA, 16 nt, Human
guagcugggauuuuaa

SEQ ID NO: 2812469 - RNA, 17 nt, Human
guagcugggauuuuaaa

SEQ ID NO: 2812470 - RNA, 22 nt, Human
guagcugggauuuuaaacuaga

SEQ ID NO: 2812471 - RNA, 24 nt, Human
guagcugggauuuuaaacuagaug

SEQ ID NO: 2812472 - RNA, 22 nt, Human
guagcuuaccagaagcuuccau

SEQ ID NO: 2812473 - RNA, 17 nt, Human
guagcuuaccugacaca

SEQ ID NO: 2812474 - RNA, 18 nt, Human
guagcuuaccugacacaa

SEQ ID NO: 2812475 - RNA, 19 nt, Human
guagcuuaccugacacaag

SEQ ID NO: 2812476 - RNA, 22 nt, Human
guagcuuaccugacacaagagg

SEQ ID NO: 2812477 - RNA, 19 nt, Human
guagcugggacuacaggca

SEQ ID NO: 2812478 - RNA, 18 nt, Human
guagcugggacuacaggc

SEQ ID NO: 2812479 - RNA, 12 nt, Human
guagcugggacu

SEQ ID NO: 2812480 - RNA, 17 nt, Human
guagcuggauuacaggc

SEQ ID NO: 2812481 - RNA, 16 nt, Human
aaaggaggcaugccuc

SEQ ID NO: 2812482 - RNA, 18 nt, Human
aaaggaggcaugccucug

SEQ ID NO: 2812483 - RNA, 14 nt, Human
aaaggaggcuggca

SEQ ID NO: 2812484 - RNA, 13 nt, Human
aaaggaggcuggc

SEQ ID NO: 2812485 - RNA, 16 nt, Human
aaaggagucaaaacua

SEQ ID NO: 2812486 - RNA, 19 nt, Human
aaaggagagaagagagaaa

SEQ ID NO: 2812487 - RNA, 22 nt, Human
aaaggagagacucccaugaagc

SEQ ID NO: 2812488 - RNA, 23 nt, Human
aaaggagagacucccaugaagcc

SEQ ID NO: 2812489 - RNA, 19 nt, Human
aaaggagacaaguuccaug

SEQ ID NO: 2812490 - RNA, 20 nt, Human
aaaggagacaaguuccaugg

SEQ ID NO: 2812491 - RNA, 13 nt, Human
aaaggacuguaau

SEQ ID NO: 2812492 - RNA, 18 nt, Human
aaaggauaguauuuuuau

SEQ ID NO: 2812493 - RNA, 21 nt, Human
aaaggauaguauuuuuaucca

SEQ ID NO: 2812494 - RNA, 17 nt, Human
aaagcgauauacagaug

SEQ ID NO: 2812495 - RNA, 21 nt, Human
aaaggauagaucaaagucaaa

SEQ ID NO: 2812496 - RNA, 20 nt, Human
aaaggaugaucaaaaauaau

SEQ ID NO: 2812497 - RNA, 14 nt, Human
guagcugccacuug

SEQ ID NO: 2812498 - RNA, 23 nt, Human
guagcugccacuugaacaaaauc

SEQ ID NO: 2812499 - RNA, 14 nt, Human
aaaugaaagaugau

SEQ ID NO: 2812500 - RNA, 15 nt, Human
aaaugaaagaugauu

SEQ ID NO: 2812501 - RNA, 20 nt, Human
aaaugaaagaugauuugcaa

SEQ ID NO: 2812502 - RNA, 13 nt, Human
aaaugaaauauuu

SEQ ID NO: 2812503 - RNA, 18 nt, Human
aaaugaagcagcuuuaaa

SEQ ID NO: 2812504 - RNA, 11 nt, Human
aaaugaagugc

SEQ ID NO: 2812505 - RNA, 12 nt, Human
aaaugaaauugu

SEQ ID NO: 2812506 - RNA, 14 nt, Human
aaaugaaauuguaa

SEQ ID NO: 2812507 - RNA, 15 nt, Human
aaaugaaauuguaaa

SEQ ID NO: 2812508 - RNA, 11 nt, Human
aaaugaaauuu

SEQ ID NO: 2812509 - RNA, 13 nt, Human
aaaugaaauuuaa

SEQ ID NO: 2812510 - RNA, 15 nt, Human
aaaugaaauuuaaac

SEQ ID NO: 2812511 - RNA, 16 nt, Human
aaaugaaauuuaaaca

SEQ ID NO: 2812512 - RNA, 17 nt, Human
aaaugaaauuuaaacau

SEQ ID NO: 2812513 - RNA, 19 nt, Human
aaaugaaauuuaaacauua

SEQ ID NO: 2812514 - RNA, 17 nt, Human
aaaugacuacuuagcau

SEQ ID NO: 2812515 - RNA, 21 nt, Human
aaaugacuacuuagcauccua

SEQ ID NO: 2812516 - RNA, 22 nt, Human
aaaugacuacuuagcauccuaa

SEQ ID NO: 2812517 - RNA, 20 nt, Human
aaaugaccucuguccucccu

SEQ ID NO: 2812518 - RNA, 14 nt, Human
aaaugacaucuuuu

SEQ ID NO: 2812519 - RNA, 15 nt, Human
aaaugacaucuuuuu

SEQ ID NO: 2812520 - RNA, 16 nt, Human
aaaugacaucuuuuua

SEQ ID NO: 2812521 - RNA, 17 nt, Human
aaaugacaucuuuuuaa

SEQ ID NO: 2812522 - RNA, 20 nt, Human
aaaugacaucuuuuuaaagc

SEQ ID NO: 2812523 - RNA, 21 nt, Human
aaaugacaucuuuuuaaagcu

SEQ ID NO: 2812524 - RNA, 22 nt, Human
aaaugacaucuuuuuaaagcuu

SEQ ID NO: 2812525 - RNA, 14 nt, Human
aaaugacaugcacu

SEQ ID NO: 2812526 - RNA, 17 nt, Human
aaaugacaugcacugac

SEQ ID NO: 2812527 - RNA, 19 nt, Human
aaaugacaugcacugaccc

SEQ ID NO: 2812528 - RNA, 15 nt, Human
aaaugacagacugaa

SEQ ID NO: 2812529 - RNA, 16 nt, Human
aaaugaauaucuauua

SEQ ID NO: 2812530 - RNA, 20 nt, Human
aaaugaagugcaaauuugau

SEQ ID NO: 2812531 - RNA, 17 nt, Human
aaaugaauaucuauuaa

SEQ ID NO: 2812532 - RNA, 18 nt, Human
aaaugaauaucuauuaau

SEQ ID NO: 2812533 - RNA, 19 nt, Human
aaaugaauaucuauuaaua

SEQ ID NO: 2812534 - RNA, 14 nt, Human
aaaugaauauuuug

SEQ ID NO: 2812535 - RNA, 15 nt, Human
aaaugaauauuuuga

SEQ ID NO: 2812536 - RNA, 16 nt, Human
aaaugaauauuuugau

SEQ ID NO: 2812537 - RNA, 18 nt, Human
aaaugaauauuuugauaa

SEQ ID NO: 2812538 - RNA, 19 nt, Human
aaaugaauauuuugauaau

SEQ ID NO: 2812539 - RNA, 11 nt, Human
aaaugaaugag

SEQ ID NO: 2812540 - RNA, 19 nt, Human
aaaugaaugucuaaaauug

SEQ ID NO: 2812541 - RNA, 15 nt, Human
aaaugagugugaagg

SEQ ID NO: 2812542 - RNA, 15 nt, Human
aaaugaggucuguuu

SEQ ID NO: 2812543 - RNA, 16 nt, Human
aaaugaggucuguuua

SEQ ID NO: 2812544 - RNA, 21 nt, Human
aaaugaggucuguuuaaagug

SEQ ID NO: 2812545 - RNA, 14 nt, Human
aaaugaguugugaa

SEQ ID NO: 2812546 - RNA, 15 nt, Human
aaaugaguugugaaa

SEQ ID NO: 2812547 - RNA, 19 nt, Human
aaaugaguugugaaaguuu

SEQ ID NO: 2812548 - RNA, 23 nt, Human
aaaugaguugugaaaguuuugag

SEQ ID NO: 2812549 - RNA, 13 nt, Human
aaaugauagauuu

SEQ ID NO: 2812550 - RNA, 15 nt, Human
aaaugauagauuuga

SEQ ID NO: 2812551 - RNA, 19 nt, Human
aaaugauagauuugaccuc

SEQ ID NO: 2812552 - RNA, 20 nt, Human
aaaugauagauuugaccucc

SEQ ID NO: 2812553 - RNA, 21 nt, Human
aaaugauagauuugaccuccu

SEQ ID NO: 2812554 - RNA, 21 nt, Human
aaaugauaguugauuuucaaa

SEQ ID NO: 2812555 - RNA, 19 nt, Human
aaaugaggucagagccugc

SEQ ID NO: 2812556 - RNA, 17 nt, Human
aaaugaggucagagccu

SEQ ID NO: 2812557 - RNA, 18 nt, Human
aaaugaggauuauugaua

SEQ ID NO: 2812558 - RNA, 16 nt, Human
aaaugaggacauguuu

SEQ ID NO: 2812559 - RNA, 14 nt, Human
aaaugaggacaugu

SEQ ID NO: 2812560 - RNA, 21 nt, Human
aaaugagaaggcagccaccag

SEQ ID NO: 2812561 - RNA, 17 nt, Human
aaaugccauaauacaaa

SEQ ID NO: 2812562 - RNA, 19 nt, Human
aaaugccauaauacaaaag

SEQ ID NO: 2812563 - RNA, 20 nt, Human
aaaugccauaauacaaaagg

SEQ ID NO: 2812564 - RNA, 23 nt, Human
aaaugccauaauacaaaaggcuc

SEQ ID NO: 2812565 - RNA, 22 nt, Human
aaaugccauuuauuuauugauu

SEQ ID NO: 2812566 - RNA, 21 nt, Human
aaaugccauuuauuuauugau

SEQ ID NO: 2812567 - RNA, 20 nt, Human
aaaugccauuuauuuauuga

SEQ ID NO: 2812568 - RNA, 14 nt, Human
aaaugcaugaacaa

SEQ ID NO: 2812569 - RNA, 19 nt, Human
aaaugccauuuauuuauug

SEQ ID NO: 2812570 - RNA, 15 nt, Human
aaaugccuaauaaac

SEQ ID NO: 2812571 - RNA, 15 nt, Human
aaaugccuaguuuuu

SEQ ID NO: 2812572 - RNA, 16 nt, Human
aaaugccuaguuuuua

SEQ ID NO: 2812573 - RNA, 19 nt, Human
aaaugccuaguuuuuagua

SEQ ID NO: 2812574 - RNA, 13 nt, Human
aaaugggaacauu

SEQ ID NO: 2812575 - RNA, 21 nt, Human
aaaugggaacauuuauuuuau

SEQ ID NO: 2812576 - RNA, 15 nt, Human
aaaugccuuaaaaug

SEQ ID NO: 2812577 - RNA, 17 nt, Human
aaaugccuuaaaaugga

SEQ ID NO: 2812578 - RNA, 18 nt, Human
aaaugccuuaaaauggaa

SEQ ID NO: 2812579 - RNA, 15 nt, Human
aaaugcaauauuugu

SEQ ID NO: 2812580 - RNA, 11 nt, Human
aaaugcaauau

SEQ ID NO: 2812581 - RNA, 15 nt, Human
aaaugcaaaguucug

SEQ ID NO: 2812582 - RNA, 17 nt, Human
aaaugcaaaguucugug

SEQ ID NO: 2812583 - RNA, 19 nt, Human
aaaugcaaaguucuguguu

SEQ ID NO: 2812584 - RNA, 23 nt, Human
aaaugauguucauuuagauugaa

SEQ ID NO: 2812585 - RNA, 15 nt, Human
aaaugauucuuagug

SEQ ID NO: 2812586 - RNA, 22 nt, Human
aaaugauccccaagugugaaca

SEQ ID NO: 2812587 - RNA, 15 nt, Human
aaaugauuguaaaau

SEQ ID NO: 2812588 - RNA, 22 nt, Human
aaaugauuguaaaauagcuugu

SEQ ID NO: 2812589 - RNA, 21 nt, Human
aaaugauuuguaguggaaaca

SEQ ID NO: 2812590 - RNA, 23 nt, Human
aaaugauuuuuacaaguuuuaaa

SEQ ID NO: 2812591 - RNA, 12 nt, Human
aaaugcagccca

SEQ ID NO: 2812592 - RNA, 13 nt, Human
aaaugcagcccau

SEQ ID NO: 2812593 - RNA, 21 nt, Human
aaaugcagcccauuucuccag

SEQ ID NO: 2812594 - RNA, 22 nt, Human
aaaugcagcccauuucuccaga

SEQ ID NO: 2812595 - RNA, 22 nt, Human
aaaugcagggauugcugccacu

SEQ ID NO: 2812596 - RNA, 14 nt, Human
aaaugcaguauauu

SEQ ID NO: 2812597 - RNA, 18 nt, Human
aaaugcaguauauuucuu

SEQ ID NO: 2812598 - RNA, 15 nt, Human
aaaugcauaaaugca

SEQ ID NO: 2812599 - RNA, 20 nt, Human
aaaugcauuauaggaucauu

SEQ ID NO: 2812600 - RNA, 15 nt, Human
aacauuucuguaaau

SEQ ID NO: 2812601 - RNA, 16 nt, Human
aacauuucuguaaaua

SEQ ID NO: 2812602 - RNA, 18 nt, Human
aacauuucuguaaauacc

SEQ ID NO: 2812603 - RNA, 19 nt, Human
aacauuucuguaaauacca

SEQ ID NO: 2812604 - RNA, 20 nt, Human
aacauuucuguaaauaccau

SEQ ID NO: 2812605 - RNA, 12 nt, Human
aacauuugccuu

SEQ ID NO: 2812606 - RNA, 13 nt, Human
aacauuugccuug

SEQ ID NO: 2812607 - RNA, 14 nt, Human
aacauuugccuugc

SEQ ID NO: 2812608 - RNA, 17 nt, Human
aacauuugccuugcaga

SEQ ID NO: 2812609 - RNA, 18 nt, Human
aacauuugccuugcagaa

SEQ ID NO: 2812610 - RNA, 20 nt, Human
aacauuugccuugcagaacu

SEQ ID NO: 2812611 - RNA, 22 nt, Human
aacauuugccuugcagaacugc

SEQ ID NO: 2812612 - RNA, 12 nt, Human
aacauuguauua

SEQ ID NO: 2812613 - RNA, 17 nt, Human
aacauucugauuuggaa

SEQ ID NO: 2812614 - RNA, 14 nt, Human
aacauuuacaugua

SEQ ID NO: 2812615 - RNA, 13 nt, Human
aacauuuacuaca

SEQ ID NO: 2812616 - RNA, 17 nt, Human
aacauuuacuacaguuu

SEQ ID NO: 2812617 - RNA, 19 nt, Human
aacauuuacuacaguuuuu

SEQ ID NO: 2812618 - RNA, 17 nt, Human
aacauuuauuuuaugag

SEQ ID NO: 2812619 - RNA, 19 nt, Human
aacauuuauuuuaugagaa

SEQ ID NO: 2812620 - RNA, 20 nt, Human
aacauuuauuuuaugagaaa

SEQ ID NO: 2812621 - RNA, 21 nt, Human
aacauuuauuuuaugagaaau

SEQ ID NO: 2812622 - RNA, 23 nt, Human
aacauuuauuuuaugagaaaugu

SEQ ID NO: 2812623 - RNA, 15 nt, Human
aacauugugauguau

SEQ ID NO: 2812624 - RNA, 22 nt, Human
aacauugugauguauauuccuu

SEQ ID NO: 2812625 - RNA, 19 nt, Human
aacauuguugcucccugug

SEQ ID NO: 2812626 - RNA, 20 nt, Human
aacauuguugcucccuguga

SEQ ID NO: 2812627 - RNA, 15 nt, Human
aacauuuacaguccu

SEQ ID NO: 2812628 - RNA, 15 nt, Human
aacauaccaacaugu

SEQ ID NO: 2812629 - RNA, 18 nt, Human
aacauucugauuuggaaa

SEQ ID NO: 2812630 - RNA, 21 nt, Human
aacauucuuuuaacuucuuuc

SEQ ID NO: 2812631 - RNA, 16 nt, Human
aacauucugauuugga

SEQ ID NO: 2812632 - RNA, 20 nt, Human
aacauugagauuaugaugaa

SEQ ID NO: 2812633 - RNA, 18 nt, Human
guccucuggagcccuaac

SEQ ID NO: 2812634 - RNA, 13 nt, Human
guccucuggagcc

SEQ ID NO: 2812635 - RNA, 17 nt, Human
guccucugaaugaaccu

SEQ ID NO: 2812636 - RNA, 13 nt, Human
guccucugaauga

SEQ ID NO: 2812637 - RNA, 12 nt, Human
aacauuugugau

SEQ ID NO: 2812638 - RNA, 13 nt, Human
aacauuugugaua

SEQ ID NO: 2812639 - RNA, 22 nt, Human
aacauuugugauauauguauua

SEQ ID NO: 2812640 - RNA, 15 nt, Human
aacauuuguguguua

SEQ ID NO: 2812641 - RNA, 17 nt, Human
aacauuuguguguuaua

SEQ ID NO: 2812642 - RNA, 17 nt, Human
guccucuccccuccagc

SEQ ID NO: 2812643 - RNA, 18 nt, Human
guccucuccccuccagcc

SEQ ID NO: 2812644 - RNA, 19 nt, Human
guccucuccccuccagccu

SEQ ID NO: 2812645 - RNA, 20 nt, Human
guccucuccccuccagccuu

SEQ ID NO: 2812646 - RNA, 21 nt, Human
guccucuccccuccagccuuu

SEQ ID NO: 2812647 - RNA, 20 nt, Human
guccugccuggccaggcaga

SEQ ID NO: 2812648 - RNA, 19 nt, Human
guccugccuggccaggcag

SEQ ID NO: 2812649 - RNA, 17 nt, Human
guccugccugcaauauu

SEQ ID NO: 2812650 - RNA, 14 nt, Human
guccuuccaccucg

SEQ ID NO: 2812651 - RNA, 22 nt, Human
guccuucaaaauccuuccaaag

SEQ ID NO: 2812652 - RNA, 15 nt, Human
guccugccuggccag

SEQ ID NO: 2812653 - RNA, 14 nt, Human
guccugccuggcca

SEQ ID NO: 2812654 - RNA, 13 nt, Human
guccugccuggcc

SEQ ID NO: 2812655 - RNA, 17 nt, Human
guccugccucagccucc

SEQ ID NO: 2812656 - RNA, 15 nt, Human
guccugccucagccu

SEQ ID NO: 2812657 - RNA, 16 nt, Human
guccugccggagagga

SEQ ID NO: 2812658 - RNA, 18 nt, Human
guccugccggagaggaag

SEQ ID NO: 2812659 - RNA, 18 nt, Human
guccugaggguccccacc

SEQ ID NO: 2812660 - RNA, 21 nt, Human
guccugaggguccccaccugg

SEQ ID NO: 2812661 - RNA, 14 nt, Human
aacaguaaaugugc

SEQ ID NO: 2812662 - RNA, 21 nt, Human
aacaggcuguucugcacugaa

SEQ ID NO: 2812663 - RNA, 22 nt, Human
aacaggcuguucugcacugaaa

SEQ ID NO: 2812664 - RNA, 23 nt, Human
aacaggcuguucugcacugaaaa

SEQ ID NO: 2812665 - RNA, 23 nt, Human
aacaggcugggcuucaguggcag

SEQ ID NO: 2812666 - RNA, 13 nt, Human
aacaggcugggcu

SEQ ID NO: 2812667 - RNA, 22 nt, Human
aacaggcugggcuucaguggca

SEQ ID NO: 2812668 - RNA, 19 nt, Human
aacagacuggaagcacagc

SEQ ID NO: 2812669 - RNA, 19 nt, Human
aacagacucgauucauauu

SEQ ID NO: 2812670 - RNA, 22 nt, Human
aacaguugugaaccaagaucua

SEQ ID NO: 2812671 - RNA, 20 nt, Human
aacagugcuugccacagagc

SEQ ID NO: 2812672 - RNA, 19 nt, Human
aacagaaagucauuccuuc

SEQ ID NO: 2812673 - RNA, 16 nt, Human
aacagaaacaaaaaca

SEQ ID NO: 2812674 - RNA, 13 nt, Human
aacagaacagcuu

SEQ ID NO: 2812675 - RNA, 14 nt, Human
aacagaacagcuuc

SEQ ID NO: 2812676 - RNA, 15 nt, Human
aacagaacagcuuca

SEQ ID NO: 2812677 - RNA, 16 nt, Human
aacagaacagcuucag

SEQ ID NO: 2812678 - RNA, 11 nt, Human
aacagaacagg

SEQ ID NO: 2812679 - RNA, 12 nt, Human
aacagaacaggg

SEQ ID NO: 2812680 - RNA, 13 nt, Human
aacagaacagggu

SEQ ID NO: 2812681 - RNA, 14 nt, Human
aacagaacaggguc

SEQ ID NO: 2812682 - RNA, 17 nt, Human
aacagaacagggucaug

SEQ ID NO: 2812683 - RNA, 20 nt, Human
aacagaacaucauuagaaca

SEQ ID NO: 2812684 - RNA, 16 nt, Human
guccggaaugccaccc

SEQ ID NO: 2812685 - RNA, 18 nt, Human
guccggacacuccuagag

SEQ ID NO: 2812686 - RNA, 19 nt, Human
guccggacccaccucaccc

SEQ ID NO: 2812687 - RNA, 22 nt, Human
guccgcugggugguacccucug

SEQ ID NO: 2812688 - RNA, 14 nt, Human
aacagaaaacauuc

SEQ ID NO: 2812689 - RNA, 19 nt, Human
aacagaaaacauucugauu

SEQ ID NO: 2812690 - RNA, 13 nt, Human
aacagaaacaaaa

SEQ ID NO: 2812691 - RNA, 19 nt, Human
aacacuuucucuucuuguu

SEQ ID NO: 2812692 - RNA, 17 nt, Human
aacacuuugccuccugu

SEQ ID NO: 2812693 - RNA, 13 nt, Human
aacacuuuuuugg

SEQ ID NO: 2812694 - RNA, 18 nt, Human
aacacuuuuuugggggua

SEQ ID NO: 2812695 - RNA, 17 nt, Human
guccggacacuccuaga

SEQ ID NO: 2812696 - RNA, 15 nt, Human
guccgauaauaucuu

SEQ ID NO: 2812697 - RNA, 16 nt, Human
gucccaaggaaagccc

SEQ ID NO: 2812698 - RNA, 15 nt, Human
gucccaacuuguaaa

SEQ ID NO: 2812699 - RNA, 18 nt, Human
guccauuuuucuuccagg

SEQ ID NO: 2812700 - RNA, 19 nt, Human
gucccaaauccuucccaag

SEQ ID NO: 2812701 - RNA, 21 nt, Human
aaauuuuucucaguuuguaua

SEQ ID NO: 2812702 - RNA, 22 nt, Human
aacaagaccaccacuucgaaac

SEQ ID NO: 2812703 - RNA, 15 nt, Human
gucacaggcaggucc

SEQ ID NO: 2812704 - RNA, 13 nt, Human
gucacaggcaggu

SEQ ID NO: 2812705 - RNA, 16 nt, Human
gucacaggcaggucca

SEQ ID NO: 2812706 - RNA, 12 nt, Human
aaauuuuuguaa

SEQ ID NO: 2812707 - RNA, 13 nt, Human
aaauuuuuguaaa

SEQ ID NO: 2812708 - RNA, 14 nt, Human
aaauuuuuguaaau

SEQ ID NO: 2812709 - RNA, 21 nt, Human
aaauuuuucaaccccacccug

SEQ ID NO: 2812710 - RNA, 12 nt, Human
aaauuuuguaau

SEQ ID NO: 2812711 - RNA, 14 nt, Human
aaauuuuguaauga

SEQ ID NO: 2812712 - RNA, 15 nt, Human
aaauuuuguaaugaa

SEQ ID NO: 2812713 - RNA, 18 nt, Human
aaauuuuguaaugaauuc

SEQ ID NO: 2812714 - RNA, 14 nt, Human
aacaaugaagauaa

SEQ ID NO: 2812715 - RNA, 18 nt, Human
aacaaugaagauaaaaag

SEQ ID NO: 2812716 - RNA, 22 nt, Human
aacaauugucgaaaagagucuu

SEQ ID NO: 2812717 - RNA, 15 nt, Human
aacaaugaugcccug

SEQ ID NO: 2812718 - RNA, 19 nt, Human
aacaaugcagcaaggcccu

SEQ ID NO: 2812719 - RNA, 19 nt, Human
aacaaugacacuagaaaac

SEQ ID NO: 2812720 - RNA, 20 nt, Human
aacaaugacacuagaaaacu

SEQ ID NO: 2812721 - RNA, 14 nt, Human
aacaauugugaagu

SEQ ID NO: 2812722 - RNA, 13 nt, Human
aacaauuuaaaaa

SEQ ID NO: 2812723 - RNA, 14 nt, Human
aacaauuuaaaaau

SEQ ID NO: 2812724 - RNA, 19 nt, Human
aacaauuuaaaaaugagug

SEQ ID NO: 2812725 - RNA, 20 nt, Human
aacaauuuccuuuauauuua

SEQ ID NO: 2812726 - RNA, 21 nt, Human
aacaauuuccuuuauauuuag

SEQ ID NO: 2812727 - RNA, 22 nt, Human
aacaauuuccuuuauauuuagu

SEQ ID NO: 2812728 - RNA, 20 nt, Human
aacaauuugggcuuccuguu

SEQ ID NO: 2812729 - RNA, 19 nt, Human
aacaaggggcuguuacaua

SEQ ID NO: 2812730 - RNA, 22 nt, Human
aacaagccugacccuguaaaau

SEQ ID NO: 2812731 - RNA, 23 nt, Human
aacaagcuaauugggaguccagg

SEQ ID NO: 2812732 - RNA, 13 nt, Human
aacaaguaccaaa

SEQ ID NO: 2812733 - RNA, 15 nt, Human
aacaauaaaugugca

SEQ ID NO: 2812734 - RNA, 18 nt, Human
aacaauaggcuguuccca

SEQ ID NO: 2812735 - RNA, 18 nt, Human
aacaauaguaauucucag

SEQ ID NO: 2812736 - RNA, 13 nt, Human
aacaauaucauau

SEQ ID NO: 2812737 - RNA, 18 nt, Human
aacaauaucauaucauca

SEQ ID NO: 2812738 - RNA, 13 nt, Human
aacaaucacacuc

SEQ ID NO: 2812739 - RNA, 17 nt, Human
aacaaucuggaagaaaa

SEQ ID NO: 2812740 - RNA, 20 nt, Human
aacaaucuggaagaaaaaaa

SEQ ID NO: 2812741 - RNA, 16 nt, Human
aacaaggcgaaauccu

SEQ ID NO: 2812742 - RNA, 19 nt, Human
aacaauaaauguuggcuug

SEQ ID NO: 2812743 - RNA, 20 nt, Human
guccaagguuuaaagagucu

SEQ ID NO: 2812744 - RNA, 17 nt, Human
guccaaggaaaccacag

SEQ ID NO: 2812745 - RNA, 22 nt, Human
guccaaggaaaccacagcugcu

SEQ ID NO: 2812746 - RNA, 21 nt, Human
guccaagguuuaaagagucua

SEQ ID NO: 2812747 - RNA, 12 nt, Human
guccaauaagac

SEQ ID NO: 2812748 - RNA, 19 nt, Human
guccauuuauauaugaaaa

SEQ ID NO: 2812749 - RNA, 22 nt, Human
guccauuuauauaugaaaacua

SEQ ID NO: 2812750 - RNA, 23 nt, Human
guccauuuauauaugaaaacuau

SEQ ID NO: 2812751 - RNA, 21 nt, Human
guccauuuauccacaggaaag

SEQ ID NO: 2812752 - RNA, 13 nt, Human
guccauuucuacc

SEQ ID NO: 2812753 - RNA, 13 nt, Human
guccauuuguaaa

SEQ ID NO: 2812754 - RNA, 14 nt, Human
guccauuuguaaaa

SEQ ID NO: 2812755 - RNA, 15 nt, Human
guccauuuguaaaac

SEQ ID NO: 2812756 - RNA, 16 nt, Human
guccauuuguaaaacu

SEQ ID NO: 2812757 - RNA, 14 nt, Human
guccauuuugugaa

SEQ ID NO: 2812758 - RNA, 15 nt, Human
guccauuuugugaag

SEQ ID NO: 2812759 - RNA, 16 nt, Human
guccauuuugugaagc

SEQ ID NO: 2812760 - RNA, 17 nt, Human
guccauuuugugaagcc

SEQ ID NO: 2812761 - RNA, 20 nt, Human
guccauuuugugaagcccug

SEQ ID NO: 2812762 - RNA, 21 nt, Human
guccauuuugugaagcccugu

SEQ ID NO: 2812763 - RNA, 22 nt, Human
guccauuuugugaagcccuguu

SEQ ID NO: 2812764 - RNA, 16 nt, Human
guccaauuuuaauuua

SEQ ID NO: 2812765 - RNA, 18 nt, Human
guccaauuuuaauuuagu

SEQ ID NO: 2812766 - RNA, 12 nt, Human
guccaauguggc

SEQ ID NO: 2812767 - RNA, 13 nt, Human
guccacagcuucc

SEQ ID NO: 2812768 - RNA, 14 nt, Human
guccacagcuuccu

SEQ ID NO: 2812769 - RNA, 19 nt, Human
guccacacccaauuccacu

SEQ ID NO: 2812770 - RNA, 13 nt, Human
guccacagagagg

SEQ ID NO: 2812771 - RNA, 15 nt, Human
guccacaacacacag

SEQ ID NO: 2812772 - RNA, 22 nt, Human
guccaagauuccggauccuaag

SEQ ID NO: 2812773 - RNA, 22 nt, Human
gucauuugcugugaacugaaau

SEQ ID NO: 2812774 - RNA, 16 nt, Human
gucauuuguuaaaaua

SEQ ID NO: 2812775 - RNA, 17 nt, Human
gucauuuguugugaugu

SEQ ID NO: 2812776 - RNA, 21 nt, Human
gucauuuguugugaugucuuu

SEQ ID NO: 2812777 - RNA, 22 nt, Human
gucauuugagcagggcucagcg

SEQ ID NO: 2812778 - RNA, 16 nt, Human
gucauuugcucugccu

SEQ ID NO: 2812779 - RNA, 21 nt, Human
gucauuugagcagggcucagc

SEQ ID NO: 2812780 - RNA, 11 nt, Human
aacacuuccau

SEQ ID NO: 2812781 - RNA, 14 nt, Human
aacacuucuguccu

SEQ ID NO: 2812782 - RNA, 17 nt, Human
aacacuucuguccugug

SEQ ID NO: 2812783 - RNA, 19 nt, Human
aacacuucuguccugugag

SEQ ID NO: 2812784 - RNA, 21 nt, Human
aacacuucuguccugugaggu

SEQ ID NO: 2812785 - RNA, 13 nt, Human
aacacuugaaccu

SEQ ID NO: 2812786 - RNA, 22 nt, Human
aacacuugcccaugcuauuugu

SEQ ID NO: 2812787 - RNA, 13 nt, Human
aacacuuggugcu

SEQ ID NO: 2812788 - RNA, 20 nt, Human
aacacuuggugcugggaacc

SEQ ID NO: 2812789 - RNA, 15 nt, Human
aacacuucaauaauu

SEQ ID NO: 2812790 - RNA, 12 nt, Human
aacacuguggaa

SEQ ID NO: 2812791 - RNA, 20 nt, Human
aacacuguggaacuaauaaa

SEQ ID NO: 2812792 - RNA, 18 nt, Human
aacacuguggguguguga

SEQ ID NO: 2812793 - RNA, 12 nt, Human
aacacugugaaa

SEQ ID NO: 2812794 - RNA, 15 nt, Human
aacacugccuuuuua

SEQ ID NO: 2812795 - RNA, 14 nt, Human
aacacugccuuuuu

SEQ ID NO: 2812796 - RNA, 14 nt, Human
aacacugcaggcau

SEQ ID NO: 2812797 - RNA, 22 nt, Human
aacacugccaucuuaguuugga

SEQ ID NO: 2812798 - RNA, 12 nt, Human
aacacugcccuc

SEQ ID NO: 2812799 - RNA, 21 nt, Human
aacacugcccucgcacggccc

SEQ ID NO: 2812800 - RNA, 23 nt, Human
aacacugccuuuuuauuuauaug

SEQ ID NO: 2812801 - RNA, 15 nt, Human
aacacugagcuguca

SEQ ID NO: 2812802 - RNA, 19 nt, Human
aacacucuuuugcuuuauu

SEQ ID NO: 2812803 - RNA, 15 nt, Human
aacacugaaaaauua

SEQ ID NO: 2812804 - RNA, 16 nt, Human
aacacucuuuugcuuu

SEQ ID NO: 2812805 - RNA, 13 nt, Human
aacacucuauauu

SEQ ID NO: 2812806 - RNA, 12 nt, Human
aacacucuuuug

SEQ ID NO: 2812807 - RNA, 12 nt, Human
aacaauuuucuu

SEQ ID NO: 2812808 - RNA, 18 nt, Human
aacaauuuucuugugaca

SEQ ID NO: 2812809 - RNA, 15 nt, Human
aacacaaaccacaac

SEQ ID NO: 2812810 - RNA, 16 nt, Human
aacacuccuugcauca

SEQ ID NO: 2812811 - RNA, 13 nt, Human
aacuccagcaacu

SEQ ID NO: 2812812 - RNA, 16 nt, Human
aacucccaucaccucu

SEQ ID NO: 2812813 - RNA, 19 nt, Human
aacuccccuuccucacugc

SEQ ID NO: 2812814 - RNA, 16 nt, Human
aacuccccuguuucaa

SEQ ID NO: 2812815 - RNA, 17 nt, Human
aacuccccuguuucaau

SEQ ID NO: 2812816 - RNA, 19 nt, Human
aacuccccuguuucaauca

SEQ ID NO: 2812817 - RNA, 22 nt, Human
aacuccccuguuucaaucacug

SEQ ID NO: 2812818 - RNA, 19 nt, Human
aacucccugccccccagcc

SEQ ID NO: 2812819 - RNA, 13 nt, Human
aacucccugcccc

SEQ ID NO: 2812820 - RNA, 23 nt, Human
aacuccccuuccucacugcccaa

SEQ ID NO: 2812821 - RNA, 15 nt, Human
aacucuacuguguaa

SEQ ID NO: 2812822 - RNA, 19 nt, Human
gugaaccaccacacccagc

SEQ ID NO: 2812823 - RNA, 19 nt, Human
gugaacaggcugggcugcu

SEQ ID NO: 2812824 - RNA, 14 nt, Human
aacucuaucugggc

SEQ ID NO: 2812825 - RNA, 18 nt, Human
aacucuaucugggccugg

SEQ ID NO: 2812826 - RNA, 23 nt, Human
gucuuuucuuggcaaaagccuug

SEQ ID NO: 2812827 - RNA, 19 nt, Human
aaccuggaaaaauuccaga

SEQ ID NO: 2812828 - RNA, 20 nt, Human
aaccugcucuccucuugcca

SEQ ID NO: 2812829 - RNA, 11 nt, Human
aaccugcucuc

SEQ ID NO: 2812830 - RNA, 15 nt, Human
aaccugcucuccucu

SEQ ID NO: 2812831 - RNA, 14 nt, Human
aacuaaauuugaua

SEQ ID NO: 2812832 - RNA, 16 nt, Human
aacuaaauuugauacu

SEQ ID NO: 2812833 - RNA, 17 nt, Human
aacuaaauuugauacuu

SEQ ID NO: 2812834 - RNA, 19 nt, Human
aacuaaauuugauacuuau

SEQ ID NO: 2812835 - RNA, 20 nt, Human
aacuaaauuugauacuuaua

SEQ ID NO: 2812836 - RNA, 21 nt, Human
aacuaaauuugauacuuauau

SEQ ID NO: 2812837 - RNA, 23 nt, Human
aacuaauccuucuggcagauuca

SEQ ID NO: 2812838 - RNA, 19 nt, Human
aacuaacacgugaugugau

SEQ ID NO: 2812839 - RNA, 13 nt, Human
aacuaaauguucu

SEQ ID NO: 2812840 - RNA, 14 nt, Human
aacuaaauguucua

SEQ ID NO: 2812841 - RNA, 18 nt, Human
aacuaaauguucuauggu

SEQ ID NO: 2812842 - RNA, 19 nt, Human
aacuaaagaagaucuguaa

SEQ ID NO: 2812843 - RNA, 22 nt, Human
aacuacagaccugcuuuuugaa

SEQ ID NO: 2812844 - RNA, 13 nt, Human
aacuacaaaucaa

SEQ ID NO: 2812845 - RNA, 13 nt, Human
aacuacaugagaa

SEQ ID NO: 2812846 - RNA, 15 nt, Human
aacuagaugaccuca

SEQ ID NO: 2812847 - RNA, 17 nt, Human
aacuagaugaccucauu

SEQ ID NO: 2812848 - RNA, 18 nt, Human
aacuagaugaccucauua

SEQ ID NO: 2812849 - RNA, 18 nt, Human
aacuaauugacuuuagaa

SEQ ID NO: 2812850 - RNA, 20 nt, Human
aacuaauugacuuuagaaag

SEQ ID NO: 2812851 - RNA, 13 nt, Human
gucuuaauuauua

SEQ ID NO: 2812852 - RNA, 18 nt, Human
gucuuaauuauuauuugu

SEQ ID NO: 2812853 - RNA, 21 nt, Human
gucuuaauuauuauuuguguu

SEQ ID NO: 2812854 - RNA, 20 nt, Human
gucuuaauuucuaucuuguu

SEQ ID NO: 2812855 - RNA, 22 nt, Human
gucuuaauuuuugaaaaaagua

SEQ ID NO: 2812856 - RNA, 17 nt, Human
gucugggcuagguagaa

SEQ ID NO: 2812857 - RNA, 20 nt, Human
gucugggaggaauggacaga

SEQ ID NO: 2812858 - RNA, 15 nt, Human
gucuggcuucacaga

SEQ ID NO: 2812859 - RNA, 18 nt, Human
gucugggaaaugagcagg

SEQ ID NO: 2812860 - RNA, 22 nt, Human
gucugggaaaugagcagggaug

SEQ ID NO: 2812861 - RNA, 14 nt, Human
gucugggacacaaa

SEQ ID NO: 2812862 - RNA, 17 nt, Human
aaccucuucuggcucaa

SEQ ID NO: 2812863 - RNA, 23 nt, Human
gucugcucagacagaaccccuac

SEQ ID NO: 2812864 - RNA, 12 nt, Human
aaccucuucccc

SEQ ID NO: 2812865 - RNA, 11 nt, Human
aaccucuuccc

SEQ ID NO: 2812866 - RNA, 14 nt, Human
aaccucuuccccag

SEQ ID NO: 2812867 - RNA, 21 nt, Human
aaccucuccucauguucugcu

SEQ ID NO: 2812868 - RNA, 16 nt, Human
aaccucuacauauuua

SEQ ID NO: 2812869 - RNA, 20 nt, Human
aaccucugccuccuggguuc

SEQ ID NO: 2812870 - RNA, 16 nt, Human
aaccucugcuucccag

SEQ ID NO: 2812871 - RNA, 18 nt, Human
aaccucugcuucccaggu

SEQ ID NO: 2812872 - RNA, 20 nt, Human
aaccucugcuucccagguuc

SEQ ID NO: 2812873 - RNA, 13 nt, Human
aaccucugucuca

SEQ ID NO: 2812874 - RNA, 14 nt, Human
aaccucugucucau

SEQ ID NO: 2812875 - RNA, 16 nt, Human
aaccucugucucaucc

SEQ ID NO: 2812876 - RNA, 13 nt, Human
gucugcugaggag

SEQ ID NO: 2812877 - RNA, 13 nt, Human
aaccucucacucc

SEQ ID NO: 2812878 - RNA, 17 nt, Human
gucugcuccuuuccccu

SEQ ID NO: 2812879 - RNA, 21 nt, Human
gucugcucuagaugagcuggg

SEQ ID NO: 2812880 - RNA, 18 nt, Human
gucuuuggaaaaauguuu

SEQ ID NO: 2812881 - RNA, 19 nt, Human
gucuuuggaaaaauguuug

SEQ ID NO: 2812882 - RNA, 20 nt, Human
gucuuuggaaaaauguuugu

SEQ ID NO: 2812883 - RNA, 14 nt, Human
gucuuuugaauauu

SEQ ID NO: 2812884 - RNA, 19 nt, Human
gucuuaauuauuauuugug

SEQ ID NO: 2812885 - RNA, 16 nt, Human
gucuucccuaccucag

SEQ ID NO: 2812886 - RNA, 17 nt, Human
gucuuauauagcagcaa

SEQ ID NO: 2812887 - RNA, 15 nt, Human
gucuucccuaccuca

SEQ ID NO: 2812888 - RNA, 18 nt, Human
gucuuccugaaaugcagu

SEQ ID NO: 2812889 - RNA, 21 nt, Human
gucuucccuaccucaggcagg

SEQ ID NO: 2812890 - RNA, 18 nt, Human
gucuucccuaccucaggc

SEQ ID NO: 2812891 - RNA, 19 nt, Human
gucuucccucuucccucag

SEQ ID NO: 2812892 - RNA, 17 nt, Human
gucuuccgccccugccu

SEQ ID NO: 2812893 - RNA, 19 nt, Human
gucuuccgccccugccugc

SEQ ID NO: 2812894 - RNA, 21 nt, Human
gucuuccgccccugccugcca

SEQ ID NO: 2812895 - RNA, 23 nt, Human
gucuuccgccccugccugccaug

SEQ ID NO: 2812896 - RNA, 18 nt, Human
aaccacaucuugcucugc

SEQ ID NO: 2812897 - RNA, 16 nt, Human
aaccaauuccucaucc

SEQ ID NO: 2812898 - RNA, 17 nt, Human
aaccaauuccucauccu

SEQ ID NO: 2812899 - RNA, 22 nt, Human
aaccaauuccucauccucagau

SEQ ID NO: 2812900 - RNA, 18 nt, Human
aaccaauuuucaaaguuc

SEQ ID NO: 2812901 - RNA, 20 nt, Human
aaccaauuuuuuguucuuca

SEQ ID NO: 2812902 - RNA, 21 nt, Human
aaccaauuuuuuguucuucag

SEQ ID NO: 2812903 - RNA, 22 nt, Human
aaccacaaaaaaauaccucagg

SEQ ID NO: 2812904 - RNA, 11 nt, Human
aaccacaaagg

SEQ ID NO: 2812905 - RNA, 15 nt, Human
aaccacaaaggccaa

SEQ ID NO: 2812906 - RNA, 20 nt, Human
aaccacaaaggccaaacugc

SEQ ID NO: 2812907 - RNA, 21 nt, Human
aaccacaaaggccaaacugcu

SEQ ID NO: 2812908 - RNA, 14 nt, Human
aaccacaacugaca

SEQ ID NO: 2812909 - RNA, 16 nt, Human
aaccacaacugacaca

SEQ ID NO: 2812910 - RNA, 17 nt, Human
aaccacaacugacacag

SEQ ID NO: 2812911 - RNA, 20 nt, Human
aaccacaacugacacaggaa

SEQ ID NO: 2812912 - RNA, 15 nt, Human
aaccacacaaagaca

SEQ ID NO: 2812913 - RNA, 15 nt, Human
aaccacacaccucac

SEQ ID NO: 2812914 - RNA, 21 nt, Human
aaccaaaagaacaagaauuuc

SEQ ID NO: 2812915 - RNA, 11 nt, Human
aaccaaaauga

SEQ ID NO: 2812916 - RNA, 16 nt, Human
aaccaaaaugacaucu

SEQ ID NO: 2812917 - RNA, 17 nt, Human
aaccaaaaugacaucuu

SEQ ID NO: 2812918 - RNA, 20 nt, Human
aaccaaaaugacaucuuuuu

SEQ ID NO: 2812919 - RNA, 21 nt, Human
aaccaaaaugacaucuuuuua

SEQ ID NO: 2812920 - RNA, 22 nt, Human
aaccaaaaugacaucuuuuuaa

SEQ ID NO: 2812921 - RNA, 14 nt, Human
aaccaaaaugauac

SEQ ID NO: 2812922 - RNA, 13 nt, Human
aaccaaacaauua

SEQ ID NO: 2812923 - RNA, 13 nt, Human
aaccaaaggacau

SEQ ID NO: 2812924 - RNA, 16 nt, Human
aaccaaaggacauuau

SEQ ID NO: 2812925 - RNA, 22 nt, Human
aaccacaucuugcucugcugac

SEQ ID NO: 2812926 - RNA, 20 nt, Human
aaccacaucuugcucugcug

SEQ ID NO: 2812927 - RNA, 14 nt, Human
aacauuuuguucuu

SEQ ID NO: 2812928 - RNA, 15 nt, Human
aacauuuuguucuua

SEQ ID NO: 2812929 - RNA, 18 nt, Human
aacauuuuguucuuacac

SEQ ID NO: 2812930 - RNA, 20 nt, Human
aacauuuuguucuuacacau

SEQ ID NO: 2812931 - RNA, 21 nt, Human
aacauuuuguucuuacacaua

SEQ ID NO: 2812932 - RNA, 23 nt, Human
aacauuuuguucuuacacauaca

SEQ ID NO: 2812933 - RNA, 15 nt, Human
aacauuuuucaacaa

SEQ ID NO: 2812934 - RNA, 22 nt, Human
aacauuuuucaacaaauaucuu

SEQ ID NO: 2812935 - RNA, 19 nt, Human
aacauuuuugauaaagccu

SEQ ID NO: 2812936 - RNA, 19 nt, Human
aacauuuuuuuuuuaaauc

SEQ ID NO: 2812937 - RNA, 23 nt, Human
aacauuuuuuuuuuaaaucaagu

SEQ ID NO: 2812938 - RNA, 14 nt, Human
gucuccuccccuuc

SEQ ID NO: 2812939 - RNA, 16 nt, Human
gucuccuccccuuccc

SEQ ID NO: 2812940 - RNA, 15 nt, Human
gucuccucucagccc

SEQ ID NO: 2812941 - RNA, 13 nt, Human
gucuccucuuuaa

SEQ ID NO: 2812942 - RNA, 18 nt, Human
gucuccucuuuaaaacaa

SEQ ID NO: 2812943 - RNA, 20 nt, Human
gucucccgauucccaacuga

SEQ ID NO: 2812944 - RNA, 14 nt, Human
gucuccuacuccug

SEQ ID NO: 2812945 - RNA, 15 nt, Human
gucuccuacuccuga

SEQ ID NO: 2812946 - RNA, 17 nt, Human
gucuccuacuccugacu

SEQ ID NO: 2812947 - RNA, 23 nt, Human
gucuccucaauuuuugucucaga

SEQ ID NO: 2812948 - RNA, 16 nt, Human
gucucccucccuuggg

SEQ ID NO: 2812949 - RNA, 22 nt, Human
guccuuccaggcccccaccacu

SEQ ID NO: 2812950 - RNA, 14 nt, Human
guccuuccaggccc

SEQ ID NO: 2812951 - RNA, 14 nt, Human
guccuugaaaauau

SEQ ID NO: 2812952 - RNA, 16 nt, Human
guccuugaaugccaua

SEQ ID NO: 2812953 - RNA, 11 nt, Human
guccuugaaaa

SEQ ID NO: 2812954 - RNA, 18 nt, Human
gucucaguggcuucaucu

SEQ ID NO: 2812955 - RNA, 22 nt, Human
gucucaguggcuucaucuguca

SEQ ID NO: 2812956 - RNA, 15 nt, Human
gucucaguuggaaau

SEQ ID NO: 2812957 - RNA, 21 nt, Human
gucucaguuugugugucuuaa

SEQ ID NO: 2812958 - RNA, 18 nt, Human
gucucaguuugugugucu

SEQ ID NO: 2812959 - RNA, 19 nt, Human
gucucaguuugugugucuu

SEQ ID NO: 2812960 - RNA, 15 nt, Human
gucucauccccaggg

SEQ ID NO: 2812961 - RNA, 14 nt, Human
gucucauccccagg

SEQ ID NO: 2812962 - RNA, 16 nt, Human
gucucauccccagggg

SEQ ID NO: 2812963 - RNA, 14 nt, Human
gucucauccuccug

SEQ ID NO: 2812964 - RNA, 13 nt, Human
gucucauccccag

SEQ ID NO: 2812965 - RNA, 17 nt, Human
gucucccacgugggaga

SEQ ID NO: 2812966 - RNA, 20 nt, Human
gucucccaguuaugaaucag

SEQ ID NO: 2812967 - RNA, 16 nt, Human
aaccuauaugauuuau

SEQ ID NO: 2812968 - RNA, 21 nt, Human
aaccuaugaagcaauggauau

SEQ ID NO: 2812969 - RNA, 17 nt, Human
aaccuaguacugccccc

SEQ ID NO: 2812970 - RNA, 15 nt, Human
aaccccacccuguuu

SEQ ID NO: 2812971 - RNA, 16 nt, Human
aacccccauucucauc

SEQ ID NO: 2812972 - RNA, 17 nt, Human
aaccucaaaaugucuaa

SEQ ID NO: 2812973 - RNA, 15 nt, Human
aacccccagccugcu

SEQ ID NO: 2812974 - RNA, 14 nt, Human
aacccccagccugc

SEQ ID NO: 2812975 - RNA, 13 nt, Human
aacccccagccug

SEQ ID NO: 2812976 - RNA, 12 nt, Human
aaccccagcucc

SEQ ID NO: 2812977 - RNA, 14 nt, Human
aaccccagcauccu

SEQ ID NO: 2812978 - RNA, 15 nt, Human
aaccuccuguggaac

SEQ ID NO: 2812979 - RNA, 22 nt, Human
aaccuccuguggaacccagcag

SEQ ID NO: 2812980 - RNA, 14 nt, Human
aaccuccugggcua

SEQ ID NO: 2812981 - RNA, 17 nt, Human
aaccuccgccucuuggg

SEQ ID NO: 2812982 - RNA, 13 nt, Human
aaccucccucuug

SEQ ID NO: 2812983 - RNA, 14 nt, Human
aaccucccucuugu

SEQ ID NO: 2812984 - RNA, 16 nt, Human
aaccucccucuuguuu

SEQ ID NO: 2812985 - RNA, 19 nt, Human
aaccucccucuuguuuugu

SEQ ID NO: 2812986 - RNA, 20 nt, Human
aaccucccucuuguuuuguu

SEQ ID NO: 2812987 - RNA, 23 nt, Human
aaccucccucuuguuuuguuugu

SEQ ID NO: 2812988 - RNA, 20 nt, Human
aaccuccgccaaugcacggc

SEQ ID NO: 2812989 - RNA, 12 nt, Human
aaccucaccccg

SEQ ID NO: 2812990 - RNA, 20 nt, Human
aaccucaccccgaggcccug

SEQ ID NO: 2812991 - RNA, 21 nt, Human
aaccucaccccgaggcccugc

SEQ ID NO: 2812992 - RNA, 22 nt, Human
aaccucaccccgaggcccugca

SEQ ID NO: 2812993 - RNA, 23 nt, Human
aaccucaccccgaggcccugcau

SEQ ID NO: 2812994 - RNA, 20 nt, Human
aaccucaaguaaacuccccu

SEQ ID NO: 2812995 - RNA, 15 nt, Human
aaccccaacgcacag

SEQ ID NO: 2812996 - RNA, 17 nt, Human
aaccccaacgcacagga

SEQ ID NO: 2812997 - RNA, 18 nt, Human
aaccccaacgcacaggaa

SEQ ID NO: 2812998 - RNA, 19 nt, Human
aaccccaacgcacaggaaa

SEQ ID NO: 2812999 - RNA, 20 nt, Human
aacccauuugucucuacuuu

SEQ ID NO: 2813000 - RNA, 15 nt, Human
aacccaugagauuca

SEQ ID NO: 2813001 - RNA, 18 nt, Human
aacccauaggcccacaca

SEQ ID NO: 2813002 - RNA, 19 nt, Human
aacccauaggcccacacac

SEQ ID NO: 2813003 - RNA, 21 nt, Human
aacccauaggcccacacacag

SEQ ID NO: 2813004 - RNA, 22 nt, Human
aacccauaggcccacacacagg

SEQ ID NO: 2813005 - RNA, 23 nt, Human
aacccauaggcccacacacaggu

SEQ ID NO: 2813006 - RNA, 15 nt, Human
aacccagucgcccuu

SEQ ID NO: 2813007 - RNA, 23 nt, Human
aacccagucgcccuuacuucuug

SEQ ID NO: 2813008 - RNA, 17 nt, Human
aacccagggcucugccc

SEQ ID NO: 2813009 - RNA, 19 nt, Human
aacccagggcucugcccca

SEQ ID NO: 2813010 - RNA, 20 nt, Human
aacccagggcucugccccag

SEQ ID NO: 2813011 - RNA, 21 nt, Human
aacccagggcucugccccagu

SEQ ID NO: 2813012 - RNA, 22 nt, Human
aacccagggcucugccccaguc

SEQ ID NO: 2813013 - RNA, 15 nt, Human
guuguaacuuauauu

SEQ ID NO: 2813014 - RNA, 22 nt, Human
guuguaacuuauauugaagaca

SEQ ID NO: 2813015 - RNA, 18 nt, Human
guuguaacuuauguagau

SEQ ID NO: 2813016 - RNA, 19 nt, Human
guuguaacuuauguagaua

SEQ ID NO: 2813017 - RNA, 18 nt, Human
guugguguuccacguguu

SEQ ID NO: 2813018 - RNA, 12 nt, Human
guuguacaugaa

SEQ ID NO: 2813019 - RNA, 14 nt, Human
guuguacaugaaau

SEQ ID NO: 2813020 - RNA, 16 nt, Human
guuguacaugaaauuu

SEQ ID NO: 2813021 - RNA, 14 nt, Human
guuguaaugcugca

SEQ ID NO: 2813022 - RNA, 23 nt, Human
guuguacuauggaaaaucagcug

SEQ ID NO: 2813023 - RNA, 16 nt, Human
guuguacuguauguga

SEQ ID NO: 2813024 - RNA, 23 nt, Human
guuguacauuuaugauuuaauaa

SEQ ID NO: 2813025 - RNA, 16 nt, Human
guuguacauuuaugau

SEQ ID NO: 2813026 - RNA, 18 nt, Human
guuguacauuuaugauuu

SEQ ID NO: 2813027 - RNA, 20 nt, Human
guuguacauuuaugauuuaa

SEQ ID NO: 2813028 - RNA, 13 nt, Human
guuuaaaacagua

SEQ ID NO: 2813029 - RNA, 17 nt, Human
guuuaaaacaguauuua

SEQ ID NO: 2813030 - RNA, 19 nt, Human
guuuaaaacaguauuuauu

SEQ ID NO: 2813031 - RNA, 13 nt, Human
guuguauuaacaa

SEQ ID NO: 2813032 - RNA, 16 nt, Human
guuguauuaacaaaag

SEQ ID NO: 2813033 - RNA, 12 nt, Human
guuguauaauuu

SEQ ID NO: 2813034 - RNA, 14 nt, Human
guuguauaauuucg

SEQ ID NO: 2813035 - RNA, 19 nt, Human
guuggugagaaaccuguau

SEQ ID NO: 2813036 - RNA, 16 nt, Human
guuggucgguggguug

SEQ ID NO: 2813037 - RNA, 23 nt, Human
guuggucucugcauuuuucugca

SEQ ID NO: 2813038 - RNA, 14 nt, Human
guuggucaggcugg

SEQ ID NO: 2813039 - RNA, 15 nt, Human
guuggucaggcuggu

SEQ ID NO: 2813040 - RNA, 14 nt, Human
guugguccagagcg

SEQ ID NO: 2813041 - RNA, 22 nt, Human
guugguccagagcggaggcugu

SEQ ID NO: 2813042 - RNA, 23 nt, Human
guugguccagagcggaggcugug

SEQ ID NO: 2813043 - RNA, 13 nt, Human
guuggguggaugc

SEQ ID NO: 2813044 - RNA, 19 nt, Human
guuggguggcaauuccaau

SEQ ID NO: 2813045 - RNA, 13 nt, Human
guugguaguuucu

SEQ ID NO: 2813046 - RNA, 20 nt, Human
guugcugguuauaagcagca

SEQ ID NO: 2813047 - RNA, 18 nt, Human
guugcuggcuuguuguaa

SEQ ID NO: 2813048 - RNA, 19 nt, Human
guugcuggcuuguuguaaa

SEQ ID NO: 2813049 - RNA, 21 nt, Human
guugcuggcuuguuguaaagc

SEQ ID NO: 2813050 - RNA, 22 nt, Human
guugcuggcuuguuguaaagca

SEQ ID NO: 2813051 - RNA, 23 nt, Human
guugcuggcuuguuguaaagcaa

SEQ ID NO: 2813052 - RNA, 12 nt, Human
guugcugccuca

SEQ ID NO: 2813053 - RNA, 19 nt, Human
guugcuguguuuaauuuga

SEQ ID NO: 2813054 - RNA, 15 nt, Human
guugcuguuucacaa

SEQ ID NO: 2813055 - RNA, 13 nt, Human
guuuaacauuugc

SEQ ID NO: 2813056 - RNA, 21 nt, Human
guuuaacauuugccuugcaga

SEQ ID NO: 2813057 - RNA, 22 nt, Human
guuuaacauuugccuugcagaa

SEQ ID NO: 2813058 - RNA, 23 nt, Human
guuuaagaaaaaauaacacacau

SEQ ID NO: 2813059 - RNA, 18 nt, Human
guuuaagaaaaguauuuu

SEQ ID NO: 2813060 - RNA, 20 nt, Human
guuuaagaaaaguauuuuga

SEQ ID NO: 2813061 - RNA, 21 nt, Human
guuuaagaaaaguauuuugaa

SEQ ID NO: 2813062 - RNA, 22 nt, Human
guuuaagaaaaguauuuugaag

SEQ ID NO: 2813063 - RNA, 23 nt, Human
guuuaagaaaaguauuuugaagu

SEQ ID NO: 2813064 - RNA, 20 nt, Human
guuuaagacauuuuuggaag

SEQ ID NO: 2813065 - RNA, 14 nt, Human
guuuauuuuucaua

SEQ ID NO: 2813066 - RNA, 16 nt, Human
guuuacaaguguauau

SEQ ID NO: 2813067 - RNA, 22 nt, Human
guuuacaagcccccccuuccac

SEQ ID NO: 2813068 - RNA, 18 nt, Human
guuuacaaguguauauca

SEQ ID NO: 2813069 - RNA, 19 nt, Human
guuuacaaguguauaucag

SEQ ID NO: 2813070 - RNA, 23 nt, Human
guuuacaaguguauaucagaaaa

SEQ ID NO: 2813071 - RNA, 18 nt, Human
guuuauguaaauguuugu

SEQ ID NO: 2813072 - RNA, 18 nt, Human
guuuacaagcccccccuu

SEQ ID NO: 2813073 - RNA, 19 nt, Human
guuuacaagcccccccuuc

SEQ ID NO: 2813074 - RNA, 15 nt, Human
guuuaauuguuuguc

SEQ ID NO: 2813075 - RNA, 19 nt, Human
guuuaauuguuuguccuca

SEQ ID NO: 2813076 - RNA, 14 nt, Human
guuuaauuucuuca

SEQ ID NO: 2813077 - RNA, 15 nt, Human
guuuaaugugaacuu

SEQ ID NO: 2813078 - RNA, 18 nt, Human
guuuaaugugaacuugua

SEQ ID NO: 2813079 - RNA, 21 nt, Human
guuuaaugugaacuuguagcu

SEQ ID NO: 2813080 - RNA, 20 nt, Human
guuuaauguucugugauaca

SEQ ID NO: 2813081 - RNA, 16 nt, Human
guugccccgucucugu

SEQ ID NO: 2813082 - RNA, 17 nt, Human
guugccccgucucuguu

SEQ ID NO: 2813083 - RNA, 17 nt, Human
guugcccaggcuggcgu

SEQ ID NO: 2813084 - RNA, 15 nt, Human
guugcccaggcaggu

SEQ ID NO: 2813085 - RNA, 21 nt, Human
guugcccaggcuggcgugcag

SEQ ID NO: 2813086 - RNA, 19 nt, Human
guugcccaggcaggucuug

SEQ ID NO: 2813087 - RNA, 18 nt, Human
guugcccaggcaggucuu

SEQ ID NO: 2813088 - RNA, 17 nt, Human
guugcccaggcaggucu

SEQ ID NO: 2813089 - RNA, 22 nt, Human
aaggaugugauuguggaaugga

SEQ ID NO: 2813090 - RNA, 17 nt, Human
aaggaugugauugugga

SEQ ID NO: 2813091 - RNA, 15 nt, Human
aaggaugugauugug

SEQ ID NO: 2813092 - RNA, 15 nt, Human
aaggaugucacaggg

SEQ ID NO: 2813093 - RNA, 16 nt, Human
aaggaugucacagggc

SEQ ID NO: 2813094 - RNA, 17 nt, Human
aaggaugucacagggcc

SEQ ID NO: 2813095 - RNA, 21 nt, Human
aaggccaauaaagaguuagaa

SEQ ID NO: 2813096 - RNA, 21 nt, Human
aaggccagaguggccuggcca

SEQ ID NO: 2813097 - RNA, 20 nt, Human
aaggccagaguggccuggcc

SEQ ID NO: 2813098 - RNA, 19 nt, Human
aaggccagaguggccuggc

SEQ ID NO: 2813099 - RNA, 17 nt, Human
aaggccagaguggccug

SEQ ID NO: 2813100 - RNA, 15 nt, Human
aaggcuaugugauua

SEQ ID NO: 2813101 - RNA, 17 nt, Human
aaggcucagucucagga

SEQ ID NO: 2813102 - RNA, 15 nt, Human
aaggcuccaagaccu

SEQ ID NO: 2813103 - RNA, 16 nt, Human
aaggcucagucucagg

SEQ ID NO: 2813104 - RNA, 22 nt, Human
aaggccagaguggccuggccag

SEQ ID NO: 2813105 - RNA, 23 nt, Human
guugaugaucuuugcagacaggc

SEQ ID NO: 2813106 - RNA, 21 nt, Human
guugaugccugugaacugaac

SEQ ID NO: 2813107 - RNA, 23 nt, Human
aaggaugaaugaggucccaggca

SEQ ID NO: 2813108 - RNA, 17 nt, Human
aaggaugggguuaugaa

SEQ ID NO: 2813109 - RNA, 19 nt, Human
aaggaugccccgucccccu

SEQ ID NO: 2813110 - RNA, 14 nt, Human
aaggaugucacagg

SEQ ID NO: 2813111 - RNA, 22 nt, Human
aaggauguagcuuuucaccuuu

SEQ ID NO: 2813112 - RNA, 23 nt, Human
aaggauguagcuuuucaccuuua

SEQ ID NO: 2813113 - RNA, 18 nt, Human
aaggcuuauauucaacca

SEQ ID NO: 2813114 - RNA, 21 nt, Human
aaggcuuauauucaaccaugg

SEQ ID NO: 2813115 - RNA, 23 nt, Human
aaggcuuauauucaaccauggac

SEQ ID NO: 2813116 - RNA, 18 nt, Human
guuucaaacacaaaugca

SEQ ID NO: 2813117 - RNA, 19 nt, Human
guuucaaacacaaaugcag

SEQ ID NO: 2813118 - RNA, 14 nt, Human
guuucaaacuguaa

SEQ ID NO: 2813119 - RNA, 16 nt, Human
guuuauuuuucauauu

SEQ ID NO: 2813120 - RNA, 18 nt, Human
guuuauuuuucauauugu

SEQ ID NO: 2813121 - RNA, 17 nt, Human
guuuauuuuucauauug

SEQ ID NO: 2813122 - RNA, 22 nt, Human
aaggcuuuuggucucccuggga

SEQ ID NO: 2813123 - RNA, 16 nt, Human
aaggcuuuuuauaaac

SEQ ID NO: 2813124 - RNA, 11 nt, Human
aaggcuuugug

SEQ ID NO: 2813125 - RNA, 15 nt, Human
aaggcuuuaucucag

SEQ ID NO: 2813126 - RNA, 23 nt, Human
aaggcuuugauuaguuuucuugu

SEQ ID NO: 2813127 - RNA, 16 nt, Human
aaggcuugaagcugug

SEQ ID NO: 2813128 - RNA, 14 nt, Human
aaggcuugaagcug

SEQ ID NO: 2813129 - RNA, 13 nt, Human
aaggcuugaagcu

SEQ ID NO: 2813130 - RNA, 13 nt, Human
aaggcuucagucu

SEQ ID NO: 2813131 - RNA, 15 nt, Human
aaggcuucagucuca

SEQ ID NO: 2813132 - RNA, 23 nt, Human
aaggggaauguuugccucugccu

SEQ ID NO: 2813133 - RNA, 22 nt, Human
aaggggaauguuugccucugcc

SEQ ID NO: 2813134 - RNA, 13 nt, Human
aaggggugugcau

SEQ ID NO: 2813135 - RNA, 16 nt, Human
aagggguuggauugca

SEQ ID NO: 2813136 - RNA, 15 nt, Human
aagggguugggguga

SEQ ID NO: 2813137 - RNA, 19 nt, Human
aagggguuggggugacagu

SEQ ID NO: 2813138 - RNA, 22 nt, Human
aagggguuggggugacagucau

SEQ ID NO: 2813139 - RNA, 16 nt, Human
aaggggucacuuacag

SEQ ID NO: 2813140 - RNA, 16 nt, Human
aaggggucugaaauuu

SEQ ID NO: 2813141 - RNA, 18 nt, Human
aaggggaagcacucgugu

SEQ ID NO: 2813142 - RNA, 16 nt, Human
aaggguaucaggugcu

SEQ ID NO: 2813143 - RNA, 16 nt, Human
aagggguuugccauuu

SEQ ID NO: 2813144 - RNA, 20 nt, Human
aagggguuugccauuugaua

SEQ ID NO: 2813145 - RNA, 21 nt, Human
aaggguuuuccacccuggaau

SEQ ID NO: 2813146 - RNA, 19 nt, Human
aaggguuuuccacccugga

SEQ ID NO: 2813147 - RNA, 22 nt, Human
aagguuuuggaucuugaaugug

SEQ ID NO: 2813148 - RNA, 23 nt, Human
aagguuuuggaucuugaaugugg

SEQ ID NO: 2813149 - RNA, 20 nt, Human
aagguuuuccucuucuauuu

SEQ ID NO: 2813150 - RNA, 14 nt, Human
guuuuauaaaauag

SEQ ID NO: 2813151 - RNA, 16 nt, Human
guuuuauaaaaucaag

SEQ ID NO: 2813152 - RNA, 21 nt, Human
guuuuagguucuaaaguucua

SEQ ID NO: 2813153 - RNA, 13 nt, Human
guuuuagguucua

SEQ ID NO: 2813154 - RNA, 15 nt, Human
guuuuagguucuaaa

SEQ ID NO: 2813155 - RNA, 16 nt, Human
guuuuagguucuaaag

SEQ ID NO: 2813156 - RNA, 17 nt, Human
guuuuagguucuaaagu

SEQ ID NO: 2813157 - RNA, 18 nt, Human
guuuuagaguaagaaauu

SEQ ID NO: 2813158 - RNA, 15 nt, Human
guuuucuguagucau

SEQ ID NO: 2813159 - RNA, 17 nt, Human
guuuucuguagucauuu

SEQ ID NO: 2813160 - RNA, 18 nt, Human
guuuucuguagucauuua

SEQ ID NO: 2813161 - RNA, 23 nt, Human
guuuucuguagucauuuacuaaa

SEQ ID NO: 2813162 - RNA, 18 nt, Human
guuuucuguguaaccauu

SEQ ID NO: 2813163 - RNA, 16 nt, Human
guuuucugagggaaag

SEQ ID NO: 2813164 - RNA, 18 nt, Human
guuuggggaugagaaagg

SEQ ID NO: 2813165 - RNA, 11 nt, Human
guuugggcuuc

SEQ ID NO: 2813166 - RNA, 13 nt, Human
guuugggcuucag

SEQ ID NO: 2813167 - RNA, 20 nt, Human
guuugggccccagaggcugg

SEQ ID NO: 2813168 - RNA, 11 nt, Human
guuuuacacug

SEQ ID NO: 2813169 - RNA, 12 nt, Human
guuuuacaaagg

SEQ ID NO: 2813170 - RNA, 23 nt, Human
guuuuacaauaaaaucuugaaaa

SEQ ID NO: 2813171 - RNA, 16 nt, Human
guuuuagguagaaaaa

SEQ ID NO: 2813172 - RNA, 17 nt, Human
guuuuagguagaaaaac

SEQ ID NO: 2813173 - RNA, 12 nt, Human
guuuuagguucu

SEQ ID NO: 2813174 - RNA, 21 nt, Human
guuuuagauuuucugguucua

SEQ ID NO: 2813175 - RNA, 16 nt, Human
guuuuagaagguucuc

SEQ ID NO: 2813176 - RNA, 20 nt, Human
guuuuagauuuucugguucu

SEQ ID NO: 2813177 - RNA, 21 nt, Human
guuuuacauuguugagcuauu

SEQ ID NO: 2813178 - RNA, 12 nt, Human
guuuuacauugu

SEQ ID NO: 2813179 - RNA, 15 nt, Human
guuucuaagauucua

SEQ ID NO: 2813180 - RNA, 17 nt, Human
guuucuguccugcuggu

SEQ ID NO: 2813181 - RNA, 14 nt, Human
guuucuaagauucu

SEQ ID NO: 2813182 - RNA, 13 nt, Human
aaguaauauaaug

SEQ ID NO: 2813183 - RNA, 16 nt, Human
aaguaauauaauggaa

SEQ ID NO: 2813184 - RNA, 21 nt, Human
aaguaauauaauggaagagaa

SEQ ID NO: 2813185 - RNA, 23 nt, Human
aaguaauauaauggaagagaaau

SEQ ID NO: 2813186 - RNA, 14 nt, Human
guuucuguuauuaa

SEQ ID NO: 2813187 - RNA, 13 nt, Human
guuucugucugua

SEQ ID NO: 2813188 - RNA, 16 nt, Human
guuucuguccugcugg

SEQ ID NO: 2813189 - RNA, 16 nt, Human
guuugccucugccucu

SEQ ID NO: 2813190 - RNA, 13 nt, Human
guuugccucugcc

SEQ ID NO: 2813191 - RNA, 14 nt, Human
guuuggcuuccucc

SEQ ID NO: 2813192 - RNA, 16 nt, Human
guuuggcuuccuccug

SEQ ID NO: 2813193 - RNA, 12 nt, Human
guuugcauuccu

SEQ ID NO: 2813194 - RNA, 22 nt, Human
guuugccauacuuugucugaaa

SEQ ID NO: 2813195 - RNA, 14 nt, Human
guuugccauacuuu

SEQ ID NO: 2813196 - RNA, 15 nt, Human
guuugccauacuuug

SEQ ID NO: 2813197 - RNA, 21 nt, Human
aagcuucauucuccuuguugu

SEQ ID NO: 2813198 - RNA, 15 nt, Human
aagcuuccaugauuc

SEQ ID NO: 2813199 - RNA, 18 nt, Human
aagcuucaaacugcauga

SEQ ID NO: 2813200 - RNA, 14 nt, Human
aagcuucaaauuaa

SEQ ID NO: 2813201 - RNA, 18 nt, Human
aagcuucaaauuaaaaca

SEQ ID NO: 2813202 - RNA, 17 nt, Human
aagcugagaacuccuga

SEQ ID NO: 2813203 - RNA, 18 nt, Human
aagcugagaacuccugac

SEQ ID NO: 2813204 - RNA, 19 nt, Human
aagcugagaacuccugacu

SEQ ID NO: 2813205 - RNA, 18 nt, Human
aagcugagagugcuauga

SEQ ID NO: 2813206 - RNA, 17 nt, Human
aagcugacauugccaaa

SEQ ID NO: 2813207 - RNA, 22 nt, Human
aagcugacauugccaaaaagga

SEQ ID NO: 2813208 - RNA, 17 nt, Human
aagcuccuguccuccca

SEQ ID NO: 2813209 - RNA, 20 nt, Human
aagcuccuguccucccaucc

SEQ ID NO: 2813210 - RNA, 22 nt, Human
aagcuccuguccucccaucccc

SEQ ID NO: 2813211 - RNA, 13 nt, Human
aagcuccuguccu

SEQ ID NO: 2813212 - RNA, 14 nt, Human
aagcuccuguccuc

SEQ ID NO: 2813213 - RNA, 15 nt, Human
aagcuccuguccucc

SEQ ID NO: 2813214 - RNA, 21 nt, Human
aagcuauuagccaggaucaug

SEQ ID NO: 2813215 - RNA, 16 nt, Human
aagcuauuagccagga

SEQ ID NO: 2813216 - RNA, 19 nt, Human
aagcuauuagccaggauca

SEQ ID NO: 2813217 - RNA, 17 nt, Human
aagcuauccuggcucuu

SEQ ID NO: 2813218 - RNA, 14 nt, Human
aagcuaucuaaagu

SEQ ID NO: 2813219 - RNA, 15 nt, Human
guucccucucccugu

SEQ ID NO: 2813220 - RNA, 17 nt, Human
guucccucucccuguug

SEQ ID NO: 2813221 - RNA, 19 nt, Human
guucccuuuccuuccaucc

SEQ ID NO: 2813222 - RNA, 19 nt, Human
guucccuuggccucagaau

SEQ ID NO: 2813223 - RNA, 18 nt, Human
guucccuuggccucagaa

SEQ ID NO: 2813224 - RNA, 14 nt, Human
guucccucugcuca

SEQ ID NO: 2813225 - RNA, 15 nt, Human
guucccucugcucag

SEQ ID NO: 2813226 - RNA, 16 nt, Human
guucccucugcucagc

SEQ ID NO: 2813227 - RNA, 17 nt, Human
guucccucugcucagcc

SEQ ID NO: 2813228 - RNA, 15 nt, Human
guucccggucccgag

SEQ ID NO: 2813229 - RNA, 14 nt, Human
guucccguuucucc

SEQ ID NO: 2813230 - RNA, 16 nt, Human
guucccguuucuccac

SEQ ID NO: 2813231 - RNA, 18 nt, Human
guucccguuucuccaccu

SEQ ID NO: 2813232 - RNA, 20 nt, Human
guucccuacuuccugugacu

SEQ ID NO: 2813233 - RNA, 19 nt, Human
guucccguuucuccaccua

SEQ ID NO: 2813234 - RNA, 18 nt, Human
guucccauguagcccccu

SEQ ID NO: 2813235 - RNA, 19 nt, Human
guucccauguagcccccug

SEQ ID NO: 2813236 - RNA, 16 nt, Human
guuccaugggauacaa

SEQ ID NO: 2813237 - RNA, 17 nt, Human
guucccauguagccccc

SEQ ID NO: 2813238 - RNA, 21 nt, Human
guucccagauggcuggaaggg

SEQ ID NO: 2813239 - RNA, 22 nt, Human
guucccagucuucugacaaacu

SEQ ID NO: 2813240 - RNA, 15 nt, Human
aagcuuguuuuccag

SEQ ID NO: 2813241 - RNA, 12 nt, Human
aagcuuuaugau

SEQ ID NO: 2813242 - RNA, 18 nt, Human
aagcuuuaugauuuucau

SEQ ID NO: 2813243 - RNA, 21 nt, Human
aagcuuuaugauuuucauaac

SEQ ID NO: 2813244 - RNA, 16 nt, Human
aagcuuuauuaccagu

SEQ ID NO: 2813245 - RNA, 21 nt, Human
aagcuuuauuaccaguggcgu

SEQ ID NO: 2813246 - RNA, 16 nt, Human
aagcuuccaugauucu

SEQ ID NO: 2813247 - RNA, 23 nt, Human
guuccaucuccuauaaucuguca

SEQ ID NO: 2813248 - RNA, 16 nt, Human
guuccaugaugcuggg

SEQ ID NO: 2813249 - RNA, 16 nt, Human
guugaggaacuguaca

SEQ ID NO: 2813250 - RNA, 17 nt, Human
guugaggaacuguacag

SEQ ID NO: 2813251 - RNA, 21 nt, Human
guugaggcagggcaaaugaca

SEQ ID NO: 2813252 - RNA, 22 nt, Human
guugaugaucuuugcagacagg

SEQ ID NO: 2813253 - RNA, 21 nt, Human
guugauaaauuccacuggacu

SEQ ID NO: 2813254 - RNA, 18 nt, Human
guugauaaauuccacugg

SEQ ID NO: 2813255 - RNA, 18 nt, Human
guugaggggcuccuggaa

SEQ ID NO: 2813256 - RNA, 17 nt, Human
guugaggggcuccugga

SEQ ID NO: 2813257 - RNA, 16 nt, Human
guugaggggcuccugg

SEQ ID NO: 2813258 - RNA, 15 nt, Human
guucuuaggcugcug

SEQ ID NO: 2813259 - RNA, 18 nt, Human
guucuuaggcugcuggga

SEQ ID NO: 2813260 - RNA, 14 nt, Human
guucuuaugcaaaa

SEQ ID NO: 2813261 - RNA, 17 nt, Human
guucuuaugcaaaaugg

SEQ ID NO: 2813262 - RNA, 18 nt, Human
guucuuaugcaaaaugga

SEQ ID NO: 2813263 - RNA, 19 nt, Human
guucuuaugcaaaauggaa

SEQ ID NO: 2813264 - RNA, 23 nt, Human
guucugggacacaguucaauucu

SEQ ID NO: 2813265 - RNA, 16 nt, Human
guucucuccuccccaa

SEQ ID NO: 2813266 - RNA, 18 nt, Human
guucuccuuuuccucucu

SEQ ID NO: 2813267 - RNA, 22 nt, Human
guucuccuuuuccucucucccg

SEQ ID NO: 2813268 - RNA, 13 nt, Human
guucuccuuuucc

SEQ ID NO: 2813269 - RNA, 22 nt, Human
guucuuaccuguaugucuccag

SEQ ID NO: 2813270 - RNA, 13 nt, Human
guucuuacacaua

SEQ ID NO: 2813271 - RNA, 16 nt, Human
guucuuacacauacag

SEQ ID NO: 2813272 - RNA, 22 nt, Human
guucuuacacauacaguuuuau

SEQ ID NO: 2813273 - RNA, 14 nt, Human
guucugggcucuuu

SEQ ID NO: 2813274 - RNA, 18 nt, Human
guucugggcucuuuccuc

SEQ ID NO: 2813275 - RNA, 20 nt, Human
guucuagacauggagguucu

SEQ ID NO: 2813276 - RNA, 21 nt, Human
guucuagacauggagguucua

SEQ ID NO: 2813277 - RNA, 22 nt, Human
guucuagacauggagguucuaa

SEQ ID NO: 2813278 - RNA, 23 nt, Human
guucuagacauggagguucuaag

SEQ ID NO: 2813279 - RNA, 23 nt, Human
guucuagcacuucaucuggcugc

SEQ ID NO: 2813280 - RNA, 21 nt, Human
guucuaccucaggcagcucaa

SEQ ID NO: 2813281 - RNA, 19 nt, Human
guucuacggaucaucaaca

SEQ ID NO: 2813282 - RNA, 22 nt, Human
guucccuuuccuuccaucccua

SEQ ID NO: 2813283 - RNA, 16 nt, Human
guucccuuggccucag

SEQ ID NO: 2813284 - RNA, 17 nt, Human
guucuacccguuccaaa

SEQ ID NO: 2813285 - RNA, 18 nt, Human
guucuacccguuccaaaa

SEQ ID NO: 2813286 - RNA, 20 nt, Human
guucuaccucaggcagcuca

SEQ ID NO: 2813287 - RNA, 21 nt, Human
guuacacacuuuuuaagaaau

SEQ ID NO: 2813288 - RNA, 20 nt, Human
guuacacauuaaguaaucaa

SEQ ID NO: 2813289 - RNA, 20 nt, Human
guuagcucaggaggcuugga

SEQ ID NO: 2813290 - RNA, 15 nt, Human
guuagcaaacuuugu

SEQ ID NO: 2813291 - RNA, 14 nt, Human
guuagcacuguuga

SEQ ID NO: 2813292 - RNA, 16 nt, Human
guuagcacuguugaug

SEQ ID NO: 2813293 - RNA, 21 nt, Human
guuagcacuguugauguaucu

SEQ ID NO: 2813294 - RNA, 13 nt, Human
guuacaaguauac

SEQ ID NO: 2813295 - RNA, 22 nt, Human
guuacaaguauacuuauauuuc

SEQ ID NO: 2813296 - RNA, 21 nt, Human
guuaauuuuuugguacaaaaa

SEQ ID NO: 2813297 - RNA, 11 nt, Human
guuaauguauu

SEQ ID NO: 2813298 - RNA, 20 nt, Human
guuaauguauuuguucaugu

SEQ ID NO: 2813299 - RNA, 22 nt, Human
guuaauguauuuguucauguuu

SEQ ID NO: 2813300 - RNA, 23 nt, Human
guuaauguauuuguucauguuug

SEQ ID NO: 2813301 - RNA, 15 nt, Human
guuaauguuauauca

SEQ ID NO: 2813302 - RNA, 23 nt, Human
guuaauguuauaucauauguaua

SEQ ID NO: 2813303 - RNA, 14 nt, Human
guuaauuagcauuc

SEQ ID NO: 2813304 - RNA, 15 nt, Human
guuaauuagcauucu

SEQ ID NO: 2813305 - RNA, 16 nt, Human
guuacaaacuacagac

SEQ ID NO: 2813306 - RNA, 17 nt, Human
guuaguguuuuaagaaa

SEQ ID NO: 2813307 - RNA, 21 nt, Human
guuaguguuuuaagaaaugua

SEQ ID NO: 2813308 - RNA, 22 nt, Human
guuagcguuucggccuucauaa

SEQ ID NO: 2813309 - RNA, 21 nt, Human
guuagguagagggaguuguca

SEQ ID NO: 2813310 - RNA, 18 nt, Human
guuagguagagggaguug

SEQ ID NO: 2813311 - RNA, 15 nt, Human
guuagguacagagac

SEQ ID NO: 2813312 - RNA, 18 nt, Human
guuaaugauagcuacugu

SEQ ID NO: 2813313 - RNA, 20 nt, Human
guuaauguaaucugauggcu

SEQ ID NO: 2813314 - RNA, 19 nt, Human
guuaaugcuuaagagggaa

SEQ ID NO: 2813315 - RNA, 14 nt, Human
guuaaucuucaugg

SEQ ID NO: 2813316 - RNA, 18 nt, Human
guuaaucucuguuaugua

SEQ ID NO: 2813317 - RNA, 19 nt, Human
guuaaucucuguuauguac

SEQ ID NO: 2813318 - RNA, 22 nt, Human
guuaaucucuguuauguacugu

SEQ ID NO: 2813319 - RNA, 23 nt, Human
guuaaucucuguuauguacugua

SEQ ID NO: 2813320 - RNA, 14 nt, Human
guuaaguaugugua

SEQ ID NO: 2813321 - RNA, 22 nt, Human
guuaaguugauggugaugaaau

SEQ ID NO: 2813322 - RNA, 17 nt, Human
guuaagguucaagacag

SEQ ID NO: 2813323 - RNA, 12 nt, Human
guuaaggaaacu

SEQ ID NO: 2813324 - RNA, 14 nt, Human
guuaaggaaacucu

SEQ ID NO: 2813325 - RNA, 21 nt, Human
guuaaggaaacucuuaucuca

SEQ ID NO: 2813326 - RNA, 22 nt, Human
guuaaggaccguggcccugccc

SEQ ID NO: 2813327 - RNA, 16 nt, Human
guuaaggaaacucuua

SEQ ID NO: 2813328 - RNA, 19 nt, Human
guuaaggaaacucuuaucu

SEQ ID NO: 2813329 - RNA, 21 nt, Human
guguuugggucaccccuccag

SEQ ID NO: 2813330 - RNA, 14 nt, Human
guguuugguuuaca

SEQ ID NO: 2813331 - RNA, 15 nt, Human
guguuugguuuacau

SEQ ID NO: 2813332 - RNA, 16 nt, Human
guguuugguuuacauu

SEQ ID NO: 2813333 - RNA, 17 nt, Human
guguuugguuuacauuu

SEQ ID NO: 2813334 - RNA, 20 nt, Human
guguuugguuuacauuuaaa

SEQ ID NO: 2813335 - RNA, 22 nt, Human
guguuuuaauuccaauaugaug

SEQ ID NO: 2813336 - RNA, 18 nt, Human
guguuuguugcuggcuug

SEQ ID NO: 2813337 - RNA, 15 nt, Human
guguuuuaauuccaa

SEQ ID NO: 2813338 - RNA, 13 nt, Human
guguuuuaauuua

SEQ ID NO: 2813339 - RNA, 20 nt, Human
guuaagcauuaccacucagg

SEQ ID NO: 2813340 - RNA, 11 nt, Human
guguuuguguu

SEQ ID NO: 2813341 - RNA, 13 nt, Human
guguuuuaaauuc

SEQ ID NO: 2813342 - RNA, 16 nt, Human
guguuuuaagaaaugu

SEQ ID NO: 2813343 - RNA, 21 nt, Human
guuaagcauuaccacucaggc

SEQ ID NO: 2813344 - RNA, 16 nt, Human
guuaagccuuuggaaa

SEQ ID NO: 2813345 - RNA, 13 nt, Human
guuaagccuuugg

SEQ ID NO: 2813346 - RNA, 12 nt, Human
guuaagccuuug

SEQ ID NO: 2813347 - RNA, 20 nt, Human
guuauuuauacaagauugaa

SEQ ID NO: 2813348 - RNA, 19 nt, Human
guuauuuauagucauuuau

SEQ ID NO: 2813349 - RNA, 17 nt, Human
guuaguuauagaugucu

SEQ ID NO: 2813350 - RNA, 15 nt, Human
guuauuucugcaaac

SEQ ID NO: 2813351 - RNA, 16 nt, Human
guuauuugcacacugc

SEQ ID NO: 2813352 - RNA, 12 nt, Human
guuauuuagacu

SEQ ID NO: 2813353 - RNA, 17 nt, Human
guucagcuccagcucac

SEQ ID NO: 2813354 - RNA, 16 nt, Human
guucagcuccagcuca

SEQ ID NO: 2813355 - RNA, 18 nt, Human
guucagcuccagcucacc

SEQ ID NO: 2813356 - RNA, 15 nt, Human
guucagcuccagcuc

SEQ ID NO: 2813357 - RNA, 20 nt, Human
guucaggggacucagcccug

SEQ ID NO: 2813358 - RNA, 19 nt, Human
guucaggguuggccccugc

SEQ ID NO: 2813359 - RNA, 18 nt, Human
guucaggguuggccccug

SEQ ID NO: 2813360 - RNA, 17 nt, Human
guucaggguuggccccu

SEQ ID NO: 2813361 - RNA, 19 nt, Human
guucaggggacucagcccu

SEQ ID NO: 2813362 - RNA, 22 nt, Human
guucauacacuaaccaaaucuc

SEQ ID NO: 2813363 - RNA, 18 nt, Human
guucaguuucuucugcgc

SEQ ID NO: 2813364 - RNA, 22 nt, Human
aagcuaggccuggccagaugca

SEQ ID NO: 2813365 - RNA, 16 nt, Human
aagcuaggccuggcca

SEQ ID NO: 2813366 - RNA, 18 nt, Human
aagcuaggccuggccaga

SEQ ID NO: 2813367 - RNA, 17 nt, Human
aagcuaggccuggccag

SEQ ID NO: 2813368 - RNA, 18 nt, Human
aagccucgaggugccuuc

SEQ ID NO: 2813369 - RNA, 19 nt, Human
aagccugcuuuuuaagugu

SEQ ID NO: 2813370 - RNA, 21 nt, Human
aagccugcguugguccagagc

SEQ ID NO: 2813371 - RNA, 22 nt, Human
aagccugcguugguccagagcg

SEQ ID NO: 2813372 - RNA, 17 nt, Human
aagccugggauugacag

SEQ ID NO: 2813373 - RNA, 14 nt, Human
guucauacauuuga

SEQ ID NO: 2813374 - RNA, 16 nt, Human
guucauacauuugagg

SEQ ID NO: 2813375 - RNA, 13 nt, Human
guucauaccuaag

SEQ ID NO: 2813376 - RNA, 16 nt, Human
guucauaccuaaguac

SEQ ID NO: 2813377 - RNA, 17 nt, Human
guucauaccuaaguacu

SEQ ID NO: 2813378 - RNA, 19 nt, Human
guucauaccuaaguacugu

SEQ ID NO: 2813379 - RNA, 20 nt, Human
guucauaccuaaguacugua

SEQ ID NO: 2813380 - RNA, 21 nt, Human
guucauaccuaaguacuguaa

SEQ ID NO: 2813381 - RNA, 14 nt, Human
aagccucuggcuag

SEQ ID NO: 2813382 - RNA, 12 nt, Human
aagccucuggcu

SEQ ID NO: 2813383 - RNA, 14 nt, Human
aagccucugcugcc

SEQ ID NO: 2813384 - RNA, 11 nt, Human
aagccucugcu

SEQ ID NO: 2813385 - RNA, 23 nt, Human
aagccucuggcuagaggccagcc

SEQ ID NO: 2813386 - RNA, 12 nt, Human
aagccucuggga

SEQ ID NO: 2813387 - RNA, 18 nt, Human
gugucuuuuuucacuaca

SEQ ID NO: 2813388 - RNA, 17 nt, Human
gugugaaaaugugugug

SEQ ID NO: 2813389 - RNA, 13 nt, Human
gugugaaaauggg

SEQ ID NO: 2813390 - RNA, 14 nt, Human
gugugaaacauacu

SEQ ID NO: 2813391 - RNA, 13 nt, Human
gugugaccugagg

SEQ ID NO: 2813392 - RNA, 12 nt, Human
gugugaccccuc

SEQ ID NO: 2813393 - RNA, 14 nt, Human
gugugaccccuccu

SEQ ID NO: 2813394 - RNA, 15 nt, Human
gugugaccccuccug

SEQ ID NO: 2813395 - RNA, 16 nt, Human
gugugaccccuccugg

SEQ ID NO: 2813396 - RNA, 17 nt, Human
gugugaccccuccuggg

SEQ ID NO: 2813397 - RNA, 18 nt, Human
gugugaccccuccugggg

SEQ ID NO: 2813398 - RNA, 23 nt, Human
gugugaccccuccuggggccagg

SEQ ID NO: 2813399 - RNA, 19 nt, Human
gugugaggagcugcuggcu

SEQ ID NO: 2813400 - RNA, 18 nt, Human
gugugaggagcugcuggc

SEQ ID NO: 2813401 - RNA, 16 nt, Human
gugugaggagcugcug

SEQ ID NO: 2813402 - RNA, 17 nt, Human
guguguagacaaauauu

SEQ ID NO: 2813403 - RNA, 15 nt, Human
gugugaccugagggc

SEQ ID NO: 2813404 - RNA, 14 nt, Human
guguguagccaagg

SEQ ID NO: 2813405 - RNA, 22 nt, Human
guguguauaagugcacacagaa

SEQ ID NO: 2813406 - RNA, 23 nt, Human
guguguauauauguguauauaua

SEQ ID NO: 2813407 - RNA, 21 nt, Human
guguguagaguuaagaagcug

SEQ ID NO: 2813408 - RNA, 19 nt, Human
guguguagacaaauauuug

SEQ ID NO: 2813409 - RNA, 13 nt, Human
guguguagaguua

SEQ ID NO: 2813410 - RNA, 16 nt, Human
guguguagaguuaaga

SEQ ID NO: 2813411 - RNA, 17 nt, Human
guguguagaguuaagaa

SEQ ID NO: 2813412 - RNA, 18 nt, Human
gugucuugcaauggcagc

SEQ ID NO: 2813413 - RNA, 17 nt, Human
gugucuugcaauggcag

SEQ ID NO: 2813414 - RNA, 21 nt, Human
gugucuuugugauuuugagua

SEQ ID NO: 2813415 - RNA, 18 nt, Human
gugucuuucacagcuccu

SEQ ID NO: 2813416 - RNA, 20 nt, Human
gugucuucuccaccacgcug

SEQ ID NO: 2813417 - RNA, 20 nt, Human
aagcaauccucucaccucag

SEQ ID NO: 2813418 - RNA, 22 nt, Human
aagcaauccucucaccucagcc

SEQ ID NO: 2813419 - RNA, 22 nt, Human
aagcaaugcugaugaaucacug

SEQ ID NO: 2813420 - RNA, 17 nt, Human
aagcaauggauauuugu

SEQ ID NO: 2813421 - RNA, 15 nt, Human
aagcaauuagacaag

SEQ ID NO: 2813422 - RNA, 12 nt, Human
gugucuuagcau

SEQ ID NO: 2813423 - RNA, 17 nt, Human
gugucuuccacuuugca

SEQ ID NO: 2813424 - RNA, 15 nt, Human
aagcaauuucuugcu

SEQ ID NO: 2813425 - RNA, 14 nt, Human
guguuguauuaaca

SEQ ID NO: 2813426 - RNA, 18 nt, Human
guguuguauuaacaaaag

SEQ ID NO: 2813427 - RNA, 19 nt, Human
guguuguauuaacaaaagu

SEQ ID NO: 2813428 - RNA, 15 nt, Human
guguugucauuguaa

SEQ ID NO: 2813429 - RNA, 17 nt, Human
guguugucauuguaaac

SEQ ID NO: 2813430 - RNA, 21 nt, Human
guguugucauuguaaacaaac

SEQ ID NO: 2813431 - RNA, 14 nt, Human
guguugggagggau

SEQ ID NO: 2813432 - RNA, 21 nt, Human
guguugggauacugcagggcc

SEQ ID NO: 2813433 - RNA, 14 nt, Human
guguuggguaaauu

SEQ ID NO: 2813434 - RNA, 17 nt, Human
guguuguaauucuucag

SEQ ID NO: 2813435 - RNA, 18 nt, Human
guguuguaauucuucagu

SEQ ID NO: 2813436 - RNA, 20 nt, Human
guguuguaauucuucaguug

SEQ ID NO: 2813437 - RNA, 20 nt, Human
guguugcccaggcuggucuc

SEQ ID NO: 2813438 - RNA, 18 nt, Human
guguugcgugucgugggu

SEQ ID NO: 2813439 - RNA, 16 nt, Human
guguuggacaaaugug

SEQ ID NO: 2813440 - RNA, 19 nt, Human
guguuggacaaaugugaag

SEQ ID NO: 2813441 - RNA, 20 nt, Human
guguuggacaaaugugaaga

SEQ ID NO: 2813442 - RNA, 14 nt, Human
guguuggacagaga

SEQ ID NO: 2813443 - RNA, 18 nt, Human
guguuuccauauuuuaua

SEQ ID NO: 2813444 - RNA, 20 nt, Human
guguuuauuuuucauauugu

SEQ ID NO: 2813445 - RNA, 14 nt, Human
guguugggauacug

SEQ ID NO: 2813446 - RNA, 16 nt, Human
guguugucuugaaaga

SEQ ID NO: 2813447 - RNA, 18 nt, Human
guguuguccuuuugucuu

SEQ ID NO: 2813448 - RNA, 20 nt, Human
guguugugauagcuaacauu

SEQ ID NO: 2813449 - RNA, 18 nt, Human
guguugucuugaaagauu

SEQ ID NO: 2813450 - RNA, 16 nt, Human
guguuuauuuuucaua

SEQ ID NO: 2813451 - RNA, 15 nt, Human
guguugaucccaaga

SEQ ID NO: 2813452 - RNA, 22 nt, Human
gugugucuguucacuuuuccuc

SEQ ID NO: 2813453 - RNA, 15 nt, Human
gugugucuguucacu

SEQ ID NO: 2813454 - RNA, 16 nt, Human
gugugucugcucagua

SEQ ID NO: 2813455 - RNA, 15 nt, Human
gugugucugcucagu

SEQ ID NO: 2813456 - RNA, 14 nt, Human
gugugucuuaauua

SEQ ID NO: 2813457 - RNA, 21 nt, Human
gugugucuuaauuauuauuug

SEQ ID NO: 2813458 - RNA, 20 nt, Human
guguguagaguuaagaagcu

SEQ ID NO: 2813459 - RNA, 18 nt, Human
guguguaugcgugugugu

SEQ ID NO: 2813460 - RNA, 17 nt, Human
gugguuugaucauuucu

SEQ ID NO: 2813461 - RNA, 21 nt, Human
gugguuugauggugacuuccu

SEQ ID NO: 2813462 - RNA, 21 nt, Human
gugguuugguuccucucuggu

SEQ ID NO: 2813463 - RNA, 23 nt, Human
gugguuuuagauuuucugguucu

SEQ ID NO: 2813464 - RNA, 14 nt, Human
aagauauacaugaa

SEQ ID NO: 2813465 - RNA, 23 nt, Human
aagaucuuagauucucugugucu

SEQ ID NO: 2813466 - RNA, 17 nt, Human
aagaucuucaaaaguaa

SEQ ID NO: 2813467 - RNA, 22 nt, Human
aagaucuucaaaaguaaugccu

SEQ ID NO: 2813468 - RNA, 23 nt, Human
aagaucuucaaaaguaaugccuc

SEQ ID NO: 2813469 - RNA, 13 nt, Human
aagaucuugcaga

SEQ ID NO: 2813470 - RNA, 19 nt, Human
aagaucuugcagaaguucu

SEQ ID NO: 2813471 - RNA, 22 nt, Human
aagaucuguuuugaaggcaaaa

SEQ ID NO: 2813472 - RNA, 21 nt, Human
aagaucuguuuugaaggcaaa

SEQ ID NO: 2813473 - RNA, 20 nt, Human
aagaucuguuuugaaggcaa

SEQ ID NO: 2813474 - RNA, 13 nt, Human
aagaucuuagauu

SEQ ID NO: 2813475 - RNA, 14 nt, Human
aagaucuuagauuc

SEQ ID NO: 2813476 - RNA, 15 nt, Human
aagaucuuagauucu

SEQ ID NO: 2813477 - RNA, 16 nt, Human
aagaucuuagauucuc

SEQ ID NO: 2813478 - RNA, 17 nt, Human
aagaucuuagauucucu

SEQ ID NO: 2813479 - RNA, 13 nt, Human
aagauauggagaa

SEQ ID NO: 2813480 - RNA, 15 nt, Human
aagauauggagaauu

SEQ ID NO: 2813481 - RNA, 17 nt, Human
aagauauggagaauugc

SEQ ID NO: 2813482 - RNA, 13 nt, Human
aagauaucuuuuc

SEQ ID NO: 2813483 - RNA, 16 nt, Human
aagauaucuuuucuuu

SEQ ID NO: 2813484 - RNA, 19 nt, Human
aagauaucuuuucuuuaga

SEQ ID NO: 2813485 - RNA, 13 nt, Human
aagauauuguaca

SEQ ID NO: 2813486 - RNA, 15 nt, Human
aagauauuguacaua

SEQ ID NO: 2813487 - RNA, 16 nt, Human
aagauauuguacauaa

SEQ ID NO: 2813488 - RNA, 17 nt, Human
aagauauuguacauaaa

SEQ ID NO: 2813489 - RNA, 14 nt, Human
aagauauuguucaa

SEQ ID NO: 2813490 - RNA, 15 nt, Human
aagauauuguucaaa

SEQ ID NO: 2813491 - RNA, 13 nt, Human
aagcaaauaaaua

SEQ ID NO: 2813492 - RNA, 14 nt, Human
aagcaaauaaauau

SEQ ID NO: 2813493 - RNA, 16 nt, Human
aagcaaauaaauauca

SEQ ID NO: 2813494 - RNA, 12 nt, Human
aagcaaauacuu

SEQ ID NO: 2813495 - RNA, 19 nt, Human
aagcaaccucccaacccag

SEQ ID NO: 2813496 - RNA, 22 nt, Human
aagcaagugauugggacagagg

SEQ ID NO: 2813497 - RNA, 19 nt, Human
aagcaauaaaauuuuuuug

SEQ ID NO: 2813498 - RNA, 20 nt, Human
aagcaauaaaauuuuuuugg

SEQ ID NO: 2813499 - RNA, 14 nt, Human
aagcaacuguuaug

SEQ ID NO: 2813500 - RNA, 22 nt, Human
aagcaaagacuuuccucuuagu

SEQ ID NO: 2813501 - RNA, 14 nt, Human
aagaugugauauuc

SEQ ID NO: 2813502 - RNA, 16 nt, Human
aagaugugauauucua

SEQ ID NO: 2813503 - RNA, 11 nt, Human
aagaugucugu

SEQ ID NO: 2813504 - RNA, 12 nt, Human
aagaugucuguu

SEQ ID NO: 2813505 - RNA, 16 nt, Human
aagaugucuguuugcu

SEQ ID NO: 2813506 - RNA, 18 nt, Human
aagaugucuguuugcuga

SEQ ID NO: 2813507 - RNA, 20 nt, Human
aagaugucuguuugcugaug

SEQ ID NO: 2813508 - RNA, 17 nt, Human
aagaugugauauucuaa

SEQ ID NO: 2813509 - RNA, 18 nt, Human
aagaugugauauucuaag

SEQ ID NO: 2813510 - RNA, 19 nt, Human
aagaugugauauucuaaga

SEQ ID NO: 2813511 - RNA, 23 nt, Human
aagaugcuccagcaacacagccu

SEQ ID NO: 2813512 - RNA, 15 nt, Human
aagaugcucuuuuaa

SEQ ID NO: 2813513 - RNA, 15 nt, Human
aagaugcucuucugu

SEQ ID NO: 2813514 - RNA, 16 nt, Human
aagaugccaucugugu

SEQ ID NO: 2813515 - RNA, 15 nt, Human
aagaugcauuguagu

SEQ ID NO: 2813516 - RNA, 17 nt, Human
aagaugcauuguaguuu

SEQ ID NO: 2813517 - RNA, 18 nt, Human
aagaugcauuguaguuua

SEQ ID NO: 2813518 - RNA, 22 nt, Human
aagaugcauuguaguuuaacca

SEQ ID NO: 2813519 - RNA, 18 nt, Human
aagaugccaauuauuguu

SEQ ID NO: 2813520 - RNA, 16 nt, Human
aagaugucagacuggc

SEQ ID NO: 2813521 - RNA, 17 nt, Human
aagaugcucuucugugg

SEQ ID NO: 2813522 - RNA, 22 nt, Human
aagaugcuggaugucugccaau

SEQ ID NO: 2813523 - RNA, 16 nt, Human
aagagcuuaacagugu

SEQ ID NO: 2813524 - RNA, 13 nt, Human
aagagcuugcuuu

SEQ ID NO: 2813525 - RNA, 14 nt, Human
aagagcuugcuuug

SEQ ID NO: 2813526 - RNA, 16 nt, Human
aagagcuugcuuugau

SEQ ID NO: 2813527 - RNA, 10 nt, Human
aagaggaaaa

SEQ ID NO: 2813528 - RNA, 23 nt, Human
aagaggaaaacccucaagggcau

SEQ ID NO: 2813529 - RNA, 16 nt, Human
aagaggaacugggccu

SEQ ID NO: 2813530 - RNA, 15 nt, Human
aagaggaacugggcc

SEQ ID NO: 2813531 - RNA, 22 nt, Human
aagaggaacagcacuggggagu

SEQ ID NO: 2813532 - RNA, 20 nt, Human
aagaggaacagcacugggga

SEQ ID NO: 2813533 - RNA, 18 nt, Human
guggcccgacagccuggc

SEQ ID NO: 2813534 - RNA, 19 nt, Human
guggcccgacagccuggca

SEQ ID NO: 2813535 - RNA, 17 nt, Human
guggcccgacagccugg

SEQ ID NO: 2813536 - RNA, 19 nt, Human
guggcccucucccuuaccc

SEQ ID NO: 2813537 - RNA, 20 nt, Human
aagacuuacucuaagaucuu

SEQ ID NO: 2813538 - RNA, 17 nt, Human
aagacuuagauugugcu

SEQ ID NO: 2813539 - RNA, 14 nt, Human
aagacuuacucuaa

SEQ ID NO: 2813540 - RNA, 15 nt, Human
aagacuuacucuaag

SEQ ID NO: 2813541 - RNA, 16 nt, Human
aagacuuacucuaaga

SEQ ID NO: 2813542 - RNA, 17 nt, Human
aagacuuacucuaagau

SEQ ID NO: 2813543 - RNA, 17 nt, Human
aagagauuguuguuugc

SEQ ID NO: 2813544 - RNA, 13 nt, Human
aagagcaaaaaua

SEQ ID NO: 2813545 - RNA, 14 nt, Human
aagagcaaaaauau

SEQ ID NO: 2813546 - RNA, 19 nt, Human
aagagccugaucucuuccu

SEQ ID NO: 2813547 - RNA, 20 nt, Human
aagagccugaucucuuccug

SEQ ID NO: 2813548 - RNA, 21 nt, Human
aagagccugaucucuuccugu

SEQ ID NO: 2813549 - RNA, 19 nt, Human
aagagcaauguguggcuga

SEQ ID NO: 2813550 - RNA, 16 nt, Human
aagagcacaaacauuu

SEQ ID NO: 2813551 - RNA, 17 nt, Human
aagagcacaaacauuuu

SEQ ID NO: 2813552 - RNA, 21 nt, Human
aagagcacaaacauuuuucaa

SEQ ID NO: 2813553 - RNA, 13 nt, Human
aagagcacacuug

SEQ ID NO: 2813554 - RNA, 14 nt, Human
aagagcagaacaga

SEQ ID NO: 2813555 - RNA, 22 nt, Human
aagacucuuuuugguuguccuc

SEQ ID NO: 2813556 - RNA, 12 nt, Human
aagacucuagag

SEQ ID NO: 2813557 - RNA, 13 nt, Human
aagacucuagagu

SEQ ID NO: 2813558 - RNA, 15 nt, Human
aagacucuagagucc

SEQ ID NO: 2813559 - RNA, 19 nt, Human
aagacucuagaguccaagg

SEQ ID NO: 2813560 - RNA, 21 nt, Human
aagacucuagaguccaagguu

SEQ ID NO: 2813561 - RNA, 17 nt, Human
aagacucuauucucaaa

SEQ ID NO: 2813562 - RNA, 19 nt, Human
aagaccugggguugucagc

SEQ ID NO: 2813563 - RNA, 12 nt, Human
aagaccuggcaa

SEQ ID NO: 2813564 - RNA, 21 nt, Human
aagaccuggcaaggacacaga

SEQ ID NO: 2813565 - RNA, 21 nt, Human
aagaccuacuguucuaaagcu

SEQ ID NO: 2813566 - RNA, 16 nt, Human
aagaccucaccuagaa

SEQ ID NO: 2813567 - RNA, 22 nt, Human
aagaccuacuguucuaaagcuc

SEQ ID NO: 2813568 - RNA, 23 nt, Human
aagaccuaggcucauggacgaga

SEQ ID NO: 2813569 - RNA, 18 nt, Human
aagaccuagugcucuuaa

SEQ ID NO: 2813570 - RNA, 17 nt, Human
aagaccucaccuagaaa

SEQ ID NO: 2813571 - RNA, 13 nt, Human
aagaccucuguga

SEQ ID NO: 2813572 - RNA, 17 nt, Human
aagaccuacuguucuaa

SEQ ID NO: 2813573 - RNA, 18 nt, Human
aagaccuacuguucuaaa

SEQ ID NO: 2813574 - RNA, 20 nt, Human
aagaccuacuguucuaaagc

SEQ ID NO: 2813575 - RNA, 22 nt, Human
gugggacccauagaucuucuga

SEQ ID NO: 2813576 - RNA, 13 nt, Human
gugggaccccagg

SEQ ID NO: 2813577 - RNA, 14 nt, Human
gugggaccccaggc

SEQ ID NO: 2813578 - RNA, 15 nt, Human
gugggaccccaggcc

SEQ ID NO: 2813579 - RNA, 17 nt, Human
gugggaccccaggccca

SEQ ID NO: 2813580 - RNA, 22 nt, Human
guggcuaaaugccuaauaaaca

SEQ ID NO: 2813581 - RNA, 16 nt, Human
guggcccugucccucc

SEQ ID NO: 2813582 - RNA, 17 nt, Human
guggcccugucccuccc

SEQ ID NO: 2813583 - RNA, 17 nt, Human
guggcccugcccucucc

SEQ ID NO: 2813584 - RNA, 18 nt, Human
guggcccugcccucuccu

SEQ ID NO: 2813585 - RNA, 21 nt, Human
guggcccugcccucuccuucc

SEQ ID NO: 2813586 - RNA, 23 nt, Human
guggcccugcccucuccuuccuu

SEQ ID NO: 2813587 - RNA, 11 nt, Human
guggcccuggc

SEQ ID NO: 2813588 - RNA, 15 nt, Human
guggcggccccagca

SEQ ID NO: 2813589 - RNA, 23 nt, Human
gugggaggcuccuguuagcuccu

SEQ ID NO: 2813590 - RNA, 15 nt, Human
gugggagaaggcagu

SEQ ID NO: 2813591 - RNA, 13 nt, Human
gugggagggagca

SEQ ID NO: 2813592 - RNA, 14 nt, Human
gugggagggagcag

SEQ ID NO: 2813593 - RNA, 15 nt, Human
gugggagggagcaga

SEQ ID NO: 2813594 - RNA, 19 nt, Human
gugggagggagcagacagg

SEQ ID NO: 2813595 - RNA, 13 nt, Human
gugggaggucagg

SEQ ID NO: 2813596 - RNA, 16 nt, Human
gugggaggucuugcua

SEQ ID NO: 2813597 - RNA, 21 nt, Human
gugggaggggcgcccaccucc

SEQ ID NO: 2813598 - RNA, 23 nt, Human
gugggugagaugcuggagaagag

SEQ ID NO: 2813599 - RNA, 13 nt, Human
gugggugcucaga

SEQ ID NO: 2813600 - RNA, 14 nt, Human
gugggugcucagaa

SEQ ID NO: 2813601 - RNA, 15 nt, Human
gugggugcucagaau

SEQ ID NO: 2813602 - RNA, 15 nt, Human
gugggugagaugcug

SEQ ID NO: 2813603 - RNA, 20 nt, Human
gugggugagaugcuggagaa

SEQ ID NO: 2813604 - RNA, 16 nt, Human
gugggugacaagagcc

SEQ ID NO: 2813605 - RNA, 18 nt, Human
gugggggccaccugccug

SEQ ID NO: 2813606 - RNA, 19 nt, Human
gugggggccaccugccugc

SEQ ID NO: 2813607 - RNA, 18 nt, Human
gugggguuucgcagccug

SEQ ID NO: 2813608 - RNA, 22 nt, Human
gugggguuucgcagccugaguc

SEQ ID NO: 2813609 - RNA, 13 nt, Human
guggguaaaauua

SEQ ID NO: 2813610 - RNA, 15 nt, Human
gugggguucuaggca

SEQ ID NO: 2813611 - RNA, 17 nt, Human
gugggguucugcuggga

SEQ ID NO: 2813612 - RNA, 22 nt, Human
guggguaauccaggcacagcug

SEQ ID NO: 2813613 - RNA, 16 nt, Human
aagaagugaguguuuc

SEQ ID NO: 2813614 - RNA, 20 nt, Human
aagaagugaguguuucuaug

SEQ ID NO: 2813615 - RNA, 21 nt, Human
aagaagugaguguuucuauga

SEQ ID NO: 2813616 - RNA, 16 nt, Human
aagaaggcaaaaaugu

SEQ ID NO: 2813617 - RNA, 15 nt, Human
aagaauacagcuuuc

SEQ ID NO: 2813618 - RNA, 13 nt, Human
aagaauacaguua

SEQ ID NO: 2813619 - RNA, 23 nt, Human
aagaauacaguuaggcaccagaa

SEQ ID NO: 2813620 - RNA, 14 nt, Human
aagaaaucccuguu

SEQ ID NO: 2813621 - RNA, 13 nt, Human
aagaaaucccugu

SEQ ID NO: 2813622 - RNA, 13 nt, Human
aagaaauauguga

SEQ ID NO: 2813623 - RNA, 15 nt, Human
aagaaauaugugaga

SEQ ID NO: 2813624 - RNA, 16 nt, Human
aagaaauaugugagau

SEQ ID NO: 2813625 - RNA, 18 nt, Human
aagaaauaugugagauuu

SEQ ID NO: 2813626 - RNA, 19 nt, Human
aagaaauaugugagauuuu

SEQ ID NO: 2813627 - RNA, 20 nt, Human
aagaaauaugugagauuuuu

SEQ ID NO: 2813628 - RNA, 20 nt, Human
aagaaauauuccaaaugucu

SEQ ID NO: 2813629 - RNA, 16 nt, Human
aagaagcuguuguaca

SEQ ID NO: 2813630 - RNA, 14 nt, Human
aagaagcuguugua

SEQ ID NO: 2813631 - RNA, 17 nt, Human
aagaagcuguuguacau

SEQ ID NO: 2813632 - RNA, 18 nt, Human
aagaagcuguuguacauu

SEQ ID NO: 2813633 - RNA, 19 nt, Human
aagaagcuguuguacauuu

SEQ ID NO: 2813634 - RNA, 21 nt, Human
aagaagcuguuguacauuuau

SEQ ID NO: 2813635 - RNA, 22 nt, Human
aagaagcuguuguacauuuaug

SEQ ID NO: 2813636 - RNA, 23 nt, Human
aagaagcuguuguacauuuauga

SEQ ID NO: 2813637 - RNA, 11 nt, Human
aagaaggaagu

SEQ ID NO: 2813638 - RNA, 14 nt, Human
aagaaggcaaaaau

SEQ ID NO: 2813639 - RNA, 15 nt, Human
aagaagcuucuaaua

SEQ ID NO: 2813640 - RNA, 18 nt, Human
aagaagcuucuaauaaau

SEQ ID NO: 2813641 - RNA, 19 nt, Human
aagaagcuucuaauaaauu

SEQ ID NO: 2813642 - RNA, 21 nt, Human
aagaagcuucuaauaaauuau

SEQ ID NO: 2813643 - RNA, 22 nt, Human
aagaagcuucuaauaaauuaua

SEQ ID NO: 2813644 - RNA, 21 nt, Human
aagaagcuuuaauauuuaaau

SEQ ID NO: 2813645 - RNA, 19 nt, Human
aagaauaggcauuaacaca

SEQ ID NO: 2813646 - RNA, 11 nt, Human
aagaaauaugu

SEQ ID NO: 2813647 - RNA, 20 nt, Human
aagaauagccuagauaugaa

SEQ ID NO: 2813648 - RNA, 15 nt, Human
aagaauagcaucugu

SEQ ID NO: 2813649 - RNA, 16 nt, Human
aagaauagcaucugua

SEQ ID NO: 2813650 - RNA, 21 nt, Human
aagaauagcaucuguacaaag

SEQ ID NO: 2813651 - RNA, 23 nt, Human
aagaauagcaucuguacaaaggg

SEQ ID NO: 2813652 - RNA, 16 nt, Human
aagaaacugaggaauu

SEQ ID NO: 2813653 - RNA, 20 nt, Human
aagaaacugaggaauuuucu

SEQ ID NO: 2813654 - RNA, 19 nt, Human
aagaaacugaggaauuuuc

SEQ ID NO: 2813655 - RNA, 21 nt, Human
aagaaacugaggaauuuucuu

SEQ ID NO: 2813656 - RNA, 15 nt, Human
aagaaaaagaagaac

SEQ ID NO: 2813657 - RNA, 12 nt, Human
aagaaaaagauu

SEQ ID NO: 2813658 - RNA, 14 nt, Human
aagaaagaaggaag

SEQ ID NO: 2813659 - RNA, 13 nt, Human
aagaaagaaggaa

SEQ ID NO: 2813660 - RNA, 12 nt, Human
aagaaacuuuug

SEQ ID NO: 2813661 - RNA, 13 nt, Human
aagaaacuuuugu

SEQ ID NO: 2813662 - RNA, 15 nt, Human
aagaaacuuuuguaa

SEQ ID NO: 2813663 - RNA, 16 nt, Human
aagaaacuuuuguaaa

SEQ ID NO: 2813664 - RNA, 17 nt, Human
aagaaacuuuuguaaag

SEQ ID NO: 2813665 - RNA, 18 nt, Human
aagaaacuuuuguaaaga

SEQ ID NO: 2813666 - RNA, 19 nt, Human
aagaaacuuuuguaaagaa

SEQ ID NO: 2813667 - RNA, 15 nt, Human
aagaaagaaggaagu

SEQ ID NO: 2813668 - RNA, 12 nt, Human
aagaaagacauc

SEQ ID NO: 2813669 - RNA, 14 nt, Human
aagaaagacaucuu

SEQ ID NO: 2813670 - RNA, 18 nt, Human
aagaaauaauaauaucca

SEQ ID NO: 2813671 - RNA, 13 nt, Human
aagaaagacucua

SEQ ID NO: 2813672 - RNA, 16 nt, Human
aagaaagacucuauuc

SEQ ID NO: 2813673 - RNA, 22 nt, Human
aagaaagacucuauucucaaag

SEQ ID NO: 2813674 - RNA, 22 nt, Human
aagaaauauaaacacaaauaua

SEQ ID NO: 2813675 - RNA, 12 nt, Human
aacuuuaaucaa

SEQ ID NO: 2813676 - RNA, 16 nt, Human
aacuuuaaucaaguug

SEQ ID NO: 2813677 - RNA, 20 nt, Human
aacuuuaauucucuuucaaa

SEQ ID NO: 2813678 - RNA, 21 nt, Human
aacuuuaauucucuuucaaag

SEQ ID NO: 2813679 - RNA, 13 nt, Human
aacuuguuuucug

SEQ ID NO: 2813680 - RNA, 15 nt, Human
aacuuuaaaaaauau

SEQ ID NO: 2813681 - RNA, 17 nt, Human
aacuuuaaaaaauauuu

SEQ ID NO: 2813682 - RNA, 19 nt, Human
aacuuuaaaaaauauuuau

SEQ ID NO: 2813683 - RNA, 15 nt, Human
aagaaaaaaaucuuc

SEQ ID NO: 2813684 - RNA, 14 nt, Human
aagaaaaaaaaaug

SEQ ID NO: 2813685 - RNA, 15 nt, Human
aagaaaaaaaaaugc

SEQ ID NO: 2813686 - RNA, 18 nt, Human
aagaaaaaaaaaugccau

SEQ ID NO: 2813687 - RNA, 19 nt, Human
aagaaaaaaacgaaaacag

SEQ ID NO: 2813688 - RNA, 20 nt, Human
aacuuuacccaaaaacuaaa

SEQ ID NO: 2813689 - RNA, 19 nt, Human
aagaaaaaaaaaagaagaa

SEQ ID NO: 2813690 - RNA, 20 nt, Human
aagaaaaaaaaaagaagaag

SEQ ID NO: 2813691 - RNA, 22 nt, Human
aagaaaaaaaaaagaagaagaa

SEQ ID NO: 2813692 - RNA, 11 nt, Human
aacuugucacu

SEQ ID NO: 2813693 - RNA, 12 nt, Human
aacuugucacuu

SEQ ID NO: 2813694 - RNA, 13 nt, Human
aacuugucacuug

SEQ ID NO: 2813695 - RNA, 17 nt, Human
aacuugucacuugcaug

SEQ ID NO: 2813696 - RNA, 17 nt, Human
aacuugguauuuuucag

SEQ ID NO: 2813697 - RNA, 12 nt, Human
aacuugggaacu

SEQ ID NO: 2813698 - RNA, 21 nt, Human
gugaaccaccacacccagccc

SEQ ID NO: 2813699 - RNA, 21 nt, Human
gugccgccugcacuccucagg

SEQ ID NO: 2813700 - RNA, 13 nt, Human
gugccgugugagu

SEQ ID NO: 2813701 - RNA, 15 nt, Human
gugccgugugagugu

SEQ ID NO: 2813702 - RNA, 18 nt, Human
gugccgugugagugugac

SEQ ID NO: 2813703 - RNA, 19 nt, Human
gugccgugugagugugaca

SEQ ID NO: 2813704 - RNA, 20 nt, Human
gugccgugugagugugacag

SEQ ID NO: 2813705 - RNA, 21 nt, Human
gugccgugugagugugacagg

SEQ ID NO: 2813706 - RNA, 23 nt, Human
gugccgugugagugugacagggc

SEQ ID NO: 2813707 - RNA, 15 nt, Human
gugccucugccuguc

SEQ ID NO: 2813708 - RNA, 13 nt, Human
gugccucugccug

SEQ ID NO: 2813709 - RNA, 12 nt, Human
gugccucugccu

SEQ ID NO: 2813710 - RNA, 21 nt, Human
aagaaugagaaggagucagaa

SEQ ID NO: 2813711 - RNA, 13 nt, Human
aagaauccuuuug

SEQ ID NO: 2813712 - RNA, 21 nt, Human
aagaauccuuuuguagaauga

SEQ ID NO: 2813713 - RNA, 21 nt, Human
aagaauccacauuucuaaaau

SEQ ID NO: 2813714 - RNA, 18 nt, Human
aagaaucccuagacuuua

SEQ ID NO: 2813715 - RNA, 23 nt, Human
aagaaucccuagacuuuaggcuu

SEQ ID NO: 2813716 - RNA, 14 nt, Human
guggcagcccugua

SEQ ID NO: 2813717 - RNA, 17 nt, Human
aagaauccacauuucua

SEQ ID NO: 2813718 - RNA, 18 nt, Human
aagaauccacauuucuaa

SEQ ID NO: 2813719 - RNA, 19 nt, Human
aagaauccacauuucuaaa

SEQ ID NO: 2813720 - RNA, 13 nt, Human
guggcagcccugu

SEQ ID NO: 2813721 - RNA, 12 nt, Human
guggcagcccug

SEQ ID NO: 2813722 - RNA, 19 nt, Human
guggaccucuacuuuccag

SEQ ID NO: 2813723 - RNA, 12 nt, Human
guggcacugcca

SEQ ID NO: 2813724 - RNA, 18 nt, Human
guggauucugaggcccug

SEQ ID NO: 2813725 - RNA, 13 nt, Human
aagaaugcauuga

SEQ ID NO: 2813726 - RNA, 20 nt, Human
aagaaugcauugauauugug

SEQ ID NO: 2813727 - RNA, 21 nt, Human
aagaaugcauugauauuguga

SEQ ID NO: 2813728 - RNA, 23 nt, Human
aagaaugcauugauauugugaac

SEQ ID NO: 2813729 - RNA, 13 nt, Human
aagaauggaaaag

SEQ ID NO: 2813730 - RNA, 15 nt, Human
aagaauggaaaagag

SEQ ID NO: 2813731 - RNA, 15 nt, Human
aagaauggagaggaa

SEQ ID NO: 2813732 - RNA, 16 nt, Human
aagaauggagcaguac

SEQ ID NO: 2813733 - RNA, 22 nt, Human
aagaaucagaguagaaauaaaa

SEQ ID NO: 2813734 - RNA, 19 nt, Human
aagaaugguggcuucuuuu

SEQ ID NO: 2813735 - RNA, 13 nt, Human
aagaauguguuuc

SEQ ID NO: 2813736 - RNA, 14 nt, Human
aagaauguguuuca

SEQ ID NO: 2813737 - RNA, 20 nt, Human
aagaauugaccaucugcuuu

SEQ ID NO: 2813738 - RNA, 21 nt, Human
aagaauugaccaucugcuuuu

SEQ ID NO: 2813739 - RNA, 22 nt, Human
aagaauugaccaucugcuuuua

SEQ ID NO: 2813740 - RNA, 17 nt, Human
aagacaaaucaaagcag

SEQ ID NO: 2813741 - RNA, 22 nt, Human
aagacaaaucaacagaagcauu

SEQ ID NO: 2813742 - RNA, 17 nt, Human
aagacaaagguuuuccu

SEQ ID NO: 2813743 - RNA, 13 nt, Human
aagacccuccccg

SEQ ID NO: 2813744 - RNA, 23 nt, Human
aagaccccuuaccacugcucuga

SEQ ID NO: 2813745 - RNA, 12 nt, Human
aagacaacacaa

SEQ ID NO: 2813746 - RNA, 18 nt, Human
guggaaguuccaagucca

SEQ ID NO: 2813747 - RNA, 20 nt, Human
guggaccaauuauugauaua

SEQ ID NO: 2813748 - RNA, 15 nt, Human
guggacaguccuggg

SEQ ID NO: 2813749 - RNA, 14 nt, Human
guggacaguccugg

SEQ ID NO: 2813750 - RNA, 16 nt, Human
guggacaguccuggga

SEQ ID NO: 2813751 - RNA, 22 nt, Human
guggacagucugcucuagauga

SEQ ID NO: 2813752 - RNA, 17 nt, Human
guggaccuuaggccuuc

SEQ ID NO: 2813753 - RNA, 18 nt, Human
guggaccuuaggccuucc

SEQ ID NO: 2813754 - RNA, 19 nt, Human
guggacccagcgggcaggu

SEQ ID NO: 2813755 - RNA, 21 nt, Human
guggaccuuaggccuuccucu

SEQ ID NO: 2813756 - RNA, 18 nt, Human
guggaccuuuuaaagugu

SEQ ID NO: 2813757 - RNA, 21 nt, Human
guggaccuuuuaaaguguuuc

SEQ ID NO: 2813758 - RNA, 21 nt, Human
guggaugccugguggcagcug

SEQ ID NO: 2813759 - RNA, 21 nt, Human
guggauggaaggggcugacag

SEQ ID NO: 2813760 - RNA, 14 nt, Human
guggauuaaacuua

SEQ ID NO: 2813761 - RNA, 18 nt, Human
guggauuaaacuuaugaa

SEQ ID NO: 2813762 - RNA, 21 nt, Human
guggauuaaacuuaugaaugu

SEQ ID NO: 2813763 - RNA, 21 nt, Human
guggauggguuuuaugagaug

SEQ ID NO: 2813764 - RNA, 23 nt, Human
guggauggguuuuaugagaugga

SEQ ID NO: 2813765 - RNA, 22 nt, Human
guggacacagcucuucuccagg

SEQ ID NO: 2813766 - RNA, 18 nt, Human
guggacacagcucuucuc

SEQ ID NO: 2813767 - RNA, 23 nt, Human
guggacacagcucuucuccaggc

SEQ ID NO: 2813768 - RNA, 13 nt, Human
guggacaguccug

SEQ ID NO: 2813769 - RNA, 17 nt, Human
guggacacagcucuucu

SEQ ID NO: 2813770 - RNA, 14 nt, Human
guggaaugagugug

SEQ ID NO: 2813771 - RNA, 18 nt, Human
guggaaugagugugcaug

SEQ ID NO: 2813772 - RNA, 13 nt, Human
guggaauauaaag

SEQ ID NO: 2813773 - RNA, 20 nt, Human
gugcugggauuacaggugug

SEQ ID NO: 2813774 - RNA, 20 nt, Human
gugcugggauuacaggcgug

SEQ ID NO: 2813775 - RNA, 22 nt, Human
gugcugggauuacaagcgugag

SEQ ID NO: 2813776 - RNA, 21 nt, Human
gugcugggauuacaagcguga

SEQ ID NO: 2813777 - RNA, 12 nt, Human
aagaauauauau

SEQ ID NO: 2813778 - RNA, 19 nt, Human
gugcucagaauaaggcagg

SEQ ID NO: 2813779 - RNA, 22 nt, Human
gugcucagaauaaggcaggcau

SEQ ID NO: 2813780 - RNA, 20 nt, Human
gugcucagagaccugaagug

SEQ ID NO: 2813781 - RNA, 21 nt, Human
gugcuauuuuguuuguuuugu

SEQ ID NO: 2813782 - RNA, 19 nt, Human
gugcucaccaugcuuccag

SEQ ID NO: 2813783 - RNA, 20 nt, Human
gugcugggaaccucagggua

SEQ ID NO: 2813784 - RNA, 22 nt, Human
gugcugggaaccucaggguauu

SEQ ID NO: 2813785 - RNA, 22 nt, Human
gugcucaggacucagaagccuc

SEQ ID NO: 2813786 - RNA, 18 nt, Human
gugcucaggacucagaag

SEQ ID NO: 2813787 - RNA, 14 nt, Human
gugcuggcucacag

SEQ ID NO: 2813788 - RNA, 19 nt, Human
gugcuggcucacaguacag

SEQ ID NO: 2813789 - RNA, 20 nt, Human
gugcuggcucacaguacagc

SEQ ID NO: 2813790 - RNA, 21 nt, Human
gugcuggcucacaguacagca

SEQ ID NO: 2813791 - RNA, 22 nt, Human
gugcuggcucacaguacagcau

SEQ ID NO: 2813792 - RNA, 19 nt, Human
aaugagacucuagggucca

SEQ ID NO: 2813793 - RNA, 15 nt, Human
aaugagacuugccuu

SEQ ID NO: 2813794 - RNA, 17 nt, Human
aaugagacuugccuucc

SEQ ID NO: 2813795 - RNA, 14 nt, Human
aaugacuuauugug

SEQ ID NO: 2813796 - RNA, 19 nt, Human
aaugacuuauuguggauaa

SEQ ID NO: 2813797 - RNA, 15 nt, Human
aaugagaaggcagcc

SEQ ID NO: 2813798 - RNA, 17 nt, Human
aaugagaaggcagccac

SEQ ID NO: 2813799 - RNA, 13 nt, Human
aaugagaaucuac

SEQ ID NO: 2813800 - RNA, 19 nt, Human
aaugaaaagucguuuucca

SEQ ID NO: 2813801 - RNA, 20 nt, Human
aaugaaaagucguuuuccaa

SEQ ID NO: 2813802 - RNA, 21 nt, Human
aaugaaaagucguuuuccaaa

SEQ ID NO: 2813803 - RNA, 11 nt, Human
aaugaaaauaa

SEQ ID NO: 2813804 - RNA, 13 nt, Human
aaugaaaaugaau

SEQ ID NO: 2813805 - RNA, 16 nt, Human
aaugaaaaugaauauc

SEQ ID NO: 2813806 - RNA, 15 nt, Human
aaugaaaauaaguga

SEQ ID NO: 2813807 - RNA, 21 nt, Human
aaugaaaauaagugaauaaua

SEQ ID NO: 2813808 - RNA, 13 nt, Human
aaugacacagucu

SEQ ID NO: 2813809 - RNA, 20 nt, Human
aaugacucaggacauccccc

SEQ ID NO: 2813810 - RNA, 22 nt, Human
aaugacaucucaggggccagag

SEQ ID NO: 2813811 - RNA, 12 nt, Human
aaugacaugcac

SEQ ID NO: 2813812 - RNA, 15 nt, Human
aaugacaugcacuga

SEQ ID NO: 2813813 - RNA, 16 nt, Human
aaugacaugcacugac

SEQ ID NO: 2813814 - RNA, 19 nt, Human
aaugacaugcacugacccu

SEQ ID NO: 2813815 - RNA, 22 nt, Human
aaugacaugcacugacccuucc

SEQ ID NO: 2813816 - RNA, 13 nt, Human
aaugacaucuuuu

SEQ ID NO: 2813817 - RNA, 16 nt, Human
aaugacaucuuuuuaa

SEQ ID NO: 2813818 - RNA, 19 nt, Human
aaugacaucuuuuuaaagc

SEQ ID NO: 2813819 - RNA, 20 nt, Human
aaugacaucuuuuuaaagcu

SEQ ID NO: 2813820 - RNA, 21 nt, Human
aaugacaucuuuuuaaagcuu

SEQ ID NO: 2813821 - RNA, 22 nt, Human
aaugacaucuuuuuaaagcuua

SEQ ID NO: 2813822 - RNA, 13 nt, Human
uaauggucuaaaa

SEQ ID NO: 2813823 - RNA, 17 nt, Human
uaauggucuaaaaauaa

SEQ ID NO: 2813824 - RNA, 21 nt, Human
uaauggucuaaaaauaaacca

SEQ ID NO: 2813825 - RNA, 23 nt, Human
uaaugaggagagaaaauauaugu

SEQ ID NO: 2813826 - RNA, 14 nt, Human
uaaugauaaaacac

SEQ ID NO: 2813827 - RNA, 14 nt, Human
uaaugguguuuuaa

SEQ ID NO: 2813828 - RNA, 13 nt, Human
uaauguaaaauga

SEQ ID NO: 2813829 - RNA, 14 nt, Human
uaauguaaaaugau

SEQ ID NO: 2813830 - RNA, 14 nt, Human
uaauguaaaauguu

SEQ ID NO: 2813831 - RNA, 18 nt, Human
uaaugguccacacccaau

SEQ ID NO: 2813832 - RNA, 17 nt, Human
uaauguaaaauguugaa

SEQ ID NO: 2813833 - RNA, 12 nt, Human
uaauguaaagau

SEQ ID NO: 2813834 - RNA, 18 nt, Human
uaauguaaagauuugcuu

SEQ ID NO: 2813835 - RNA, 13 nt, Human
aaucuuucugcag

SEQ ID NO: 2813836 - RNA, 14 nt, Human
aaucuugugcuaga

SEQ ID NO: 2813837 - RNA, 16 nt, Human
aaucuugugcuagaau

SEQ ID NO: 2813838 - RNA, 18 nt, Human
aaucuugugcuagaauac

SEQ ID NO: 2813839 - RNA, 19 nt, Human
aaucuugugcuagaauacu

SEQ ID NO: 2813840 - RNA, 20 nt, Human
aaucuugugcuagaauacuu

SEQ ID NO: 2813841 - RNA, 22 nt, Human
aaucuugugcuagaauacuuuu

SEQ ID NO: 2813842 - RNA, 22 nt, Human
aaucuuuguuucagguucagua

SEQ ID NO: 2813843 - RNA, 21 nt, Human
aaucuuuuaaaaauucaaaug

SEQ ID NO: 2813844 - RNA, 12 nt, Human
aaucuuuuacaa

SEQ ID NO: 2813845 - RNA, 22 nt, Human
aaucuuucuuuugauucuuccu

SEQ ID NO: 2813846 - RNA, 14 nt, Human
aaucuuugaaagac

SEQ ID NO: 2813847 - RNA, 16 nt, Human
aaucuuugaaagacuu

SEQ ID NO: 2813848 - RNA, 19 nt, Human
aaucuuugaaagacuucca

SEQ ID NO: 2813849 - RNA, 23 nt, Human
aaucuuugaaagacuuccaaaga

SEQ ID NO: 2813850 - RNA, 21 nt, Human
aaucuuuuacaacugccucga

SEQ ID NO: 2813851 - RNA, 16 nt, Human
aaucuucuccagauuu

SEQ ID NO: 2813852 - RNA, 21 nt, Human
uaauacugguauuuuuacuua

SEQ ID NO: 2813853 - RNA, 15 nt, Human
uaauacuaccuugaa

SEQ ID NO: 2813854 - RNA, 14 nt, Human
uaauacuaccuuga

SEQ ID NO: 2813855 - RNA, 22 nt, Human
uaauacgcaggcaucugauuug

SEQ ID NO: 2813856 - RNA, 13 nt, Human
uaauacuaaaaua

SEQ ID NO: 2813857 - RNA, 17 nt, Human
uaauacuaaaauauguc

SEQ ID NO: 2813858 - RNA, 18 nt, Human
uaauacuaaaauaugucu

SEQ ID NO: 2813859 - RNA, 21 nt, Human
uaauagcuuuuauuguauaaa

SEQ ID NO: 2813860 - RNA, 15 nt, Human
uaauacucuguugua

SEQ ID NO: 2813861 - RNA, 18 nt, Human
uaauagcuuuuauuguau

SEQ ID NO: 2813862 - RNA, 23 nt, Human
uaaucagugugucuaaauuugaa

SEQ ID NO: 2813863 - RNA, 14 nt, Human
uaaucaauaaagaa

SEQ ID NO: 2813864 - RNA, 17 nt, Human
uaaucaaguuguaacuu

SEQ ID NO: 2813865 - RNA, 21 nt, Human
uaaucaaguuguaacuuauau

SEQ ID NO: 2813866 - RNA, 17 nt, Human
uaaucaaucaucugugu

SEQ ID NO: 2813867 - RNA, 17 nt, Human
uaaucaaugaauauuga

SEQ ID NO: 2813868 - RNA, 19 nt, Human
uaaucaaugaauauugaag

SEQ ID NO: 2813869 - RNA, 20 nt, Human
uaaucaaugaauauugaagu

SEQ ID NO: 2813870 - RNA, 18 nt, Human
uaaugagcuauuaaaacu

SEQ ID NO: 2813871 - RNA, 19 nt, Human
uaaugagcuauuaaaacuc

SEQ ID NO: 2813872 - RNA, 21 nt, Human
uaaugagcuauuaaaacucag

SEQ ID NO: 2813873 - RNA, 16 nt, Human
uaaugacaugccuaua

SEQ ID NO: 2813874 - RNA, 19 nt, Human
uaaugaaagugaugacaua

SEQ ID NO: 2813875 - RNA, 22 nt, Human
uaaugaaagugaugacauauuu

SEQ ID NO: 2813876 - RNA, 16 nt, Human
uaaucaucuauaaaga

SEQ ID NO: 2813877 - RNA, 17 nt, Human
uaaucaucuauaaagaa

SEQ ID NO: 2813878 - RNA, 13 nt, Human
uaaucaugaaauu

SEQ ID NO: 2813879 - RNA, 16 nt, Human
uaaucaugaaauuacu

SEQ ID NO: 2813880 - RNA, 15 nt, Human
aaucaucuauaaaga

SEQ ID NO: 2813881 - RNA, 17 nt, Human
aaucaugaugcuagcca

SEQ ID NO: 2813882 - RNA, 18 nt, Human
aaucaucuauaaagaaga

SEQ ID NO: 2813883 - RNA, 12 nt, Human
aaucaucuauuu

SEQ ID NO: 2813884 - RNA, 13 nt, Human
aaucaucuauuuu

SEQ ID NO: 2813885 - RNA, 15 nt, Human
aaucaucuauuuuga

SEQ ID NO: 2813886 - RNA, 19 nt, Human
aaucaucuauuuugaugca

SEQ ID NO: 2813887 - RNA, 20 nt, Human
aaucaucuauuuugaugcag

SEQ ID NO: 2813888 - RNA, 23 nt, Human
aaucaucuauuuugaugcagcau

SEQ ID NO: 2813889 - RNA, 16 nt, Human
aaucaugucaggccug

SEQ ID NO: 2813890 - RNA, 15 nt, Human
aaucaucugugugaa

SEQ ID NO: 2813891 - RNA, 18 nt, Human
uaauaaaauguguugaaa

SEQ ID NO: 2813892 - RNA, 23 nt, Human
aaucauauugaugaaaagauuua

SEQ ID NO: 2813893 - RNA, 14 nt, Human
aaucaucgaaaauu

SEQ ID NO: 2813894 - RNA, 16 nt, Human
aaucaucgaaaauuca

SEQ ID NO: 2813895 - RNA, 17 nt, Human
aaucaucgaaaauucau

SEQ ID NO: 2813896 - RNA, 19 nt, Human
aaucaucgaaaauucauuu

SEQ ID NO: 2813897 - RNA, 21 nt, Human
aaucaucgaaaauucauuuca

SEQ ID NO: 2813898 - RNA, 23 nt, Human
aaucaucgaaaauucauuucaca

SEQ ID NO: 2813899 - RNA, 24 nt, Human
aaucaucggagucagccaggagcu

SEQ ID NO: 2813900 - RNA, 22 nt, Human
uaauaaaacuuaacuuccaaug

SEQ ID NO: 2813901 - RNA, 18 nt, Human
uaaguuugaaggaaacag

SEQ ID NO: 2813902 - RNA, 14 nt, Human
uaauaaaaaugaca

SEQ ID NO: 2813903 - RNA, 21 nt, Human
uaauaaaaaugacagacugaa

SEQ ID NO: 2813904 - RNA, 13 nt, Human
uaauaaaauaauu

SEQ ID NO: 2813905 - RNA, 19 nt, Human
uaauaaaauaauucuaaag

SEQ ID NO: 2813906 - RNA, 16 nt, Human
uaauaaaauaauucua

SEQ ID NO: 2813907 - RNA, 18 nt, Human
uaauaaaauaauucuaaa

SEQ ID NO: 2813908 - RNA, 12 nt, Human
uaaguacuguaa

SEQ ID NO: 2813909 - RNA, 14 nt, Human
uaaguacuguaaua

SEQ ID NO: 2813910 - RNA, 17 nt, Human
uaaguacuguaauaaua

SEQ ID NO: 2813911 - RNA, 19 nt, Human
uaaguacuguaauaauacc

SEQ ID NO: 2813912 - RNA, 21 nt, Human
uaaguacuguaauaauaccuc

SEQ ID NO: 2813913 - RNA, 23 nt, Human
uaaguacuguaauaauaccucaa

SEQ ID NO: 2813914 - RNA, 14 nt, Human
aaucagcaagaaga

SEQ ID NO: 2813915 - RNA, 20 nt, Human
aaucagcacagauaaaaagu

SEQ ID NO: 2813916 - RNA, 12 nt, Human
aaucagcacuga

SEQ ID NO: 2813917 - RNA, 13 nt, Human
aaucagcacugaa

SEQ ID NO: 2813918 - RNA, 14 nt, Human
aaucagcacugaaa

SEQ ID NO: 2813919 - RNA, 15 nt, Human
aaucagcacugaaaa

SEQ ID NO: 2813920 - RNA, 16 nt, Human
aaucagcacugaaaau

SEQ ID NO: 2813921 - RNA, 17 nt, Human
aaucagcacugaaaaua

SEQ ID NO: 2813922 - RNA, 20 nt, Human
uaaguauguguaaaauguga

SEQ ID NO: 2813923 - RNA, 16 nt, Human
uaaguauaaaauacaa

SEQ ID NO: 2813924 - RNA, 13 nt, Human
uaaguauacaguu

SEQ ID NO: 2813925 - RNA, 14 nt, Human
uaaguauacaguuc

SEQ ID NO: 2813926 - RNA, 20 nt, Human
uaaguauacaguucaauaaa

SEQ ID NO: 2813927 - RNA, 15 nt, Human
uaaguauaucaugua

SEQ ID NO: 2813928 - RNA, 17 nt, Human
uaaguauaucauguaaa

SEQ ID NO: 2813929 - RNA, 22 nt, Human
uaaguauaucauguaaagaaau

SEQ ID NO: 2813930 - RNA, 16 nt, Human
uaaguacuguuuacca

SEQ ID NO: 2813931 - RNA, 15 nt, Human
uaaguagauaagcag

SEQ ID NO: 2813932 - RNA, 16 nt, Human
uaaguagauaagcaga

SEQ ID NO: 2813933 - RNA, 13 nt, Human
aaucagagacaaa

SEQ ID NO: 2813934 - RNA, 18 nt, Human
aaucagagaccaggcccu

SEQ ID NO: 2813935 - RNA, 21 nt, Human
aaucagagaccaggcccuggc

SEQ ID NO: 2813936 - RNA, 15 nt, Human
aaucagaguagaaau

SEQ ID NO: 2813937 - RNA, 17 nt, Human
aaucagaguagaaauaa

SEQ ID NO: 2813938 - RNA, 18 nt, Human
aaucagaguagaaauaaa

SEQ ID NO: 2813939 - RNA, 13 nt, Human
aaucagacaaagu

SEQ ID NO: 2813940 - RNA, 15 nt, Human
aaucagaucuuuauu

SEQ ID NO: 2813941 - RNA, 13 nt, Human
uaaguucacauua

SEQ ID NO: 2813942 - RNA, 16 nt, Human
uaaguucacauuagaa

SEQ ID NO: 2813943 - RNA, 17 nt, Human
uaaguucacauuagaau

SEQ ID NO: 2813944 - RNA, 14 nt, Human
uaaguucagcacuu

SEQ ID NO: 2813945 - RNA, 14 nt, Human
uaaguauuaaaaca

SEQ ID NO: 2813946 - RNA, 17 nt, Human
aauauuuuaucuuuccu

SEQ ID NO: 2813947 - RNA, 15 nt, Human
uaaguauuaaaacau

SEQ ID NO: 2813948 - RNA, 16 nt, Human
uaaguauuaaaacauu

SEQ ID NO: 2813949 - RNA, 12 nt, Human
uaaguuugaagg

SEQ ID NO: 2813950 - RNA, 12 nt, Human
aauccuuccaaa

SEQ ID NO: 2813951 - RNA, 20 nt, Human
aauccuuccaaaaauuauua

SEQ ID NO: 2813952 - RNA, 21 nt, Human
aauccuuccaaaaauuauuau

SEQ ID NO: 2813953 - RNA, 17 nt, Human
aauccuugcuuaugaca

SEQ ID NO: 2813954 - RNA, 13 nt, Human
aauccuugcuuau

SEQ ID NO: 2813955 - RNA, 16 nt, Human
aaucuacuaauuccac

SEQ ID NO: 2813956 - RNA, 15 nt, Human
aaucuacuaauucca

SEQ ID NO: 2813957 - RNA, 14 nt, Human
aaucauugcuuuga

SEQ ID NO: 2813958 - RNA, 19 nt, Human
aaucauugcuuugaagcag

SEQ ID NO: 2813959 - RNA, 21 nt, Human
aaucauugcuuugaagcaguu

SEQ ID NO: 2813960 - RNA, 22 nt, Human
aaucauugcuuugaagcaguug

SEQ ID NO: 2813961 - RNA, 12 nt, Human
aaucauuguugc

SEQ ID NO: 2813962 - RNA, 14 nt, Human
aaucauuguugccu

SEQ ID NO: 2813963 - RNA, 14 nt, Human
aaucauuguuuuga

SEQ ID NO: 2813964 - RNA, 16 nt, Human
aaucauuguuuugaau

SEQ ID NO: 2813965 - RNA, 17 nt, Human
aaucauuguuuugaaua

SEQ ID NO: 2813966 - RNA, 18 nt, Human
aaucauuguuuugaauau

SEQ ID NO: 2813967 - RNA, 19 nt, Human
aaucauuguuuugaauauu

SEQ ID NO: 2813968 - RNA, 20 nt, Human
aaucauuguuuugaauauua

SEQ ID NO: 2813969 - RNA, 22 nt, Human
aaucauuguuuugaauauuacu

SEQ ID NO: 2813970 - RNA, 20 nt, Human
aaucauuuccccauaacuca

SEQ ID NO: 2813971 - RNA, 13 nt, Human
aaucauuucucac

SEQ ID NO: 2813972 - RNA, 16 nt, Human
aaucauuucucacugu

SEQ ID NO: 2813973 - RNA, 15 nt, Human
aauccuaaaagaagc

SEQ ID NO: 2813974 - RNA, 14 nt, Human
aauccuaagacaca

SEQ ID NO: 2813975 - RNA, 15 nt, Human
aauccuaagacacaa

SEQ ID NO: 2813976 - RNA, 17 nt, Human
aauccuaagacacaaau

SEQ ID NO: 2813977 - RNA, 17 nt, Human
aauccuauauagaaugc

SEQ ID NO: 2813978 - RNA, 22 nt, Human
aauccuauauagaaugcugcac

SEQ ID NO: 2813979 - RNA, 21 nt, Human
aaucuguccaaaggaggcugg

SEQ ID NO: 2813980 - RNA, 20 nt, Human
aaucuguccaaaggaggcug

SEQ ID NO: 2813981 - RNA, 19 nt, Human
aaucugucaaaacacugug

SEQ ID NO: 2813982 - RNA, 20 nt, Human
aaucugucaaaacacugugg

SEQ ID NO: 2813983 - RNA, 21 nt, Human
aaucugucaaaacacugugga

SEQ ID NO: 2813984 - RNA, 23 nt, Human
aaucugucaaaacacuguggaac

SEQ ID NO: 2813985 - RNA, 13 nt, Human
aaucugucaagag

SEQ ID NO: 2813986 - RNA, 19 nt, Human
aaucugucaagaguaguua

SEQ ID NO: 2813987 - RNA, 20 nt, Human
aaucugucaagaguaguuau

SEQ ID NO: 2813988 - RNA, 23 nt, Human
aaucuaggcaugaagagcaaaaa

SEQ ID NO: 2813989 - RNA, 19 nt, Human
aaucuaguauuucaugcug

SEQ ID NO: 2813990 - RNA, 15 nt, Human
aaucuaguuuacaga

SEQ ID NO: 2813991 - RNA, 17 nt, Human
aaucuaguuuacagaaa

SEQ ID NO: 2813992 - RNA, 18 nt, Human
aaucuaguuuacagaaaa

SEQ ID NO: 2813993 - RNA, 19 nt, Human
aaucuaguuuacagaaaaa

SEQ ID NO: 2813994 - RNA, 17 nt, Human
aaucuauaaacaaugaa

SEQ ID NO: 2813995 - RNA, 13 nt, Human
aaucuagacaaua

SEQ ID NO: 2813996 - RNA, 16 nt, Human
aaucuagacaauauac

SEQ ID NO: 2813997 - RNA, 17 nt, Human
aaucuacuaauuccaca

SEQ ID NO: 2813998 - RNA, 14 nt, Human
uacaaaaauaaauu

SEQ ID NO: 2813999 - RNA, 15 nt, Human
uacaaaaauaaauuu

SEQ ID NO: 2814000 - RNA, 17 nt, Human
uacaaaaauaaauuuau

SEQ ID NO: 2814001 - RNA, 22 nt, Human
uacaaaaauaaauuuauaugaa

SEQ ID NO: 2814002 - RNA, 19 nt, Human
uacaaaauaaacaaauaac

SEQ ID NO: 2814003 - RNA, 13 nt, Human
uacaaaauaaaaa

SEQ ID NO: 2814004 - RNA, 15 nt, Human
uacaaaauaaaaaca

SEQ ID NO: 2814005 - RNA, 12 nt, Human
uacaaaaauaaa

SEQ ID NO: 2814006 - RNA, 23 nt, Human
uacaaaagaggagcacuuccaaa

SEQ ID NO: 2814007 - RNA, 22 nt, Human
uacaaaaauuugccaggcgugg

SEQ ID NO: 2814008 - RNA, 16 nt, Human
uacaaaaaucagccag

SEQ ID NO: 2814009 - RNA, 17 nt, Human
uacaaaaaucagccaga

SEQ ID NO: 2814010 - RNA, 18 nt, Human
uacaaaaaucagccagac

SEQ ID NO: 2814011 - RNA, 19 nt, Human
uacaaaaaucagccagaca

SEQ ID NO: 2814012 - RNA, 17 nt, Human
uacaaaacgcgcagaug

SEQ ID NO: 2814013 - RNA, 19 nt, Human
uacaaaacgcgcagaugug

SEQ ID NO: 2814014 - RNA, 20 nt, Human
uacaaaacgcgcagaugugc

SEQ ID NO: 2814015 - RNA, 23 nt, Human
uaauuucaguccuguaguuuuau

SEQ ID NO: 2814016 - RNA, 20 nt, Human
uaauuucaaaaugcuuuuua

SEQ ID NO: 2814017 - RNA, 16 nt, Human
uaauuucaaaaugcuu

SEQ ID NO: 2814018 - RNA, 15 nt, Human
uaauuucaaaaugcu

SEQ ID NO: 2814019 - RNA, 18 nt, Human
uaauuuauuauugaaauu

SEQ ID NO: 2814020 - RNA, 20 nt, Human
uaauuuauuauugaaauugu

SEQ ID NO: 2814021 - RNA, 17 nt, Human
uaauuuauuauugaaau

SEQ ID NO: 2814022 - RNA, 14 nt, Human
uaauuuauuauuga

SEQ ID NO: 2814023 - RNA, 20 nt, Human
uaauuuaugaguuuuugaua

SEQ ID NO: 2814024 - RNA, 22 nt, Human
uaauuuaugcacuuauaaggug

SEQ ID NO: 2814025 - RNA, 14 nt, Human
uaauuuaugugaaa

SEQ ID NO: 2814026 - RNA, 13 nt, Human
aaucuuuguuaag

SEQ ID NO: 2814027 - RNA, 12 nt, Human
uaauuucaaaau

SEQ ID NO: 2814028 - RNA, 20 nt, Human
uaauuucaaaaauauaacuu

SEQ ID NO: 2814029 - RNA, 21 nt, Human
uaauuucaaaaauauaacuua

SEQ ID NO: 2814030 - RNA, 17 nt, Human
uaauuucaaaaauauaa

SEQ ID NO: 2814031 - RNA, 18 nt, Human
uaauuucaaaaauauaac

SEQ ID NO: 2814032 - RNA, 19 nt, Human
uaauuucaaaaauauaacu

SEQ ID NO: 2814033 - RNA, 15 nt, Human
uaauuccaauaugau

SEQ ID NO: 2814034 - RNA, 16 nt, Human
uaauuccaauaugaug

SEQ ID NO: 2814035 - RNA, 18 nt, Human
uaauuccaauaugaugac

SEQ ID NO: 2814036 - RNA, 13 nt, Human
uaauucaagaaaa

SEQ ID NO: 2814037 - RNA, 18 nt, Human
aaugagcuauuaaaacuc

SEQ ID NO: 2814038 - RNA, 19 nt, Human
aaugagcuauuaaaacuca

SEQ ID NO: 2814039 - RNA, 23 nt, Human
aaugagcuauuaaaacucagccu

SEQ ID NO: 2814040 - RNA, 14 nt, Human
aaugaggacauguu

SEQ ID NO: 2814041 - RNA, 16 nt, Human
aaugaggacauguuuu

SEQ ID NO: 2814042 - RNA, 15 nt, Human
uaauuuaaaaaauaa

SEQ ID NO: 2814043 - RNA, 14 nt, Human
uaauuuaugaguuu

SEQ ID NO: 2814044 - RNA, 14 nt, Human
uaauuuaucuaaau

SEQ ID NO: 2814045 - RNA, 15 nt, Human
uaauuuaucuaaauu

SEQ ID NO: 2814046 - RNA, 18 nt, Human
uaauuuaucuaaauuaaa

SEQ ID NO: 2814047 - RNA, 20 nt, Human
uaauuuaucuaaauuaaagc

SEQ ID NO: 2814048 - RNA, 21 nt, Human
uaauuuaucuaaauuaaagcc

SEQ ID NO: 2814049 - RNA, 16 nt, Human
uaauuguuuugcacuu

SEQ ID NO: 2814050 - RNA, 18 nt, Human
uaauuguuuugcacuuuu

SEQ ID NO: 2814051 - RNA, 17 nt, Human
uaauuccacaccuuuua

SEQ ID NO: 2814052 - RNA, 15 nt, Human
uaauuguuguuucuu

SEQ ID NO: 2814053 - RNA, 16 nt, Human
uaauuguuguuucuuu

SEQ ID NO: 2814054 - RNA, 19 nt, Human
uaauuguuguuucuuucua

SEQ ID NO: 2814055 - RNA, 22 nt, Human
uaauuguuguuucuuucuagug

SEQ ID NO: 2814056 - RNA, 17 nt, Human
uaauuccacagcugcuc

SEQ ID NO: 2814057 - RNA, 14 nt, Human
uaauuccacagcug

SEQ ID NO: 2814058 - RNA, 13 nt, Human
uaauuccacagcu

SEQ ID NO: 2814059 - RNA, 15 nt, Human
uaauuccacaccuuu

SEQ ID NO: 2814060 - RNA, 19 nt, Human
uaauuccaauaugaugacu

SEQ ID NO: 2814061 - RNA, 20 nt, Human
uaauuccaauaugaugacuc

SEQ ID NO: 2814062 - RNA, 23 nt, Human
aaugccaacuuguccuuuuguac

SEQ ID NO: 2814063 - RNA, 13 nt, Human
aaugccaagauaa

SEQ ID NO: 2814064 - RNA, 17 nt, Human
aaugccaagauaauuca

SEQ ID NO: 2814065 - RNA, 14 nt, Human
aaugcauaaaugca

SEQ ID NO: 2814066 - RNA, 16 nt, Human
aaugcauaaaauguua

SEQ ID NO: 2814067 - RNA, 17 nt, Human
aaugcauacagaaauau

SEQ ID NO: 2814068 - RNA, 22 nt, Human
aaugcauuauaggaucauuugu

SEQ ID NO: 2814069 - RNA, 23 nt, Human
aaugcauuauaggaucauuuguu

SEQ ID NO: 2814070 - RNA, 14 nt, Human
aaugcauugauauu

SEQ ID NO: 2814071 - RNA, 16 nt, Human
aaugcauugauauugu

SEQ ID NO: 2814072 - RNA, 19 nt, Human
aaugcauugauauugugaa

SEQ ID NO: 2814073 - RNA, 20 nt, Human
aaugcauugauauugugaac

SEQ ID NO: 2814074 - RNA, 21 nt, Human
aaugcauugauauugugaaca

SEQ ID NO: 2814075 - RNA, 22 nt, Human
aaugcauugauauugugaacau

SEQ ID NO: 2814076 - RNA, 19 nt, Human
uacaaggggccauuuggca

SEQ ID NO: 2814077 - RNA, 14 nt, Human
uacaaggacagccc

SEQ ID NO: 2814078 - RNA, 17 nt, Human
uacaaggaagguggugg

SEQ ID NO: 2814079 - RNA, 20 nt, Human
uacaaaauaaacaaauaaca

SEQ ID NO: 2814080 - RNA, 13 nt, Human
uacaaaaggcucc

SEQ ID NO: 2814081 - RNA, 20 nt, Human
uacaaguauacuuauauuuc

SEQ ID NO: 2814082 - RNA, 13 nt, Human
aaugcauaaaaug

SEQ ID NO: 2814083 - RNA, 15 nt, Human
aaugcaguauauuuc

SEQ ID NO: 2814084 - RNA, 12 nt, Human
aaugcuguguua

SEQ ID NO: 2814085 - RNA, 20 nt, Human
aaugcuuuuuauuucugcau

SEQ ID NO: 2814086 - RNA, 19 nt, Human
aaugcuuuuuauuucugca

SEQ ID NO: 2814087 - RNA, 11 nt, Human
aaugcuuuuug

SEQ ID NO: 2814088 - RNA, 14 nt, Human
aaugcuuuuugaau

SEQ ID NO: 2814089 - RNA, 17 nt, Human
aaugcuuuuugaauguu

SEQ ID NO: 2814090 - RNA, 18 nt, Human
aauggaaaaaaaaaaaag

SEQ ID NO: 2814091 - RNA, 20 nt, Human
aauggaaaaaaaaaaaagag

SEQ ID NO: 2814092 - RNA, 21 nt, Human
aauggaaaaaaaaaaaagagg

SEQ ID NO: 2814093 - RNA, 22 nt, Human
aauggaaaaaaaaaaaagagga

SEQ ID NO: 2814094 - RNA, 22 nt, Human
aauggaauaaaaggcuugaagc

SEQ ID NO: 2814095 - RNA, 12 nt, Human
aauggacacuuu

SEQ ID NO: 2814096 - RNA, 22 nt, Human
aauggacauccuguauaagcac

SEQ ID NO: 2814097 - RNA, 14 nt, Human
aauggacauggugg

SEQ ID NO: 2814098 - RNA, 18 nt, Human
aauggaauaaaaggcuug

SEQ ID NO: 2814099 - RNA, 17 nt, Human
aauggaaaccacaacuu

SEQ ID NO: 2814100 - RNA, 19 nt, Human
aauggaaaccacaacuuuu

SEQ ID NO: 2814101 - RNA, 14 nt, Human
aauggaaaccucac

SEQ ID NO: 2814102 - RNA, 14 nt, Human
aauggaagagaaau

SEQ ID NO: 2814103 - RNA, 15 nt, Human
aauggaagagaaauc

SEQ ID NO: 2814104 - RNA, 16 nt, Human
aauggaagagaaaucu

SEQ ID NO: 2814105 - RNA, 18 nt, Human
aauggaagagaaaucuca

SEQ ID NO: 2814106 - RNA, 16 nt, Human
uacacuccagccugag

SEQ ID NO: 2814107 - RNA, 15 nt, Human
uacacuccagccuga

SEQ ID NO: 2814108 - RNA, 18 nt, Human
uacacuccagccugagca

SEQ ID NO: 2814109 - RNA, 17 nt, Human
uacacuccagccugagc

SEQ ID NO: 2814110 - RNA, 11 nt, Human
uacagaggaaa

SEQ ID NO: 2814111 - RNA, 15 nt, Human
uacagaggaaaucug

SEQ ID NO: 2814112 - RNA, 17 nt, Human
uacagaggaaaucugua

SEQ ID NO: 2814113 - RNA, 18 nt, Human
uacagaggaaaucuguaa

SEQ ID NO: 2814114 - RNA, 18 nt, Human
uacagaggccaugggccu

SEQ ID NO: 2814115 - RNA, 15 nt, Human
uacaggcauagaguu

SEQ ID NO: 2814116 - RNA, 17 nt, Human
uacaggcuccugccacc

SEQ ID NO: 2814117 - RNA, 16 nt, Human
uacagggaaugccuga

SEQ ID NO: 2814118 - RNA, 20 nt, Human
uacagggaaugccugagugc

SEQ ID NO: 2814119 - RNA, 16 nt, Human
uacaguaacuuuaugu

SEQ ID NO: 2814120 - RNA, 13 nt, Human
uacaguaacuuua

SEQ ID NO: 2814121 - RNA, 17 nt, Human
uacaguaacuuuaugug

SEQ ID NO: 2814122 - RNA, 18 nt, Human
uacaguaacuuuaugugu

SEQ ID NO: 2814123 - RNA, 20 nt, Human
uacaguaacuuuauguguaa
